United States Patent
Nguyen et al.

(10) Patent No.: US 11,421,016 B2
(45) Date of Patent: Aug. 23, 2022

(54) CANCER NEOEPITOPES

(71) Applicants: NANTOMICS, LLC, Culver City, CA (US); Nant Holdings IP, LLC, Culver City, CA (US)

(72) Inventors: Andrew Nguyen, San Jose, CA (US); Kayvan Niazi, Agoura Hills, CA (US); Patrick Soon-Shiong, Los Angeles, CA (US); Shahrooz Rabizadeh, Los Angeles, CA (US); Stephen Charles Benz, Santa Cruz, CA (US)

(73) Assignees: NantOmics LLC, Culver City, CA (US); Nant Holdings IP, LLC, Culver City, CA (US)

( * ) Notice: Subject to any disclaimer, the term of this patent is extended or adjusted under 35 U.S.C. 154(b) by 935 days.

(21) Appl. No.: 15/568,487

(22) PCT Filed: Apr. 25, 2016

(86) PCT No.: PCT/US2016/029244
§ 371 (c)(1),
(2) Date: Oct. 23, 2017

(87) PCT Pub. No.: WO2016/172722
PCT Pub. Date: Oct. 27, 2016

(65) Prior Publication Data
US 2018/0141998 A1     May 24, 2018

Related U.S. Application Data

(60) Provisional application No. 62/159,145, filed on May 8, 2015, provisional application No. 62/178,956, filed on Apr. 23, 2015.

(51) Int. Cl.
| | |
|---|---|
| C07K 16/00 | (2006.01) |
| G16B 5/00 | (2019.01) |
| G16B 20/00 | (2019.01) |
| G16B 30/00 | (2019.01) |
| G16B 35/00 | (2019.01) |
| G16C 20/60 | (2019.01) |
| A61K 35/17 | (2015.01) |
| C07K 16/30 | (2006.01) |
| C07K 16/32 | (2006.01) |
| C12Q 1/6886 | (2018.01) |
| G16B 20/30 | (2019.01) |
| G16B 20/20 | (2019.01) |
| G16B 35/20 | (2019.01) |
| G16B 20/50 | (2019.01) |
| A61P 35/00 | (2006.01) |
| A61K 38/17 | (2006.01) |
| A61K 39/00 | (2006.01) |
| A61K 39/395 | (2006.01) |
| A61K 45/00 | (2006.01) |
| C07K 14/735 | (2006.01) |

(52) U.S. Cl.
CPC ............ *C07K 16/005* (2013.01); *A61K 35/17* (2013.01); *A61K 38/1774* (2013.01); *A61K 39/0011* (2013.01); *A61K 39/39558* (2013.01); *A61K 45/05* (2013.01); *A61P 35/00* (2018.01); *C07K 14/70535* (2013.01); *C07K 16/30* (2013.01); *C07K 16/32* (2013.01); *C12Q 1/6886* (2013.01); *G16B 5/00* (2019.02); *G16B 20/00* (2019.02); *G16B 20/20* (2019.02); *G16B 20/30* (2019.02); *G16B 20/50* (2019.02); *G16B 30/00* (2019.02); *G16B 35/00* (2019.02); *G16B 35/20* (2019.02); *G16C 20/60* (2019.02); *A61K 2039/505* (2013.01); *A61K 2039/55* (2013.01); *A61K 2039/585* (2013.01); *C07K 2317/32* (2013.01); *C07K 2317/34* (2013.01); *C07K 2317/622* (2013.01); *C07K 2317/92* (2013.01); *C12Q 2600/106* (2013.01); *C12Q 2600/156* (2013.01); *C12Q 2600/158* (2013.01)

(58) Field of Classification Search
None
See application file for complete search history.

(56) References Cited

U.S. PATENT DOCUMENTS

| | | | |
|---|---|---|---|
| 7,473,532 | B2 | 1/2009 | Darfler et al. |
| 8,207,315 | B2 | 6/2012 | Wang et al. |
| 8,652,473 | B2 | 2/2014 | Johns et al. |
| 2005/0048070 | A1 | 3/2005 | Ditzel et al. |
| 2010/0202968 | A1 | 8/2010 | Nitsch |

(Continued)

FOREIGN PATENT DOCUMENTS

| | | |
|---|---|---|
| CA | 2 987 730 A1 | 10/2016 |
| CA | 2 988 388 A1 | 10/2016 |
| CN | 102504024 A | 6/2012 |
| CN | 103384887 A | 11/2013 |
| CN | 108513593 A | 9/2018 |

(Continued)

OTHER PUBLICATIONS

Carter, Paul, "Improving The Efficacy of Antibody-Based Cancer Therapies," Nature Reviews (Cancer), vol. 1, pp. 118-129 (Nov. 2001).

(Continued)

*Primary Examiner* — Michael L Borin
(74) *Attorney, Agent, or Firm* — Martin Fessenmaier; Umberg Zipser LLP (57) ABSTRACT

Contemplated compositions and methods are directed to cancer neoepitopes and uses of such neoepitopes, especially to generate synthetic antibodies against neoepitopes that may then be employed in the manufacture of a therapeutic agent. Preferred therapeutic agents will comprise a synthetic antibody against a neoepitope, and most preferably in combination with a cellular or non-cellular component for use as a diagnostic or therapeutic agent.

17 Claims, 2 Drawing Sheets
Specification includes a Sequence Listing.

(56) References Cited

U.S. PATENT DOCUMENTS

| | | | |
|---|---|---|---|
| 2010/0203109 A1 | 8/2010 | Herlyn | |
| 2011/0293637 A1 | 12/2011 | Hacohen et al. | |
| 2012/0059670 A1* | 3/2012 | Sanborn | G06F 19/00 705/3 |
| 2012/0066001 A1* | 3/2012 | Sanborn | G06N 7/005 705/3 |
| 2015/0125463 A1 | 5/2015 | Cogswell et al. | |
| 2016/0101170 A1 | 4/2016 | Hacohen et al. | |
| 2018/0142016 A1* | 5/2018 | Wong | A61K 51/1027 |
| 2018/0147294 A1* | 5/2018 | Jackson | A61K 31/454 |
| 2019/0070308 A1* | 3/2019 | Goldenberg | A61K 47/6859 |
| 2019/0099475 A1 | 4/2019 | Benz et al. | |

FOREIGN PATENT DOCUMENTS

| | | |
|---|---|---|
| EP | 2 279 749 A1 | 2/2011 |
| EP | 3 280 738 A1 | 2/2018 |
| EP | 3 286 361 A1 | 2/2018 |
| JP | 2018513187 A | 5/2018 |
| MX | 2017013613 A | 9/2018 |
| WO | 0158956 A2 | 8/2001 |
| WO | 2011/143656 A2 | 11/2011 |
| WO | 2011/143656 A3 | 8/2012 |
| WO | 2014-052707 A2 | 4/2014 |
| WO | 2015/058159 A1 | 4/2015 |
| WO | 2015095811 A2 | 6/2015 |
| WO | 2015103037 A2 | 7/2015 |
| WO | 2016/164833 A1 | 10/2016 |
| WO | 2016/172722 A1 | 10/2016 |

OTHER PUBLICATIONS

Fritsch, et al., "HLA-Binding Properties of Tumor Neoepitopes in Humans," Cancer Immunology Research, vol. 2, No. 6, Jun. 2014, 9 pages.
ISA/KR, International Search Report and Written Opinion, completed Aug. 9, 2016 for PCT Application No. PCT/US2016/029244, 15 pages.
Alexandrov et al. "Signatures of mutational processes in human cancer", Nature, 2013, vol. 500, pp. 415-421.
Dung T. Le et al., "PD-1 Blockade in Tumors with Mismatch-Repair Deficiency", The New England Journal of Medicine,—NEJM—, US, (Jun. 25, 2015), vol. 372, No. 26, doi:10.1056/NEJMoa1500596, ISSN 0028-4793, pp. 2509-2520.
E. M. Van Allen et al, "Genomic correlates of response to CTLA-4 blockade in metastatic melanoma", Science, US, (Oct. 9, 2015), vol. 350, No. 6257, ISSN 0036-8075, pp. 207-211.
First Office Action received for Australian Patent Application Serial No. 2016339035, dated Nov. 6, 2019, 04 pages.
Snyder et al., "Genetic basis for clinical response to CTLA-4 blockade in melanoma", New England Journal of Medicine, (2014), vol. 371, No. 23, pp. 2189-2199.
Carreno, B.M., et al. Supplementary Materials for A dendritic cell vaccine increases the breadth and diversity of melanoma neoantigen-specific T cells, Science Express, Apr. 2, 2015, pp. 1-27.
Matsushita, H., et al.. Cancer exome analysis reveals a T-cell-dependent mechanism of cancer immunoediting, Nature, Feb. 2012, pp. 400-404, vol. 482.
Reuschenback, M., et al., A multiplex method for the detection of serum antibodies against in silico-predicted tumor antigens, Cancer Immunol Immunother, Aug. 21, 2014, pp. 63:1251-1259.
Carreno, B. M. et al., A dendritic cell vaccine increases the breadth and diversity of melanoma neoantigen-specific T cells, Cancer Immunotherapy, May 15, 2015, pp. 803-808, vol. 348.
Notice of acceptance received for Australian Patent Application Serial No. 2016253145 dated Jun. 18, 2020, 3 pages.
Office Action received in Canadian Patent Application Serial No. 2988388 dated May 19, 2020, 4 pages.
Notice of Reasons for Refusal received for Japanese Patent Application Serial No. 2017555492 dated Apr. 14, 2020, 6 pages (Including English Translation).

Schietinger et al., "A Mutant Chaperone Converts a Wild-Type Protein into a Tumor-Specific Antigen", Science, 2006, vol. 314, pp. 304-308.
Ito et al., "Molecular Designs of Antibodies and Peptides by Phage Display", Biophysics, 2008, vol. 48, No. 5, 8 pages.
Wang et al., "Overexpression of AGGF1 is correlated with angiogenesis and poor prognosis of hepatocellular carcinoma", Medical Oncology, Mar. 22, 2015, vol. 32, No. 131, 9 pages.
Tian et al., "Identification of an angiogenic factor that when mutated causes susceptibility to Klippel-Trenaunay syndrome", Nature, Feb. 12, 2004, vol. 427, pp. 640-645.
Lutz et al., "Can we predict mutant neoepitopes in human cancers for patient-specific vaccine therapy?", Cancer Immunology Research, Jun. 2014, vol. 2, No. 6, pp. 1-5.
Fritsch et al., "Personal neoantigen cancer vaccines: The momentum builds", Oncolmmunology, Jun. 2014, vol. 3, 4 pages.
International Search Report and Written Opinion received for PCT Application Serial No. PCT/US2016/026798 dated Jul. 18, 2016, 14 pages.
Parmiani et al., "Integrating Immune Checkpoint Blockade with Anti-Neo/Mutated Antigens Reactivity to Increase the Clinical Outcome of Immunotherapy", Vaccines, 2015, vol. 3, pp. 420-428.
Rooij et al., "Tumor Exome Analysis Reveals Neoantigen-Specific T-Cell Reactivity in an Ipilimumab-Responsive Melanoma", Journal of Clinical Oncology, Nov. 10, 2013, vol. 31, No. 32, pp. e439-e442.
Castle et al., "Exploiting the Mutanome for Tumor Vaccination", Cancer Research, Mar. 1, 2012, vol. 72, No. 5, pp. 1081-1091.
Hacohen et al., "Getting Personal with Neoantigen-Based Therapeutic Cancer Vaccines", Cancer Immunology research, Jul. 2013, vol. 1, No. 1, p. 1-8.
Lundegaard et al., "NetMHC-3.0: accurate web accessible predictions of human, mouse and monkey MHC class I affinities for peptides of length 8-11", Nucleic Acids Research, 2008, vol. 36, pp. W509-W512.
Kelderman et al., "Mismatch Repair-Deficient Cancers Are Targets for Anti-PD-1 Therapy", Cancer Cell, Jul. 13, 2015, vol. 28, pp. 11-13.
Charoentong et al., "Bioinformatics for cancer immunology and immunotherapy", Cancer Immunol Immunother, 2012, vol. 61, pp. 1885-1903.
Rizvi et al., "Mutational landscape determines sensitivity to PD-1 blockade in non-small cell lung cancer", Cancer Immunology, Science, Apr. 3, 2015, vol. 348, No. 6230, pp. 124-128.
Segal et al., "Epitope Landscape in Breast and Colorectal Cancer", Cancer Research, Feb. 1, 2008, vol. 68, No. 3, pp. 889-892.
Sykulev et al., "Evidence that a Single Peptide-MHC Complex on a Target Cell Can Elicit a Cytolytic T Cell Response", Immunity, Jun. 1, 1996, vol. 4, No. 6, pp. 565-571.
Kim et al., "HLA Haplotyping from RNA-seq Data Using Hierarchical Read Weighting", PLoS One, Jun. 2013, vol. 8, No. 6, pp. 1-10.
Warren et al., "Derivation of HLA types from shotgun sequence datasets", Genome Medicine, 2012, vol. 4, No. 12, pp. 1-8.
Liu et al., "ATHLATES: accurate typing of human leukocyte antigen through exome sequencing", Nucleic Acids Research, Jun. 8, 2013, vol. 41, No. 14, pp. 1-8.
Bai et al., "Inference of high resolution HLA types using genome-wide RNA or DNA sequencing reads", BMC Genomics, 2014, vol. 15, No. 325, pp. 1-16.
Amalfitano et al., "Production and Characterization of Improved Adenovirus Vectors with the E1, E2b, and E3 Genes Deleted", Journal of Virology, Feb. 1998, vol. 72, No. 2, pp. 926-933.
Vigneron et al., "Database of T cell-defined human tumor antigens: the 2013 update", Cancer Immunity, Jul. 15, 2013, vol. 13, 6 pages.
Carmen et al., "Concepts in antibody phage display", Briefings in Functional Genomics and Proteomics, Jul. 2002, vol. 1. No. 2, pp. 189-203.
Hosse et al., "A new generation of protein display scaffolds for molecular recognition", Protein Science, Jan. 2006, vol. 15, No. 1, pp. 14-27.
First Office Action received for Canadian Patent Application Serial No. 2987730 dated Jul. 31, 2018, 06 pages.

(56) References Cited

OTHER PUBLICATIONS

Second Office Action received for Canadian Patent Application Serial No. 2987730 dated Feb. 25, 2019, 04 pages.
Haisma H.J, "Monoclonal antibodies and cancer: Studies on the use of monoclonal antibodies for imaging and therapy of cancer, with a special emphasis on ovarian carcinoma", Dec. 8, 1957, 175 pages.
Gubin et al., Tumor neoantigens: building a framework for, personalized cancer immunotherapy, The Journal of Clinical Investigation, Sep. 2015, vol. 125, No. 9, pp. 3413-3421.
Srivastava P.K, "Neoepitopes of Cancers: Looking Back, Looking Ahead", Cancer Immunology Research, Sep. 1, 2015, vol. 3, No. 9, pp. 969-977.
Monteiro J, "Cancer Immunotherapy Scores Again", Cell, Jan. 15, 2015, vol. 160, p. 7-9.
Hundal et al., "pVAC-Seq: A genome-guided in silica approach to identifying tumor neoantigens", Genome Medicine, Jan. 29, 2016, vol. 8, No. 11, p. 1-11.
Akkawi et al., "The human VG5Q gene 2 transcript is over-expressed in colorectal and bladder carcinomas", Gene Therapy Molecular Biology, 2006, vol. 10, pp. 173-178.
Supplementary European Search report received for European Patent Application Serial No. 16777432 dated Aug. 29, 2018, 03 pages.
Rabizadeh et al., "Comprehensive genomic transcriptomic tumor-normal gene panel analysis for enhanced precision n patients with lung cancer", Oncotarget, Apr. 2018, vol. 9, No. 27, pp. 19223-19232.
Extended European Search report received for European Patent Application Serial No. 16784102.2 dated Apr. 5, 2019, 13 pages.
International Preliminary Report on Patentability received for PCT Application Serial No. PCT/US2016026798 dated Oct. 10, 2017, 01 pages.
Herbst et al., "Predictive correlates of response to the anti-PD-L1 antibody MPDL3280A in cancer patients", Nature, Nov. 27, 2014, vol. 515, pp. 1-18.
First Office Action received for Russian Patent Application Serial No. 2017145136/10(077299) dated Sep. 13, 2019, 14 pages (Including English Translation).
Extended European Search report received for European Patent Application Serial No. 16777432.2 dated Nov. 30, 2018, 11 pages.
Non-Final office Action Received for U.S. Appl. No. 15/565,203, dated Jun. 18, 2019, 17 pages.
International Preliminary Report on Patentability Chapter II received for PCT Application Serial No. PCT/US2016/029244 dated Aug. 22, 2017, 18 pages.
First Examination report received for Australian Patent Application Serial No. 2016253145, dated Jan. 17, 2020, 05 pages.
Communication Pursuant to rule 164(1) EPC received in European Patent Application Serial No. 16784102.2, dated Jan. 3, 2019, 15 pages.
Office Action received for Canadian Patent Application Serial No. 2,988,388 dated Apr. 7, 2021, 3 pages.
Office Action received for Mexico Patent Application Serial No. MX/a/2017/013613 dated Jul. 6, 2021, 8 pages. (Including English Translation).
Second Office Action received for Chinese Patent Application Serial No. 201680037507.1 dated Jul. 20, 2021, 15 pages. (Including English Translation).
Office Action received for Mexico Patent Application Serial No. MX/a/2017/013613 dated Nov. 19, 2021, 8 pages. (Including English Translation).
Decision of Refusal received for Japanese Patent Application Serial No. 2017-555492 dated Dec. 22, 2020, 6 pages (Including English Translation).
First Office Action received for Chinese Patent Application Serial No. 201680037507.1 dated Jan. 29, 2021, 4 pages (Including English Translation).
Larman et al., "Construction of a rationally designed antibody platform for sequencing-assisted selection", PNAS, 2012, vol. 109, No. 45, pp. 18523-18528.
Notice of objection received in Israeli Patent Application Serial No. 255217 dated Aug. 31, 2020, 8 pages (Including English Translation).
Notice of Allowance received for Canadian Patent Application Serial No. 2,988,388 dated May 5, 2022, 1 page.
Notice of Reasons for Refusal received for Japanese Patent Application Serial No. 2021-072238 dated May 31, 2022, 3 pages. (Including English Translation).

* cited by examiner

CANCER NEOEPITOPES

This application claims priority to our U.S. Provisional Application Ser. No. 62/178,956, filed Apr. 23, 2015, and to our U.S. Provisional Application Ser. No. 62/159,145, filed May 8, 2015, both of which are incorporated by reference herein.

FIELD OF THE INVENTION

The field of the invention is cancer neoepitopes, and especially identification and use of neoepitopes in the production of neoepitope specific antibodies, and use of neoepitopes and neoepitope specific antibodies in prophylaxis and therapy.

BACKGROUND OF THE INVENTION

The background description includes information that may be useful in understanding the present invention. It is not an admission that any of the information provided herein is prior art or relevant to the presently claimed invention, or that any publication specifically or implicitly referenced is prior art.

It is well known in the art that most, if not all neoplastic diseases are accompanied by a relatively large number of mutations, including point mutations, insertions, deletions, and translocations. Thus, it is at least conceptually reasonable to assume that neoplastic cells may also be characterizable by the presence of one or more mutated proteins. More recently, as a result of numerous research efforts, a fairly small collection of T cell defined human tumor antigens has become available (see e.g., *Cancer Immunity* (15 Jul. 2013) Vol. 13, p. 15) for a limited number of tumor types. Unfortunately, these antigens have not resulted in an effective therapeutic agent for a particular tumor type. All publications cited herein are incorporated by reference to the same extent as if each individual publication or patent application were specifically and individually indicated to be incorporated by reference. Further, where a definition or use of a term in an incorporated reference is inconsistent or contrary to the definition of that term provided herein, the definition of that term provided herein applies and the definition of that term in the reference does not apply.

Among other possible reasons for failure to produce an immunotherapeutic agent for a specific tumor, the apparent random distribution of mutations in most tumors among different patients diagnosed with the same tumor type has severely complicated the quest to identify one or more antigens that can be used as an immunologically effective agent. Moreover, as the immune response to a particular antigen is also dependent on an individual's capacity to bind and display the antigen via the HLA complex, the statistical probability of identifying a suitable antigen for treatment of a tumor in multiple patients is very low. Thus, identification of patient specific tumor antigens is at least conceptually more likely to potentially lead to a therapeutic agent.

Unfortunately, as many tumors have developed various immune evading mechanisms, potentially useful patient and tumor-specific antigens typically fail to elicit a therapeutically effective immune response, or even production of antibodies that would bind to the patient and tumor-specific antigen. Moreover, even if a patient would have generated B cells that produce antibodies with specificity against the patient and tumor-specific antigen, isolation of such B cells is rather complex and time consuming. Likewise, isolation of therapeutically useful quantities of antibodies from such patients is equally cumbersome and time consuming and will likely exceed a patient's expected life span. In addition, even if one would be able to obtain sufficient quantities of antibodies against one patient- and tumor-specific antigen, the heterogeneity of many tumors may still render treatment ineffective as not all cells in the tumor mass may express the same antigen. Still further, even if one could produce or isolate different therapeutic antibodies from a mammal for use in a single patient, such approach would be entirely unsuitable as a mass production platform for the large amount of patients in need for immune therapy. Indeed, conventional production of monoclonal antibodies against a single antigen will often take many months.

Thus, even though antibody production is generally well known in the art, there is still a need for systems and methods that allow for rapid identification of patient-specific antigens of a tumor and accelerated production of antibodies targeting such antigens for diagnostic or therapeutic use.

SUMMARY OF THE INVENTION

The inventive subject matter is directed to identification and use of various cancer neoepitopes in a patient, particularly where such neoepitopes have not elicited a protective immune response in the patient.

In one aspect of the inventive subject matter, method of generating a pharmaceutical agent for cancer immune therapy. Especially preferred methods include a step of using matched normal omics data of a tumor to generate in silico a plurality of n-mers that contain at least one patient- and cancer-specific cancer neoepitope, and a further step of filtering in silico the n-mers to so obtain a subset of neoepitope sequences. In yet another step, at least one synthetic n-mer peptide is prepared using sequence information from the subset of neoepitope sequences, and the synthetic n-mer peptide is then employed to isolate a recombinant antibody. Sequence information of the complementarity determining region of the recombinant antibody is obtained and a synthetic antibody is generated using the sequence information of the complementarity determining region of the recombinant antibody. In still another step, the synthetic antibody may then be coupled to a therapeutic or diagnostic agent to so obtain the pharmaceutical agent.

It is generally contemplated that the matched normal omics data are whole genomic sequencing data, exome sequencing data, and/or transcriptome data, and that the matched normal omics data are matched against normal before treatment of the patient. Moreover, it is contemplated that each of the plurality of n-mer peptides has a length of between 7 and 11 amino acids, and/or that the plurality of n-mer peptides is at least 1,000 n-mer peptides. Most typically, different of the plurality of n-mer peptides have different neoepitopes. While not limiting the inventive subject matter, it is further contemplated that the step of filtering includes filtering by type of mutation, filtering by strength of expression, filtering by sub-cellular location, and/or filtering by binding affinity towards an HLA-type of the patient.

Additionally, it is contemplated that the step of using the synthetic n-mer peptide to isolate the recombinant antibody comprises phage panning, which may further comprise a step of affinity maturation. It is also contemplated that the sequence information of the complementarity determining region of the recombinant antibody comprises CDR1-H, CDR2-H, and CDR3-H, and optionally CDR1-L, CDR2-L, and CDR3-L, and/or that the synthetic antibody is generated using CDR or SDR grafting onto a human antibody scaffold.

Contemplated synthetic antibodies are typically generated via recombinant expression as a IgG, a F(ab')2, a Fab', a Fab, or a scFv, and contemplated therapeutic or diagnostic agents include non-cellular agents (e.g., chemotherapeutic drug, radio isotope, PET detectable isotope, SPECT detectable isotope, affinity agent, etc) and immune competent cells (e.g., T-cell, NK cell, etc.). For example, where the cell is a T-cell, the T cell may express a chimeric receptor having a scFv as ectodomain wherein the synthetic antibody is the scFv. Alternatively, or additionally, where the cell is an NK cell, the NK cell may express a high-affinity Fcγ receptor (CD16) and the synthetic antibody may then be an IgG that is bound to the NK cell via the high-affinity Fcγ receptor. Most notably, it should therefore be recognized that patient- and cancer-specific antibodies and compositions comprising such antibodies can be prepared in a remarkably short time (e.g., less than 8 weeks, or less than 6 weeks, or even less than 4 weeks), even in cases where the patient does not mount an effective and protective immune response to the neoepitope.

Therefore, the inventors also contemplate a method of generating a synthetic antibody to a cancer neoepitope of a patient where the cancer neoepitope failed to elicit a protective immune response. Contemplated methods will typically include a step of using the cancer neoepitope (typically fully synthetic) to select a binding recombinant antibody from a library of recombinant antibodies, wherein the cancer neoepitope is patient- and cancer-specific. In another step, hypervariable loops are then analyzed in the binding recombinant antibody to thereby obtain specificity information for the binding recombinant antibody, and a gene coding for at least a portion of a human antibody is modified using the specificity information. Finally, the gene is then recombinantly expressed to produce the synthetic antibody. Most notably, a cancer and patient specific antibody is thusly produced without use of a mammalian immune system.

In especially contemplated methods, the cancer neoepitope is an HLA matched cancer neoepitope, and/or the library of recombinant antibodies is a phage display library. Where desired, the method may further include a step of affinity maturing the binding recombinant antibody to derive an optimized binding recombinant antibody. Regardless of additional steps, the hypervariable loops are preferably analyzed by sequencing the DNA that encodes the hypervariable loops, and the step of modifying will preferably comprise CDR or SDR grafting (e.g., where the portion of the human antibody is a scFv). Recombinant expression of the modified gene will then result in the synthetic antibody in form of a IgG, a F(ab')2, a Fab', a Fab, or a scFv. Most typically, the cancer neoepitope is expressed in the cancer of the patient, and/or the neoepitope is unique to the patient and cancer in the patient.

Viewed from another perspective, the inventors therefore also contemplate a composition that comprises a synthetic antibody having binding affinity against a patient- and cancer-specific HLA-matched cancer neoepitope wherein the neoepitope is unique to the patient and cancer in the patient.

In especially preferred aspects, the HLA-matched cancer neoepitope is matched for MHC-I presentation, and the synthetic antibody is selected from the group consisting of an IgG, a F(ab')2, a Fab', a Fab, and a scFv. Where desired, the therapeutic agent may be coupled to the synthetic antibody and the therapeutic agent is a non-cellular agent (e.g., chemotherapeutic drug, radio isotope, PET detectable isotope, SPECT detectable isotope, or affinity agent). Alternatively, the therapeutic agent may also be a cell, and especially an immune competent cell (e.g., T-cell or an NK cell). For example, where the cell is a T-cell, it may express a chimeric receptor having a scFv as ectodomain wherein the synthetic antibody is the scFv. On the other hand, where the cell is an NK cell, it may express a high-affinity Fcγ receptor (CD16) wherein the synthetic antibody is an IgG that is bound to the NK cell via the high-affinity Fcγ receptor. Among other compositions, contemplated cancer neoepitope may have a sequence selected from the group consisting of SEQ ID NO 1 to SEQ ID NO 1,408,729.

In yet another aspect of the inventive subject matter, the inventors also contemplate a composition that comprises a solid phase to which is bound a patient- and cancer-specific HLA-matched cancer neoepitope, wherein the cancer neoepitope is unique to the patient and cancer in the patient. For example, suitable solid phases will include a wall of a reagent container, a magnetic bead, or an individually addressable element, and especially preferred cancer neoepitopes will have a length of between 7 and 9 amino acids. Among other neoepitopes, contemplated neoepitopes include those having a sequence according to any one of SEQ ID NO 1 to SEQ ID NO 1,408,729. Where desired, it is contemplated that a synthetic antibody (e.g., IgG, a F(ab')2, a Fab', a Fab, and a scFv) is bound to the cancer neoepitope, which may be in turn be coupled to a virus particle.

Various objects, features, aspects and advantages of the inventive subject matter will become more apparent from the following detailed description of preferred embodiments, along with the accompanying drawing figures in which like numerals represent like components.

DETAILED DESCRIPTION

The inventors have discovered that various diagnostic and therapeutic compositions and agents can be prepared in a conceptually simple but effective approach that combines in silico and in vitro techniques.

Using the inventors' systems and methods, it should now be appreciated that entirely synthetic antibodies against one or more patient specific neoepitopes can be generated, and particularly against antigens that have either not elicited a protective immune response and/or against antigens that exhibited a suppressed immune response. Even more advantageously, it should be noted that such synthetic antibodies can be prepared by in silico analysis of omics data of a patient to so derive a relatively large number of potentially useful neoepitopes that can then be further filtered to increase therapeutic efficacy. Viewed from another perspective, contemplated synthetic monoclonal antibodies are prepared without actual time consuming isolation of tumor specific peptides from the tumor and without any immunization procedure in a mammal (or other animal with immune system). Still further, it should be noted that the methods contemplated herein will allow for fast production of synthetic antibodies, typically within several days to several weeks (e.g., between 5 and 21 days).

Figure 1:
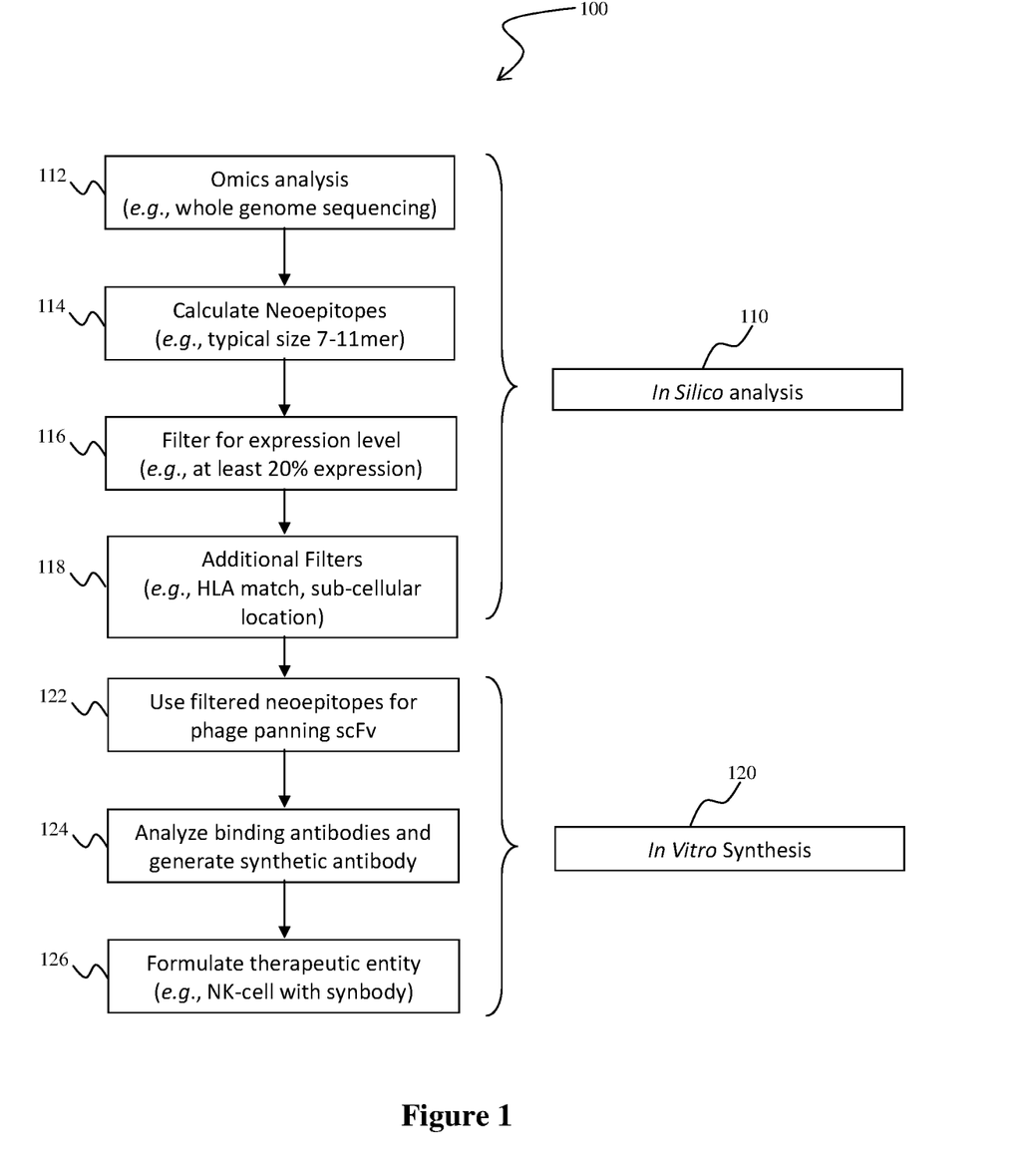
FIG. 1 is an exemplary schematic flow diagram of one aspect of the inventive subject matter.
Figure 2:
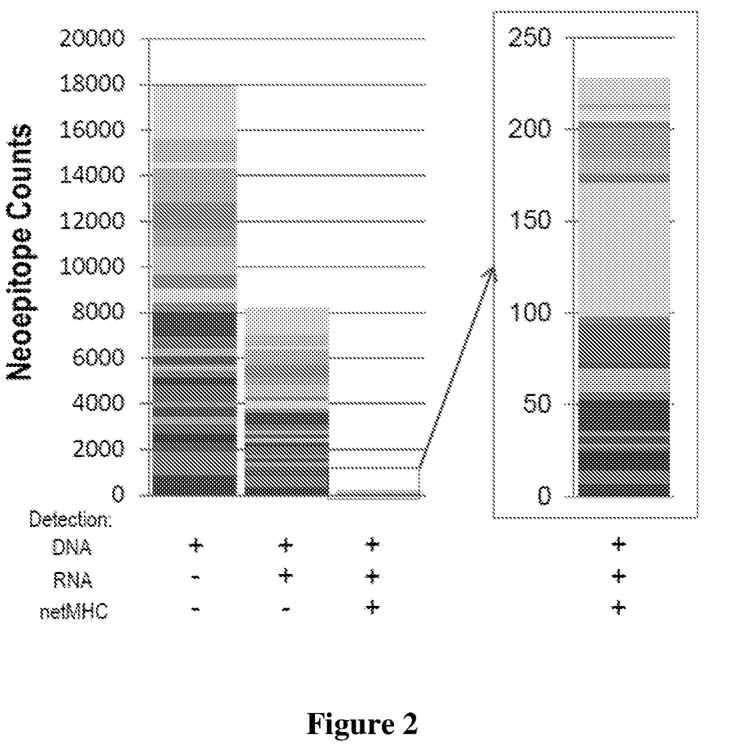
FIG. 2 is an exemplary plot depicting filtering outcomes for calculated neoepitopes.

Briefly, and as exemplarily illustrated in the flow chart of FIG. 1, one contemplated method 100 will comprise an in silico analysis portion 110 and an in vitro synthesis portion 120. Most typically, the in silico analysis commences with an omics analysis 112 to identify mutations in the tumor relative to normal tissue of the same patient, and a step of calculation of one or more neoepitopes 114 is performed to define neoepitopes that are specific to the tumor and patient. So obtained neoepitopes are further subjected to filtering step 116 to, for example, eliminate weakly or non-expressed neoepitopes. Identified expressed neoepitopes may then be subject to additional filtering algorithms 118, for example, to limit neoepitopes to extracellularly exposed or MHC-I bound neoepitopes. FIG. 2 exemplarily shows the outcome of a series of filtering steps. Here, whole genome sequencing analysis of a triple negative breast cancer sample against matched normal (i.e., compared against non-diseased tissue of the same patient) revealed a relatively large number (~18,000) of neoepitopes in the tumor sample. Notably, a first filtering step removed more than 50% of all of the identified neoepitopes on the basis of expression strength. Here, neoepitope sequences were removed with an expression level of less than 20% of expression as compared to the matched normal sample. The remaining sequences were subjected to an in silico analysis to determine those sequences that would bind (e.g., less than 500 nM affinity) to a single specific HLA-type of the same sample. It should be noted that once more a substantial fraction of neoepitopes was eliminated, and that ultimately only less than 1.3% of all neoepitopes were found suitable for use.

Referring again to FIG. 1, and after the in silico identification of suitable neoepitope sequences, corresponding synthetic peptides are then prepared in vitro (e.g., using solid phase synthesis) and used in a phage display assay, typically using a large diversity library (e.g., at least $10^9$ distinct members) of scFv constructs as shown in step 122. It should be appreciated that avidly binding phages will bind via a matching scFv displayed by the phage, which is encoded by the corresponding nucleic acid found in the bound phage. Sequence analysis on that phage DNA will then reveal the sequences for the complementarity determining regions (typically at least CDR1-H, CDR2-H, and CDR3-H, and CDR1-L, CDR2-L, and CDR3-L) in the scFv as shown in step 124. This information can then be used as a guide to modify a nucleic acid encoding a human or humanized scFv or other antibody. Once expressed in a suitable expression system, the synthetic antibody ('synbody') is then formulated into a desired therapeutic entity, for example, by binding the antibody to an NK cell, or grafting the corresponding scFv onto a chimeric T-cell receptor.

More particularly, and with respect to obtaining omics information from the patient to identify one or more neoepitopes it is generally contemplated that the omics data are obtained from one or more patient biopsy samples following standard tissue processing protocol and sequencing protocols. While not limiting to the inventive subject matter, it is typically preferred that the data are patient matched tumor data (e.g., tumor versus same patient normal), and that the data format is in SAM, BAM, GAR, or VCF format. However, non-matched or matched versus other reference (e.g., prior same patient normal or prior same patient tumor, or homo statisticus) are also deemed suitable for use herein. Therefore, the omics data may be 'fresh' omics data or omics data that were obtained from a prior procedure (or even different patient). For example, neoepitopes may be identified from a patient tumor in a first step by whole genome and/or exome analysis of a tumor biopsy (or lymph biopsy or biopsy of a metastatic site) and matched normal tissue (i.e., non-diseased tissue from the same patient such as peripheral blood) via location-guided synchronous comparison of the so obtained omics information.

Among other options, it is contemplated that genomic analysis can be performed by any number of analytic methods, however, especially preferred analytic methods include WGS (whole genome sequencing) and exome sequencing of both tumor and matched normal sample using next generation sequencing such as massively parallel sequencing methods, ion torrent sequencing, pyrosequencing, etc. Likewise, it should be appreciated that computational analysis of the sequence data may be performed in numerous manners. In most preferred methods, however, analysis is performed in silico by location-guided synchronous alignment of tumor and normal samples as, for example, disclosed in US 2012/0059670A1 and US 2012/0066001A1 using BAM files and BAM servers. Of course, alternative file formats for sequence analysis (e.g., SAM, GAR, FASTA, etc.) are also expressly contemplated herein.

It should be noted that any language directed to a computer should be read to include any suitable combination of computing devices, including servers, interfaces, systems, databases, agents, peers, engines, controllers, or other types of computing devices operating individually or collectively. One should appreciate the computing devices comprise a processor configured to execute software instructions stored on a tangible, non-transitory computer readable storage medium (e.g., hard drive, solid state drive, RAM, flash, ROM, etc.). The software instructions preferably configure the computing device to provide the roles, responsibilities, or other functionality as discussed below with respect to the disclosed apparatus. Further, the disclosed technologies can be embodied as a computer program product that includes a non-transitory computer readable medium storing software instructions that causes a processor to execute the disclosed steps associated with implementations of computer-based algorithms, processes, methods, or other instructions. In especially preferred embodiments, the various servers, systems, databases, or interfaces exchange data using standardized protocols or algorithms, possibly based on HTTP, HTTPS, AES, public-private key exchanges, web service APIs, known financial transaction protocols, or other electronic information exchanging methods. Data exchanges among devices can be conducted over a packet-switched network, the Internet, LAN, WAN, VPN, or other type of packet switched network; a circuit switched network; cell switched network; or other type of network.

Of course, it should be appreciated that downstream analysis may be performed on the so identified sequence differences to identify those that lead to a new peptide sequence based on the cancer and patient specific mutation. Neoepitopes may therefore be identified by considering the type (e.g., deletion, insertion, transversion, transition, translocation) and impact of the mutation (e.g., non-sense, missense, frame shift, etc.), and may as such serve as a content filter through which silent and other non-relevant (e.g., non-expressed) mutations are eliminated.

It should further be appreciated that neoepitope sequences as contemplated herein can be defined as sequence stretches with relatively short length (e.g., 5-30 mers, more typically 7-11 mers, or 12-25 mers) wherein such stretches include the change(s) in the amino acid sequences. Most typically, the change(s) is/are located centrally or near the center (e.g., less than 4, or less than 5, or less than 6 amino acids from center position). Therefore, and viewed from a different perspective, neoepitope sequences contemplated herein will especially include those in which a single amino acid is exchanged relative to the matched normal sequence, and in which the position of the changed amino acid is centrally located, or near the center of the neoepitope sequence (e.g., in a 9-mer, the changed amino acid is at position 2, 3, 4, or 5, and more typically at position 3, 4, or 5, and most typically at position 4 or 5). Thus, it should be appreciated that a single amino acid change may be presented in numerous neoepitope sequences that include the changed amino acid, depending on the position of the changed amino acid. Advantageously, such sequence variability allows for multiple choices of neoepitopes and so increases the number of potentially useful targets that can then be selected on the basis of one or more desirable traits (e.g., highest affinity to a patient HLA-type, highest structural stability, etc.). Most typically, neoepitopes will be calculated to have a length of between 2-50 amino acids, more typically between 5-30 amino acids, and most typically between 9-15 amino acids, with a changed amino acid preferably centrally located or otherwise situated in a manner that improves its binding to MHC. For example, where the epitope is to be presented by the MHC-I complex, a typical epitope length will be about 8-11 amino acids, while the typical epitope length for presentation via MHC-II complex will have a length of about 13-17 amino acids. As will be readily appreciated, since the position of the changed amino acid in the neoepitope may be other than central, the actual peptide sequence and with that actual topology of the neoepitope may vary considerably. Moreover, where the neoepitope is presented to an immune competent (or other) cell as a synthetic peptide, it should be appreciated that the synthetic peptide may be significantly longer than the peptide portion that is ultimately bound by the MHC-I or MHC-II system to so allow for proteolytic processing in the cell. For example, contemplated synthetic peptides may therefore have between 8 and 15 amino acids upstream and downstream of the changed amino acid.

With respect to filtering identified neoepitopes, it is generally contemplated that neoepitopes are especially suitable for use herein where omics (o other) analysis reveals that the neoepitope is actually expressed. Identification of expression and expression level of a neoepitope can be performed in all manners known in the art and preferred methods include quantitative RNA (hnRNA or mRNA) analysis and/or quantitative proteomics analysis. Most typically, the threshold level for inclusion of neoepitopes will be an expression level of at least 20%, and more typically at least 50% of expression level of the corresponding matched normal sequence, thus ensuring that the (neo)epitope is at least potentially 'visible' to the immune system. Consequently, it is generally preferred that the omics analysis also includes an analysis of gene expression (transcriptomic analysis) to so help identify the level of expression for the gene with a mutation. There are numerous methods of transcriptomic analysis know in the art, and all of the known methods are deemed suitable for use herein. For example, preferred materials include mRNA and primary transcripts (hnRNA), and RNA sequence information may be obtained from reverse transcribed polyA$^+$-RNA, which is in turn obtained from a tumor sample and a matched normal (healthy) sample of the same patient. Likewise, it should be noted that while polyA$^+$-RNA is typically preferred as a representation of the transcriptome, other forms of RNA (hn-RNA, non-polyadenylated RNA, siRNA, miRNA, etc.) are also deemed suitable for use herein. Preferred methods include quantitative RNA (hnRNA or mRNA) analysis and/or quantitative proteomics analysis. Most typically, RNA quantification and sequencing is performed using qPCR and/or rtPCR based methods, although other methods (e.g., solid phase hybridization-based methods) are also deemed suitable. Viewed from another perspective, transcriptomic analysis may be suitable (alone or in combination with genomic analysis) to identify and quantify genes having a cancer and patient specific mutation.

Similarly, proteomics analysis can be performed in numerous manners to ascertain expression of the neoepitope, and all known manners or proteomics analysis are contemplated herein. However, particularly preferred proteomics methods include antibody-based methods and mass spectroscopic methods. Moreover, it should be noted that the proteomics analysis may not only provide qualitative or quantitative information about the protein per se, but may also include protein activity data where the protein has catalytic or other functional activity. One example of technique for conducting proteomic assays includes U.S. Pat. No. 7,473,532 to Darfler et al. titled "Liquid Tissue Preparation from Histopathologically Processed Biological Samples, Tissues, and Cells" filed on Mar. 10, 2004.

In addition, neoepitopes may also be subject to detailed analysis and filtering using predefined structural and/or sub-cellular location parameters. For example, it is contemplated that neoepitope sequences are selected for further use if they are identified as having a membrane associated location (e.g., are located at the outside of a cell membrane of a cell) and/or if in silico structural calculation confirms that the neoepitope is likely to be solvent exposed or presents a structurally stable epitope, etc.

Consequently, it should be recognized that patient and cancer specific neoepitopes can be identified from omics information in an exclusively in silico environment that ultimately predicts potential epitopes that are unique to the patient and tumor type. So identified and selected neoepitopes can then be further filtered in silico against an identified patient HLA-type. Such HLA-matching is thought to ensure strong binding of the neoepitopes to the MHC-I complex of nucleated cells and the MHC-II complex of specific antigen presenting cells. Targeting both antigen presentation systems is particularly thought to produce a therapeutically effective and durable immune response involving both, the cellular and the humoral branch of the immune system. Of course, it should also be appreciated that thusly identified HLA-matched neoepitopes can be biochemically validated in vitro.

HLA determination for both MHC-I and MHC-II can be done using various methods in wet-chemistry that are well known in the art, and all of these methods are deemed suitable for use herein. However, in especially preferred methods, the HLA-type can also be predicted from omics data in silico using a reference sequence containing most or all of the known and/or common HLA-types as is shown in more detail below. In short, a patient's HLA-type is ascertained (using wet chemistry or in silico determination), and a structural solution for the HLA-type is calculated or obtained from a database, which is then used as a docking model in silico to determine binding affinity of the neoepitope to the HLA structural solution. Suitable systems for determination of binding affinities include the NetMHC platform (see e.g., Nucleic Acids Res. 2008 Jul. 1; 36 (Web Server issue): W509-W512.), HLAMatchmaker (http://www.epitopes.net/downloads.html), and IEDB Analysis Resource (http://tools.immuneepitope.org/mhcii/). Neoepitopes with high affinity (e.g., less than 100 nM, less than 75 nM, less than 50 nM for MHC-I; less than 500 nM, less than 300 nM, less than 100 nM for MHC-II) against the previously determined HLA-type are then selected. In calculating the highest affinity, modifications to the neoepitopes may be implemented by adding N- and/or C-terminal modifications to the epitope to further increase binding of a synthetic neoepitope to the HLA-type of the patient. Thus, neoepitopes may be native as identified or further modified to better match a particular HLA-type.

In yet another aspect of filtering, the neoepitopes may be compared against a database that contains known human sequences to so avoid use of a human-identical sequence. Moreover, filtering may also include removal of neoepitope sequences that are due to SNPs in the patient. For example, The Single Nucleotide Polymorphism Database (dbSNP) is a free public archive for genetic variation within and across different species developed and hosted by the National Center for Biotechnology Information (NCBI) in collaboration with the National Human Genome Research Institute (NHGRI). Although the name of the database implies a collection of one class of polymorphisms only (i.e., single nucleotide polymorphisms (SNPs)), it in fact contains a relatively wide range of molecular variation: (1) SNPs, (2) short deletion and insertion polymorphisms (indels/DIPs), (3) microsatellite markers or short tandem repeats (STRs), (4) multinucleotide polymorphisms (MNPs), (5) heterozygous sequences, and (6) named variants. The dbSNP accepts apparently neutral polymorphisms, polymorphisms corresponding to known phenotypes, and regions of no variation. Using such database, the patient and tumor specific neoepitopes may be further filtered to remove those know sequences, yielding a therapeutic sequence set with a plurality of neoepitope sequences.

Consequently, it should be appreciated that the so identified cancer neoepitopes are unique to the patient and the particular cancer in the patient (e.g., having a frequency of less than 0.1% of all neoepitopes, and more typically less than 0.01% in a population of cancer patients diagnosed with the same cancer), but that the so identified cancer neoepitopes have a high likelihood of being presented in a tumor and therefore provide a high likelihood of being specifically targeted by a synthetic antibody, even if the cancer has an immune suppressive microenvironment.

In practice, neoepitopes can be scored/ranked based on allele frequency multiplied by the transcripts per million number to get a likelihood score. This score can then be further augmented using HLA information and calculated or actual binding affinity to the patient's HLA type. For example, an exemplary ranking format may be:
>254 NM_001000.3 RPL39 Missense p.M29K A→T Normal: WIRMKTGNK, AF: 0.179104477612 TPM: 1023.96 TPM_MEDIAN: 7.35 LL: 183.395820896 netMHC: 242.96 Allele: HLA-A0301 WIRKKTGNK.

Here, the file is a FASTA formatted file, and entries start with the '>' character, which just reports sample information. The next line is the neoepitope. In the sample information line contains a number used for indexing the sample (e.g., 254), the Refseq Gene ID (e.g., NM_001000.3), the HUGO common name (e.g., RPL39), the variant classification (e.g., Missense), the protein change (e.g., p.M29K), the base pair change (e.g., A→T), the normal epitope (e.g., Normal: WIRMKTGNK), allele frequency (e.g., AF: 0.179104477612), Transcripts per million for this gene (e.g., TPM: 1023.96), TPM_MEDIAN which is the median expression level of all the genes (e.g., TPM_MEDIAN: 7.35), the LL score which is just AF×TPM (e.g., LL: 183.395820896), the netMHC predicted binding value (e.g., netMHC: 242.96), and the specific HLA allele that the neoepitope binds to (e.g., Allele: HLA-A0301). The next line is then the neoepitope (e.g., WIRKKTGNK).

The feasibility of such approach was shown by the inventors using omics information from the publically available TCGA database covering numerous cancers, in which each of the cancers had data available for multiple patients. Table 1 below lists the name and cancer type, followed by neoepitopes found for each cancer type.

TABLE 1

| Name | Cancer Type | SEQ ID NOs. |
|---|---|---|
| BLCA | Bladder Urothelial Carcinoma | 1-35,781 |
| BRCA | Breast invasive carcinoma | 35,782-105,572 |
| CESC | Cervical squamous cell carcinoma and endocervical adenocarcinoma | 105,573-117,234 |
| COAD | Colon adenocarcinoma | 117,235-454,041 |
| DLBC | Lymphoid Neoplasm Diffuse Large B-cell Lymphoma | 454,042-461,532 |
| GBM | Glioblastoma multiforme | 461,533-470,083 |
| HNSC | Head and Neck squamous cell carcinoma | 470,084-527,237 |
| KICH | Kidney Chromophobe | 527,238-541,231 |
| KIRC | Kidney renal clear cell carcinoma | 541,232-562,123 |
| KIRP | Kidney renal papillary cell carcinoma | 562,124-570,663 |
| LAML | Acute Myeloid Leukemia | 570,664-570,775 |
| LGG | Brain Lower Grade Glioma | 570,776-573,578 |
| LIHC | Liver hepatocellular carcinoma | 573,579-607,372 |
| LUAD | Lung adenocarcinoma | 607,373-683,023 |
| LUSC | Lung squamous cell carcinoma | 683,024-770,110 |
| OV | Ovarian serous cystadenocarcinoma | 770,111-797,661 |
| PRAD | Prostate adenocarcinoma | 797,662-800,692 |
| READ | Rectum adenocarcinoma | 800,693-906,174 |
| SARC | Sarcoma | 906,175-913,860 |
| SKCM | Skin Cutaneous Melanoma | 913,861-1,089,652 |
| STAD | Stomach adenocarcinoma | 1,089,653-1,202,468 |
| THCA | Thyroid carcinoma | 1,202,469-1,208,734 |
| UCEC | Uterine Corpus Endometrial Carcinoma | 1,208,735-1,408,729 |

Thus, it should be recognized that it is feasible to assemble an entire rational-designed collection of neoepitopes of a specific patient with a specific cancer, which can then be further tested in vitro to find or generate high-affinity antibodies. Indeed, contemplated collections may include one, two, three, four, five, six-ten, 10-50, 50-150, 1,000 and even more patient- and cancer-specific neoepitopes. Viewed from a different perspective, the rational-designed collection of neoepitopes may cover between 1-10%, or between 10-25%, or between 25-60%, or between 60-100% of all neoepitopes that are expressed and bind to the HLA type of the patient. Thus, contemplated collections will comprise at least 15%, at least 25%, at least 50%, at least 70, or at least 90% of the cancer immunome (neoepitopes that are expressed and bind to the HLA type of the patient). Consequently, it should also be appreciated that even for patients with tumor immune suppression or chemotherapy-damaged immune system, numerous targets for immune therapy are now available.

To obtain a synthetic antibody against the identified neoepitope(s), it is contemplated that the in silico identified is prepared in vitro to yield a synthetic peptide. There are numerous methods known in the art to prepare synthetic peptides, and all known manners are deemed suitable for use herein. For example, peptides with cancer neoepitope sequences can be prepared on a solid phase (e.g., using Merrified synthesis), via liquid phase synthesis, or from smaller peptide fragments. In less preferred aspects, peptides could also be produced by expression of a recombinant nucleic acid in a suitable host (especially where multiple neoepitopes are on a single peptide chain, optionally with spacers between neoepitopes or cleavage sites).

Therefore, the structure of the synthetic peptides corresponding to or comprising the neoepitope sequences may be X-L$_1$-(A$_n$-L$_2$)$_m$-Q, in which X is an optional coupling group or moiety that is suitable to covalently or non-covalently attaches the synthetic peptide to a solid phase, L$_1$ is an optional linker that covalently links the synthetic peptide to a solid phase or the coupling group. A$_n$ is the synthetic peptide having the neoepitope sequence with A being a natural (proteinogenic) amino acid and n is an integer between 7 and 30, and most typically between 7 and 11 or 15-25. L$_2$ is an optional linker that may be present, especially where multiple synthetic peptide sequences (identical or different) are in the construct, and m is an integer, typically between 1 and 30, and most typically between 2 and 15. Finally, Q is a terminal group which may used to couple the end of the synthetic peptide to the solid phase (e.g., to sterically constrain the peptide) or to a reporter group (e.g., fluorescence marker) or other functional moiety (e.g., affinity marker). Consequently, it should be noted that where the synthetic peptide is used for direct MHC-I binding, the overall length will be between 8 and 10 amino acids. Similarly, where the synthetic peptide is used for direct MHC-II binding, the overall length will be between 14 and 20 amino acids. On the other hand, where the synthetic peptide is processed in the cell (typically via proteasome processing) prior to MHC presentation, the overall length will typically be between 10 and 40 amino acids, with the changed amino at or near a central position in the synthetic peptide.

For example, X could be a non-covalent affinity moiety (e.g., biotin) that binds a corresponding binding agent (e.g., avidin) on the solid phase, or a chemical group (with or without spacer) that reacts with the N- or C-terminal amino or carboxyl group of the peptide, or a selectively reactive group (e.g., iodoacetyl or maleimide group) that reacts with a sulfhydryl group in the peptide or linker L$_1$. L$_1$ may be used to increase the distance of the synthetic peptide from the solid phase and will therefore typically comprise a flexible linear moiety (e.g., comprising glycol groups, alkoxy groups, glycine, etc.) having a length of equivalent to between about 2-20 carbon-carbon bonds (e.g., between 0.3 nm and 3 nm). Of course, it should also be appreciated that the synthetic peptide may use the solid phase on which the peptide was produced and as such not require a separate coupling group or linker.

Depending on the particular synthetic peptide and coupling method, it should be appreciated that the nature of the solid phase may vary considerably, and all known solid phases for attachment of peptides are deemed suitable for use herein. For example, suitable solid phases include agarose beads, polymer beads (colored or otherwise individually addressable), wall surfaces of a well in a microtiter plate, paper, nitrocellulose, glass, etc. The person of ordinary skill in the art will be readily appraised of a suitable choice of solid phase and attachment chemistry. In further preferred aspects, it is also noted that the solid phase will generally be suitable for protocols associated with phage display methods such as to allow peptides presented on a phage (or other scaffold carrier) to reversibly bind to the solid phase via the synthetic peptide. In still further contemplated uses, it should also be recognized that the solid phase may be a carrier protein used in vaccination (e.g., albumin, KLH, tetanus toxoid, diphtheria toxin, etc.), particularly where the synthetic protein is used as a vaccine in a mammal or as an immunogenic compound in a non-human mammal for antibody production. Likewise, the synthetic protein may also be used as a vaccine or immunogenic compound without any carrier.

In still further preferred methods, it should be recognized that where the synthetic peptide (that comprises or corresponds to the cancer neoepitope) is immobilized on a solid phase, affinity agents, and particularly antibodies, to the neoepitope may be isolated and/or refined. Most preferably, such isolation will include a prefabricated high-diversity library of antibodies. As used herein, and unless the context dictates otherwise, the term "antibody" or "antibodies" includes all isotypes and subtypes of antibodies (e.g., IgG, IgM, IgE, etc.) as well as all fragments thereof, including monovalent IgG, F(ab')$_2$, Fab', Fab, scFv, scFv-Fc, VhH, etc. Moreover, contemplated antibodies may be humanized, of human or non-human (e.g., rodent) origin, or may be chimeric. In a typical method, a high-diversity library may be a phage display library having a diversity of at least $10^9$ diverse members, or at least $10^{10}$ diverse members, or even higher, typically based on M13 phages and display via pIII, pVIII, pVI, or pIX, or based on T7 phages and the gene 10 capsid protein. As should be readily appreciated, use of large diversity libraries will provide in relatively short time several binding candidate antibodies that can be further selected for best binders. Indeed, where binding affinity to the immobilized synthetic peptide is less than desired, it should be recognized that affinity can be improved via affinity maturation using protocols well known in the art. For example, low affinity (K$_D$>10$^{-7}$M) binders or members of smaller libraries may be subjected to affinity maturation to improve binding affinity and/or kinetic using methods well known in the art (see e.g., *Briefings In Functional Genomics And Proteomics*. Vol 1. No 2. 189-203. July 2002). In addition, it should be noted that while antibody libraries are generally preferred, other scaffolds are also deemed suitable and include beta barrels, ribosome display, cell surface display, etc. (see e.g., *Protein Sci.* 2006 January; 15(1): 14-27.) Thus, it should be appreciated that in preferred aspects the synthetic peptide is used as a bait in a library of antibodies to so identify high-affinity binding (K$_D$<10$^{-7}$M, and more typically K$_D$<10$^{-8}$M) antibodies.

As the antibodies are directly coupled to the cell that carries the nucleic acid encoding these antibodies, it should be further appreciated that such nucleic acid can then be analyzed to identify sequence elements encoding the hypervariable loops, the CDR1, CDR2, and CDR3, for light and heavy chain, respectively, and/or SDRs (specificity determining residues). Most typically, determination is performed using standard sequencing methods. Once determined, it is then contemplated that the hypervariable loops, or the CDR1-H, CDR2-H, and/or CDR3-H and/or the CDR1-L, CDR2-L, and/or CDR3-L, and/or SDRs are grafted onto a human or humanized antibody scaffold or antibody. As will be readily appreciated, grafting can be done by genetic engineering of a nucleic acid that encodes the human or humanized antibody scaffold or antibody. For example, within each CDR, there are more variable positions that are directly involved in the interaction with antigen, i.e., specificity-determining residues (SDRs), whereas there are more conserved residues that maintain the conformations of CDRs loops. SDRs may be identified from the 3D structure of the antigen-antibody complex and/or the mutational analysis of the CDRs. An SDR-grafted humanized antibody is constructed by grafting the SDRs and the residues maintaining the conformations of the CDRs onto human template. Consequently, it should be recognized that human or humanized antibodies with specificity to cancer neoepitopes can be prepared in an entirely synthetic manner in which the antibody is expressed in a cell that has not previously contacted the antigen. Moreover, contemplated methods allow production of patient and cancer specific antibodies for treatment of a patient that has failed to produce or effectively use antibodies against the neoepitopes.

While not limiting to the inventive subject matter, so prepared synthetic antibodies can be used directly as an IgG (or other isotype), as a fragment (e.g., bispecific Fab or other bispecific fragment), and/or as a chimeric protein (e.g., scFv as ectodomain in a chimeric T cell receptor), alone or in conjugation with a therapeutic or diagnostic agent, and/or as a hybrid protein with a transmembrane domain to ensure membrane anchoring of the antibody to a cell. Consequently, the inventors contemplate a method of generating a pharmaceutical agent for cancer immune therapy in which the so identified synthetic antibodies are coupled to a therapeutic or diagnostic agent (which may have a cellular or non-cellular component) to so obtain the pharmaceutical agent.

For example, contemplated non-cellular agents include various chemotherapeutic drugs to so deliver the chemotherapeutic drug directly to a cancer cell. For example, suitable chemotherapeutic drugs include kinase inhibitors (e.g., erlotinib, imatinib, bortezomib, etc.), topoisomerase inhibitors (e.g., topotecan, etoposide, teniposide, etc.), nucleotide analogs (e.g., fluorouracil, gemcitabine, azacytidine, etc.), platinum based agents (e.g., cisplatin, carboplatin, etc.), alkylating agents (e.g., cyclophosphamide, chlorambucil, temozolomide, etc.), taxanes (e.g., docetaxel, paclitaxel, etc.), microtubulin inhibitors (e.g., vincristine, vinblastine, etc.). On the other hand, directed and site specific radiotherapy may be employed by coupling a radiologic agent to the antibody to selectively destroy a cancer cell. Suitable radiologic agents include all agents suitable for brachytherapy, and especially $^{125}$I, $^{103}$Pd, or $^{192}$Ir. Alternatively, $^{10}$B may be used where neutron capture therapy with low-energy thermal neutrons is desired. Likewise, imaging agents may be coupled to the antibody or fragment thereof, and especially preferred imaging agents include PET (e.g., $^{11}$C, $^{13}$N, $^{15}$O, and $^{18}$F) and SPECT labels (e.g., $^{123}$I, $^{99m}$Tc, $^{133}$Xe, $^{201}$Tl, and $^{18}$F). As used herein, and unless the context dictates otherwise, the term "coupled to" is intended to include both direct coupling (in which two elements that are coupled to each other contact each other) and indirect coupling (in which at least one additional element is located between the two elements). Therefore, the terms "coupled to" and "coupled with" are used synonymously. In still further contemplated aspects, the antibody may be modified with an antigen that is known to be an immunogenic antigen. Such modification is particularly advantageous where the patient was previously immunized with the same antigen. In such scenario, it is contemplated that the cancer cells with the neoepitopes are 'painted' with the modified antibody presenting the immunogenic antigen, which is particularly advantageous where an immune response to the original neoepitope was not immunogenic or suppressed.

Where the neoepitopes are employed to target immune cells to a tumor, it should be noted that the antibody may also be coupled to a portion of a T-cell receptor or a cytotoxic T-cell or an NK cell. For example, where the antibody is used in a chimeric T-cell receptor of a cytotoxic T-cell, the antigen binding portion of the chimeric T-cell receptor may have a scFv as ectodomain and the scFv has binding affinity against one of the neoepitopes (e.g., those of SEQ ID NO:1-SEQ ID NO:1,408,729). On the other hand, where the antibody is used with an NK cell, preferred NK cells are NK-92 derivatives that are modified to have a reduced or abolished expression of at least one killer cell immunoglobulin-like receptor (KIR), which will render such cells constitutively activated (via lack of or reduced inhibition). Such NK cells may be obtained from NantKwest (see nantkwest.com) as aNK cells ('activated natural killer cells) and may be further modified to express a membrane bound synthetic antibody with binding affinity to a neoepitope (e.g., those of SEQ ID NO:1-SEQ ID NO:1,408,729).

Alternatively, the NK cell may also be a NK-92 derivative that is modified to express the high-affinity Fcγ receptor (CD16), and it is especially contemplated that the antibodies contemplated herein may be bound to such modified NK cells. Such cells may be obtained from NantKwest as haNK cells ('high-affinity natural killer cells). Likewise, the NK cell may also be genetically engineered to express a chimeric T-cell receptor. In especially preferred aspects, the chimeric T-cell receptor will have an scFv portion or other ectodomain with binding specificity against a neoepitope (e.g., SEQ ID NO:1-SEQ ID NO:1,408,729). Of course, it should also be noted that where the therapeutic agent has a cellular component, the cell may be an autologous cell from the patient or a heterologous cell.

Consequently, it should be recognized that an effective immune response against a cancer neoepitope may be elicited using a process that does not require immunization in the patient or other organism, reducing dramatically response time and availability of therapeutic antibodies. Indeed, using contemplated compositions and methods allows to stimulate or even produce an immune response against a neoepitope in a patient where the immune system of that patient was not sufficient to generate a protective response (e.g., due to chemotherapy or immune suppression by the tumor or Tregs or myeloid-derived suppressor cells).

Depending on the particular composition, it should therefore be appreciated that the pharmaceutical agent may be administered to a patient in vivo or a cell or tissue in vitro. For example, where the synthetic antibody is used in diagnosis, the antibody may be added to a tissue sample ex vivo. (e.g., on a microscope slide to a FFPE sample using a fluorescence labeled antibody) or in vivo (e.g., where the antibody is labeled with a PET label). On the other hand, where the antibody is bound to an immune competent cell, the antibody may be administered to a patient in vivo.

In some embodiments, the numbers expressing quantities of ingredients, properties such as concentration, reaction conditions, and so forth, used to describe and claim certain embodiments of the invention are to be understood as being modified in some instances by the term "about." Accordingly, in some embodiments, the numerical parameters set forth in the written description and attached claims are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the invention are approximations, the numerical values set forth in the specific examples are reported as precisely as practicable. Unless the context dictates the contrary, all ranges set forth herein should be interpreted as being inclusive of their endpoints, and open-ended ranges should be interpreted to include commercially practical values. Similarly, all lists of values should be considered as inclusive of intermediate values unless the context indicates the contrary.

It should be apparent to those skilled in the art that many more modifications besides those already described are possible without departing from the inventive concepts herein. The inventive subject matter, therefore, is not to be

SEQUENCE LISTING (1408729 sequences)

SEQ ID NO: 1 - protein, 9 aa, Homo Sapiens
GSTFDYIQW

SEQ ID NO: 2 - protein, 9 aa, Homo Sapiens
PDAMSLQHT

SEQ ID NO: 3 - protein, 9 aa, Homo Sapiens
YVFTLAQNF

SEQ ID NO: 4 - protein, 9 aa, Homo Sapiens
CCPHSADRV

SEQ ID NO: 5 - protein, 9 aa, Homo Sapiens
GMMKGGGGH

SEQ ID NO: 6 - protein, 9 aa, Homo Sapiens
VSQDVVFQD

SEQ ID NO: 7 - protein, 9 aa, Homo Sapiens
RRNSGMVPS

SEQ ID NO: 8 - protein, 9 aa, Homo Sapiens
TVADCVGIN

SEQ ID NO: 9 - protein, 9 aa, Homo Sapiens
DLTDIVLEL

SEQ ID NO: 10 - protein, 9 aa, Homo Sapiens
EERRLRYGE

SEQ ID NO: 11 - protein, 9 aa, Homo Sapiens
CWFCLAIPE

SEQ ID NO: 12 - protein, 9 aa, Homo Sapiens
ATSGKSHLD

SEQ ID NO: 13 - protein, 9 aa, Homo Sapiens
VAEDGHELR

SEQ ID NO: 14 - protein, 9 aa, Homo Sapiens
EPDGTYQPG

SEQ ID NO: 15 - protein, 9 aa, Homo Sapiens
WYDKGKCGS

SEQ ID NO: 16 - protein, 9 aa, Homo Sapiens
RNMLLENPQ

SEQ ID NO: 17 - protein, 9 aa, Homo Sapiens
SAYCKIVHE

SEQ ID NO: 18 - protein, 9 aa, Homo Sapiens
PPIIVVLAS

SEQ ID NO: 19 - protein, 9 aa, Homo Sapiens
RELFNKAQQ

SEQ ID NO: 20 - protein, 9 aa, Homo Sapiens
PEDPQYVSQ

SEQ ID NO: 21 - protein, 9 aa, Homo Sapiens
VSITYRLLL

SEQ ID NO: 22 - protein, 9 aa, Homo Sapiens
QNLLASRPQ

SEQ ID NO: 23 - protein, 9 aa, Homo Sapiens
FKKMFGWGN

SEQ ID NO: 24 - protein, 9 aa, Homo Sapiens
EHCWGTMQA

SEQ ID NO: 25 - protein, 9 aa, Homo Sapiens
GAGQTFEYF

SEQ ID NO: 26 - protein, 9 aa, Homo Sapiens
MNYVGQLAS

SEQ ID NO: 27 - protein, 9 aa, Homo Sapiens
TGSKDGTAR

SEQ ID NO: 28 - protein, 9 aa, Homo Sapiens
LAQDISQPL

SEQ ID NO: 29 - protein, 9 aa, Homo Sapiens
AKEVLPQYL

SEQ ID NO: 30 - protein, 9 aa, Homo Sapiens
MHSSIERGK

SEQ ID NO: 31 - protein, 9 aa, Homo Sapiens
KKMFGWGNF

SEQ ID NO: 32 - protein, 9 aa, Homo Sapiens
LGKTTSLKM

SEQ ID NO: 33 - protein, 9 aa, Homo Sapiens
FILVAFSHS

SEQ ID NO: 34 - protein, 9 aa, Homo Sapiens
IGLGTVADC

SEQ ID NO: 35 - protein, 9 aa, Homo Sapiens
YDKGKCGSG

SEQ ID NO: 36 - protein, 9 aa, Homo Sapiens
TSGKSHLDF

SEQ ID NO: 37 - protein, 9 aa, Homo Sapiens
NESCEKRAC

SEQ ID NO: 38 - protein, 9 aa, Homo Sapiens
RSYLCNESC

SEQ ID NO: 39 - protein, 9 aa, Homo Sapiens
NNARRATAN

SEQ ID NO: 40 - protein, 9 aa, Homo Sapiens
HGVRDVFKE

SEQ ID NO: 41 - protein, 9 aa, Homo Sapiens
DGHELRTEP

SEQ ID NO: 42 - protein, 9 aa, Homo Sapiens
FTCLSAYCK

SEQ ID NO: 43 - protein, 9 aa, Homo Sapiens
DSFVHLRVP

SEQ ID NO: 44 - protein, 9 aa, Homo Sapiens
PSSLSPDTA

SEQ ID NO: 45 - protein, 9 aa, Homo Sapiens
LTGSKDGTA

SEQ ID NO: 46 - protein, 9 aa, Homo Sapiens
VHAALPLDV

SEQ ID NO: 47 - protein, 9 aa, Homo Sapiens
GSKDGTARL

SEQ ID NO: 48 - protein, 9 aa, Homo Sapiens
YVAFTDTKR

SEQ ID NO: 49 - protein, 9 aa, Homo Sapiens
SSTEERRLR

SEQ ID NO: 50 - protein, 9 aa, Homo Sapiens
EGDTQFNWN

SEQ ID NO: 51 - protein, 9 aa, Homo Sapiens
GKTTSLKML

SEQ ID NO: 52 - protein, 9 aa, Homo Sapiens
FHIITMDYK

SEQ ID NO: 53 - protein, 9 aa, Homo Sapiens
LTCPNASFM

SEQ ID NO: 54 - protein, 9 aa, Homo Sapiens
MDLAEIVSR

SEQ ID NO: 55 - protein, 9 aa, Homo Sapiens
DDRNTFQHS

SEQ ID NO: 56 - protein, 9 aa, Homo Sapiens
LRPERPESL

SEQ ID NO: 57 - protein, 9 aa, Homo Sapiens
GAVAEDGHE

SEQ ID NO: 58 - protein, 9 aa, Homo Sapiens
LFNKAQQGN

SEQ ID NO: 59 - protein, 9 aa, Homo Sapiens
GSIIINMSS

SEQ ID NO: 60 - protein, 9 aa, Homo Sapiens
TSLRAKLKY

SEQ ID NO: 61 - protein, 9 aa, Homo Sapiens
TWENDLNGI

SEQ ID NO: 62 - protein, 9 aa, Homo Sapiens
MPKPSSLSP

SEQ ID NO: 63 - protein, 9 aa, Homo Sapiens
FHSTSAIFV

SEQ ID NO: 64 - protein, 9 aa, Homo Sapiens
LKPCGEDEM

SEQ ID NO: 65 - protein, 9 aa, Homo Sapiens
LGTVADCVG

SEQ ID NO: 66 - protein, 9 aa, Homo Sapiens
AVAEDGHEL

SEQ ID NO: 67 - protein, 9 aa, Homo Sapiens
ITPVPVVGL

SEQ ID NO: 68 - protein, 9 aa, Homo Sapiens
SDFILAEKT

SEQ ID NO: 69 - protein, 9 aa, Homo Sapiens
DIMATTYLS

SEQ ID NO: 70 - protein, 9 aa, Homo Sapiens
LKHSNMASF

SEQ ID NO: 71 - protein, 9 aa, Homo Sapiens
STFDYIQWK

SEQ ID NO: 72 - protein, 9 aa, Homo Sapiens
KAEAAFLNV

SEQ ID NO: 73 - protein, 9 aa, Homo Sapiens
AHLVPWNHD

SEQ ID NO: 74 - protein, 9 aa, Homo Sapiens
MEPDGTYQP

SEQ ID NO: 75 - protein, 9 aa, Homo Sapiens
RRLRYGENG

SEQ ID NO: 76 - protein, 9 aa, Homo Sapiens
EYIGLGTVA

SEQ ID NO: 77 - protein, 9 aa, Homo Sapiens
IQWKGQTSP

SEQ ID NO: 78 - protein, 9 aa, Homo Sapiens
ELFNKAQQG

SEQ ID NO: 79 - protein, 9 aa, Homo Sapiens
FVHLRVPAA

SEQ ID NO: 80 - protein, 9 aa, Homo Sapiens
WGNFHSNIK

SEQ ID NO: 81 - protein, 9 aa, Homo Sapiens
HRDVGADRT

SEQ ID NO: 82 - protein, 9 aa, Homo Sapiens
VHLRVPAAY

SEQ ID NO: 83 - protein, 9 aa, Homo Sapiens
KRYQPQIMA

SEQ ID NO: 84 - protein, 9 aa, Homo Sapiens
GLGTVADCV

SEQ ID NO: 85 - protein, 9 aa, Homo Sapiens
QVSWERSGS

SEQ ID NO: 86 - protein, 9 aa, Homo Sapiens
FLFYFTTRK

SEQ ID NO: 87 - protein, 9 aa, Homo Sapiens
YQPGFVGIR

SEQ ID NO: 88 - protein, 9 aa, Homo Sapiens
RYGENGVQK

SEQ ID NO: 89 - protein, 9 aa, Homo Sapiens
GDTQFNWNI

SEQ ID NO: 90 - protein, 9 aa, Homo Sapiens
EITYSIYMY

SEQ ID NO: 91 - protein, 9 aa, Homo Sapiens
ILFFIVSNL

SEQ ID NO: 92 - protein, 9 aa, Homo Sapiens
IYLSDPKQL

SEQ ID NO: 93 - protein, 9 aa, Homo Sapiens
FYFTTRKLL

SEQ ID NO: 94 - protein, 9 aa, Homo Sapiens
YQYRPQNKD

SEQ ID NO: 95 - protein, 9 aa, Homo Sapiens
GAVAAVKAA

SEQ ID NO: 96 - protein, 9 aa, Homo Sapiens
DEPKSGRGA

SEQ ID NO: 97 - protein, 9 aa, Homo Sapiens
AQRHKEDLE

SEQ ID NO: 98 - protein, 9 aa, Homo Sapiens
RLTHNDIMA

SEQ ID NO: 99 - protein, 9 aa, Homo Sapiens
LSDFILAEK

SEQ ID NO: 100 - protein, 9 aa, Homo Sapiens
STSLSPNYT

SEQ ID NO: 101 - protein, 9 aa, Homo Sapiens
SPDLCDPMS

SEQ ID NO: 102 - protein, 9 aa, Homo Sapiens
APGFVHIDM

SEQ ID NO: 103 - protein, 9 aa, Homo Sapiens
SLRAKLKYE

SEQ ID NO: 104 - protein, 9 aa, Homo Sapiens
FDITALKNP

SEQ ID NO: 105 - protein, 9 aa, Homo Sapiens
DGDSFVHLR

SEQ ID NO: 106 - protein, 9 aa, Homo Sapiens
FSDVAAEQS

SEQ ID NO: 107 - protein, 9 aa, Homo Sapiens
EVLSEHCWG

SEQ ID NO: 108 - protein, 9 aa, Homo Sapiens
LICSNLELH

SEQ ID NO: 109 - protein, 9 aa, Homo Sapiens
KKNRSYLCN

SEQ ID NO: 110 - protein, 9 aa, Homo Sapiens
PEEEVARLF

SEQ ID NO: 111 - protein, 9 aa, Homo Sapiens
PDQDSYSHY

SEQ ID NO: 112 - protein, 9 aa, Homo Sapiens
GICAAGSFI

SEQ ID NO: 113 - protein, 9 aa, Homo Sapiens
QAFDMQGDL

SEQ ID NO: 114 - protein, 9 aa, Homo Sapiens
LRAHMYQAQ

SEQ ID NO: 115 - protein, 9 aa, Homo Sapiens
GCGLNVGLH

SEQ ID NO: 116 - protein, 9 aa, Homo Sapiens
LDLGCLLFE

SEQ ID NO: 117 - protein, 9 aa, Homo Sapiens
IPEVEKHLV

SEQ ID NO: 118 - protein, 9 aa, Homo Sapiens
SVAGLLAQD

SEQ ID NO: 119 - protein, 9 aa, Homo Sapiens
LTDEITYSI

SEQ ID NO: 120 - protein, 9 aa, Homo Sapiens
GRRGQFIPR

SEQ ID NO: 121 - protein, 9 aa, Homo Sapiens
ICAAGSFIL

SEQ ID NO: 122 - protein, 9 aa, Homo Sapiens
MLQARTSNP

SEQ ID NO: 123 - protein, 9 aa, Homo Sapiens
ISFIKDPER

SEQ ID NO: 124 - protein, 9 aa, Homo Sapiens
PQNKDELEL

SEQ ID NO: 125 - protein, 9 aa, Homo Sapiens
KKEKTMTCV

SEQ ID NO: 126 - protein, 9 aa, Homo Sapiens
NLQEVLQEW

SEQ ID NO: 127 - protein, 9 aa, Homo Sapiens
IRERALNSI

SEQ ID NO: 128 - protein, 9 aa, Homo Sapiens
DRNTFQHSV

SEQ ID NO: 129 - protein, 9 aa, Homo Sapiens
NTMGSYRCI

SEQ ID NO: 130 - protein, 9 aa, Homo Sapiens
LRELFNKAQ

SEQ ID NO: 131 - protein, 9 aa, Homo Sapiens
LAGTSLRAK

SEQ ID NO: 132 - protein, 9 aa, Homo Sapiens
PGEDSAPAA

SEQ ID NO: 133 - protein, 9 aa, Homo Sapiens
QSVLRELFN

SEQ ID NO: 134 - protein, 9 aa, Homo Sapiens
PGGIPGIYL

SEQ ID NO: 135 - protein, 9 aa, Homo Sapiens
QKPYACSQC

SEQ ID NO: 136 - protein, 9 aa, Homo Sapiens
LSPLSDFIL

SEQ ID NO: 137 - protein, 9 aa, Homo Sapiens
ETMRITFLP

SEQ ID NO: 138 - protein, 9 aa, Homo Sapiens
SNILGAFCY

SEQ ID NO: 139 - protein, 9 aa, Homo Sapiens
DKKQFPPII

SEQ ID NO: 140 - protein, 9 aa, Homo Sapiens
DQFCRTALH

SEQ ID NO: 141 - protein, 9 aa, Homo Sapiens
RLSPLQLKP

SEQ ID NO: 142 - protein, 9 aa, Homo Sapiens
TQLICSNLE

SEQ ID NO: 143 - protein, 9 aa, Homo Sapiens
NSGSMSGRK

SEQ ID NO: 144 - protein, 9 aa, Homo Sapiens
HQRLHTGQK

SEQ ID NO: 145 - protein, 9 aa, Homo Sapiens
KEVLPQYLK

SEQ ID NO: 146 - protein, 9 aa, Homo Sapiens
NYVGQLASQ

SEQ ID NO: 147 - protein, 9 aa, Homo Sapiens
ALPLPDSPG

SEQ ID NO: 148 - protein, 9 aa, Homo Sapiens
WERSGSPHS

SEQ ID NO: 149 - protein, 9 aa, Homo Sapiens
KAAGLPGGG

SEQ ID NO: 150 - protein, 9 aa, Homo Sapiens
MSSGSPDLC

SEQ ID NO: 151 - protein, 9 aa, Homo Sapiens
EELAPFSLV

SEQ ID NO: 152 - protein, 9 aa, Homo Sapiens
LLTYKSDPV

SEQ ID NO: 153 - protein, 9 aa, Homo Sapiens
SEAALPLPD

SEQ ID NO: 154 - protein, 9 aa, Homo Sapiens
GDMLSALLV

SEQ ID NO: 155 - protein, 9 aa, Homo Sapiens
IDNSGSMSG

SEQ ID NO: 156 - protein, 9 aa, Homo Sapiens
ADWLPSCNT

SEQ ID NO: 157 - protein, 9 aa, Homo Sapiens
SCSFPHNFV

SEQ ID NO: 158 - protein, 9 aa, Homo Sapiens
FDVAFNFTA

SEQ ID NO: 159 - protein, 9 aa, Homo Sapiens
GDGDYMEIF

SEQ ID NO: 160 - protein, 9 aa, Homo Sapiens
NKAQQGNEA

SEQ ID NO: 161 - protein, 9 aa, Homo Sapiens
EGKVKQPQE

SEQ ID NO: 162 - protein, 9 aa, Homo Sapiens
QARLSAGER

SEQ ID NO: 163 - protein, 9 aa, Homo Sapiens
MSLQHTRNV

SEQ ID NO: 164 - protein, 9 aa, Homo Sapiens
VPWRKDQIN

SEQ ID NO: 165 - protein, 9 aa, Homo Sapiens
APFSLVILG

SEQ ID NO: 166 - protein, 9 aa, Homo Sapiens
VKRGAEAHL

SEQ ID NO: 167 - protein, 9 aa, Homo Sapiens
AHICLPVYR

SEQ ID NO: 168 - protein, 9 aa, Homo Sapiens
KSDPVMRKM

SEQ ID NO: 169 - protein, 9 aa, Homo Sapiens
QEGWFSVSG

SEQ ID NO: 170 - protein, 9 aa, Homo Sapiens
NRSRGIRKD

SEQ ID NO: 171 - protein, 9 aa, Homo Sapiens
YFTTRKLLR

SEQ ID NO: 172 - protein, 9 aa, Homo Sapiens
KEVPWRKDQ

SEQ ID NO: 173 - protein, 9 aa, Homo Sapiens
GVIICNVPG

SEQ ID NO: 174 - protein, 9 aa, Homo Sapiens
DLKDQPRGS

SEQ ID NO: 175 - protein, 9 aa, Homo Sapiens
HINALILFF

SEQ ID NO: 176 - protein, 9 aa, Homo Sapiens
LYAVVSITY

SEQ ID NO: 177 - protein, 9 aa, Homo Sapiens
KVEMLLEAE

SEQ ID NO: 178 - protein, 9 aa, Homo Sapiens
GGEGSIIIN

SEQ ID NO: 179 - protein, 9 aa, Homo Sapiens
HQGPSCSFP

SEQ ID NO: 180 - protein, 9 aa, Homo Sapiens
EEEVARLFT

SEQ ID NO: 181 - protein, 9 aa, Homo Sapiens
YLFDVAFNF

SEQ ID NO: 182 - protein, 9 aa, Homo Sapiens
ANRAIWKLD

SEQ ID NO: 183 - protein, 9 aa, Homo Sapiens
GKCGSGGGD

SEQ ID NO: 184 - protein, 9 aa, Homo Sapiens
YRCICKIGF

SEQ ID NO: 185 - protein, 9 aa, Homo Sapiens
CTFIALGLR

SEQ ID NO: 186 - protein, 9 aa, Homo Sapiens
VSKPAGAAA

SEQ ID NO: 187 - protein, 9 aa, Homo Sapiens
RFNLQEVLQ

SEQ ID NO: 188 - protein, 9 aa, Homo Sapiens
WFSVSGSEL

SEQ ID NO: 189 - protein, 9 aa, Homo Sapiens
GFVHIDMTK

SEQ ID NO: 190 - protein, 9 aa, Homo Sapiens
QGDLQITPK

SEQ ID NO: 191 - protein, 9 aa, Homo Sapiens
DVFKELVGL

SEQ ID NO: 192 - protein, 9 aa, Homo Sapiens
RRQVEEAKR

SEQ ID NO: 193 - protein, 9 aa, Homo Sapiens
HNDIMATTY

SEQ ID NO: 194 - protein, 9 aa, Homo Sapiens
NLVGGAVPV

SEQ ID NO: 195 - protein, 9 aa, Homo Sapiens
DVAAEQSLR

SEQ ID NO: 196 - protein, 9 aa, Homo Sapiens
LQARTSNPI

SEQ ID NO: 197 - protein, 9 aa, Homo Sapiens
LDPLGIQLS

SEQ ID NO: 198 - protein, 9 aa, Homo Sapiens
PPAQGDSTS

SEQ ID NO: 199 - protein, 9 aa, Homo Sapiens
FILAEKTIT

SEQ ID NO: 200 - protein, 9 aa, Homo Sapiens
LHTGQKPYA

SEQ ID NO: 201 - protein, 9 aa, Homo Sapiens
RRRLEEAQR

SEQ ID NO: 202 - protein, 9 aa, Homo Sapiens
RFPSKLSFD

SEQ ID NO: 203 - protein, 9 aa, Homo Sapiens
LSAYCKIVH

SEQ ID NO: 204 - protein, 9 aa, Homo Sapiens
GWFSVSGSE

SEQ ID NO: 205 - protein, 9 aa, Homo Sapiens
RHQRLHTGQ

SEQ ID NO: 206 - protein, 9 aa, Homo Sapiens
TGSWRQGMT

SEQ ID NO: 207 - protein, 9 aa, Homo Sapiens
EVLPQYLKH

SEQ ID NO: 208 - protein, 9 aa, Homo Sapiens
LFSDVAAEQ

SEQ ID NO: 209 - protein, 9 aa, Homo Sapiens
YRRRFNLQE

SEQ ID NO: 210 - protein, 9 aa, Homo Sapiens
SKQNGGEGS

SEQ ID NO: 211 - protein, 9 aa, Homo Sapiens
WWYDKGKCG

SEQ ID NO: 212 - protein, 9 aa, Homo Sapiens
LEEAQRHKE

SEQ ID NO: 213 - protein, 9 aa, Homo Sapiens
NFHSNIKTV

SEQ ID NO: 214 - protein, 9 aa, Homo Sapiens
LQEELAPFS

SEQ ID NO: 215 - protein, 9 aa, Homo Sapiens
SLQVANQTP

SEQ ID NO: 216 - protein, 9 aa, Homo Sapiens
PGPMVSKPA

SEQ ID NO: 217 - protein, 9 aa, Homo Sapiens
AVAAVKAAG

SEQ ID NO: 218 - protein, 9 aa, Homo Sapiens
WLYGSSESS

SEQ ID NO: 219 - protein, 9 aa, Homo Sapiens
GTVADCVGI

SEQ ID NO: 220 - protein, 9 aa, Homo Sapiens
FEIEHEAFI

SEQ ID NO: 221 - protein, 9 aa, Homo Sapiens
DPMSSGSPD

SEQ ID NO: 222 - protein, 9 aa, Homo Sapiens
PDQVRPLPA

SEQ ID NO: 223 - protein, 9 aa, Homo Sapiens
RLEEAQRHK

SEQ ID NO: 224 - protein, 9 aa, Homo Sapiens
ERSGPLCTD

SEQ ID NO: 225 - protein, 9 aa, Homo Sapiens
LGIQLSALF

SEQ ID NO: 226 - protein, 9 aa, Homo Sapiens
CGIRSLPAT

SEQ ID NO: 227 - protein, 9 aa, Homo Sapiens
FDGDSFVHL

SEQ ID NO: 228 - protein, 9 aa, Homo Sapiens
VCLCPYERS

SEQ ID NO: 229 - protein, 9 aa, Homo Sapiens
LNPDQDSYS

SEQ ID NO: 230 - protein, 9 aa, Homo Sapiens
PKSGRGAAE

SEQ ID NO: 231 - protein, 9 aa, Homo Sapiens
INQAFDMQG

SEQ ID NO: 232 - protein, 9 aa, Homo Sapiens
LQLKPKVPA

SEQ ID NO: 233 - protein, 9 aa, Homo Sapiens
SPDTAALSH

SEQ ID NO: 234 - protein, 9 aa, Homo Sapiens
QTFEYFKRE

SEQ ID NO: 235 - protein, 9 aa, Homo Sapiens
MKGGGGHRD

SEQ ID NO: 236 - protein, 9 aa, Homo Sapiens
TNNNARRAT

SEQ ID NO: 237 - protein, 9 aa, Homo Sapiens
DGTYQPGFV

SEQ ID NO: 238 - protein, 9 aa, Homo Sapiens
AFDGDSFVH

SEQ ID NO: 239 - protein, 9 aa, Homo Sapiens
TCDQFCRTA

SEQ ID NO: 240 - protein, 9 aa, Homo Sapiens
AEAHLVPWN

SEQ ID NO: 241 - protein, 9 aa, Homo Sapiens
KRREMVRQV

SEQ ID NO: 242 - protein, 9 aa, Homo Sapiens
VEEAKRLKQ

SEQ ID NO: 243 - protein, 9 aa, Homo Sapiens
FILFTKKEK

SEQ ID NO: 244 - protein, 9 aa, Homo Sapiens
VPVVGLALV

SEQ ID NO: 245 - protein, 9 aa, Homo Sapiens
SKKAEAAFL

SEQ ID NO: 246 - protein, 9 aa, Homo Sapiens
DLKPCGEDE

SEQ ID NO: 247 - protein, 9 aa, Homo Sapiens
KDGTARLWS

SEQ ID NO: 248 - protein, 9 aa, Homo Sapiens
LGDDEPKSG

SEQ ID NO: 249 - protein, 9 aa, Homo Sapiens
AVPEAIGFH

SEQ ID NO: 250 - protein, 9 aa, Homo Sapiens
FETWENDLN

SEQ ID NO: 251 - protein, 9 aa, Homo Sapiens
KDQINRHWH

SEQ ID NO: 252 - protein, 9 aa, Homo Sapiens
PHSADRVVL

SEQ ID NO: 253 - protein, 9 aa, Homo Sapiens
LSWEYREHN

SEQ ID NO: 254 - protein, 9 aa, Homo Sapiens
GVRDVFKEL

SEQ ID NO: 255 - protein, 9 aa, Homo Sapiens
DLRAFGWQL

SEQ ID NO: 256 - protein, 9 aa, Homo Sapiens
HLDFKPKLL

SEQ ID NO: 257 - protein, 9 aa, Homo Sapiens
EKQREEGKV

SEQ ID NO: 258 - protein, 9 aa, Homo Sapiens
PKRREMVRQ

SEQ ID NO: 259 - protein, 9 aa, Homo Sapiens
VNILRFSGR

SEQ ID NO: 260 - protein, 9 aa, Homo Sapiens
NPPAQGDST

SEQ ID NO: 261 - protein, 9 aa, Homo Sapiens
HAALPLDVS

SEQ ID NO: 262 - protein, 9 aa, Homo Sapiens
YMEIFMEEM

SEQ ID NO: 263 - protein, 9 aa, Homo Sapiens
ALNSILCKI

SEQ ID NO: 264 - protein, 9 aa, Homo Sapiens
RGQFIPRVE

SEQ ID NO: 265 - protein, 9 aa, Homo Sapiens
ASDNLSWVI

SEQ ID NO: 266 - protein, 9 aa, Homo Sapiens
RYYELKEKH

SEQ ID NO: 267 - protein, 9 aa, Homo Sapiens
TDEITYSIY

SEQ ID NO: 268 - protein, 9 aa, Homo Sapiens
TSCASLAYS

SEQ ID NO: 269 - protein, 9 aa, Homo Sapiens
YCKIVHEYI

SEQ ID NO: 270 - protein, 9 aa, Homo Sapiens
LLVNISKQD

SEQ ID NO: 271 - protein, 9 aa, Homo Sapiens
TTRKLLRPF

SEQ ID NO: 272 - protein, 9 aa, Homo Sapiens
YRVLQWTRA

SEQ ID NO: 273 - protein, 9 aa, Homo Sapiens
ITALKNPSA

SEQ ID NO: 274 - protein, 9 aa, Homo Sapiens
KDPERKYHF

SEQ ID NO: 275 - protein, 9 aa, Homo Sapiens
QWKGQTSPG

SEQ ID NO: 276 - protein, 9 aa, Homo Sapiens
ECLAGTSLR

SEQ ID NO: 277 - protein, 9 aa, Homo Sapiens
KTKEVPWRK

SEQ ID NO: 278 - protein, 9 aa, Homo Sapiens
PVMRKMLNH

SEQ ID NO: 279 - protein, 9 aa, Homo Sapiens
FKNKASSSD

SEQ ID NO: 280 - protein, 9 aa, Homo Sapiens
LTEGDTQFN

SEQ ID NO: 281 - protein, 9 aa, Homo Sapiens
MQTKHIYQN

SEQ ID NO: 282 - protein, 9 aa, Homo Sapiens
LRAKLKYES

SEQ ID NO: 283 - protein, 9 aa, Homo Sapiens
YVEMLQART

SEQ ID NO: 284 - protein, 9 aa, Homo Sapiens
TRASGGLPT

SEQ ID NO: 285 - protein, 9 aa, Homo Sapiens
RLFTMAGVP

SEQ ID NO: 286 - protein, 9 aa, Homo Sapiens
GNFHSNIKT

SEQ ID NO: 287 - protein, 9 aa, Homo Sapiens
FDEEMSRVL

SEQ ID NO: 288 - protein, 9 aa, Homo Sapiens
ADTCDQFCR

SEQ ID NO: 289 - protein, 9 aa, Homo Sapiens
HCWGTMQAV

SEQ ID NO: 290 - protein, 9 aa, Homo Sapiens
EVPWRKDQI

SEQ ID NO: 291 - protein, 9 aa, Homo Sapiens
KSGRGAAEA

SEQ ID NO: 292 - protein, 9 aa, Homo Sapiens
IDMTKDLKE

SEQ ID NO: 293 - protein, 9 aa, Homo Sapiens
LLFSDVAAE

SEQ ID NO: 294 - protein, 9 aa, Homo Sapiens
RCIVRKDLR

SEQ ID NO: 295 - protein, 9 aa, Homo Sapiens
LGCPSCGTA

SEQ ID NO: 296 - protein, 9 aa, Homo Sapiens
DHQHAHICL

SEQ ID NO: 297 - protein, 9 aa, Homo Sapiens
CDPMSSGSP

SEQ ID NO: 298 - protein, 9 aa, Homo Sapiens
VLSPLSDFI

SEQ ID NO: 299 - protein, 9 aa, Homo Sapiens
YIQWKGQTS

SEQ ID NO: 300 - protein, 9 aa, Homo Sapiens
VGAICCGIR

SEQ ID NO: 301 - protein, 9 aa, Homo Sapiens
MYQAQGLIA

SEQ ID NO: 302 - protein, 9 aa, Homo Sapiens
AGGHGPDQV

SEQ ID NO: 303 - protein, 9 aa, Homo Sapiens
AGTSLRAKL

SEQ ID NO: 304 - protein, 9 aa, Homo Sapiens
EYREHNGPI

SEQ ID NO: 305 - protein, 9 aa, Homo Sapiens
AEIRERALN

SEQ ID NO: 306 - protein, 9 aa, Homo Sapiens
EIEHEAFIS

SEQ ID NO: 307 - protein, 9 aa, Homo Sapiens
GTSLRAKLK

SEQ ID NO: 308 - protein, 9 aa, Homo Sapiens
SLDSNSSQN

SEQ ID NO: 309 - protein, 9 aa, Homo Sapiens
QHTRNVNQI

SEQ ID NO: 310 - protein, 9 aa, Homo Sapiens
QREEGKVKQ

SEQ ID NO: 311 - protein, 9 aa, Homo Sapiens
VVFVIDNSG

SEQ ID NO: 312 - protein, 9 aa, Homo Sapiens
DEEMSRVLA

SEQ ID NO: 313 - protein, 9 aa, Homo Sapiens
VMPVCVALS

SEQ ID NO: 314 - protein, 9 aa, Homo Sapiens
EIRERALNS

SEQ ID NO: 315 - protein, 9 aa, Homo Sapiens
SYVAFTDTK

SEQ ID NO: 316 - protein, 9 aa, Homo Sapiens
GKVKQPQEE

SEQ ID NO: 317 - protein, 9 aa, Homo Sapiens
QPGFVGIRF

SEQ ID NO: 318 - protein, 9 aa, Homo Sapiens
EGSIIINMS

SEQ ID NO: 319 - protein, 9 aa, Homo Sapiens
FDMQGDLQI

SEQ ID NO: 320 - protein, 9 aa, Homo Sapiens
VPEAIGFHI

SEQ ID NO: 321 - protein, 9 aa, Homo Sapiens
KDQPRGSPP

SEQ ID NO: 322 - protein, 9 aa, Homo Sapiens
PLDVSTFWV

SEQ ID NO: 323 - protein, 9 aa, Homo Sapiens
RLLTGSKDG

SEQ ID NO: 324 - protein, 9 aa, Homo Sapiens
QGDSTSLSP

SEQ ID NO: 325 - protein, 9 aa, Homo Sapiens
DMEWLYGSS

SEQ ID NO: 326 - protein, 9 aa, Homo Sapiens
RSRGIRKDI

SEQ ID NO: 327 - protein, 9 aa, Homo Sapiens
RGAEAHLVP

SEQ ID NO: 328 - protein, 9 aa, Homo Sapiens
VKAAGLPGG

SEQ ID NO: 329 - protein, 9 aa, Homo Sapiens
VAAVKAAGL

SEQ ID NO: 330 - protein, 9 aa, Homo Sapiens
WNRSRGIRK

SEQ ID NO: 331 - protein, 9 aa, Homo Sapiens
GMEEAGSVT

SEQ ID NO: 332 - protein, 9 aa, Homo Sapiens
KLSFDLKHL

SEQ ID NO: 333 - protein, 9 aa, Homo Sapiens
PNPPAQGDS

SEQ ID NO: 334 - protein, 9 aa, Homo Sapiens
GSYRCICKI

SEQ ID NO: 335 - protein, 9 aa, Homo Sapiens
VLQWTRASG

SEQ ID NO: 336 - protein, 9 aa, Homo Sapiens
RPQNKDELE

SEQ ID NO: 337 - protein, 9 aa, Homo Sapiens
GHMTESSCM

SEQ ID NO: 338 - protein, 9 aa, Homo Sapiens
YGPESPKRR

SEQ ID NO: 339 - protein, 9 aa, Homo Sapiens
CSFPHNFVL

SEQ ID NO: 340 - protein, 9 aa, Homo Sapiens
CPSCGTARL

SEQ ID NO: 341 - protein, 9 aa, Homo Sapiens
AVVSITYRL

SEQ ID NO: 342 - protein, 9 aa, Homo Sapiens
ILRFSGRRN

SEQ ID NO: 343 - protein, 9 aa, Homo Sapiens
QASDNLSWV

SEQ ID NO: 344 - protein, 9 aa, Homo Sapiens
HELRTEPEA

SEQ ID NO: 345 - protein, 9 aa, Homo Sapiens
GQRLLTGSK

SEQ ID NO: 346 - protein, 9 aa, Homo Sapiens
DPVMRKMLN

SEQ ID NO: 347 - protein, 9 aa, Homo Sapiens
CLAIPEVEK

SEQ ID NO: 348 - protein, 9 aa, Homo Sapiens
SFVHLRVPA

SEQ ID NO: 349 - protein, 9 aa, Homo Sapiens
SKGISRKDG

SEQ ID NO: 350 - protein, 9 aa, Homo Sapiens
AHMYQAQGL

SEQ ID NO: 351 - protein, 9 aa, Homo Sapiens
LCNESCEKR

SEQ ID NO: 352 - protein, 9 aa, Homo Sapiens
FTMAGVPED

SEQ ID NO: 353 - protein, 9 aa, Homo Sapiens
KKLTTSCAS

SEQ ID NO: 354 - protein, 9 aa, Homo Sapiens
CPETMRITF

SEQ ID NO: 355 - protein, 9 aa, Homo Sapiens
LVKRGAEAH

SEQ ID NO: 356 - protein, 9 aa, Homo Sapiens
AFTCLSAYC

SEQ ID NO: 357 - protein, 9 aa, Homo Sapiens
LFDVAFNFT

SEQ ID NO: 358 - protein, 9 aa, Homo Sapiens
RYLGCPSCG

SEQ ID NO: 359 - protein, 9 aa, Homo Sapiens
VDERQLFHS

SEQ ID NO: 360 - protein, 9 aa, Homo Sapiens
YLSDPKQLA

SEQ ID NO: 361 - protein, 9 aa, Homo Sapiens
AQEGWFSVS

SEQ ID NO: 362 - protein, 9 aa, Homo Sapiens
NNFQSFFGS

SEQ ID NO: 363 - protein, 9 aa, Homo Sapiens
LASRPQDRQ

SEQ ID NO: 364 - protein, 9 aa, Homo Sapiens
KRGAEAHLV

SEQ ID NO: 365 - protein, 9 aa, Homo Sapiens
THHINALIL

SEQ ID NO: 366 - protein, 9 aa, Homo Sapiens
GAEAHLVPW

SEQ ID NO: 367 - protein, 9 aa, Homo Sapiens
RAPGMRIYS

SEQ ID NO: 368 - protein, 9 aa, Homo Sapiens
EAALPLPDS

SEQ ID NO: 369 - protein, 9 aa, Homo Sapiens
EDPQYVSQD

SEQ ID NO: 370 - protein, 9 aa, Homo Sapiens
PWRKDQINR

SEQ ID NO: 371 - protein, 9 aa, Homo Sapiens
GFHIITMDY

SEQ ID NO: 372 - protein, 9 aa, Homo Sapiens
NDLNGIHIV

SEQ ID NO: 373 - protein, 9 aa, Homo Sapiens
RRFNLQEVL

SEQ ID NO: 374 - protein, 9 aa, Homo Sapiens
RDVFKELVG

SEQ ID NO: 375 - protein, 9 aa, Homo Sapiens
LVQRYLGCP

SEQ ID NO: 376 - protein, 9 aa, Homo Sapiens
QDANRAIWK

SEQ ID NO: 377 - protein, 9 aa, Homo Sapiens
PESPKRREM

SEQ ID NO: 378 - protein, 9 aa, Homo Sapiens
LSFKKEEEE

SEQ ID NO: 379 - protein, 9 aa, Homo Sapiens
VTVTGHMTE

SEQ ID NO: 380 - protein, 9 aa, Homo Sapiens
GDLQITPKR

SEQ ID NO: 381 - protein, 9 aa, Homo Sapiens
LLTGSKDGT

SEQ ID NO: 382 - protein, 9 aa, Homo Sapiens
PVARCLYLR

SEQ ID NO: 383 - protein, 9 aa, Homo Sapiens
ESPKRREMV

SEQ ID NO: 384 - protein, 9 aa, Homo Sapiens
NPDQDSYSH

SEQ ID NO: 385 - protein, 9 aa, Homo Sapiens
QARTSNPIP

SEQ ID NO: 386 - protein, 9 aa, Homo Sapiens
PSCGTARLG

SEQ ID NO: 387 - protein, 9 aa, Homo Sapiens
RLSWEYREH

SEQ ID NO: 388 - protein, 9 aa, Homo Sapiens
AGDMLSALL

SEQ ID NO: 389 - protein, 9 aa, Homo Sapiens
AMSLQHTRN

SEQ ID NO: 390 - protein, 9 aa, Homo Sapiens
KRLKQSAEE

SEQ ID NO: 391 - protein, 9 aa, Homo Sapiens
ALTEGDTQF

SEQ ID NO: 392 - protein, 9 aa, Homo Sapiens
SLVILGFPC

SEQ ID NO: 393 - protein, 9 aa, Homo Sapiens
NVVFVIDNS

SEQ ID NO: 394 - protein, 9 aa, Homo Sapiens
VDLKPCGED

SEQ ID NO: 395 - protein, 9 aa, Homo Sapiens
EEAGSVTLE

SEQ ID NO: 396 - protein, 9 aa, Homo Sapiens
KKQFPPIIV

SEQ ID NO: 397 - protein, 9 aa, Homo Sapiens
VGAVAAVKA

SEQ ID NO: 398 - protein, 9 aa, Homo Sapiens
IYQNLSQFL

SEQ ID NO: 399 - protein, 9 aa, Homo Sapiens
SSTGLSFKK

SEQ ID NO: 400 - protein, 9 aa, Homo Sapiens
RALNSILCK

SEQ ID NO: 401 - protein, 9 aa, Homo Sapiens
ARLFTMAGV

SEQ ID NO: 402 - protein, 9 aa, Homo Sapiens
HEAFISVLG

SEQ ID NO: 403 - protein, 9 aa, Homo Sapiens
PQYLKHSNM

SEQ ID NO: 404 - protein, 9 aa, Homo Sapiens
VPQNLLASR

SEQ ID NO: 405 - protein, 9 aa, Homo Sapiens
HSTSAIFVD

SEQ ID NO: 406 - protein, 9 aa, Homo Sapiens
KPCGEDEMI

SEQ ID NO: 407 - protein, 9 aa, Homo Sapiens
NSILCKIEH

SEQ ID NO: 408 - protein, 9 aa, Homo Sapiens
KLLRPFQPV

SEQ ID NO: 409 - protein, 9 aa, Homo Sapiens
FKETVHIPV

SEQ ID NO: 410 - protein, 9 aa, Homo Sapiens
ICSNLELHS

SEQ ID NO: 411 - protein, 9 aa, Homo Sapiens
LCDPMSSGS

SEQ ID NO: 412 - protein, 9 aa, Homo Sapiens
EHEAFISVL

SEQ ID NO: 413 - protein, 9 aa, Homo Sapiens
GAFCYMNDV

SEQ ID NO: 414 - protein, 9 aa, Homo Sapiens
SPPALRPER

SEQ ID NO: 415 - protein, 9 aa, Homo Sapiens
TKRLIGDAA

SEQ ID NO: 416 - protein, 9 aa, Homo Sapiens
GAICCGIRS

SEQ ID NO: 417 - protein, 9 aa, Homo Sapiens
ATSTNNNAR

SEQ ID NO: 418 - protein, 9 aa, Homo Sapiens
QVRPLPAAS

SEQ ID NO: 419 - protein, 9 aa, Homo Sapiens
KLAERLVEC

SEQ ID NO: 420 - protein, 9 aa, Homo Sapiens
PRVEPGSPA

SEQ ID NO: 421 - protein, 9 aa, Homo Sapiens
FQSFFGSLM

SEQ ID NO: 422 - protein, 9 aa, Homo Sapiens
RGYFDEEMS

SEQ ID NO: 423 - protein, 9 aa, Homo Sapiens
HNNFQSFFG

SEQ ID NO: 424 - protein, 9 aa, Homo Sapiens
ARQAGHHKL

SEQ ID NO: 425 - protein, 9 aa, Homo Sapiens
EMLQARTSN

SEQ ID NO: 426 - protein, 9 aa, Homo Sapiens
FPSKLSFDL

SEQ ID NO: 427 - protein, 9 aa, Homo Sapiens
VRFPSKLSF

SEQ ID NO: 428 - protein, 9 aa, Homo Sapiens
PPGPMVSKP

SEQ ID NO: 429 - protein, 9 aa, Homo Sapiens
SVLRELFNK

SEQ ID NO: 430 - protein, 9 aa, Homo Sapiens
FVWNRSRGI

SEQ ID NO: 431 - protein, 9 aa, Homo Sapiens
AVSAFEIEH

SEQ ID NO: 432 - protein, 9 aa, Homo Sapiens
KHQSLDLGC

SEQ ID NO: 433 - protein, 9 aa, Homo Sapiens
GPESPKRRE

SEQ ID NO: 434 - protein, 9 aa, Homo Sapiens
SSHEQARLS

SEQ ID NO: 435 - protein, 9 aa, Homo Sapiens
THNDIMATT

SEQ ID NO: 436 - protein, 9 aa, Homo Sapiens
DSAPAAGYR

SEQ ID NO: 437 - protein, 9 aa, Homo Sapiens
IIVVLASSE

SEQ ID NO: 438 - protein, 9 aa, Homo Sapiens
GPGEDSAPA

SEQ ID NO: 439 - protein, 9 aa, Homo Sapiens
QYRPQNKDE

SEQ ID NO: 440 - protein, 9 aa, Homo Sapiens
RCICKIGFG

SEQ ID NO: 441 - protein, 9 aa, Homo Sapiens
GIYLSDPKQ

SEQ ID NO: 442 - protein, 9 aa, Homo Sapiens
CGEDEMITM

SEQ ID NO: 443 - protein, 9 aa, Homo Sapiens
EQSLRQLLH

SEQ ID NO: 444 - protein, 9 aa, Homo Sapiens
NASFMDLAE

SEQ ID NO: 445 - protein, 9 aa, Homo Sapiens
RASGGLPTN

SEQ ID NO: 446 - protein, 9 aa, Homo Sapiens
VSSTGLSFK

SEQ ID NO: 447 - protein, 9 aa, Homo Sapiens
GCPSCGTAR

SEQ ID NO: 448 - protein, 9 aa, Homo Sapiens
EDKPSLISG

SEQ ID NO: 449 - protein, 9 aa, Homo Sapiens
FSVSGSELR

SEQ ID NO: 450 - protein, 9 aa, Homo Sapiens
PRAEAMMHS

SEQ ID NO: 451 - protein, 9 aa, Homo Sapiens
RNGLGKTTS

SEQ ID NO: 452 - protein, 9 aa, Homo Sapiens
LDDRNTFQH

SEQ ID NO: 453 - protein, 9 aa, Homo Sapiens
ITYSIYMYT

SEQ ID NO: 454 - protein, 9 aa, Homo Sapiens
GQFIPRVEP

SEQ ID NO: 455 - protein, 9 aa, Homo Sapiens
KQVSWERSG

SEQ ID NO: 456 - protein, 9 aa, Homo Sapiens
SPLQLKPKV

SEQ ID NO: 457 - protein, 9 aa, Homo Sapiens
FGWGNFHSN

SEQ ID NO: 458 - protein, 9 aa, Homo Sapiens
SLKMLATRS

SEQ ID NO: 459 - protein, 9 aa, Homo Sapiens
QEVLQEWEA

SEQ ID NO: 460 - protein, 9 aa, Homo Sapiens
TRLSPLQLK

SEQ ID NO: 461 - protein, 9 aa, Homo Sapiens
DTKRLIGDA

SEQ ID NO: 462 - protein, 9 aa, Homo Sapiens
LSAGERHGS

SEQ ID NO: 463 - protein, 9 aa, Homo Sapiens
DEITYSIYM

SEQ ID NO: 464 - protein, 9 aa, Homo Sapiens
SRRQVEEAK

SEQ ID NO: 465 - protein, 9 aa, Homo Sapiens
VCVALSTFG

SEQ ID NO: 466 - protein, 9 aa, Homo Sapiens
DTCDQFCRT

SEQ ID NO: 467 - protein, 9 aa, Homo Sapiens
TEGDTQFNW

SEQ ID NO: 468 - protein, 9 aa, Homo Sapiens
VTGHMTESS

SEQ ID NO: 469 - protein, 9 aa, Homo Sapiens
RQGMTAQVG

SEQ ID NO: 470 - protein, 9 aa, Homo Sapiens
CNESCEKRA

SEQ ID NO: 471 - protein, 9 aa, Homo Sapiens
ASSPSPPAL

SEQ ID NO: 472 - protein, 9 aa, Homo Sapiens
ICCGIRSLP

SEQ ID NO: 473 - protein, 9 aa, Homo Sapiens
YFSWVMPVC

SEQ ID NO: 474 - protein, 9 aa, Homo Sapiens
VIICNVPGT

SEQ ID NO: 475 - protein, 9 aa, Homo Sapiens
DETKKGSLQ

SEQ ID NO: 476 - protein, 9 aa, Homo Sapiens
CLAGTSLRA

SEQ ID NO: 477 - protein, 9 aa, Homo Sapiens
KGGGGHRDV

SEQ ID NO: 478 - protein, 9 aa, Homo Sapiens
WYDFVWNRS

SEQ ID NO: 479 - protein, 9 aa, Homo Sapiens
YLPDAMSLQ

SEQ ID NO: 480 - protein, 9 aa, Homo Sapiens
KGSLQVANQ

SEQ ID NO: 481 - protein, 9 aa, Homo Sapiens
GHGPDQVRP

SEQ ID NO: 482 - protein, 9 aa, Homo Sapiens
CPNASFMDL

SEQ ID NO: 483 - protein, 9 aa, Homo Sapiens
DERQLFHST

SEQ ID NO: 484 - protein, 9 aa, Homo Sapiens
NFQSFFGSL

SEQ ID NO: 485 - protein, 9 aa, Homo Sapiens
EDGHELRTE

SEQ ID NO: 486 - protein, 9 aa, Homo Sapiens
LAQDANRAI

SEQ ID NO: 487 - protein, 9 aa, Homo Sapiens
PSSSLPCTF

SEQ ID NO: 488 - protein, 9 aa, Homo Sapiens
GQLASQVFV

SEQ ID NO: 489 - protein, 9 aa, Homo Sapiens
NRSYLCNES

SEQ ID NO: 490 - protein, 9 aa, Homo Sapiens
LTTSCASLA

SEQ ID NO: 491 - protein, 9 aa, Homo Sapiens
TKKGSLQVA

SEQ ID NO: 492 - protein, 9 aa, Homo Sapiens
HHINALILF

SEQ ID NO: 493 - protein, 9 aa, Homo Sapiens
GCLLFEGCS

SEQ ID NO: 494 - protein, 9 aa, Homo Sapiens
QFCRTALHR

SEQ ID NO: 495 - protein, 9 aa, Homo Sapiens
MPVCVALST

SEQ ID NO: 496 - protein, 9 aa, Homo Sapiens
VDLKDQPRG

SEQ ID NO: 497 - protein, 9 aa, Homo Sapiens
QDLSKGISR

SEQ ID NO: 498 - protein, 9 aa, Homo Sapiens
MQGDLQITP

SEQ ID NO: 499 - protein, 9 aa, Homo Sapiens
DPQYVSQDV

SEQ ID NO: 500 - protein, 9 aa, Homo Sapiens
PPGGIPGIY

SEQ ID NO: 501 - protein, 9 aa, Homo Sapiens
SPSPPALRP

SEQ ID NO: 502 - protein, 9 aa, Homo Sapiens
DLSKGISRK

SEQ ID NO: 503 - protein, 9 aa, Homo Sapiens
YLGCPSCGT

SEQ ID NO: 504 - protein, 9 aa, Homo Sapiens
FPHNFVLLV

SEQ ID NO: 505 - protein, 9 aa, Homo Sapiens
GPSCSFPHN

SEQ ID NO: 506 - protein, 9 aa, Homo Sapiens
KGASGVIIC

SEQ ID NO: 507 - protein, 9 aa, Homo Sapiens
QFPPIIVVL

SEQ ID NO: 508 - protein, 9 aa, Homo Sapiens
LHVIAPPRN

SEQ ID NO: 509 - protein, 9 aa, Homo Sapiens
FEYIGLGTV

SEQ ID NO: 510 - protein, 9 aa, Homo Sapiens
MRQPQKKRK

SEQ ID NO: 511 - protein, 9 aa, Homo Sapiens
AEAMMHSSI

SEQ ID NO: 512 - protein, 9 aa, Homo Sapiens
FVHIDMTKD

SEQ ID NO: 513 - protein, 9 aa, Homo Sapiens
QNFKNKASS

SEQ ID NO: 514 - protein, 9 aa, Homo Sapiens
RDPDNKLYF

SEQ ID NO: 515 - protein, 9 aa, Homo Sapiens
IVLELRGQL

SEQ ID NO: 516 - protein, 9 aa, Homo Sapiens
GGIPGIYLS

SEQ ID NO: 517 - protein, 9 aa, Homo Sapiens
YQAQGLIAA

SEQ ID NO: 518 - protein, 9 aa, Homo Sapiens
GPCWFCLAI

SEQ ID NO: 519 - protein, 9 aa, Homo Sapiens
LKNPSAAEE

SEQ ID NO: 520 - protein, 9 aa, Homo Sapiens
LKKNRSYLC

SEQ ID NO: 521 - protein, 9 aa, Homo Sapiens
MLLEAETQS

SEQ ID NO: 522 - protein, 9 aa, Homo Sapiens
NILRFSGRR

SEQ ID NO: 523 - protein, 9 aa, Homo Sapiens
KFEYIGLGT

SEQ ID NO: 524 - protein, 9 aa, Homo Sapiens
YQPQIMAAL

SEQ ID NO: 525 - protein, 9 aa, Homo Sapiens
DPLGIQLSA

SEQ ID NO: 526 - protein, 9 aa, Homo Sapiens
FGALYAVVS

SEQ ID NO: 527 - protein, 9 aa, Homo Sapiens
ELAPFSLVI

SEQ ID NO: 528 - protein, 9 aa, Homo Sapiens
LPQYLKHSN

SEQ ID NO: 529 - protein, 9 aa, Homo Sapiens
EPKSGRGAA

SEQ ID NO: 530 - protein, 9 aa, Homo Sapiens
SSLSPDTAA

SEQ ID NO: 531 - protein, 9 aa, Homo Sapiens
SFMDLAEIV

SEQ ID NO: 532 - protein, 9 aa, Homo Sapiens
KQFPPIIVV

SEQ ID NO: 533 - protein, 9 aa, Homo Sapiens
TGQKPYACS

SEQ ID NO: 534 - protein, 9 aa, Homo Sapiens
YVGQLASQV

SEQ ID NO: 535 - protein, 9 aa, Homo Sapiens
PDGTYQPGF

SEQ ID NO: 536 - protein, 9 aa, Homo Sapiens
DQDSYSHYH

SEQ ID NO: 537 - protein, 9 aa, Homo Sapiens
VLRELFNKA

SEQ ID NO: 538 - protein, 9 aa, Homo Sapiens
DQVRPLPAA

SEQ ID NO: 539 - protein, 9 aa, Homo Sapiens
FTDTKRLIG

SEQ ID NO: 540 - protein, 9 aa, Homo Sapiens
TAFTCLSAY

SEQ ID NO: 541 - protein, 9 aa, Homo Sapiens
ASGVIICNV

SEQ ID NO: 542 - protein, 9 aa, Homo Sapiens
FIRQELNIT

SEQ ID NO: 543 - protein, 9 aa, Homo Sapiens
EDSAPAAGY

SEQ ID NO: 544 - protein, 9 aa, Homo Sapiens
VSWERSGSP

SEQ ID NO: 545 - protein, 9 aa, Homo Sapiens
RRATANNQQ

SEQ ID NO: 546 - protein, 9 aa, Homo Sapiens
DIVCLCPYE

SEQ ID NO: 547 - protein, 9 aa, Homo Sapiens
PGPGEDSAP

SEQ ID NO: 548 - protein, 9 aa, Homo Sapiens
ILGAFCYMN

SEQ ID NO: 549 - protein, 9 aa, Homo Sapiens
TVGAICCGI

SEQ ID NO: 550 - protein, 9 aa, Homo Sapiens
ISQTGSWRQ

SEQ ID NO: 551 - protein, 9 aa, Homo Sapiens
FWLAQDANR

SEQ ID NO: 552 - protein, 9 aa, Homo Sapiens
AFEIEHEAF

SEQ ID NO: 553 - protein, 9 aa, Homo Sapiens
WRKDQINRH

SEQ ID NO: 554 - protein, 9 aa, Homo Sapiens
INRHNNFQS

SEQ ID NO: 555 - protein, 9 aa, Homo Sapiens
HQSLDLGCL

SEQ ID NO: 556 - protein, 9 aa, Homo Sapiens
SSPSPPALR

SEQ ID NO: 557 - protein, 9 aa, Homo Sapiens
STEERRLRY

SEQ ID NO: 558 - protein, 9 aa, Homo Sapiens
VMRKMLNHL

SEQ ID NO: 559 - protein, 9 aa, Homo Sapiens
NVGLHVIAP

SEQ ID NO: 560 - protein, 9 aa, Homo Sapiens
DYIQWKGQT

SEQ ID NO: 561 - protein, 9 aa, Homo Sapiens
VAPGFVHID

SEQ ID NO: 562 - protein, 9 aa, Homo Sapiens
KDLRAFGWQ

SEQ ID NO: 563 - protein, 9 aa, Homo Sapiens
LDHQHAHIC

SEQ ID NO: 564 - protein, 9 aa, Homo Sapiens
RSKKAEAAF

SEQ ID NO: 565 - protein, 9 aa, Homo Sapiens
QAGHHKLAE

SEQ ID NO: 566 - protein, 9 aa, Homo Sapiens
RAEAMMHSS

SEQ ID NO: 567 - protein, 9 aa, Homo Sapiens
PHNFVLLVQ

SEQ ID NO: 568 - protein, 9 aa, Homo Sapiens
CPHSADRVV

SEQ ID NO: 569 - protein, 9 aa, Homo Sapiens
VSAFEIEHE

SEQ ID NO: 570 - protein, 9 aa, Homo Sapiens
STGLSFKKE

SEQ ID NO: 571 - protein, 9 aa, Homo Sapiens
MTTQLICSN

SEQ ID NO: 572 - protein, 9 aa, Homo Sapiens
LQEVLQEWE

SEQ ID NO: 573 - protein, 9 aa, Homo Sapiens
QELNITAAA

SEQ ID NO: 574 - protein, 9 aa, Homo Sapiens
FTAVDLKPC

SEQ ID NO: 575 - protein, 9 aa, Homo Sapiens
HIDMTKDLK

SEQ ID NO: 576 - protein, 9 aa, Homo Sapiens
DDEPKSGRG

SEQ ID NO: 577 - protein, 9 aa, Homo Sapiens
AAVKAAGLP

SEQ ID NO: 578 - protein, 9 aa, Homo Sapiens
ELKEKHVLK

SEQ ID NO: 579 - protein, 9 aa, Homo Sapiens
EVPQNLLAS

SEQ ID NO: 580 - protein, 9 aa, Homo Sapiens
RAIWKLDLS

SEQ ID NO: 581 - protein, 9 aa, Homo Sapiens
TPVPVVGLA

SEQ ID NO: 582 - protein, 9 aa, Homo Sapiens
KGKCGSGGG

SEQ ID NO: 583 - protein, 9 aa, Homo Sapiens
GSVTLEELV

SEQ ID NO: 584 - protein, 9 aa, Homo Sapiens
DWLPSCNTP

SEQ ID NO: 585 - protein, 9 aa, Homo Sapiens
TTVGAICCG

SEQ ID NO: 586 - protein, 9 aa, Homo Sapiens
EWLYGSSES

SEQ ID NO: 587 - protein, 9 aa, Homo Sapiens
KPAGAAAEG

SEQ ID NO: 588 - protein, 9 aa, Homo Sapiens
LENPQLAYA

SEQ ID NO: 589 - protein, 9 aa, Homo Sapiens
WRQGMTAQV

SEQ ID NO: 590 - protein, 9 aa, Homo Sapiens
PCTFIALGL

SEQ ID NO: 591 - protein, 9 aa, Homo Sapiens
ASQVFVTVK

SEQ ID NO: 592 - protein, 9 aa, Homo Sapiens
TMGSYRCIC

SEQ ID NO: 593 - protein, 9 aa, Homo Sapiens
EKTMTCVFF

SEQ ID NO: 594 - protein, 9 aa, Homo Sapiens
PKPSSLSPD

SEQ ID NO: 595 - protein, 9 aa, Homo Sapiens
GTTVGAICC

SEQ ID NO: 596 - protein, 9 aa, Homo Sapiens
AHGVRDVFK

SEQ ID NO: 597 - protein, 9 aa, Homo Sapiens
GDYMEIFME

SEQ ID NO: 598 - protein, 9 aa, Homo Sapiens
PAQGDSTSL

SEQ ID NO: 599 - protein, 9 aa, Homo Sapiens
SAPAAGYRR

SEQ ID NO: 600 - protein, 9 aa, Homo Sapiens
FQECCPHSA

SEQ ID NO: 601 - protein, 9 aa, Homo Sapiens
HLRVPAAYA

SEQ ID NO: 602 - protein, 9 aa, Homo Sapiens
GGDGDYMEI

SEQ ID NO: 603 - protein, 9 aa, Homo Sapiens
KCGSGGGDS

SEQ ID NO: 604 - protein, 9 aa, Homo Sapiens
PYERSGPLC

SEQ ID NO: 605 - protein, 9 aa, Homo Sapiens
HVIAPPRNL

SEQ ID NO: 606 - protein, 9 aa, Homo Sapiens
LAPFSLVIL

SEQ ID NO: 607 - protein, 9 aa, Homo Sapiens
LFTMAGVPE

SEQ ID NO: 608 - protein, 9 aa, Homo Sapiens
EEMFETWEN

SEQ ID NO: 609 - protein, 9 aa, Homo Sapiens
DTQFNWNIV

SEQ ID NO: 610 - protein, 9 aa, Homo Sapiens
ASFMDLAEI

SEQ ID NO: 611 - protein, 9 aa, Homo Sapiens
QDSYSHYHG

SEQ ID NO: 612 - protein, 9 aa, Homo Sapiens
SALLVNISK

SEQ ID NO: 613 - protein, 9 aa, Homo Sapiens
QEELAPFSL

SEQ ID NO: 614 - protein, 9 aa, Homo Sapiens
LDFKPKLLV

SEQ ID NO: 615 - protein, 9 aa, Homo Sapiens
IPGIYLSDP

SEQ ID NO: 616 - protein, 9 aa, Homo Sapiens
TSTNNNARR

SEQ ID NO: 617 - protein, 9 aa, Homo Sapiens
NQAFDMQGD

SEQ ID NO: 618 - protein, 9 aa, Homo Sapiens
TKEVPWRKD

SEQ ID NO: 619 - protein, 9 aa, Homo Sapiens
PSGGRAPGM

SEQ ID NO: 620 - protein, 9 aa, Homo Sapiens
TTQLICSNL

SEQ ID NO: 621 - protein, 9 aa, Homo Sapiens
AQGLIAADS

SEQ ID NO: 622 - protein, 9 aa, Homo Sapiens
ALPLDVSTF

SEQ ID NO: 623 - protein, 9 aa, Homo Sapiens
NGLGKTTSL

SEQ ID NO: 624 - protein, 9 aa, Homo Sapiens
SRGIRKDIT

SEQ ID NO: 625 - protein, 9 aa, Homo Sapiens
KEKHVLKFG

SEQ ID NO: 626 - protein, 9 aa, Homo Sapiens
TADWLPSCN

SEQ ID NO: 627 - protein, 9 aa, Homo Sapiens
RAQEGWFSV

SEQ ID NO: 628 - protein, 9 aa, Homo Sapiens
PRDPDNKLY

SEQ ID NO: 629 - protein, 9 aa, Homo Sapiens
YKYAKRYQP

SEQ ID NO: 630 - protein, 9 aa, Homo Sapiens
KHVLKFGFS

SEQ ID NO: 631 - protein, 9 aa, Homo Sapiens
LDSNSSQNL

SEQ ID NO: 632 - protein, 9 aa, Homo Sapiens
GQKPYACSQ

SEQ ID NO: 633 - protein, 9 aa, Homo Sapiens
VRKQVSWER

SEQ ID NO: 634 - protein, 9 aa, Homo Sapiens
MEWLYGSSE

SEQ ID NO: 635 - protein, 9 aa, Homo Sapiens
AKRYQPQIM

SEQ ID NO: 636 - protein, 9 aa, Homo Sapiens
YAKRYQPQI

SEQ ID NO: 637 - protein, 9 aa, Homo Sapiens
EMLLEAETQ

SEQ ID NO: 638 - protein, 9 aa, Homo Sapiens
EAHLVPWNH

SEQ ID NO: 639 - protein, 9 aa, Homo Sapiens
EMFETWEND

SEQ ID NO: 640 - protein, 9 aa, Homo Sapiens
GIPGIYLSD

SEQ ID NO: 641 - protein, 9 aa, Homo Sapiens
IPVARCLYL

SEQ ID NO: 642 - protein, 9 aa, Homo Sapiens
WFIRQELNI

SEQ ID NO: 643 - protein, 9 aa, Homo Sapiens
QRLHTGQKP

SEQ ID NO: 644 - protein, 9 aa, Homo Sapiens
LKIENLDPL

SEQ ID NO: 645 - protein, 9 aa, Homo Sapiens
SSESSNMEV

SEQ ID NO: 646 - protein, 9 aa, Homo Sapiens
FIKDPERKY

SEQ ID NO: 647 - protein, 9 aa, Homo Sapiens
KPSLISGVS

SEQ ID NO: 648 - protein, 9 aa, Homo Sapiens
SAHGVRDVF

SEQ ID NO: 649 - protein, 9 aa, Homo Sapiens
MMHSSIERG

SEQ ID NO: 650 - protein, 9 aa, Homo Sapiens
AEVRKQVSW

SEQ ID NO: 651 - protein, 9 aa, Homo Sapiens
GDDEPKSGR

SEQ ID NO: 652 - protein, 9 aa, Homo Sapiens
HEQARLSAG

SEQ ID NO: 653 - protein, 9 aa, Homo Sapiens
EAQRHKEDL

SEQ ID NO: 654 - protein, 9 aa, Homo Sapiens
KSHLDFKPK

SEQ ID NO: 655 - protein, 9 aa, Homo Sapiens
YMNDVEVPL

SEQ ID NO: 656 - protein, 9 aa, Homo Sapiens
MEEAGSVTL

SEQ ID NO: 657 - protein, 9 aa, Homo Sapiens
LFTKKEKTM

SEQ ID NO: 658 - protein, 9 aa, Homo Sapiens
APGPGEDSA

SEQ ID NO: 659 - protein, 9 aa, Homo Sapiens
WEYREHNGP

SEQ ID NO: 660 - protein, 9 aa, Homo Sapiens
IYMYTARGL

SEQ ID NO: 661 - protein, 9 aa, Homo Sapiens
PCWFCLAIP

SEQ ID NO: 662 - protein, 9 aa, Homo Sapiens
LASQVFVTV

SEQ ID NO: 663 - protein, 9 aa, Homo Sapiens
QYLKHSNMA

SEQ ID NO: 664 - protein, 9 aa, Homo Sapiens
RHNNFQSFF

SEQ ID NO: 665 - protein, 9 aa, Homo Sapiens
AEDGHELRT

SEQ ID NO: 666 - protein, 9 aa, Homo Sapiens
SEHCWGTMQ

SEQ ID NO: 667 - protein, 9 aa, Homo Sapiens
WGDMRQPQK

SEQ ID NO: 668 - protein, 9 aa, Homo Sapiens
DMLSALLVN

SEQ ID NO: 669 - protein, 9 aa, Homo Sapiens
VAFTDTKRL

SEQ ID NO: 670 - protein, 9 aa, Homo Sapiens
VARLFTMAG

SEQ ID NO: 671 - protein, 9 aa, Homo Sapiens
GSWRQGMTA

SEQ ID NO: 672 - protein, 9 aa, Homo Sapiens
LCPYERSGP

SEQ ID NO: 673 - protein, 9 aa, Homo Sapiens
DLCDPMSSG

SEQ ID NO: 674 - protein, 9 aa, Homo Sapiens
GLHVIAPPR

SEQ ID NO: 675 - protein, 9 aa, Homo Sapiens
ESGMQTKHI

SEQ ID NO: 676 - protein, 9 aa, Homo Sapiens
IYKYAKRYQ

SEQ ID NO: 677 - protein, 9 aa, Homo Sapiens
PEKQREEGK

SEQ ID NO: 678 - protein, 9 aa, Homo Sapiens
LSPDTAALS

SEQ ID NO: 679 - protein, 9 aa, Homo Sapiens
IPKEDGYTI

SEQ ID NO: 680 - protein, 9 aa, Homo Sapiens
EEMSRVLAD

SEQ ID NO: 681 - protein, 9 aa, Homo Sapiens
LYVEMLQAR

SEQ ID NO: 682 - protein, 9 aa, Homo Sapiens
VRDVFKELV

SEQ ID NO: 683 - protein, 9 aa, Homo Sapiens
VLELRGQLL

SEQ ID NO: 684 - protein, 9 aa, Homo Sapiens
SLPCTFIAL

SEQ ID NO: 685 - protein, 9 aa, Homo Sapiens
RTSNPIPGD

SEQ ID NO: 686 - protein, 9 aa, Homo Sapiens
CDQFCRTAL

SEQ ID NO: 687 - protein, 9 aa, Homo Sapiens
SGVIICNVP

SEQ ID NO: 688 - protein, 9 aa, Homo Sapiens
NTADWLPSC

SEQ ID NO: 689 - protein, 9 aa, Homo Sapiens
PDNKLYFAH

SEQ ID NO: 690 - protein, 9 aa, Homo Sapiens
VHIDMTKDL

SEQ ID NO: 691 - protein, 9 aa, Homo Sapiens
TLAQNFKNK

SEQ ID NO: 692 - protein, 9 aa, Homo Sapiens
LILFFIVSN

SEQ ID NO: 693 - protein, 9 aa, Homo Sapiens
GALYAVVSI

SEQ ID NO: 694 - protein, 9 aa, Homo Sapiens
VWNRSRGIR

SEQ ID NO: 695 - protein, 9 aa, Homo Sapiens
DVAFNFTAT

SEQ ID NO: 696 - protein, 9 aa, Homo Sapiens
VRLKKNRSY

SEQ ID NO: 697 - protein, 9 aa, Homo Sapiens
LSKRSKKAE

SEQ ID NO: 698 - protein, 9 aa, Homo Sapiens
LEVLSEHCW

SEQ ID NO: 699 - protein, 9 aa, Homo Sapiens
GQGCPETMR

SEQ ID NO: 700 - protein, 9 aa, Homo Sapiens
KDELELREG

SEQ ID NO: 701 - protein, 9 aa, Homo Sapiens
MTESSCMAQ

SEQ ID NO: 702 - protein, 9 aa, Homo Sapiens
CICKIGFGP

SEQ ID NO: 703 - protein, 9 aa, Homo Sapiens
CLCPYERSG

SEQ ID NO: 704 - protein, 9 aa, Homo Sapiens
FTKKEKTMT

SEQ ID NO: 705 - protein, 9 aa, Homo Sapiens
LELRGQLLE

SEQ ID NO: 706 - protein, 9 aa, Homo Sapiens
IKDPERKYH

SEQ ID NO: 707 - protein, 9 aa, Homo Sapiens
IPRVEPGSP

SEQ ID NO: 708 - protein, 9 aa, Homo Sapiens
QWTRASGGL

SEQ ID NO: 709 - protein, 9 aa, Homo Sapiens
DSYSHYHGT

SEQ ID NO: 710 - protein, 9 aa, Homo Sapiens
GSSESSNME

SEQ ID NO: 711 - protein, 9 aa, Homo Sapiens
LSPLQLKPK

SEQ ID NO: 712 - protein, 9 aa, Homo Sapiens
NILGAFCYM

SEQ ID NO: 713 - protein, 9 aa, Homo Sapiens
QSFFGSLML

SEQ ID NO: 714 - protein, 9 aa, Homo Sapiens
DALSKRSKK

SEQ ID NO: 715 - protein, 9 aa, Homo Sapiens
PSKLSFDLK

SEQ ID NO: 716 - protein, 9 aa, Homo Sapiens
LFGALYAVV

SEQ ID NO: 717 - protein, 9 aa, Homo Sapiens
QLASQVFVT

SEQ ID NO: 718 - protein, 9 aa, Homo Sapiens
LLEAETQSE

SEQ ID NO: 719 - protein, 9 aa, Homo Sapiens
ENPQLAYAL

SEQ ID NO: 720 - protein, 9 aa, Homo Sapiens
NKDELELRE

SEQ ID NO: 721 - protein, 9 aa, Homo Sapiens
QTGSWRQGM

SEQ ID NO: 722 - protein, 9 aa, Homo Sapiens
QVEEAKRLK

SEQ ID NO: 723 - protein, 9 aa, Homo Sapiens
ETVHIPVAR

SEQ ID NO: 724 - protein, 9 aa, Homo Sapiens
GKKLTTSCA

SEQ ID NO: 725 - protein, 9 aa, Homo Sapiens
HRYGPESPK

SEQ ID NO: 726 - protein, 9 aa, Homo Sapiens
RLSAGERHG

SEQ ID NO: 727 - protein, 9 aa, Homo Sapiens
RQVEEAKRL

SEQ ID NO: 728 - protein, 9 aa, Homo Sapiens
VFVIDNSGS

SEQ ID NO: 729 - protein, 9 aa, Homo Sapiens
NKLYFAHGL

SEQ ID NO: 730 - protein, 9 aa, Homo Sapiens
SPLSDFILA

SEQ ID NO: 731 - protein, 9 aa, Homo Sapiens
SSQNLVGGA

SEQ ID NO: 732 - protein, 9 aa, Homo Sapiens
GTYQPGFVG

SEQ ID NO: 733 - protein, 9 aa, Homo Sapiens
LNTADWLPS

SEQ ID NO: 734 - protein, 9 aa, Homo Sapiens
YLDDRNTFQ

SEQ ID NO: 735 - protein, 9 aa, Homo Sapiens
ALSKRSKKA

SEQ ID NO: 736 - protein, 9 aa, Homo Sapiens
CCGIRSLPA

SEQ ID NO: 737 - protein, 9 aa, Homo Sapiens
LAIPEVEKH

SEQ ID NO: 738 - protein, 9 aa, Homo Sapiens
VGLHVIAPP

SEQ ID NO: 739 - protein, 9 aa, Homo Sapiens
PVTVTGHMT

SEQ ID NO: 740 - protein, 9 aa, Homo Sapiens
GHELRTEPE

SEQ ID NO: 741 - protein, 9 aa, Homo Sapiens
EEGKVKQPQ

SEQ ID NO: 742 - protein, 9 aa, Homo Sapiens
GDMRQPQKK

SEQ ID NO: 743 - protein, 9 aa, Homo Sapiens
PFSLVILGF

SEQ ID NO: 744 - protein, 9 aa, Homo Sapiens
YKSDPVMRK

SEQ ID NO: 745 - protein, 9 aa, Homo Sapiens
LPEDKPSLI

SEQ ID NO: 746 - protein, 9 aa, Homo Sapiens
TFIALGLRH

SEQ ID NO: 747 - protein, 9 aa, Homo Sapiens
NKWWYDKGK

SEQ ID NO: 748 - protein, 9 aa, Homo Sapiens
DFILAEKTI

SEQ ID NO: 749 - protein, 9 aa, Homo Sapiens
DNSGSMSGR

SEQ ID NO: 750 - protein, 9 aa, Homo Sapiens
SIIINMSSL

SEQ ID NO: 751 - protein, 9 aa, Homo Sapiens
NSSQNLVGG

SEQ ID NO: 752 - protein, 9 aa, Homo Sapiens
RERALNSIL

SEQ ID NO: 753 - protein, 9 aa, Homo Sapiens
EEVARLFTM

SEQ ID NO: 754 - protein, 9 aa, Homo Sapiens
DIVLELRGQ

SEQ ID NO: 755 - protein, 9 aa, Homo Sapiens
SGKSHLDFK

SEQ ID NO: 756 - protein, 9 aa, Homo Sapiens
HVHAALPLD

SEQ ID NO: 757 - protein, 9 aa, Homo Sapiens
PPALRPERP

SEQ ID NO: 758 - protein, 9 aa, Homo Sapiens
FNFTATQEM

SEQ ID NO: 759 - protein, 9 aa, Homo Sapiens
SHEQARLSA

SEQ ID NO: 760 - protein, 9 aa, Homo Sapiens
HIPVARCLY

SEQ ID NO: 761 - protein, 9 aa, Homo Sapiens
AMMHSSIER

SEQ ID NO: 762 - protein, 9 aa, Homo Sapiens
GLKIPKEDG

SEQ ID NO: 763 - protein, 9 aa, Homo Sapiens
AVDLKPCGE

SEQ ID NO: 764 - protein, 9 aa, Homo Sapiens
ALKNPSAAE

SEQ ID NO: 765 - protein, 9 aa, Homo Sapiens
FIALGLRHE

SEQ ID NO: 766 - protein, 9 aa, Homo Sapiens
RVLQWTRAS

SEQ ID NO: 767 - protein, 9 aa, Homo Sapiens
PALRPERPE

SEQ ID NO: 768 - protein, 9 aa, Homo Sapiens
TGHMTESSC

SEQ ID NO: 769 - protein, 9 aa, Homo Sapiens
TQDLSKGIS

SEQ ID NO: 770 - protein, 9 aa, Homo Sapiens
TYQPGFVGI

SEQ ID NO: 771 - protein, 9 aa, Homo Sapiens
SFDLKHLLR

SEQ ID NO: 772 - protein, 9 aa, Homo Sapiens
SHLDFKPKL

SEQ ID NO: 773 - protein, 9 aa, Homo Sapiens
SDNLSWVIN

SEQ ID NO: 774 - protein, 9 aa, Homo Sapiens
ASSHEQARL

SEQ ID NO: 775 - protein, 9 aa, Homo Sapiens
RYGPESPKR

SEQ ID NO: 776 - protein, 9 aa, Homo Sapiens
PCGEDEMIT

SEQ ID NO: 777 - protein, 9 aa, Homo Sapiens
AKRLKQSAE

SEQ ID NO: 778 - protein, 9 aa, Homo Sapiens
CPYERSGPL

SEQ ID NO: 779 - protein, 9 aa, Homo Sapiens
PPGLKIPKE

SEQ ID NO: 780 - protein, 9 aa, Homo Sapiens
PKEDGYTIT

SEQ ID NO: 781 - protein, 9 aa, Homo Sapiens
INALILFFI

SEQ ID NO: 782 - protein, 9 aa, Homo Sapiens
SNSSQNLVG

SEQ ID NO: 783 - protein, 9 aa, Homo Sapiens
KTMTCVFFS

SEQ ID NO: 784 - protein, 9 aa, Homo Sapiens
QNKDELELR

SEQ ID NO: 785 - protein, 9 aa, Homo Sapiens
MGGDGDYME

SEQ ID NO: 786 - protein, 9 aa, Homo Sapiens
SPKRREMVR

SEQ ID NO: 787 - protein, 9 aa, Homo Sapiens
RKLLRPFQP

SEQ ID NO: 788 - protein, 9 aa, Homo Sapiens
ERALNSILC

SEQ ID NO: 789 - protein, 9 aa, Homo Sapiens
AFNFTATQE

SEQ ID NO: 790 - protein, 9 aa, Homo Sapiens
KEDGYTITP

SEQ ID NO: 791 - protein, 9 aa, Homo Sapiens
FIPRVEPGS

SEQ ID NO: 792 - protein, 9 aa, Homo Sapiens
AFNATSGKS

SEQ ID NO: 793 - protein, 9 aa, Homo Sapiens
GTRLSPLQL

SEQ ID NO: 794 - protein, 9 aa, Homo Sapiens
QAGDMLSAL

SEQ ID NO: 795 - protein, 9 aa, Homo Sapiens
QHSVVVPYE

SEQ ID NO: 796 - protein, 9 aa, Homo Sapiens
QEARNMLLE

SEQ ID NO: 797 - protein, 9 aa, Homo Sapiens
AVKAAGLPG

SEQ ID NO: 798 - protein, 9 aa, Homo Sapiens
AALPLPDSP

SEQ ID NO: 799 - protein, 9 aa, Homo Sapiens
KGISRKDGD

SEQ ID NO: 800 - protein, 9 aa, Homo Sapiens
QPQIMAALE

SEQ ID NO: 801 - protein, 9 aa, Homo Sapiens
GDSFVHLRV

SEQ ID NO: 802 - protein, 9 aa, Homo Sapiens
SLEVLSEHC

SEQ ID NO: 803 - protein, 9 aa, Homo Sapiens
PVPVVGLAL

SEQ ID NO: 804 - protein, 9 aa, Homo Sapiens
RAGGHGPDQ

SEQ ID NO: 805 - protein, 9 aa, Homo Sapiens
MLLENPQLA

SEQ ID NO: 806 - protein, 9 aa, Homo Sapiens
RLRYGENGV

SEQ ID NO: 807 - protein, 9 aa, Homo Sapiens
ILFTKKEKT

SEQ ID NO: 808 - protein, 9 aa, Homo Sapiens
HSADRVVLI

SEQ ID NO: 809 - protein, 9 aa, Homo Sapiens
LPCTFIALG

SEQ ID NO: 810 - protein, 9 aa, Homo Sapiens
SGGRAPGMR

SEQ ID NO: 811 - protein, 9 aa, Homo Sapiens
EAFDITALK

SEQ ID NO: 812 - protein, 9 aa, Homo Sapiens
FDLTDIVLE

SEQ ID NO: 813 - protein, 9 aa, Homo Sapiens
GGHGPDQVR

SEQ ID NO: 814 - protein, 9 aa, Homo Sapiens
SGMQTKHIY

SEQ ID NO: 815 - protein, 9 aa, Homo Sapiens
IVVLASSES

SEQ ID NO: 816 - protein, 9 aa, Homo Sapiens
MRIYSWSCP

SEQ ID NO: 817 - protein, 9 aa, Homo Sapiens
TDTKRLIGD

SEQ ID NO: 818 - protein, 9 aa, Homo Sapiens
SRVLADPSD

SEQ ID NO: 819 - protein, 9 aa, Homo Sapiens
FCYMNDVEV

SEQ ID NO: 820 - protein, 9 aa, Homo Sapiens
QLFHSTSAI

SEQ ID NO: 821 - protein, 9 aa, Homo Sapiens
NARRATANN

SEQ ID NO: 822 - protein, 9 aa, Homo Sapiens
NRAIWKLDL

SEQ ID NO: 823 - protein, 9 aa, Homo Sapiens
LRFSGRRNS

SEQ ID NO: 824 - protein, 9 aa, Homo Sapiens
LQHTRNVNQ

SEQ ID NO: 825 - protein, 9 aa, Homo Sapiens
AALPLDVST

SEQ ID NO: 826 - protein, 9 aa, Homo Sapiens
TKKEKTMTC

SEQ ID NO: 827 - protein, 9 aa, Homo Sapiens
YYELKEKHV

SEQ ID NO: 828 - protein, 9 aa, Homo Sapiens
VTLEELVEK

SEQ ID NO: 829 - protein, 9 aa, Homo Sapiens
LQWTRASGG

SEQ ID NO: 830 - protein, 9 aa, Homo Sapiens
VEMLQARTS

SEQ ID NO: 831 - protein, 9 aa, Homo Sapiens
HQHAHICLP

SEQ ID NO: 832 - protein, 9 aa, Homo Sapiens
GGGHRDVGA

SEQ ID NO: 833 - protein, 9 aa, Homo Sapiens
HIITMDYKG

SEQ ID NO: 834 - protein, 9 aa, Homo Sapiens
KETVHIPVA

SEQ ID NO: 835 - protein, 9 aa, Homo Sapiens
VRRRLEEAQ

SEQ ID NO: 836 - protein, 9 aa, Homo Sapiens
KRLIGDAAK

SEQ ID NO: 837 - protein, 9 aa, Homo Sapiens
ASLEVLSEH

SEQ ID NO: 838 - protein, 9 aa, Homo Sapiens
LFHSTSAIF

SEQ ID NO: 839 - protein, 9 aa, Homo Sapiens
LKDQPRGSP

SEQ ID NO: 840 - protein, 9 aa, Homo Sapiens
YAVVSITYR

SEQ ID NO: 841 - protein, 9 aa, Homo Sapiens
VAFNFTATQ

SEQ ID NO: 842 - protein, 9 aa, Homo Sapiens
YSHYHGTSS

SEQ ID NO: 843 - protein, 9 aa, Homo Sapiens
QHAHICLPV

SEQ ID NO: 844 - protein, 9 aa, Homo Sapiens
QGCPETMRI

SEQ ID NO: 845 - protein, 9 aa, Homo Sapiens
QVLSPLSDF

SEQ ID NO: 846 - protein, 9 aa, Homo Sapiens
TDMTTQLIC

SEQ ID NO: 847 - protein, 9 aa, Homo Sapiens
DVDLKDQPR

SEQ ID NO: 848 - protein, 9 aa, Homo Sapiens
SFKKEEEEE

SEQ ID NO: 849 - protein, 9 aa, Homo Sapiens
NNNARRATA

SEQ ID NO: 850 - protein, 9 aa, Homo Sapiens
QRLLTGSKD

SEQ ID NO: 851 - protein, 9 aa, Homo Sapiens
ASEAALPLP

SEQ ID NO: 852 - protein, 9 aa, Homo Sapiens
LFFIVSNLT

SEQ ID NO: 853 - protein, 9 aa, Homo Sapiens
LDVSTFWVS

SEQ ID NO: 854 - protein, 9 aa, Homo Sapiens
EAIGFHIIT

SEQ ID NO: 855 - protein, 9 aa, Homo Sapiens
FSGRRNSGM

SEQ ID NO: 856 - protein, 9 aa, Homo Sapiens
SGTRLSPLQ

SEQ ID NO: 857 - protein, 9 aa, Homo Sapiens
QAQGLIAAD

SEQ ID NO: 858 - protein, 9 aa, Homo Sapiens
KKAEAAFLN

SEQ ID NO: 859 - protein, 9 aa, Homo Sapiens
LNVGLHVIA

SEQ ID NO: 860 - protein, 9 aa, Homo Sapiens
WTRASGGLP

SEQ ID NO: 861 - protein, 9 aa, Homo Sapiens
LLENPQLAY

SEQ ID NO: 862 - protein, 9 aa, Homo Sapiens
IICNVPGTG

SEQ ID NO: 863 - protein, 9 aa, Homo Sapiens
FNATSGKSH

SEQ ID NO: 864 - protein, 9 aa, Homo Sapiens
EKHVLKFGF

SEQ ID NO: 865 - protein, 9 aa, Homo Sapiens
SWERSGSPH

SEQ ID NO: 866 - protein, 9 aa, Homo Sapiens
YIGLGTVAD

SEQ ID NO: 867 - protein, 9 aa, Homo Sapiens
LLVRLKKNR

SEQ ID NO: 868 - protein, 9 aa, Homo Sapiens
KIPKEDGYT

SEQ ID NO: 869 - protein, 9 aa, Homo Sapiens
SGRRNSGMV

SEQ ID NO: 870 - protein, 9 aa, Homo Sapiens
TGLSFKKEE

SEQ ID NO: 871 - protein, 9 aa, Homo Sapiens
RAHMYQAQG

SEQ ID NO: 872 - protein, 9 aa, Homo Sapiens
DFVWNRSRG

SEQ ID NO: 873 - protein, 9 aa, Homo Sapiens
QECCPHSAD

SEQ ID NO: 874 - protein, 9 aa, Homo Sapiens
TKHIYQNLS

SEQ ID NO: 875 - protein, 9 aa, Homo Sapiens
LRAFGWQLL

SEQ ID NO: 876 - protein, 9 aa, Homo Sapiens
FCRTALHRA

SEQ ID NO: 877 - protein, 9 aa, Homo Sapiens
VNPEDPQYV

SEQ ID NO: 878 - protein, 9 aa, Homo Sapiens
FKREHSLSK

SEQ ID NO: 879 - protein, 9 aa, Homo Sapiens
FTLAQNFKN

SEQ ID NO: 880 - protein, 9 aa, Homo Sapiens
IMATTYLSM

SEQ ID NO: 881 - protein, 9 aa, Homo Sapiens
AFDMQGDLQ

SEQ ID NO: 882 - protein, 9 aa, Homo Sapiens
PGIYLSDPK

SEQ ID NO: 883 - protein, 9 aa, Homo Sapiens
VVTSVAGLL

SEQ ID NO: 884 - protein, 9 aa, Homo Sapiens
SYSHYHGTS

SEQ ID NO: 885 - protein, 9 aa, Homo Sapiens
KYAKRYQPQ

SEQ ID NO: 886 - protein, 9 aa, Homo Sapiens
DLGCLLFEG

SEQ ID NO: 887 - protein, 9 aa, Homo Sapiens
LAQNFKNKA

SEQ ID NO: 888 - protein, 9 aa, Homo Sapiens
YSIYMYTAR

SEQ ID NO: 889 - protein, 9 aa, Homo Sapiens
EAMMHSSIE

SEQ ID NO: 890 - protein, 9 aa, Homo Sapiens
FMDLAEIVS

SEQ ID NO: 891 - protein, 9 aa, Homo Sapiens
FNWNIVSFP

SEQ ID NO: 892 - protein, 9 aa, Homo Sapiens
PETMRITFL

SEQ ID NO: 893 - protein, 9 aa, Homo Sapiens
MYQYRPQNK

SEQ ID NO: 894 - protein, 9 aa, Homo Sapiens
VEMLLEAET

SEQ ID NO: 895 - protein, 9 aa, Homo Sapiens
SFPHNFVLL

SEQ ID NO: 896 - protein, 9 aa, Homo Sapiens
QRYLGCPSC

SEQ ID NO: 897 - protein, 9 aa, Homo Sapiens
RLKKNRSYL

SEQ ID NO: 898 - protein, 9 aa, Homo Sapiens
SFIKDPERK

SEQ ID NO: 899 - protein, 9 aa, Homo Sapiens
LRYGENGVQ

SEQ ID NO: 900 - protein, 9 aa, Homo Sapiens
YFKREHSLS

SEQ ID NO: 901 - protein, 9 aa, Homo Sapiens
TFQHSVVVP

SEQ ID NO: 902 - protein, 9 aa, Homo Sapiens
PIIVVLASS

SEQ ID NO: 903 - protein, 9 aa, Homo Sapiens
GGGGHRDVG

SEQ ID NO: 904 - protein, 9 aa, Homo Sapiens
TFSISFIKD

SEQ ID NO: 905 - protein, 9 aa, Homo Sapiens
KNLPITPVP

SEQ ID NO: 906 - protein, 9 aa, Homo Sapiens
VHIPVARCL

SEQ ID NO: 907 - protein, 9 aa, Homo Sapiens
AAGSFILVA

SEQ ID NO: 908 - protein, 9 aa, Homo Sapiens
ARNMLLENP

SEQ ID NO: 909 - protein, 9 aa, Homo Sapiens
ERRLRYGEN

SEQ ID NO: 910 - protein, 9 aa, Homo Sapiens
FNLQEVLQE

SEQ ID NO: 911 - protein, 9 aa, Homo Sapiens
GRAPGMRIY

SEQ ID NO: 912 - protein, 9 aa, Homo Sapiens
GDSTSLSPN

SEQ ID NO: 913 - protein, 9 aa, Homo Sapiens
DMRQPQKKR

SEQ ID NO: 914 - protein, 9 aa, Homo Sapiens
GLGKTTSLK

SEQ ID NO: 915 - protein, 9 aa, Homo Sapiens
STSAIFVDA

SEQ ID NO: 916 - protein, 9 aa, Homo Sapiens
AQDANRAIW

SEQ ID NO: 917 - protein, 9 aa, Homo Sapiens
FVIDNSGSM

SEQ ID NO: 918 - protein, 9 aa, Homo Sapiens
FSWVMPVCV

SEQ ID NO: 919 - protein, 9 aa, Homo Sapiens
HHKLAERLV

SEQ ID NO: 920 - protein, 9 aa, Homo Sapiens
EAKRLKQSA

SEQ ID NO: 921 - protein, 9 aa, Homo Sapiens
LSALLVNIS

SEQ ID NO: 922 - protein, 9 aa, Homo Sapiens
SDPVMRKML

SEQ ID NO: 923 - protein, 9 aa, Homo Sapiens
SWRQGMTAQ

SEQ ID NO: 924 - protein, 9 aa, Homo Sapiens
KGRRGQFIP

SEQ ID NO: 925 - protein, 9 aa, Homo Sapiens
FKELVGLAE

SEQ ID NO: 926 - protein, 9 aa, Homo Sapiens
PQYVSQDVV

SEQ ID NO: 927 - protein, 9 aa, Homo Sapiens
PGFVHIDMT

SEQ ID NO: 928 - protein, 9 aa, Homo Sapiens
KWGDMRQPQ

SEQ ID NO: 929 - protein, 9 aa, Homo Sapiens
GLLAQDISQ

SEQ ID NO: 930 - protein, 9 aa, Homo Sapiens
FSISFIKDP

SEQ ID NO: 931 - protein, 9 aa, Homo Sapiens
AGHHKLAER

SEQ ID NO: 932 - protein, 9 aa, Homo Sapiens
RQELNITAA

SEQ ID NO: 933 - protein, 9 aa, Homo Sapiens
TSLKMLATR

SEQ ID NO: 934 - protein, 9 aa, Homo Sapiens
RQAGHHKLA

SEQ ID NO: 935 - protein, 9 aa, Homo Sapiens
WLAQDANRA

SEQ ID NO: 936 - protein, 9 aa, Homo Sapiens
AIPEVEKHL

SEQ ID NO: 937 - protein, 9 aa, Homo Sapiens
RAKLKYESY

SEQ ID NO: 938 - protein, 9 aa, Homo Sapiens
VVSITYRLL

SEQ ID NO: 939 - protein, 9 aa, Homo Sapiens
MFETWENDL

SEQ ID NO: 940 - protein, 9 aa, Homo Sapiens
DGDYMEIFM

SEQ ID NO: 941 - protein, 9 aa, Homo Sapiens
LVRLKKNRS

SEQ ID NO: 942 - protein, 9 aa, Homo Sapiens
NFTATQEMV

SEQ ID NO: 943 - protein, 9 aa, Homo Sapiens
KKGSLQVAN

SEQ ID NO: 944 - protein, 9 aa, Homo Sapiens
DRLTHNDIM

SEQ ID NO: 945 - protein, 9 aa, Homo Sapiens
SYLCNESCE

SEQ ID NO: 946 - protein, 9 aa, Homo Sapiens
FKKEEEEEE

SEQ ID NO: 947 - protein, 9 aa, Homo Sapiens
AIGFHIITM

SEQ ID NO: 948 - protein, 9 aa, Homo Sapiens
GGHRDVGAD

SEQ ID NO: 949 - protein, 9 aa, Homo Sapiens
MMSLDVCLG

SEQ ID NO: 950 - protein, 9 aa, Homo Sapiens
IGFHIITMD

SEQ ID NO: 951 - protein, 9 aa, Homo Sapiens
PDTAALSHA

SEQ ID NO: 952 - protein, 9 aa, Homo Sapiens
QLKPKVPAS

SEQ ID NO: 953 - protein, 9 aa, Homo Sapiens
TYKSDPVMR

SEQ ID NO: 954 - protein, 9 aa, Homo Sapiens
TSVAGLLAQ

SEQ ID NO: 955 - protein, 9 aa, Homo Sapiens
NRHNNFQSF

SEQ ID NO: 956 - protein, 9 aa, Homo Sapiens
VIDNSGSMS

SEQ ID NO: 957 - protein, 9 aa, Homo Sapiens
VQRYLGCPS

SEQ ID NO: 958 - protein, 9 aa, Homo Sapiens
ETWENDLNG

SEQ ID NO: 959 - protein, 9 aa, Homo Sapiens
PVCVALSTF

SEQ ID NO: 960 - protein, 9 aa, Homo Sapiens
IRQELNITA

SEQ ID NO: 961 - protein, 9 aa, Homo Sapiens
RRRFNLQEV

SEQ ID NO: 962 - protein, 9 aa, Homo Sapiens
SQTGSWRQG

SEQ ID NO: 963 - protein, 9 aa, Homo Sapiens
LLAQDISQP

SEQ ID NO: 964 - protein, 9 aa, Homo Sapiens
YGSSESSNM

SEQ ID NO: 965 - protein, 9 aa, Homo Sapiens
PLNPDQDSY

SEQ ID NO: 966 - protein, 9 aa, Homo Sapiens
ICNVPGTGN

SEQ ID NO: 967 - protein, 9 aa, Homo Sapiens
DNLSWVINS

SEQ ID NO: 968 - protein, 9 aa, Homo Sapiens
LKEKHVLKF

SEQ ID NO: 969 - protein, 9 aa, Homo Sapiens
RITFLPGET

SEQ ID NO: 970 - protein, 9 aa, Homo Sapiens
SSSLPCTFI

SEQ ID NO: 971 - protein, 9 aa, Homo Sapiens
GYRVLQWTR

SEQ ID NO: 972 - protein, 9 aa, Homo Sapiens
DKGKCGSGG

SEQ ID NO: 973 - protein, 9 aa, Homo Sapiens
YRPQNKDEL

SEQ ID NO: 974 - protein, 9 aa, Homo Sapiens
HTGQKPYAC

SEQ ID NO: 975 - protein, 9 aa, Homo Sapiens
KPSSLSPDT

SEQ ID NO: 976 - protein, 9 aa, Homo Sapiens
CSNLELHSL

SEQ ID NO: 977 - protein, 9 aa, Homo Sapiens
KQREEGKVK

SEQ ID NO: 978 - protein, 9 aa, Homo Sapiens
KASEAALPL

SEQ ID NO: 979 - protein, 9 aa, Homo Sapiens
ARRATANNQ

SEQ ID NO: 980 - protein, 9 aa, Homo Sapiens
SLDLGCLLF

SEQ ID NO: 981 - protein, 9 aa, Homo Sapiens
RYQPQIMAA

SEQ ID NO: 982 - protein, 9 aa, Homo Sapiens
VRKDLRAFG

SEQ ID NO: 983 - protein, 9 aa, Homo Sapiens
MSRVLADPS

SEQ ID NO: 984 - protein, 9 aa, Homo Sapiens
FCLAIPEVE

SEQ ID NO: 985 - protein, 9 aa, Homo Sapiens
YELKEKHVL

SEQ ID NO: 986 - protein, 9 aa, Homo Sapiens
VLSEHCWGT

SEQ ID NO: 987 - protein, 9 aa, Homo Sapiens
AFCYMNDVE

SEQ ID NO: 988 - protein, 9 aa, Homo Sapiens
LTDIVLELR

SEQ ID NO: 989 - protein, 9 aa, Homo Sapiens
ARLSAGERH

SEQ ID NO: 990 - protein, 9 aa, Homo Sapiens
LSEHCWGTM

SEQ ID NO: 991 - protein, 9 aa, Homo Sapiens
TFDYIQWKG

SEQ ID NO: 992 - protein, 9 aa, Homo Sapiens
PDLCDPMSS

SEQ ID NO: 993 - protein, 9 aa, Homo Sapiens
MATTYLSMS

SEQ ID NO: 994 - protein, 9 aa, Homo Sapiens
YVGAVAAVK

SEQ ID NO: 995 - protein, 9 aa, Homo Sapiens
AYCKIVHEY

SEQ ID NO: 996 - protein, 9 aa, Homo Sapiens
PLSDFILAE

SEQ ID NO: 997 - protein, 9 aa, Homo Sapiens
VVAPGFVHI

SEQ ID NO: 998 - protein, 9 aa, Homo Sapiens
YVSQDVVFQ

SEQ ID NO: 999 - protein, 9 aa, Homo Sapiens
KLTTSCASL

SEQ ID NO: 1000 - protein, 9 aa, Homo Sapiens
TFEYFKREH

SEQ ID NO: 1001 - protein, 9 aa, Homo Sapiens
GKSHLDFKP

SEQ ID NO: 1002 - protein, 9 aa, Homo Sapiens
VARCLYLRF

SEQ ID NO: 1003 - protein, 9 aa, Homo Sapiens
EAGSVTLEE

SEQ ID NO: 1004 - protein, 9 aa, Homo Sapiens
DKPSLISGV

SEQ ID NO: 1005 - protein, 9 aa, Homo Sapiens
YERSGPLCT

SEQ ID NO: 1006 - protein, 9 aa, Homo Sapiens
GSFILVAFS

SEQ ID NO: 1007 - protein, 9 aa, Homo Sapiens
SQVFVTVKE

SEQ ID NO: 1008 - protein, 9 aa, Homo Sapiens
LLVKRGAEA

SEQ ID NO: 1009 - protein, 9 aa, Homo Sapiens
ADRVVLIGG

SEQ ID NO: 1010 - protein, 9 aa, Homo Sapiens
FKPKLLVQR

SEQ ID NO: 1011 - protein, 9 aa, Homo Sapiens
QTKHIYQNL

SEQ ID NO: 1012 - protein, 9 aa, Homo Sapiens
LPLDVSTFW

SEQ ID NO: 1013 - protein, 9 aa, Homo Sapiens
SISFIKDPE

SEQ ID NO: 1014 - protein, 9 aa, Homo Sapiens
GEDSAPAAG

SEQ ID NO: 1015 - protein, 9 aa, Homo Sapiens
LPPGPMVSK

SEQ ID NO: 1016 - protein, 9 aa, Homo Sapiens
REEGKVKQP

SEQ ID NO: 1017 - protein, 9 aa, Homo Sapiens
ASLAYSAPE

SEQ ID NO: 1018 - protein, 9 aa, Homo Sapiens
LNSILCKIE

SEQ ID NO: 1019 - protein, 9 aa, Homo Sapiens
KPKLLVQRY

SEQ ID NO: 1020 - protein, 9 aa, Homo Sapiens
APGMRIYSW

SEQ ID NO: 1021 - protein, 9 aa, Homo Sapiens
FDYIQWKGQ

SEQ ID NO: 1022 - protein, 9 aa, Homo Sapiens
NFKNKASSS

SEQ ID NO: 1023 - protein, 9 aa, Homo Sapiens
QNLVGGAVP

SEQ ID NO: 1024 - protein, 9 aa, Homo Sapiens
TLEELVEKE

SEQ ID NO: 1025 - protein, 9 aa, Homo Sapiens
GPRAEAMMH

SEQ ID NO: 1026 - protein, 9 aa, Homo Sapiens
CLSAYCKIV

SEQ ID NO: 1027 - protein, 9 aa, Homo Sapiens
ELNITAAAA

SEQ ID NO: 1028 - protein, 9 aa, Homo Sapiens
ALLVNISKQ

SEQ ID NO: 1029 - protein, 9 aa, Homo Sapiens
QVANQTPGL

SEQ ID NO: 1030 - protein, 9 aa, Homo Sapiens
KNRSYLCNE

SEQ ID NO: 1031 - protein, 9 aa, Homo Sapiens
YLKHSNMAS

SEQ ID NO: 1032 - protein, 9 aa, Homo Sapiens
EAETQSERA

SEQ ID NO: 1033 - protein, 9 aa, Homo Sapiens
SKPAGAAAE

SEQ ID NO: 1034 - protein, 9 aa, Homo Sapiens
QDDVDLKDQ

SEQ ID NO: 1035 - protein, 9 aa, Homo Sapiens
RKDQINRHW

SEQ ID NO: 1036 - protein, 9 aa, Homo Sapiens
AFTDTKRLI

SEQ ID NO: 1037 - protein, 9 aa, Homo Sapiens
KRSKKAEAA

SEQ ID NO: 1038 - protein, 9 aa, Homo Sapiens
HSSIERGKW

SEQ ID NO: 1039 - protein, 9 aa, Homo Sapiens
YARQAGHHK

SEQ ID NO: 1040 - protein, 9 aa, Homo Sapiens
KLYFAHGLF

SEQ ID NO: 1041 - protein, 9 aa, Homo Sapiens
HKLAERLVE

SEQ ID NO: 1042 - protein, 9 aa, Homo Sapiens
YFDEEMSRV

SEQ ID NO: 1043 - protein, 9 aa, Homo Sapiens
VVMMSLDVC

SEQ ID NO: 1044 - protein, 9 aa, Homo Sapiens
RQLFHSTSA

SEQ ID NO: 1045 - protein, 9 aa, Homo Sapiens
SYLFDVAFN

SEQ ID NO: 1046 - protein, 9 aa, Homo Sapiens
CLLFEGCSN

SEQ ID NO: 1047 - protein, 9 aa, Homo Sapiens
QLICSNLEL

SEQ ID NO: 1048 - protein, 9 aa, Homo Sapiens
GSPDLCDPM

SEQ ID NO: 1049 - protein, 9 aa, Homo Sapiens
DMTTQLICS

SEQ ID NO: 1050 - protein, 9 aa, Homo Sapiens
DANRAIWKL

SEQ ID NO: 1051 - protein, 9 aa, Homo Sapiens
DITALKNPS

SEQ ID NO: 1052 - protein, 9 aa, Homo Sapiens
MLSALLVNI

SEQ ID NO: 1053 - protein, 9 aa, Homo Sapiens
EMSRVLADP

SEQ ID NO: 1054 - protein, 9 aa, Homo Sapiens
GPDQVRPLP

SEQ ID NO: 1055 - protein, 9 aa, Homo Sapiens
LPSCNTPSS

SEQ ID NO: 1056 - protein, 9 aa, Homo Sapiens
QRHKEDLEQ

SEQ ID NO: 1057 - protein, 9 aa, Homo Sapiens
SWEYREHNG

SEQ ID NO: 1058 - protein, 9 aa, Homo Sapiens
NLPITPVPV

SEQ ID NO: 1059 - protein, 9 aa, Homo Sapiens
GLNVGLHVI

SEQ ID NO: 1060 - protein, 9 aa, Homo Sapiens
LLVQRYLGC

SEQ ID NO: 1061 - protein, 9 aa, Homo Sapiens
VAGLLAQDI

SEQ ID NO: 1062 - protein, 9 aa, Homo Sapiens
KTTSLKMLA

SEQ ID NO: 1063 - protein, 9 aa, Homo Sapiens
KPRDPDNKL

SEQ ID NO: 1064 - protein, 9 aa, Homo Sapiens
PSCSFPHNF

SEQ ID NO: 1065 - protein, 9 aa, Homo Sapiens
ALRPERPES

SEQ ID NO: 1066 - protein, 9 aa, Homo Sapiens
PSCNTPSSA

SEQ ID NO: 1067 - protein, 9 aa, Homo Sapiens
VTSVAGLLA

SEQ ID NO: 1068 - protein, 9 aa, Homo Sapiens
FSKASEAAL

SEQ ID NO: 1069 - protein, 9 aa, Homo Sapiens
EVARLFTMA

SEQ ID NO: 1070 - protein, 9 aa, Homo Sapiens
PSLISGVSR

SEQ ID NO: 1071 - protein, 9 aa, Homo Sapiens
GMRIYSWSC

SEQ ID NO: 1072 - protein, 9 aa, Homo Sapiens
KMFGWGNFH

SEQ ID NO: 1073 - protein, 9 aa, Homo Sapiens
LLLGDDEPK

SEQ ID NO: 1074 - protein, 9 aa, Homo Sapiens
IEHEAFISV

SEQ ID NO: 1075 - protein, 9 aa, Homo Sapiens
HMTESSCMA

SEQ ID NO: 1076 - protein, 9 aa, Homo Sapiens
PQNLLASRP

SEQ ID NO: 1077 - protein, 9 aa, Homo Sapiens
KHIYQNLSQ

SEQ ID NO: 1078 - protein, 9 aa, Homo Sapiens
YDFVWNRSR

SEQ ID NO: 1079 - protein, 9 aa, Homo Sapiens
DDVDLKDQP

SEQ ID NO: 1080 - protein, 9 aa, Homo Sapiens
VGQLASQVF

SEQ ID NO: 1081 - protein, 9 aa, Homo Sapiens
SYRCICKIG

SEQ ID NO: 1082 - protein, 9 aa, Homo Sapiens
AQGDSTSLS

SEQ ID NO: 1083 - protein, 9 aa, Homo Sapiens
GEGSIIINM

SEQ ID NO: 1084 - protein, 9 aa, Homo Sapiens
GQTFEYFKR

SEQ ID NO: 1085 - protein, 9 aa, Homo Sapiens
TRKLLRPFQ

SEQ ID NO: 1086 - protein, 9 aa, Homo Sapiens
KQNGGEGSI

SEQ ID NO: 1087 - protein, 9 aa, Homo Sapiens
SLQHTRNVN

SEQ ID NO: 1088 - protein, 9 aa, Homo Sapiens
DGMGGDGDY

SEQ ID NO: 1089 - protein, 9 aa, Homo Sapiens
ALYAVVSIT

SEQ ID NO: 1090 - protein, 9 aa, Homo Sapiens
RKDLRAFGW

SEQ ID NO: 1091 - protein, 9 aa, Homo Sapiens
MVSKPAGAA

SEQ ID NO: 1092 - protein, 9 aa, Homo Sapiens
SDVAAEQSL

SEQ ID NO: 1093 - protein, 9 aa, Homo Sapiens
EGWFSVSGS

SEQ ID NO: 1094 - protein, 9 aa, Homo Sapiens
SVTLEELVE

SEQ ID NO: 1095 - protein, 9 aa, Homo Sapiens
EEAQRHKED

SEQ ID NO: 1096 - protein, 9 aa, Homo Sapiens
NLSWVINSY

SEQ ID NO: 1097 - protein, 9 aa, Homo Sapiens
MMKGGGGHR

SEQ ID NO: 1098 - protein, 9 aa, Homo Sapiens
NLLASRPQD

SEQ ID NO: 1099 - protein, 9 aa, Homo Sapiens
QFNWNIVSF

SEQ ID NO: 1100 - protein, 9 aa, Homo Sapiens
GMQTKHIYQ

SEQ ID NO: 1101 - protein, 9 aa, Homo Sapiens
DPVTVTGHM

SEQ ID NO: 1102 - protein, 9 aa, Homo Sapiens
TTSLKMLAT

SEQ ID NO: 1103 - protein, 9 aa, Homo Sapiens
HMYQAQGLI

SEQ ID NO: 1104 - protein, 9 aa, Homo Sapiens
CAAGSFILV

SEQ ID NO: 1105 - protein, 9 aa, Homo Sapiens
DPDNKLYFA

SEQ ID NO: 1106 - protein, 9 aa, Homo Sapiens
TQFNWNIVS

SEQ ID NO: 1107 - protein, 9 aa, Homo Sapiens
CVALSTFGG

SEQ ID NO: 1108 - protein, 9 aa, Homo Sapiens
DSTSLSPNY

SEQ ID NO: 1109 - protein, 9 aa, Homo Sapiens
KGAVAEDGH

SEQ ID NO: 1110 - protein, 9 aa, Homo Sapiens
EYFKREHSL

SEQ ID NO: 1111 - protein, 9 aa, Homo Sapiens
LQVANQTPG

SEQ ID NO: 1112 - protein, 9 aa, Homo Sapiens
EKVEMLLEA

SEQ ID NO: 1113 - protein, 9 aa, Homo Sapiens
EQARLSAGE

SEQ ID NO: 1114 - protein, 9 aa, Homo Sapiens
STQDLSKGI

SEQ ID NO: 1115 - protein, 9 aa, Homo Sapiens
KVKQPQEED

SEQ ID NO: 1116 - protein, 9 aa, Homo Sapiens
MFGWGNFHS

SEQ ID NO: 1117 - protein, 9 aa, Homo Sapiens
QGMTAQVGI

SEQ ID NO: 1118 - protein, 9 aa, Homo Sapiens
NALILFFIV

SEQ ID NO: 1119 - protein, 9 aa, Homo Sapiens
SFILVAFSH

SEQ ID NO: 1120 - protein, 9 aa, Homo Sapiens
PKLLVQRYL

SEQ ID NO: 1121 - protein, 9 aa, Homo Sapiens
MSRLSWEYR

SEQ ID NO: 1122 - protein, 9 aa, Homo Sapiens
NYRRRFNLQ

SEQ ID NO: 1123 - protein, 9 aa, Homo Sapiens
PSPPALRPE

SEQ ID NO: 1124 - protein, 9 aa, Homo Sapiens
KLLVQRYLG

SEQ ID NO: 1125 - protein, 9 aa, Homo Sapiens
SWVMPVCVA

SEQ ID NO: 1126 - protein, 9 aa, Homo Sapiens
SADTCDQFC

SEQ ID NO: 1127 - protein, 9 aa, Homo Sapiens
TAVDLKPCG

SEQ ID NO: 1128 - protein, 9 aa, Homo Sapiens
LGAFCYMND

SEQ ID NO: 1129 - protein, 9 aa, Homo Sapiens
CNVPGTGNQ

SEQ ID NO: 1130 - protein, 9 aa, Homo Sapiens
GCPETMRIT

SEQ ID NO: 1131 - protein, 9 aa, Homo Sapiens
NDIMATTYL

SEQ ID NO: 1132 - protein, 9 aa, Homo Sapiens
QGPSCSFPH

SEQ ID NO: 1133 - protein, 9 aa, Homo Sapiens
QFIPRVEPG

SEQ ID NO: 1134 - protein, 9 aa, Homo Sapiens
PEDKPSLIS

SEQ ID NO: 1135 - protein, 9 aa, Homo Sapiens
WLPSCNTPS

SEQ ID NO: 1136 - protein, 9 aa, Homo Sapiens
GMGGDGDYM

SEQ ID NO: 1137 - protein, 9 aa, Homo Sapiens
MRITFLPGE

SEQ ID NO: 1138 - protein, 9 aa, Homo Sapiens
CPPGLKIPK

SEQ ID NO: 1139 - protein, 9 aa, Homo Sapiens
LTYKSDPVM

SEQ ID NO: 1140 - protein, 9 aa, Homo Sapiens
QNGGEGSII

SEQ ID NO: 1141 - protein, 9 aa, Homo Sapiens
FNKAQQGNE

SEQ ID NO: 1142 - protein, 9 aa, Homo Sapiens
NGGEGSIII

SEQ ID NO: 1143 - protein, 9 aa, Homo Sapiens
PLGIQLSAL

SEQ ID NO: 1144 - protein, 9 aa, Homo Sapiens
DNKLYFAHG

SEQ ID NO: 1145 - protein, 9 aa, Homo Sapiens
AGSVTLEEL

SEQ ID NO: 1146 - protein, 9 aa, Homo Sapiens
RFSGRRNSG

SEQ ID NO: 1147 - protein, 9 aa, Homo Sapiens
DMQGDLQIT

SEQ ID NO: 1148 - protein, 9 aa, Homo Sapiens
TCLSAYCKI

SEQ ID NO: 1149 - protein, 9 aa, Homo Sapiens
KNVVFVIDN

SEQ ID NO: 1150 - protein, 9 aa, Homo Sapiens
NATSGKSHL

SEQ ID NO: 1151 - protein, 9 aa, Homo Sapiens
SKDGTARLW

SEQ ID NO: 1152 - protein, 9 aa, Homo Sapiens
LLGDDEPKS

SEQ ID NO: 1153 - protein, 9 aa, Homo Sapiens
FSLVILGFP

SEQ ID NO: 1154 - protein, 9 aa, Homo Sapiens
LSFDLKHLL

SEQ ID NO: 1155 - protein, 9 aa, Homo Sapiens
VDMEWLYGS

SEQ ID NO: 1156 - protein, 9 aa, Homo Sapiens
HINRHNNFQ

SEQ ID NO: 1157 - protein, 9 aa, Homo Sapiens
SRLSWEYRE

SEQ ID NO: 1158 - protein, 9 aa, Homo Sapiens
PGLKIPKED

SEQ ID NO: 1159 - protein, 9 aa, Homo Sapiens
AICCGIRSL

SEQ ID NO: 1160 - protein, 9 aa, Homo Sapiens
GGRAPGMRI

SEQ ID NO: 1161 - protein, 9 aa, Homo Sapiens
QGLIAADSN

SEQ ID NO: 1162 - protein, 9 aa, Homo Sapiens
PITPVPVVG

SEQ ID NO: 1163 - protein, 9 aa, Homo Sapiens
LYGSSESSN

SEQ ID NO: 1164 - protein, 9 aa, Homo Sapiens
EEAKRLKQS

SEQ ID NO: 1165 - protein, 9 aa, Homo Sapiens
ARTSNPIPG

SEQ ID NO: 1166 - protein, 9 aa, Homo Sapiens
DYMEIFMEE

SEQ ID NO: 1167 - protein, 9 aa, Homo Sapiens
KVSSTGLSF

SEQ ID NO: 1168 - protein, 9 aa, Homo Sapiens
NPEDPQYVS

SEQ ID NO: 1169 - protein, 9 aa, Homo Sapiens
ELPEDKPSL

SEQ ID NO: 1170 - protein, 9 aa, Homo Sapiens
HGPDQVRPL

SEQ ID NO: 1171 - protein, 9 aa, Homo Sapiens
SSEVPQNLL

SEQ ID NO: 1172 - protein, 9 aa, Homo Sapiens
GASGVIICN

SEQ ID NO: 1173 - protein, 9 aa, Homo Sapiens
TTSCASLAY

SEQ ID NO: 1174 - protein, 9 aa, Homo Sapiens
PMVSKPAGA

SEQ ID NO: 1175 - protein, 9 aa, Homo Sapiens
CRTALHRAS

SEQ ID NO: 1176 - protein, 9 aa, Homo Sapiens
GTFSISFIK

SEQ ID NO: 1177 - protein, 9 aa, Homo Sapiens
QSLDLGCLL

SEQ ID NO: 1178 - protein, 9 aa, Homo Sapiens
GYFDEEMSR

SEQ ID NO: 1179 - protein, 9 aa, Homo Sapiens
SVSGSELRA

SEQ ID NO: 1180 - protein, 9 aa, Homo Sapiens
CIVRKDLRA

SEQ ID NO: 1181 - protein, 9 aa, Homo Sapiens
HAHICLPVY

SEQ ID NO: 1182 - protein, 9 aa, Homo Sapiens
ILVAFSHSV

SEQ ID NO: 1183 - protein, 9 aa, Homo Sapiens
NTFQHSVVV

SEQ ID NO: 1184 - protein, 9 aa, Homo Sapiens
LLASRPQDR

SEQ ID NO: 1185 - protein, 9 aa, Homo Sapiens
QYVSQDVVF

SEQ ID NO: 1186 - protein, 9 aa, Homo Sapiens
TYSIYMYTA

SEQ ID NO: 1187 - protein, 9 aa, Homo Sapiens
ERQLFHSTS

SEQ ID NO: 1188 - protein, 9 aa, Homo Sapiens
CASLAYSAP

SEQ ID NO: 1189 - protein, 9 aa, Homo Sapiens
LQASDNLSW

SEQ ID NO: 1190 - protein, 9 aa, Homo Sapiens
PLQLKPKVP

SEQ ID NO: 1191 - protein, 9 aa, Homo Sapiens
GHHKLAERL

SEQ ID NO: 1192 - protein, 9 aa, Homo Sapiens
ALILFFIVS

SEQ ID NO: 1193 - protein, 9 aa, Homo Sapiens
IVCLCPYER

SEQ ID NO: 1194 - protein, 9 aa, Homo Sapiens
DFKPKLLVQ

SEQ ID NO: 1195 - protein, 9 aa, Homo Sapiens
EVRKQVSWE

SEQ ID NO: 1196 - protein, 9 aa, Homo Sapiens
SIYMYTARG

SEQ ID NO: 1197 - protein, 9 aa, Homo Sapiens
LPLPDSPGD

SEQ ID NO: 1198 - protein, 9 aa, Homo Sapiens
GWGNFHSNI

SEQ ID NO: 1199 - protein, 9 aa, Homo Sapiens
LEAETQSER

SEQ ID NO: 1200 - protein, 9 aa, Homo Sapiens
VMMSLDVCL

SEQ ID NO: 1201 - protein, 9 aa, Homo Sapiens
RRLEEAQRH

SEQ ID NO: 1202 - protein, 9 aa, Homo Sapiens
AGQTFEYFK

SEQ ID NO: 1203 - protein, 9 aa, Homo Sapiens
ENDLNGIHI

SEQ ID NO: 1204 - protein, 9 aa, Homo Sapiens
STNNNARRA

SEQ ID NO: 1205 - protein, 9 aa, Homo Sapiens
ICKIGFGPD

SEQ ID NO: 1206 - protein, 9 aa, Homo Sapiens
SKLSFDLKH

SEQ ID NO: 1207 - protein, 9 aa, Homo Sapiens
AELPEDKPS

SEQ ID NO: 1208 - protein, 9 aa, Homo Sapiens
PEAIGFHII

SEQ ID NO: 1209 - protein, 9 aa, Homo Sapiens
SSLPCTFIA

SEQ ID NO: 1210 - protein, 9 aa, Homo Sapiens
LGCLLFEGC

SEQ ID NO: 1211 - protein, 9 aa, Homo Sapiens
SLSPDTAAL

SEQ ID NO: 1212 - protein, 9 aa, Homo Sapiens
RRGQFIPRV

SEQ ID NO: 1213 - protein, 9 aa, Homo Sapiens
WVMPVCVAL

SEQ ID NO: 1214 - protein, 9 aa, Homo Sapiens
LPDAMSLQH

SEQ ID NO: 1215 - protein, 9 aa, Homo Sapiens
SEVPQNLLA

SEQ ID NO: 1216 - protein, 9 aa, Homo Sapiens
AFDITALKN

SEQ ID NO: 1217 - protein, 9 aa, Homo Sapiens
IENLDPLGI

SEQ ID NO: 1218 - protein, 9 aa, Homo Sapiens
KWWYDKGKC

SEQ ID NO: 1219 - protein, 9 aa, Homo Sapiens
ECCPHSADR

SEQ ID NO: 1220 - protein, 9 aa, Homo Sapiens
TVHIPVARC

SEQ ID NO: 1221 - protein, 9 aa, Homo Sapiens
EARNMLLEN

SEQ ID NO: 1222 - protein, 9 aa, Homo Sapiens
CGLNVGLHV

SEQ ID NO: 1223 - protein, 9 aa, Homo Sapiens
LKIPKEDGY

SEQ ID NO: 1224 - protein, 9 aa, Homo Sapiens
DAMSLQHTR

SEQ ID NO: 1225 - protein, 9 aa, Homo Sapiens
SADRVVLIG

SEQ ID NO: 1226 - protein, 9 aa, Homo Sapiens
LSWVINSYK

SEQ ID NO: 1227 - protein, 9 aa, Homo Sapiens
PMSSGSPDL

SEQ ID NO: 1228 - protein, 9 aa, Homo Sapiens
WVINSYKTI

SEQ ID NO: 1229 - protein, 9 aa, Homo Sapiens
KEKTMTCVF

SEQ ID NO: 1230 - protein, 9 aa, Homo Sapiens
GFQDDVDLK

SEQ ID NO: 1231 - protein, 9 aa, Homo Sapiens
HVLKFGFSS

SEQ ID NO: 1232 - protein, 9 aa, Homo Sapiens
SAFEIEHEA

SEQ ID NO: 1233 - protein, 9 aa, Homo Sapiens
ARCIVRKDL

SEQ ID NO: 1234 - protein, 9 aa, Homo Sapiens
VSGSELRAV

SEQ ID NO: 1235 - protein, 9 aa, Homo Sapiens
PVVGLALVR

SEQ ID NO: 1236 - protein, 9 aa, Homo Sapiens
AKSTQDLSK

SEQ ID NO: 1237 - protein, 9 aa, Homo Sapiens
LFYFTTRKL

SEQ ID NO: 1238 - protein, 9 aa, Homo Sapiens
VAAEQSLRQ

SEQ ID NO: 1239 - protein, 9 aa, Homo Sapiens
GPMVSKPAG

SEQ ID NO: 1240 - protein, 9 aa, Homo Sapiens
SKASEAALP

SEQ ID NO: 1241 - protein, 9 aa, Homo Sapiens
PNASFMDLA

SEQ ID NO: 1242 - protein, 9 aa, Homo Sapiens
SQNLVGGAV

SEQ ID NO: 1243 - protein, 9 aa, Homo Sapiens
TVTGHMTES

SEQ ID NO: 1244 - protein, 9 aa, Homo Sapiens
NLDPLGIQL

SEQ ID NO: 1245 - protein, 9 aa, Homo Sapiens
TDIVLELRG

SEQ ID NO: 1246 - protein, 9 aa, Homo Sapiens
HIYQNLSQF

SEQ ID NO: 1247 - protein, 9 aa, Homo Sapiens
WFCLAIPEV

SEQ ID NO: 1248 - protein, 9 aa, Homo Sapiens
YLCNESCEK

SEQ ID NO: 1249 - protein, 9 aa, Homo Sapiens
TCPNASFMD

SEQ ID NO: 1250 - protein, 9 aa, Homo Sapiens
GSLQVANQT

SEQ ID NO: 1251 - protein, 9 aa, Homo Sapiens
AAEQSLRQL

SEQ ID NO: 1252 - protein, 9 aa, Homo Sapiens
PGMRIYSWS

SEQ ID NO: 1253 - protein, 9 aa, Homo Sapiens
AGLLAQDIS

SEQ ID NO: 1254 - protein, 9 aa, Homo Sapiens
ETKKGSLQV

SEQ ID NO: 1255 - protein, 9 aa, Homo Sapiens
KIENLDPLG

SEQ ID NO: 1256 - protein, 9 aa, Homo Sapiens
MGSYRCICK

SEQ ID NO: 1257 - protein, 9 aa, Homo Sapiens
TKPRDPDNK

SEQ ID NO: 1258 - protein, 9 aa, Homo Sapiens
VFKELVGLA

SEQ ID NO: 1259 - protein, 9 aa, Homo Sapiens
SCASLAYSA

SEQ ID NO: 1260 - protein, 9 aa, Homo Sapiens
GHRDVGADR

SEQ ID NO: 1261 - protein, 9 aa, Homo Sapiens
TEERRLRYG

SEQ ID NO: 1262 - protein, 9 aa, Homo Sapiens
FQDDVDLKD

SEQ ID NO: 1263 - protein, 9 aa, Homo Sapiens
VLPQYLKHS

SEQ ID NO: 1264 - protein, 9 aa, Homo Sapiens
LSKGISRKD

SEQ ID NO: 1265 - protein, 9 aa, Homo Sapiens
LPITPVPVV

SEQ ID NO: 1266 - protein, 9 aa, Homo Sapiens
VLNTADWLP

SEQ ID NO: 1267 - protein, 9 aa, Homo Sapiens
TALKNPSAA

SEQ ID NO: 1268 - protein, 9 aa, Homo Sapiens
RNTFQHSVV

SEQ ID NO: 1269 - protein, 9 aa, Homo Sapiens
LTHNDIMAT

SEQ ID NO: 1270 - protein, 9 aa, Homo Sapiens
DVSTFWVSL

SEQ ID NO: 1271 - protein, 9 aa, Homo Sapiens
FTTRKLLRP

SEQ ID NO: 1272 - protein, 9 aa, Homo Sapiens
AEQSLRQLL

SEQ ID NO: 1273 - protein, 9 aa, Homo Sapiens
TMRITFLPG

SEQ ID NO: 1274 - protein, 9 aa, Homo Sapiens
KSTQDLSKG

SEQ ID NO: 1275 - protein, 9 aa, Homo Sapiens
FEYFKREHS

SEQ ID NO: 1276 - protein, 9 aa, Homo Sapiens
PAPGPGEDS

SEQ ID NO: 1277 - protein, 9 aa, Homo Sapiens
AGSFILVAF

SEQ ID NO: 1278 - protein, 9 aa, Homo Sapiens
ENLDPLGIQ

SEQ ID NO: 1279 - protein, 9 aa, Homo Sapiens
SLISGVSRP

SEQ ID NO: 1280 - protein, 9 aa, Homo Sapiens
KNPSAAEEL

SEQ ID NO: 1281 - protein, 9 aa, Homo Sapiens
VFTLAQNFK

SEQ ID NO: 1282 - protein, 9 aa, Homo Sapiens
WENDLNGIH

SEQ ID NO: 1283 - protein, 9 aa, Homo Sapiens
FQHSVVVPY

SEQ ID NO: 1284 - protein, 9 aa, Homo Sapiens
CYMNDVEVP

SEQ ID NO: 1285 - protein, 9 aa, Homo Sapiens
GLSFKKEEE

SEQ ID NO: 1286 - protein, 9 aa, Homo Sapiens
GRRNSGMVP

SEQ ID NO: 1287 - protein, 9 aa, Homo Sapiens
NMLLENPQL

SEQ ID NO: 1288 - protein, 9 aa, Homo Sapiens
DSNSSQNLV

SEQ ID NO: 1289 - protein, 9 aa, Homo Sapiens
RKQVSWERS

SEQ ID NO: 1290 - protein, 9 aa, Homo Sapiens
FPPIIVVLA

SEQ ID NO: 1291 - protein, 9 aa, Homo Sapiens
SWVINSYKT

SEQ ID NO: 1292 - protein, 9 aa, Homo Sapiens
SKRSKKAEA

SEQ ID NO: 1293 - protein, 9 aa, Homo Sapiens
PFDLTDIVL

SEQ ID NO: 1294 - protein, 9 aa, Homo Sapiens
FDLKHLLRS

SEQ ID NO: 1295 - protein, 9 aa, Homo Sapiens
DGSTFDYIQ

SEQ ID NO: 1296 - protein, 9 aa, Homo Sapiens
IVRKDLRAF

SEQ ID NO: 1297 - protein, 9 aa, Homo Sapiens
NEKVEMLLE

SEQ ID NO: 1298 - protein, 9 aa, Homo Sapiens
AQNFKNKAS

SEQ ID NO: 1299 - protein, 9 aa, Homo Sapiens
SPEPGEEKF

SEQ ID NO: 1300 - protein, 9 aa, Homo Sapiens
HAFAEKNNL

SEQ ID NO: 1301 - protein, 9 aa, Homo Sapiens
RQAITVKEA

SEQ ID NO: 1302 - protein, 9 aa, Homo Sapiens
PVSGTPIPV

SEQ ID NO: 1303 - protein, 9 aa, Homo Sapiens
TTVSCEMKN

SEQ ID NO: 1304 - protein, 9 aa, Homo Sapiens
AACDQHVCH

SEQ ID NO: 1305 - protein, 9 aa, Homo Sapiens
VAQRPYMTL

SEQ ID NO: 1306 - protein, 9 aa, Homo Sapiens
LSAFPKQDG

SEQ ID NO: 1307 - protein, 9 aa, Homo Sapiens
SESSNHSLC

SEQ ID NO: 1308 - protein, 9 aa, Homo Sapiens
SIMASLSTF

SEQ ID NO: 1309 - protein, 9 aa, Homo Sapiens
DSVLDLAER

SEQ ID NO: 1310 - protein, 9 aa, Homo Sapiens
RQIEYFRFL

SEQ ID NO: 1311 - protein, 9 aa, Homo Sapiens
WRYRLYKRM

SEQ ID NO: 1312 - protein, 9 aa, Homo Sapiens
STGPPTECT

SEQ ID NO: 1313 - protein, 9 aa, Homo Sapiens
AKVAEVRGP

SEQ ID NO: 1314 - protein, 9 aa, Homo Sapiens
RAVPTDEAH

SEQ ID NO: 1315 - protein, 9 aa, Homo Sapiens
STLAEEVAA

SEQ ID NO: 1316 - protein, 9 aa, Homo Sapiens
LPGLQLEWI

SEQ ID NO: 1317 - protein, 9 aa, Homo Sapiens
DTEQETLYS

SEQ ID NO: 1318 - protein, 9 aa, Homo Sapiens
MASLSTFQQ

SEQ ID NO: 1319 - protein, 9 aa, Homo Sapiens
PVNVRCLVL

SEQ ID NO: 1320 - protein, 9 aa, Homo Sapiens
RHSLQELPA

SEQ ID NO: 1321 - protein, 9 aa, Homo Sapiens
TPVHVTSPS

SEQ ID NO: 1322 - protein, 9 aa, Homo Sapiens
VPVAKVAEV

SEQ ID NO: 1323 - protein, 9 aa, Homo Sapiens
QCAHMLLHQ

SEQ ID NO: 1324 - protein, 9 aa, Homo Sapiens
NHSLCSVGS

SEQ ID NO: 1325 - protein, 9 aa, Homo Sapiens
QFRDLNADV

SEQ ID NO: 1326 - protein, 9 aa, Homo Sapiens
LSLQKLEID

SEQ ID NO: 1327 - protein, 9 aa, Homo Sapiens
LEPELSAFP

SEQ ID NO: 1328 - protein, 9 aa, Homo Sapiens
GGRWWGGEP

SEQ ID NO: 1329 - protein, 9 aa, Homo Sapiens
KSEKTLLTP

SEQ ID NO: 1330 - protein, 9 aa, Homo Sapiens
TTHKTIHTG

SEQ ID NO: 1331 - protein, 9 aa, Homo Sapiens
DSASVVAPF

SEQ ID NO: 1332 - protein, 9 aa, Homo Sapiens
VSIFLKEAN

SEQ ID NO: 1333 - protein, 9 aa, Homo Sapiens
KLYEAMQPV

SEQ ID NO: 1334 - protein, 9 aa, Homo Sapiens
PELYATVAG

SEQ ID NO: 1335 - protein, 9 aa, Homo Sapiens
VGAPLGSSG

SEQ ID NO: 1336 - protein, 9 aa, Homo Sapiens
PPPVSGTPI

SEQ ID NO: 1337 - protein, 9 aa, Homo Sapiens
GRDLNCVPK

SEQ ID NO: 1338 - protein, 9 aa, Homo Sapiens
DLISDSKAS

SEQ ID NO: 1339 - protein, 9 aa, Homo Sapiens
LVKKRKAYQ

SEQ ID NO: 1340 - protein, 9 aa, Homo Sapiens
QAVVTGHRR

SEQ ID NO: 1341 - protein, 9 aa, Homo Sapiens
LPSESCSVQ

SEQ ID NO: 1342 - protein, 9 aa, Homo Sapiens
GPHRLYVQM

SEQ ID NO: 1343 - protein, 9 aa, Homo Sapiens
ECRKSFNCL

SEQ ID NO: 1344 - protein, 9 aa, Homo Sapiens
SQAQLHQEQ

SEQ ID NO: 1345 - protein, 9 aa, Homo Sapiens
AQAAVAAVE

SEQ ID NO: 1346 - protein, 9 aa, Homo Sapiens
SGQRAAEPR

SEQ ID NO: 1347 - protein, 9 aa, Homo Sapiens
LSLDNVKRH

SEQ ID NO: 1348 - protein, 9 aa, Homo Sapiens
ILRHYVNRN

SEQ ID NO: 1349 - protein, 9 aa, Homo Sapiens
IQDWKKAAN

SEQ ID NO: 1350 - protein, 9 aa, Homo Sapiens
VRCLVLEYG

SEQ ID NO: 1351 - protein, 9 aa, Homo Sapiens
KFGRWMFHT

SEQ ID NO: 1352 - protein, 9 aa, Homo Sapiens
AHCSVSLAS

SEQ ID NO: 1353 - protein, 9 aa, Homo Sapiens
RIQDWKKAA

SEQ ID NO: 1354 - protein, 9 aa, Homo Sapiens
APERTDTCE

SEQ ID NO: 1355 - protein, 9 aa, Homo Sapiens
RRPSSWRQK

SEQ ID NO: 1356 - protein, 9 aa, Homo Sapiens
QVARQAQTS

SEQ ID NO: 1357 - protein, 9 aa, Homo Sapiens
NNKSNKVLP

SEQ ID NO: 1358 - protein, 9 aa, Homo Sapiens
RQNPCGRPP

SEQ ID NO: 1359 - protein, 9 aa, Homo Sapiens
NCVPKIADT

SEQ ID NO: 1360 - protein, 9 aa, Homo Sapiens
SLQSLAFRE

SEQ ID NO: 1361 - protein, 9 aa, Homo Sapiens
RQYVTFKPQ

SEQ ID NO: 1362 - protein, 9 aa, Homo Sapiens
GGHIAYLHV

SEQ ID NO: 1363 - protein, 9 aa, Homo Sapiens
LKLVLKGQM

SEQ ID NO: 1364 - protein, 9 aa, Homo Sapiens
AKRGHGDIC

SEQ ID NO: 1365 - protein, 9 aa, Homo Sapiens
KVVAVDSDS

SEQ ID NO: 1366 - protein, 9 aa, Homo Sapiens
WYNITDSED

SEQ ID NO: 1367 - protein, 9 aa, Homo Sapiens
AAPERTDTC

SEQ ID NO: 1368 - protein, 9 aa, Homo Sapiens
PVEISYDNM

SEQ ID NO: 1369 - protein, 9 aa, Homo Sapiens
RGGMPNTGN

SEQ ID NO: 1370 - protein, 9 aa, Homo Sapiens
PGLPSESCS

SEQ ID NO: 1371 - protein, 9 aa, Homo Sapiens
LVLEYGSLE

SEQ ID NO: 1372 - protein, 9 aa, Homo Sapiens
SSSSDSNVS

SEQ ID NO: 1373 - protein, 9 aa, Homo Sapiens
LVLKGQMCK

SEQ ID NO: 1374 - protein, 9 aa, Homo Sapiens
TCQHVRHSL

SEQ ID NO: 1375 - protein, 9 aa, Homo Sapiens
GGYKFRWAP

SEQ ID NO: 1376 - protein, 9 aa, Homo Sapiens
GLAWVGAPL

SEQ ID NO: 1377 - protein, 9 aa, Homo Sapiens
VGGSIMASL

SEQ ID NO: 1378 - protein, 9 aa, Homo Sapiens
VSCEMKNKV

SEQ ID NO: 1379 - protein, 9 aa, Homo Sapiens
LYKRMKTGF

SEQ ID NO: 1380 - protein, 9 aa, Homo Sapiens
PLVPENLVK

SEQ ID NO: 1381 - protein, 9 aa, Homo Sapiens
VRHSLQELP

SEQ ID NO: 1382 - protein, 9 aa, Homo Sapiens
AWVGAPLGS

SEQ ID NO: 1383 - protein, 9 aa, Homo Sapiens
CDLEFHLRP

SEQ ID NO: 1384 - protein, 9 aa, Homo Sapiens
NPARNAALF

SEQ ID NO: 1385 - protein, 9 aa, Homo Sapiens
PSPCTCHAL

SEQ ID NO: 1386 - protein, 9 aa, Homo Sapiens
YRLYKRMKT

SEQ ID NO: 1387 - protein, 9 aa, Homo Sapiens
FYRIYSAVS

SEQ ID NO: 1388 - protein, 9 aa, Homo Sapiens
IITLTSVDC

SEQ ID NO: 1389 - protein, 9 aa, Homo Sapiens
PPPLRPSGQ

SEQ ID NO: 1390 - protein, 9 aa, Homo Sapiens
VGGGAEPRK

SEQ ID NO: 1391 - protein, 9 aa, Homo Sapiens
ALERLVVWH

SEQ ID NO: 1392 - protein, 9 aa, Homo Sapiens
KTLLTPERL

SEQ ID NO: 1393 - protein, 9 aa, Homo Sapiens
GLAESLQPH

SEQ ID NO: 1394 - protein, 9 aa, Homo Sapiens
KQLVIGSVN

SEQ ID NO: 1395 - protein, 9 aa, Homo Sapiens
LSKLYENNK

SEQ ID NO: 1396 - protein, 9 aa, Homo Sapiens
ADDSRISQD

SEQ ID NO: 1397 - protein, 9 aa, Homo Sapiens
GDGNFCDLE

SEQ ID NO: 1398 - protein, 9 aa, Homo Sapiens
LHYLILMNQ

SEQ ID NO: 1399 - protein, 9 aa, Homo Sapiens
EILRHYVNR

SEQ ID NO: 1400 - protein, 9 aa, Homo Sapiens
WNGPHRLYV

SEQ ID NO: 1401 - protein, 9 aa, Homo Sapiens
LTTHKTIHT

SEQ ID NO: 1402 - protein, 9 aa, Homo Sapiens
SSTLAEEVA

SEQ ID NO: 1403 - protein, 9 aa, Homo Sapiens
YVAQRPYMT

SEQ ID NO: 1404 - protein, 9 aa, Homo Sapiens
DIMQRQYVT

SEQ ID NO: 1405 - protein, 9 aa, Homo Sapiens
IPSIIRSIH

SEQ ID NO: 1406 - protein, 9 aa, Homo Sapiens
GPVLFTEEH

SEQ ID NO: 1407 - protein, 9 aa, Homo Sapiens
ACSAKWRKY

SEQ ID NO: 1408 - protein, 9 aa, Homo Sapiens
VEISYDNMR

SEQ ID NO: 1409 - protein, 9 aa, Homo Sapiens
WTGAACDQH

SEQ ID NO: 1410 - protein, 9 aa, Homo Sapiens
QKKITRTKE

SEQ ID NO: 1411 - protein, 9 aa, Homo Sapiens
YTLDVLERC

SEQ ID NO: 1412 - protein, 9 aa, Homo Sapiens
RHYVNRNGD

SEQ ID NO: 1413 - protein, 9 aa, Homo Sapiens
AALLHTLHS

SEQ ID NO: 1414 - protein, 9 aa, Homo Sapiens
KWLCSQFKE

SEQ ID NO: 1415 - protein, 9 aa, Homo Sapiens
VTGQAVVTG

SEQ ID NO: 1416 - protein, 9 aa, Homo Sapiens
EKISKSEKT

SEQ ID NO: 1417 - protein, 9 aa, Homo Sapiens
YLLKDTTSA

SEQ ID NO: 1418 - protein, 9 aa, Homo Sapiens
IKDDGTMCD

SEQ ID NO: 1419 - protein, 9 aa, Homo Sapiens
GKSWILLPS

SEQ ID NO: 1420 - protein, 9 aa, Homo Sapiens
TFKEKRKCL

SEQ ID NO: 1421 - protein, 9 aa, Homo Sapiens
HYSERLCLV

SEQ ID NO: 1422 - protein, 9 aa, Homo Sapiens
YKRMKTGFE

SEQ ID NO: 1423 - protein, 9 aa, Homo Sapiens
SSLQSLAFR

SEQ ID NO: 1424 - protein, 9 aa, Homo Sapiens
HSPQTIPIA

SEQ ID NO: 1425 - protein, 9 aa, Homo Sapiens
ERIQDWKKA

SEQ ID NO: 1426 - protein, 9 aa, Homo Sapiens
WVGGSIMAS

SEQ ID NO: 1427 - protein, 9 aa, Homo Sapiens
WLCSQFKES

SEQ ID NO: 1428 - protein, 9 aa, Homo Sapiens
GGSIMASLS

SEQ ID NO: 1429 - protein, 9 aa, Homo Sapiens
LYLMKEEIQ

SEQ ID NO: 1430 - protein, 9 aa, Homo Sapiens
AAKRGHGDI

SEQ ID NO: 1431 - protein, 9 aa, Homo Sapiens
PGEEKFGRW

SEQ ID NO: 1432 - protein, 9 aa, Homo Sapiens
IMQRQYVTF

SEQ ID NO: 1433 - protein, 9 aa, Homo Sapiens
DSAPTGIKD

SEQ ID NO: 1434 - protein, 9 aa, Homo Sapiens
LNCVPKIAD

SEQ ID NO: 1435 - protein, 9 aa, Homo Sapiens
KIADTLGAV

SEQ ID NO: 1436 - protein, 9 aa, Homo Sapiens
DATLQTRLN

SEQ ID NO: 1437 - protein, 9 aa, Homo Sapiens
GSIMASLST

SEQ ID NO: 1438 - protein, 9 aa, Homo Sapiens
SSWRQKKIT

SEQ ID NO: 1439 - protein, 9 aa, Homo Sapiens
ILGRCAEQL

SEQ ID NO: 1440 - protein, 9 aa, Homo Sapiens
KEECLSLQK

SEQ ID NO: 1441 - protein, 9 aa, Homo Sapiens
PSIIRSIHQ

SEQ ID NO: 1442 - protein, 9 aa, Homo Sapiens
AVDSDSGQN

SEQ ID NO: 1443 - protein, 9 aa, Homo Sapiens
HVCHPRCIE

SEQ ID NO: 1444 - protein, 9 aa, Homo Sapiens
LAERAVVRV

SEQ ID NO: 1445 - protein, 9 aa, Homo Sapiens
KDLTSSSRP

SEQ ID NO: 1446 - protein, 9 aa, Homo Sapiens
WRQKKITRT

SEQ ID NO: 1447 - protein, 9 aa, Homo Sapiens
SLERLRQAI

SEQ ID NO: 1448 - protein, 9 aa, Homo Sapiens
IITSLSHQI

SEQ ID NO: 1449 - protein, 9 aa, Homo Sapiens
RDLNCVPKI

SEQ ID NO: 1450 - protein, 9 aa, Homo Sapiens
KAGESASPA

SEQ ID NO: 1451 - protein, 9 aa, Homo Sapiens
CHALETMGL

SEQ ID NO: 1452 - protein, 9 aa, Homo Sapiens
GPLTGLKSY

SEQ ID NO: 1453 - protein, 9 aa, Homo Sapiens
YLHVLAVHR

SEQ ID NO: 1454 - protein, 9 aa, Homo Sapiens
ARDWIFQLN

SEQ ID NO: 1455 - protein, 9 aa, Homo Sapiens
TDWAWYNIT

SEQ ID NO: 1456 - protein, 9 aa, Homo Sapiens
KERQLMGII

SEQ ID NO: 1457 - protein, 9 aa, Homo Sapiens
GLLYLMKEE

SEQ ID NO: 1458 - protein, 9 aa, Homo Sapiens
TSLEAQGKA

SEQ ID NO: 1459 - protein, 9 aa, Homo Sapiens
PSSWRQKKI

SEQ ID NO: 1460 - protein, 9 aa, Homo Sapiens
QAQLHQEQF

SEQ ID NO: 1461 - protein, 9 aa, Homo Sapiens
HYVNRNGDV

SEQ ID NO: 1462 - protein, 9 aa, Homo Sapiens
LYVQMSTHG

SEQ ID NO: 1463 - protein, 9 aa, Homo Sapiens
CLADHVACA

SEQ ID NO: 1464 - protein, 9 aa, Homo Sapiens
LEPACSAKW

SEQ ID NO: 1465 - protein, 9 aa, Homo Sapiens
PLYGNMCCP

SEQ ID NO: 1466 - protein, 9 aa, Homo Sapiens
ALYSGAFQR

SEQ ID NO: 1467 - protein, 9 aa, Homo Sapiens
TPTIRGNKH

SEQ ID NO: 1468 - protein, 9 aa, Homo Sapiens
CCPLVAQPA

SEQ ID NO: 1469 - protein, 9 aa, Homo Sapiens
EKCINSKQL

SEQ ID NO: 1470 - protein, 9 aa, Homo Sapiens
LNADVNVFQ

SEQ ID NO: 1471 - protein, 9 aa, Homo Sapiens
PGLQLEWID

SEQ ID NO: 1472 - protein, 9 aa, Homo Sapiens
PENLVKKRK

SEQ ID NO: 1473 - protein, 9 aa, Homo Sapiens
TFWRNNKSN

SEQ ID NO: 1474 - protein, 9 aa, Homo Sapiens
ASKHKYTSK

SEQ ID NO: 1475 - protein, 9 aa, Homo Sapiens
YDCEWRCTS

SEQ ID NO: 1476 - protein, 9 aa, Homo Sapiens
PQLCEGLFS

SEQ ID NO: 1477 - protein, 9 aa, Homo Sapiens
DIFTNIEAH

SEQ ID NO: 1478 - protein, 9 aa, Homo Sapiens
GGWRARAEC

SEQ ID NO: 1479 - protein, 9 aa, Homo Sapiens
IMASLSTFQ

SEQ ID NO: 1480 - protein, 9 aa, Homo Sapiens
TSKEECLSL

SEQ ID NO: 1481 - protein, 9 aa, Homo Sapiens
LNPLSFHLQ

SEQ ID NO: 1482 - protein, 9 aa, Homo Sapiens
VDGVVFYRI

SEQ ID NO: 1483 - protein, 9 aa, Homo Sapiens
SVVAPFAPG

SEQ ID NO: 1484 - protein, 9 aa, Homo Sapiens
VVPELYATV

SEQ ID NO: 1485 - protein, 9 aa, Homo Sapiens
HKYTSKDLT

SEQ ID NO: 1486 - protein, 9 aa, Homo Sapiens
IFLKEANQD

SEQ ID NO: 1487 - protein, 9 aa, Homo Sapiens
RWWGGEPDI

SEQ ID NO: 1488 - protein, 9 aa, Homo Sapiens
SLDNVKRHN

SEQ ID NO: 1489 - protein, 9 aa, Homo Sapiens
RLQCSDVTS

SEQ ID NO: 1490 - protein, 9 aa, Homo Sapiens
NLQSAYELP

SEQ ID NO: 1491 - protein, 9 aa, Homo Sapiens
LRGSRELGT

SEQ ID NO: 1492 - protein, 9 aa, Homo Sapiens
RNNKSNKVL

SEQ ID NO: 1493 - protein, 9 aa, Homo Sapiens
LLQRLQNSK

SEQ ID NO: 1494 - protein, 9 aa, Homo Sapiens
LEDSEKVEK

SEQ ID NO: 1495 - protein, 9 aa, Homo Sapiens
LPSSMSEPR

SEQ ID NO: 1496 - protein, 9 aa, Homo Sapiens
LGAANPARN

SEQ ID NO: 1497 - protein, 9 aa, Homo Sapiens
AQIAASAKL

SEQ ID NO: 1498 - protein, 9 aa, Homo Sapiens
DESKWLCSQ

SEQ ID NO: 1499 - protein, 9 aa, Homo Sapiens
RKQIFILLL

SEQ ID NO: 1500 - protein, 9 aa, Homo Sapiens
VNAAVAHSP

SEQ ID NO: 1501 - protein, 9 aa, Homo Sapiens
WVGAPLGSS

SEQ ID NO: 1502 - protein, 9 aa, Homo Sapiens
LDVLERCPH

SEQ ID NO: 1503 - protein, 9 aa, Homo Sapiens
KRMKTGFEH

SEQ ID NO: 1504 - protein, 9 aa, Homo Sapiens
TATFWRNNK

SEQ ID NO: 1505 - protein, 9 aa, Homo Sapiens
KGRLESALR

SEQ ID NO: 1506 - protein, 9 aa, Homo Sapiens
HEACLADHV

SEQ ID NO: 1507 - protein, 9 aa, Homo Sapiens
KIYNLQSAY

SEQ ID NO: 1508 - protein, 9 aa, Homo Sapiens
WLHPVTGQA

SEQ ID NO: 1509 - protein, 9 aa, Homo Sapiens
QAAVAAVEE

SEQ ID NO: 1510 - protein, 9 aa, Homo Sapiens
LASAFAIAT

SEQ ID NO: 1511 - protein, 9 aa, Homo Sapiens
GDSGLRCLV

SEQ ID NO: 1512 - protein, 9 aa, Homo Sapiens
PETSSLQSL

SEQ ID NO: 1513 - protein, 9 aa, Homo Sapiens
LLYLMKEEI

SEQ ID NO: 1514 - protein, 9 aa, Homo Sapiens
ERCPHRPIL

SEQ ID NO: 1515 - protein, 9 aa, Homo Sapiens
SAFPKQDGG

SEQ ID NO: 1516 - protein, 9 aa, Homo Sapiens
LKSYLLKDT

SEQ ID NO: 1517 - protein, 9 aa, Homo Sapiens
VAPFAPGSE

SEQ ID NO: 1518 - protein, 9 aa, Homo Sapiens
IRGNKHEAE

SEQ ID NO: 1519 - protein, 9 aa, Homo Sapiens
QHVCHPRCI

SEQ ID NO: 1520 - protein, 9 aa, Homo Sapiens
LSLIPAWAL

SEQ ID NO: 1521 - protein, 9 aa, Homo Sapiens
HPLHYLILM

SEQ ID NO: 1522 - protein, 9 aa, Homo Sapiens
AVDWLLDQF

SEQ ID NO: 1523 - protein, 9 aa, Homo Sapiens
HVASRIKTI

SEQ ID NO: 1524 - protein, 9 aa, Homo Sapiens
ECLSLQKLE

SEQ ID NO: 1525 - protein, 9 aa, Homo Sapiens
SKAASCFFS

SEQ ID NO: 1526 - protein, 9 aa, Homo Sapiens
AAGAAQAAV

SEQ ID NO: 1527 - protein, 9 aa, Homo Sapiens
DNMRFLITH

SEQ ID NO: 1528 - protein, 9 aa, Homo Sapiens
EENIREQEE

SEQ ID NO: 1529 - protein, 9 aa, Homo Sapiens
QPVNAAVAH

SEQ ID NO: 1530 - protein, 9 aa, Homo Sapiens
ACLADHVAC

SEQ ID NO: 1531 - protein, 9 aa, Homo Sapiens
LLLQRLQNS

SEQ ID NO: 1532 - protein, 9 aa, Homo Sapiens
YFRFLLDEH

SEQ ID NO: 1533 - protein, 9 aa, Homo Sapiens
AEEVAALLH

SEQ ID NO: 1534 - protein, 9 aa, Homo Sapiens
SDSKASQEE

SEQ ID NO: 1535 - protein, 9 aa, Homo Sapiens
RNKYEIHIP

SEQ ID NO: 1536 - protein, 9 aa, Homo Sapiens
SCFFSTQAH

SEQ ID NO: 1537 - protein, 9 aa, Homo Sapiens
LQPHYSERL

SEQ ID NO: 1538 - protein, 9 aa, Homo Sapiens
RGKLFYVAQ

SEQ ID NO: 1539 - protein, 9 aa, Homo Sapiens
EPGEEKFGR

SEQ ID NO: 1540 - protein, 9 aa, Homo Sapiens
IMTEFTVFT

SEQ ID NO: 1541 - protein, 9 aa, Homo Sapiens
LRLVLRGSR

SEQ ID NO: 1542 - protein, 9 aa, Homo Sapiens
LKLYEAMQP

SEQ ID NO: 1543 - protein, 9 aa, Homo Sapiens
QCSDVTSCL

SEQ ID NO: 1544 - protein, 9 aa, Homo Sapiens
QLHQEQFEV

SEQ ID NO: 1545 - protein, 9 aa, Homo Sapiens
SVSLASAFA

SEQ ID NO: 1546 - protein, 9 aa, Homo Sapiens
PSESCSVQS

SEQ ID NO: 1547 - protein, 9 aa, Homo Sapiens
DRNKYEIHI

SEQ ID NO: 1548 - protein, 9 aa, Homo Sapiens
SYDNMRFLI

SEQ ID NO: 1549 - protein, 9 aa, Homo Sapiens
STGHVTPVH

SEQ ID NO: 1550 - protein, 9 aa, Homo Sapiens
ARNAALFPG

SEQ ID NO: 1551 - protein, 9 aa, Homo Sapiens
VVAVDSDSG

SEQ ID NO: 1552 - protein, 9 aa, Homo Sapiens
TVAGIRVES

SEQ ID NO: 1553 - protein, 9 aa, Homo Sapiens
LLDQFRTMV

SEQ ID NO: 1554 - protein, 9 aa, Homo Sapiens
LFRLGPSLR

SEQ ID NO: 1555 - protein, 9 aa, Homo Sapiens
DFSSFEMQV

SEQ ID NO: 1556 - protein, 9 aa, Homo Sapiens
AIAKTRRPL

SEQ ID NO: 1557 - protein, 9 aa, Homo Sapiens
VLERCPHRP

SEQ ID NO: 1558 - protein, 9 aa, Homo Sapiens
LQCSDVTSC

SEQ ID NO: 1559 - protein, 9 aa, Homo Sapiens
EEVAALLHT

SEQ ID NO: 1560 - protein, 9 aa, Homo Sapiens
LQQPGLPSE

SEQ ID NO: 1561 - protein, 9 aa, Homo Sapiens
SGGHIAYLH

SEQ ID NO: 1562 - protein, 9 aa, Homo Sapiens
PLHYLILMN

SEQ ID NO: 1563 - protein, 9 aa, Homo Sapiens
HALETMGLW

SEQ ID NO: 1564 - protein, 9 aa, Homo Sapiens
TSPYDCEWR

SEQ ID NO: 1565 - protein, 9 aa, Homo Sapiens
YDNMRFLIT

SEQ ID NO: 1566 - protein, 9 aa, Homo Sapiens
SYEKIYNLQ

SEQ ID NO: 1567 - protein, 9 aa, Homo Sapiens
SLQPHYSER

SEQ ID NO: 1568 - protein, 9 aa, Homo Sapiens
EAHAFAEKN

SEQ ID NO: 1569 - protein, 9 aa, Homo Sapiens
DLNADVNVF

SEQ ID NO: 1570 - protein, 9 aa, Homo Sapiens
LCSQFKESM

SEQ ID NO: 1571 - protein, 9 aa, Homo Sapiens
PPVSGTPIP

SEQ ID NO: 1572 - protein, 9 aa, Homo Sapiens
ETCQHVRHS

SEQ ID NO: 1573 - protein, 9 aa, Homo Sapiens
GFVSLFRLG

SEQ ID NO: 1574 - protein, 9 aa, Homo Sapiens
GPKPTTVSC

SEQ ID NO: 1575 - protein, 9 aa, Homo Sapiens
ILLLQRLQN

SEQ ID NO: 1576 - protein, 9 aa, Homo Sapiens
TLAEEVAAL

SEQ ID NO: 1577 - protein, 9 aa, Homo Sapiens
APRPNPPAP

SEQ ID NO: 1578 - protein, 9 aa, Homo Sapiens
HGSGPGARH

SEQ ID NO: 1579 - protein, 9 aa, Homo Sapiens
PVTGQAVVT

SEQ ID NO: 1580 - protein, 9 aa, Homo Sapiens
QIVGDFKSE

SEQ ID NO: 1581 - protein, 9 aa, Homo Sapiens
MCKEINVIS

SEQ ID NO: 1582 - protein, 9 aa, Homo Sapiens
RCPHRPILQ

SEQ ID NO: 1583 - protein, 9 aa, Homo Sapiens
QLVIGSVNG

SEQ ID NO: 1584 - protein, 9 aa, Homo Sapiens
EKDEEEKTL

SEQ ID NO: 1585 - protein, 9 aa, Homo Sapiens
EEVGLLYLM

SEQ ID NO: 1586 - protein, 9 aa, Homo Sapiens
GDPGWGTRV

SEQ ID NO: 1587 - protein, 9 aa, Homo Sapiens
QIAASAKLE

SEQ ID NO: 1588 - protein, 9 aa, Homo Sapiens
FDLISDSKA

SEQ ID NO: 1589 - protein, 9 aa, Homo Sapiens
SVWVGGSIM

SEQ ID NO: 1590 - protein, 9 aa, Homo Sapiens
QQPGLPSES

SEQ ID NO: 1591 - protein, 9 aa, Homo Sapiens
IAASAKLES

SEQ ID NO: 1592 - protein, 9 aa, Homo Sapiens
DVLERCPHR

SEQ ID NO: 1593 - protein, 9 aa, Homo Sapiens
DDGTMCDTC

SEQ ID NO: 1594 - protein, 9 aa, Homo Sapiens
ITVKEALST

SEQ ID NO: 1595 - protein, 9 aa, Homo Sapiens
LSSLEPACS

SEQ ID NO: 1596 - protein, 9 aa, Homo Sapiens
GRSFTQCAH

SEQ ID NO: 1597 - protein, 9 aa, Homo Sapiens
IFTNIEAHL

SEQ ID NO: 1598 - protein, 9 aa, Homo Sapiens
GTTNQQEAL

SEQ ID NO: 1599 - protein, 9 aa, Homo Sapiens
LQSAYELPE

SEQ ID NO: 1600 - protein, 9 aa, Homo Sapiens
LVVPELYAT

SEQ ID NO: 1601 - protein, 9 aa, Homo Sapiens
PFAPGSEDN

SEQ ID NO: 1602 - protein, 9 aa, Homo Sapiens
SERGQEDML

SEQ ID NO: 1603 - protein, 9 aa, Homo Sapiens
DDSRISQDE

SEQ ID NO: 1604 - protein, 9 aa, Homo Sapiens
FRDLNADVN

SEQ ID NO: 1605 - protein, 9 aa, Homo Sapiens
LNSAEGFFV

SEQ ID NO: 1606 - protein, 9 aa, Homo Sapiens
EVGLLYLMK

SEQ ID NO: 1607 - protein, 9 aa, Homo Sapiens
QTRLNPLSF

SEQ ID NO: 1608 - protein, 9 aa, Homo Sapiens
SKLVPVAKV

SEQ ID NO: 1609 - protein, 9 aa, Homo Sapiens
ASAKLESGA

SEQ ID NO: 1610 - protein, 9 aa, Homo Sapiens
FLLDEHHIS

SEQ ID NO: 1611 - protein, 9 aa, Homo Sapiens
ERLRQAITV

SEQ ID NO: 1612 - protein, 9 aa, Homo Sapiens
MQGPPAWPL

SEQ ID NO: 1613 - protein, 9 aa, Homo Sapiens
GAAQAAVAA

SEQ ID NO: 1614 - protein, 9 aa, Homo Sapiens
PTTVSCEMK

SEQ ID NO: 1615 - protein, 9 aa, Homo Sapiens
SSSSSDSNV

SEQ ID NO: 1616 - protein, 9 aa, Homo Sapiens
LLQIPSIIR

SEQ ID NO: 1617 - protein, 9 aa, Homo Sapiens
EISYDNMRF

SEQ ID NO: 1618 - protein, 9 aa, Homo Sapiens
HRSGGHIAY

SEQ ID NO: 1619 - protein, 9 aa, Homo Sapiens
CLSLQKLEI

SEQ ID NO: 1620 - protein, 9 aa, Homo Sapiens
LNTQAHQGH

SEQ ID NO: 1621 - protein, 9 aa, Homo Sapiens
SKDLTSSSR

SEQ ID NO: 1622 - protein, 9 aa, Homo Sapiens
CVPKIADTL

SEQ ID NO: 1623 - protein, 9 aa, Homo Sapiens
ENLVKKRKA

SEQ ID NO: 1624 - protein, 9 aa, Homo Sapiens
LGPITLVFI

SEQ ID NO: 1625 - protein, 9 aa, Homo Sapiens
RPSGQRAAE

SEQ ID NO: 1626 - protein, 9 aa, Homo Sapiens
LEALRSMMK

SEQ ID NO: 1627 - protein, 9 aa, Homo Sapiens
WLLDQFRTM

SEQ ID NO: 1628 - protein, 9 aa, Homo Sapiens
MTFKEKRKC

SEQ ID NO: 1629 - protein, 9 aa, Homo Sapiens
LYEAMQPVY

SEQ ID NO: 1630 - protein, 9 aa, Homo Sapiens
IPLVPENLV

SEQ ID NO: 1631 - protein, 9 aa, Homo Sapiens
ECTRQEQES

SEQ ID NO: 1632 - protein, 9 aa, Homo Sapiens
FTVFTFVNL

SEQ ID NO: 1633 - protein, 9 aa, Homo Sapiens
ENNKIASAT

SEQ ID NO: 1634 - protein, 9 aa, Homo Sapiens
EQEENIREQ

SEQ ID NO: 1635 - protein, 9 aa, Homo Sapiens
KLFYVAQRP

SEQ ID NO: 1636 - protein, 9 aa, Homo Sapiens
LAWVGAPLG

SEQ ID NO: 1637 - protein, 9 aa, Homo Sapiens
KSFNCLGNL

SEQ ID NO: 1638 - protein, 9 aa, Homo Sapiens
RCTPVGGGA

SEQ ID NO: 1639 - protein, 9 aa, Homo Sapiens
EDSEKVEKD

SEQ ID NO: 1640 - protein, 9 aa, Homo Sapiens
GRWWGGEPD

SEQ ID NO: 1641 - protein, 9 aa, Homo Sapiens
ATFWRNNKS

SEQ ID NO: 1642 - protein, 9 aa, Homo Sapiens
TGNYNQNFR

SEQ ID NO: 1643 - protein, 9 aa, Homo Sapiens
GWRARAECS

SEQ ID NO: 1644 - protein, 9 aa, Homo Sapiens
NSESSNHSL

SEQ ID NO: 1645 - protein, 9 aa, Homo Sapiens
DNAHCSVSL

SEQ ID NO: 1646 - protein, 9 aa, Homo Sapiens
EYFRFLLDE

SEQ ID NO: 1647 - protein, 9 aa, Homo Sapiens
SCEMKNKVW

SEQ ID NO: 1648 - protein, 9 aa, Homo Sapiens
SHPLHYLIL

SEQ ID NO: 1649 - protein, 9 aa, Homo Sapiens
SFNCLGNLQ

SEQ ID NO: 1650 - protein, 9 aa, Homo Sapiens
QEDMLPLFH

SEQ ID NO: 1651 - protein, 9 aa, Homo Sapiens
QVEILGRCA

SEQ ID NO: 1652 - protein, 9 aa, Homo Sapiens
KSYLLKDTT

SEQ ID NO: 1653 - protein, 9 aa, Homo Sapiens
SLFRLGPSL

SEQ ID NO: 1654 - protein, 9 aa, Homo Sapiens
TQCAHMLLH

SEQ ID NO: 1655 - protein, 9 aa, Homo Sapiens
ITAHVASRI

SEQ ID NO: 1656 - protein, 9 aa, Homo Sapiens
KDEEEKTLF

SEQ ID NO: 1657 - protein, 9 aa, Homo Sapiens
DGDGNFCDL

SEQ ID NO: 1658 - protein, 9 aa, Homo Sapiens
AYLNSAEGF

SEQ ID NO: 1659 - protein, 9 aa, Homo Sapiens
CPHRPILQA

SEQ ID NO: 1660 - protein, 9 aa, Homo Sapiens
KVEKDEEEK

SEQ ID NO: 1661 - protein, 9 aa, Homo Sapiens
GSKLVPVAK

SEQ ID NO: 1662 - protein, 9 aa, Homo Sapiens
KVAEVRGPA

SEQ ID NO: 1663 - protein, 9 aa, Homo Sapiens
SRQIEYFRF

SEQ ID NO: 1664 - protein, 9 aa, Homo Sapiens
FVSLFRLGP

SEQ ID NO: 1665 - protein, 9 aa, Homo Sapiens
YSSGPGTSL

SEQ ID NO: 1666 - protein, 9 aa, Homo Sapiens
QEQIVGDFK

SEQ ID NO: 1667 - protein, 9 aa, Homo Sapiens
KYEIHIPLP

SEQ ID NO: 1668 - protein, 9 aa, Homo Sapiens
QSLAFREGT

SEQ ID NO: 1669 - protein, 9 aa, Homo Sapiens
SNVSVKKPP

SEQ ID NO: 1670 - protein, 9 aa, Homo Sapiens
TDEAHAFAE

SEQ ID NO: 1671 - protein, 9 aa, Homo Sapiens
ESPEPGEEK

SEQ ID NO: 1672 - protein, 9 aa, Homo Sapiens
SCHAIAKTR

SEQ ID NO: 1673 - protein, 9 aa, Homo Sapiens
SRILTTHKT

SEQ ID NO: 1674 - protein, 9 aa, Homo Sapiens
GIVLGPITL

SEQ ID NO: 1675 - protein, 9 aa, Homo Sapiens
EGEEEVGLL

SEQ ID NO: 1676 - protein, 9 aa, Homo Sapiens
SSKAASCFF

SEQ ID NO: 1677 - protein, 9 aa, Homo Sapiens
PPTECTRQE

SEQ ID NO: 1678 - protein, 9 aa, Homo Sapiens
VDRNKYEIH

SEQ ID NO: 1679 - protein, 9 aa, Homo Sapiens
PFLKLYEAM

SEQ ID NO: 1680 - protein, 9 aa, Homo Sapiens
GHIAYLHVL

SEQ ID NO: 1681 - protein, 9 aa, Homo Sapiens
ITLVFIGII

SEQ ID NO: 1682 - protein, 9 aa, Homo Sapiens
PLHEACLAD

SEQ ID NO: 1683 - protein, 9 aa, Homo Sapiens
ESKWLCSQF

SEQ ID NO: 1684 - protein, 9 aa, Homo Sapiens
EKERQLMGI

SEQ ID NO: 1685 - protein, 9 aa, Homo Sapiens
WRARAECSA

SEQ ID NO: 1686 - protein, 9 aa, Homo Sapiens
HVRHSLQEL

SEQ ID NO: 1687 - protein, 9 aa, Homo Sapiens
CEMKNKVWN

SEQ ID NO: 1688 - protein, 9 aa, Homo Sapiens
ENTETSPYD

SEQ ID NO: 1689 - protein, 9 aa, Homo Sapiens
SLAFREGTS

SEQ ID NO: 1690 - protein, 9 aa, Homo Sapiens
VHVTSPSSA

SEQ ID NO: 1691 - protein, 9 aa, Homo Sapiens
DCRLQNPMY

SEQ ID NO: 1692 - protein, 9 aa, Homo Sapiens
LYATVAGIR

SEQ ID NO: 1693 - protein, 9 aa, Homo Sapiens
SCSERGQED

SEQ ID NO: 1694 - protein, 9 aa, Homo Sapiens
PHYSERLCL

SEQ ID NO: 1695 - protein, 9 aa, Homo Sapiens
EGLFSRIND

SEQ ID NO: 1696 - protein, 9 aa, Homo Sapiens
RKDELPGLQ

SEQ ID NO: 1697 - protein, 9 aa, Homo Sapiens
CAEQLPQIY

SEQ ID NO: 1698 - protein, 9 aa, Homo Sapiens
YENNKIASA

SEQ ID NO: 1699 - protein, 9 aa, Homo Sapiens
YNRGGMPNT

SEQ ID NO: 1700 - protein, 9 aa, Homo Sapiens
EKVEKDEEE

SEQ ID NO: 1701 - protein, 9 aa, Homo Sapiens
NPLSFHLQR

SEQ ID NO: 1702 - protein, 9 aa, Homo Sapiens
TLEPELSAF

SEQ ID NO: 1703 - protein, 9 aa, Homo Sapiens
SMMKAGESA

SEQ ID NO: 1704 - protein, 9 aa, Homo Sapiens
IIPQLCEGL

SEQ ID NO: 1705 - protein, 9 aa, Homo Sapiens
APVEISYDN

SEQ ID NO: 1706 - protein, 9 aa, Homo Sapiens
FTQCAHMLL

SEQ ID NO: 1707 - protein, 9 aa, Homo Sapiens
LQRLQNSKT

SEQ ID NO: 1708 - protein, 9 aa, Homo Sapiens
GVALSLDNV

SEQ ID NO: 1709 - protein, 9 aa, Homo Sapiens
SYLLKDTTS

SEQ ID NO: 1710 - protein, 9 aa, Homo Sapiens
GAACDQHVC

SEQ ID NO: 1711 - protein, 9 aa, Homo Sapiens
SKQLVIGSV

SEQ ID NO: 1712 - protein, 9 aa, Homo Sapiens
TNQQEALQY

SEQ ID NO: 1713 - protein, 9 aa, Homo Sapiens
KCLSRMQRK

SEQ ID NO: 1714 - protein, 9 aa, Homo Sapiens
VKKRKAYQA

SEQ ID NO: 1715 - protein, 9 aa, Homo Sapiens
GNFCDLEFH

SEQ ID NO: 1716 - protein, 9 aa, Homo Sapiens
TAHVASRIK

SEQ ID NO: 1717 - protein, 9 aa, Homo Sapiens
TNIEAHLRA

SEQ ID NO: 1718 - protein, 9 aa, Homo Sapiens
ALSLDNVKR

SEQ ID NO: 1719 - protein, 9 aa, Homo Sapiens
SKWLCSQFK

SEQ ID NO: 1720 - protein, 9 aa, Homo Sapiens
ERLVVWHVH

SEQ ID NO: 1721 - protein, 9 aa, Homo Sapiens
GTFDFSSFE

SEQ ID NO: 1722 - protein, 9 aa, Homo Sapiens
CRPFLKLYE

SEQ ID NO: 1723 - protein, 9 aa, Homo Sapiens
EKFGRWMFH

SEQ ID NO: 1724 - protein, 9 aa, Homo Sapiens
EPACSAKWR

SEQ ID NO: 1725 - protein, 9 aa, Homo Sapiens
LSAKCSASL

SEQ ID NO: 1726 - protein, 9 aa, Homo Sapiens
LAFREGTSL

SEQ ID NO: 1727 - protein, 9 aa, Homo Sapiens
PRERCTPVG

SEQ ID NO: 1728 - protein, 9 aa, Homo Sapiens
KCINSKQLV

SEQ ID NO: 1729 - protein, 9 aa, Homo Sapiens
SKASQEETT

SEQ ID NO: 1730 - protein, 9 aa, Homo Sapiens
CTLEPELSA

SEQ ID NO: 1731 - protein, 9 aa, Homo Sapiens
MQRQYVTFK

SEQ ID NO: 1732 - protein, 9 aa, Homo Sapiens
VGLLYLMKE

SEQ ID NO: 1733 - protein, 9 aa, Homo Sapiens
IFILLLQRL

SEQ ID NO: 1734 - protein, 9 aa, Homo Sapiens
LDNVKRHNP

SEQ ID NO: 1735 - protein, 9 aa, Homo Sapiens
RPPPLRPSG

SEQ ID NO: 1736 - protein, 9 aa, Homo Sapiens
DWAWYNITD

SEQ ID NO: 1737 - protein, 9 aa, Homo Sapiens
NTETSPYDC

SEQ ID NO: 1738 - protein, 9 aa, Homo Sapiens
SDSNVSVKK

SEQ ID NO: 1739 - protein, 9 aa, Homo Sapiens
ISYDNMRFL

SEQ ID NO: 1740 - protein, 9 aa, Homo Sapiens
CSAKWRKYL

SEQ ID NO: 1741 - protein, 9 aa, Homo Sapiens
LILMNQRVC

SEQ ID NO: 1742 - protein, 9 aa, Homo Sapiens
YCAAPERTD

SEQ ID NO: 1743 - protein, 9 aa, Homo Sapiens
ENIREQEEK

SEQ ID NO: 1744 - protein, 9 aa, Homo Sapiens
TSVDCRLQN

SEQ ID NO: 1745 - protein, 9 aa, Homo Sapiens
PYDCEWRCT

SEQ ID NO: 1746 - protein, 9 aa, Homo Sapiens
RNAALFPGE

SEQ ID NO: 1747 - protein, 9 aa, Homo Sapiens
QPHYSERLC

SEQ ID NO: 1748 - protein, 9 aa, Homo Sapiens
NADVSIFLK

SEQ ID NO: 1749 - protein, 9 aa, Homo Sapiens
NRKDELPGL

SEQ ID NO: 1750 - protein, 9 aa, Homo Sapiens
PGKSWILLP

SEQ ID NO: 1751 - protein, 9 aa, Homo Sapiens
RGAVGGRWW

SEQ ID NO: 1752 - protein, 9 aa, Homo Sapiens
DSRISQDET

SEQ ID NO: 1753 - protein, 9 aa, Homo Sapiens
GRCAEQLPQ

SEQ ID NO: 1754 - protein, 9 aa, Homo Sapiens
TGAACDQHV

SEQ ID NO: 1755 - protein, 9 aa, Homo Sapiens
PAPRPNPPA

SEQ ID NO: 1756 - protein, 9 aa, Homo Sapiens
QVDGVVFYR

SEQ ID NO: 1757 - protein, 9 aa, Homo Sapiens
VEKDEEEKT

SEQ ID NO: 1758 - protein, 9 aa, Homo Sapiens
RARAECSAC

SEQ ID NO: 1759 - protein, 9 aa, Homo Sapiens
QLMGIINQL

SEQ ID NO: 1760 - protein, 9 aa, Homo Sapiens
PPTLPLHQS

SEQ ID NO: 1761 - protein, 9 aa, Homo Sapiens
NGPHRLYVQ

SEQ ID NO: 1762 - protein, 9 aa, Homo Sapiens
WALYSGAFQ

SEQ ID NO: 1763 - protein, 9 aa, Homo Sapiens
LVPVAKVAE

SEQ ID NO: 1764 - protein, 9 aa, Homo Sapiens
KSWILLPSS

SEQ ID NO: 1765 - protein, 9 aa, Homo Sapiens
RGNKHEAEK

SEQ ID NO: 1766 - protein, 9 aa, Homo Sapiens
AAVAHSPQT

SEQ ID NO: 1767 - protein, 9 aa, Homo Sapiens
EILGRCAEQ

SEQ ID NO: 1768 - protein, 9 aa, Homo Sapiens
PCGRPPPLR

SEQ ID NO: 1769 - protein, 9 aa, Homo Sapiens
MTSLHKAAK

SEQ ID NO: 1770 - protein, 9 aa, Homo Sapiens
TQVDGVVFY

SEQ ID NO: 1771 - protein, 9 aa, Homo Sapiens
ADHVACART

SEQ ID NO: 1772 - protein, 9 aa, Homo Sapiens
PQPPAPRPN

SEQ ID NO: 1773 - protein, 9 aa, Homo Sapiens
FRLGPSLRD

SEQ ID NO: 1774 - protein, 9 aa, Homo Sapiens
LQKLEIDLL

SEQ ID NO: 1775 - protein, 9 aa, Homo Sapiens
LYCAAPERT

SEQ ID NO: 1776 - protein, 9 aa, Homo Sapiens
TVSCEMKNK

SEQ ID NO: 1777 - protein, 9 aa, Homo Sapiens
CRKSFNCLG

SEQ ID NO: 1778 - protein, 9 aa, Homo Sapiens
QYVTFKPQT

SEQ ID NO: 1779 - protein, 9 aa, Homo Sapiens
MKAGESASP

SEQ ID NO: 1780 - protein, 9 aa, Homo Sapiens
TRQEQESPC

SEQ ID NO: 1781 - protein, 9 aa, Homo Sapiens
CTRQEQESP

SEQ ID NO: 1782 - protein, 9 aa, Homo Sapiens
IIRSIHQDK

SEQ ID NO: 1783 - protein, 9 aa, Homo Sapiens
KDIMQRQYV

SEQ ID NO: 1784 - protein, 9 aa, Homo Sapiens
DEAHAFAEK

SEQ ID NO: 1785 - protein, 9 aa, Homo Sapiens
DQFRTMVNV

SEQ ID NO: 1786 - protein, 9 aa, Homo Sapiens
PFDLISDSK

SEQ ID NO: 1787 - protein, 9 aa, Homo Sapiens
SLHKAAKRG

SEQ ID NO: 1788 - protein, 9 aa, Homo Sapiens
IREQEENIR

SEQ ID NO: 1789 - protein, 9 aa, Homo Sapiens
KRGHGDICS

SEQ ID NO: 1790 - protein, 9 aa, Homo Sapiens
SSSSSSDSN

SEQ ID NO: 1791 - protein, 9 aa, Homo Sapiens
KAYLNSAEG

SEQ ID NO: 1792 - protein, 9 aa, Homo Sapiens
HYLILMNQR

SEQ ID NO: 1793 - protein, 9 aa, Homo Sapiens
AVPTDEAHA

SEQ ID NO: 1794 - protein, 9 aa, Homo Sapiens
LGRCAEQLP

SEQ ID NO: 1795 - protein, 9 aa, Homo Sapiens
NKHEAEKLM

SEQ ID NO: 1796 - protein, 9 aa, Homo Sapiens
SAKCSASLC

SEQ ID NO: 1797 - protein, 9 aa, Homo Sapiens
DMLPLFHHL

SEQ ID NO: 1798 - protein, 9 aa, Homo Sapiens
NPLQERIQD

SEQ ID NO: 1799 - protein, 9 aa, Homo Sapiens
IVLGPITLV

SEQ ID NO: 1800 - protein, 9 aa, Homo Sapiens
SAKLESGAM

SEQ ID NO: 1801 - protein, 9 aa, Homo Sapiens
QGPPAWPLR

SEQ ID NO: 1802 - protein, 9 aa, Homo Sapiens
RRLQCSDVT

SEQ ID NO: 1803 - protein, 9 aa, Homo Sapiens
HKAAKRGHG

SEQ ID NO: 1804 - protein, 9 aa, Homo Sapiens
GHVTPVHVT

SEQ ID NO: 1805 - protein, 9 aa, Homo Sapiens
PCTCHALET

SEQ ID NO: 1806 - protein, 9 aa, Homo Sapiens
YLILMNQRV

SEQ ID NO: 1807 - protein, 9 aa, Homo Sapiens
LDLAERAVV

SEQ ID NO: 1808 - protein, 9 aa, Homo Sapiens
GPPTECTRQ

SEQ ID NO: 1809 - protein, 9 aa, Homo Sapiens
NAAVAHSPQ

SEQ ID NO: 1810 - protein, 9 aa, Homo Sapiens
LVECLPQVP

SEQ ID NO: 1811 - protein, 9 aa, Homo Sapiens
DSKASQEET

SEQ ID NO: 1812 - protein, 9 aa, Homo Sapiens
FWRNNKSNK

SEQ ID NO: 1813 - protein, 9 aa, Homo Sapiens
KISKSEKTL

SEQ ID NO: 1814 - protein, 9 aa, Homo Sapiens
RILTTHKTI

SEQ ID NO: 1815 - protein, 9 aa, Homo Sapiens
TDTEQETLY

SEQ ID NO: 1816 - protein, 9 aa, Homo Sapiens
HCSVSLASA

SEQ ID NO: 1817 - protein, 9 aa, Homo Sapiens
GAVGGRWWG

SEQ ID NO: 1818 - protein, 9 aa, Homo Sapiens
SLEPACSAK

SEQ ID NO: 1819 - protein, 9 aa, Homo Sapiens
VTDWAWYNI

SEQ ID NO: 1820 - protein, 9 aa, Homo Sapiens
GPRERCTPV

SEQ ID NO: 1821 - protein, 9 aa, Homo Sapiens
PLNSESSNH

SEQ ID NO: 1822 - protein, 9 aa, Homo Sapiens
NIEAHLRAD

SEQ ID NO: 1823 - protein, 9 aa, Homo Sapiens
TEFTVFTFV

SEQ ID NO: 1824 - protein, 9 aa, Homo Sapiens
INSKQLVIG

SEQ ID NO: 1825 - protein, 9 aa, Homo Sapiens
EACLADHVA

SEQ ID NO: 1826 - protein, 9 aa, Homo Sapiens
IAVDWLLDQ

SEQ ID NO: 1827 - protein, 9 aa, Homo Sapiens
QRGAVGGRW

SEQ ID NO: 1828 - protein, 9 aa, Homo Sapiens
SIFLKEANQ

SEQ ID NO: 1829 - protein, 9 aa, Homo Sapiens
FQLNTQAHQ

SEQ ID NO: 1830 - protein, 9 aa, Homo Sapiens
YATVAGIRV

SEQ ID NO: 1831 - protein, 9 aa, Homo Sapiens
ERTDTCEHS

SEQ ID NO: 1832 - protein, 9 aa, Homo Sapiens
TGHVTPVHV

SEQ ID NO: 1833 - protein, 9 aa, Homo Sapiens
AITVKEALS

SEQ ID NO: 1834 - protein, 9 aa, Homo Sapiens
RPFLKLYEA

SEQ ID NO: 1835 - protein, 9 aa, Homo Sapiens
FYVAQRPYM

SEQ ID NO: 1836 - protein, 9 aa, Homo Sapiens
DLEFHLRPP

SEQ ID NO: 1837 - protein, 9 aa, Homo Sapiens
GIIPQLCEG

SEQ ID NO: 1838 - protein, 9 aa, Homo Sapiens
SGPGARHEA

SEQ ID NO: 1839 - protein, 9 aa, Homo Sapiens
SSDSNVSVK

SEQ ID NO: 1840 - protein, 9 aa, Homo Sapiens
LHPVTGQAV

SEQ ID NO: 1841 - protein, 9 aa, Homo Sapiens
GQEDMLPLF

SEQ ID NO: 1842 - protein, 9 aa, Homo Sapiens
RLVVWHVHS

SEQ ID NO: 1843 - protein, 9 aa, Homo Sapiens
HSLQELPAG

SEQ ID NO: 1844 - protein, 9 aa, Homo Sapiens
SNHSLCSVG

SEQ ID NO: 1845 - protein, 9 aa, Homo Sapiens
NSAEGFFVL

SEQ ID NO: 1846 - protein, 9 aa, Homo Sapiens
AGAAQAAVA

SEQ ID NO: 1847 - protein, 9 aa, Homo Sapiens
RRPLKDFIW

SEQ ID NO: 1848 - protein, 9 aa, Homo Sapiens
SVLDLAERA

SEQ ID NO: 1849 - protein, 9 aa, Homo Sapiens
GPITLVFIG

SEQ ID NO: 1850 - protein, 9 aa, Homo Sapiens
LVLRGSREL

SEQ ID NO: 1851 - protein, 9 aa, Homo Sapiens
ANPARNAAL

SEQ ID NO: 1852 - protein, 9 aa, Homo Sapiens
PAWALYSGA

SEQ ID NO: 1853 - protein, 9 aa, Homo Sapiens
EMQVPPPAH

SEQ ID NO: 1854 - protein, 9 aa, Homo Sapiens
SIQEQIVGD

SEQ ID NO: 1855 - protein, 9 aa, Homo Sapiens
ETSSLQSLA

SEQ ID NO: 1856 - protein, 9 aa, Homo Sapiens
RLLLQIPSI

SEQ ID NO: 1857 - protein, 9 aa, Homo Sapiens
NLVKKRKAY

SEQ ID NO: 1858 - protein, 9 aa, Homo Sapiens
GMPNTGNYN

SEQ ID NO: 1859 - protein, 9 aa, Homo Sapiens
CLSAKCSAS

SEQ ID NO: 1860 - protein, 9 aa, Homo Sapiens
MCCPLVAQP

SEQ ID NO: 1861 - protein, 9 aa, Homo Sapiens
TRRPLKDFI

SEQ ID NO: 1862 - protein, 9 aa, Homo Sapiens
EKIYNLQSA

SEQ ID NO: 1863 - protein, 9 aa, Homo Sapiens
PGWGTRVPG

SEQ ID NO: 1864 - protein, 9 aa, Homo Sapiens
QDETDTEQE

SEQ ID NO: 1865 - protein, 9 aa, Homo Sapiens
TVFTFVNLP

SEQ ID NO: 1866 - protein, 9 aa, Homo Sapiens
ERCTPVGGG

SEQ ID NO: 1867 - protein, 9 aa, Homo Sapiens
KLVLKGQMC

SEQ ID NO: 1868 - protein, 9 aa, Homo Sapiens
PSGQRAAEP

SEQ ID NO: 1869 - protein, 9 aa, Homo Sapiens
DCPSPCTCH

SEQ ID NO: 1870 - protein, 9 aa, Homo Sapiens
PARNAALFP

SEQ ID NO: 1871 - protein, 9 aa, Homo Sapiens
LTSVDCRLQ

SEQ ID NO: 1872 - protein, 9 aa, Homo Sapiens
NKYEIHIPL

SEQ ID NO: 1873 - protein, 9 aa, Homo Sapiens
RLVLRGSRE

SEQ ID NO: 1874 - protein, 9 aa, Homo Sapiens
PVAKVAEVR

SEQ ID NO: 1875 - protein, 9 aa, Homo Sapiens
KYTSKDLTS

SEQ ID NO: 1876 - protein, 9 aa, Homo Sapiens
SSFEMQVPP

SEQ ID NO: 1877 - protein, 9 aa, Homo Sapiens
PTEGTPPPV

SEQ ID NO: 1878 - protein, 9 aa, Homo Sapiens
DGNFCDLEF

SEQ ID NO: 1879 - protein, 9 aa, Homo Sapiens
GSRELGTFH

SEQ ID NO: 1880 - protein, 9 aa, Homo Sapiens
KHKYTSKDL

SEQ ID NO: 1881 - protein, 9 aa, Homo Sapiens
RLRQAITVK

SEQ ID NO: 1882 - protein, 9 aa, Homo Sapiens
AKCSASLCF

SEQ ID NO: 1883 - protein, 9 aa, Homo Sapiens
GRPPPLRPS

SEQ ID NO: 1884 - protein, 9 aa, Homo Sapiens
APLGSSGGI

SEQ ID NO: 1885 - protein, 9 aa, Homo Sapiens
NGGYKFRWA

SEQ ID NO: 1886 - protein, 9 aa, Homo Sapiens
GNMCCPLVA

SEQ ID NO: 1887 - protein, 9 aa, Homo Sapiens
EKIREQEEN

SEQ ID NO: 1888 - protein, 9 aa, Homo Sapiens
ETDTEQETL

SEQ ID NO: 1889 - protein, 9 aa, Homo Sapiens
SDVTSCLGC

SEQ ID NO: 1890 - protein, 9 aa, Homo Sapiens
SLSHQIMED

SEQ ID NO: 1891 - protein, 9 aa, Homo Sapiens
QLNTQAHQG

SEQ ID NO: 1892 - protein, 9 aa, Homo Sapiens
KGVALSLDN

SEQ ID NO: 1893 - protein, 9 aa, Homo Sapiens
LCEGLFSRI

SEQ ID NO: 1894 - protein, 9 aa, Homo Sapiens
GSGPGARHE

SEQ ID NO: 1895 - protein, 9 aa, Homo Sapiens
LIPAWALYS

SEQ ID NO: 1896 - protein, 9 aa, Homo Sapiens
DQHVCHPRC

SEQ ID NO: 1897 - protein, 9 aa, Homo Sapiens
LERLRQAIT

SEQ ID NO: 1898 - protein, 9 aa, Homo Sapiens
PVGGGAEPR

SEQ ID NO: 1899 - protein, 9 aa, Homo Sapiens
TCHALETMG

SEQ ID NO: 1900 - protein, 9 aa, Homo Sapiens
TLDVLERCP

SEQ ID NO: 1901 - protein, 9 aa, Homo Sapiens
TRLNPLSFH

SEQ ID NO: 1902 - protein, 9 aa, Homo Sapiens
ISSKAASCF

SEQ ID NO: 1903 - protein, 9 aa, Homo Sapiens
SQDSVLDLA

SEQ ID NO: 1904 - protein, 9 aa, Homo Sapiens
SSLEPACSA

SEQ ID NO: 1905 - protein, 9 aa, Homo Sapiens
RHEAFKTSS

SEQ ID NO: 1906 - protein, 9 aa, Homo Sapiens
KTRRPLKDF

SEQ ID NO: 1907 - protein, 9 aa, Homo Sapiens
EQFEVVVIL

SEQ ID NO: 1908 - protein, 9 aa, Homo Sapiens
INNADVSIF

SEQ ID NO: 1909 - protein, 9 aa, Homo Sapiens
PLGSSGGIC

SEQ ID NO: 1910 - protein, 9 aa, Homo Sapiens
DWLLDQFRT

SEQ ID NO: 1911 - protein, 9 aa, Homo Sapiens
PEPGEEKFG

SEQ ID NO: 1912 - protein, 9 aa, Homo Sapiens
VAALLHTLH

SEQ ID NO: 1913 - protein, 9 aa, Homo Sapiens
WEWRYRLYK

SEQ ID NO: 1914 - protein, 9 aa, Homo Sapiens
RDWIFQLNT

SEQ ID NO: 1915 - protein, 9 aa, Homo Sapiens
DSEKVEKDE

SEQ ID NO: 1916 - protein, 9 aa, Homo Sapiens
GLFSRINDT

SEQ ID NO: 1917 - protein, 9 aa, Homo Sapiens
IINQLTSLR

SEQ ID NO: 1918 - protein, 9 aa, Homo Sapiens
VWVGGSIMA

SEQ ID NO: 1919 - protein, 9 aa, Homo Sapiens
ACDQHVCHP

SEQ ID NO: 1920 - protein, 9 aa, Homo Sapiens
SWILLPSSM

SEQ ID NO: 1921 - protein, 9 aa, Homo Sapiens
VTFKPQTFT

SEQ ID NO: 1922 - protein, 9 aa, Homo Sapiens
EKTLLTPER

SEQ ID NO: 1923 - protein, 9 aa, Homo Sapiens
FAPGSEDNF

SEQ ID NO: 1924 - protein, 9 aa, Homo Sapiens
DEEGCLSAK

SEQ ID NO: 1925 - protein, 9 aa, Homo Sapiens
LMGIINQLT

SEQ ID NO: 1926 - protein, 9 aa, Homo Sapiens
ELYATVAGI

SEQ ID NO: 1927 - protein, 9 aa, Homo Sapiens
QIFILLLQR

SEQ ID NO: 1928 - protein, 9 aa, Homo Sapiens
TSKDLTSSS

SEQ ID NO: 1929 - protein, 9 aa, Homo Sapiens
NVSVKKPPR

SEQ ID NO: 1930 - protein, 9 aa, Homo Sapiens
DWIFQLNTQ

SEQ ID NO: 1931 - protein, 9 aa, Homo Sapiens
IPAWALYSG

SEQ ID NO: 1932 - protein, 9 aa, Homo Sapiens
CDQHVCHPR

SEQ ID NO: 1933 - protein, 9 aa, Homo Sapiens
PVHVTSPSS

SEQ ID NO: 1934 - protein, 9 aa, Homo Sapiens
CQHVRHSLQ

SEQ ID NO: 1935 - protein, 9 aa, Homo Sapiens
NNKIASATH

SEQ ID NO: 1936 - protein, 9 aa, Homo Sapiens
YVQMSTHGK

SEQ ID NO: 1937 - protein, 9 aa, Homo Sapiens
ECTLEPELS

SEQ ID NO: 1938 - protein, 9 aa, Homo Sapiens
GNKHEAEKL

SEQ ID NO: 1939 - protein, 9 aa, Homo Sapiens
VTKVVAVDS

SEQ ID NO: 1940 - protein, 9 aa, Homo Sapiens
GENTETSPY

SEQ ID NO: 1941 - protein, 9 aa, Homo Sapiens
GWGTRVPGG

SEQ ID NO: 1942 - protein, 9 aa, Homo Sapiens
VPTDEAHAF

SEQ ID NO: 1943 - protein, 9 aa, Homo Sapiens
LQERIQDWK

SEQ ID NO: 1944 - protein, 9 aa, Homo Sapiens
TGIKDDGTM

SEQ ID NO: 1945 - protein, 9 aa, Homo Sapiens
MAQVARQAQ

SEQ ID NO: 1946 - protein, 9 aa, Homo Sapiens
DSGLRCLVE

SEQ ID NO: 1947 - protein, 9 aa, Homo Sapiens
QDWKKAANQ

SEQ ID NO: 1948 - protein, 9 aa, Homo Sapiens
TLQTRLNPL

SEQ ID NO: 1949 - protein, 9 aa, Homo Sapiens
KLVPVAKVA

SEQ ID NO: 1950 - protein, 9 aa, Homo Sapiens
ADVNVFQRK

SEQ ID NO: 1951 - protein, 9 aa, Homo Sapiens
GGMPNTGNY

SEQ ID NO: 1952 - protein, 9 aa, Homo Sapiens
STATFWRNN

SEQ ID NO: 1953 - protein, 9 aa, Homo Sapiens
EETCQHVRH

SEQ ID NO: 1954 - protein, 9 aa, Homo Sapiens
PITLVFIGI

SEQ ID NO: 1955 - protein, 9 aa, Homo Sapiens
CSQFKESML

SEQ ID NO: 1956 - protein, 9 aa, Homo Sapiens
RQLMGIINQ

SEQ ID NO: 1957 - protein, 9 aa, Homo Sapiens
ALRSMMKAG

SEQ ID NO: 1958 - protein, 9 aa, Homo Sapiens
ISQDETERN

SEQ ID NO: 1959 - protein, 9 aa, Homo Sapiens
KQIFILLLQ

SEQ ID NO: 1960 - protein, 9 aa, Homo Sapiens
SFTQCAHML

SEQ ID NO: 1961 - protein, 9 aa, Homo Sapiens
SIIRSIHQD

SEQ ID NO: 1962 - protein, 9 aa, Homo Sapiens
VRQNPCGRP

SEQ ID NO: 1963 - protein, 9 aa, Homo Sapiens
REQEENIRE

SEQ ID NO: 1964 - protein, 9 aa, Homo Sapiens
PELSAFPKQ

SEQ ID NO: 1965 - protein, 9 aa, Homo Sapiens
EAMQPVYTS

SEQ ID NO: 1966 - protein, 9 aa, Homo Sapiens
VSLFRLGPS

SEQ ID NO: 1967 - protein, 9 aa, Homo Sapiens
RSMMKAGES

SEQ ID NO: 1968 - protein, 9 aa, Homo Sapiens
HSLCSVGSL

SEQ ID NO: 1969 - protein, 9 aa, Homo Sapiens
VLKGQMCKE

SEQ ID NO: 1970 - protein, 9 aa, Homo Sapiens
GPGTSLEAQ

SEQ ID NO: 1971 - protein, 9 aa, Homo Sapiens
PHRLYVQMS

SEQ ID NO: 1972 - protein, 9 aa, Homo Sapiens
GARHEAFKT

SEQ ID NO: 1973 - protein, 9 aa, Homo Sapiens
RERCTPVGG

SEQ ID NO: 1974 - protein, 9 aa, Homo Sapiens
ISHPLHYLI

SEQ ID NO: 1975 - protein, 9 aa, Homo Sapiens
LQIPSIIRS

SEQ ID NO: 1976 - protein, 9 aa, Homo Sapiens
CSDVTSCLG

SEQ ID NO: 1977 - protein, 9 aa, Homo Sapiens
NITFLMDLL

SEQ ID NO: 1978 - protein, 9 aa, Homo Sapiens
PNPPAPAPL

SEQ ID NO: 1979 - protein, 9 aa, Homo Sapiens
APFAPGSED

SEQ ID NO: 1980 - protein, 9 aa, Homo Sapiens
GQRAAEPRL

SEQ ID NO: 1981 - protein, 9 aa, Homo Sapiens
DPGWGTRVP

SEQ ID NO: 1982 - protein, 9 aa, Homo Sapiens
QIPSIIRSI

SEQ ID NO: 1983 - protein, 9 aa, Homo Sapiens
LYGNMCCPL

SEQ ID NO: 1984 - protein, 9 aa, Homo Sapiens
VVFYRIYSA

SEQ ID NO: 1985 - protein, 9 aa, Homo Sapiens
NVRCLVLEY

SEQ ID NO: 1986 - protein, 9 aa, Homo Sapiens
EEGCLSAKC

SEQ ID NO: 1987 - protein, 9 aa, Homo Sapiens
AHVASRIKT

SEQ ID NO: 1988 - protein, 9 aa, Homo Sapiens
EIIITSLSH

SEQ ID NO: 1989 - protein, 9 aa, Homo Sapiens
GPGKSWILL

SEQ ID NO: 1990 - protein, 9 aa, Homo Sapiens
LYENNKIAS

SEQ ID NO: 1991 - protein, 9 aa, Homo Sapiens
SGLRCLVEC

SEQ ID NO: 1992 - protein, 9 aa, Homo Sapiens
CSACLETFG

SEQ ID NO: 1993 - protein, 9 aa, Homo Sapiens
GTSLEAQGK

SEQ ID NO: 1994 - protein, 9 aa, Homo Sapiens
LHKAAKRGH

SEQ ID NO: 1995 - protein, 9 aa, Homo Sapiens
INPLQERIQ

SEQ ID NO: 1996 - protein, 9 aa, Homo Sapiens
MGIINQLTS

SEQ ID NO: 1997 - protein, 9 aa, Homo Sapiens
RISQDETER

SEQ ID NO: 1998 - protein, 9 aa, Homo Sapiens
TECTRQEQE

SEQ ID NO: 1999 - protein, 9 aa, Homo Sapiens
CPSPCTCHA

SEQ ID NO: 2000 - protein, 9 aa, Homo Sapiens
AECSACLET

SEQ ID NO: 2001 - protein, 9 aa, Homo Sapiens
KEKRKCLSR

SEQ ID NO: 2002 - protein, 9 aa, Homo Sapiens
EAQIAASAK

SEQ ID NO: 2003 - protein, 9 aa, Homo Sapiens
IQEQIVGDF

SEQ ID NO: 2004 - protein, 9 aa, Homo Sapiens
VAKVAEVRG

SEQ ID NO: 2005 - protein, 9 aa, Homo Sapiens
FRFLLDEHH

SEQ ID NO: 2006 - protein, 9 aa, Homo Sapiens
VQFRDLNAD

SEQ ID NO: 2007 - protein, 9 aa, Homo Sapiens
SEKVEKDEE

SEQ ID NO: 2008 - protein, 9 aa, Homo Sapiens
ADVSIFLKE

SEQ ID NO: 2009 - protein, 9 aa, Homo Sapiens
QERIQDWKK

SEQ ID NO: 2010 - protein, 9 aa, Homo Sapiens
ILTTHKTIH

SEQ ID NO: 2011 - protein, 9 aa, Homo Sapiens
VPENLVKKR

SEQ ID NO: 2012 - protein, 9 aa, Homo Sapiens
ESSNHSLCS

SEQ ID NO: 2013 - protein, 9 aa, Homo Sapiens
ATLQTRLNP

SEQ ID NO: 2014 - protein, 9 aa, Homo Sapiens
RGSRELGTF

SEQ ID NO: 2015 - protein, 9 aa, Homo Sapiens
PNTGNYNQN

SEQ ID NO: 2016 - protein, 9 aa, Homo Sapiens
PTIRGNKHE

SEQ ID NO: 2017 - protein, 9 aa, Homo Sapiens
KRKCLSRMQ

SEQ ID NO: 2018 - protein, 9 aa, Homo Sapiens
LERLVVWHV

SEQ ID NO: 2019 - protein, 9 aa, Homo Sapiens
VDSDSGQNA

SEQ ID NO: 2020 - protein, 9 aa, Homo Sapiens
VLFSNNITF

SEQ ID NO: 2021 - protein, 9 aa, Homo Sapiens
HVTPVHVTS

SEQ ID NO: 2022 - protein, 9 aa, Homo Sapiens
RPNPPAPAP

SEQ ID NO: 2023 - protein, 9 aa, Homo Sapiens
LSHQIMEDS

SEQ ID NO: 2024 - protein, 9 aa, Homo Sapiens
YTSKDLTSS

SEQ ID NO: 2025 - protein, 9 aa, Homo Sapiens
AQVARQAQT

SEQ ID NO: 2026 - protein, 9 aa, Homo Sapiens
GTPPPVSGT

SEQ ID NO: 2027 - protein, 9 aa, Homo Sapiens
QEQFEVVVI

SEQ ID NO: 2028 - protein, 9 aa, Homo Sapiens
RGQEDMLPL

SEQ ID NO: 2029 - protein, 9 aa, Homo Sapiens
WIFQLNTQA

SEQ ID NO: 2030 - protein, 9 aa, Homo Sapiens
HQIMEDSPP

SEQ ID NO: 2031 - protein, 9 aa, Homo Sapiens
SEKTLLTPE

SEQ ID NO: 2032 - protein, 9 aa, Homo Sapiens
FKWITAHVA

SEQ ID NO: 2033 - protein, 9 aa, Homo Sapiens
CSERGQEDM

SEQ ID NO: 2034 - protein, 9 aa, Homo Sapiens
VLFTEEHGT

SEQ ID NO: 2035 - protein, 9 aa, Homo Sapiens
AKGRLESAL

SEQ ID NO: 2036 - protein, 9 aa, Homo Sapiens
VSGTPIPVP

SEQ ID NO: 2037 - protein, 9 aa, Homo Sapiens
QETLYSSKH

SEQ ID NO: 2038 - protein, 9 aa, Homo Sapiens
SSGPGTSLE

SEQ ID NO: 2039 - protein, 9 aa, Homo Sapiens
WKREILRHY

SEQ ID NO: 2040 - protein, 9 aa, Homo Sapiens
LFTEEHGTE

SEQ ID NO: 2041 - protein, 9 aa, Homo Sapiens
GLQLEWIDS

SEQ ID NO: 2042 - protein, 9 aa, Homo Sapiens
PVTDWAWYN

SEQ ID NO: 2043 - protein, 9 aa, Homo Sapiens
YNITDSEDK

SEQ ID NO: 2044 - protein, 9 aa, Homo Sapiens
TIPLCLAAK

SEQ ID NO: 2045 - protein, 9 aa, Homo Sapiens
LCLAAKGRL

SEQ ID NO: 2046 - protein, 9 aa, Homo Sapiens
FCDLEFHLR

SEQ ID NO: 2047 - protein, 9 aa, Homo Sapiens
GLKSYLLKD

SEQ ID NO: 2048 - protein, 9 aa, Homo Sapiens
NMCCPLVAQ

SEQ ID NO: 2049 - protein, 9 aa, Homo Sapiens
VVAPFAPGS

SEQ ID NO: 2050 - protein, 9 aa, Homo Sapiens
SVDCRLQNP

SEQ ID NO: 2051 - protein, 9 aa, Homo Sapiens
AAQAAVAAV

SEQ ID NO: 2052 - protein, 9 aa, Homo Sapiens
RCAEQLPQI

SEQ ID NO: 2053 - protein, 9 aa, Homo Sapiens
TGLKSYLLK

SEQ ID NO: 2054 - protein, 9 aa, Homo Sapiens
TEQETLYSS

SEQ ID NO: 2055 - protein, 9 aa, Homo Sapiens
KLESGAMPW

SEQ ID NO: 2056 - protein, 9 aa, Homo Sapiens
QFRTMVNVL

SEQ ID NO: 2057 - protein, 9 aa, Homo Sapiens
AASCFFSTQ

SEQ ID NO: 2058 - protein, 9 aa, Homo Sapiens
SLASAFAIA

SEQ ID NO: 2059 - protein, 9 aa, Homo Sapiens
AVAHSPQTI

SEQ ID NO: 2060 - protein, 9 aa, Homo Sapiens
HQEQFEVVV

SEQ ID NO: 2061 - protein, 9 aa, Homo Sapiens
WILLPSSMS

SEQ ID NO: 2062 - protein, 9 aa, Homo Sapiens
LDQFRTMVN

SEQ ID NO: 2063 - protein, 9 aa, Homo Sapiens
AVGGRWWGG

SEQ ID NO: 2064 - protein, 9 aa, Homo Sapiens
SISSKAASC

SEQ ID NO: 2065 - protein, 9 aa, Homo Sapiens
TPPPVSGTP

SEQ ID NO: 2066 - protein, 9 aa, Homo Sapiens
CAHMLLHQR

SEQ ID NO: 2067 - protein, 9 aa, Homo Sapiens
DLAERAVVR

SEQ ID NO: 2068 - protein, 9 aa, Homo Sapiens
NVKRHNPCE

SEQ ID NO: 2069 - protein, 9 aa, Homo Sapiens
EVAALLHTL

SEQ ID NO: 2070 - protein, 9 aa, Homo Sapiens
FEMQVPPPA

SEQ ID NO: 2071 - protein, 9 aa, Homo Sapiens
KHEAEKLMT

SEQ ID NO: 2072 - protein, 9 aa, Homo Sapiens
GGTTNQQEA

SEQ ID NO: 2073 - protein, 9 aa, Homo Sapiens
AGIVLGPIT

SEQ ID NO: 2074 - protein, 9 aa, Homo Sapiens
FSSFEMQVP

SEQ ID NO: 2075 - protein, 9 aa, Homo Sapiens
SHQIMEDSP

SEQ ID NO: 2076 - protein, 9 aa, Homo Sapiens
CLVLEYGSL

SEQ ID NO: 2077 - protein, 9 aa, Homo Sapiens
RLYVQMSTH

SEQ ID NO: 2078 - protein, 9 aa, Homo Sapiens
QQEALQYAK

SEQ ID NO: 2079 - protein, 9 aa, Homo Sapiens
ISDSKASQE

SEQ ID NO: 2080 - protein, 9 aa, Homo Sapiens
MKAYLNSAE

SEQ ID NO: 2081 - protein, 9 aa, Homo Sapiens
KECRKSFNC

SEQ ID NO: 2082 - protein, 9 aa, Homo Sapiens
KGQMCKEIN

SEQ ID NO: 2083 - protein, 9 aa, Homo Sapiens
EFTVFTFVN

SEQ ID NO: 2084 - protein, 9 aa, Homo Sapiens
QPGLPSESC

SEQ ID NO: 2085 - protein, 9 aa, Homo Sapiens
VNVRCLVLE

SEQ ID NO: 2086 - protein, 9 aa, Homo Sapiens
GEEKFGRWM

SEQ ID NO: 2087 - protein, 9 aa, Homo Sapiens
CRLQNPMYF

SEQ ID NO: 2088 - protein, 9 aa, Homo Sapiens
NKIASATHN

SEQ ID NO: 2089 - protein, 9 aa, Homo Sapiens
AWALYSGAF

SEQ ID NO: 2090 - protein, 9 aa, Homo Sapiens
YVNRNGDVH

SEQ ID NO: 2091 - protein, 9 aa, Homo Sapiens
GAPLGSSGG

SEQ ID NO: 2092 - protein, 9 aa, Homo Sapiens
HAIAKTRRP

SEQ ID NO: 2093 - protein, 9 aa, Homo Sapiens
AASAKLESG

SEQ ID NO: 2094 - protein, 9 aa, Homo Sapiens
MMKAGESAS

SEQ ID NO: 2095 - protein, 9 aa, Homo Sapiens
GIKDDGTMC

SEQ ID NO: 2096 - protein, 9 aa, Homo Sapiens
SNNITFLMD

SEQ ID NO: 2097 - protein, 9 aa, Homo Sapiens
RPSSWRQKK

SEQ ID NO: 2098 - protein, 9 aa, Homo Sapiens
IAYLHVLAV

SEQ ID NO: 2099 - protein, 9 aa, Homo Sapiens
RFLLDEHHI

SEQ ID NO: 2100 - protein, 9 aa, Homo Sapiens
KDELPGLQL

SEQ ID NO: 2101 - protein, 9 aa, Homo Sapiens
FNCLGNLQR

SEQ ID NO: 2102 - protein, 9 aa, Homo Sapiens
SWRQKKITR

SEQ ID NO: 2103 - protein, 9 aa, Homo Sapiens
ATVAGIRVE

SEQ ID NO: 2104 - protein, 9 aa, Homo Sapiens
EGTPPPVSG

SEQ ID NO: 2105 - protein, 9 aa, Homo Sapiens
CLGNLQRHM

SEQ ID NO: 2106 - protein, 9 aa, Homo Sapiens
RCLVLEYGS

SEQ ID NO: 2107 - protein, 9 aa, Homo Sapiens
GQMCKEINV

SEQ ID NO: 2108 - protein, 9 aa, Homo Sapiens
CPLVAQPAC

SEQ ID NO: 2109 - protein, 9 aa, Homo Sapiens
ARHEAFKTS

SEQ ID NO: 2110 - protein, 9 aa, Homo Sapiens
IAKTRRPLK

SEQ ID NO: 2111 - protein, 9 aa, Homo Sapiens
CHAIAKTRR

SEQ ID NO: 2112 - protein, 9 aa, Homo Sapiens
VECLPQVPI

SEQ ID NO: 2113 - protein, 9 aa, Homo Sapiens
AESLQPHYS

SEQ ID NO: 2114 - protein, 9 aa, Homo Sapiens
NADVNVFQR

SEQ ID NO: 2115 - protein, 9 aa, Homo Sapiens
TGPPTECTR

SEQ ID NO: 2116 - protein, 9 aa, Homo Sapiens
QDETERNGD

SEQ ID NO: 2117 - protein, 9 aa, Homo Sapiens
ASVVAPFAP

SEQ ID NO: 2118 - protein, 9 aa, Homo Sapiens
DSGFVSLFR

SEQ ID NO: 2119 - protein, 9 aa, Homo Sapiens
NFCDLEFHL

SEQ ID NO: 2120 - protein, 9 aa, Homo Sapiens
APTGIKDDG

SEQ ID NO: 2121 - protein, 9 aa, Homo Sapiens
CAAPERTDT

SEQ ID NO: 2122 - protein, 9 aa, Homo Sapiens
PKPTTVSCE

SEQ ID NO: 2123 - protein, 9 aa, Homo Sapiens
TSSLQSLAF

SEQ ID NO: 2124 - protein, 9 aa, Homo Sapiens
DVTSCLGCL

SEQ ID NO: 2125 - protein, 9 aa, Homo Sapiens
GDSGFVSLF

SEQ ID NO: 2126 - protein, 9 aa, Homo Sapiens
LNSESSNHS

SEQ ID NO: 2127 - protein, 9 aa, Homo Sapiens
SDVLFSNNI

SEQ ID NO: 2128 - protein, 9 aa, Homo Sapiens
KWITAHVAS

SEQ ID NO: 2129 - protein, 9 aa, Homo Sapiens
ASTGHVTPV

SEQ ID NO: 2130 - protein, 9 aa, Homo Sapiens
TPLHEACLA

SEQ ID NO: 2131 - protein, 9 aa, Homo Sapiens
KLYENNKIA

SEQ ID NO: 2132 - protein, 9 aa, Homo Sapiens
CINSKQLVI

SEQ ID NO: 2133 - protein, 9 aa, Homo Sapiens
IFKWITAHV

SEQ ID NO: 2134 - protein, 9 aa, Homo Sapiens
FSIMTEFTV

SEQ ID NO: 2135 - protein, 9 aa, Homo Sapiens
PLCLAAKGR

SEQ ID NO: 2136 - protein, 9 aa, Homo Sapiens
QMCKEINVI

SEQ ID NO: 2137 - protein, 9 aa, Homo Sapiens
SRISQDETE

SEQ ID NO: 2138 - protein, 9 aa, Homo Sapiens
IPLCLAAKG

SEQ ID NO: 2139 - protein, 9 aa, Homo Sapiens
PACSAKWRK

SEQ ID NO: 2140 - protein, 9 aa, Homo Sapiens
CGRSFTQCA

SEQ ID NO: 2141 - protein, 9 aa, Homo Sapiens
NAALFPGEE

SEQ ID NO: 2142 - protein, 9 aa, Homo Sapiens
PVNAAVAHS

SEQ ID NO: 2143 - protein, 9 aa, Homo Sapiens
LAESLQPHY

SEQ ID NO: 2144 - protein, 9 aa, Homo Sapiens
HEAFKTSSR

SEQ ID NO: 2145 - protein, 9 aa, Homo Sapiens
CFFSTQAHV

SEQ ID NO: 2146 - protein, 9 aa, Homo Sapiens
LHQEQFEVV

SEQ ID NO: 2147 - protein, 9 aa, Homo Sapiens
TWLHPVTGQ

SEQ ID NO: 2148 - protein, 9 aa, Homo Sapiens
QNPCGRPPP

SEQ ID NO: 2149 - protein, 9 aa, Homo Sapiens
VLGPITLVF

SEQ ID NO: 2150 - protein, 9 aa, Homo Sapiens
VAHSPQTIP

SEQ ID NO: 2151 - protein, 9 aa, Homo Sapiens
LEFHLRPPS

SEQ ID NO: 2152 - protein, 9 aa, Homo Sapiens
VALSLDNVK

SEQ ID NO: 2153 - protein, 9 aa, Homo Sapiens
QEENIREQE

SEQ ID NO: 2154 - protein, 9 aa, Homo Sapiens
KCSASLCFH

SEQ ID NO: 2155 - protein, 9 aa, Homo Sapiens
SRELGTFHS

SEQ ID NO: 2156 - protein, 9 aa, Homo Sapiens
MPNTGNYNQ

SEQ ID NO: 2157 - protein, 9 aa, Homo Sapiens
NTGNYNQNF

SEQ ID NO: 2158 - protein, 9 aa, Homo Sapiens
KKITRTKEE

SEQ ID NO: 2159 - protein, 9 aa, Homo Sapiens
VFYRIYSAV

SEQ ID NO: 2160 - protein, 9 aa, Homo Sapiens
PLRPSGQRA

SEQ ID NO: 2161 - protein, 9 aa, Homo Sapiens
CTCHALETM

SEQ ID NO: 2162 - protein, 9 aa, Homo Sapiens
EAHLRADPS

SEQ ID NO: 2163 - protein, 9 aa, Homo Sapiens
GEEEVGLLY

SEQ ID NO: 2164 - protein, 9 aa, Homo Sapiens
TKVVAVDSD

SEQ ID NO: 2165 - protein, 9 aa, Homo Sapiens
TETSPYDCE

SEQ ID NO: 2166 - protein, 9 aa, Homo Sapiens
DNVKRHNPC

SEQ ID NO: 2167 - protein, 9 aa, Homo Sapiens
PLVAQPACM

SEQ ID NO: 2168 - protein, 9 aa, Homo Sapiens
KREILRHYV

SEQ ID NO: 2169 - protein, 9 aa, Homo Sapiens
IIITSLSHQ

SEQ ID NO: 2170 - protein, 9 aa, Homo Sapiens
ERGKLFYVA

SEQ ID NO: 2171 - protein, 9 aa, Homo Sapiens
PRPNPPAPA

SEQ ID NO: 2172 - protein, 9 aa, Homo Sapiens
SPCTCHALE

SEQ ID NO: 2173 - protein, 9 aa, Homo Sapiens
KAASCFFST

SEQ ID NO: 2174 - protein, 9 aa, Homo Sapiens
QLCEGLFSR

SEQ ID NO: 2175 - protein, 9 aa, Homo Sapiens
AHLRADPSW

SEQ ID NO: 2176 - protein, 9 aa, Homo Sapiens
LLLQIPSII

SEQ ID NO: 2177 - protein, 9 aa, Homo Sapiens
WRNNKSNKV

SEQ ID NO: 2178 - protein, 9 aa, Homo Sapiens
PTECTRQEQ

SEQ ID NO: 2179 - protein, 9 aa, Homo Sapiens
TEGTPPPVS

SEQ ID NO: 2180 - protein, 9 aa, Homo Sapiens
QHVRHSLQE

SEQ ID NO: 2181 - protein, 9 aa, Homo Sapiens
FSNNITFLM

SEQ ID NO: 2182 - protein, 9 aa, Homo Sapiens
NIREQEEKM

SEQ ID NO: 2183 - protein, 9 aa, Homo Sapiens
KASQEETTK

SEQ ID NO: 2184 - protein, 9 aa, Homo Sapiens
ARAECSACL

SEQ ID NO: 2185 - protein, 9 aa, Homo Sapiens
TSLHKAAKR

SEQ ID NO: 2186 - protein, 9 aa, Homo Sapiens
PVSIQEQIV

SEQ ID NO: 2187 - protein, 9 aa, Homo Sapiens
TFDFSSFEM

SEQ ID NO: 2188 - protein, 9 aa, Homo Sapiens
CSDVLFSNN

SEQ ID NO: 2189 - protein, 9 aa, Homo Sapiens
NAHCSVSLA

SEQ ID NO: 2190 - protein, 9 aa, Homo Sapiens
HEAEKLMTL

SEQ ID NO: 2191 - protein, 9 aa, Homo Sapiens
HTPVSIQEQ

SEQ ID NO: 2192 - protein, 9 aa, Homo Sapiens
FDFSSFEMQ

SEQ ID NO: 2193 - protein, 9 aa, Homo Sapiens
AHAFAEKNN

SEQ ID NO: 2194 - protein, 9 aa, Homo Sapiens
FTNIEAHLR

SEQ ID NO: 2195 - protein, 9 aa, Homo Sapiens
SKSEKTLLT

SEQ ID NO: 2196 - protein, 9 aa, Homo Sapiens
SLEAQGKAS

SEQ ID NO: 2197 - protein, 9 aa, Homo Sapiens
SESCSVQSS

SEQ ID NO: 2198 - protein, 9 aa, Homo Sapiens
ERQLMGIIN

SEQ ID NO: 2199 - protein, 9 aa, Homo Sapiens
TLVFIGIIS

SEQ ID NO: 2200 - protein, 9 aa, Homo Sapiens
IYNLQSAYE

SEQ ID NO: 2201 - protein, 9 aa, Homo Sapiens
KAAKRGHGD

SEQ ID NO: 2202 - protein, 9 aa, Homo Sapiens
RDLNADVNV

SEQ ID NO: 2203 - protein, 9 aa, Homo Sapiens
SLIPAWALY

SEQ ID NO: 2204 - protein, 9 aa, Homo Sapiens
PPAPRPNPP

SEQ ID NO: 2205 - protein, 9 aa, Homo Sapiens
TSLSHQIME

SEQ ID NO: 2206 - protein, 9 aa, Homo Sapiens
GVVFYRIYS

SEQ ID NO: 2207 - protein, 9 aa, Homo Sapiens
CTPVGGGAE

SEQ ID NO: 2208 - protein, 9 aa, Homo Sapiens
QAITVKEAL

SEQ ID NO: 2209 - protein, 9 aa, Homo Sapiens
LQTRLNPLS

SEQ ID NO: 2210 - protein, 9 aa, Homo Sapiens
QIEYFRFLL

SEQ ID NO: 2211 - protein, 9 aa, Homo Sapiens
EEKFGRWMF

SEQ ID NO: 2212 - protein, 9 aa, Homo Sapiens
KSQDSVLDL

SEQ ID NO: 2213 - protein, 9 aa, Homo Sapiens
GCLSAKCSA

SEQ ID NO: 2214 - protein, 9 aa, Homo Sapiens
QEALQYAKN

SEQ ID NO: 2215 - protein, 9 aa, Homo Sapiens
LQSLAFREG

SEQ ID NO: 2216 - protein, 9 aa, Homo Sapiens
RSGGHIAYL

SEQ ID NO: 2217 - protein, 9 aa, Homo Sapiens
AKLESGAMP

SEQ ID NO: 2218 - protein, 9 aa, Homo Sapiens
YGNMCCPLV

SEQ ID NO: 2219 - protein, 9 aa, Homo Sapiens
RLYKRMKTG

SEQ ID NO: 2220 - protein, 9 aa, Homo Sapiens
ELSAFPKQD

SEQ ID NO: 2221 - protein, 9 aa, Homo Sapiens
SSSDSNVSV

SEQ ID NO: 2222 - protein, 9 aa, Homo Sapiens
DGVVFYRIY

SEQ ID NO: 2223 - protein, 9 aa, Homo Sapiens
LVPENLVKK

SEQ ID NO: 2224 - protein, 9 aa, Homo Sapiens
QFEVVVILE

SEQ ID NO: 2225 - protein, 9 aa, Homo Sapiens
MAAGAAQAA

SEQ ID NO: 2226 - protein, 9 aa, Homo Sapiens
NKSNKVLPM

SEQ ID NO: 2227 - protein, 9 aa, Homo Sapiens
ILLPSSMSE

SEQ ID NO: 2228 - protein, 9 aa, Homo Sapiens
YEIHIPLPP

SEQ ID NO: 2229 - protein, 9 aa, Homo Sapiens
HPVTGQAVV

SEQ ID NO: 2230 - protein, 9 aa, Homo Sapiens
WITAHVASR

SEQ ID NO: 2231 - protein, 9 aa, Homo Sapiens
CLSRMQRKW

SEQ ID NO: 2232 - protein, 9 aa, Homo Sapiens
DELPGLQLE

SEQ ID NO: 2233 - protein, 9 aa, Homo Sapiens
ITLTSVDCR

SEQ ID NO: 2234 - protein, 9 aa, Homo Sapiens
VLRGSRELG

SEQ ID NO: 2235 - protein, 9 aa, Homo Sapiens
EWRYRLYKR

SEQ ID NO: 2236 - protein, 9 aa, Homo Sapiens
RNRKDELPG

SEQ ID NO: 2237 - protein, 9 aa, Homo Sapiens
YNLQSAYEL

SEQ ID NO: 2238 - protein, 9 aa, Homo Sapiens
AKTRRPLKD

SEQ ID NO: 2239 - protein, 9 aa, Homo Sapiens
VGVDRNKYE

SEQ ID NO: 2240 - protein, 9 aa, Homo Sapiens
VTPVHVTSP

SEQ ID NO: 2241 - protein, 9 aa, Homo Sapiens
DLNCVPKIA

SEQ ID NO: 2242 - protein, 9 aa, Homo Sapiens
DSNVSVKKP

SEQ ID NO: 2243 - protein, 9 aa, Homo Sapiens
LFYVAQRPY

SEQ ID NO: 2244 - protein, 9 aa, Homo Sapiens
MTEFTVFTF

SEQ ID NO: 2245 - protein, 9 aa, Homo Sapiens
RKSFNCLGN

SEQ ID NO: 2246 - protein, 9 aa, Homo Sapiens
SSNHSLCSV

SEQ ID NO: 2247 - protein, 9 aa, Homo Sapiens
LAEEVAALL

SEQ ID NO: 2248 - protein, 9 aa, Homo Sapiens
CLAAKGRLE

SEQ ID NO: 2249 - protein, 9 aa, Homo Sapiens
YVTFKPQTF

SEQ ID NO: 2250 - protein, 9 aa, Homo Sapiens
FKEKRKCLS

SEQ ID NO: 2251 - protein, 9 aa, Homo Sapiens
SKLYENNKI

SEQ ID NO: 2252 - protein, 9 aa, Homo Sapiens
LFSNNITFL

SEQ ID NO: 2253 - protein, 9 aa, Homo Sapiens
EQIVGDFKS

SEQ ID NO: 2254 - protein, 9 aa, Homo Sapiens
TIRGNKHEA

SEQ ID NO: 2255 - protein, 9 aa, Homo Sapiens
YLNSAEGFF

SEQ ID NO: 2256 - protein, 9 aa, Homo Sapiens
KVQFRDLNA

SEQ ID NO: 2257 - protein, 9 aa, Homo Sapiens
AQLHQEQFE

SEQ ID NO: 2258 - protein, 9 aa, Homo Sapiens
SKHKYTSKD

SEQ ID NO: 2259 - protein, 9 aa, Homo Sapiens
NRGGMPNTG

SEQ ID NO: 2260 - protein, 9 aa, Homo Sapiens
CLVECLPQV

SEQ ID NO: 2261 - protein, 9 aa, Homo Sapiens
SQDETERNG

SEQ ID NO: 2262 - protein, 9 aa, Homo Sapiens
NTQAHQGHW

SEQ ID NO: 2263 - protein, 9 aa, Homo Sapiens
PTDEAHAFA

SEQ ID NO: 2264 - protein, 9 aa, Homo Sapiens
TDTCEHSSE

SEQ ID NO: 2265 - protein, 9 aa, Homo Sapiens
TPVSIQEQI

SEQ ID NO: 2266 - protein, 9 aa, Homo Sapiens
IEYFRFLLD

SEQ ID NO: 2267 - protein, 9 aa, Homo Sapiens
RAECSACLE

SEQ ID NO: 2268 - protein, 9 aa, Homo Sapiens
ASCFFSTQA

SEQ ID NO: 2269 - protein, 9 aa, Homo Sapiens
GVDRNKYEI

SEQ ID NO: 2270 - protein, 9 aa, Homo Sapiens
IEKCINSKQ

SEQ ID NO: 2271 - protein, 9 aa, Homo Sapiens
FQDETDTEQ

SEQ ID NO: 2272 - protein, 9 aa, Homo Sapiens
PLQERIQDW

SEQ ID NO: 2273 - protein, 9 aa, Homo Sapiens
LEAQGKASV

SEQ ID NO: 2274 - protein, 9 aa, Homo Sapiens
VLRLVLRGS

SEQ ID NO: 2275 - protein, 9 aa, Homo Sapiens
KPPTLPLHQ

SEQ ID NO: 2276 - protein, 9 aa, Homo Sapiens
EQETLYSSK

SEQ ID NO: 2277 - protein, 9 aa, Homo Sapiens
TSCLGCLRE

SEQ ID NO: 2278 - protein, 9 aa, Homo Sapiens
ESCSVQSSG

SEQ ID NO: 2279 - protein, 9 aa, Homo Sapiens
TLSSLEPAC

SEQ ID NO: 2280 - protein, 9 aa, Homo Sapiens
QQVEILGRC

SEQ ID NO: 2281 - protein, 9 aa, Homo Sapiens
VASRIKTIY

SEQ ID NO: 2282 - protein, 9 aa, Homo Sapiens
LYSGAFQRL

SEQ ID NO: 2283 - protein, 9 aa, Homo Sapiens
PKIADTLGA

SEQ ID NO: 2284 - protein, 9 aa, Homo Sapiens
AAKGRLESA

SEQ ID NO: 2285 - protein, 9 aa, Homo Sapiens
PPLRPSGQR

SEQ ID NO: 2286 - protein, 9 aa, Homo Sapiens
LLPSSMSEP

SEQ ID NO: 2287 - protein, 9 aa, Homo Sapiens
DCGRSFTQC

SEQ ID NO: 2288 - protein, 9 aa, Homo Sapiens
ESLQPHYSE

SEQ ID NO: 2289 - protein, 9 aa, Homo Sapiens
VGGRWWGGE

SEQ ID NO: 2290 - protein, 9 aa, Homo Sapiens
NPCGRPPPL

SEQ ID NO: 2291 - protein, 9 aa, Homo Sapiens
IFQLNTQAH

SEQ ID NO: 2292 - protein, 9 aa, Homo Sapiens
DETDTEQET

SEQ ID NO: 2293 - protein, 9 aa, Homo Sapiens
DVSIFLKEA

SEQ ID NO: 2294 - protein, 9 aa, Homo Sapiens
LADHVACAR

SEQ ID NO: 2295 - protein, 9 aa, Homo Sapiens
VLSKLYENN

SEQ ID NO: 2296 - protein, 9 aa, Homo Sapiens
SEKISKSEK

SEQ ID NO: 2297 - protein, 9 aa, Homo Sapiens
HINNADVSI

SEQ ID NO: 2298 - protein, 9 aa, Homo Sapiens
TTNQQEALQ

SEQ ID NO: 2299 - protein, 9 aa, Homo Sapiens
AISHPLHYL

SEQ ID NO: 2300 - protein, 9 aa, Homo Sapiens
AHSPQTIPI

SEQ ID NO: 2301 - protein, 9 aa, Homo Sapiens
EECLSLQKL

SEQ ID NO: 2302 - protein, 9 aa, Homo Sapiens
LGSSGGICE

SEQ ID NO: 2303 - protein, 9 aa, Homo Sapiens
ITSLSHQIM

SEQ ID NO: 2304 - protein, 9 aa, Homo Sapiens
LRCLVECLP

SEQ ID NO: 2305 - protein, 9 aa, Homo Sapiens
ELPGLQLEW

SEQ ID NO: 2306 - protein, 9 aa, Homo Sapiens
SQFKESMLT

SEQ ID NO: 2307 - protein, 9 aa, Homo Sapiens
HRLYVQMST

SEQ ID NO: 2308 - protein, 9 aa, Homo Sapiens
NPPAPAPLA

SEQ ID NO: 2309 - protein, 9 aa, Homo Sapiens
SLQKLEIDL

SEQ ID NO: 2310 - protein, 9 aa, Homo Sapiens
SKEECLSLQ

SEQ ID NO: 2311 - protein, 9 aa, Homo Sapiens
PLTGLKSYL

SEQ ID NO: 2312 - protein, 9 aa, Homo Sapiens
TLTSVDCRL

SEQ ID NO: 2313 - protein, 9 aa, Homo Sapiens
NNADVSIFL

SEQ ID NO: 2314 - protein, 9 aa, Homo Sapiens
CFSIMTEFT

SEQ ID NO: 2315 - protein, 9 aa, Homo Sapiens
LAAKGRLES

SEQ ID NO: 2316 - protein, 9 aa, Homo Sapiens
GAANPARNA

SEQ ID NO: 2317 - protein, 9 aa, Homo Sapiens
AQRPYMTLG

SEQ ID NO: 2318 - protein, 9 aa, Homo Sapiens
HLRADPSWL

SEQ ID NO: 2319 - protein, 9 aa, Homo Sapiens
THKTIHTGE

SEQ ID NO: 2320 - protein, 9 aa, Homo Sapiens
FTEEHGTEF

SEQ ID NO: 2321 - protein, 9 aa, Homo Sapiens
EIHIPLPPK

SEQ ID NO: 2322 - protein, 9 aa, Homo Sapiens
ERGQEDMLP

SEQ ID NO: 2323 - protein, 9 aa, Homo Sapiens
SIMTEFTVF

SEQ ID NO: 2324 - protein, 9 aa, Homo Sapiens
VDCRLQNPM

SEQ ID NO: 2325 - protein, 9 aa, Homo Sapiens
AANPARNAA

SEQ ID NO: 2326 - protein, 9 aa, Homo Sapiens
CGRPPPLRP

SEQ ID NO: 2327 - protein, 9 aa, Homo Sapiens
TTQVDGVVF

SEQ ID NO: 2328 - protein, 9 aa, Homo Sapiens
NSKQLVIGS

SEQ ID NO: 2329 - protein, 9 aa, Homo Sapiens
ETSPYDCEW

SEQ ID NO: 2330 - protein, 9 aa, Homo Sapiens
QPPAPRPNP

SEQ ID NO: 2331 - protein, 9 aa, Homo Sapiens
IEAHLRADP

SEQ ID NO: 2332 - protein, 9 aa, Homo Sapiens
QFKESMLTL

SEQ ID NO: 2333 - protein, 9 aa, Homo Sapiens
NNITFLMDL

SEQ ID NO: 2334 - protein, 9 aa, Homo Sapiens
RKCLSRMQR

SEQ ID NO: 2335 - protein, 9 aa, Homo Sapiens
VAVDSDSGQ

SEQ ID NO: 2336 - protein, 9 aa, Homo Sapiens
LKGQMCKEI

SEQ ID NO: 2337 - protein, 9 aa, Homo Sapiens
HADDSRISQ

SEQ ID NO: 2338 - protein, 9 aa, Homo Sapiens
AWYNITDSE

SEQ ID NO: 2339 - protein, 9 aa, Homo Sapiens
FILLLQRLQ

SEQ ID NO: 2340 - protein, 9 aa, Homo Sapiens
VTSCLGCLR

SEQ ID NO: 2341 - protein, 9 aa, Homo Sapiens
HKPPTLPLH

SEQ ID NO: 2342 - protein, 9 aa, Homo Sapiens
LRHYVNRNG

SEQ ID NO: 2343 - protein, 9 aa, Homo Sapiens
PGTSLEAQG

SEQ ID NO: 2344 - protein, 9 aa, Homo Sapiens
ISKSEKTLL

SEQ ID NO: 2345 - protein, 9 aa, Homo Sapiens
GQAVVTGHR

SEQ ID NO: 2346 - protein, 9 aa, Homo Sapiens
AYLHVLAVH

SEQ ID NO: 2347 - protein, 9 aa, Homo Sapiens
PGARHEAFK

SEQ ID NO: 2348 - protein, 9 aa, Homo Sapiens
QRQYVTFKP

SEQ ID NO: 2349 - protein, 9 aa, Homo Sapiens
SGPGTSLEA

SEQ ID NO: 2350 - protein, 9 aa, Homo Sapiens
WAWYNITDS

SEQ ID NO: 2351 - protein, 9 aa, Homo Sapiens
RQKKITRTK

SEQ ID NO: 2352 - protein, 9 aa, Homo Sapiens
EGCLSAKCS

SEQ ID NO: 2353 - protein, 9 aa, Homo Sapiens
LEYGSLERS

SEQ ID NO: 2354 - protein, 9 aa, Homo Sapiens
EQRGAVGGR

SEQ ID NO: 2355 - protein, 9 aa, Homo Sapiens
NITDSEDKA

SEQ ID NO: 2356 - protein, 9 aa, Homo Sapiens
RLNPLSFHL

SEQ ID NO: 2357 - protein, 9 aa, Homo Sapiens
CSVSLASAF

SEQ ID NO: 2358 - protein, 9 aa, Homo Sapiens
MGGTTNQQE

SEQ ID NO: 2359 - protein, 9 aa, Homo Sapiens
VQMSTHGKV

SEQ ID NO: 2360 - protein, 9 aa, Homo Sapiens
NCLGNLQRH

SEQ ID NO: 2361 - protein, 9 aa, Homo Sapiens
QDSVLDLAE

SEQ ID NO: 2362 - protein, 9 aa, Homo Sapiens
DVRQNPCGR

SEQ ID NO: 2363 - protein, 9 aa, Homo Sapiens
VPELYATVA

SEQ ID NO: 2364 - protein, 9 aa, Homo Sapiens
LMGGTTNQQ

SEQ ID NO: 2365 - protein, 9 aa, Homo Sapiens
VLDLAERAV

SEQ ID NO: 2366 - protein, 9 aa, Homo Sapiens
GKLFYVAQR

SEQ ID NO: 2367 - protein, 9 aa, Homo Sapiens
SPYDCEWRC

SEQ ID NO: 2368 - protein, 9 aa, Homo Sapiens
GIINQLTSL

SEQ ID NO: 2369 - protein, 9 aa, Homo Sapiens
PTGIKDDGT

SEQ ID NO: 2370 - protein, 9 aa, Homo Sapiens
PVLFTEEHG

SEQ ID NO: 2371 - protein, 9 aa, Homo Sapiens
VSLASAFAI

SEQ ID NO: 2372 - protein, 9 aa, Homo Sapiens
ECSACLETF

SEQ ID NO: 2373 - protein, 9 aa, Homo Sapiens
RSFTQCAHM

SEQ ID NO: 2374 - protein, 9 aa, Homo Sapiens
HIAYLHVLA

SEQ ID NO: 2375 - protein, 9 aa, Homo Sapiens
EDMLPLFHH

SEQ ID NO: 2376 - protein, 9 aa, Homo Sapiens
VSIQEQIVG

SEQ ID NO: 2377 - protein, 9 aa, Homo Sapiens
NQQEALQYA

SEQ ID NO: 2378 - protein, 9 aa, Homo Sapiens
LRSMMKAGE

SEQ ID NO: 2379 - protein, 9 aa, Homo Sapiens
EALRSMMKA

SEQ ID NO: 2380 - protein, 9 aa, Homo Sapiens
GPGARHEAF

SEQ ID NO: 2381 - protein, 9 aa, Homo Sapiens
LISDSKASQ

SEQ ID NO: 2382 - protein, 9 aa, Homo Sapiens
GLPSESCSV

SEQ ID NO: 2383 - protein, 9 aa, Homo Sapiens
IPQLCEGLF

SEQ ID NO: 2384 - protein, 9 aa, Homo Sapiens
DVLFSNNIT

SEQ ID NO: 2385 - protein, 9 aa, Homo Sapiens
LRPSGQRAA

SEQ ID NO: 2386 - protein, 9 aa, Homo Sapiens
KDDGTMCDT

SEQ ID NO: 2387 - protein, 9 aa, Homo Sapiens
VPKIADTLG

SEQ ID NO: 2388 - protein, 9 aa, Homo Sapiens
LERCPHRPI

SEQ ID NO: 2389 - protein, 9 aa, Homo Sapiens
RCLVECLPQ

SEQ ID NO: 2390 - protein, 9 aa, Homo Sapiens
KIREQEENI

SEQ ID NO: 2391 - protein, 9 aa, Homo Sapiens
LTGLKSYLL

SEQ ID NO: 2392 - protein, 9 aa, Homo Sapiens
VEILGRCAE

SEQ ID NO: 2393 - protein, 9 aa, Homo Sapiens
VDWLLDQFR

SEQ ID NO: 2394 - protein, 9 aa, Homo Sapiens
LRQAITVKE

SEQ ID NO: 2395 - protein, 9 aa, Homo Sapiens
SGFVSLFRL

SEQ ID NO: 2396 - protein, 9 aa, Homo Sapiens
SFEMQVPPP

SEQ ID NO: 2397 - protein, 9 aa, Homo Sapiens
REILRHYVN

SEQ ID NO: 2398 - protein, 9 aa, Homo Sapiens
YEAMQPVYT

SEQ ID NO: 2399 - protein, 9 aa, Homo Sapiens
PERTDTCEH

SEQ ID NO: 2400 - protein, 9 aa, Homo Sapiens
QSAYELPER

SEQ ID NO: 2401 - protein, 9 aa, Homo Sapiens
TPVGGGAEP

SEQ ID NO: 2402 - protein, 9 aa, Homo Sapiens
EKRKCLSRM

SEQ ID NO: 2403 - protein, 9 aa, Homo Sapiens
YEKIYNLQS

SEQ ID NO: 2404 - protein, 9 aa, Homo Sapiens
GYKFRWAPS

SEQ ID NO: 2405 - protein, 9 aa, Homo Sapiens
VLEYGSLER

SEQ ID NO: 2406 - protein, 9 aa, Homo Sapiens
SAPTGIKDD

SEQ ID NO: 2407 - protein, 9 aa, Homo Sapiens
GLRCLVECL

SEQ ID NO: 2408 - protein, 9 aa, Homo Sapiens
EPELSAFPK

SEQ ID NO: 2409 - protein, 9 aa, Homo Sapiens
FLKLYEAMQ

SEQ ID NO: 2410 - protein, 9 aa, Homo Sapiens
SASVVAPFA

SEQ ID NO: 2411 - protein, 9 aa, Homo Sapiens
KPTTVSCEM

SEQ ID NO: 2412 - protein, 9 aa, Homo Sapiens
PAPVEISYD

SEQ ID NO: 2413 - protein, 9 aa, Homo Sapiens
EEEVGLLYL

SEQ ID NO: 2414 - protein, 9 aa, Homo Sapiens
RTDTCEHSS

SEQ ID NO: 2415 - protein, 9 aa, Homo Sapiens
LHEACLADH

SEQ ID NO: 2416 - protein, 9 aa, Homo Sapiens
TGQAVVTGH

SEQ ID NO: 2417 - protein, 9 aa, Homo Sapiens
RYRLYKRMK

SEQ ID NO: 2418 - protein, 9 aa, Homo Sapiens
MALERLVVW

SEQ ID NO: 2419 - protein, 9 aa, Homo Sapiens
TILAIDIGQ

SEQ ID NO: 2420 - protein, 9 aa, Homo Sapiens
EQEARTREP

SEQ ID NO: 2421 - protein, 9 aa, Homo Sapiens
RKESDQELQ

SEQ ID NO: 2422 - protein, 9 aa, Homo Sapiens
STHSQRNNA

SEQ ID NO: 2423 - protein, 9 aa, Homo Sapiens
MKLWILRLL

SEQ ID NO: 2424 - protein, 9 aa, Homo Sapiens
NSTVIEKWM

SEQ ID NO: 2425 - protein, 9 aa, Homo Sapiens
QIAKNKEIE

SEQ ID NO: 2426 - protein, 9 aa, Homo Sapiens
QEETMRRQE

SEQ ID NO: 2427 - protein, 9 aa, Homo Sapiens
SASGVESLS

SEQ ID NO: 2428 - protein, 9 aa, Homo Sapiens
THSQRNNAS

SEQ ID NO: 2429 - protein, 9 aa, Homo Sapiens
HRRHHRCRC

SEQ ID NO: 2430 - protein, 9 aa, Homo Sapiens
QGPPALLQA

SEQ ID NO: 2431 - protein, 9 aa, Homo Sapiens
VVNHSNDCC

SEQ ID NO: 2432 - protein, 9 aa, Homo Sapiens
IAKNKEIEK

SEQ ID NO: 2433 - protein, 9 aa, Homo Sapiens
HNLVPNSLS

SEQ ID NO: 2434 - protein, 9 aa, Homo Sapiens
TAPPVQLGL

SEQ ID NO: 2435 - protein, 9 aa, Homo Sapiens
NLRLVRGTQ

SEQ ID NO: 2436 - protein, 9 aa, Homo Sapiens
GEEDPQKQQ

SEQ ID NO: 2437 - protein, 9 aa, Homo Sapiens
ISRGCDFCQ

SEQ ID NO: 2438 - protein, 9 aa, Homo Sapiens
QESTKMKLW

SEQ ID NO: 2439 - protein, 9 aa, Homo Sapiens
KCHNKQVEG

SEQ ID NO: 2440 - protein, 9 aa, Homo Sapiens
CCVTVTGPD

SEQ ID NO: 2441 - protein, 9 aa, Homo Sapiens
FESYITNLQ

SEQ ID NO: 2442 - protein, 9 aa, Homo Sapiens
SSASGVESL

SEQ ID NO: 2443 - protein, 9 aa, Homo Sapiens
AEPYSSRSV

SEQ ID NO: 2444 - protein, 9 aa, Homo Sapiens
GTKLWKNSY

SEQ ID NO: 2445 - protein, 9 aa, Homo Sapiens
GVPPHLGHH

SEQ ID NO: 2446 - protein, 9 aa, Homo Sapiens
VGRQNHKVV

SEQ ID NO: 2447 - protein, 9 aa, Homo Sapiens
RYLESRPVK

SEQ ID NO: 2448 - protein, 9 aa, Homo Sapiens
PHLGHHFHW

SEQ ID NO: 2449 - protein, 9 aa, Homo Sapiens
YAQTPLGRL

SEQ ID NO: 2450 - protein, 9 aa, Homo Sapiens
LSSSIISVA

SEQ ID NO: 2451 - protein, 9 aa, Homo Sapiens
SSKCHNKQV

SEQ ID NO: 2452 - protein, 9 aa, Homo Sapiens
TKMKLWILR

SEQ ID NO: 2453 - protein, 9 aa, Homo Sapiens
MGSAERIER

SEQ ID NO: 2454 - protein, 9 aa, Homo Sapiens
KYGEKTKTV

SEQ ID NO: 2455 - protein, 9 aa, Homo Sapiens
ISSLSNSVV

SEQ ID NO: 2456 - protein, 9 aa, Homo Sapiens
AERIERVYF

SEQ ID NO: 2457 - protein, 9 aa, Homo Sapiens
PIPLDPKEN

SEQ ID NO: 2458 - protein, 9 aa, Homo Sapiens
ISSTQSGDS

SEQ ID NO: 2459 - protein, 9 aa, Homo Sapiens
MSVIRPHWP

SEQ ID NO: 2460 - protein, 9 aa, Homo Sapiens
THEQIRKEI

SEQ ID NO: 2461 - protein, 9 aa, Homo Sapiens
QEYFSGEEC

SEQ ID NO: 2462 - protein, 9 aa, Homo Sapiens
VFSTDSYLQ

SEQ ID NO: 2463 - protein, 9 aa, Homo Sapiens
AEPPGVLEQ

SEQ ID NO: 2464 - protein, 9 aa, Homo Sapiens
MKLLLFLRL

SEQ ID NO: 2465 - protein, 9 aa, Homo Sapiens
EPYSSRSVP

SEQ ID NO: 2466 - protein, 9 aa, Homo Sapiens
VNFESFEVG

SEQ ID NO: 2467 - protein, 9 aa, Homo Sapiens
TLPLPNLRL

SEQ ID NO: 2468 - protein, 9 aa, Homo Sapiens
LESRPVKLF

SEQ ID NO: 2469 - protein, 9 aa, Homo Sapiens
FCWKRKREW

SEQ ID NO: 2470 - protein, 9 aa, Homo Sapiens
CLHTHVLEK

SEQ ID NO: 2471 - protein, 9 aa, Homo Sapiens
WILRLLCFQ

SEQ ID NO: 2472 - protein, 9 aa, Homo Sapiens
YSVDKSAGY

SEQ ID NO: 2473 - protein, 9 aa, Homo Sapiens
GDVEYSVDK

SEQ ID NO: 2474 - protein, 9 aa, Homo Sapiens
SRRRRQLPS

SEQ ID NO: 2475 - protein, 9 aa, Homo Sapiens
LFLRLDVFI

SEQ ID NO: 2476 - protein, 9 aa, Homo Sapiens
ILAIDIGQI

SEQ ID NO: 2477 - protein, 9 aa, Homo Sapiens
KPGNLSPPP

SEQ ID NO: 2478 - protein, 9 aa, Homo Sapiens
TQRYLIWEC

SEQ ID NO: 2479 - protein, 9 aa, Homo Sapiens
TRTALLFGG

SEQ ID NO: 2480 - protein, 9 aa, Homo Sapiens
FAHPQEILR

SEQ ID NO: 2481 - protein, 9 aa, Homo Sapiens
LWKNSYADN

SEQ ID NO: 2482 - protein, 9 aa, Homo Sapiens
RCRCQRPNS

SEQ ID NO: 2483 - protein, 9 aa, Homo Sapiens
RKREWWDES

SEQ ID NO: 2484 - protein, 9 aa, Homo Sapiens
NKEIEKGEV

SEQ ID NO: 2485 - protein, 9 aa, Homo Sapiens
DSGKQSLSR

SEQ ID NO: 2486 - protein, 9 aa, Homo Sapiens
RHHRCRCQR

SEQ ID NO: 2487 - protein, 9 aa, Homo Sapiens
CKIGEERAS

SEQ ID NO: 2488 - protein, 9 aa, Homo Sapiens
KEKVKVENG

SEQ ID NO: 2489 - protein, 9 aa, Homo Sapiens
AIIDLMYSA

SEQ ID NO: 2490 - protein, 9 aa, Homo Sapiens
DSTNFLFLS

SEQ ID NO: 2491 - protein, 9 aa, Homo Sapiens
LQRQLEVLV

SEQ ID NO: 2492 - protein, 9 aa, Homo Sapiens
PTCCVTVTG

SEQ ID NO: 2493 - protein, 9 aa, Homo Sapiens
FLFCCIAIW

SEQ ID NO: 2494 - protein, 9 aa, Homo Sapiens
NLVPNSLSY

SEQ ID NO: 2495 - protein, 9 aa, Homo Sapiens
PKVEAPSSE

SEQ ID NO: 2496 - protein, 9 aa, Homo Sapiens
TPLGRLRFK

SEQ ID NO: 2497 - protein, 9 aa, Homo Sapiens
GVFHIGPVG

SEQ ID NO: 2498 - protein, 9 aa, Homo Sapiens
QVEGHVQLS

SEQ ID NO: 2499 - protein, 9 aa, Homo Sapiens
LMYSAHLAL

SEQ ID NO: 2500 - protein, 9 aa, Homo Sapiens
VENSPGIVL

SEQ ID NO: 2501 - protein, 9 aa, Homo Sapiens
LTICCCCCW

SEQ ID NO: 2502 - protein, 9 aa, Homo Sapiens
RASAISLMR

SEQ ID NO: 2503 - protein, 9 aa, Homo Sapiens
IDIGQIQGA

SEQ ID NO: 2504 - protein, 9 aa, Homo Sapiens
KMNSTGDFH

SEQ ID NO: 2505 - protein, 9 aa, Homo Sapiens
VLEQEARTR

SEQ ID NO: 2506 - protein, 9 aa, Homo Sapiens
SLSNSVVEN

SEQ ID NO: 2507 - protein, 9 aa, Homo Sapiens
ECIYISEAA

SEQ ID NO: 2508 - protein, 9 aa, Homo Sapiens
FPRACVCVP

SEQ ID NO: 2509 - protein, 9 aa, Homo Sapiens
IPYAQTPLG

SEQ ID NO: 2510 - protein, 9 aa, Homo Sapiens
DSLEHMKAV

SEQ ID NO: 2511 - protein, 9 aa, Homo Sapiens
SDSLEHMKA

SEQ ID NO: 2512 - protein, 9 aa, Homo Sapiens
ARAPAALEP

SEQ ID NO: 2513 - protein, 9 aa, Homo Sapiens
SDMIYFGRS

SEQ ID NO: 2514 - protein, 9 aa, Homo Sapiens
HSSPLPVTA

SEQ ID NO: 2515 - protein, 9 aa, Homo Sapiens
DQELQESTK

SEQ ID NO: 2516 - protein, 9 aa, Homo Sapiens
DCVQGPPAL

SEQ ID NO: 2517 - protein, 9 aa, Homo Sapiens
SVDKSAGYV

SEQ ID NO: 2518 - protein, 9 aa, Homo Sapiens
IDMTFKAKL

SEQ ID NO: 2519 - protein, 9 aa, Homo Sapiens
SRSLDWLSR

SEQ ID NO: 2520 - protein, 9 aa, Homo Sapiens
LDVLERCPH

SEQ ID NO: 2521 - protein, 9 aa, Homo Sapiens
RAVAPFPRA

SEQ ID NO: 2522 - protein, 9 aa, Homo Sapiens
PKYELIIDA

SEQ ID NO: 2523 - protein, 9 aa, Homo Sapiens
VSWIYLLRK

SEQ ID NO: 2524 - protein, 9 aa, Homo Sapiens
MLGLLLCPL

SEQ ID NO: 2525 - protein, 9 aa, Homo Sapiens
RRDSAEPYS

SEQ ID NO: 2526 - protein, 9 aa, Homo Sapiens
GEERASAIS

SEQ ID NO: 2527 - protein, 9 aa, Homo Sapiens
SRFAHPQEI

SEQ ID NO: 2528 - protein, 9 aa, Homo Sapiens
GRCSGHNLV

SEQ ID NO: 2529 - protein, 9 aa, Homo Sapiens
HRKESDQEL

SEQ ID NO: 2530 - protein, 9 aa, Homo Sapiens
HKVVNHSND

SEQ ID NO: 2531 - protein, 9 aa, Homo Sapiens
PGSRRRRQL

SEQ ID NO: 2532 - protein, 9 aa, Homo Sapiens
YFSGEECYE

SEQ ID NO: 2533 - protein, 9 aa, Homo Sapiens
TQIRCSVPE

SEQ ID NO: 2534 - protein, 9 aa, Homo Sapiens
GTASLRVTE

SEQ ID NO: 2535 - protein, 9 aa, Homo Sapiens
GEKTKTVSS

SEQ ID NO: 2536 - protein, 9 aa, Homo Sapiens
SGREAGEGG

SEQ ID NO: 2537 - protein, 9 aa, Homo Sapiens
EGGAVAAPE

SEQ ID NO: 2538 - protein, 9 aa, Homo Sapiens
ANSTVIEKW

SEQ ID NO: 2539 - protein, 9 aa, Homo Sapiens
LPLPNLRLV

SEQ ID NO: 2540 - protein, 9 aa, Homo Sapiens
LTLRAFEAN

SEQ ID NO: 2541 - protein, 9 aa, Homo Sapiens
APFPRACVC

SEQ ID NO: 2542 - protein, 9 aa, Homo Sapiens
KGRCSGHNL

SEQ ID NO: 2543 - protein, 9 aa, Homo Sapiens
LGIPYAQTP

SEQ ID NO: 2544 - protein, 9 aa, Homo Sapiens
AVAPFPRAC

SEQ ID NO: 2545 - protein, 9 aa, Homo Sapiens
DASGETTYR

SEQ ID NO: 2546 - protein, 9 aa, Homo Sapiens
SCILSSSII

SEQ ID NO: 2547 - protein, 9 aa, Homo Sapiens
NLSPPPPVV

SEQ ID NO: 2548 - protein, 9 aa, Homo Sapiens
RRRQLPSVG

SEQ ID NO: 2549 - protein, 9 aa, Homo Sapiens
STGDFHLHL

SEQ ID NO: 2550 - protein, 9 aa, Homo Sapiens
EAKLPDDFT

SEQ ID NO: 2551 - protein, 9 aa, Homo Sapiens
TGCTQIRCS

SEQ ID NO: 2552 - protein, 9 aa, Homo Sapiens
ESTKMKLWI

SEQ ID NO: 2553 - protein, 9 aa, Homo Sapiens
SDTRTRYLE

SEQ ID NO: 2554 - protein, 9 aa, Homo Sapiens
EIEKTFVPK

SEQ ID NO: 2555 - protein, 9 aa, Homo Sapiens
QLSNDVILD

SEQ ID NO: 2556 - protein, 9 aa, Homo Sapiens
SLDWLSRVK

SEQ ID NO: 2557 - protein, 9 aa, Homo Sapiens
LSNCHNSKL

SEQ ID NO: 2558 - protein, 9 aa, Homo Sapiens
SYITNLQRQ

SEQ ID NO: 2559 - protein, 9 aa, Homo Sapiens
TLRAFEANS

SEQ ID NO: 2560 - protein, 9 aa, Homo Sapiens
CHNSKLTKV

SEQ ID NO: 2561 - protein, 9 aa, Homo Sapiens
GSSSSPKVE

SEQ ID NO: 2562 - protein, 9 aa, Homo Sapiens
NHKVVNHSN

SEQ ID NO: 2563 - protein, 9 aa, Homo Sapiens
SRVKAELSG

SEQ ID NO: 2564 - protein, 9 aa, Homo Sapiens
EYFSGEECY

SEQ ID NO: 2565 - protein, 9 aa, Homo Sapiens
PYAQTPLGR

SEQ ID NO: 2566 - protein, 9 aa, Homo Sapiens
EYSVDKSAG

SEQ ID NO: 2567 - protein, 9 aa, Homo Sapiens
LFGGQRKRL

SEQ ID NO: 2568 - protein, 9 aa, Homo Sapiens
PSGREAGEG

SEQ ID NO: 2569 - protein, 9 aa, Homo Sapiens
QRISRGCDF

SEQ ID NO: 2570 - protein, 9 aa, Homo Sapiens
DFHLHLLKV

SEQ ID NO: 2571 - protein, 9 aa, Homo Sapiens
LFLNPIPLD

SEQ ID NO: 2572 - protein, 9 aa, Homo Sapiens
LEAKLPDDF

SEQ ID NO: 2573 - protein, 9 aa, Homo Sapiens
SPKVEAPSS

SEQ ID NO: 2574 - protein, 9 aa, Homo Sapiens
LAIDIGQIQ

SEQ ID NO: 2575 - protein, 9 aa, Homo Sapiens
NHSNDCCPS

SEQ ID NO: 2576 - protein, 9 aa, Homo Sapiens
ERCPHRPIL

SEQ ID NO: 2577 - protein, 9 aa, Homo Sapiens
PESIHSSPL

SEQ ID NO: 2578 - protein, 9 aa, Homo Sapiens
LNGSSSSPK

SEQ ID NO: 2579 - protein, 9 aa, Homo Sapiens
VCVNFESFE

SEQ ID NO: 2580 - protein, 9 aa, Homo Sapiens
LSPPPPVVV

SEQ ID NO: 2581 - protein, 9 aa, Homo Sapiens
TSLTQYLPA

SEQ ID NO: 2582 - protein, 9 aa, Homo Sapiens
KPGTASLRV

SEQ ID NO: 2583 - protein, 9 aa, Homo Sapiens
FFRAAFLEE

SEQ ID NO: 2584 - protein, 9 aa, Homo Sapiens
EECMFPKAI

SEQ ID NO: 2585 - protein, 9 aa, Homo Sapiens
STDSYLQLS

SEQ ID NO: 2586 - protein, 9 aa, Homo Sapiens
LLFGGQRKR

SEQ ID NO: 2587 - protein, 9 aa, Homo Sapiens
ETMRRQEEK

SEQ ID NO: 2588 - protein, 9 aa, Homo Sapiens
AVQLLQLSN

SEQ ID NO: 2589 - protein, 9 aa, Homo Sapiens
ALLQAYEDP

SEQ ID NO: 2590 - protein, 9 aa, Homo Sapiens
CSGHNLVPN

SEQ ID NO: 2591 - protein, 9 aa, Homo Sapiens
TVSDSLEHM

SEQ ID NO: 2592 - protein, 9 aa, Homo Sapiens
VIRPHWPYF

SEQ ID NO: 2593 - protein, 9 aa, Homo Sapiens
PKAIDMTFK

SEQ ID NO: 2594 - protein, 9 aa, Homo Sapiens
SRGCDFCQV

SEQ ID NO: 2595 - protein, 9 aa, Homo Sapiens
VTYAAVEEV

SEQ ID NO: 2596 - protein, 9 aa, Homo Sapiens
FLGIPYAQT

SEQ ID NO: 2597 - protein, 9 aa, Homo Sapiens
PQKQQARMT

SEQ ID NO: 2598 - protein, 9 aa, Homo Sapiens
KLWKNSYAD

SEQ ID NO: 2599 - protein, 9 aa, Homo Sapiens
RRQLPSVGV

SEQ ID NO: 2600 - protein, 9 aa, Homo Sapiens
RQLPSVGVQ

SEQ ID NO: 2601 - protein, 9 aa, Homo Sapiens
VMKLLLFLR

SEQ ID NO: 2602 - protein, 9 aa, Homo Sapiens
KREWWDESE

SEQ ID NO: 2603 - protein, 9 aa, Homo Sapiens
LSNDVILDV

SEQ ID NO: 2604 - protein, 9 aa, Homo Sapiens
LHRKESDQE

SEQ ID NO: 2605 - protein, 9 aa, Homo Sapiens
VLERCPHRP

SEQ ID NO: 2606 - protein, 9 aa, Homo Sapiens
RGEEDPQKQ

SEQ ID NO: 2607 - protein, 9 aa, Homo Sapiens
SLASSASGV

SEQ ID NO: 2608 - protein, 9 aa, Homo Sapiens
TTVSDSLEH

SEQ ID NO: 2609 - protein, 9 aa, Homo Sapiens
KAIDMTFKA

SEQ ID NO: 2610 - protein, 9 aa, Homo Sapiens
SSSKCHNKQ

SEQ ID NO: 2611 - protein, 9 aa, Homo Sapiens
RCSGHNLVP

SEQ ID NO: 2612 - protein, 9 aa, Homo Sapiens
RLTQRYLIW

SEQ ID NO: 2613 - protein, 9 aa, Homo Sapiens
NFESFEVGA

SEQ ID NO: 2614 - protein, 9 aa, Homo Sapiens
EFPQRYEIL

SEQ ID NO: 2615 - protein, 9 aa, Homo Sapiens
NSYADNILS

SEQ ID NO: 2616 - protein, 9 aa, Homo Sapiens
LRAFEANST

SEQ ID NO: 2617 - protein, 9 aa, Homo Sapiens
LVRGTQVYD

SEQ ID NO: 2618 - protein, 9 aa, Homo Sapiens
LLQLSNDVI

SEQ ID NO: 2619 - protein, 9 aa, Homo Sapiens
MQEQEETMR

SEQ ID NO: 2620 - protein, 9 aa, Homo Sapiens
DIGQIQGAT

SEQ ID NO: 2621 - protein, 9 aa, Homo Sapiens
LTQRYLIWE

SEQ ID NO: 2622 - protein, 9 aa, Homo Sapiens
CDFCQVLQW

SEQ ID NO: 2623 - protein, 9 aa, Homo Sapiens
YVLFLALGS

SEQ ID NO: 2624 - protein, 9 aa, Homo Sapiens
QRQLEVLVS

SEQ ID NO: 2625 - protein, 9 aa, Homo Sapiens
NTAPPVQLG

SEQ ID NO: 2626 - protein, 9 aa, Homo Sapiens
ALWNKVTEL

SEQ ID NO: 2627 - protein, 9 aa, Homo Sapiens
FPKAIDMTF

SEQ ID NO: 2628 - protein, 9 aa, Homo Sapiens
VVSWIYLLR

SEQ ID NO: 2629 - protein, 9 aa, Homo Sapiens
AWEPQPEGL

SEQ ID NO: 2630 - protein, 9 aa, Homo Sapiens
NFLFLSNCH

SEQ ID NO: 2631 - protein, 9 aa, Homo Sapiens
GEQEYFSGE

SEQ ID NO: 2632 - protein, 9 aa, Homo Sapiens
GFNGTFTVR

SEQ ID NO: 2633 - protein, 9 aa, Homo Sapiens
LPNLRLVRG

SEQ ID NO: 2634 - protein, 9 aa, Homo Sapiens
VLFLFCCIA

SEQ ID NO: 2635 - protein, 9 aa, Homo Sapiens
HHFHWGGHE

SEQ ID NO: 2636 - protein, 9 aa, Homo Sapiens
VRPYICEAT

SEQ ID NO: 2637 - protein, 9 aa, Homo Sapiens
GPRVREPLL

SEQ ID NO: 2638 - protein, 9 aa, Homo Sapiens
CPPCWNRLT

SEQ ID NO: 2639 - protein, 9 aa, Homo Sapiens
VRPEPPARA

SEQ ID NO: 2640 - protein, 9 aa, Homo Sapiens
FGFVTYAAV

SEQ ID NO: 2641 - protein, 9 aa, Homo Sapiens
TTDALWNKV

SEQ ID NO: 2642 - protein, 9 aa, Homo Sapiens
CVTVTGPDL

SEQ ID NO: 2643 - protein, 9 aa, Homo Sapiens
RPEPPARAP

SEQ ID NO: 2644 - protein, 9 aa, Homo Sapiens
LDPKENSKT

SEQ ID NO: 2645 - protein, 9 aa, Homo Sapiens
KLPDDFTAH

SEQ ID NO: 2646 - protein, 9 aa, Homo Sapiens
PEEASDMIY

SEQ ID NO: 2647 - protein, 9 aa, Homo Sapiens
FHLHLLKVS

SEQ ID NO: 2648 - protein, 9 aa, Homo Sapiens
LGEQEYFSG

SEQ ID NO: 2649 - protein, 9 aa, Homo Sapiens
EGLLPLDIP

SEQ ID NO: 2650 - protein, 9 aa, Homo Sapiens
WNKVTELER

SEQ ID NO: 2651 - protein, 9 aa, Homo Sapiens
SGHNLVPNS

SEQ ID NO: 2652 - protein, 9 aa, Homo Sapiens
RILFQEFPQ

SEQ ID NO: 2653 - protein, 9 aa, Homo Sapiens
LWILRLLCF

SEQ ID NO: 2654 - protein, 9 aa, Homo Sapiens
KESDQELQE

SEQ ID NO: 2655 - protein, 9 aa, Homo Sapiens
PGNLSPPPP

SEQ ID NO: 2656 - protein, 9 aa, Homo Sapiens
PARAPAALE

SEQ ID NO: 2657 - protein, 9 aa, Homo Sapiens
FLFLSNCHN

SEQ ID NO: 2658 - protein, 9 aa, Homo Sapiens
NRILFQEFP

SEQ ID NO: 2659 - protein, 9 aa, Homo Sapiens
SNSVVENSP

SEQ ID NO: 2660 - protein, 9 aa, Homo Sapiens
ILFQEFPQR

SEQ ID NO: 2661 - protein, 9 aa, Homo Sapiens
GETTYRKTT

SEQ ID NO: 2662 - protein, 9 aa, Homo Sapiens
LLQAYEDPG

SEQ ID NO: 2663 - protein, 9 aa, Homo Sapiens
GSRRRRQLP

SEQ ID NO: 2664 - protein, 9 aa, Homo Sapiens
SQRNNASEA

SEQ ID NO: 2665 - protein, 9 aa, Homo Sapiens
DMIYFGRSK

SEQ ID NO: 2666 - protein, 9 aa, Homo Sapiens
GPDLKNNRI

SEQ ID NO: 2667 - protein, 9 aa, Homo Sapiens
RKRGKPGTA

SEQ ID NO: 2668 - protein, 9 aa, Homo Sapiens
PVQLGLGRK

SEQ ID NO: 2669 - protein, 9 aa, Homo Sapiens
EANSTVIEK

SEQ ID NO: 2670 - protein, 9 aa, Homo Sapiens
KNSYADNIL

SEQ ID NO: 2671 - protein, 9 aa, Homo Sapiens
CQRPNSCDR

SEQ ID NO: 2672 - protein, 9 aa, Homo Sapiens
IRCSVPEEL

SEQ ID NO: 2673 - protein, 9 aa, Homo Sapiens
RNNASEACF

SEQ ID NO: 2674 - protein, 9 aa, Homo Sapiens
ESYITNLQR

SEQ ID NO: 2675 - protein, 9 aa, Homo Sapiens
LGHHFHWGG

SEQ ID NO: 2676 - protein, 9 aa, Homo Sapiens
EEDPQKQQA

SEQ ID NO: 2677 - protein, 9 aa, Homo Sapiens
IDAQDMAGL

SEQ ID NO: 2678 - protein, 9 aa, Homo Sapiens
IGEERASAI

SEQ ID NO: 2679 - protein, 9 aa, Homo Sapiens
SGEECYEDD

SEQ ID NO: 2680 - protein, 9 aa, Homo Sapiens
IRPHWPYFT

SEQ ID NO: 2681 - protein, 9 aa, Homo Sapiens
KVENGFQDN

SEQ ID NO: 2682 - protein, 9 aa, Homo Sapiens
ETTYRKTTS

SEQ ID NO: 2683 - protein, 9 aa, Homo Sapiens
ICCCCCWAP

SEQ ID NO: 2684 - protein, 9 aa, Homo Sapiens
RAFEANSTV

SEQ ID NO: 2685 - protein, 9 aa, Homo Sapiens
DKSAGYVEV

SEQ ID NO: 2686 - protein, 9 aa, Homo Sapiens
VTGPDLKNN

SEQ ID NO: 2687 - protein, 9 aa, Homo Sapiens
CPHRPILQA

SEQ ID NO: 2688 - protein, 9 aa, Homo Sapiens
TQYLPAAGK

SEQ ID NO: 2689 - protein, 9 aa, Homo Sapiens
VEGHVQLSR

SEQ ID NO: 2690 - protein, 9 aa, Homo Sapiens
HMKAVYNNF

SEQ ID NO: 2691 - protein, 9 aa, Homo Sapiens
CTQIRCSVP

SEQ ID NO: 2692 - protein, 9 aa, Homo Sapiens
PPSGREAGE

SEQ ID NO: 2693 - protein, 9 aa, Homo Sapiens
GVGDSGKQS

SEQ ID NO: 2694 - protein, 9 aa, Homo Sapiens
LDWLSRVKA

SEQ ID NO: 2695 - protein, 9 aa, Homo Sapiens
EQEETMRRQ

SEQ ID NO: 2696 - protein, 9 aa, Homo Sapiens
ISEAAPRQR

SEQ ID NO: 2697 - protein, 9 aa, Homo Sapiens
GLLPLDIPQ

SEQ ID NO: 2698 - protein, 9 aa, Homo Sapiens
YELIIDAQD

SEQ ID NO: 2699 - protein, 9 aa, Homo Sapiens
MEKVAKDLN

SEQ ID NO: 2700 - protein, 9 aa, Homo Sapiens
GRQNHKVVN

SEQ ID NO: 2701 - protein, 9 aa, Homo Sapiens
KLLLFLRLD

SEQ ID NO: 2702 - protein, 9 aa, Homo Sapiens
TALLFGGQR

SEQ ID NO: 2703 - protein, 9 aa, Homo Sapiens
FQEFPQRYE

SEQ ID NO: 2704 - protein, 9 aa, Homo Sapiens
GPVGRQNHK

SEQ ID NO: 2705 - protein, 9 aa, Homo Sapiens
FEANSTVIE

SEQ ID NO: 2706 - protein, 9 aa, Homo Sapiens
YGEKTKTVS

SEQ ID NO: 2707 - protein, 9 aa, Homo Sapiens
KQQDHFFRA

SEQ ID NO: 2708 - protein, 9 aa, Homo Sapiens
DLMYSAHLA

SEQ ID NO: 2709 - protein, 9 aa, Homo Sapiens
CSVPEELEK

SEQ ID NO: 2710 - protein, 9 aa, Homo Sapiens
ERASAISLM

SEQ ID NO: 2711 - protein, 9 aa, Homo Sapiens
VQGPPALLQ

SEQ ID NO: 2712 - protein, 9 aa, Homo Sapiens
RRRRQLPSV

SEQ ID NO: 2713 - protein, 9 aa, Homo Sapiens
LNTAPPVQL

SEQ ID NO: 2714 - protein, 9 aa, Homo Sapiens
EEPGYVLFL

SEQ ID NO: 2715 - protein, 9 aa, Homo Sapiens
ALLFGGQRK

SEQ ID NO: 2716 - protein, 9 aa, Homo Sapiens
PCWNRLTQR

SEQ ID NO: 2717 - protein, 9 aa, Homo Sapiens
DHFFRAAFL

SEQ ID NO: 2718 - protein, 9 aa, Homo Sapiens
QDHFFRAAF

SEQ ID NO: 2719 - protein, 9 aa, Homo Sapiens
YLPAAGKRE

SEQ ID NO: 2720 - protein, 9 aa, Homo Sapiens
QKILLEDES

SEQ ID NO: 2721 - protein, 9 aa, Homo Sapiens
PRVREPLLP

SEQ ID NO: 2722 - protein, 9 aa, Homo Sapiens
RFAHPQEIL

SEQ ID NO: 2723 - protein, 9 aa, Homo Sapiens
TNLQRQLEV

SEQ ID NO: 2724 - protein, 9 aa, Homo Sapiens
FSTDSYLQL

SEQ ID NO: 2725 - protein, 9 aa, Homo Sapiens
CRCQRPNSC

SEQ ID NO: 2726 - protein, 9 aa, Homo Sapiens
FSCILSSSI

SEQ ID NO: 2727 - protein, 9 aa, Homo Sapiens
VRSSSVSSI

SEQ ID NO: 2728 - protein, 9 aa, Homo Sapiens
RKTTSSTLK

SEQ ID NO: 2729 - protein, 9 aa, Homo Sapiens
QNHKVVNHS

SEQ ID NO: 2730 - protein, 9 aa, Homo Sapiens
HTHVLEKLP

SEQ ID NO: 2731 - protein, 9 aa, Homo Sapiens
GEGGAVAAP

SEQ ID NO: 2732 - protein, 9 aa, Homo Sapiens
GVLEQEART

SEQ ID NO: 2733 - protein, 9 aa, Homo Sapiens
SVSSISSTQ

SEQ ID NO: 2734 - protein, 9 aa, Homo Sapiens
SHTRTALLF

SEQ ID NO: 2735 - protein, 9 aa, Homo Sapiens
VQSTHSQRN

SEQ ID NO: 2736 - protein, 9 aa, Homo Sapiens
EERAVAPFP

SEQ ID NO: 2737 - protein, 9 aa, Homo Sapiens
CVSSVCVNF

SEQ ID NO: 2738 - protein, 9 aa, Homo Sapiens
DVEYSVDKS

SEQ ID NO: 2739 - protein, 9 aa, Homo Sapiens
ASGVESLSE

SEQ ID NO: 2740 - protein, 9 aa, Homo Sapiens
TCCVTVTGP

SEQ ID NO: 2741 - protein, 9 aa, Homo Sapiens
KAIIDLMYS

SEQ ID NO: 2742 - protein, 9 aa, Homo Sapiens
SSSIISVAE

SEQ ID NO: 2743 - protein, 9 aa, Homo Sapiens
VESLSEEEL

SEQ ID NO: 2744 - protein, 9 aa, Homo Sapiens
EASDMIYFG

SEQ ID NO: 2745 - protein, 9 aa, Homo Sapiens
SAISLMRKF

SEQ ID NO: 2746 - protein, 9 aa, Homo Sapiens
LGLLLCPLL

SEQ ID NO: 2747 - protein, 9 aa, Homo Sapiens
WEPQPEGLL

SEQ ID NO: 2748 - protein, 9 aa, Homo Sapiens
KVVNHSNDC

SEQ ID NO: 2749 - protein, 9 aa, Homo Sapiens
NGTFTVRPY

SEQ ID NO: 2750 - protein, 9 aa, Homo Sapiens
CMFPKAIDM

SEQ ID NO: 2751 - protein, 9 aa, Homo Sapiens
NGSSSSPKV

SEQ ID NO: 2752 - protein, 9 aa, Homo Sapiens
FPQRYEILT

SEQ ID NO: 2753 - protein, 9 aa, Homo Sapiens
PYSSRSVPV

SEQ ID NO: 2754 - protein, 9 aa, Homo Sapiens
ITNLQRQLE

SEQ ID NO: 2755 - protein, 9 aa, Homo Sapiens
TASLRVTEL

SEQ ID NO: 2756 - protein, 9 aa, Homo Sapiens
VQLGLGRKP

SEQ ID NO: 2757 - protein, 9 aa, Homo Sapiens
EILRDSTNF

SEQ ID NO: 2758 - protein, 9 aa, Homo Sapiens
QSTHSQRNN

SEQ ID NO: 2759 - protein, 9 aa, Homo Sapiens
MFPKAIDMT

SEQ ID NO: 2760 - protein, 9 aa, Homo Sapiens
PAAGKREVP

SEQ ID NO: 2761 - protein, 9 aa, Homo Sapiens
EIMGSAERI

SEQ ID NO: 2762 - protein, 9 aa, Homo Sapiens
PGYVLFLAL

SEQ ID NO: 2763 - protein, 9 aa, Homo Sapiens
HLGHHFHWG

SEQ ID NO: 2764 - protein, 9 aa, Homo Sapiens
ESRPVKLFR

SEQ ID NO: 2765 - protein, 9 aa, Homo Sapiens
VNHSNDCCP

SEQ ID NO: 2766 - protein, 9 aa, Homo Sapiens
AVEEVDAAM

SEQ ID NO: 2767 - protein, 9 aa, Homo Sapiens
SSVSSISST

SEQ ID NO: 2768 - protein, 9 aa, Homo Sapiens
LPSVGVQSL

SEQ ID NO: 2769 - protein, 9 aa, Homo Sapiens
YISEAAPRQ

SEQ ID NO: 2770 - protein, 9 aa, Homo Sapiens
QLLQLSNDV

SEQ ID NO: 2771 - protein, 9 aa, Homo Sapiens
SVCVNFESF

SEQ ID NO: 2772 - protein, 9 aa, Homo Sapiens
LFLALGSFY

SEQ ID NO: 2773 - protein, 9 aa, Homo Sapiens
EKTKTVSSR

SEQ ID NO: 2774 - protein, 9 aa, Homo Sapiens
ELHRKESDQ

SEQ ID NO: 2775 - protein, 9 aa, Homo Sapiens
IGPVGRQNH

SEQ ID NO: 2776 - protein, 9 aa, Homo Sapiens
VENGFQDNY

SEQ ID NO: 2777 - protein, 9 aa, Homo Sapiens
GCDFCQVLQ

SEQ ID NO: 2778 - protein, 9 aa, Homo Sapiens
GNLSPPPPV

SEQ ID NO: 2779 - protein, 9 aa, Homo Sapiens
AGEGGAVAA

SEQ ID NO: 2780 - protein, 9 aa, Homo Sapiens
KVQAEICSL

SEQ ID NO: 2781 - protein, 9 aa, Homo Sapiens
RAAFLEERD

SEQ ID NO: 2782 - protein, 9 aa, Homo Sapiens
MYKPGNLSP

SEQ ID NO: 2783 - protein, 9 aa, Homo Sapiens
LLPCRDPGD

SEQ ID NO: 2784 - protein, 9 aa, Homo Sapiens
DPQKQQARM

SEQ ID NO: 2785 - protein, 9 aa, Homo Sapiens
PALLQAYED

SEQ ID NO: 2786 - protein, 9 aa, Homo Sapiens
GKPGTASLR

SEQ ID NO: 2787 - protein, 9 aa, Homo Sapiens
PPALLQAYE

SEQ ID NO: 2788 - protein, 9 aa, Homo Sapiens
RLVRGTQVY

SEQ ID NO: 2789 - protein, 9 aa, Homo Sapiens
YRGEEDPQK

SEQ ID NO: 2790 - protein, 9 aa, Homo Sapiens
KILLEDESK

SEQ ID NO: 2791 - protein, 9 aa, Homo Sapiens
PHWPYFTDY

SEQ ID NO: 2792 - protein, 9 aa, Homo Sapiens
VDKSAGYVE

SEQ ID NO: 2793 - protein, 9 aa, Homo Sapiens
FHIGPVGRQ

SEQ ID NO: 2794 - protein, 9 aa, Homo Sapiens
LVPNSLSYA

SEQ ID NO: 2795 - protein, 9 aa, Homo Sapiens
VQLLQLSND

SEQ ID NO: 2796 - protein, 9 aa, Homo Sapiens
NKECIYISE

SEQ ID NO: 2797 - protein, 9 aa, Homo Sapiens
PNLRLVRGT

SEQ ID NO: 2798 - protein, 9 aa, Homo Sapiens
HPAGVFHIG

SEQ ID NO: 2799 - protein, 9 aa, Homo Sapiens
KTVSSRKKP

SEQ ID NO: 2800 - protein, 9 aa, Homo Sapiens
QIRCSVPEE

SEQ ID NO: 2801 - protein, 9 aa, Homo Sapiens
LLPLDIPQA

SEQ ID NO: 2802 - protein, 9 aa, Homo Sapiens
RCSVPEELE

SEQ ID NO: 2803 - protein, 9 aa, Homo Sapiens
STSPESIHS

SEQ ID NO: 2804 - protein, 9 aa, Homo Sapiens
FLSNCHNSK

SEQ ID NO: 2805 - protein, 9 aa, Homo Sapiens
EPPGVLEQE

SEQ ID NO: 2806 - protein, 9 aa, Homo Sapiens
EKVAKDLNP

SEQ ID NO: 2807 - protein, 9 aa, Homo Sapiens
ERAVAPFPR

SEQ ID NO: 2808 - protein, 9 aa, Homo Sapiens
EHMKAVYNN

SEQ ID NO: 2809 - protein, 9 aa, Homo Sapiens
PPPPVVVPH

SEQ ID NO: 2810 - protein, 9 aa, Homo Sapiens
PPARAPAAL

SEQ ID NO: 2811 - protein, 9 aa, Homo Sapiens
PNKECIYIS

SEQ ID NO: 2812 - protein, 9 aa, Homo Sapiens
REPLLPCRD

SEQ ID NO: 2813 - protein, 9 aa, Homo Sapiens
QTPLGRLRF

SEQ ID NO: 2814 - protein, 9 aa, Homo Sapiens
AKLPDDFTA

SEQ ID NO: 2815 - protein, 9 aa, Homo Sapiens
IPLDPKENS

SEQ ID NO: 2816 - protein, 9 aa, Homo Sapiens
SIISVAENG

SEQ ID NO: 2817 - protein, 9 aa, Homo Sapiens
IFSCILSSS

SEQ ID NO: 2818 - protein, 9 aa, Homo Sapiens
VFHIGPVGR

SEQ ID NO: 2819 - protein, 9 aa, Homo Sapiens
NSVVENSPG

SEQ ID NO: 2820 - protein, 9 aa, Homo Sapiens
VSDSLEHMK

SEQ ID NO: 2821 - protein, 9 aa, Homo Sapiens
ILRDSTNFL

SEQ ID NO: 2822 - protein, 9 aa, Homo Sapiens
MKTFLEAKL

SEQ ID NO: 2823 - protein, 9 aa, Homo Sapiens
VQAEICSLH

SEQ ID NO: 2824 - protein, 9 aa, Homo Sapiens
KEIEKTFVP

SEQ ID NO: 2825 - protein, 9 aa, Homo Sapiens
GHVQLSRFA

SEQ ID NO: 2826 - protein, 9 aa, Homo Sapiens
THVLEKLPD

SEQ ID NO: 2827 - protein, 9 aa, Homo Sapiens
IHSSPLPVT

SEQ ID NO: 2828 - protein, 9 aa, Homo Sapiens
YLESRPVKL

SEQ ID NO: 2829 - protein, 9 aa, Homo Sapiens
SSVCVNFES

SEQ ID NO: 2830 - protein, 9 aa, Homo Sapiens
LLEDESKEK

SEQ ID NO: 2831 - protein, 9 aa, Homo Sapiens
REWWDESEE

SEQ ID NO: 2832 - protein, 9 aa, Homo Sapiens
EGHVQLSRF

SEQ ID NO: 2833 - protein, 9 aa, Homo Sapiens
EPPARAPAA

SEQ ID NO: 2834 - protein, 9 aa, Homo Sapiens
KSAGYVEVQ

SEQ ID NO: 2835 - protein, 9 aa, Homo Sapiens
EVLICLHTH

SEQ ID NO: 2836 - protein, 9 aa, Homo Sapiens
SLTQYLPAA

SEQ ID NO: 2837 - protein, 9 aa, Homo Sapiens
TVTGPDLKN

SEQ ID NO: 2838 - protein, 9 aa, Homo Sapiens
YSSRSVPVA

SEQ ID NO: 2839 - protein, 9 aa, Homo Sapiens
ALLVGVGDS

SEQ ID NO: 2840 - protein, 9 aa, Homo Sapiens
WKNSYADNI

SEQ ID NO: 2841 - protein, 9 aa, Homo Sapiens
RIEIMGSAE

SEQ ID NO: 2842 - protein, 9 aa, Homo Sapiens
SGVESLSEE

SEQ ID NO: 2843 - protein, 9 aa, Homo Sapiens
TTILAIDIG

SEQ ID NO: 2844 - protein, 9 aa, Homo Sapiens
STNFLFLSN

SEQ ID NO: 2845 - protein, 9 aa, Homo Sapiens
RRHHRCRCQ

SEQ ID NO: 2846 - protein, 9 aa, Homo Sapiens
VGVGDSGKQ

SEQ ID NO: 2847 - protein, 9 aa, Homo Sapiens
GDFHLHLLK

SEQ ID NO: 2848 - protein, 9 aa, Homo Sapiens
ELIIDAQDM

SEQ ID NO: 2849 - protein, 9 aa, Homo Sapiens
TYAAVEEVD

SEQ ID NO: 2850 - protein, 9 aa, Homo Sapiens
IEIMGSAER

SEQ ID NO: 2851 - protein, 9 aa, Homo Sapiens
VKVENGFQD

SEQ ID NO: 2852 - protein, 9 aa, Homo Sapiens
QEILRDSTN

SEQ ID NO: 2853 - protein, 9 aa, Homo Sapiens
AKNKEIEKG

SEQ ID NO: 2854 - protein, 9 aa, Homo Sapiens
GSAERIERV

SEQ ID NO: 2855 - protein, 9 aa, Homo Sapiens
QIRKEIEKT

SEQ ID NO: 2856 - protein, 9 aa, Homo Sapiens
HLHLLKVSE

SEQ ID NO: 2857 - protein, 9 aa, Homo Sapiens
GYVLFLALG

SEQ ID NO: 2858 - protein, 9 aa, Homo Sapiens
YLQLSDAVS

SEQ ID NO: 2859 - protein, 9 aa, Homo Sapiens
SSTSPESIH

SEQ ID NO: 2860 - protein, 9 aa, Homo Sapiens
SSISSTQSG

SEQ ID NO: 2861 - protein, 9 aa, Homo Sapiens
SSSSPKVEA

SEQ ID NO: 2862 - protein, 9 aa, Homo Sapiens
LLHPAGVFH

SEQ ID NO: 2863 - protein, 9 aa, Homo Sapiens
EAGEGGAVA

SEQ ID NO: 2864 - protein, 9 aa, Homo Sapiens
LQLSNDVIL

SEQ ID NO: 2865 - protein, 9 aa, Homo Sapiens
TTYRKTTSS

SEQ ID NO: 2866 - protein, 9 aa, Homo Sapiens
CIAIWMGNL

SEQ ID NO: 2867 - protein, 9 aa, Homo Sapiens
QLPSVGVQS

SEQ ID NO: 2868 - protein, 9 aa, Homo Sapiens
QEFPQRYEI

SEQ ID NO: 2869 - protein, 9 aa, Homo Sapiens
CWKRKREWW

SEQ ID NO: 2870 - protein, 9 aa, Homo Sapiens
ETGCTQIRC

SEQ ID NO: 2871 - protein, 9 aa, Homo Sapiens
ESIHSSPLP

SEQ ID NO: 2872 - protein, 9 aa, Homo Sapiens
IDLMYSAHL

SEQ ID NO: 2873 - protein, 9 aa, Homo Sapiens
ILLHPAGVF

SEQ ID NO: 2874 - protein, 9 aa, Homo Sapiens
KIGEERASA

SEQ ID NO: 2875 - protein, 9 aa, Homo Sapiens
CHNKQVEGH

SEQ ID NO: 2876 - protein, 9 aa, Homo Sapiens
RQNHKVVNH

SEQ ID NO: 2877 - protein, 9 aa, Homo Sapiens
FILLHPAGV

SEQ ID NO: 2878 - protein, 9 aa, Homo Sapiens
LQESTKMKL

SEQ ID NO: 2879 - protein, 9 aa, Homo Sapiens
NDVILDVWG

SEQ ID NO: 2880 - protein, 9 aa, Homo Sapiens
TELHRKESD

SEQ ID NO: 2881 - protein, 9 aa, Homo Sapiens
ASLRVTELH

SEQ ID NO: 2882 - protein, 9 aa, Homo Sapiens
HHRCRCQRP

SEQ ID NO: 2883 - protein, 9 aa, Homo Sapiens
RPHWPYFTD

SEQ ID NO: 2884 - protein, 9 aa, Homo Sapiens
GIPYAQTPL

SEQ ID NO: 2885 - protein, 9 aa, Homo Sapiens
SVVENSPGI

SEQ ID NO: 2886 - protein, 9 aa, Homo Sapiens
RTALLFGGQ

SEQ ID NO: 2887 - protein, 9 aa, Homo Sapiens
REAGEGGAV

SEQ ID NO: 2888 - protein, 9 aa, Homo Sapiens
YRKTTSSTL

SEQ ID NO: 2889 - protein, 9 aa, Homo Sapiens
GQIQGATGS

SEQ ID NO: 2890 - protein, 9 aa, Homo Sapiens
DTRTRYLES

SEQ ID NO: 2891 - protein, 9 aa, Homo Sapiens
PSSSKCHNK

SEQ ID NO: 2892 - protein, 9 aa, Homo Sapiens
LEDESKEKP

SEQ ID NO: 2893 - protein, 9 aa, Homo Sapiens
IRKEIEKTF

SEQ ID NO: 2894 - protein, 9 aa, Homo Sapiens
DWLSRVKAE

SEQ ID NO: 2895 - protein, 9 aa, Homo Sapiens
PQEILRDST

SEQ ID NO: 2896 - protein, 9 aa, Homo Sapiens
PVGRQNHKV

SEQ ID NO: 2897 - protein, 9 aa, Homo Sapiens
SSSVSSISS

SEQ ID NO: 2898 - protein, 9 aa, Homo Sapiens
HNKQVEGHV

SEQ ID NO: 2899 - protein, 9 aa, Homo Sapiens
CALLVGVGD

SEQ ID NO: 2900 - protein, 9 aa, Homo Sapiens
TDSYLQLSD

SEQ ID NO: 2901 - protein, 9 aa, Homo Sapiens
SKCHNKQVE

SEQ ID NO: 2902 - protein, 9 aa, Homo Sapiens
DSAEPYSSR

SEQ ID NO: 2903 - protein, 9 aa, Homo Sapiens
RVTELHRKE

SEQ ID NO: 2904 - protein, 9 aa, Homo Sapiens
TNFLFLSNC

SEQ ID NO: 2905 - protein, 9 aa, Homo Sapiens
GTFTVRPYI

SEQ ID NO: 2906 - protein, 9 aa, Homo Sapiens
GREAGEGGA

SEQ ID NO: 2907 - protein, 9 aa, Homo Sapiens
FTVRPYICE

SEQ ID NO: 2908 - protein, 9 aa, Homo Sapiens
SISSTQSGD

SEQ ID NO: 2909 - protein, 9 aa, Homo Sapiens
DVFILLHPA

SEQ ID NO: 2910 - protein, 9 aa, Homo Sapiens
SSPKVEAPS

SEQ ID NO: 2911 - protein, 9 aa, Homo Sapiens
EKVKVENGF

SEQ ID NO: 2912 - protein, 9 aa, Homo Sapiens
RCQRPNSCD

SEQ ID NO: 2913 - protein, 9 aa, Homo Sapiens
DTGTKLWKN

SEQ ID NO: 2914 - protein, 9 aa, Homo Sapiens
VAPFPRACV

SEQ ID NO: 2915 - protein, 9 aa, Homo Sapiens
PFPRACVCV

SEQ ID NO: 2916 - protein, 9 aa, Homo Sapiens
TRTRYLESR

SEQ ID NO: 2917 - protein, 9 aa, Homo Sapiens
LRLVRGTQV

SEQ ID NO: 2918 - protein, 9 aa, Homo Sapiens
LSRVKAELS

SEQ ID NO: 2919 - protein, 9 aa, Homo Sapiens
AIDIGQIQG

SEQ ID NO: 2920 - protein, 9 aa, Homo Sapiens
TKVQAEICS

SEQ ID NO: 2921 - protein, 9 aa, Homo Sapiens
NPIPLDPKE

SEQ ID NO: 2922 - protein, 9 aa, Homo Sapiens
PAGVFHIGP

SEQ ID NO: 2923 - protein, 9 aa, Homo Sapiens
PLPNLRLVR

SEQ ID NO: 2924 - protein, 9 aa, Homo Sapiens
DAQDMAGLD

SEQ ID NO: 2925 - protein, 9 aa, Homo Sapiens
LASSASGVE

SEQ ID NO: 2926 - protein, 9 aa, Homo Sapiens
RPYICEATV

SEQ ID NO: 2927 - protein, 9 aa, Homo Sapiens
SVFSTDSYL

SEQ ID NO: 2928 - protein, 9 aa, Homo Sapiens
MIYFGRSKK

SEQ ID NO: 2929 - protein, 9 aa, Homo Sapiens
LALGSFYLP

SEQ ID NO: 2930 - protein, 9 aa, Homo Sapiens
RTRYLESRP

SEQ ID NO: 2931 - protein, 9 aa, Homo Sapiens
LFQEFPQRY

SEQ ID NO: 2932 - protein, 9 aa, Homo Sapiens
TRYLESRPV

SEQ ID NO: 2933 - protein, 9 aa, Homo Sapiens
LRDSTNFLF

SEQ ID NO: 2934 - protein, 9 aa, Homo Sapiens
EDPQKQQAR

SEQ ID NO: 2935 - protein, 9 aa, Homo Sapiens
AHPQEILRD

SEQ ID NO: 2936 - protein, 9 aa, Homo Sapiens
KEIEKGEVV

SEQ ID NO: 2937 - protein, 9 aa, Homo Sapiens
GCTQIRCSV

SEQ ID NO: 2938 - protein, 9 aa, Homo Sapiens
NRLTQRYLI

SEQ ID NO: 2939 - protein, 9 aa, Homo Sapiens
VTVTGPDLK

SEQ ID NO: 2940 - protein, 9 aa, Homo Sapiens
DCCPSSSKC

SEQ ID NO: 2941 - protein, 9 aa, Homo Sapiens
FSGEECYED

SEQ ID NO: 2942 - protein, 9 aa, Homo Sapiens
EKQRISRGC

SEQ ID NO: 2943 - protein, 9 aa, Homo Sapiens
SAEPYSSRS

SEQ ID NO: 2944 - protein, 9 aa, Homo Sapiens
TICCCCCWA

SEQ ID NO: 2945 - protein, 9 aa, Homo Sapiens
HVQLSRFAH

SEQ ID NO: 2946 - protein, 9 aa, Homo Sapiens
ESKEKPETS

SEQ ID NO: 2947 - protein, 9 aa, Homo Sapiens
SKLTKVQAE

SEQ ID NO: 2948 - protein, 9 aa, Homo Sapiens
PLLPCRDPG

SEQ ID NO: 2949 - protein, 9 aa, Homo Sapiens
FLNPIPLDP

SEQ ID NO: 2950 - protein, 9 aa, Homo Sapiens
GHNLVPNSL

SEQ ID NO: 2951 - protein, 9 aa, Homo Sapiens
NKQVEGHVQ

SEQ ID NO: 2952 - protein, 9 aa, Homo Sapiens
IEKTFVPKV

SEQ ID NO: 2953 - protein, 9 aa, Homo Sapiens
RKEIEKTFV

SEQ ID NO: 2954 - protein, 9 aa, Homo Sapiens
EEKEKVKVE

SEQ ID NO: 2955 - protein, 9 aa, Homo Sapiens
SSSPKVEAP

SEQ ID NO: 2956 - protein, 9 aa, Homo Sapiens
EERASAISL

SEQ ID NO: 2957 - protein, 9 aa, Homo Sapiens
AFEANSTVI

SEQ ID NO: 2958 - protein, 9 aa, Homo Sapiens
VLICLHTHV

SEQ ID NO: 2959 - protein, 9 aa, Homo Sapiens
RAPAALEPA

SEQ ID NO: 2960 - protein, 9 aa, Homo Sapiens
RSFCWKRKR

SEQ ID NO: 2961 - protein, 9 aa, Homo Sapiens
LHTHVLEKL

SEQ ID NO: 2962 - protein, 9 aa, Homo Sapiens
TFLEAKLPD

SEQ ID NO: 2963 - protein, 9 aa, Homo Sapiens
SSIISVAEN

SEQ ID NO: 2964 - protein, 9 aa, Homo Sapiens
HWPYFTDYM

SEQ ID NO: 2965 - protein, 9 aa, Homo Sapiens
EETMRRQEE

SEQ ID NO: 2966 - protein, 9 aa, Homo Sapiens
KTKTVSSRK

SEQ ID NO: 2967 - protein, 9 aa, Homo Sapiens
SLEHMKAVY

SEQ ID NO: 2968 - protein, 9 aa, Homo Sapiens
RISRGCDFC

SEQ ID NO: 2969 - protein, 9 aa, Homo Sapiens
STKMKLWIL

SEQ ID NO: 2970 - protein, 9 aa, Homo Sapiens
GFVTYAAVE

SEQ ID NO: 2971 - protein, 9 aa, Homo Sapiens
FCCIAIWMG

SEQ ID NO: 2972 - protein, 9 aa, Homo Sapiens
GEERAVAPF

SEQ ID NO: 2973 - protein, 9 aa, Homo Sapiens
ECMFPKAID

SEQ ID NO: 2974 - protein, 9 aa, Homo Sapiens
EIEKGEVVS

SEQ ID NO: 2975 - protein, 9 aa, Homo Sapiens
PPCWNRLTQ

SEQ ID NO: 2976 - protein, 9 aa, Homo Sapiens
SNDCCPSSS

SEQ ID NO: 2977 - protein, 9 aa, Homo Sapiens
SLRVTELHR

SEQ ID NO: 2978 - protein, 9 aa, Homo Sapiens
SIHSSPLPV

SEQ ID NO: 2979 - protein, 9 aa, Homo Sapiens
EDESKEKPE

SEQ ID NO: 2980 - protein, 9 aa, Homo Sapiens
KLTKVQAEI

SEQ ID NO: 2981 - protein, 9 aa, Homo Sapiens
NLQRQLEVL

SEQ ID NO: 2982 - protein, 9 aa, Homo Sapiens
LLFLRLDVF

SEQ ID NO: 2983 - protein, 9 aa, Homo Sapiens
YAAVEEVDA

SEQ ID NO: 2984 - protein, 9 aa, Homo Sapiens
EPLLPCRDP

SEQ ID NO: 2985 - protein, 9 aa, Homo Sapiens
EPQPEGLLP

SEQ ID NO: 2986 - protein, 9 aa, Homo Sapiens
LTKVQAEIC

SEQ ID NO: 2987 - protein, 9 aa, Homo Sapiens
FLEAKLPDD

SEQ ID NO: 2988 - protein, 9 aa, Homo Sapiens
ASAISLMRK

SEQ ID NO: 2989 - protein, 9 aa, Homo Sapiens
HIGPVGRQN

SEQ ID NO: 2990 - protein, 9 aa, Homo Sapiens
AIDMTFKAK

SEQ ID NO: 2991 - protein, 9 aa, Homo Sapiens
FNGTFTVRP

SEQ ID NO: 2992 - protein, 9 aa, Homo Sapiens
CCIAIWMGN

SEQ ID NO: 2993 - protein, 9 aa, Homo Sapiens
SSLSNSVVE

SEQ ID NO: 2994 - protein, 9 aa, Homo Sapiens
NSKLTKVQA

SEQ ID NO: 2995 - protein, 9 aa, Homo Sapiens
EQIRKEIEK

SEQ ID NO: 2996 - protein, 9 aa, Homo Sapiens
CVQGPPALL

SEQ ID NO: 2997 - protein, 9 aa, Homo Sapiens
ETSLTQYLP

SEQ ID NO: 2998 - protein, 9 aa, Homo Sapiens
NCHNSKLTK

SEQ ID NO: 2999 - protein, 9 aa, Homo Sapiens
AVRPEPPAR

SEQ ID NO: 3000 - protein, 9 aa, Homo Sapiens
LSRFAHPQE

SEQ ID NO: 3001 - protein, 9 aa, Homo Sapiens
TFTVRPYIC

SEQ ID NO: 3002 - protein, 9 aa, Homo Sapiens
SPESIHSSP

SEQ ID NO: 3003 - protein, 9 aa, Homo Sapiens
WKRKREWWD

SEQ ID NO: 3004 - protein, 9 aa, Homo Sapiens
IIDAQDMAG

SEQ ID NO: 3005 - protein, 9 aa, Homo Sapiens
ILFLNPIPL

SEQ ID NO: 3006 - protein, 9 aa, Homo Sapiens
WLSRVKAEL

SEQ ID NO: 3007 - protein, 9 aa, Homo Sapiens
PQRYEILTP

SEQ ID NO: 3008 - protein, 9 aa, Homo Sapiens
KTFLEAKLP

SEQ ID NO: 3009 - protein, 9 aa, Homo Sapiens
QPEGLLPLD

SEQ ID NO: 3010 - protein, 9 aa, Homo Sapiens
LTTDALWNK

SEQ ID NO: 3011 - protein, 9 aa, Homo Sapiens
LIIDAQDMA

SEQ ID NO: 3012 - protein, 9 aa, Homo Sapiens
KVKVENGFQ

SEQ ID NO: 3013 - protein, 9 aa, Homo Sapiens
KECIYISEA

SEQ ID NO: 3014 - protein, 9 aa, Homo Sapiens
KHQIAKNKE

SEQ ID NO: 3015 - protein, 9 aa, Homo Sapiens
FVQSTHSQR

SEQ ID NO: 3016 - protein, 9 aa, Homo Sapiens
QGFKAIIDL

SEQ ID NO: 3017 - protein, 9 aa, Homo Sapiens
RSLDWLSRV

SEQ ID NO: 3018 - protein, 9 aa, Homo Sapiens
TKLWKNSYA

SEQ ID NO: 3019 - protein, 9 aa, Homo Sapiens
QRNNASEAC

SEQ ID NO: 3020 - protein, 9 aa, Homo Sapiens
ASGETTYRK

SEQ ID NO: 3021 - protein, 9 aa, Homo Sapiens
LRLDVFILL

SEQ ID NO: 3022 - protein, 9 aa, Homo Sapiens
LEQEARTRE

SEQ ID NO: 3023 - protein, 9 aa, Homo Sapiens
GHHFHWGGH

SEQ ID NO: 3024 - protein, 9 aa, Homo Sapiens
SNDVILDVW

SEQ ID NO: 3025 - protein, 9 aa, Homo Sapiens
VLFLALGSF

SEQ ID NO: 3026 - protein, 9 aa, Homo Sapiens
HVLEKLPDL

SEQ ID NO: 3027 - protein, 9 aa, Homo Sapiens
LFLFCCIAI

SEQ ID NO: 3028 - protein, 9 aa, Homo Sapiens
WIYLLRKNY

SEQ ID NO: 3029 - protein, 9 aa, Homo Sapiens
MSPEEASDM

SEQ ID NO: 3030 - protein, 9 aa, Homo Sapiens
PEGLLPLDI

SEQ ID NO: 3031 - protein, 9 aa, Homo Sapiens
HSNDCCPSS

SEQ ID NO: 3032 - protein, 9 aa, Homo Sapiens
SAERIERVY

SEQ ID NO: 3033 - protein, 9 aa, Homo Sapiens
SPEEASDMI

SEQ ID NO: 3034 - protein, 9 aa, Homo Sapiens
DSYLQLSDA

SEQ ID NO: 3035 - protein, 9 aa, Homo Sapiens
EQEYFSGEE

SEQ ID NO: 3036 - protein, 9 aa, Homo Sapiens
LWNKVTELE

SEQ ID NO: 3037 - protein, 9 aa, Homo Sapiens
IYLLRKNYY

SEQ ID NO: 3038 - protein, 9 aa, Homo Sapiens
GPPALLQAY

SEQ ID NO: 3039 - protein, 9 aa, Homo Sapiens
FLALGSFYL

SEQ ID NO: 3040 - protein, 9 aa, Homo Sapiens
VTELHRKES

SEQ ID NO: 3041 - protein, 9 aa, Homo Sapiens
LLVGVGDSG

SEQ ID NO: 3042 - protein, 9 aa, Homo Sapiens
RGKPGTASL

SEQ ID NO: 3043 - protein, 9 aa, Homo Sapiens
LNPIPLDPK

SEQ ID NO: 3044 - protein, 9 aa, Homo Sapiens
MNSTGDFHL

SEQ ID NO: 3045 - protein, 9 aa, Homo Sapiens
GFKAIIDLM

SEQ ID NO: 3046 - protein, 9 aa, Homo Sapiens
CILSSSIIS

SEQ ID NO: 3047 - protein, 9 aa, Homo Sapiens
PPGVLEQEA

SEQ ID NO: 3048 - protein, 9 aa, Homo Sapiens
HTRTALLFG

SEQ ID NO: 3049 - protein, 9 aa, Homo Sapiens
TGPDLKNNR

SEQ ID NO: 3050 - protein, 9 aa, Homo Sapiens
PPVQLGLGR

SEQ ID NO: 3051 - protein, 9 aa, Homo Sapiens
LHPAGVFHI

SEQ ID NO: 3052 - protein, 9 aa, Homo Sapiens
QKQQARMTA

SEQ ID NO: 3053 - protein, 9 aa, Homo Sapiens
ELQESTKMK

SEQ ID NO: 3054 - protein, 9 aa, Homo Sapiens
NSTGDFHLH

SEQ ID NO: 3055 - protein, 9 aa, Homo Sapiens
AQTPLGRLR

SEQ ID NO: 3056 - protein, 9 aa, Homo Sapiens
KMKLWILRL

SEQ ID NO: 3057 - protein, 9 aa, Homo Sapiens
VGDSGKQSL

SEQ ID NO: 3058 - protein, 9 aa, Homo Sapiens
HQIAKNKEI

SEQ ID NO: 3059 - protein, 9 aa, Homo Sapiens
LICLHTHVL

SEQ ID NO: 3060 - protein, 9 aa, Homo Sapiens
HFFRAAFLE

SEQ ID NO: 3061 - protein, 9 aa, Homo Sapiens
CIYISEAAP

SEQ ID NO: 3062 - protein, 9 aa, Homo Sapiens
PQPEGLLPL

SEQ ID NO: 3063 - protein, 9 aa, Homo Sapiens
HEEKEKVKV

SEQ ID NO: 3064 - protein, 9 aa, Homo Sapiens
GLLLCPLLS

SEQ ID NO: 3065 - protein, 9 aa, Homo Sapiens
FKAIIDLMY

SEQ ID NO: 3066 - protein, 9 aa, Homo Sapiens
GFGFVTYAA

SEQ ID NO: 3067 - protein, 9 aa, Homo Sapiens
VSSVCVNFE

SEQ ID NO: 3068 - protein, 9 aa, Homo Sapiens
LVGVGDSGK

SEQ ID NO: 3069 - protein, 9 aa, Homo Sapiens
TGTKLWKNS

SEQ ID NO: 3070 - protein, 9 aa, Homo Sapiens
QLSRFAHPQ

SEQ ID NO: 3071 - protein, 9 aa, Homo Sapiens
VEYSVDKSA

SEQ ID NO: 3072 - protein, 9 aa, Homo Sapiens
TKQQDHFFR

SEQ ID NO: 3073 - protein, 9 aa, Homo Sapiens
LLLFLRLDV

SEQ ID NO: 3074 - protein, 9 aa, Homo Sapiens
VFILLHPAG

SEQ ID NO: 3075 - protein, 9 aa, Homo Sapiens
HNSKLTKVQ

SEQ ID NO: 3076 - protein, 9 aa, Homo Sapiens
ICLHTHVLE

SEQ ID NO: 3077 - protein, 9 aa, Homo Sapiens
VREPLLPCR

SEQ ID NO: 3078 - protein, 9 aa, Homo Sapiens
FRAAFLEER

SEQ ID NO: 3079 - protein, 9 aa, Homo Sapiens
LFCCIAIWM

SEQ ID NO: 3080 - protein, 9 aa, Homo Sapiens
GDSGKQSLS

SEQ ID NO: 3081 - protein, 9 aa, Homo Sapiens
KKYGEKTKT

SEQ ID NO: 3082 - protein, 9 aa, Homo Sapiens
YTLDVLERC

SEQ ID NO: 3083 - protein, 9 aa, Homo Sapiens
TDALWNKVT

SEQ ID NO: 3084 - protein, 9 aa, Homo Sapiens
HFHWGGHER

SEQ ID NO: 3085 - protein, 9 aa, Homo Sapiens
ESDQELQES

SEQ ID NO: 3086 - protein, 9 aa, Homo Sapiens
LFLSNCHNS

SEQ ID NO: 3087 - protein, 9 aa, Homo Sapiens
SMSVIRPHW

SEQ ID NO: 3088 - protein, 9 aa, Homo Sapiens
KRGKPGTAS

SEQ ID NO: 3089 - protein, 9 aa, Homo Sapiens
HPQEILRDS

SEQ ID NO: 3090 - protein, 9 aa, Homo Sapiens
EKEKVKVEN

SEQ ID NO: 3091 - protein, 9 aa, Homo Sapiens
EQKILLEDE

SEQ ID NO: 3092 - protein, 9 aa, Homo Sapiens
KYELIIDAQ

SEQ ID NO: 3093 - protein, 9 aa, Homo Sapiens
RLDVFILLH

SEQ ID NO: 3094 - protein, 9 aa, Homo Sapiens
RGCDFCQVL

SEQ ID NO: 3095 - protein, 9 aa, Homo Sapiens
MSRSLDWLS

SEQ ID NO: 3096 - protein, 9 aa, Homo Sapiens
EPGYVLFLA

SEQ ID NO: 3097 - protein, 9 aa, Homo Sapiens
RSSSVSSIS

SEQ ID NO: 3098 - protein, 9 aa, Homo Sapiens
TYRKTTSST

SEQ ID NO: 3099 - protein, 9 aa, Homo Sapiens
PGTASLRVT

SEQ ID NO: 3100 - protein, 9 aa, Homo Sapiens
TMRRQEEKM

SEQ ID NO: 3101 - protein, 9 aa, Homo Sapiens
KQVEGHVQL

SEQ ID NO: 3102 - protein, 9 aa, Homo Sapiens
CPSSSKCHN

SEQ ID NO: 3103 - protein, 9 aa, Homo Sapiens
TSPESIHSS

SEQ ID NO: 3104 - protein, 9 aa, Homo Sapiens
PLDPKENSK

SEQ ID NO: 3105 - protein, 9 aa, Homo Sapiens
RCPHRPILQ

SEQ ID NO: 3106 - protein, 9 aa, Homo Sapiens
RDSAEPYSS

SEQ ID NO: 3107 - protein, 9 aa, Homo Sapiens
SNCHNSKLT

SEQ ID NO: 3108 - protein, 9 aa, Homo Sapiens
IYISEAAPR

SEQ ID NO: 3109 - protein, 9 aa, Homo Sapiens
SFCWKRKRE

SEQ ID NO: 3110 - protein, 9 aa, Homo Sapiens
FVTYAAVEE

SEQ ID NO: 3111 - protein, 9 aa, Homo Sapiens
SDQELQEST

SEQ ID NO: 3112 - protein, 9 aa, Homo Sapiens
CFVLFLFCC

SEQ ID NO: 3113 - protein, 9 aa, Homo Sapiens
ASSASGVES

SEQ ID NO: 3114 - protein, 9 aa, Homo Sapiens
ERIERVYFE

SEQ ID NO: 3115 - protein, 9 aa, Homo Sapiens
TVRPYICEA

SEQ ID NO: 3116 - protein, 9 aa, Homo Sapiens
RVREPLLPC

SEQ ID NO: 3117 - protein, 9 aa, Homo Sapiens
HEQIRKEIE

SEQ ID NO: 3118 - protein, 9 aa, Homo Sapiens
CVNFESFEV

SEQ ID NO: 3119 - protein, 9 aa, Homo Sapiens
FSVFSTDSY

SEQ ID NO: 3120 - protein, 9 aa, Homo Sapiens
DESKEKPET

SEQ ID NO: 3121 - protein, 9 aa, Homo Sapiens
SVIRPHWPY

SEQ ID NO: 3122 - protein, 9 aa, Homo Sapiens
QQDHFFRAA

SEQ ID NO: 3123 - protein, 9 aa, Homo Sapiens
PGVLEQEAR

SEQ ID NO: 3124 - protein, 9 aa, Homo Sapiens
PEPPARAPA

SEQ ID NO: 3125 - protein, 9 aa, Homo Sapiens
ASDMIYFGR

SEQ ID NO: 3126 - protein, 9 aa, Homo Sapiens
EEASDMIYF

SEQ ID NO: 3127 - protein, 9 aa, Homo Sapiens
KVEAPSSED

SEQ ID NO: 3128 - protein, 9 aa, Homo Sapiens
PPHLGHHFH

SEQ ID NO: 3129 - protein, 9 aa, Homo Sapiens
IYRGEEDPQ

SEQ ID NO: 3130 - protein, 9 aa, Homo Sapiens
KNKEIEKGE

SEQ ID NO: 3131 - protein, 9 aa, Homo Sapiens
FLRLDVFIL

SEQ ID NO: 3132 - protein, 9 aa, Homo Sapiens
VQLSRFAHP

SEQ ID NO: 3133 - protein, 9 aa, Homo Sapiens
QEQEETMRR

SEQ ID NO: 3134 - protein, 9 aa, Homo Sapiens
WNRLTQRYL

SEQ ID NO: 3135 - protein, 9 aa, Homo Sapiens
IIDLMYSAH

SEQ ID NO: 3136 - protein, 9 aa, Homo Sapiens
NDCCPSSSK

SEQ ID NO: 3137 - protein, 9 aa, Homo Sapiens
YITNLQRQL

SEQ ID NO: 3138 - protein, 9 aa, Homo Sapiens
NPKYELIID

SEQ ID NO: 3139 - protein, 9 aa, Homo Sapiens
CWNRLTQRY

SEQ ID NO: 3140 - protein, 9 aa, Homo Sapiens
LPAAGKREV

SEQ ID NO: 3141 - protein, 9 aa, Homo Sapiens
DALWNKVTE

SEQ ID NO: 3142 - protein, 9 aa, Homo Sapiens
FGGQRKRLA

SEQ ID NO: 3143 - protein, 9 aa, Homo Sapiens
QAEPPGVLE

SEQ ID NO: 3144 - protein, 9 aa, Homo Sapiens
DVLERCPHR

SEQ ID NO: 3145 - protein, 9 aa, Homo Sapiens
TGDFHLHLL

SEQ ID NO: 3146 - protein, 9 aa, Homo Sapiens
FESFEVGAG

SEQ ID NO: 3147 - protein, 9 aa, Homo Sapiens
ILSSSIISV

SEQ ID NO: 3148 - protein, 9 aa, Homo Sapiens
SSMSVIRPH

SEQ ID NO: 3149 - protein, 9 aa, Homo Sapiens
VPPHLGHHF

SEQ ID NO: 3150 - protein, 9 aa, Homo Sapiens
LGLGRKPLD

SEQ ID NO: 3151 - protein, 9 aa, Homo Sapiens
TKTVSSRKK

SEQ ID NO: 3152 - protein, 9 aa, Homo Sapiens
GVESLSEEE

SEQ ID NO: 3153 - protein, 9 aa, Homo Sapiens
ILLEDESKE

SEQ ID NO: 3154 - protein, 9 aa, Homo Sapiens
SPPPPVVVP

SEQ ID NO: 3155 - protein, 9 aa, Homo Sapiens
TLDVLERCP

SEQ ID NO: 3156 - protein, 9 aa, Homo Sapiens
AGVFHIGPV

SEQ ID NO: 3157 - protein, 9 aa, Homo Sapiens
SEAAPRQRI

SEQ ID NO: 3158 - protein, 9 aa, Homo Sapiens
FMKTFLEAK

SEQ ID NO: 3159 - protein, 9 aa, Homo Sapiens
LEHMKAVYN

SEQ ID NO: 3160 - protein, 9 aa, Homo Sapiens
VVENSPGIV

SEQ ID NO: 3161 - protein, 9 aa, Homo Sapiens
HSQRNNASE

SEQ ID NO: 3162 - protein, 9 aa, Homo Sapiens
GNLTTDALW

SEQ ID NO: 3163 - protein, 9 aa, Homo Sapiens
NLTTDALWN

SEQ ID NO: 3164 - protein, 9 aa, Homo Sapiens
QYLPAAGKR

SEQ ID NO: 3165 - protein, 9 aa, Homo Sapiens
KRKREWWDE

SEQ ID NO: 3166 - protein, 9 aa, Homo Sapiens
GEECYEDDS

SEQ ID NO: 3167 - protein, 9 aa, Homo Sapiens
QELQESTKM

SEQ ID NO: 3168 - protein, 9 aa, Homo Sapiens
CCPSSSKCH

SEQ ID NO: 3169 - protein, 9 aa, Homo Sapiens
LERCPHRPI

SEQ ID NO: 3170 - protein, 9 aa, Homo Sapiens
QLGLGRKPL

SEQ ID NO: 3171 - protein, 9 aa, Homo Sapiens
VSSISSTQS

SEQ ID NO: 3172 - protein, 9 aa, Homo Sapiens
TRRDSAEPY

SEQ ID NO: 3173 - protein, 9 aa, Homo Sapiens
FVLFLFCCI

SEQ ID NO: 3174 - protein, 9 aa, Homo Sapiens
LTQYLPAAG

SEQ ID NO: 3175 - protein, 9 aa, Homo Sapiens
YKPGNLSPP

SEQ ID NO: 3176 - protein, 9 aa, Homo Sapiens
SGETTYRKT

SEQ ID NO: 3177 - protein, 9 aa, Homo Sapiens
HRCRCQRPN

SEQ ID NO: 3178 - protein, 9 aa, Homo Sapiens
AAVEEVDAA

SEQ ID NO: 3179 - protein, 9 aa, Homo Sapiens
SWIYLLRKN

SEQ ID NO: 3180 - protein, 9 aa, Homo Sapiens
LSNSVVENS

SEQ ID NO: 3181 - protein, 9 aa, Homo Sapiens
LDVFILLHP

SEQ ID NO: 3182 - protein, 9 aa, Homo Sapiens
LRVTELHRK

SEQ ID NO: 3183 - protein, 9 aa, Homo Sapiens
APPVQLGLG

SEQ ID NO: 3184 - protein, 9 aa, Homo Sapiens
IGQIQGATG

SEQ ID NO: 3185 - protein, 9 aa, Homo Sapiens
SYLQLSDAV

SEQ ID NO: 3186 - protein, 9 aa, Homo Sapiens
RDSTNFLFL

SEQ ID NO: 3187 - protein, 9 aa, Homo Sapiens
KQRISRGCD

SEQ ID NO: 3188 - protein, 9 aa, Homo Sapiens
IMGSAERIE

SEQ ID NO: 3189 - protein, 9 aa, Homo Sapiens
LPCRDPGDF

SEQ ID NO: 3190 - protein, 9 aa, Homo Sapiens
DAVQLLQLS

SEQ ID NO: 3191 - protein, 9 aa, Homo Sapiens
KLWILRLLC

SEQ ID NO: 3192 - protein, 9 aa, Homo Sapiens
SSTSTGHAN

SEQ ID NO: 3193 - protein, 9 aa, Homo Sapiens
SGDLPLGDQ

SEQ ID NO: 3194 - protein, 9 aa, Homo Sapiens
GPSARAPLQ

SEQ ID NO: 3195 - protein, 9 aa, Homo Sapiens
FRYQKNPRA

SEQ ID NO: 3196 - protein, 9 aa, Homo Sapiens
FAGLVSLLH

SEQ ID NO: 3197 - protein, 9 aa, Homo Sapiens
RLLATGGAD

SEQ ID NO: 3198 - protein, 9 aa, Homo Sapiens
PSARAPLQH

SEQ ID NO: 3199 - protein, 9 aa, Homo Sapiens
NSLAVYRLP

SEQ ID NO: 3200 - protein, 9 aa, Homo Sapiens
KKRKQKKQD

SEQ ID NO: 3201 - protein, 9 aa, Homo Sapiens
GDLPLGDQK

SEQ ID NO: 3202 - protein, 9 aa, Homo Sapiens
VVMPPLIRG

SEQ ID NO: 3203 - protein, 9 aa, Homo Sapiens
GDNPNSLAV

SEQ ID NO: 3204 - protein, 9 aa, Homo Sapiens
VTEPPVVCS

SEQ ID NO: 3205 - protein, 9 aa, Homo Sapiens
SRLLATGGA

SEQ ID NO: 3206 - protein, 9 aa, Homo Sapiens
TDTSSTSTG

SEQ ID NO: 3207 - protein, 9 aa, Homo Sapiens
GPFRYQKNP

SEQ ID NO: 3208 - protein, 9 aa, Homo Sapiens
NGPFRYQKN

SEQ ID NO: 3209 - protein, 9 aa, Homo Sapiens
SSSGDLPLG

SEQ ID NO: 3210 - protein, 9 aa, Homo Sapiens
FFPGQPILY

SEQ ID NO: 3211 - protein, 9 aa, Homo Sapiens
FGPNSRLLA

SEQ ID NO: 3212 - protein, 9 aa, Homo Sapiens
PPLSLGKKC

SEQ ID NO: 3213 - protein, 9 aa, Homo Sapiens
NPNSLAVYR

SEQ ID NO: 3214 - protein, 9 aa, Homo Sapiens
YFFPGQPIL

SEQ ID NO: 3215 - protein, 9 aa, Homo Sapiens
LIRGAQQIH

SEQ ID NO: 3216 - protein, 9 aa, Homo Sapiens
SLGKKCPAR

SEQ ID NO: 3217 - protein, 9 aa, Homo Sapiens
RRRAKKAWL

SEQ ID NO: 3218 - protein, 9 aa, Homo Sapiens
AWLLGPTVM

SEQ ID NO: 3219 - protein, 9 aa, Homo Sapiens
QKNPRAAWL

SEQ ID NO: 3220 - protein, 9 aa, Homo Sapiens
NSRLLATGG

SEQ ID NO: 3221 - protein, 9 aa, Homo Sapiens
LSLGKKCPA

SEQ ID NO: 3222 - protein, 9 aa, Homo Sapiens
EDLRGALRD

SEQ ID NO: 3223 - protein, 9 aa, Homo Sapiens
KKAWLLGPT

SEQ ID NO: 3224 - protein, 9 aa, Homo Sapiens
DLPLGDQKP

SEQ ID NO: 3225 - protein, 9 aa, Homo Sapiens
SSSSGDLPL

SEQ ID NO: 3226 - protein, 9 aa, Homo Sapiens
AGLVSLLHY

SEQ ID NO: 3227 - protein, 9 aa, Homo Sapiens
PPLIRGAQQ

SEQ ID NO: 3228 - protein, 9 aa, Homo Sapiens
MGFAGLVSL

SEQ ID NO: 3229 - protein, 9 aa, Homo Sapiens
ARAPLQHPA

SEQ ID NO: 3230 - protein, 9 aa, Homo Sapiens
KRRRAKKAW

SEQ ID NO: 3231 - protein, 9 aa, Homo Sapiens
KRKQKKQDA

SEQ ID NO: 3232 - protein, 9 aa, Homo Sapiens
APGPCPCSN

SEQ ID NO: 3233 - protein, 9 aa, Homo Sapiens
PCSNAMLAV

SEQ ID NO: 3234 - protein, 9 aa, Homo Sapiens
GFAGLVSLL

SEQ ID NO: 3235 - protein, 9 aa, Homo Sapiens
KQDALAASH

SEQ ID NO: 3236 - protein, 9 aa, Homo Sapiens
RHMSPPLSL

SEQ ID NO: 3237 - protein, 9 aa, Homo Sapiens
LLHYHEPSN

SEQ ID NO: 3238 - protein, 9 aa, Homo Sapiens
LRHMSPPLS

SEQ ID NO: 3239 - protein, 9 aa, Homo Sapiens
SARAPLQHP

SEQ ID NO: 3240 - protein, 9 aa, Homo Sapiens
MVTEPPVVC

SEQ ID NO: 3241 - protein, 9 aa, Homo Sapiens
QDALAASHE

SEQ ID NO: 3242 - protein, 9 aa, Homo Sapiens
LPVTDTSST

SEQ ID NO: 3243 - protein, 9 aa, Homo Sapiens
SPAPGPCPC

SEQ ID NO: 3244 - protein, 9 aa, Homo Sapiens
LRGALRDQA

SEQ ID NO: 3245 - protein, 9 aa, Homo Sapiens
PNSLAVYRL

SEQ ID NO: 3246 - protein, 9 aa, Homo Sapiens
TRSLEDLRG

SEQ ID NO: 3247 - protein, 9 aa, Homo Sapiens
RFGPNSRLL

SEQ ID NO: 3248 - protein, 9 aa, Homo Sapiens
CPCSNAMLA

SEQ ID NO: 3249 - protein, 9 aa, Homo Sapiens
KQKKQDALA

SEQ ID NO: 3250 - protein, 9 aa, Homo Sapiens
TSTGHANPL

SEQ ID NO: 3251 - protein, 9 aa, Homo Sapiens
GSSSSGDLP

SEQ ID NO: 3252 - protein, 9 aa, Homo Sapiens
SLEDLRGAL

SEQ ID NO: 3253 - protein, 9 aa, Homo Sapiens
PAPGPCPCS

SEQ ID NO: 3254 - protein, 9 aa, Homo Sapiens
RAPLQHPAF

SEQ ID NO: 3255 - protein, 9 aa, Homo Sapiens
SQVVMPPLI

SEQ ID NO: 3256 - protein, 9 aa, Homo Sapiens
QKKQDALAA

SEQ ID NO: 3257 - protein, 9 aa, Homo Sapiens
AVYRLPTLD

SEQ ID NO: 3258 - protein, 9 aa, Homo Sapiens
QVVMPPLIR

SEQ ID NO: 3259 - protein, 9 aa, Homo Sapiens
GLVSLLHYH

SEQ ID NO: 3260 - protein, 9 aa, Homo Sapiens
GPNSRLLAT

SEQ ID NO: 3261 - protein, 9 aa, Homo Sapiens
VMPPLIRGA

SEQ ID NO: 3262 - protein, 9 aa, Homo Sapiens
VYRLPTLDP

SEQ ID NO: 3263 - protein, 9 aa, Homo Sapiens
MPPLIRGAQ

SEQ ID NO: 3264 - protein, 9 aa, Homo Sapiens
VTDTSSTST

SEQ ID NO: 3265 - protein, 9 aa, Homo Sapiens
VRFGPNSRL

SEQ ID NO: 3266 - protein, 9 aa, Homo Sapiens
ASPVYFFPG

SEQ ID NO: 3267 - protein, 9 aa, Homo Sapiens
PVTDTSSTS

SEQ ID NO: 3268 - protein, 9 aa, Homo Sapiens
CSYFAQDLW

SEQ ID NO: 3269 - protein, 9 aa, Homo Sapiens
LTRSLEDLR

SEQ ID NO: 3270 - protein, 9 aa, Homo Sapiens
DLRGALRDQ

SEQ ID NO: 3271 - protein, 9 aa, Homo Sapiens
KNPRAAWLP

SEQ ID NO: 3272 - protein, 9 aa, Homo Sapiens
HMSPPLSLG

SEQ ID NO: 3273 - protein, 9 aa, Homo Sapiens
RRAKKAWLL

SEQ ID NO: 3274 - protein, 9 aa, Homo Sapiens
KAWLLGPTV

SEQ ID NO: 3275 - protein, 9 aa, Homo Sapiens
PFRYQKNPR

SEQ ID NO: 3276 - protein, 9 aa, Homo Sapiens
SSGDLPLGD

SEQ ID NO: 3277 - protein, 9 aa, Homo Sapiens
SPPLSLGKK

SEQ ID NO: 3278 - protein, 9 aa, Homo Sapiens
PLSLGKKCP

SEQ ID NO: 3279 - protein, 9 aa, Homo Sapiens
GAHGPSARA

SEQ ID NO: 3280 - protein, 9 aa, Homo Sapiens
AHGPSARAP

SEQ ID NO: 3281 - protein, 9 aa, Homo Sapiens
PVVCSYFAQ

SEQ ID NO: 3282 - protein, 9 aa, Homo Sapiens
TSSTSTGHA

SEQ ID NO: 3283 - protein, 9 aa, Homo Sapiens
VVCSYFAQD

SEQ ID NO: 3284 - protein, 9 aa, Homo Sapiens
DTSSTSTGH

SEQ ID NO: 3285 - protein, 9 aa, Homo Sapiens
STSTGHANP

SEQ ID NO: 3286 - protein, 9 aa, Homo Sapiens
RSLEDLRGA

SEQ ID NO: 3287 - protein, 9 aa, Homo Sapiens
HGPSARAPL

SEQ ID NO: 3288 - protein, 9 aa, Homo Sapiens
ELTRSLEDL

SEQ ID NO: 3289 - protein, 9 aa, Homo Sapiens
RKKRKQKKQ

SEQ ID NO: 3290 - protein, 9 aa, Homo Sapiens
PVYFFPGQP

SEQ ID NO: 3291 - protein, 9 aa, Homo Sapiens
PGAHGPSAR

SEQ ID NO: 3292 - protein, 9 aa, Homo Sapiens
PLIRGAQQI

SEQ ID NO: 3293 - protein, 9 aa, Homo Sapiens
TEPPVVCSY

SEQ ID NO: 3294 - protein, 9 aa, Homo Sapiens
VSLLHYHEP

SEQ ID NO: 3295 - protein, 9 aa, Homo Sapiens
VYFFPGQPI

SEQ ID NO: 3296 - protein, 9 aa, Homo Sapiens
LASPVYFFP

SEQ ID NO: 3297 - protein, 9 aa, Homo Sapiens
SLLHYHEPS

SEQ ID NO: 3298 - protein, 9 aa, Homo Sapiens
AKKAWLLGP

SEQ ID NO: 3299 - protein, 9 aa, Homo Sapiens
IRGAQQIHS

SEQ ID NO: 3300 - protein, 9 aa, Homo Sapiens
PNSRLLATG

SEQ ID NO: 3301 - protein, 9 aa, Homo Sapiens
RYQKNPRAA

SEQ ID NO: 3302 - protein, 9 aa, Homo Sapiens
RAKKAWLLG

SEQ ID NO: 3303 - protein, 9 aa, Homo Sapiens
SLAVYRLPT

SEQ ID NO: 3304 - protein, 9 aa, Homo Sapiens
AVRFGPNSR

SEQ ID NO: 3305 - protein, 9 aa, Homo Sapiens
GPCPCSNAM

SEQ ID NO: 3306 - protein, 9 aa, Homo Sapiens
SPVYFFPGQ

SEQ ID NO: 3307 - protein, 9 aa, Homo Sapiens
LVSLLHYHE

SEQ ID NO: 3308 - protein, 9 aa, Homo Sapiens
RGSSSSGDL

SEQ ID NO: 3309 - protein, 9 aa, Homo Sapiens
LPLGDQKPP

SEQ ID NO: 3310 - protein, 9 aa, Homo Sapiens
PCPCSNAML

SEQ ID NO: 3311 - protein, 9 aa, Homo Sapiens
DNPNSLAVY

SEQ ID NO: 3312 - protein, 9 aa, Homo Sapiens
LEDLRGALR

SEQ ID NO: 3313 - protein, 9 aa, Homo Sapiens
PGPCPCSNA

SEQ ID NO: 3314 - protein, 9 aa, Homo Sapiens
WLLGPTVML

SEQ ID NO: 3315 - protein, 9 aa, Homo Sapiens
FNGPFRYQK

SEQ ID NO: 3316 - protein, 9 aa, Homo Sapiens
YQKNPRAAW

SEQ ID NO: 3317 - protein, 9 aa, Homo Sapiens
KKQDALAAS

SEQ ID NO: 3318 - protein, 9 aa, Homo Sapiens
LAVYRLPTL

SEQ ID NO: 3319 - protein, 9 aa, Homo Sapiens
VCSYFAQDL

SEQ ID NO: 3320 - protein, 9 aa, Homo Sapiens
CSNAMLAVK

SEQ ID NO: 3321 - protein, 9 aa, Homo Sapiens
RKQKKQDAL

SEQ ID NO: 3322 - protein, 9 aa, Homo Sapiens
MSPPLSLGK

SEQ ID NO: 3323 - protein, 9 aa, Homo Sapiens
AVPLARPRH

SEQ ID NO: 3324 - protein, 9 aa, Homo Sapiens
YRDCMKMGK

SEQ ID NO: 3325 - protein, 9 aa, Homo Sapiens
AMPMADGGE

SEQ ID NO: 3326 - protein, 9 aa, Homo Sapiens
YKQNIFDYY

SEQ ID NO: 3327 - protein, 9 aa, Homo Sapiens
RHIIFHSGE

SEQ ID NO: 3328 - protein, 9 aa, Homo Sapiens
ANRPPAPIY

SEQ ID NO: 3329 - protein, 9 aa, Homo Sapiens
KEYDVIVLG

SEQ ID NO: 3330 - protein, 9 aa, Homo Sapiens
EILQNRNIH

SEQ ID NO: 3331 - protein, 9 aa, Homo Sapiens
TEAKKHCWC

SEQ ID NO: 3332 - protein, 9 aa, Homo Sapiens
EGSERKPRM

SEQ ID NO: 3333 - protein, 9 aa, Homo Sapiens
KSSNIFVRG

SEQ ID NO: 3334 - protein, 9 aa, Homo Sapiens
SRVICTARQ

SEQ ID NO: 3335 - protein, 9 aa, Homo Sapiens
NLECLSAIL

SEQ ID NO: 3336 - protein, 9 aa, Homo Sapiens
RGYPKPLAQ

SEQ ID NO: 3337 - protein, 9 aa, Homo Sapiens
GEGSERKPR

SEQ ID NO: 3338 - protein, 9 aa, Homo Sapiens
SKESANSLV

SEQ ID NO: 3339 - protein, 9 aa, Homo Sapiens
KTENGPSYE

SEQ ID NO: 3340 - protein, 9 aa, Homo Sapiens
MVVASVVDQ

SEQ ID NO: 3341 - protein, 9 aa, Homo Sapiens
MDNSVLEIT

SEQ ID NO: 3342 - protein, 9 aa, Homo Sapiens
HYGYHQCMK

SEQ ID NO: 3343 - protein, 9 aa, Homo Sapiens
NQETDQSEI

SEQ ID NO: 3344 - protein, 9 aa, Homo Sapiens
MAGAATQAF

SEQ ID NO: 3345 - protein, 9 aa, Homo Sapiens
YQREPRSPR

SEQ ID NO: 3346 - protein, 9 aa, Homo Sapiens
HLCRPTAQV

SEQ ID NO: 3347 - protein, 9 aa, Homo Sapiens
PVKTQGPRD

SEQ ID NO: 3348 - protein, 9 aa, Homo Sapiens
GFNCKSGKR

SEQ ID NO: 3349 - protein, 9 aa, Homo Sapiens
RRPGESFHV

SEQ ID NO: 3350 - protein, 9 aa, Homo Sapiens
CLSAILIHG

SEQ ID NO: 3351 - protein, 9 aa, Homo Sapiens
ICSLCVPPV

SEQ ID NO: 3352 - protein, 9 aa, Homo Sapiens
ASAVPLARP

SEQ ID NO: 3353 - protein, 9 aa, Homo Sapiens
CVFLQYGEI

SEQ ID NO: 3354 - protein, 9 aa, Homo Sapiens
DSATKEEDT

SEQ ID NO: 3355 - protein, 9 aa, Homo Sapiens
VDTYVEIRP

SEQ ID NO: 3356 - protein, 9 aa, Homo Sapiens
TMDNSVLEI

SEQ ID NO: 3357 - protein, 9 aa, Homo Sapiens
QAQPPGMFL

SEQ ID NO: 3358 - protein, 9 aa, Homo Sapiens
AAFAYKALF

SEQ ID NO: 3359 - protein, 9 aa, Homo Sapiens
LEPSSSGEE

SEQ ID NO: 3360 - protein, 9 aa, Homo Sapiens
NITLSYKGT

SEQ ID NO: 3361 - protein, 9 aa, Homo Sapiens
MFTTVSEIT

SEQ ID NO: 3362 - protein, 9 aa, Homo Sapiens
FLQYGEIVN

SEQ ID NO: 3363 - protein, 9 aa, Homo Sapiens
SLPAESFGP

SEQ ID NO: 3364 - protein, 9 aa, Homo Sapiens
TVPGGHPLA

SEQ ID NO: 3365 - protein, 9 aa, Homo Sapiens
PLESAHDPN

SEQ ID NO: 3366 - protein, 9 aa, Homo Sapiens
GAATQAFLE

SEQ ID NO: 3367 - protein, 9 aa, Homo Sapiens
MVQRRPGES

SEQ ID NO: 3368 - protein, 9 aa, Homo Sapiens
GFHQESKLE

SEQ ID NO: 3369 - protein, 9 aa, Homo Sapiens
EEQGDRDGE

SEQ ID NO: 3370 - protein, 9 aa, Homo Sapiens
QLKGNLRTP

SEQ ID NO: 3371 - protein, 9 aa, Homo Sapiens
SYKLVAYQR

SEQ ID NO: 3372 - protein, 9 aa, Homo Sapiens
KNKLTHIPD

SEQ ID NO: 3373 - protein, 9 aa, Homo Sapiens
EPLVPKMSH

SEQ ID NO: 3374 - protein, 9 aa, Homo Sapiens
AQSGNAGRP

SEQ ID NO: 3375 - protein, 9 aa, Homo Sapiens
LMGYQTYSQ

SEQ ID NO: 3376 - protein, 9 aa, Homo Sapiens
NRKSVQRIK

SEQ ID NO: 3377 - protein, 9 aa, Homo Sapiens
VQSLKERLA

SEQ ID NO: 3378 - protein, 9 aa, Homo Sapiens
VYAGILSYR

SEQ ID NO: 3379 - protein, 9 aa, Homo Sapiens
PNVENRGCR

SEQ ID NO: 3380 - protein, 9 aa, Homo Sapiens
WALLDPFQK

SEQ ID NO: 3381 - protein, 9 aa, Homo Sapiens
VLQVIFVSL

SEQ ID NO: 3382 - protein, 9 aa, Homo Sapiens
GSVCTLKIQ

SEQ ID NO: 3383 - protein, 9 aa, Homo Sapiens
GQRQPSEQQ

SEQ ID NO: 3384 - protein, 9 aa, Homo Sapiens
PGHGRNCYD

SEQ ID NO: 3385 - protein, 9 aa, Homo Sapiens
KDEAKKQRK

SEQ ID NO: 3386 - protein, 9 aa, Homo Sapiens
DPYQREPRS

SEQ ID NO: 3387 - protein, 9 aa, Homo Sapiens
CQFYVVNSK

SEQ ID NO: 3388 - protein, 9 aa, Homo Sapiens
VGAHSEESS

SEQ ID NO: 3389 - protein, 9 aa, Homo Sapiens
SPVSHFESR

SEQ ID NO: 3390 - protein, 9 aa, Homo Sapiens
RPLQRTDSR

SEQ ID NO: 3391 - protein, 9 aa, Homo Sapiens
RTTGLIPWL

SEQ ID NO: 3392 - protein, 9 aa, Homo Sapiens
FSTTKDCCV

SEQ ID NO: 3393 - protein, 9 aa, Homo Sapiens
AGEGSERKP

SEQ ID NO: 3394 - protein, 9 aa, Homo Sapiens
DKSLEGDKT

SEQ ID NO: 3395 - protein, 9 aa, Homo Sapiens
SAITLADGG

SEQ ID NO: 3396 - protein, 9 aa, Homo Sapiens
KQFKETMMG

SEQ ID NO: 3397 - protein, 9 aa, Homo Sapiens
REQGGFEYK

SEQ ID NO: 3398 - protein, 9 aa, Homo Sapiens
GYSFKPKYD

SEQ ID NO: 3399 - protein, 9 aa, Homo Sapiens
GSERKPRMP

SEQ ID NO: 3400 - protein, 9 aa, Homo Sapiens
HSTKEHLRD

SEQ ID NO: 3401 - protein, 9 aa, Homo Sapiens
PHLGNSSSL

SEQ ID NO: 3402 - protein, 9 aa, Homo Sapiens
LGEKSQDDV

SEQ ID NO: 3403 - protein, 9 aa, Homo Sapiens
QHVNHVWSQ

SEQ ID NO: 3404 - protein, 9 aa, Homo Sapiens
ISPVSHFES

SEQ ID NO: 3405 - protein, 9 aa, Homo Sapiens
SERKPRMPV

SEQ ID NO: 3406 - protein, 9 aa, Homo Sapiens
FLDVDKTSF

SEQ ID NO: 3407 - protein, 9 aa, Homo Sapiens
PKVEPAFPG

SEQ ID NO: 3408 - protein, 9 aa, Homo Sapiens
EALSHPNCA

SEQ ID NO: 3409 - protein, 9 aa, Homo Sapiens
PRPNTEESG

SEQ ID NO: 3410 - protein, 9 aa, Homo Sapiens
GRGPKQPEQ

SEQ ID NO: 3411 - protein, 9 aa, Homo Sapiens
DIKKSSRLR

SEQ ID NO: 3412 - protein, 9 aa, Homo Sapiens
RKPRMPVLL

SEQ ID NO: 3413 - protein, 9 aa, Homo Sapiens
CFEDVENLN

SEQ ID NO: 3414 - protein, 9 aa, Homo Sapiens
NRSISCTIK

SEQ ID NO: 3415 - protein, 9 aa, Homo Sapiens
SVSKESANS

SEQ ID NO: 3416 - protein, 9 aa, Homo Sapiens
DCCVFQIPV

SEQ ID NO: 3417 - protein, 9 aa, Homo Sapiens
STTSPWGTS

SEQ ID NO: 3418 - protein, 9 aa, Homo Sapiens
NSLNELVNF

SEQ ID NO: 3419 - protein, 9 aa, Homo Sapiens
SARTFTCYS

SEQ ID NO: 3420 - protein, 9 aa, Homo Sapiens
PGMFLVHKS

SEQ ID NO: 3421 - protein, 9 aa, Homo Sapiens
PMKGFFADY

SEQ ID NO: 3422 - protein, 9 aa, Homo Sapiens
FTHPREDRE

SEQ ID NO: 3423 - protein, 9 aa, Homo Sapiens
NSFQQLCIN

SEQ ID NO: 3424 - protein, 9 aa, Homo Sapiens
VFPNGVETK

SEQ ID NO: 3425 - protein, 9 aa, Homo Sapiens
ENNPHFIIY

SEQ ID NO: 3426 - protein, 9 aa, Homo Sapiens
NEMTDSSKT

SEQ ID NO: 3427 - protein, 9 aa, Homo Sapiens
GPACLFVCP

SEQ ID NO: 3428 - protein, 9 aa, Homo Sapiens
GFDYYYSMP

SEQ ID NO: 3429 - protein, 9 aa, Homo Sapiens
NCKSGKRGS

SEQ ID NO: 3430 - protein, 9 aa, Homo Sapiens
VPEPVKTQG

SEQ ID NO: 3431 - protein, 9 aa, Homo Sapiens
PLPTIPAGK

SEQ ID NO: 3432 - protein, 9 aa, Homo Sapiens
KDPQIWDLL

SEQ ID NO: 3433 - protein, 9 aa, Homo Sapiens
GKVDGKKIG

SEQ ID NO: 3434 - protein, 9 aa, Homo Sapiens
TEELGTVMR

SEQ ID NO: 3435 - protein, 9 aa, Homo Sapiens
QEKVLQSNT

SEQ ID NO: 3436 - protein, 9 aa, Homo Sapiens
PQAGPREAE

SEQ ID NO: 3437 - protein, 9 aa, Homo Sapiens
ADLGELSFS

SEQ ID NO: 3438 - protein, 9 aa, Homo Sapiens
HPLAAHCGV

SEQ ID NO: 3439 - protein, 9 aa, Homo Sapiens
GIFQEKVLQ

SEQ ID NO: 3440 - protein, 9 aa, Homo Sapiens
HSPIRPGQL

SEQ ID NO: 3441 - protein, 9 aa, Homo Sapiens
HIDSSCPSF

SEQ ID NO: 3442 - protein, 9 aa, Homo Sapiens
EAIYGFEKS

SEQ ID NO: 3443 - protein, 9 aa, Homo Sapiens
KRSSTGSYK

SEQ ID NO: 3444 - protein, 9 aa, Homo Sapiens
YNLINITRG

SEQ ID NO: 3445 - protein, 9 aa, Homo Sapiens
IFHFLYRKK

SEQ ID NO: 3446 - protein, 9 aa, Homo Sapiens
GEGLLYGRE

SEQ ID NO: 3447 - protein, 9 aa, Homo Sapiens
KESRIPDQD

SEQ ID NO: 3448 - protein, 9 aa, Homo Sapiens
MMHLRRYPL

SEQ ID NO: 3449 - protein, 9 aa, Homo Sapiens
LAQLPGRPP

SEQ ID NO: 3450 - protein, 9 aa, Homo Sapiens
KEEDTVELT

SEQ ID NO: 3451 - protein, 9 aa, Homo Sapiens
DGETGHGAK

SEQ ID NO: 3452 - protein, 9 aa, Homo Sapiens
GQLQLKIRR

SEQ ID NO: 3453 - protein, 9 aa, Homo Sapiens
ATKEEDTVE

SEQ ID NO: 3454 - protein, 9 aa, Homo Sapiens
RSLRSPTVD

SEQ ID NO: 3455 - protein, 9 aa, Homo Sapiens
VTKEEIQFY

SEQ ID NO: 3456 - protein, 9 aa, Homo Sapiens
AQAICSLCT

SEQ ID NO: 3457 - protein, 9 aa, Homo Sapiens
RPSFHGILY

SEQ ID NO: 3458 - protein, 9 aa, Homo Sapiens
AIYGFEKSC

SEQ ID NO: 3459 - protein, 9 aa, Homo Sapiens
LESTGGLLE

SEQ ID NO: 3460 - protein, 9 aa, Homo Sapiens
EKELAPEPQ

SEQ ID NO: 3461 - protein, 9 aa, Homo Sapiens
VISTTCTYS

SEQ ID NO: 3462 - protein, 9 aa, Homo Sapiens
QGVDTYVEI

SEQ ID NO: 3463 - protein, 9 aa, Homo Sapiens
GSNDPYQRE

SEQ ID NO: 3464 - protein, 9 aa, Homo Sapiens
LFVCPPGGI

SEQ ID NO: 3465 - protein, 9 aa, Homo Sapiens
NLKNLAKKA

SEQ ID NO: 3466 - protein, 9 aa, Homo Sapiens
DRNRPSFHG

SEQ ID NO: 3467 - protein, 9 aa, Homo Sapiens
LLSVGAHSE

SEQ ID NO: 3468 - protein, 9 aa, Homo Sapiens
MLERMEDFT

SEQ ID NO: 3469 - protein, 9 aa, Homo Sapiens
GKSGFNCKS

SEQ ID NO: 3470 - protein, 9 aa, Homo Sapiens
ASVHCAHMF

SEQ ID NO: 3471 - protein, 9 aa, Homo Sapiens
DSISQLCPS

SEQ ID NO: 3472 - protein, 9 aa, Homo Sapiens
YGYHQCMKN

SEQ ID NO: 3473 - protein, 9 aa, Homo Sapiens
GVDTYVEIR

SEQ ID NO: 3474 - protein, 9 aa, Homo Sapiens
CRTAEDQFS

SEQ ID NO: 3475 - protein, 9 aa, Homo Sapiens
IGNSGANIN

SEQ ID NO: 3476 - protein, 9 aa, Homo Sapiens
SYNITLSYK

SEQ ID NO: 3477 - protein, 9 aa, Homo Sapiens
KARGMPETF

SEQ ID NO: 3478 - protein, 9 aa, Homo Sapiens
VLCPDYIYD

SEQ ID NO: 3479 - protein, 9 aa, Homo Sapiens
NVGSNSLQT

SEQ ID NO: 3480 - protein, 9 aa, Homo Sapiens
EPAFPGHHG

SEQ ID NO: 3481 - protein, 9 aa, Homo Sapiens
LNLSNQETD

SEQ ID NO: 3482 - protein, 9 aa, Homo Sapiens
EAKVTLREL

SEQ ID NO: 3483 - protein, 9 aa, Homo Sapiens
PSFHGILYY

SEQ ID NO: 3484 - protein, 9 aa, Homo Sapiens
SFEGNGFLW

SEQ ID NO: 3485 - protein, 9 aa, Homo Sapiens
QKRQRPKVF

SEQ ID NO: 3486 - protein, 9 aa, Homo Sapiens
LHLCRPTAQ

SEQ ID NO: 3487 - protein, 9 aa, Homo Sapiens
EQQQKLVEV

SEQ ID NO: 3488 - protein, 9 aa, Homo Sapiens
NLRPTFSLF

SEQ ID NO: 3489 - protein, 9 aa, Homo Sapiens
VRPRPEAQM

SEQ ID NO: 3490 - protein, 9 aa, Homo Sapiens
SLKERLATL

SEQ ID NO: 3491 - protein, 9 aa, Homo Sapiens
RQPSEQQLL

SEQ ID NO: 3492 - protein, 9 aa, Homo Sapiens
DNCEKIPTP

SEQ ID NO: 3493 - protein, 9 aa, Homo Sapiens
EASDGKVRR

SEQ ID NO: 3494 - protein, 9 aa, Homo Sapiens
APGGTGEGL

SEQ ID NO: 3495 - protein, 9 aa, Homo Sapiens
GSPSQADKC

SEQ ID NO: 3496 - protein, 9 aa, Homo Sapiens
MADGGEFNL

SEQ ID NO: 3497 - protein, 9 aa, Homo Sapiens
RKLEQQQKL

SEQ ID NO: 3498 - protein, 9 aa, Homo Sapiens
PQSGCPLPT

SEQ ID NO: 3499 - protein, 9 aa, Homo Sapiens
FMSQVSYRH

SEQ ID NO: 3500 - protein, 9 aa, Homo Sapiens
GMPASAANF

SEQ ID NO: 3501 - protein, 9 aa, Homo Sapiens
SSCPSFIKT

SEQ ID NO: 3502 - protein, 9 aa, Homo Sapiens
PPRPNTEES

SEQ ID NO: 3503 - protein, 9 aa, Homo Sapiens
DIICVFLQY

SEQ ID NO: 3504 - protein, 9 aa, Homo Sapiens
NYFHYGYHQ

SEQ ID NO: 3505 - protein, 9 aa, Homo Sapiens
EELKRIIDN

SEQ ID NO: 3506 - protein, 9 aa, Homo Sapiens
QKLQLKGNL

SEQ ID NO: 3507 - protein, 9 aa, Homo Sapiens
MRGLHLLVD

SEQ ID NO: 3508 - protein, 9 aa, Homo Sapiens
RSSNPHLLS

SEQ ID NO: 3509 - protein, 9 aa, Homo Sapiens
TLQNIEIKL

SEQ ID NO: 3510 - protein, 9 aa, Homo Sapiens
GQKLPQSAD

SEQ ID NO: 3511 - protein, 9 aa, Homo Sapiens
SFKPKYDGE

SEQ ID NO: 3512 - protein, 9 aa, Homo Sapiens
QAGPREAES

SEQ ID NO: 3513 - protein, 9 aa, Homo Sapiens
EKITVDHLL

SEQ ID NO: 3514 - protein, 9 aa, Homo Sapiens
VLQSNTFWT

SEQ ID NO: 3515 - protein, 9 aa, Homo Sapiens
MLWGIEAAA

SEQ ID NO: 3516 - protein, 9 aa, Homo Sapiens
DGKVRRGYH

SEQ ID NO: 3517 - protein, 9 aa, Homo Sapiens
KLVAYQRTH

SEQ ID NO: 3518 - protein, 9 aa, Homo Sapiens
AKGAPCPLL

SEQ ID NO: 3519 - protein, 9 aa, Homo Sapiens
GHSEISSQS

SEQ ID NO: 3520 - protein, 9 aa, Homo Sapiens
SGLSDQKVQ

SEQ ID NO: 3521 - protein, 9 aa, Homo Sapiens
FTMLREQGG

SEQ ID NO: 3522 - protein, 9 aa, Homo Sapiens
NALSQFHAA

SEQ ID NO: 3523 - protein, 9 aa, Homo Sapiens
PARCHWHRF

SEQ ID NO: 3524 - protein, 9 aa, Homo Sapiens
EDTANRPPA

SEQ ID NO: 3525 - protein, 9 aa, Homo Sapiens
PLQRTDSRP

SEQ ID NO: 3526 - protein, 9 aa, Homo Sapiens
SHMQALLDK

SEQ ID NO: 3527 - protein, 9 aa, Homo Sapiens
HDPNVGSNS

SEQ ID NO: 3528 - protein, 9 aa, Homo Sapiens
FEGNGFLWV

SEQ ID NO: 3529 - protein, 9 aa, Homo Sapiens
MTSERVQDL

SEQ ID NO: 3530 - protein, 9 aa, Homo Sapiens
TKNLKNLAK

SEQ ID NO: 3531 - protein, 9 aa, Homo Sapiens
AAGLEPSSS

SEQ ID NO: 3532 - protein, 9 aa, Homo Sapiens
APKVEPAFP

SEQ ID NO: 3533 - protein, 9 aa, Homo Sapiens
GTRRTAKTC

SEQ ID NO: 3534 - protein, 9 aa, Homo Sapiens
LVLLTAALP

SEQ ID NO: 3535 - protein, 9 aa, Homo Sapiens
ETAVRWLEN

SEQ ID NO: 3536 - protein, 9 aa, Homo Sapiens
GDGTITTEE

SEQ ID NO: 3537 - protein, 9 aa, Homo Sapiens
LEILQNRNI

SEQ ID NO: 3538 - protein, 9 aa, Homo Sapiens
GAQAAGDTA

SEQ ID NO: 3539 - protein, 9 aa, Homo Sapiens
LRWRTTGLI

SEQ ID NO: 3540 - protein, 9 aa, Homo Sapiens
DSSPAQLSS

SEQ ID NO: 3541 - protein, 9 aa, Homo Sapiens
KMGKVDGKK

SEQ ID NO: 3542 - protein, 9 aa, Homo Sapiens
PPGMFLVHK

SEQ ID NO: 3543 - protein, 9 aa, Homo Sapiens
AATQAFLES

SEQ ID NO: 3544 - protein, 9 aa, Homo Sapiens
SNKTAWILG

SEQ ID NO: 3545 - protein, 9 aa, Homo Sapiens
SNQETDQSE

SEQ ID NO: 3546 - protein, 9 aa, Homo Sapiens
LLPERPLQR

SEQ ID NO: 3547 - protein, 9 aa, Homo Sapiens
PGIFQEKVL

SEQ ID NO: 3548 - protein, 9 aa, Homo Sapiens
DGGEFNLRR

SEQ ID NO: 3549 - protein, 9 aa, Homo Sapiens
ERVELAAQL

SEQ ID NO: 3550 - protein, 9 aa, Homo Sapiens
IKARGMPET

SEQ ID NO: 3551 - protein, 9 aa, Homo Sapiens
LKGPSGLSD

SEQ ID NO: 3552 - protein, 9 aa, Homo Sapiens
KLLGELQEH

SEQ ID NO: 3553 - protein, 9 aa, Homo Sapiens
VYRANRKSV

SEQ ID NO: 3554 - protein, 9 aa, Homo Sapiens
RTYGVLDTN

SEQ ID NO: 3555 - protein, 9 aa, Homo Sapiens
CTIKNPKVE

SEQ ID NO: 3556 - protein, 9 aa, Homo Sapiens
PNTEESGSA

SEQ ID NO: 3557 - protein, 9 aa, Homo Sapiens
EEESEDDFH

SEQ ID NO: 3558 - protein, 9 aa, Homo Sapiens
SQSYKLVAY

SEQ ID NO: 3559 - protein, 9 aa, Homo Sapiens
HAWLIMVAF

SEQ ID NO: 3560 - protein, 9 aa, Homo Sapiens
PEEESEDDF

SEQ ID NO: 3561 - protein, 9 aa, Homo Sapiens
GKKVISTTC

SEQ ID NO: 3562 - protein, 9 aa, Homo Sapiens
AELVSTECQ

SEQ ID NO: 3563 - protein, 9 aa, Homo Sapiens
CPSFIKTEP

SEQ ID NO: 3564 - protein, 9 aa, Homo Sapiens
LSLRVTVAK

SEQ ID NO: 3565 - protein, 9 aa, Homo Sapiens
NAAGQALQQ

SEQ ID NO: 3566 - protein, 9 aa, Homo Sapiens
QCIEGISRV

SEQ ID NO: 3567 - protein, 9 aa, Homo Sapiens
TTEELGTVM

SEQ ID NO: 3568 - protein, 9 aa, Homo Sapiens
HVNHVWSQT

SEQ ID NO: 3569 - protein, 9 aa, Homo Sapiens
DATEFMEFE

SEQ ID NO: 3570 - protein, 9 aa, Homo Sapiens
VAYQRTHTG

SEQ ID NO: 3571 - protein, 9 aa, Homo Sapiens
GDVQRHIIF

SEQ ID NO: 3572 - protein, 9 aa, Homo Sapiens
PAESFGPRL

SEQ ID NO: 3573 - protein, 9 aa, Homo Sapiens
RPKVFSDNM

SEQ ID NO: 3574 - protein, 9 aa, Homo Sapiens
KIPTPLSLI

SEQ ID NO: 3575 - protein, 9 aa, Homo Sapiens
AKKAKKISA

SEQ ID NO: 3576 - protein, 9 aa, Homo Sapiens
ACMMHLRRY

SEQ ID NO: 3577 - protein, 9 aa, Homo Sapiens
PVAKGWAGE

SEQ ID NO: 3578 - protein, 9 aa, Homo Sapiens
YQTYSQALT

SEQ ID NO: 3579 - protein, 9 aa, Homo Sapiens
DFHLEGRDP

SEQ ID NO: 3580 - protein, 9 aa, Homo Sapiens
ADAIVVIFS

SEQ ID NO: 3581 - protein, 9 aa, Homo Sapiens
MLKGPSGLS

SEQ ID NO: 3582 - protein, 9 aa, Homo Sapiens
EEHNFVVQN

SEQ ID NO: 3583 - protein, 9 aa, Homo Sapiens
ASSAITLAD

SEQ ID NO: 3584 - protein, 9 aa, Homo Sapiens
AMVVASVVD

SEQ ID NO: 3585 - protein, 9 aa, Homo Sapiens
RASVHCAHM

SEQ ID NO: 3586 - protein, 9 aa, Homo Sapiens
DGTITTEEL

SEQ ID NO: 3587 - protein, 9 aa, Homo Sapiens
SSRLRNPHK

SEQ ID NO: 3588 - protein, 9 aa, Homo Sapiens
LKQKMQKGK

SEQ ID NO: 3589 - protein, 9 aa, Homo Sapiens
SLNELVNFY

SEQ ID NO: 3590 - protein, 9 aa, Homo Sapiens
PQPRGTRRT

SEQ ID NO: 3591 - protein, 9 aa, Homo Sapiens
AFPGHHGLA

SEQ ID NO: 3592 - protein, 9 aa, Homo Sapiens
LRMTSERVQ

SEQ ID NO: 3593 - protein, 9 aa, Homo Sapiens
AIVVIFSPM

SEQ ID NO: 3594 - protein, 9 aa, Homo Sapiens
EISSQSSIV

SEQ ID NO: 3595 - protein, 9 aa, Homo Sapiens
SLRVTVAKS

SEQ ID NO: 3596 - protein, 9 aa, Homo Sapiens
WCFEGLYPT

SEQ ID NO: 3597 - protein, 9 aa, Homo Sapiens
QSSIVSNSS

SEQ ID NO: 3598 - protein, 9 aa, Homo Sapiens
LEVDFAWER

SEQ ID NO: 3599 - protein, 9 aa, Homo Sapiens
NSEITKEDD

SEQ ID NO: 3600 - protein, 9 aa, Homo Sapiens
RDCMKMGKV

SEQ ID NO: 3601 - protein, 9 aa, Homo Sapiens
LLAAGQLAN

SEQ ID NO: 3602 - protein, 9 aa, Homo Sapiens
RGMPETFNE

SEQ ID NO: 3603 - protein, 9 aa, Homo Sapiens
GACKAAARV

SEQ ID NO: 3604 - protein, 9 aa, Homo Sapiens
TVATMTFEE

SEQ ID NO: 3605 - protein, 9 aa, Homo Sapiens
GHPLAAHCG

SEQ ID NO: 3606 - protein, 9 aa, Homo Sapiens
NYKDEAKKQ

SEQ ID NO: 3607 - protein, 9 aa, Homo Sapiens
PQNGLVTCF

SEQ ID NO: 3608 - protein, 9 aa, Homo Sapiens
MQGKKVIST

SEQ ID NO: 3609 - protein, 9 aa, Homo Sapiens
GLLSNKPSS

SEQ ID NO: 3610 - protein, 9 aa, Homo Sapiens
PCEEGELLE

SEQ ID NO: 3611 - protein, 9 aa, Homo Sapiens
RTFTCYSEL

SEQ ID NO: 3612 - protein, 9 aa, Homo Sapiens
FKREEHNFV

SEQ ID NO: 3613 - protein, 9 aa, Homo Sapiens
SYFTHLSFS

SEQ ID NO: 3614 - protein, 9 aa, Homo Sapiens
ISSQSSIVS

SEQ ID NO: 3615 - protein, 9 aa, Homo Sapiens
KTQEDAQAI

SEQ ID NO: 3616 - protein, 9 aa, Homo Sapiens
QKKQFKETM

SEQ ID NO: 3617 - protein, 9 aa, Homo Sapiens
RARHRGGPQ

SEQ ID NO: 3618 - protein, 9 aa, Homo Sapiens
FLKLRWRTT

SEQ ID NO: 3619 - protein, 9 aa, Homo Sapiens
AVRWLENQD

SEQ ID NO: 3620 - protein, 9 aa, Homo Sapiens
IIDNSEITK

SEQ ID NO: 3621 - protein, 9 aa, Homo Sapiens
FPGPYRQTI

SEQ ID NO: 3622 - protein, 9 aa, Homo Sapiens
QSGCPLPTI

SEQ ID NO: 3623 - protein, 9 aa, Homo Sapiens
LSNKPSSSS

SEQ ID NO: 3624 - protein, 9 aa, Homo Sapiens
KKHCWCFEG

SEQ ID NO: 3625 - protein, 9 aa, Homo Sapiens
GLCPDSATK

SEQ ID NO: 3626 - protein, 9 aa, Homo Sapiens
SDPLSYFTH

SEQ ID NO: 3627 - protein, 9 aa, Homo Sapiens
SQKIIYKAN

SEQ ID NO: 3628 - protein, 9 aa, Homo Sapiens
AANLIVRGS

SEQ ID NO: 3629 - protein, 9 aa, Homo Sapiens
EEWALLDPF

SEQ ID NO: 3630 - protein, 9 aa, Homo Sapiens
PSYELLKVN

SEQ ID NO: 3631 - protein, 9 aa, Homo Sapiens
EAQMPKGTQ

SEQ ID NO: 3632 - protein, 9 aa, Homo Sapiens
ANERFQYKC

SEQ ID NO: 3633 - protein, 9 aa, Homo Sapiens
EGNGFLWVK

SEQ ID NO: 3634 - protein, 9 aa, Homo Sapiens
DTANRPPAP

SEQ ID NO: 3635 - protein, 9 aa, Homo Sapiens
CSLCVPPVR

SEQ ID NO: 3636 - protein, 9 aa, Homo Sapiens
APNLRPTFS

SEQ ID NO: 3637 - protein, 9 aa, Homo Sapiens
YGRLPWYQV

SEQ ID NO: 3638 - protein, 9 aa, Homo Sapiens
QSYKLVAYQ

SEQ ID NO: 3639 - protein, 9 aa, Homo Sapiens
HAELVSTEC

SEQ ID NO: 3640 - protein, 9 aa, Homo Sapiens
ELSTTSPWG

SEQ ID NO: 3641 - protein, 9 aa, Homo Sapiens
ISQLCPSGS

SEQ ID NO: 3642 - protein, 9 aa, Homo Sapiens
LGKNIQTIA

SEQ ID NO: 3643 - protein, 9 aa, Homo Sapiens
VSACKQLHT

SEQ ID NO: 3644 - protein, 9 aa, Homo Sapiens
VVAGSGAAA

SEQ ID NO: 3645 - protein, 9 aa, Homo Sapiens
LCTSLKQKM

SEQ ID NO: 3646 - protein, 9 aa, Homo Sapiens
QEAIYGFEK

SEQ ID NO: 3647 - protein, 9 aa, Homo Sapiens
SKEFIQTES

SEQ ID NO: 3648 - protein, 9 aa, Homo Sapiens
AITLADGGE

SEQ ID NO: 3649 - protein, 9 aa, Homo Sapiens
TLSFEGNGF

SEQ ID NO: 3650 - protein, 9 aa, Homo Sapiens
ALSVAAFAY

SEQ ID NO: 3651 - protein, 9 aa, Homo Sapiens
VHCAHMFTT

SEQ ID NO: 3652 - protein, 9 aa, Homo Sapiens
AQPPGMFLV

SEQ ID NO: 3653 - protein, 9 aa, Homo Sapiens
RYCAGACKA

SEQ ID NO: 3654 - protein, 9 aa, Homo Sapiens
KLRWRTTGL

SEQ ID NO: 3655 - protein, 9 aa, Homo Sapiens
KITVDHLLV

SEQ ID NO: 3656 - protein, 9 aa, Homo Sapiens
HLVLVLGEK

SEQ ID NO: 3657 - protein, 9 aa, Homo Sapiens
YMPVPCQPL

SEQ ID NO: 3658 - protein, 9 aa, Homo Sapiens
RSSTGSYKE

SEQ ID NO: 3659 - protein, 9 aa, Homo Sapiens
YGFEKSCSI

SEQ ID NO: 3660 - protein, 9 aa, Homo Sapiens
LINITRGSV

SEQ ID NO: 3661 - protein, 9 aa, Homo Sapiens
KEHLRDFER

SEQ ID NO: 3662 - protein, 9 aa, Homo Sapiens
WDCSPVSMF

SEQ ID NO: 3663 - protein, 9 aa, Homo Sapiens
NNPHFIIYL

SEQ ID NO: 3664 - protein, 9 aa, Homo Sapiens
QREPRSPRK

SEQ ID NO: 3665 - protein, 9 aa, Homo Sapiens
RSIMLENYQ

SEQ ID NO: 3666 - protein, 9 aa, Homo Sapiens
PPASSAITL

SEQ ID NO: 3667 - protein, 9 aa, Homo Sapiens
FTHLSFSAA

SEQ ID NO: 3668 - protein, 9 aa, Homo Sapiens
SSVSDNLDF

SEQ ID NO: 3669 - protein, 9 aa, Homo Sapiens
YGLLSNKPS

SEQ ID NO: 3670 - protein, 9 aa, Homo Sapiens
TLEVMLERM

SEQ ID NO: 3671 - protein, 9 aa, Homo Sapiens
CRSHSPAHA

SEQ ID NO: 3672 - protein, 9 aa, Homo Sapiens
RPPEPETGV

SEQ ID NO: 3673 - protein, 9 aa, Homo Sapiens
LPAESFGPR

SEQ ID NO: 3674 - protein, 9 aa, Homo Sapiens
QAVQAAENA

SEQ ID NO: 3675 - protein, 9 aa, Homo Sapiens
KIIYKANER

SEQ ID NO: 3676 - protein, 9 aa, Homo Sapiens
IIEHYPRMP

SEQ ID NO: 3677 - protein, 9 aa, Homo Sapiens
SHPNCALQM

SEQ ID NO: 3678 - protein, 9 aa, Homo Sapiens
KLQLKGNLR

SEQ ID NO: 3679 - protein, 9 aa, Homo Sapiens
TCYSELEAE

SEQ ID NO: 3680 - protein, 9 aa, Homo Sapiens
CTLKIQRTE

SEQ ID NO: 3681 - protein, 9 aa, Homo Sapiens
WRNKVNELK

SEQ ID NO: 3682 - protein, 9 aa, Homo Sapiens
HYKVAQLLL

SEQ ID NO: 3683 - protein, 9 aa, Homo Sapiens
QEPQPGHKV

SEQ ID NO: 3684 - protein, 9 aa, Homo Sapiens
VELAAQLGL

SEQ ID NO: 3685 - protein, 9 aa, Homo Sapiens
SQIQNGYYL

SEQ ID NO: 3686 - protein, 9 aa, Homo Sapiens
RGCRSHSPA

SEQ ID NO: 3687 - protein, 9 aa, Homo Sapiens
SLEGDKTGS

SEQ ID NO: 3688 - protein, 9 aa, Homo Sapiens
GCPLPTIPA

SEQ ID NO: 3689 - protein, 9 aa, Homo Sapiens
VMLERMEDF

SEQ ID NO: 3690 - protein, 9 aa, Homo Sapiens
IFSPMVLTV

SEQ ID NO: 3691 - protein, 9 aa, Homo Sapiens
QLCPSGSIK

SEQ ID NO: 3692 - protein, 9 aa, Homo Sapiens
VGSQGAKGA

SEQ ID NO: 3693 - protein, 9 aa, Homo Sapiens
RNIEAGKDN

SEQ ID NO: 3694 - protein, 9 aa, Homo Sapiens
MEEETSGYS

SEQ ID NO: 3695 - protein, 9 aa, Homo Sapiens
HYPRMPAYI

SEQ ID NO: 3696 - protein, 9 aa, Homo Sapiens
GSRSSNPHL

SEQ ID NO: 3697 - protein, 9 aa, Homo Sapiens
NTEESGSAK

SEQ ID NO: 3698 - protein, 9 aa, Homo Sapiens
GSHNDLVDE

SEQ ID NO: 3699 - protein, 9 aa, Homo Sapiens
NMSVDTWSA

SEQ ID NO: 3700 - protein, 9 aa, Homo Sapiens
EAHISRLAE

SEQ ID NO: 3701 - protein, 9 aa, Homo Sapiens
LCPDSATKE

SEQ ID NO: 3702 - protein, 9 aa, Homo Sapiens
FRYCAGACK

SEQ ID NO: 3703 - protein, 9 aa, Homo Sapiens
IKKSYFPNI

SEQ ID NO: 3704 - protein, 9 aa, Homo Sapiens
GGEFNLRRG

SEQ ID NO: 3705 - protein, 9 aa, Homo Sapiens
GLYNLINIT

SEQ ID NO: 3706 - protein, 9 aa, Homo Sapiens
QDLDRELLM

SEQ ID NO: 3707 - protein, 9 aa, Homo Sapiens
ERPLQRTDS

SEQ ID NO: 3708 - protein, 9 aa, Homo Sapiens
YIRTDLEGS

SEQ ID NO: 3709 - protein, 9 aa, Homo Sapiens
STTCTYSRD

SEQ ID NO: 3710 - protein, 9 aa, Homo Sapiens
GTITTEELG

SEQ ID NO: 3711 - protein, 9 aa, Homo Sapiens
VPCQPLTCV

SEQ ID NO: 3712 - protein, 9 aa, Homo Sapiens
PVSHFESRP

SEQ ID NO: 3713 - protein, 9 aa, Homo Sapiens
KVYRANRKS

SEQ ID NO: 3714 - protein, 9 aa, Homo Sapiens
SFLEAASFM

SEQ ID NO: 3715 - protein, 9 aa, Homo Sapiens
EVDFAWERV

SEQ ID NO: 3716 - protein, 9 aa, Homo Sapiens
LFHVAFQGK

SEQ ID NO: 3717 - protein, 9 aa, Homo Sapiens
EERVQSLKE

SEQ ID NO: 3718 - protein, 9 aa, Homo Sapiens
EPTGAYPMK

SEQ ID NO: 3719 - protein, 9 aa, Homo Sapiens
LAPEPQETW

SEQ ID NO: 3720 - protein, 9 aa, Homo Sapiens
VVIFSPMVL

SEQ ID NO: 3721 - protein, 9 aa, Homo Sapiens
NFAVNSFQQ

SEQ ID NO: 3722 - protein, 9 aa, Homo Sapiens
TSRNHQDLD

SEQ ID NO: 3723 - protein, 9 aa, Homo Sapiens
NHVWSQTSS

SEQ ID NO: 3724 - protein, 9 aa, Homo Sapiens
ALQGMSVVE

SEQ ID NO: 3725 - protein, 9 aa, Homo Sapiens
KELAPEPQE

SEQ ID NO: 3726 - protein, 9 aa, Homo Sapiens
CQPQNGLVT

SEQ ID NO: 3727 - protein, 9 aa, Homo Sapiens
SKGNLECLS

SEQ ID NO: 3728 - protein, 9 aa, Homo Sapiens
ETLLSVGAH

SEQ ID NO: 3729 - protein, 9 aa, Homo Sapiens
TSERVQDLT

SEQ ID NO: 3730 - protein, 9 aa, Homo Sapiens
TSLKQKMQK

SEQ ID NO: 3731 - protein, 9 aa, Homo Sapiens
QQLLFRQQA

SEQ ID NO: 3732 - protein, 9 aa, Homo Sapiens
VTRGEDTAN

SEQ ID NO: 3733 - protein, 9 aa, Homo Sapiens
LKIRRDWVP

SEQ ID NO: 3734 - protein, 9 aa, Homo Sapiens
SQALTLVFD

SEQ ID NO: 3735 - protein, 9 aa, Homo Sapiens
AYQQLKESR

SEQ ID NO: 3736 - protein, 9 aa, Homo Sapiens
GHGRNCYDE

SEQ ID NO: 3737 - protein, 9 aa, Homo Sapiens
KERLATLAG

SEQ ID NO: 3738 - protein, 9 aa, Homo Sapiens
VICTARQQQ

SEQ ID NO: 3739 - protein, 9 aa, Homo Sapiens
VTLHLCRPT

SEQ ID NO: 3740 - protein, 9 aa, Homo Sapiens
EQQLLFRQQ

SEQ ID NO: 3741 - protein, 9 aa, Homo Sapiens
DKEEKAKKA

SEQ ID NO: 3742 - protein, 9 aa, Homo Sapiens
QWMGYGLLH

SEQ ID NO: 3743 - protein, 9 aa, Homo Sapiens
GSQGAKGAP

SEQ ID NO: 3744 - protein, 9 aa, Homo Sapiens
ESTGGLLEL

SEQ ID NO: 3745 - protein, 9 aa, Homo Sapiens
FKETMMGQT

SEQ ID NO: 3746 - protein, 9 aa, Homo Sapiens
QLENEMTDS

SEQ ID NO: 3747 - protein, 9 aa, Homo Sapiens
GKGSLISFV

SEQ ID NO: 3748 - protein, 9 aa, Homo Sapiens
TKDCCVFQI

SEQ ID NO: 3749 - protein, 9 aa, Homo Sapiens
VSLPSLVYM

SEQ ID NO: 3750 - protein, 9 aa, Homo Sapiens
EKADLGELS

SEQ ID NO: 3751 - protein, 9 aa, Homo Sapiens
ILKAEGKGS

SEQ ID NO: 3752 - protein, 9 aa, Homo Sapiens
QKFANFLSG

SEQ ID NO: 3753 - protein, 9 aa, Homo Sapiens
QCMKNLVHY

SEQ ID NO: 3754 - protein, 9 aa, Homo Sapiens
GLGKNIQTI

SEQ ID NO: 3755 - protein, 9 aa, Homo Sapiens
SPSLPAESF

SEQ ID NO: 3756 - protein, 9 aa, Homo Sapiens
DTYVEIRPV

SEQ ID NO: 3757 - protein, 9 aa, Homo Sapiens
VRPEGSVCT

SEQ ID NO: 3758 - protein, 9 aa, Homo Sapiens
RVENNPHFI

SEQ ID NO: 3759 - protein, 9 aa, Homo Sapiens
ARSPSSVSD

SEQ ID NO: 3760 - protein, 9 aa, Homo Sapiens
ILCTSLKQK

SEQ ID NO: 3761 - protein, 9 aa, Homo Sapiens
VAAFAYKAL

SEQ ID NO: 3762 - protein, 9 aa, Homo Sapiens
LDRELLMNQ

SEQ ID NO: 3763 - protein, 9 aa, Homo Sapiens
PEAQMPKGT

SEQ ID NO: 3764 - protein, 9 aa, Homo Sapiens
EGDIICVFL

SEQ ID NO: 3765 - protein, 9 aa, Homo Sapiens
RGTRRTAKT

SEQ ID NO: 3766 - protein, 9 aa, Homo Sapiens
QPRGTRRTA

SEQ ID NO: 3767 - protein, 9 aa, Homo Sapiens
SSVASAVPL

SEQ ID NO: 3768 - protein, 9 aa, Homo Sapiens
PYRQTISVP

SEQ ID NO: 3769 - protein, 9 aa, Homo Sapiens
QRHIIFHSG

SEQ ID NO: 3770 - protein, 9 aa, Homo Sapiens
VQRRPGESF

SEQ ID NO: 3771 - protein, 9 aa, Homo Sapiens
LKERLATLA

SEQ ID NO: 3772 - protein, 9 aa, Homo Sapiens
IRFICKYKQ

SEQ ID NO: 3773 - protein, 9 aa, Homo Sapiens
RVQSLKERL

SEQ ID NO: 3774 - protein, 9 aa, Homo Sapiens
ISCTIKNPK

SEQ ID NO: 3775 - protein, 9 aa, Homo Sapiens
TEKITVDHL

SEQ ID NO: 3776 - protein, 9 aa, Homo Sapiens
DLQLENEMT

SEQ ID NO: 3777 - protein, 9 aa, Homo Sapiens
VDAIVSQWM

SEQ ID NO: 3778 - protein, 9 aa, Homo Sapiens
EYTMTCEKV

SEQ ID NO: 3779 - protein, 9 aa, Homo Sapiens
VSKESANSL

SEQ ID NO: 3780 - protein, 9 aa, Homo Sapiens
MDTPLRRSQ

SEQ ID NO: 3781 - protein, 9 aa, Homo Sapiens
AIVSQWMGY

SEQ ID NO: 3782 - protein, 9 aa, Homo Sapiens
PQIWDLLTP

SEQ ID NO: 3783 - protein, 9 aa, Homo Sapiens
VIFVSLPSL

SEQ ID NO: 3784 - protein, 9 aa, Homo Sapiens
MNRSISCTI

SEQ ID NO: 3785 - protein, 9 aa, Homo Sapiens
QDLTYSVQQ

SEQ ID NO: 3786 - protein, 9 aa, Homo Sapiens
QTRDSISQL

SEQ ID NO: 3787 - protein, 9 aa, Homo Sapiens
KQNIFDYYE

SEQ ID NO: 3788 - protein, 9 aa, Homo Sapiens
GQLANALSQ

SEQ ID NO: 3789 - protein, 9 aa, Homo Sapiens
RLESTGGLL

SEQ ID NO: 3790 - protein, 9 aa, Homo Sapiens
KTKQEETEY

SEQ ID NO: 3791 - protein, 9 aa, Homo Sapiens
VLEILQNRN

SEQ ID NO: 3792 - protein, 9 aa, Homo Sapiens
QMPKGTQAD

SEQ ID NO: 3793 - protein, 9 aa, Homo Sapiens
QNRNIHLEH

SEQ ID NO: 3794 - protein, 9 aa, Homo Sapiens
VLQAQPPGM

SEQ ID NO: 3795 - protein, 9 aa, Homo Sapiens
SFKAECFED

SEQ ID NO: 3796 - protein, 9 aa, Homo Sapiens
AVVAGSGAA

SEQ ID NO: 3797 - protein, 9 aa, Homo Sapiens
HQDLDRELL

SEQ ID NO: 3798 - protein, 9 aa, Homo Sapiens
IRPVSTSSN

SEQ ID NO: 3799 - protein, 9 aa, Homo Sapiens
EFMEFEKLS

SEQ ID NO: 3800 - protein, 9 aa, Homo Sapiens
YCAGACKAA

SEQ ID NO: 3801 - protein, 9 aa, Homo Sapiens
HNFKREEHN

SEQ ID NO: 3802 - protein, 9 aa, Homo Sapiens
VAFAGSLFG

SEQ ID NO: 3803 - protein, 9 aa, Homo Sapiens
SNTFWTPVI

SEQ ID NO: 3804 - protein, 9 aa, Homo Sapiens
GNAGRPLAE

SEQ ID NO: 3805 - protein, 9 aa, Homo Sapiens
QWRNKVNEL

SEQ ID NO: 3806 - protein, 9 aa, Homo Sapiens
VAPGGTGEG

SEQ ID NO: 3807 - protein, 9 aa, Homo Sapiens
EAGKDNGLT

SEQ ID NO: 3808 - protein, 9 aa, Homo Sapiens
RHHTEKITV

SEQ ID NO: 3809 - protein, 9 aa, Homo Sapiens
DNSEEYIRT

SEQ ID NO: 3810 - protein, 9 aa, Homo Sapiens
VQRHIIFHS

SEQ ID NO: 3811 - protein, 9 aa, Homo Sapiens
AVRGLETAV

SEQ ID NO: 3812 - protein, 9 aa, Homo Sapiens
KAAARVYDL

SEQ ID NO: 3813 - protein, 9 aa, Homo Sapiens
SRSSNPHLL

SEQ ID NO: 3814 - protein, 9 aa, Homo Sapiens
MGLGKNIQT

SEQ ID NO: 3815 - protein, 9 aa, Homo Sapiens
IQNYKDEAK

SEQ ID NO: 3816 - protein, 9 aa, Homo Sapiens
SKTKQEETE

SEQ ID NO: 3817 - protein, 9 aa, Homo Sapiens
NGFLWVKSG

SEQ ID NO: 3818 - protein, 9 aa, Homo Sapiens
HIVQKNQEI

SEQ ID NO: 3819 - protein, 9 aa, Homo Sapiens
NGKPEAAGL

SEQ ID NO: 3820 - protein, 9 aa, Homo Sapiens
QRQPSEQQL

SEQ ID NO: 3821 - protein, 9 aa, Homo Sapiens
CFHNMSVDT

SEQ ID NO: 3822 - protein, 9 aa, Homo Sapiens
QGPSFRICV

SEQ ID NO: 3823 - protein, 9 aa, Homo Sapiens
TPMEAASSG

SEQ ID NO: 3824 - protein, 9 aa, Homo Sapiens
VLGEKSQDD

SEQ ID NO: 3825 - protein, 9 aa, Homo Sapiens
FQQLCINFA

SEQ ID NO: 3826 - protein, 9 aa, Homo Sapiens
PGMPASAAN

SEQ ID NO: 3827 - protein, 9 aa, Homo Sapiens
KRSVLDPTV

SEQ ID NO: 3828 - protein, 9 aa, Homo Sapiens
HKEDADSYE

SEQ ID NO: 3829 - protein, 9 aa, Homo Sapiens
VFQIPVSVR

SEQ ID NO: 3830 - protein, 9 aa, Homo Sapiens
FAYKALFAG

SEQ ID NO: 3831 - protein, 9 aa, Homo Sapiens
GAYPMKGFF

SEQ ID NO: 3832 - protein, 9 aa, Homo Sapiens
TEYLESSQV

SEQ ID NO: 3833 - protein, 9 aa, Homo Sapiens
PQYLKLIAN

SEQ ID NO: 3834 - protein, 9 aa, Homo Sapiens
NVDTTMDNS

SEQ ID NO: 3835 - protein, 9 aa, Homo Sapiens
NGLTDAQQQ

SEQ ID NO: 3836 - protein, 9 aa, Homo Sapiens
SNIFVRGWL

SEQ ID NO: 3837 - protein, 9 aa, Homo Sapiens
FHFLYRKKR

SEQ ID NO: 3838 - protein, 9 aa, Homo Sapiens
PNLRPTFSL

SEQ ID NO: 3839 - protein, 9 aa, Homo Sapiens
NSEEYIRTD

SEQ ID NO: 3840 - protein, 9 aa, Homo Sapiens
AEGLGRDHC

SEQ ID NO: 3841 - protein, 9 aa, Homo Sapiens
AGAQAAGDT

SEQ ID NO: 3842 - protein, 9 aa, Homo Sapiens
QGPAVPEPV

SEQ ID NO: 3843 - protein, 9 aa, Homo Sapiens
NKLTHIPDT

SEQ ID NO: 3844 - protein, 9 aa, Homo Sapiens
IPFLPLDSS

SEQ ID NO: 3845 - protein, 9 aa, Homo Sapiens
GPSYELLKV

SEQ ID NO: 3846 - protein, 9 aa, Homo Sapiens
LEEEGQKLP

SEQ ID NO: 3847 - protein, 9 aa, Homo Sapiens
TVDKVLAVF

SEQ ID NO: 3848 - protein, 9 aa, Homo Sapiens
LGPACLFVC

SEQ ID NO: 3849 - protein, 9 aa, Homo Sapiens
GKVRRGYHK

SEQ ID NO: 3850 - protein, 9 aa, Homo Sapiens
SWDCSPVSM

SEQ ID NO: 3851 - protein, 9 aa, Homo Sapiens
PGNASNNLF

SEQ ID NO: 3852 - protein, 9 aa, Homo Sapiens
ENEMTDSSK

SEQ ID NO: 3853 - protein, 9 aa, Homo Sapiens
NKPSSSSTS

SEQ ID NO: 3854 - protein, 9 aa, Homo Sapiens
LGNSSSLDK

SEQ ID NO: 3855 - protein, 9 aa, Homo Sapiens
ALGPACLFV

SEQ ID NO: 3856 - protein, 9 aa, Homo Sapiens
VGPAYQQLK

SEQ ID NO: 3857 - protein, 9 aa, Homo Sapiens
RLINQWRNK

SEQ ID NO: 3858 - protein, 9 aa, Homo Sapiens
VIILSPEIS

SEQ ID NO: 3859 - protein, 9 aa, Homo Sapiens
IMVQRRPGE

SEQ ID NO: 3860 - protein, 9 aa, Homo Sapiens
ACKQLHTAG

SEQ ID NO: 3861 - protein, 9 aa, Homo Sapiens
FGPRLASSS

SEQ ID NO: 3862 - protein, 9 aa, Homo Sapiens
LPGFKKINV

SEQ ID NO: 3863 - protein, 9 aa, Homo Sapiens
EWIATFGAT

SEQ ID NO: 3864 - protein, 9 aa, Homo Sapiens
YGSHMQALL

SEQ ID NO: 3865 - protein, 9 aa, Homo Sapiens
ETIRLPCEE

SEQ ID NO: 3866 - protein, 9 aa, Homo Sapiens
DVSNKTAWI

SEQ ID NO: 3867 - protein, 9 aa, Homo Sapiens
KPRMPVLLL

SEQ ID NO: 3868 - protein, 9 aa, Homo Sapiens
CYDEIKEEF

SEQ ID NO: 3869 - protein, 9 aa, Homo Sapiens
TKEHLRDFE

SEQ ID NO: 3870 - protein, 9 aa, Homo Sapiens
NILTFFVGL

SEQ ID NO: 3871 - protein, 9 aa, Homo Sapiens
EKAKKAKIK

SEQ ID NO: 3872 - protein, 9 aa, Homo Sapiens
GEYTMTCEK

SEQ ID NO: 3873 - protein, 9 aa, Homo Sapiens
CSNTNLIDH

SEQ ID NO: 3874 - protein, 9 aa, Homo Sapiens
PLRRSQRLG

SEQ ID NO: 3875 - protein, 9 aa, Homo Sapiens
SLRSPTVDK

SEQ ID NO: 3876 - protein, 9 aa, Homo Sapiens
LSTTSPWGT

SEQ ID NO: 3877 - protein, 9 aa, Homo Sapiens
PNCALQMLG

SEQ ID NO: 3878 - protein, 9 aa, Homo Sapiens
TQKKQFKET

SEQ ID NO: 3879 - protein, 9 aa, Homo Sapiens
RNRKTRTYG

SEQ ID NO: 3880 - protein, 9 aa, Homo Sapiens
TMTFEEKKE

SEQ ID NO: 3881 - protein, 9 aa, Homo Sapiens
ASPIIEHYP

SEQ ID NO: 3882 - protein, 9 aa, Homo Sapiens
AANFGPLQL

SEQ ID NO: 3883 - protein, 9 aa, Homo Sapiens
LSVTLEVML

SEQ ID NO: 3884 - protein, 9 aa, Homo Sapiens
LHLLVDLVT

SEQ ID NO: 3885 - protein, 9 aa, Homo Sapiens
SMSVGLLSE

SEQ ID NO: 3886 - protein, 9 aa, Homo Sapiens
PSSFKAECF

SEQ ID NO: 3887 - protein, 9 aa, Homo Sapiens
ATQAFLESA

SEQ ID NO: 3888 - protein, 9 aa, Homo Sapiens
DHCNEMLAY

SEQ ID NO: 3889 - protein, 9 aa, Homo Sapiens
AEEEPLVPK

SEQ ID NO: 3890 - protein, 9 aa, Homo Sapiens
KLEQQQKLV

SEQ ID NO: 3891 - protein, 9 aa, Homo Sapiens
QFKETMMGQ

SEQ ID NO: 3892 - protein, 9 aa, Homo Sapiens
NPGVKATVP

SEQ ID NO: 3893 - protein, 9 aa, Homo Sapiens
KKINVLGFR

SEQ ID NO: 3894 - protein, 9 aa, Homo Sapiens
VDKSLEGDK

SEQ ID NO: 3895 - protein, 9 aa, Homo Sapiens
CDSPSNAPA

SEQ ID NO: 3896 - protein, 9 aa, Homo Sapiens
VRGLETAVR

SEQ ID NO: 3897 - protein, 9 aa, Homo Sapiens
IRTDLEGSD

SEQ ID NO: 3898 - protein, 9 aa, Homo Sapiens
LEAHISRLA

SEQ ID NO: 3899 - protein, 9 aa, Homo Sapiens
LKCQNMHPH

SEQ ID NO: 3900 - protein, 9 aa, Homo Sapiens
LKAEGKGSL

SEQ ID NO: 3901 - protein, 9 aa, Homo Sapiens
AAENAAGQA

SEQ ID NO: 3902 - protein, 9 aa, Homo Sapiens
FSPMVLTVT

SEQ ID NO: 3903 - protein, 9 aa, Homo Sapiens
SYFPNILTF

SEQ ID NO: 3904 - protein, 9 aa, Homo Sapiens
ESFGPRLAS

SEQ ID NO: 3905 - protein, 9 aa, Homo Sapiens
GHFTHPRED

SEQ ID NO: 3906 - protein, 9 aa, Homo Sapiens
HTEKITVDH

SEQ ID NO: 3907 - protein, 9 aa, Homo Sapiens
AENAAGQAL

SEQ ID NO: 3908 - protein, 9 aa, Homo Sapiens
LVSPQYLKL

SEQ ID NO: 3909 - protein, 9 aa, Homo Sapiens
NLFHVAFQG

SEQ ID NO: 3910 - protein, 9 aa, Homo Sapiens
EEEPLVPKM

SEQ ID NO: 3911 - protein, 9 aa, Homo Sapiens
NASPIIEHY

SEQ ID NO: 3912 - protein, 9 aa, Homo Sapiens
LQLKIRRDW

SEQ ID NO: 3913 - protein, 9 aa, Homo Sapiens
CIEGISRVI

SEQ ID NO: 3914 - protein, 9 aa, Homo Sapiens
TKDAGFYVV

SEQ ID NO: 3915 - protein, 9 aa, Homo Sapiens
AHMFTTVSE

SEQ ID NO: 3916 - protein, 9 aa, Homo Sapiens
ITTEELGTV

SEQ ID NO: 3917 - protein, 9 aa, Homo Sapiens
GDTARESPA

SEQ ID NO: 3918 - protein, 9 aa, Homo Sapiens
KCDKEEKAK

SEQ ID NO: 3919 - protein, 9 aa, Homo Sapiens
PMEAASSGT

SEQ ID NO: 3920 - protein, 9 aa, Homo Sapiens
SESPPPPST

SEQ ID NO: 3921 - protein, 9 aa, Homo Sapiens
PPVRKLWSS

SEQ ID NO: 3922 - protein, 9 aa, Homo Sapiens
HGRNCYDEI

SEQ ID NO: 3923 - protein, 9 aa, Homo Sapiens
LFLKLRWRT

SEQ ID NO: 3924 - protein, 9 aa, Homo Sapiens
VLDPTVTGC

SEQ ID NO: 3925 - protein, 9 aa, Homo Sapiens
LSYKGTIKE

SEQ ID NO: 3926 - protein, 9 aa, Homo Sapiens
KNKDPTEWI

SEQ ID NO: 3927 - protein, 9 aa, Homo Sapiens
LRVTVAKSS

SEQ ID NO: 3928 - protein, 9 aa, Homo Sapiens
LDVDKTSFS

SEQ ID NO: 3929 - protein, 9 aa, Homo Sapiens
PDATEFMEF

SEQ ID NO: 3930 - protein, 9 aa, Homo Sapiens
PNGVETKDA

SEQ ID NO: 3931 - protein, 9 aa, Homo Sapiens
LLDPFQKNL

SEQ ID NO: 3932 - protein, 9 aa, Homo Sapiens
VNFYRTTTI

SEQ ID NO: 3933 - protein, 9 aa, Homo Sapiens
LRNPHKTRK

SEQ ID NO: 3934 - protein, 9 aa, Homo Sapiens
QYLALPERV

SEQ ID NO: 3935 - protein, 9 aa, Homo Sapiens
GLEAHISRL

SEQ ID NO: 3936 - protein, 9 aa, Homo Sapiens
AVQAAENAA

SEQ ID NO: 3937 - protein, 9 aa, Homo Sapiens
TGAYPMKGF

SEQ ID NO: 3938 - protein, 9 aa, Homo Sapiens
KRLYRSIML

SEQ ID NO: 3939 - protein, 9 aa, Homo Sapiens
LQHSTKEHL

SEQ ID NO: 3940 - protein, 9 aa, Homo Sapiens
AAEAEAKVT

SEQ ID NO: 3941 - protein, 9 aa, Homo Sapiens
FIQTESSSS

SEQ ID NO: 3942 - protein, 9 aa, Homo Sapiens
DCSPVSMFR

SEQ ID NO: 3943 - protein, 9 aa, Homo Sapiens
LAFRGAGQC

SEQ ID NO: 3944 - protein, 9 aa, Homo Sapiens
PNILTFFVG

SEQ ID NO: 3945 - protein, 9 aa, Homo Sapiens
EAASFMSQV

SEQ ID NO: 3946 - protein, 9 aa, Homo Sapiens
RNIHLEHIK

SEQ ID NO: 3947 - protein, 9 aa, Homo Sapiens
QFYVVNSKL

SEQ ID NO: 3948 - protein, 9 aa, Homo Sapiens
KLQHSTKEH

SEQ ID NO: 3949 - protein, 9 aa, Homo Sapiens
TYGVLDTNI

SEQ ID NO: 3950 - protein, 9 aa, Homo Sapiens
LPERPLQRT

SEQ ID NO: 3951 - protein, 9 aa, Homo Sapiens
TTMDNSVLE

SEQ ID NO: 3952 - protein, 9 aa, Homo Sapiens
NSGANINRI

SEQ ID NO: 3953 - protein, 9 aa, Homo Sapiens
KINVLGFRP

SEQ ID NO: 3954 - protein, 9 aa, Homo Sapiens
SRNHQDLDR

SEQ ID NO: 3955 - protein, 9 aa, Homo Sapiens
PFQKNLYRD

SEQ ID NO: 3956 - protein, 9 aa, Homo Sapiens
GTGEGLLYG

SEQ ID NO: 3957 - protein, 9 aa, Homo Sapiens
QRPKVFSDN

SEQ ID NO: 3958 - protein, 9 aa, Homo Sapiens
FNCKSGKRG

SEQ ID NO: 3959 - protein, 9 aa, Homo Sapiens
QLHTAGLLH

SEQ ID NO: 3960 - protein, 9 aa, Homo Sapiens
LQYGEIVNI

SEQ ID NO: 3961 - protein, 9 aa, Homo Sapiens
RINKSVAYK

SEQ ID NO: 3962 - protein, 9 aa, Homo Sapiens
EQTVATMTF

SEQ ID NO: 3963 - protein, 9 aa, Homo Sapiens
TYSQALTLV

SEQ ID NO: 3964 - protein, 9 aa, Homo Sapiens
KVNELKSLN

SEQ ID NO: 3965 - protein, 9 aa, Homo Sapiens
CTSLKQKMQ

SEQ ID NO: 3966 - protein, 9 aa, Homo Sapiens
SVCTLKIQR

SEQ ID NO: 3967 - protein, 9 aa, Homo Sapiens
LSVAAFAYK

SEQ ID NO: 3968 - protein, 9 aa, Homo Sapiens
MISPVSHFE

SEQ ID NO: 3969 - protein, 9 aa, Homo Sapiens
SCGPARCHW

SEQ ID NO: 3970 - protein, 9 aa, Homo Sapiens
QYRRSFLTS

SEQ ID NO: 3971 - protein, 9 aa, Homo Sapiens
FHYGYHQCM

SEQ ID NO: 3972 - protein, 9 aa, Homo Sapiens
KESANSLVS

SEQ ID NO: 3973 - protein, 9 aa, Homo Sapiens
RSVLDPTVT

SEQ ID NO: 3974 - protein, 9 aa, Homo Sapiens
LPWYQVLAF

SEQ ID NO: 3975 - protein, 9 aa, Homo Sapiens
HMQALLDKY

SEQ ID NO: 3976 - protein, 9 aa, Homo Sapiens
EESEDDFHL

SEQ ID NO: 3977 - protein, 9 aa, Homo Sapiens
LNNCHVNWN

SEQ ID NO: 3978 - protein, 9 aa, Homo Sapiens
NCYDEIKEE

SEQ ID NO: 3979 - protein, 9 aa, Homo Sapiens
TTSPWGTSL

SEQ ID NO: 3980 - protein, 9 aa, Homo Sapiens
YYLNNCHVN

SEQ ID NO: 3981 - protein, 9 aa, Homo Sapiens
KSSKTFGPA

SEQ ID NO: 3982 - protein, 9 aa, Homo Sapiens
GETGHGAKE

SEQ ID NO: 3983 - protein, 9 aa, Homo Sapiens
SFPGPYRQT

SEQ ID NO: 3984 - protein, 9 aa, Homo Sapiens
EFLQRDFLE

SEQ ID NO: 3985 - protein, 9 aa, Homo Sapiens
KHCWCFEGL

SEQ ID NO: 3986 - protein, 9 aa, Homo Sapiens
LGKNKLTHI

SEQ ID NO: 3987 - protein, 9 aa, Homo Sapiens
PCQPLTCVF

SEQ ID NO: 3988 - protein, 9 aa, Homo Sapiens
DSKVLIGSH

SEQ ID NO: 3989 - protein, 9 aa, Homo Sapiens
REEHNFVVQ

SEQ ID NO: 3990 - protein, 9 aa, Homo Sapiens
EWASAPNLR

SEQ ID NO: 3991 - protein, 9 aa, Homo Sapiens
GAGEGSERK

SEQ ID NO: 3992 - protein, 9 aa, Homo Sapiens
PPEPETGVS

SEQ ID NO: 3993 - protein, 9 aa, Homo Sapiens
MSVGLLSET

SEQ ID NO: 3994 - protein, 9 aa, Homo Sapiens
PGGHPLAAH

SEQ ID NO: 3995 - protein, 9 aa, Homo Sapiens
ENLKCQNMH

SEQ ID NO: 3996 - protein, 9 aa, Homo Sapiens
CMMHLRRYP

SEQ ID NO: 3997 - protein, 9 aa, Homo Sapiens
FCSNTNLID

SEQ ID NO: 3998 - protein, 9 aa, Homo Sapiens
GEDTANRPP

SEQ ID NO: 3999 - protein, 9 aa, Homo Sapiens
EPQETWVAE

SEQ ID NO: 4000 - protein, 9 aa, Homo Sapiens
SPSSVSDNL

SEQ ID NO: 4001 - protein, 9 aa, Homo Sapiens
TQAFLESAP

SEQ ID NO: 4002 - protein, 9 aa, Homo Sapiens
PNHKEDADS

SEQ ID NO: 4003 - protein, 9 aa, Homo Sapiens
HWHRFCARS

SEQ ID NO: 4004 - protein, 9 aa, Homo Sapiens
SHREAQGPS

SEQ ID NO: 4005 - protein, 9 aa, Homo Sapiens
QQQKLVEVL

SEQ ID NO: 4006 - protein, 9 aa, Homo Sapiens
LPLDSSPAQ

SEQ ID NO: 4007 - protein, 9 aa, Homo Sapiens
VDFAWERVR

SEQ ID NO: 4008 - protein, 9 aa, Homo Sapiens
AKKQRKIIF

SEQ ID NO: 4009 - protein, 9 aa, Homo Sapiens
VDKTSFSQE

SEQ ID NO: 4010 - protein, 9 aa, Homo Sapiens
SSPQSGCPL

SEQ ID NO: 4011 - protein, 9 aa, Homo Sapiens
AQMPKGTQA

SEQ ID NO: 4012 - protein, 9 aa, Homo Sapiens
PGIYEDKEG

SEQ ID NO: 4013 - protein, 9 aa, Homo Sapiens
DYGSHMQAL

SEQ ID NO: 4014 - protein, 9 aa, Homo Sapiens
AESFGPRLA

SEQ ID NO: 4015 - protein, 9 aa, Homo Sapiens
PLAQLPGRP

SEQ ID NO: 4016 - protein, 9 aa, Homo Sapiens
ACLFVCPPG

SEQ ID NO: 4017 - protein, 9 aa, Homo Sapiens
PTEWIATFG

SEQ ID NO: 4018 - protein, 9 aa, Homo Sapiens
SKVLIGSHN

SEQ ID NO: 4019 - protein, 9 aa, Homo Sapiens
YQLIKEKLL

SEQ ID NO: 4020 - protein, 9 aa, Homo Sapiens
QRTDSRPQP

SEQ ID NO: 4021 - protein, 9 aa, Homo Sapiens
GEVVAVLCP

SEQ ID NO: 4022 - protein, 9 aa, Homo Sapiens
SRLRNPHKT

SEQ ID NO: 4023 - protein, 9 aa, Homo Sapiens
GGLLELADI

SEQ ID NO: 4024 - protein, 9 aa, Homo Sapiens
NRPSFHGIL

SEQ ID NO: 4025 - protein, 8 aa, Homo Sapiens
TTSTLQKA

SEQ ID NO: 4026 - protein, 9 aa, Homo Sapiens
ENPGVKATV

SEQ ID NO: 4027 - protein, 9 aa, Homo Sapiens
RNCYDEIKE

SEQ ID NO: 4028 - protein, 9 aa, Homo Sapiens
NGLVTCFGP

SEQ ID NO: 4029 - protein, 9 aa, Homo Sapiens
KVFSDNMFC

SEQ ID NO: 4030 - protein, 9 aa, Homo Sapiens
VAVLCPDYI

SEQ ID NO: 4031 - protein, 9 aa, Homo Sapiens
ISTTCTYSR

SEQ ID NO: 4032 - protein, 9 aa, Homo Sapiens
AVLCPDYIY

SEQ ID NO: 4033 - protein, 9 aa, Homo Sapiens
RLRNPHKTR

SEQ ID NO: 4034 - protein, 9 aa, Homo Sapiens
HNMSVDTWS

SEQ ID NO: 4035 - protein, 9 aa, Homo Sapiens
WGTSLADDD

SEQ ID NO: 4036 - protein, 9 aa, Homo Sapiens
TPLSLIGST

SEQ ID NO: 4037 - protein, 9 aa, Homo Sapiens
DPNVGSNSL

SEQ ID NO: 4038 - protein, 9 aa, Homo Sapiens
KFANFLSGV

SEQ ID NO: 4039 - protein, 9 aa, Homo Sapiens
HMFTTVSEI

SEQ ID NO: 4040 - protein, 9 aa, Homo Sapiens
PQETWVAET

SEQ ID NO: 4041 - protein, 9 aa, Homo Sapiens
TGVSAGTSR

SEQ ID NO: 4042 - protein, 9 aa, Homo Sapiens
EPVKTQGPR

SEQ ID NO: 4043 - protein, 9 aa, Homo Sapiens
IKDPQIWDL

SEQ ID NO: 4044 - protein, 9 aa, Homo Sapiens
SFMSQVSYR

SEQ ID NO: 4045 - protein, 9 aa, Homo Sapiens
TRQDGETGH

SEQ ID NO: 4046 - protein, 9 aa, Homo Sapiens
LVNFYRTTT

SEQ ID NO: 4047 - protein, 9 aa, Homo Sapiens
SHFESRPNV

SEQ ID NO: 4048 - protein, 9 aa, Homo Sapiens
DYIYQLIKE

SEQ ID NO: 4049 - protein, 9 aa, Homo Sapiens
GSHMQALLD

SEQ ID NO: 4050 - protein, 9 aa, Homo Sapiens
ASAANFGPL

SEQ ID NO: 4051 - protein, 9 aa, Homo Sapiens
REASDGKVR

SEQ ID NO: 4052 - protein, 9 aa, Homo Sapiens
MCFHNMSVD

SEQ ID NO: 4053 - protein, 9 aa, Homo Sapiens
TARESPAAG

SEQ ID NO: 4054 - protein, 9 aa, Homo Sapiens
IWDLLTPPA

SEQ ID NO: 4055 - protein, 9 aa, Homo Sapiens
IFQEKVLQS

SEQ ID NO: 4056 - protein, 9 aa, Homo Sapiens
EETEYLESS

SEQ ID NO: 4057 - protein, 9 aa, Homo Sapiens
DKEGRTWVT

SEQ ID NO: 4058 - protein, 9 aa, Homo Sapiens
TMTCEKVLD

SEQ ID NO: 4059 - protein, 9 aa, Homo Sapiens
VNSKLSCQL

SEQ ID NO: 4060 - protein, 9 aa, Homo Sapiens
LGLYNLINI

SEQ ID NO: 4061 - protein, 9 aa, Homo Sapiens
PEPQETWVA

SEQ ID NO: 4062 - protein, 9 aa, Homo Sapiens
SKTTEYLKP

SEQ ID NO: 4063 - protein, 9 aa, Homo Sapiens
KIRRDWVPL

SEQ ID NO: 4064 - protein, 9 aa, Homo Sapiens
VASAVPLAR

SEQ ID NO: 4065 - protein, 9 aa, Homo Sapiens
IVVIFSPMV

SEQ ID NO: 4066 - protein, 9 aa, Homo Sapiens
DEMGLGKNI

SEQ ID NO: 4067 - protein, 9 aa, Homo Sapiens
YLKLIANLS

SEQ ID NO: 4068 - protein, 9 aa, Homo Sapiens
LRGFHQESK

SEQ ID NO: 4069 - protein, 9 aa, Homo Sapiens
YRSIMLENY

SEQ ID NO: 4070 - protein, 9 aa, Homo Sapiens
PLTCVFSSC

SEQ ID NO: 4071 - protein, 9 aa, Homo Sapiens
DKCANRLAA

SEQ ID NO: 4072 - protein, 9 aa, Homo Sapiens
RSISCTIKN

SEQ ID NO: 4073 - protein, 9 aa, Homo Sapiens
ATMTFEEKK

SEQ ID NO: 4074 - protein, 9 aa, Homo Sapiens
RDSISQLCP

SEQ ID NO: 4075 - protein, 9 aa, Homo Sapiens
DSARTFTCY

SEQ ID NO: 4076 - protein, 9 aa, Homo Sapiens
QVIFVSLPS

SEQ ID NO: 4077 - protein, 9 aa, Homo Sapiens
QLLFRQQAL

SEQ ID NO: 4078 - protein, 9 aa, Homo Sapiens
RGLHLLVDL

SEQ ID NO: 4079 - protein, 9 aa, Homo Sapiens
GSYKERVKR

SEQ ID NO: 4080 - protein, 9 aa, Homo Sapiens
NGVETKDAG

SEQ ID NO: 4081 - protein, 9 aa, Homo Sapiens
AEAKVTLRE

SEQ ID NO: 4082 - protein, 9 aa, Homo Sapiens
SQRLGGLRP

SEQ ID NO: 4083 - protein, 9 aa, Homo Sapiens
IWMRGLHLL

SEQ ID NO: 4084 - protein, 9 aa, Homo Sapiens
QESKLEVHA

SEQ ID NO: 4085 - protein, 9 aa, Homo Sapiens
SPIIEHYPR

SEQ ID NO: 4086 - protein, 9 aa, Homo Sapiens
GKDNGLTDA

SEQ ID NO: 4087 - protein, 9 aa, Homo Sapiens
KGSLISFVN

SEQ ID NO: 4088 - protein, 9 aa, Homo Sapiens
KVRRGYHKV

SEQ ID NO: 4089 - protein, 9 aa, Homo Sapiens
GPARCHWHR

SEQ ID NO: 4090 - protein, 9 aa, Homo Sapiens
PAVPEPVKT

SEQ ID NO: 4091 - protein, 9 aa, Homo Sapiens
DAIVVIFSP

SEQ ID NO: 4092 - protein, 9 aa, Homo Sapiens
LARPRHQKS

SEQ ID NO: 4093 - protein, 9 aa, Homo Sapiens
TGEKSSNIF

SEQ ID NO: 4094 - protein, 9 aa, Homo Sapiens
VLIGSHNDL

SEQ ID NO: 4095 - protein, 9 aa, Homo Sapiens
KAKKAKIKK

SEQ ID NO: 4096 - protein, 9 aa, Homo Sapiens
ISQKIIYKA

SEQ ID NO: 4097 - protein, 9 aa, Homo Sapiens
SPVSMFRRH

SEQ ID NO: 4098 - protein, 9 aa, Homo Sapiens
NAGRPLAED

SEQ ID NO: 4099 - protein, 9 aa, Homo Sapiens
WDLLTPPAD

SEQ ID NO: 4100 - protein, 9 aa, Homo Sapiens
VDTTMDNSV

SEQ ID NO: 4101 - protein, 9 aa, Homo Sapiens
ATEFMEFEK

SEQ ID NO: 4102 - protein, 9 aa, Homo Sapiens
GKVYRANRK

SEQ ID NO: 4103 - protein, 9 aa, Homo Sapiens
GILSYRVGF

SEQ ID NO: 4104 - protein, 9 aa, Homo Sapiens
RANRKSVQR

SEQ ID NO: 4105 - protein, 9 aa, Homo Sapiens
KLLQLTLQN

SEQ ID NO: 4106 - protein, 9 aa, Homo Sapiens
TIRLPCEEG

SEQ ID NO: 4107 - protein, 9 aa, Homo Sapiens
SQLCPSGSI

SEQ ID NO: 4108 - protein, 9 aa, Homo Sapiens
NFLSGVQQQ

SEQ ID NO: 4109 - protein, 9 aa, Homo Sapiens
MALQGMSVV

SEQ ID NO: 4110 - protein, 9 aa, Homo Sapiens
RREASDGKV

SEQ ID NO: 4111 - protein, 9 aa, Homo Sapiens
LYRSIMLEN

SEQ ID NO: 4112 - protein, 9 aa, Homo Sapiens
SISCTIKNP

SEQ ID NO: 4113 - protein, 9 aa, Homo Sapiens
FDYYYSMPF

SEQ ID NO: 4114 - protein, 9 aa, Homo Sapiens
FVSLPSLVY

SEQ ID NO: 4115 - protein, 9 aa, Homo Sapiens
SAQSGNAGR

SEQ ID NO: 4116 - protein, 9 aa, Homo Sapiens
KGQRINKSV

SEQ ID NO: 4117 - protein, 9 aa, Homo Sapiens
ASAPNLRPT

SEQ ID NO: 4118 - protein, 9 aa, Homo Sapiens
DDFHLEGRD

SEQ ID NO: 4119 - protein, 9 aa, Homo Sapiens
KEEGLEAHI

SEQ ID NO: 4120 - protein, 9 aa, Homo Sapiens
PTVDKVLAV

SEQ ID NO: 4121 - protein, 9 aa, Homo Sapiens
VAKSSSDGR

SEQ ID NO: 4122 - protein, 9 aa, Homo Sapiens
EHYPRMPAY

SEQ ID NO: 4123 - protein, 9 aa, Homo Sapiens
CLFVCPPGG

SEQ ID NO: 4124 - protein, 9 aa, Homo Sapiens
KQYRRSFLT

SEQ ID NO: 4125 - protein, 9 aa, Homo Sapiens
QAFLESAPR

SEQ ID NO: 4126 - protein, 9 aa, Homo Sapiens
WSQTSSSWI

SEQ ID NO: 4127 - protein, 9 aa, Homo Sapiens
SAANFGPLQ

SEQ ID NO: 4128 - protein, 9 aa, Homo Sapiens
KYKQNIFDY

SEQ ID NO: 4129 - protein, 9 aa, Homo Sapiens
LEAASFMSQ

SEQ ID NO: 4130 - protein, 9 aa, Homo Sapiens
ELGLYNLIN

SEQ ID NO: 4131 - protein, 9 aa, Homo Sapiens
RVTVAKSSS

SEQ ID NO: 4132 - protein, 9 aa, Homo Sapiens
QHLVLVLGE

SEQ ID NO: 4133 - protein, 9 aa, Homo Sapiens
TQEDAQAIC

SEQ ID NO: 4134 - protein, 9 aa, Homo Sapiens
KKQFKETMM

SEQ ID NO: 4135 - protein, 9 aa, Homo Sapiens
LPERVELAA

SEQ ID NO: 4136 - protein, 9 aa, Homo Sapiens
GNGFLWVKS

SEQ ID NO: 4137 - protein, 9 aa, Homo Sapiens
SPWGTSLAD

SEQ ID NO: 4138 - protein, 9 aa, Homo Sapiens
HRHLIGNSG

SEQ ID NO: 4139 - protein, 9 aa, Homo Sapiens
FESRPNVPQ

SEQ ID NO: 4140 - protein, 9 aa, Homo Sapiens
NGPSYELLK

SEQ ID NO: 4141 - protein, 9 aa, Homo Sapiens
SYKERVKRL

SEQ ID NO: 4142 - protein, 9 aa, Homo Sapiens
LENEMTDSS

SEQ ID NO: 4143 - protein, 9 aa, Homo Sapiens
LFTMLREQG

SEQ ID NO: 4144 - protein, 9 aa, Homo Sapiens
VAKGWAGEP

SEQ ID NO: 4145 - protein, 9 aa, Homo Sapiens
LPCEEGELL

SEQ ID NO: 4146 - protein, 9 aa, Homo Sapiens
QQKLVEVLK

SEQ ID NO: 4147 - protein, 9 aa, Homo Sapiens
ASFMSQVSY

SEQ ID NO: 4148 - protein, 9 aa, Homo Sapiens
QGDRDGETE

SEQ ID NO: 4149 - protein, 9 aa, Homo Sapiens
EKVLQSNTF

SEQ ID NO: 4150 - protein, 9 aa, Homo Sapiens
IHKPHLGNS

SEQ ID NO: 4151 - protein, 9 aa, Homo Sapiens
ELFDYIYQL

SEQ ID NO: 4152 - protein, 9 aa, Homo Sapiens
QNGLVTCFG

SEQ ID NO: 4153 - protein, 9 aa, Homo Sapiens
KLRISKRSV

SEQ ID NO: 4154 - protein, 9 aa, Homo Sapiens
QKTENGPSY

SEQ ID NO: 4155 - protein, 9 aa, Homo Sapiens
QNYKDEAKK

SEQ ID NO: 4156 - protein, 9 aa, Homo Sapiens
HISHREAQG

SEQ ID NO: 4157 - protein, 9 aa, Homo Sapiens
NSAQSGNAG

SEQ ID NO: 4158 - protein, 9 aa, Homo Sapiens
GMSVVELSG

SEQ ID NO: 4159 - protein, 9 aa, Homo Sapiens
SNTNLIDHQ

SEQ ID NO: 4160 - protein, 9 aa, Homo Sapiens
LYRKKRSRI

SEQ ID NO: 4161 - protein, 9 aa, Homo Sapiens
LELFDYIYQ

SEQ ID NO: 4162 - protein, 9 aa, Homo Sapiens
IFHSGEKPH

SEQ ID NO: 4163 - protein, 9 aa, Homo Sapiens
GYQTYSQAL

SEQ ID NO: 4164 - protein, 9 aa, Homo Sapiens
LSHPNCALQ

SEQ ID NO: 4165 - protein, 9 aa, Homo Sapiens
HHTEKITVD

SEQ ID NO: 4166 - protein, 9 aa, Homo Sapiens
PYQREPRSP

SEQ ID NO: 4167 - protein, 9 aa, Homo Sapiens
VKKLQHSTK

SEQ ID NO: 4168 - protein, 9 aa, Homo Sapiens
VATMTFEEK

SEQ ID NO: 4169 - protein, 9 aa, Homo Sapiens
FLESAPRIM

SEQ ID NO: 4170 - protein, 9 aa, Homo Sapiens
GRNCYDEIK

SEQ ID NO: 4171 - protein, 9 aa, Homo Sapiens
LEWASAPNL

SEQ ID NO: 4172 - protein, 9 aa, Homo Sapiens
MRVENNPHF

SEQ ID NO: 4173 - protein, 9 aa, Homo Sapiens
DYLGKAMVV

SEQ ID NO: 4174 - protein, 9 aa, Homo Sapiens
PMADGGEFN

SEQ ID NO: 4175 - protein, 9 aa, Homo Sapiens
LPPPPRPGP

SEQ ID NO: 4176 - protein, 9 aa, Homo Sapiens
TAGLLHNIL

SEQ ID NO: 4177 - protein, 9 aa, Homo Sapiens
ASNNLFHVA

SEQ ID NO: 4178 - protein, 9 aa, Homo Sapiens
GPEFLDVDK

SEQ ID NO: 4179 - protein, 9 aa, Homo Sapiens
MKGFFADYE

SEQ ID NO: 4180 - protein, 9 aa, Homo Sapiens
VPKSKEFIQ

SEQ ID NO: 4181 - protein, 9 aa, Homo Sapiens
DNSEITKED

SEQ ID NO: 4182 - protein, 9 aa, Homo Sapiens
EGKGSLISF

SEQ ID NO: 4183 - protein, 9 aa, Homo Sapiens
PIIEHYPRM

SEQ ID NO: 4184 - protein, 9 aa, Homo Sapiens
EDDFHLEGR

SEQ ID NO: 4185 - protein, 9 aa, Homo Sapiens
ICKYKQNIF

SEQ ID NO: 4186 - protein, 9 aa, Homo Sapiens
DSPSNAPAT

SEQ ID NO: 4187 - protein, 9 aa, Homo Sapiens
KAMVVASVV

SEQ ID NO: 4188 - protein, 9 aa, Homo Sapiens
CNEMLAYHR

SEQ ID NO: 4189 - protein, 9 aa, Homo Sapiens
LSETYLEVI

SEQ ID NO: 4190 - protein, 9 aa, Homo Sapiens
AGACKAAAR

SEQ ID NO: 4191 - protein, 9 aa, Homo Sapiens
REAQGPSFR

SEQ ID NO: 4192 - protein, 9 aa, Homo Sapiens
RNHQDLDRE

SEQ ID NO: 4193 - protein, 9 aa, Homo Sapiens
MAVVAGSGA

SEQ ID NO: 4194 - protein, 9 aa, Homo Sapiens
EENLKCQNM

SEQ ID NO: 4195 - protein, 9 aa, Homo Sapiens
NNVRHHTEK

SEQ ID NO: 4196 - protein, 9 aa, Homo Sapiens
LVPKMSHDT

SEQ ID NO: 4197 - protein, 9 aa, Homo Sapiens
TRDSISQLC

SEQ ID NO: 4198 - protein, 9 aa, Homo Sapiens
MDKEYDVIV

SEQ ID NO: 4199 - protein, 9 aa, Homo Sapiens
LQAVQAAEN

SEQ ID NO: 4200 - protein, 9 aa, Homo Sapiens
SVAAFAYKA

SEQ ID NO: 4201 - protein, 9 aa, Homo Sapiens
DVPHAELVS

SEQ ID NO: 4202 - protein, 9 aa, Homo Sapiens
SVLDPTVTG

SEQ ID NO: 4203 - protein, 9 aa, Homo Sapiens
IYGFEKSCS

SEQ ID NO: 4204 - protein, 9 aa, Homo Sapiens
SFGPRLASS

SEQ ID NO: 4205 - protein, 9 aa, Homo Sapiens
GESFHVNSE

SEQ ID NO: 4206 - protein, 9 aa, Homo Sapiens
YGFDYYYSM

SEQ ID NO: 4207 - protein, 9 aa, Homo Sapiens
WKNKDPTEW

SEQ ID NO: 4208 - protein, 9 aa, Homo Sapiens
QTYSQALTL

SEQ ID NO: 4209 - protein, 9 aa, Homo Sapiens
NDPYQREPR

SEQ ID NO: 4210 - protein, 9 aa, Homo Sapiens
PKQPEQEPQ

SEQ ID NO: 4211 - protein, 9 aa, Homo Sapiens
KEEIQFYVQ

SEQ ID NO: 4212 - protein, 9 aa, Homo Sapiens
LQRDFLETY

SEQ ID NO: 4213 - protein, 9 aa, Homo Sapiens
GPAVPEPVK

SEQ ID NO: 4214 - protein, 9 aa, Homo Sapiens
TFFPLQVNV

SEQ ID NO: 4215 - protein, 9 aa, Homo Sapiens
TEWIATFGA

SEQ ID NO: 4216 - protein, 9 aa, Homo Sapiens
FLPVAKGWA

SEQ ID NO: 4217 - protein, 9 aa, Homo Sapiens
WRTTGLIPW

SEQ ID NO: 4218 - protein, 9 aa, Homo Sapiens
PVRKLWSSR

SEQ ID NO: 4219 - protein, 9 aa, Homo Sapiens
ALLDPFQKN

SEQ ID NO: 4220 - protein, 9 aa, Homo Sapiens
FHGILYYYQ

SEQ ID NO: 4221 - protein, 9 aa, Homo Sapiens
QNIFDYYEP

SEQ ID NO: 4222 - protein, 9 aa, Homo Sapiens
PGFKKINVL

SEQ ID NO: 4223 - protein, 9 aa, Homo Sapiens
KLSCQLYQR

SEQ ID NO: 4224 - protein, 9 aa, Homo Sapiens
NGHYKVAQL

SEQ ID NO: 4225 - protein, 9 aa, Homo Sapiens
NSSSLDKQL

SEQ ID NO: 4226 - protein, 9 aa, Homo Sapiens
EKSSKTFGP

SEQ ID NO: 4227 - protein, 9 aa, Homo Sapiens
RLYRSIMLE

SEQ ID NO: 4228 - protein, 9 aa, Homo Sapiens
ANFGPLQLG

SEQ ID NO: 4229 - protein, 9 aa, Homo Sapiens
TNVDTTMDN

SEQ ID NO: 4230 - protein, 9 aa, Homo Sapiens
TLQRSVSKE

SEQ ID NO: 4231 - protein, 9 aa, Homo Sapiens
YQQLKESRI

SEQ ID NO: 4232 - protein, 9 aa, Homo Sapiens
AGKDNGLTD

SEQ ID NO: 4233 - protein, 9 aa, Homo Sapiens
SSNIFVRGW

SEQ ID NO: 4234 - protein, 9 aa, Homo Sapiens
GVRPRPEAQ

SEQ ID NO: 4235 - protein, 9 aa, Homo Sapiens
VSMFRRHTV

SEQ ID NO: 4236 - protein, 9 aa, Homo Sapiens
GDIICVFLQ

SEQ ID NO: 4237 - protein, 9 aa, Homo Sapiens
EGLLYGRES

SEQ ID NO: 4238 - protein, 9 aa, Homo Sapiens
LGELQEHIV

SEQ ID NO: 4239 - protein, 9 aa, Homo Sapiens
CWCFEGLYP

SEQ ID NO: 4240 - protein, 9 aa, Homo Sapiens
INITRGSVR

SEQ ID NO: 4241 - protein, 9 aa, Homo Sapiens
TKQEETEYL

SEQ ID NO: 4242 - protein, 9 aa, Homo Sapiens
ERTCRTAED

SEQ ID NO: 4243 - protein, 9 aa, Homo Sapiens
PGPEFLDVD

SEQ ID NO: 4244 - protein, 9 aa, Homo Sapiens
RVICTARQQ

SEQ ID NO: 4245 - protein, 9 aa, Homo Sapiens
GLVTCFGPE

SEQ ID NO: 4246 - protein, 9 aa, Homo Sapiens
TTEYLKPNP

SEQ ID NO: 4247 - protein, 9 aa, Homo Sapiens
AFRGAGQCP

SEQ ID NO: 4248 - protein, 9 aa, Homo Sapiens
MGKVDGKKI

SEQ ID NO: 4249 - protein, 9 aa, Homo Sapiens
IQTESSSSS

SEQ ID NO: 4250 - protein, 9 aa, Homo Sapiens
QRLESTGGL

SEQ ID NO: 4251 - protein, 9 aa, Homo Sapiens
AWLIMVAFA

SEQ ID NO: 4252 - protein, 9 aa, Homo Sapiens
VAQLLLLNG

SEQ ID NO: 4253 - protein, 9 aa, Homo Sapiens
FLAFRGAGQ

SEQ ID NO: 4254 - protein, 9 aa, Homo Sapiens
CQPLTCVFS

SEQ ID NO: 4255 - protein, 9 aa, Homo Sapiens
ELSFSLCYL

SEQ ID NO: 4256 - protein, 9 aa, Homo Sapiens
AQIWMRGLH

SEQ ID NO: 4257 - protein, 9 aa, Homo Sapiens
ESFLEAASF

SEQ ID NO: 4258 - protein, 9 aa, Homo Sapiens
TTLSFEGNG

SEQ ID NO: 4259 - protein, 9 aa, Homo Sapiens
HFLYRKKRS

SEQ ID NO: 4260 - protein, 9 aa, Homo Sapiens
PEPETGVSA

SEQ ID NO: 4261 - protein, 9 aa, Homo Sapiens
SLKQKMQKG

SEQ ID NO: 4262 - protein, 9 aa, Homo Sapiens
GRLPWYQVL

SEQ ID NO: 4263 - protein, 9 aa, Homo Sapiens
HQCMKNLVH

SEQ ID NO: 4264 - protein, 9 aa, Homo Sapiens
MFLVHKSTK

SEQ ID NO: 4265 - protein, 9 aa, Homo Sapiens
MPMADGGEF

SEQ ID NO: 4266 - protein, 9 aa, Homo Sapiens
CHWHRFCAR

SEQ ID NO: 4267 - protein, 9 aa, Homo Sapiens
NCEKIPTPL

SEQ ID NO: 4268 - protein, 9 aa, Homo Sapiens
RVQDLTYSV

SEQ ID NO: 4269 - protein, 9 aa, Homo Sapiens
EFLDVDKTS

SEQ ID NO: 4270 - protein, 9 aa, Homo Sapiens
EKLLQLTLQ

SEQ ID NO: 4271 - protein, 9 aa, Homo Sapiens
WASAPNLRP

SEQ ID NO: 4272 - protein, 9 aa, Homo Sapiens
KVEPAFPGH

SEQ ID NO: 4273 - protein, 9 aa, Homo Sapiens
PLARPRHQK

SEQ ID NO: 4274 - protein, 9 aa, Homo Sapiens
GGHPLAAHC

SEQ ID NO: 4275 - protein, 9 aa, Homo Sapiens
YKANERFQY

SEQ ID NO: 4276 - protein, 9 aa, Homo Sapiens
GVSAGTSRA

SEQ ID NO: 4277 - protein, 9 aa, Homo Sapiens
PEISDATAP

SEQ ID NO: 4278 - protein, 9 aa, Homo Sapiens
PAFPGHHGL

SEQ ID NO: 4279 - protein, 9 aa, Homo Sapiens
KLIANLSGC

SEQ ID NO: 4280 - protein, 9 aa, Homo Sapiens
LRPTFSLFS

SEQ ID NO: 4281 - protein, 9 aa, Homo Sapiens
EEGLEAHIS

SEQ ID NO: 4282 - protein, 9 aa, Homo Sapiens
LPVAKGWAG

SEQ ID NO: 4283 - protein, 9 aa, Homo Sapiens
PFLPLDSSP

SEQ ID NO: 4284 - protein, 9 aa, Homo Sapiens
EEYIRTDLE

SEQ ID NO: 4285 - protein, 9 aa, Homo Sapiens
QLTLQNIEI

SEQ ID NO: 4286 - protein, 9 aa, Homo Sapiens
LKLIANLSG

SEQ ID NO: 4287 - protein, 9 aa, Homo Sapiens
NASNNLFHV

SEQ ID NO: 4288 - protein, 9 aa, Homo Sapiens
PLEVDFAWE

SEQ ID NO: 4289 - protein, 9 aa, Homo Sapiens
ETSGYSFKP

SEQ ID NO: 4290 - protein, 9 aa, Homo Sapiens
THLSFSAAL

SEQ ID NO: 4291 - protein, 9 aa, Homo Sapiens
LSYRVGFFL

SEQ ID NO: 4292 - protein, 9 aa, Homo Sapiens
AKVTLRELQ

SEQ ID NO: 4293 - protein, 9 aa, Homo Sapiens
HRGGPQAGP

SEQ ID NO: 4294 - protein, 9 aa, Homo Sapiens
LECLSAILI

SEQ ID NO: 4295 - protein, 9 aa, Homo Sapiens
IEHYPRMPA

SEQ ID NO: 4296 - protein, 9 aa, Homo Sapiens
SPQSGCPLP

SEQ ID NO: 4297 - protein, 9 aa, Homo Sapiens
GTVPGGHPL

SEQ ID NO: 4298 - protein, 9 aa, Homo Sapiens
MGYQTYSQA

SEQ ID NO: 4299 - protein, 9 aa, Homo Sapiens
LSKTTEYLK

SEQ ID NO: 4300 - protein, 9 aa, Homo Sapiens
LSFEGNGFL

SEQ ID NO: 4301 - protein, 9 aa, Homo Sapiens
SSQSSIVSN

SEQ ID NO: 4302 - protein, 9 aa, Homo Sapiens
SFHGILYYY

SEQ ID NO: 4303 - protein, 9 aa, Homo Sapiens
WLQKRQRPK

SEQ ID NO: 4304 - protein, 9 aa, Homo Sapiens
FDPDATEFM

SEQ ID NO: 4305 - protein, 9 aa, Homo Sapiens
PWGTSLADD

SEQ ID NO: 4306 - protein, 9 aa, Homo Sapiens
ERVQSLKER

SEQ ID NO: 4307 - protein, 9 aa, Homo Sapiens
GPQAGPREA

SEQ ID NO: 4308 - protein, 9 aa, Homo Sapiens
VRYQECDSP

SEQ ID NO: 4309 - protein, 9 aa, Homo Sapiens
DSEPSGPWR

SEQ ID NO: 4310 - protein, 9 aa, Homo Sapiens
CKQLHTAGL

SEQ ID NO: 4311 - protein, 9 aa, Homo Sapiens
LPTIPAGKV

SEQ ID NO: 4312 - protein, 9 aa, Homo Sapiens
RRGKSGFNC

SEQ ID NO: 4313 - protein, 9 aa, Homo Sapiens
RWRTTGLIP

SEQ ID NO: 4314 - protein, 9 aa, Homo Sapiens
KGWAGEPRS

SEQ ID NO: 4315 - protein, 9 aa, Homo Sapiens
GYPKPLAQL

SEQ ID NO: 4316 - protein, 9 aa, Homo Sapiens
DKTSFSQEQ

SEQ ID NO: 4317 - protein, 9 aa, Homo Sapiens
PVSMFRRHT

SEQ ID NO: 4318 - protein, 9 aa, Homo Sapiens
SCPSFIKTE

SEQ ID NO: 4319 - protein, 9 aa, Homo Sapiens
ETYLEVIKA

SEQ ID NO: 4320 - protein, 9 aa, Homo Sapiens
TSGYSFKPK

SEQ ID NO: 4321 - protein, 9 aa, Homo Sapiens
GPAYQQLKE

SEQ ID NO: 4322 - protein, 9 aa, Homo Sapiens
FKKINVLGF

SEQ ID NO: 4323 - protein, 9 aa, Homo Sapiens
SQWMGYGLL

SEQ ID NO: 4324 - protein, 9 aa, Homo Sapiens
HVWSQTSSS

SEQ ID NO: 4325 - protein, 9 aa, Homo Sapiens
LGELSFSLC

SEQ ID NO: 4326 - protein, 9 aa, Homo Sapiens
QKIIYKANE

SEQ ID NO: 4327 - protein, 9 aa, Homo Sapiens
GEKSQDDVS

SEQ ID NO: 4328 - protein, 9 aa, Homo Sapiens
FEKSCSIWY

SEQ ID NO: 4329 - protein, 9 aa, Homo Sapiens
ERKPRMPVL

SEQ ID NO: 4330 - protein, 9 aa, Homo Sapiens
AFAGSLFGG

SEQ ID NO: 4331 - protein, 9 aa, Homo Sapiens
QETDQSEIR

SEQ ID NO: 4332 - protein, 9 aa, Homo Sapiens
HGAKENIVY

SEQ ID NO: 4333 - protein, 9 aa, Homo Sapiens
RVGFFLFIL

SEQ ID NO: 4334 - protein, 9 aa, Homo Sapiens
ENFAVNSFQ

SEQ ID NO: 4335 - protein, 9 aa, Homo Sapiens
YTMTCEKVL

SEQ ID NO: 4336 - protein, 9 aa, Homo Sapiens
PASAANFGP

SEQ ID NO: 4337 - protein, 9 aa, Homo Sapiens
KMSHDTEMN

SEQ ID NO: 4338 - protein, 9 aa, Homo Sapiens
PEGSVCTLK

SEQ ID NO: 4339 - protein, 9 aa, Homo Sapiens
GKPEAAGLE

SEQ ID NO: 4340 - protein, 9 aa, Homo Sapiens
LKESRIPDQ

SEQ ID NO: 4341 - protein, 9 aa, Homo Sapiens
KRIIDNSEI

SEQ ID NO: 4342 - protein, 9 aa, Homo Sapiens
LIMVAFAGS

SEQ ID NO: 4343 - protein, 9 aa, Homo Sapiens
AKGWAGEPR

SEQ ID NO: 4344 - protein, 9 aa, Homo Sapiens
WEVDVSNKT

SEQ ID NO: 4345 - protein, 9 aa, Homo Sapiens
IKVTQKKQF

SEQ ID NO: 4346 - protein, 9 aa, Homo Sapiens
LCPDYIYDF

SEQ ID NO: 4347 - protein, 9 aa, Homo Sapiens
SQADKCANR

SEQ ID NO: 4348 - protein, 9 aa, Homo Sapiens
QPPGMFLVH

SEQ ID NO: 4349 - protein, 9 aa, Homo Sapiens
KADLGELSF

SEQ ID NO: 4350 - protein, 9 aa, Homo Sapiens
PSLPAESFG

SEQ ID NO: 4351 - protein, 9 aa, Homo Sapiens
HVMRVENNP

SEQ ID NO: 4352 - protein, 9 aa, Homo Sapiens
KSARSPSSV

SEQ ID NO: 4353 - protein, 9 aa, Homo Sapiens
FRGAGQCPL

SEQ ID NO: 4354 - protein, 9 aa, Homo Sapiens
HTAGLLHNI

SEQ ID NO: 4355 - protein, 9 aa, Homo Sapiens
RLPWYQVLA

SEQ ID NO: 4356 - protein, 9 aa, Homo Sapiens
ECQPQNGLV

SEQ ID NO: 4357 - protein, 9 aa, Homo Sapiens
VPGHGRNCY

SEQ ID NO: 4358 - protein, 9 aa, Homo Sapiens
CVFQIPVSV

SEQ ID NO: 4359 - protein, 9 aa, Homo Sapiens
FAGSLFGGM

SEQ ID NO: 4360 - protein, 9 aa, Homo Sapiens
GCRSHSPAH

SEQ ID NO: 4361 - protein, 9 aa, Homo Sapiens
TTGLIPWLL

SEQ ID NO: 4362 - protein, 9 aa, Homo Sapiens
AVNSFQQLC

SEQ ID NO: 4363 - protein, 9 aa, Homo Sapiens
YGSNDPYQR

SEQ ID NO: 4364 - protein, 9 aa, Homo Sapiens
KEGRTWVTV

SEQ ID NO: 4365 - protein, 9 aa, Homo Sapiens
LVSTECQAV

SEQ ID NO: 4366 - protein, 9 aa, Homo Sapiens
IYQLIKEKL

SEQ ID NO: 4367 - protein, 9 aa, Homo Sapiens
YLNNCHVNW

SEQ ID NO: 4368 - protein, 9 aa, Homo Sapiens
ELKRKLEQQ

SEQ ID NO: 4369 - protein, 9 aa, Homo Sapiens
SETIRLPCE

SEQ ID NO: 4370 - protein, 9 aa, Homo Sapiens
MSVDTWSAK

SEQ ID NO: 4371 - protein, 9 aa, Homo Sapiens
RYSWDCSPV

SEQ ID NO: 4372 - protein, 9 aa, Homo Sapiens
EAQGPSFRI

SEQ ID NO: 4373 - protein, 9 aa, Homo Sapiens
IILSPEISD

SEQ ID NO: 4374 - protein, 9 aa, Homo Sapiens
HPDYGSHMQ

SEQ ID NO: 4375 - protein, 9 aa, Homo Sapiens
ESEDDFHLE

SEQ ID NO: 4376 - protein, 9 aa, Homo Sapiens
LSVGAHSEE

SEQ ID NO: 4377 - protein, 9 aa, Homo Sapiens
YVEIRPVST

SEQ ID NO: 4378 - protein, 9 aa, Homo Sapiens
KVISTTCTY

SEQ ID NO: 4379 - protein, 9 aa, Homo Sapiens
EVVAVLCPD

SEQ ID NO: 4380 - protein, 9 aa, Homo Sapiens
SEQQLLFRQ

SEQ ID NO: 4381 - protein, 9 aa, Homo Sapiens
IEAGKDNGL

SEQ ID NO: 4382 - protein, 9 aa, Homo Sapiens
VQAAENAAG

SEQ ID NO: 4383 - protein, 9 aa, Homo Sapiens
LQRSVSKES

SEQ ID NO: 4384 - protein, 9 aa, Homo Sapiens
GGSPSQADK

SEQ ID NO: 4385 - protein, 9 aa, Homo Sapiens
ICVFLQYGE

SEQ ID NO: 4386 - protein, 9 aa, Homo Sapiens
FIVGSQGAK

SEQ ID NO: 4387 - protein, 9 aa, Homo Sapiens
TEYLKPNPA

SEQ ID NO: 4388 - protein, 9 aa, Homo Sapiens
LQLTLQNIE

SEQ ID NO: 4389 - protein, 9 aa, Homo Sapiens
IQTKRSFQC

SEQ ID NO: 4390 - protein, 9 aa, Homo Sapiens
RDFLETYER

SEQ ID NO: 4391 - protein, 9 aa, Homo Sapiens
VENRGCRSH

SEQ ID NO: 4392 - protein, 9 aa, Homo Sapiens
KSKEFIQTE

SEQ ID NO: 4393 - protein, 9 aa, Homo Sapiens
QAICSLCTS

SEQ ID NO: 4394 - protein, 9 aa, Homo Sapiens
NCALQMLGL

SEQ ID NO: 4395 - protein, 9 aa, Homo Sapiens
SSAITLADG

SEQ ID NO: 4396 - protein, 9 aa, Homo Sapiens
PTAQVRSAL

SEQ ID NO: 4397 - protein, 9 aa, Homo Sapiens
KNLKNLAKK

SEQ ID NO: 4398 - protein, 9 aa, Homo Sapiens
TEFMEFEKL

SEQ ID NO: 4399 - protein, 9 aa, Homo Sapiens
KNIQTIALI

SEQ ID NO: 4400 - protein, 9 aa, Homo Sapiens
MQALLDKYN

SEQ ID NO: 4401 - protein, 9 aa, Homo Sapiens
LYGSNDPYQ

SEQ ID NO: 4402 - protein, 9 aa, Homo Sapiens
CGRAFCSNT

SEQ ID NO: 4403 - protein, 9 aa, Homo Sapiens
RSPTVDKVL

SEQ ID NO: 4404 - protein, 9 aa, Homo Sapiens
KKRSRIPLL

SEQ ID NO: 4405 - protein, 9 aa, Homo Sapiens
AEAEAKVTL

SEQ ID NO: 4406 - protein, 9 aa, Homo Sapiens
SLSRMVTKE

SEQ ID NO: 4407 - protein, 9 aa, Homo Sapiens
VPPVRKLWS

SEQ ID NO: 4408 - protein, 9 aa, Homo Sapiens
KAEGKGSLI

SEQ ID NO: 4409 - protein, 9 aa, Homo Sapiens
SVGAHSEES

SEQ ID NO: 4410 - protein, 9 aa, Homo Sapiens
FKQYRRSFL

SEQ ID NO: 4411 - protein, 9 aa, Homo Sapiens
ENRGCRSHS

SEQ ID NO: 4412 - protein, 9 aa, Homo Sapiens
NQTRDSISQ

SEQ ID NO: 4413 - protein, 9 aa, Homo Sapiens
PLVPKMSHD

SEQ ID NO: 4414 - protein, 9 aa, Homo Sapiens
VPLARPRHQ

SEQ ID NO: 4415 - protein, 9 aa, Homo Sapiens
EGEEQGDRD

SEQ ID NO: 4416 - protein, 9 aa, Homo Sapiens
CRPTAQVRS

SEQ ID NO: 4417 - protein, 9 aa, Homo Sapiens
VEIRPVSTS

SEQ ID NO: 4418 - protein, 9 aa, Homo Sapiens
ESFHVNSEV

SEQ ID NO: 4419 - protein, 9 aa, Homo Sapiens
KLPQSADVQ

SEQ ID NO: 4420 - protein, 9 aa, Homo Sapiens
NCMHSPIRP

SEQ ID NO: 4421 - protein, 9 aa, Homo Sapiens
AVPEPVKTQ

SEQ ID NO: 4422 - protein, 9 aa, Homo Sapiens
GDKTGSRDV

SEQ ID NO: 4423 - protein, 9 aa, Homo Sapiens
GRAFCSNTN

SEQ ID NO: 4424 - protein, 9 aa, Homo Sapiens
SEISSQSSI

SEQ ID NO: 4425 - protein, 9 aa, Homo Sapiens
PGESFHVNS

SEQ ID NO: 4426 - protein, 9 aa, Homo Sapiens
VFLQYGEIV

SEQ ID NO: 4427 - protein, 9 aa, Homo Sapiens
IIYKANERF

SEQ ID NO: 4428 - protein, 9 aa, Homo Sapiens
ASDGKVRRG

SEQ ID NO: 4429 - protein, 9 aa, Homo Sapiens
GLETAVRWL

SEQ ID NO: 4430 - protein, 9 aa, Homo Sapiens
RKTRTYGVL

SEQ ID NO: 4431 - protein, 9 aa, Homo Sapiens
TDNCEKIPT

SEQ ID NO: 4432 - protein, 9 aa, Homo Sapiens
GEEQGDRDG

SEQ ID NO: 4433 - protein, 9 aa, Homo Sapiens
VALGPACLF

SEQ ID NO: 4434 - protein, 9 aa, Homo Sapiens
HFESRPNVP

SEQ ID NO: 4435 - protein, 9 aa, Homo Sapiens
TVAKSSSDG

SEQ ID NO: 4436 - protein, 9 aa, Homo Sapiens
QEETEYLES

SEQ ID NO: 4437 - protein, 9 aa, Homo Sapiens
LSRMVTKEE

SEQ ID NO: 4438 - protein, 9 aa, Homo Sapiens
LEGDKTGSR

SEQ ID NO: 4439 - protein, 9 aa, Homo Sapiens
CMHSPIRPG

SEQ ID NO: 4440 - protein, 9 aa, Homo Sapiens
KKKTQEDAQ

SEQ ID NO: 4441 - protein, 9 aa, Homo Sapiens
SAPNLRPTF

SEQ ID NO: 4442 - protein, 9 aa, Homo Sapiens
QPSEQQLLF

SEQ ID NO: 4443 - protein, 9 aa, Homo Sapiens
LRRSQRLGG

SEQ ID NO: 4444 - protein, 9 aa, Homo Sapiens
AECFEDVEN

SEQ ID NO: 4445 - protein, 9 aa, Homo Sapiens
EGSVCTLKI

SEQ ID NO: 4446 - protein, 9 aa, Homo Sapiens
IYKANERFQ

SEQ ID NO: 4447 - protein, 9 aa, Homo Sapiens
HNFVVQNEI

SEQ ID NO: 4448 - protein, 9 aa, Homo Sapiens
LQKRQRPKV

SEQ ID NO: 4449 - protein, 9 aa, Homo Sapiens
TTAACMMHL

SEQ ID NO: 4450 - protein, 9 aa, Homo Sapiens
FICKYKQNI

SEQ ID NO: 4451 - protein, 9 aa, Homo Sapiens
PGEVVAVLC

SEQ ID NO: 4452 - protein, 9 aa, Homo Sapiens
DPTEWIATF

SEQ ID NO: 4453 - protein, 9 aa, Homo Sapiens
MVAFAGSLF

SEQ ID NO: 4454 - protein, 9 aa, Homo Sapiens
IVGSQGAKG

SEQ ID NO: 4455 - protein, 9 aa, Homo Sapiens
QLKIRRDWV

SEQ ID NO: 4456 - protein, 9 aa, Homo Sapiens
ALPPPPRPG

SEQ ID NO: 4457 - protein, 9 aa, Homo Sapiens
NKTAWILGV

SEQ ID NO: 4458 - protein, 9 aa, Homo Sapiens
LSAILIHGV

SEQ ID NO: 4459 - protein, 9 aa, Homo Sapiens
LCRPTAQVR

SEQ ID NO: 4460 - protein, 9 aa, Homo Sapiens
NRGCRSHSP

SEQ ID NO: 4461 - protein, 9 aa, Homo Sapiens
LQLKGNLRT

SEQ ID NO: 4462 - protein, 9 aa, Homo Sapiens
YLKPNPAYR

SEQ ID NO: 4463 - protein, 9 aa, Homo Sapiens
QVDAIVSQW

SEQ ID NO: 4464 - protein, 9 aa, Homo Sapiens
EHNFVVQNE

SEQ ID NO: 4465 - protein, 9 aa, Homo Sapiens
KQLHTAGLL

SEQ ID NO: 4466 - protein, 9 aa, Homo Sapiens
AIKARGMPE

SEQ ID NO: 4467 - protein, 9 aa, Homo Sapiens
EMISPVSHF

SEQ ID NO: 4468 - protein, 9 aa, Homo Sapiens
CPLPTIPAG

SEQ ID NO: 4469 - protein, 9 aa, Homo Sapiens
KEFIQTESS

SEQ ID NO: 4470 - protein, 9 aa, Homo Sapiens
CHFALGEYT

SEQ ID NO: 4471 - protein, 9 aa, Homo Sapiens
YRQTISVPG

SEQ ID NO: 4472 - protein, 9 aa, Homo Sapiens
NIEAGKDNG

SEQ ID NO: 4473 - protein, 9 aa, Homo Sapiens
HNDLVDEEK

SEQ ID NO: 4474 - protein, 9 aa, Homo Sapiens
SEPTGAYPM

SEQ ID NO: 4475 - protein, 9 aa, Homo Sapiens
LLQLTLQNI

SEQ ID NO: 4476 - protein, 9 aa, Homo Sapiens
HKPHLGNSS

SEQ ID NO: 4477 - protein, 9 aa, Homo Sapiens
KFHRHLIGN

SEQ ID NO: 4478 - protein, 9 aa, Homo Sapiens
QTESSSSSS

SEQ ID NO: 4479 - protein, 9 aa, Homo Sapiens
FALGEYTMT

SEQ ID NO: 4480 - protein, 9 aa, Homo Sapiens
GPPASSAIT

SEQ ID NO: 4481 - protein, 9 aa, Homo Sapiens
INVLGFRPK

SEQ ID NO: 4482 - protein, 9 aa, Homo Sapiens
LALPERVEL

SEQ ID NO: 4483 - protein, 9 aa, Homo Sapiens
EKSSNIFVR

SEQ ID NO: 4484 - protein, 9 aa, Homo Sapiens
TTPMEAASS

SEQ ID NO: 4485 - protein, 9 aa, Homo Sapiens
DQLFKQYRR

SEQ ID NO: 4486 - protein, 9 aa, Homo Sapiens
SDGKVRRGY

SEQ ID NO: 4487 - protein, 9 aa, Homo Sapiens
CFEGLYPTY

SEQ ID NO: 4488 - protein, 9 aa, Homo Sapiens
AQAAGDTAR

SEQ ID NO: 4489 - protein, 9 aa, Homo Sapiens
RAFCSNTNL

SEQ ID NO: 4490 - protein, 9 aa, Homo Sapiens
QLQLKIRRD

SEQ ID NO: 4491 - protein, 9 aa, Homo Sapiens
LTNVDTTMD

SEQ ID NO: 4492 - protein, 9 aa, Homo Sapiens
PRGTRRTAK

SEQ ID NO: 4493 - protein, 9 aa, Homo Sapiens
KSYFPNILT

SEQ ID NO: 4494 - protein, 9 aa, Homo Sapiens
PKSKEFIQT

SEQ ID NO: 4495 - protein, 9 aa, Homo Sapiens
AVRPEGSVC

SEQ ID NO: 4496 - protein, 9 aa, Homo Sapiens
FHNMSVDTW

SEQ ID NO: 4497 - protein, 9 aa, Homo Sapiens
SCTIKNPKV

SEQ ID NO: 4498 - protein, 9 aa, Homo Sapiens
NIQTIALIT

SEQ ID NO: 4499 - protein, 9 aa, Homo Sapiens
TMLREQGGF

SEQ ID NO: 4500 - protein, 9 aa, Homo Sapiens
QYLKLIANL

SEQ ID NO: 4501 - protein, 9 aa, Homo Sapiens
VNHVWSQTS

SEQ ID NO: 4502 - protein, 9 aa, Homo Sapiens
SPPRPNTEE

SEQ ID NO: 4503 - protein, 9 aa, Homo Sapiens
EVMLERMED

SEQ ID NO: 4504 - protein, 9 aa, Homo Sapiens
NLINITRGS

SEQ ID NO: 4505 - protein, 9 aa, Homo Sapiens
PSNAPATLT

SEQ ID NO: 4506 - protein, 9 aa, Homo Sapiens
SGHSEISSQ

SEQ ID NO: 4507 - protein, 9 aa, Homo Sapiens
EYIRTDLEG

SEQ ID NO: 4508 - protein, 9 aa, Homo Sapiens
RLPCEEGEL

SEQ ID NO: 4509 - protein, 9 aa, Homo Sapiens
EDAQAICSL

SEQ ID NO: 4510 - protein, 9 aa, Homo Sapiens
LESAHDPNV

SEQ ID NO: 4511 - protein, 9 aa, Homo Sapiens
YNITLSYKG

SEQ ID NO: 4512 - protein, 9 aa, Homo Sapiens
VYAIKARGM

SEQ ID NO: 4513 - protein, 9 aa, Homo Sapiens
VIQKLQLKG

SEQ ID NO: 4514 - protein, 9 aa, Homo Sapiens
CVIPFLPLD

SEQ ID NO: 4515 - protein, 9 aa, Homo Sapiens
QRINKSVAY

SEQ ID NO: 4516 - protein, 9 aa, Homo Sapiens
EFIQTESSS

SEQ ID NO: 4517 - protein, 9 aa, Homo Sapiens
GKNIQTIAL

SEQ ID NO: 4518 - protein, 9 aa, Homo Sapiens
NSKTKQEET

SEQ ID NO: 4519 - protein, 9 aa, Homo Sapiens
NMLKGPSGL

SEQ ID NO: 4520 - protein, 9 aa, Homo Sapiens
LWGIEAAAG

SEQ ID NO: 4521 - protein, 9 aa, Homo Sapiens
AGGGGGGGT

SEQ ID NO: 4522 - protein, 9 aa, Homo Sapiens
ANALSQFHA

SEQ ID NO: 4523 - protein, 9 aa, Homo Sapiens
NGYYLNNCH

SEQ ID NO: 4524 - protein, 9 aa, Homo Sapiens
PECQPQNGL

SEQ ID NO: 4525 - protein, 9 aa, Homo Sapiens
FLQRDFLET

SEQ ID NO: 4526 - protein, 9 aa, Homo Sapiens
EKSCSIWYP

SEQ ID NO: 4527 - protein, 9 aa, Homo Sapiens
VSNKTAWIL

SEQ ID NO: 4528 - protein, 9 aa, Homo Sapiens
RTAEDQFSE

SEQ ID NO: 4529 - protein, 9 aa, Homo Sapiens
AACMMHLRR

SEQ ID NO: 4530 - protein, 9 aa, Homo Sapiens
EMGLGKNIQ

SEQ ID NO: 4531 - protein, 9 aa, Homo Sapiens
NRNIHLEHI

SEQ ID NO: 4532 - protein, 9 aa, Homo Sapiens
FPNILTFFV

SEQ ID NO: 4533 - protein, 9 aa, Homo Sapiens
YGSRSSNPH

SEQ ID NO: 4534 - protein, 9 aa, Homo Sapiens
FHQESKLEV

SEQ ID NO: 4535 - protein, 9 aa, Homo Sapiens
ISNQKFANF

SEQ ID NO: 4536 - protein, 9 aa, Homo Sapiens
ITFFPLQVN

SEQ ID NO: 4537 - protein, 9 aa, Homo Sapiens
FADAIVVIF

SEQ ID NO: 4538 - protein, 9 aa, Homo Sapiens
PSQADKCAN

SEQ ID NO: 4539 - protein, 9 aa, Homo Sapiens
QKMQKGKDL

SEQ ID NO: 4540 - protein, 9 aa, Homo Sapiens
VWSQTSSSW

SEQ ID NO: 4541 - protein, 9 aa, Homo Sapiens
GNSGANINR

SEQ ID NO: 4542 - protein, 9 aa, Homo Sapiens
ESKLEVHAF

SEQ ID NO: 4543 - protein, 9 aa, Homo Sapiens
KEEKAKKAK

SEQ ID NO: 4544 - protein, 9 aa, Homo Sapiens
HCFLPVAKG

SEQ ID NO: 4545 - protein, 9 aa, Homo Sapiens
DPQIWDLLT

SEQ ID NO: 4546 - protein, 9 aa, Homo Sapiens
RPRPEAQMP

SEQ ID NO: 4547 - protein, 9 aa, Homo Sapiens
QPQNGLVTC

SEQ ID NO: 4548 - protein, 9 aa, Homo Sapiens
KTRTYGVLD

SEQ ID NO: 4549 - protein, 9 aa, Homo Sapiens
IICVFLQYG

SEQ ID NO: 4550 - protein, 9 aa, Homo Sapiens
CAGACKAAA

SEQ ID NO: 4551 - protein, 9 aa, Homo Sapiens
LEENLKCQN

SEQ ID NO: 4552 - protein, 9 aa, Homo Sapiens
KQEETEYLE

SEQ ID NO: 4553 - protein, 9 aa, Homo Sapiens
GPSGLSDQK

SEQ ID NO: 4554 - protein, 9 aa, Homo Sapiens
NVENRGCRS

SEQ ID NO: 4555 - protein, 9 aa, Homo Sapiens
KDYLGKAMV

SEQ ID NO: 4556 - protein, 9 aa, Homo Sapiens
RPGIYEDKE

SEQ ID NO: 4557 - protein, 9 aa, Homo Sapiens
MPETFNEAK

SEQ ID NO: 4558 - protein, 9 aa, Homo Sapiens
GIKDPQIWD

SEQ ID NO: 4559 - protein, 9 aa, Homo Sapiens
TLHLCRPTA

SEQ ID NO: 4560 - protein, 9 aa, Homo Sapiens
NHQDLDREL

SEQ ID NO: 4561 - protein, 9 aa, Homo Sapiens
RGEDTANRP

SEQ ID NO: 4562 - protein, 9 aa, Homo Sapiens
EYLKPNPAY

SEQ ID NO: 4563 - protein, 9 aa, Homo Sapiens
PDSATKEED

SEQ ID NO: 4564 - protein, 9 aa, Homo Sapiens
LTLQNIEIK

SEQ ID NO: 4565 - protein, 9 aa, Homo Sapiens
QTVATMTFE

SEQ ID NO: 4566 - protein, 9 aa, Homo Sapiens
LDSSPAQLS

SEQ ID NO: 4567 - protein, 9 aa, Homo Sapiens
KTTEYLKPN

SEQ ID NO: 4568 - protein, 9 aa, Homo Sapiens
AKKAKIKKA

SEQ ID NO: 4569 - protein, 9 aa, Homo Sapiens
IKGQRINKS

SEQ ID NO: 4570 - protein, 9 aa, Homo Sapiens
EKSQDDVSR

SEQ ID NO: 4571 - protein, 9 aa, Homo Sapiens
YVPGIFQEK

SEQ ID NO: 4572 - protein, 9 aa, Homo Sapiens
FKAECFEDV

SEQ ID NO: 4573 - protein, 9 aa, Homo Sapiens
LVLVLGEKS

SEQ ID NO: 4574 - protein, 9 aa, Homo Sapiens
NIFVRGWLK

SEQ ID NO: 4575 - protein, 9 aa, Homo Sapiens
KGNLRTPLP

SEQ ID NO: 4576 - protein, 9 aa, Homo Sapiens
IYEDKEGRT

SEQ ID NO: 4577 - protein, 9 aa, Homo Sapiens
FDRNRPSFH

SEQ ID NO: 4578 - protein, 9 aa, Homo Sapiens
IQKLQLKGN

SEQ ID NO: 4579 - protein, 9 aa, Homo Sapiens
WGIEAAAGE

SEQ ID NO: 4580 - protein, 9 aa, Homo Sapiens
KKSSRLRNP

SEQ ID NO: 4581 - protein, 9 aa, Homo Sapiens
VVNSKLSCQ

SEQ ID NO: 4582 - protein, 9 aa, Homo Sapiens
SFSLCYLPT

SEQ ID NO: 4583 - protein, 9 aa, Homo Sapiens
DLTNVDTTM

SEQ ID NO: 4584 - protein, 9 aa, Homo Sapiens
PACLFVCPP

SEQ ID NO: 4585 - protein, 9 aa, Homo Sapiens
QADKCANRL

SEQ ID NO: 4586 - protein, 9 aa, Homo Sapiens
TRTYGVLDT

SEQ ID NO: 4587 - protein, 9 aa, Homo Sapiens
DCMKMGKVD

SEQ ID NO: 4588 - protein, 9 aa, Homo Sapiens
GVKATVPGI

SEQ ID NO: 4589 - protein, 9 aa, Homo Sapiens
SVTLEVMLE

SEQ ID NO: 4590 - protein, 9 aa, Homo Sapiens
KPNPAYRAK

SEQ ID NO: 4591 - protein, 9 aa, Homo Sapiens
ECDSPSNAP

SEQ ID NO: 4592 - protein, 9 aa, Homo Sapiens
DPLSYFTHL

SEQ ID NO: 4593 - protein, 9 aa, Homo Sapiens
YAGILSYRV

SEQ ID NO: 4594 - protein, 9 aa, Homo Sapiens
KVAQLLLLN

SEQ ID NO: 4595 - protein, 9 aa, Homo Sapiens
EISDATAPA

SEQ ID NO: 4596 - protein, 9 aa, Homo Sapiens
PHVMRVENN

SEQ ID NO: 4597 - protein, 9 aa, Homo Sapiens
YLALPERVE

SEQ ID NO: 4598 - protein, 9 aa, Homo Sapiens
LHTAGLLHN

SEQ ID NO: 4599 - protein, 9 aa, Homo Sapiens
VHPDYGSHM

SEQ ID NO: 4600 - protein, 9 aa, Homo Sapiens
SKNLNLSNQ

SEQ ID NO: 4601 - protein, 9 aa, Homo Sapiens
DKEYDVIVL

SEQ ID NO: 4602 - protein, 9 aa, Homo Sapiens
NKDPTEWIA

SEQ ID NO: 4603 - protein, 9 aa, Homo Sapiens
SKLEVHAFD

SEQ ID NO: 4604 - protein, 9 aa, Homo Sapiens
LQNRNIHLE

SEQ ID NO: 4605 - protein, 9 aa, Homo Sapiens
SNKPSSSST

SEQ ID NO: 4606 - protein, 9 aa, Homo Sapiens
HGILYYYQS

SEQ ID NO: 4607 - protein, 9 aa, Homo Sapiens
VSQWMGYGL

SEQ ID NO: 4608 - protein, 9 aa, Homo Sapiens
SLGKNKLTH

SEQ ID NO: 4609 - protein, 9 aa, Homo Sapiens
VTETPLEVD

SEQ ID NO: 4610 - protein, 9 aa, Homo Sapiens
ILEKSSKTF

SEQ ID NO: 4611 - protein, 9 aa, Homo Sapiens
EEPLVPKMS

SEQ ID NO: 4612 - protein, 9 aa, Homo Sapiens
DEAKKQRKI

SEQ ID NO: 4613 - protein, 9 aa, Homo Sapiens
LANALSQFH

SEQ ID NO: 4614 - protein, 9 aa, Homo Sapiens
EEETSGYSF

SEQ ID NO: 4615 - protein, 9 aa, Homo Sapiens
RDHCNEMLA

SEQ ID NO: 4616 - protein, 9 aa, Homo Sapiens
QGAKGAPCP

SEQ ID NO: 4617 - protein, 9 aa, Homo Sapiens
NRPPAPIYQ

SEQ ID NO: 4618 - protein, 9 aa, Homo Sapiens
AAGQLANAL

SEQ ID NO: 4619 - protein, 9 aa, Homo Sapiens
LETAVRWLE

SEQ ID NO: 4620 - protein, 9 aa, Homo Sapiens
CAHMFTTVS

SEQ ID NO: 4621 - protein, 9 aa, Homo Sapiens
FEEKKERPI

SEQ ID NO: 4622 - protein, 9 aa, Homo Sapiens
YKERVKRLS

SEQ ID NO: 4623 - protein, 9 aa, Homo Sapiens
MHLRRYPLD

SEQ ID NO: 4624 - protein, 9 aa, Homo Sapiens
ESAHDPNVG

SEQ ID NO: 4625 - protein, 9 aa, Homo Sapiens
VENNPHFII

SEQ ID NO: 4626 - protein, 9 aa, Homo Sapiens
QSGNAGRPL

SEQ ID NO: 4627 - protein, 9 aa, Homo Sapiens
QPEQEPQPG

SEQ ID NO: 4628 - protein, 9 aa, Homo Sapiens
EELGTVMRS

SEQ ID NO: 4629 - protein, 9 aa, Homo Sapiens
LAAGQLANA

SEQ ID NO: 4630 - protein, 9 aa, Homo Sapiens
SAANLIVRG

SEQ ID NO: 4631 - protein, 9 aa, Homo Sapiens
NLAKKAKKI

SEQ ID NO: 4632 - protein, 9 aa, Homo Sapiens
IGSHNDLVD

SEQ ID NO: 4633 - protein, 9 aa, Homo Sapiens
ELVNFYRTT

SEQ ID NO: 4634 - protein, 9 aa, Homo Sapiens
CYSELEAEE

SEQ ID NO: 4635 - protein, 9 aa, Homo Sapiens
YMCFHNMSV

SEQ ID NO: 4636 - protein, 9 aa, Homo Sapiens
YPMKGFFAD

SEQ ID NO: 4637 - protein, 9 aa, Homo Sapiens
FYVVNSKLS

SEQ ID NO: 4638 - protein, 9 aa, Homo Sapiens
PKMSHDTEM

SEQ ID NO: 4639 - protein, 9 aa, Homo Sapiens
NVLGFRPKK

SEQ ID NO: 4640 - protein, 9 aa, Homo Sapiens
KANERFQYK

SEQ ID NO: 4641 - protein, 9 aa, Homo Sapiens
NGQLQLKIR

SEQ ID NO: 4642 - protein, 9 aa, Homo Sapiens
LGPPASSAI

SEQ ID NO: 4643 - protein, 9 aa, Homo Sapiens
PNCMHSPIR

SEQ ID NO: 4644 - protein, 9 aa, Homo Sapiens
IDNSEITKE

SEQ ID NO: 4645 - protein, 9 aa, Homo Sapiens
SSKTFGPAG

SEQ ID NO: 4646 - protein, 9 aa, Homo Sapiens
KPEAAGLEP

SEQ ID NO: 4647 - protein, 9 aa, Homo Sapiens
TAACMMHLR

SEQ ID NO: 4648 - protein, 9 aa, Homo Sapiens
AQKRLYRSI

SEQ ID NO: 4649 - protein, 9 aa, Homo Sapiens
YQRTHTGEK

SEQ ID NO: 4650 - protein, 9 aa, Homo Sapiens
AQLPGRPPI

SEQ ID NO: 4651 - protein, 9 aa, Homo Sapiens
SNQKFANFL

SEQ ID NO: 4652 - protein, 9 aa, Homo Sapiens
VLLTAALPP

SEQ ID NO: 4653 - protein, 9 aa, Homo Sapiens
QGMSVVELS

SEQ ID NO: 4654 - protein, 9 aa, Homo Sapiens
DVDKTSFSQ

SEQ ID NO: 4655 - protein, 9 aa, Homo Sapiens
LYGRLPWYQ

SEQ ID NO: 4656 - protein, 9 aa, Homo Sapiens
FLYRKKRSR

SEQ ID NO: 4657 - protein, 9 aa, Homo Sapiens
SEEYIRTDL

SEQ ID NO: 4658 - protein, 9 aa, Homo Sapiens
LQSNTFWTP

SEQ ID NO: 4659 - protein, 9 aa, Homo Sapiens
TYVEIRPVS

SEQ ID NO: 4660 - protein, 9 aa, Homo Sapiens
LKRIIDNSE

SEQ ID NO: 4661 - protein, 9 aa, Homo Sapiens
QLANALSQF

SEQ ID NO: 4662 - protein, 9 aa, Homo Sapiens
PRSLRSPTV

SEQ ID NO: 4663 - protein, 9 aa, Homo Sapiens
YHQCMKNLV

SEQ ID NO: 4664 - protein, 9 aa, Homo Sapiens
FTGEKSSNI

SEQ ID NO: 4665 - protein, 9 aa, Homo Sapiens
NLSVTLEVM

SEQ ID NO: 4666 - protein, 9 aa, Homo Sapiens
ANRKSVQRI

SEQ ID NO: 4667 - protein, 9 aa, Homo Sapiens
LAAHCGVRH

SEQ ID NO: 4668 - protein, 9 aa, Homo Sapiens
LSPEISDAT

SEQ ID NO: 4669 - protein, 9 aa, Homo Sapiens
YQVLAFAAA

SEQ ID NO: 4670 - protein, 9 aa, Homo Sapiens
TLLSVGAHS

SEQ ID NO: 4671 - protein, 9 aa, Homo Sapiens
TTTAACMMH

SEQ ID NO: 4672 - protein, 9 aa, Homo Sapiens
KVDGKKIGC

SEQ ID NO: 4673 - protein, 9 aa, Homo Sapiens
RGQPGPNHK

SEQ ID NO: 4674 - protein, 9 aa, Homo Sapiens
VHCFLPVAK

SEQ ID NO: 4675 - protein, 9 aa, Homo Sapiens
QSLKERLAT

SEQ ID NO: 4676 - protein, 9 aa, Homo Sapiens
PSFIKTEPS

SEQ ID NO: 4677 - protein, 9 aa, Homo Sapiens
SEDDFHLEG

SEQ ID NO: 4678 - protein, 9 aa, Homo Sapiens
NKVNELKSL

SEQ ID NO: 4679 - protein, 9 aa, Homo Sapiens
ISRVICTAR

SEQ ID NO: 4680 - protein, 9 aa, Homo Sapiens
KGAPCPLLH

SEQ ID NO: 4681 - protein, 9 aa, Homo Sapiens
FLSGVQQQL

SEQ ID NO: 4682 - protein, 9 aa, Homo Sapiens
GKNKLTHIP

SEQ ID NO: 4683 - protein, 9 aa, Homo Sapiens
GLLELADID

SEQ ID NO: 4684 - protein, 9 aa, Homo Sapiens
LQRTDSRPQ

SEQ ID NO: 4685 - protein, 9 aa, Homo Sapiens
LKGNLRTPL

SEQ ID NO: 4686 - protein, 9 aa, Homo Sapiens
ILSYRVGFF

SEQ ID NO: 4687 - protein, 9 aa, Homo Sapiens
GFKKINVLG

SEQ ID NO: 4688 - protein, 9 aa, Homo Sapiens
KKAKIKKAI

SEQ ID NO: 4689 - protein, 9 aa, Homo Sapiens
KRSRIPLLR

SEQ ID NO: 4690 - protein, 9 aa, Homo Sapiens
NQWRNKVNE

SEQ ID NO: 4691 - protein, 9 aa, Homo Sapiens
SGYSFKPKY

SEQ ID NO: 4692 - protein, 9 aa, Homo Sapiens
SYKGTIKES

SEQ ID NO: 4693 - protein, 9 aa, Homo Sapiens
RGLETAVRW

SEQ ID NO: 4694 - protein, 9 aa, Homo Sapiens
NFKREEHNF

SEQ ID NO: 4695 - protein, 9 aa, Homo Sapiens
GEKSSNIFV

SEQ ID NO: 4696 - protein, 9 aa, Homo Sapiens
LIKKSYFPN

SEQ ID NO: 4697 - protein, 9 aa, Homo Sapiens
PLSYFTHLS

SEQ ID NO: 4698 - protein, 9 aa, Homo Sapiens
AQRLESTGG

SEQ ID NO: 4699 - protein, 9 aa, Homo Sapiens
SELSTTSPW

SEQ ID NO: 4700 - protein, 9 aa, Homo Sapiens
PERPLQRTD

SEQ ID NO: 4701 - protein, 9 aa, Homo Sapiens
NQKFANFLS

SEQ ID NO: 4702 - protein, 9 aa, Homo Sapiens
KDNGLTDAQ

SEQ ID NO: 4703 - protein, 9 aa, Homo Sapiens
QLKESRIPD

SEQ ID NO: 4704 - protein, 9 aa, Homo Sapiens
CCVFQIPVS

SEQ ID NO: 4705 - protein, 9 aa, Homo Sapiens
LIGNSGANI

SEQ ID NO: 4706 - protein, 9 aa, Homo Sapiens
EGISRVICT

SEQ ID NO: 4707 - protein, 9 aa, Homo Sapiens
STKEHLRDF

SEQ ID NO: 4708 - protein, 9 aa, Homo Sapiens
VRWLENQDP

SEQ ID NO: 4709 - protein, 9 aa, Homo Sapiens
YKVAQLLLL

SEQ ID NO: 4710 - protein, 9 aa, Homo Sapiens
DSYNITLSY

SEQ ID NO: 4711 - protein, 9 aa, Homo Sapiens
AQLLLLNGA

SEQ ID NO: 4712 - protein, 9 aa, Homo Sapiens
RFICKYKQN

SEQ ID NO: 4713 - protein, 9 aa, Homo Sapiens
EHIVQKNQE

SEQ ID NO: 4714 - protein, 9 aa, Homo Sapiens
IKKSSRLRN

SEQ ID NO: 4715 - protein, 9 aa, Homo Sapiens
IEGISRVIC

SEQ ID NO: 4716 - protein, 9 aa, Homo Sapiens
DTPLRRSQR

SEQ ID NO: 4717 - protein, 9 aa, Homo Sapiens
RYQECDSPS

SEQ ID NO: 4718 - protein, 9 aa, Homo Sapiens
HCWCFEGLY

SEQ ID NO: 4719 - protein, 9 aa, Homo Sapiens
DAIVSQWMG

SEQ ID NO: 4720 - protein, 9 aa, Homo Sapiens
VPGGHPLAA

SEQ ID NO: 4721 - protein, 9 aa, Homo Sapiens
INQWRNKVN

SEQ ID NO: 4722 - protein, 9 aa, Homo Sapiens
SVDTWSAKV

SEQ ID NO: 4723 - protein, 9 aa, Homo Sapiens
NKSVAYKTK

SEQ ID NO: 4724 - protein, 9 aa, Homo Sapiens
IIFHSGEKP

SEQ ID NO: 4725 - protein, 9 aa, Homo Sapiens
ALSHPNCAL

SEQ ID NO: 4726 - protein, 9 aa, Homo Sapiens
QAAENAAGQ

SEQ ID NO: 4727 - protein, 9 aa, Homo Sapiens
KNLAKKAKK

SEQ ID NO: 4728 - protein, 9 aa, Homo Sapiens
SERVQDLTY

SEQ ID NO: 4729 - protein, 9 aa, Homo Sapiens
SLCVPPVRK

SEQ ID NO: 4730 - protein, 9 aa, Homo Sapiens
AKEEGLEAH

SEQ ID NO: 4731 - protein, 8 aa, Homo Sapiens
NYTESSPL

SEQ ID NO: 4732 - protein, 9 aa, Homo Sapiens
NYGFDYYYS

SEQ ID NO: 4733 - protein, 9 aa, Homo Sapiens
KTFGPAGVR

SEQ ID NO: 4734 - protein, 9 aa, Homo Sapiens
CEKIPTPLS

SEQ ID NO: 4735 - protein, 9 aa, Homo Sapiens
LTAALPPPP

SEQ ID NO: 4736 - protein, 9 aa, Homo Sapiens
SLEEEGQKL

SEQ ID NO: 4737 - protein, 9 aa, Homo Sapiens
GSGGHFTHP

SEQ ID NO: 4738 - protein, 9 aa, Homo Sapiens
LVFPNGVET

SEQ ID NO: 4739 - protein, 9 aa, Homo Sapiens
AYPMKGFFA

SEQ ID NO: 4740 - protein, 9 aa, Homo Sapiens
QQLKESRIP

SEQ ID NO: 4741 - protein, 9 aa, Homo Sapiens
ETPLEVDFA

SEQ ID NO: 4742 - protein, 9 aa, Homo Sapiens
NLSNQETDQ

SEQ ID NO: 4743 - protein, 9 aa, Homo Sapiens
ACKAAARVY

SEQ ID NO: 4744 - protein, 9 aa, Homo Sapiens
DRHIDSSCP

SEQ ID NO: 4745 - protein, 9 aa, Homo Sapiens
LNELVNFYR

SEQ ID NO: 4746 - protein, 9 aa, Homo Sapiens
EGDKTGSRD

SEQ ID NO: 4747 - protein, 9 aa, Homo Sapiens
HPGNASNNL

SEQ ID NO: 4748 - protein, 9 aa, Homo Sapiens
GISRVICTA

SEQ ID NO: 4749 - protein, 9 aa, Homo Sapiens
TRRTAKTCH

SEQ ID NO: 4750 - protein, 9 aa, Homo Sapiens
GPKQPEQEP

SEQ ID NO: 4751 - protein, 9 aa, Homo Sapiens
LFDYIYQLI

SEQ ID NO: 4752 - protein, 9 aa, Homo Sapiens
KKDYLGKAM

SEQ ID NO: 4753 - protein, 9 aa, Homo Sapiens
SDLQLENEM

SEQ ID NO: 4754 - protein, 9 aa, Homo Sapiens
QLYGRLPWY

SEQ ID NO: 4755 - protein, 9 aa, Homo Sapiens
CPDSATKEE

SEQ ID NO: 4756 - protein, 9 aa, Homo Sapiens
NTFWTPVIS

SEQ ID NO: 4757 - protein, 9 aa, Homo Sapiens
NIERTCRTA

SEQ ID NO: 4758 - protein, 9 aa, Homo Sapiens
PPSFPGPYR

SEQ ID NO: 4759 - protein, 9 aa, Homo Sapiens
GITFFPLQV

SEQ ID NO: 4760 - protein, 9 aa, Homo Sapiens
YFHYGYHQC

SEQ ID NO: 4761 - protein, 9 aa, Homo Sapiens
QKLPQSADV

SEQ ID NO: 4762 - protein, 9 aa, Homo Sapiens
LPSLVYMGH

SEQ ID NO: 4763 - protein, 9 aa, Homo Sapiens
SETYLEVIK

SEQ ID NO: 4764 - protein, 9 aa, Homo Sapiens
DRDGETEEQ

SEQ ID NO: 4765 - protein, 9 aa, Homo Sapiens
SAVPLARPR

SEQ ID NO: 4766 - protein, 9 aa, Homo Sapiens
VSAGTSRAA

SEQ ID NO: 4767 - protein, 9 aa, Homo Sapiens
QLIKEKLLD

SEQ ID NO: 4768 - protein, 9 aa, Homo Sapiens
KQKMQKGKD

SEQ ID NO: 4769 - protein, 9 aa, Homo Sapiens
QGKKVISTT

SEQ ID NO: 4770 - protein, 9 aa, Homo Sapiens
RRRNRKTRT

SEQ ID NO: 4771 - protein, 9 aa, Homo Sapiens
QECDSPSNA

SEQ ID NO: 4772 - protein, 9 aa, Homo Sapiens
VPAAEAEAK

SEQ ID NO: 4773 - protein, 9 aa, Homo Sapiens
RHIDSSCPS

SEQ ID NO: 4774 - protein, 9 aa, Homo Sapiens
PNVGSNSLQ

SEQ ID NO: 4775 - protein, 9 aa, Homo Sapiens
CVPPVRKLW

SEQ ID NO: 4776 - protein, 9 aa, Homo Sapiens
NGGITFFPL

SEQ ID NO: 4777 - protein, 9 aa, Homo Sapiens
GIHKPHLGN

SEQ ID NO: 4778 - protein, 9 aa, Homo Sapiens
TGILEKSSK

SEQ ID NO: 4779 - protein, 9 aa, Homo Sapiens
LVTCFGPEA

SEQ ID NO: 4780 - protein, 9 aa, Homo Sapiens
ESPPPPSTP

SEQ ID NO: 4781 - protein, 9 aa, Homo Sapiens
TAVRWLENQ

SEQ ID NO: 4782 - protein, 9 aa, Homo Sapiens
PAYQQLKES

SEQ ID NO: 4783 - protein, 9 aa, Homo Sapiens
LSNQETDQS

SEQ ID NO: 4784 - protein, 9 aa, Homo Sapiens
FNSLNELVN

SEQ ID NO: 4785 - protein, 9 aa, Homo Sapiens
VVAVLCPDY

SEQ ID NO: 4786 - protein, 9 aa, Homo Sapiens
VLMGYQTYS

SEQ ID NO: 4787 - protein, 9 aa, Homo Sapiens
SEFLQRDFL

SEQ ID NO: 4788 - protein, 9 aa, Homo Sapiens
PSFPGPYRQ

SEQ ID NO: 4789 - protein, 9 aa, Homo Sapiens
RRTAKTCHP

SEQ ID NO: 4790 - protein, 9 aa, Homo Sapiens
ETGHGAKEN

SEQ ID NO: 4791 - protein, 9 aa, Homo Sapiens
LYNLINITR

SEQ ID NO: 4792 - protein, 9 aa, Homo Sapiens
MLREQGGFE

SEQ ID NO: 4793 - protein, 9 aa, Homo Sapiens
YSFKPKYDG

SEQ ID NO: 4794 - protein, 9 aa, Homo Sapiens
NFYRTTTIA

SEQ ID NO: 4795 - protein, 9 aa, Homo Sapiens
QLLLLNGAD

SEQ ID NO: 4796 - protein, 9 aa, Homo Sapiens
PEQEPQPGH

SEQ ID NO: 4797 - protein, 9 aa, Homo Sapiens
KKLQHSTKE

SEQ ID NO: 4798 - protein, 9 aa, Homo Sapiens
VDVSNKTAW

SEQ ID NO: 4799 - protein, 9 aa, Homo Sapiens
LINQWRNKV

SEQ ID NO: 4800 - protein, 9 aa, Homo Sapiens
QPLTCVFSS

SEQ ID NO: 4801 - protein, 9 aa, Homo Sapiens
RKKRSRIPL

SEQ ID NO: 4802 - protein, 9 aa, Homo Sapiens
RTVETLLSV

SEQ ID NO: 4803 - protein, 9 aa, Homo Sapiens
IPSPNCMHS

SEQ ID NO: 4804 - protein, 9 aa, Homo Sapiens
AGQLANALS

SEQ ID NO: 4805 - protein, 9 aa, Homo Sapiens
LCEALSHPN

SEQ ID NO: 4806 - protein, 9 aa, Homo Sapiens
EQEPQPGHK

SEQ ID NO: 4807 - protein, 9 aa, Homo Sapiens
EQGGFEYKR

SEQ ID NO: 4808 - protein, 9 aa, Homo Sapiens
AGILSYRVG

SEQ ID NO: 4809 - protein, 9 aa, Homo Sapiens
YAIKARGMP

SEQ ID NO: 4810 - protein, 9 aa, Homo Sapiens
ARCHWHRFC

SEQ ID NO: 4811 - protein, 9 aa, Homo Sapiens
YKLVAYQRT

SEQ ID NO: 4812 - protein, 9 aa, Homo Sapiens
KSCSIWYPN

SEQ ID NO: 4813 - protein, 9 aa, Homo Sapiens
LGKAMVVAS

SEQ ID NO: 4814 - protein, 9 aa, Homo Sapiens
LLNSAQSGN

SEQ ID NO: 4815 - protein, 9 aa, Homo Sapiens
KKTTPMEAA

SEQ ID NO: 4816 - protein, 9 aa, Homo Sapiens
NLKCQNMHP

SEQ ID NO: 4817 - protein, 9 aa, Homo Sapiens
YIYQLIKEK

SEQ ID NO: 4818 - protein, 9 aa, Homo Sapiens
KNLNLSNQE

SEQ ID NO: 4819 - protein, 9 aa, Homo Sapiens
EGLEAHISR

SEQ ID NO: 4820 - protein, 9 aa, Homo Sapiens
VNIKGQRIN

SEQ ID NO: 4821 - protein, 9 aa, Homo Sapiens
VTLEVMLER

SEQ ID NO: 4822 - protein, 9 aa, Homo Sapiens
RTCRTAEDQ

SEQ ID NO: 4823 - protein, 9 aa, Homo Sapiens
TLSYKGTIK

SEQ ID NO: 4824 - protein, 9 aa, Homo Sapiens
FQEKVLQSN

SEQ ID NO: 4825 - protein, 9 aa, Homo Sapiens
ELVLLTAAL

SEQ ID NO: 4826 - protein, 9 aa, Homo Sapiens
FFPLQVNVG

SEQ ID NO: 4827 - protein, 9 aa, Homo Sapiens
GLHLLVDLV

SEQ ID NO: 4828 - protein, 9 aa, Homo Sapiens
GVAPGGTGE

SEQ ID NO: 4829 - protein, 9 aa, Homo Sapiens
RQRPKVFSD

SEQ ID NO: 4830 - protein, 9 aa, Homo Sapiens
FTCYSELEA

SEQ ID NO: 4831 - protein, 9 aa, Homo Sapiens
GIYEDKEGR

SEQ ID NO: 4832 - protein, 9 aa, Homo Sapiens
LLGELQEHI

SEQ ID NO: 4833 - protein, 9 aa, Homo Sapiens
QAAGDTARE

SEQ ID NO: 4834 - protein, 9 aa, Homo Sapiens
KREEHNFVV

SEQ ID NO: 4835 - protein, 9 aa, Homo Sapiens
DGDGTITTE

SEQ ID NO: 4836 - protein, 9 aa, Homo Sapiens
LGEYTMTCE

SEQ ID NO: 4837 - protein, 9 aa, Homo Sapiens
RTAKTCHPA

SEQ ID NO: 4838 - protein, 9 aa, Homo Sapiens
ANFLSGVQQ

SEQ ID NO: 4839 - protein, 9 aa, Homo Sapiens
PETGVSAGT

SEQ ID NO: 4840 - protein, 9 aa, Homo Sapiens
WYQVLAFAA

SEQ ID NO: 4841 - protein, 9 aa, Homo Sapiens
KCQNMHPHS

SEQ ID NO: 4842 - protein, 9 aa, Homo Sapiens
PEAAGLEPS

SEQ ID NO: 4843 - protein, 9 aa, Homo Sapiens
KLEVHAFDK

SEQ ID NO: 4844 - protein, 9 aa, Homo Sapiens
FPLQVNVGG

SEQ ID NO: 4845 - protein, 9 aa, Homo Sapiens
TITTEELGT

SEQ ID NO: 4846 - protein, 9 aa, Homo Sapiens
AKKHCWCFE

SEQ ID NO: 4847 - protein, 9 aa, Homo Sapiens
FPNGVETKD

SEQ ID NO: 4848 - protein, 9 aa, Homo Sapiens
SVSSAANLI

SEQ ID NO: 4849 - protein, 9 aa, Homo Sapiens
SKLSCQLYQ

SEQ ID NO: 4850 - protein, 9 aa, Homo Sapiens
FLEAASFMS

SEQ ID NO: 4851 - protein, 9 aa, Homo Sapiens
IMVAFAGSL

SEQ ID NO: 4852 - protein, 9 aa, Homo Sapiens
FQKNLYRDV

SEQ ID NO: 4853 - protein, 9 aa, Homo Sapiens
DNGLTDAQQ

SEQ ID NO: 4854 - protein, 9 aa, Homo Sapiens
GGITFFPLQ

SEQ ID NO: 4855 - protein, 9 aa, Homo Sapiens
PVPCQPLTC

SEQ ID NO: 4856 - protein, 9 aa, Homo Sapiens
ELKRIIDNS

SEQ ID NO: 4857 - protein, 9 aa, Homo Sapiens
PLQVNVGGQ

SEQ ID NO: 4858 - protein, 9 aa, Homo Sapiens
FEDVENLNA

SEQ ID NO: 4859 - protein, 9 aa, Homo Sapiens
AYQRTHTGE

SEQ ID NO: 4860 - protein, 9 aa, Homo Sapiens
RSPSSVSDN

SEQ ID NO: 4861 - protein, 9 aa, Homo Sapiens
GEFNLRRGD

SEQ ID NO: 4862 - protein, 9 aa, Homo Sapiens
ALGEYTMTC

SEQ ID NO: 4863 - protein, 9 aa, Homo Sapiens
GFEKSCSIW

SEQ ID NO: 4864 - protein, 9 aa, Homo Sapiens
FFTGEKSSN

SEQ ID NO: 4865 - protein, 9 aa, Homo Sapiens
WMRGLHLLV

SEQ ID NO: 4866 - protein, 9 aa, Homo Sapiens
QIQNGYYLN

SEQ ID NO: 4867 - protein, 9 aa, Homo Sapiens
CMKMGKVDG

SEQ ID NO: 4868 - protein, 9 aa, Homo Sapiens
LEERVQSLK

SEQ ID NO: 4869 - protein, 9 aa, Homo Sapiens
LQAQPPGMF

SEQ ID NO: 4870 - protein, 9 aa, Homo Sapiens
TSDLQLENE

SEQ ID NO: 4871 - protein, 9 aa, Homo Sapiens
GVENPGVKA

SEQ ID NO: 4872 - protein, 9 aa, Homo Sapiens
DPDATEFME

SEQ ID NO: 4873 - protein, 9 aa, Homo Sapiens
HLSFSAALK

SEQ ID NO: 4874 - protein, 9 aa, Homo Sapiens
VKTQGPRDP

SEQ ID NO: 4875 - protein, 9 aa, Homo Sapiens
EGLGRDHCN

SEQ ID NO: 4876 - protein, 9 aa, Homo Sapiens
GGTGEGLLY

SEQ ID NO: 4877 - protein, 9 aa, Homo Sapiens
KGALSVAAF

SEQ ID NO: 4878 - protein, 9 aa, Homo Sapiens
KVTLRELQE

SEQ ID NO: 4879 - protein, 9 aa, Homo Sapiens
HFALGEYTM

SEQ ID NO: 4880 - protein, 9 aa, Homo Sapiens
SFQQLCINF

SEQ ID NO: 4881 - protein, 9 aa, Homo Sapiens
TKEEIQFYV

SEQ ID NO: 4882 - protein, 9 aa, Homo Sapiens
GQPGPNHKE

SEQ ID NO: 4883 - protein, 9 aa, Homo Sapiens
DDKVFLAFR

SEQ ID NO: 4884 - protein, 9 aa, Homo Sapiens
APGEVVAVL

SEQ ID NO: 4885 - protein, 9 aa, Homo Sapiens
PGVKATVPG

SEQ ID NO: 4886 - protein, 9 aa, Homo Sapiens
LTHIPDTLP

SEQ ID NO: 4887 - protein, 9 aa, Homo Sapiens
THIPDTLPS

SEQ ID NO: 4888 - protein, 9 aa, Homo Sapiens
STTKDCCVF

SEQ ID NO: 4889 - protein, 9 aa, Homo Sapiens
SGGSPSQAD

SEQ ID NO: 4890 - protein, 9 aa, Homo Sapiens
DKVFLAFRG

SEQ ID NO: 4891 - protein, 9 aa, Homo Sapiens
NFGPLQLGG

SEQ ID NO: 4892 - protein, 9 aa, Homo Sapiens
LQLENEMTD

SEQ ID NO: 4893 - protein, 9 aa, Homo Sapiens
KAECFEDVE

SEQ ID NO: 4894 - protein, 9 aa, Homo Sapiens
SPEISDATA

SEQ ID NO: 4895 - protein, 9 aa, Homo Sapiens
EGQKLPQSA

SEQ ID NO: 4896 - protein, 9 aa, Homo Sapiens
IRRDWVPLS

SEQ ID NO: 4897 - protein, 9 aa, Homo Sapiens
DTARESPAA

SEQ ID NO: 4898 - protein, 9 aa, Homo Sapiens
EEKAKKAKI

SEQ ID NO: 4899 - protein, 9 aa, Homo Sapiens
SQSSIVSNS

SEQ ID NO: 4900 - protein, 9 aa, Homo Sapiens
LAPKVEPAF

SEQ ID NO: 4901 - protein, 9 aa, Homo Sapiens
TAYKKTTPM

SEQ ID NO: 4902 - protein, 9 aa, Homo Sapiens
GHGAKENIV

SEQ ID NO: 4903 - protein, 9 aa, Homo Sapiens
AGDTARESP

SEQ ID NO: 4904 - protein, 9 aa, Homo Sapiens
EAKKHCWCF

SEQ ID NO: 4905 - protein, 9 aa, Homo Sapiens
EQVDAIVSQ

SEQ ID NO: 4906 - protein, 9 aa, Homo Sapiens
GPYRQTISV

SEQ ID NO: 4907 - protein, 9 aa, Homo Sapiens
AYKKTTPME

SEQ ID NO: 4908 - protein, 9 aa, Homo Sapiens
FEKLLQLTL

SEQ ID NO: 4909 - protein, 9 aa, Homo Sapiens
AFCSNTNLI

SEQ ID NO: 4910 - protein, 9 aa, Homo Sapiens
CFLPVAKGW

SEQ ID NO: 4911 - protein, 9 aa, Homo Sapiens
LTCVFSSCN

SEQ ID NO: 4912 - protein, 9 aa, Homo Sapiens
YRANRKSVQ

SEQ ID NO: 4913 - protein, 9 aa, Homo Sapiens
FDYIYQLIK

SEQ ID NO: 4914 - protein, 9 aa, Homo Sapiens
GVLEILQNR

SEQ ID NO: 4915 - protein, 9 aa, Homo Sapiens
RNRPSFHGI

SEQ ID NO: 4916 - protein, 9 aa, Homo Sapiens
ENAAGQALQ

SEQ ID NO: 4917 - protein, 9 aa, Homo Sapiens
SVSDNLDFS

SEQ ID NO: 4918 - protein, 9 aa, Homo Sapiens
PWYQVLAFA

SEQ ID NO: 4919 - protein, 9 aa, Homo Sapiens
PSLSRMVTK

SEQ ID NO: 4920 - protein, 9 aa, Homo Sapiens
QRRPGESFH

SEQ ID NO: 4921 - protein, 9 aa, Homo Sapiens
LIGSHNDLV

SEQ ID NO: 4922 - protein, 9 aa, Homo Sapiens
RRSFLTSEK

SEQ ID NO: 4923 - protein, 9 aa, Homo Sapiens
PSGLSDQKV

SEQ ID NO: 4924 - protein, 9 aa, Homo Sapiens
KSLEGDKTG

SEQ ID NO: 4925 - protein, 9 aa, Homo Sapiens
WHRFCARSP

SEQ ID NO: 4926 - protein, 9 aa, Homo Sapiens
LKRKLEQQQ

SEQ ID NO: 4927 - protein, 9 aa, Homo Sapiens
VIPFLPLDS

SEQ ID NO: 4928 - protein, 9 aa, Homo Sapiens
SPSQADKCA

SEQ ID NO: 4929 - protein, 9 aa, Homo Sapiens
KEDADSYEN

SEQ ID NO: 4930 - protein, 9 aa, Homo Sapiens
ARGMPETFN

SEQ ID NO: 4931 - protein, 9 aa, Homo Sapiens
QIWMRGLHL

SEQ ID NO: 4932 - protein, 9 aa, Homo Sapiens
DTTMDNSVL

SEQ ID NO: 4933 - protein, 9 aa, Homo Sapiens
GIPSPNCMH

SEQ ID NO: 4934 - protein, 9 aa, Homo Sapiens
QNGYYLNNC

SEQ ID NO: 4935 - protein, 9 aa, Homo Sapiens
YRVGFFLFI

SEQ ID NO: 4936 - protein, 9 aa, Homo Sapiens
LSLGKNKLT

SEQ ID NO: 4937 - protein, 9 aa, Homo Sapiens
GNASNNLFH

SEQ ID NO: 4938 - protein, 9 aa, Homo Sapiens
SPSNAPATL

SEQ ID NO: 4939 - protein, 9 aa, Homo Sapiens
TGHGAKENI

SEQ ID NO: 4940 - protein, 9 aa, Homo Sapiens
ECFEDVENL

SEQ ID NO: 4941 - protein, 9 aa, Homo Sapiens
QSNTFWTPV

SEQ ID NO: 4942 - protein, 9 aa, Homo Sapiens
QEDAQAICS

SEQ ID NO: 4943 - protein, 9 aa, Homo Sapiens
SKTFGPAGV

SEQ ID NO: 4944 - protein, 9 aa, Homo Sapiens
MNGHYKVAQ

SEQ ID NO: 4945 - protein, 9 aa, Homo Sapiens
AEGKGSLIS

SEQ ID NO: 4946 - protein, 9 aa, Homo Sapiens
FHSGEKPHL

SEQ ID NO: 4947 - protein, 9 aa, Homo Sapiens
RVELAAQLG

SEQ ID NO: 4948 - protein, 9 aa, Homo Sapiens
SRMVTKEEI

SEQ ID NO: 4949 - protein, 9 aa, Homo Sapiens
QQLCINFAN

SEQ ID NO: 4950 - protein, 9 aa, Homo Sapiens
PSPNCMHSP

SEQ ID NO: 4951 - protein, 9 aa, Homo Sapiens
LSYFTHLSF

SEQ ID NO: 4952 - protein, 9 aa, Homo Sapiens
RGPKQPEQE

SEQ ID NO: 4953 - protein, 9 aa, Homo Sapiens
TAQVRSALR

SEQ ID NO: 4954 - protein, 9 aa, Homo Sapiens
AHDPNVGSN

SEQ ID NO: 4955 - protein, 9 aa, Homo Sapiens
TGGLLELAD

SEQ ID NO: 4956 - protein, 9 aa, Homo Sapiens
TCRTAEDQF

SEQ ID NO: 4957 - protein, 9 aa, Homo Sapiens
IQNGYYLNN

SEQ ID NO: 4958 - protein, 9 aa, Homo Sapiens
KSSRLRNPH

SEQ ID NO: 4959 - protein, 9 aa, Homo Sapiens
DLDRELLMN

SEQ ID NO: 4960 - protein, 9 aa, Homo Sapiens
IPTPLSLIG

SEQ ID NO: 4961 - protein, 9 aa, Homo Sapiens
FHRHLIGNS

SEQ ID NO: 4962 - protein, 9 aa, Homo Sapiens
KVLQSNTFW

SEQ ID NO: 4963 - protein, 9 aa, Homo Sapiens
PTLQRSVSK

SEQ ID NO: 4964 - protein, 9 aa, Homo Sapiens
FAVNSFQQL

SEQ ID NO: 4965 - protein, 9 aa, Homo Sapiens
KTTPMEAAS

SEQ ID NO: 4966 - protein, 9 aa, Homo Sapiens
TIKNPKVEV

SEQ ID NO: 4967 - protein, 9 aa, Homo Sapiens
RMTSERVQD

SEQ ID NO: 4968 - protein, 9 aa, Homo Sapiens
PGGTGEGLL

SEQ ID NO: 4969 - protein, 9 aa, Homo Sapiens
YRRSFLTSE

SEQ ID NO: 4970 - protein, 9 aa, Homo Sapiens
LAKKAKKIS

SEQ ID NO: 4971 - protein, 9 aa, Homo Sapiens
ADKCANRLA

SEQ ID NO: 4972 - protein, 9 aa, Homo Sapiens
GDRDGETEE

SEQ ID NO: 4973 - protein, 9 aa, Homo Sapiens
RHLIGNSGA

SEQ ID NO: 4974 - protein, 9 aa, Homo Sapiens
LVDKSLEGD

SEQ ID NO: 4975 - protein, 9 aa, Homo Sapiens
PEFLDVDKT

SEQ ID NO: 4976 - protein, 9 aa, Homo Sapiens
EETSGYSFK

SEQ ID NO: 4977 - protein, 9 aa, Homo Sapiens
NVRHHTEKI

SEQ ID NO: 4978 - protein, 9 aa, Homo Sapiens
IDSSCPSFI

SEQ ID NO: 4979 - protein, 9 aa, Homo Sapiens
CKAAARVYD

SEQ ID NO: 4980 - protein, 9 aa, Homo Sapiens
HVIQKLQLK

SEQ ID NO: 4981 - protein, 9 aa, Homo Sapiens
GLEPSSSGE

SEQ ID NO: 4982 - protein, 9 aa, Homo Sapiens
SGFNCKSGK

SEQ ID NO: 4983 - protein, 9 aa, Homo Sapiens
KVTQKKQFK

SEQ ID NO: 4984 - protein, 9 aa, Homo Sapiens
VSPQYLKLI

SEQ ID NO: 4985 - protein, 9 aa, Homo Sapiens
AKSSSDGRG

SEQ ID NO: 4986 - protein, 9 aa, Homo Sapiens
SGGHFTHPR

SEQ ID NO: 4987 - protein, 9 aa, Homo Sapiens
TRGEDTANR

SEQ ID NO: 4988 - protein, 9 aa, Homo Sapiens
SNDPYQREP

SEQ ID NO: 4989 - protein, 9 aa, Homo Sapiens
PRPEAQMPK

SEQ ID NO: 4990 - protein, 9 aa, Homo Sapiens
APEPQETWV

SEQ ID NO: 4991 - protein, 9 aa, Homo Sapiens
IFVSLPSLV

SEQ ID NO: 4992 - protein, 9 aa, Homo Sapiens
HLRRYPLDE

SEQ ID NO: 4993 - protein, 9 aa, Homo Sapiens
PDYGSHMQA

SEQ ID NO: 4994 - protein, 9 aa, Homo Sapiens
KGPSGLSDQ

SEQ ID NO: 4995 - protein, 9 aa, Homo Sapiens
YPKPLAQLP

SEQ ID NO: 4996 - protein, 9 aa, Homo Sapiens
AHISRLAEL

SEQ ID NO: 4997 - protein, 9 aa, Homo Sapiens
DVQRHIIFH

SEQ ID NO: 4998 - protein, 9 aa, Homo Sapiens
SGCPLPTIP

SEQ ID NO: 4999 - protein, 9 aa, Homo Sapiens
LKPNPAYRA

SEQ ID NO: 5000 - protein, 9 aa, Homo Sapiens
TPLEVDFAW

SEQ ID NO: 5001 - protein, 9 aa, Homo Sapiens
VENPGVKAT

SEQ ID NO: 5002 - protein, 9 aa, Homo Sapiens
MKMGKVDGK

SEQ ID NO: 5003 - protein, 9 aa, Homo Sapiens
TSPWGTSLA

SEQ ID NO: 5004 - protein, 9 aa, Homo Sapiens
QGGFEYKRA

SEQ ID NO: 5005 - protein, 9 aa, Homo Sapiens
STGSYKERV

SEQ ID NO: 5006 - protein, 9 aa, Homo Sapiens
ELAPEPQET

SEQ ID NO: 5007 - protein, 9 aa, Homo Sapiens
DKTGSRDVI

SEQ ID NO: 5008 - protein, 9 aa, Homo Sapiens
RGKSGFNCK

SEQ ID NO: 5009 - protein, 9 aa, Homo Sapiens
QNMHPHSRL

SEQ ID NO: 5010 - protein, 9 aa, Homo Sapiens
ILSPEISDA

SEQ ID NO: 5011 - protein, 9 aa, Homo Sapiens
TAEDQFSEI

SEQ ID NO: 5012 - protein, 9 aa, Homo Sapiens
MTFEEKKER

SEQ ID NO: 5013 - protein, 9 aa, Homo Sapiens
LTSDLQLEN

SEQ ID NO: 5014 - protein, 9 aa, Homo Sapiens
TGVENPGVK

SEQ ID NO: 5015 - protein, 9 aa, Homo Sapiens
VQDLTYSVQ

SEQ ID NO: 5016 - protein, 9 aa, Homo Sapiens
ETKDAGFYV

SEQ ID NO: 5017 - protein, 9 aa, Homo Sapiens
HLIGNSGAN

SEQ ID NO: 5018 - protein, 9 aa, Homo Sapiens
KKSYFPNIL

SEQ ID NO: 5019 - protein, 9 aa, Homo Sapiens
SVASAVPLA

SEQ ID NO: 5020 - protein, 9 aa, Homo Sapiens
GNLECLSAI

SEQ ID NO: 5021 - protein, 9 aa, Homo Sapiens
LNSAQSGNA

SEQ ID NO: 5022 - protein, 9 aa, Homo Sapiens
DKVIILSPE

SEQ ID NO: 5023 - protein, 9 aa, Homo Sapiens
LLTAALPPP

SEQ ID NO: 5024 - protein, 9 aa, Homo Sapiens
FPGHHGLAL

SEQ ID NO: 5025 - protein, 9 aa, Homo Sapiens
KSSSDGRGD

SEQ ID NO: 5026 - protein, 9 aa, Homo Sapiens
LRSPTVDKV

SEQ ID NO: 5027 - protein, 9 aa, Homo Sapiens
ENGPSYELL

SEQ ID NO: 5028 - protein, 9 aa, Homo Sapiens
MPVPCQPLT

SEQ ID NO: 5029 - protein, 9 aa, Homo Sapiens
ITLSYKGTI

SEQ ID NO: 5030 - protein, 9 aa, Homo Sapiens
LKLRWRTTG

SEQ ID NO: 5031 - protein, 9 aa, Homo Sapiens
HISRLAELI

SEQ ID NO: 5032 - protein, 9 aa, Homo Sapiens
YRKKRSRIP

SEQ ID NO: 5033 - protein, 9 aa, Homo Sapiens
DPFQKNLYR

SEQ ID NO: 5034 - protein, 9 aa, Homo Sapiens
TANRPPAPI

SEQ ID NO: 5035 - protein, 9 aa, Homo Sapiens
AGLEPSSSG

SEQ ID NO: 5036 - protein, 9 aa, Homo Sapiens
IERTCRTAE

SEQ ID NO: 5037 - protein, 9 aa, Homo Sapiens
KDCCVFQIP

SEQ ID NO: 5038 - protein, 9 aa, Homo Sapiens
RPGESFHVN

SEQ ID NO: 5039 - protein, 9 aa, Homo Sapiens
SQTSSSWIR

SEQ ID NO: 5040 - protein, 9 aa, Homo Sapiens
YYYSMPFTL

SEQ ID NO: 5041 - protein, 9 aa, Homo Sapiens
LREQGGFEY

SEQ ID NO: 5042 - protein, 9 aa, Homo Sapiens
HCNEMLAYH

SEQ ID NO: 5043 - protein, 9 aa, Homo Sapiens
LEKSSKTFG

SEQ ID NO: 5044 - protein, 9 aa, Homo Sapiens
LFKQYRRSF

SEQ ID NO: 5045 - protein, 9 aa, Homo Sapiens
LGRDHCNEM

SEQ ID NO: 5046 - protein, 9 aa, Homo Sapiens
KYGLLSNKP

SEQ ID NO: 5047 - protein, 9 aa, Homo Sapiens
NSKLSCQLY

SEQ ID NO: 5048 - protein, 9 aa, Homo Sapiens
TENGPSYEL

SEQ ID NO: 5049 - protein, 9 aa, Homo Sapiens
EIRPVSTSS

SEQ ID NO: 5050 - protein, 9 aa, Homo Sapiens
SIMLENYQS

SEQ ID NO: 5051 - protein, 9 aa, Homo Sapiens
CDKEEKAKK

SEQ ID NO: 5052 - protein, 9 aa, Homo Sapiens
KGNLECLSA

SEQ ID NO: 5053 - protein, 9 aa, Homo Sapiens
AFLESAPRI

SEQ ID NO: 5054 - protein, 9 aa, Homo Sapiens
FANFLSGVQ

SEQ ID NO: 5055 - protein, 9 aa, Homo Sapiens
DFLETYERY

SEQ ID NO: 5056 - protein, 9 aa, Homo Sapiens
RPTAQVRSA

SEQ ID NO: 5057 - protein, 9 aa, Homo Sapiens
YQECDSPSN

SEQ ID NO: 5058 - protein, 9 aa, Homo Sapiens
NIKGQRINK

SEQ ID NO: 5059 - protein, 9 aa, Homo Sapiens
GEGEEQGDR

SEQ ID NO: 5060 - protein, 9 aa, Homo Sapiens
RMVTKEEIQ

SEQ ID NO: 5061 - protein, 9 aa, Homo Sapiens
RHRGGPQAG

SEQ ID NO: 5062 - protein, 9 aa, Homo Sapiens
PSEQQLLFR

SEQ ID NO: 5063 - protein, 9 aa, Homo Sapiens
VRREASDGK

SEQ ID NO: 5064 - protein, 9 aa, Homo Sapiens
VNSFQQLCI

SEQ ID NO: 5065 - protein, 9 aa, Homo Sapiens
INKSVAYKT

SEQ ID NO: 5066 - protein, 9 aa, Homo Sapiens
TPLRRSQRL

SEQ ID NO: 5067 - protein, 9 aa, Homo Sapiens
NELVNFYRT

SEQ ID NO: 5068 - protein, 9 aa, Homo Sapiens
NTNLIDHQR

SEQ ID NO: 5069 - protein, 9 aa, Homo Sapiens
SGNAGRPLA

SEQ ID NO: 5070 - protein, 9 aa, Homo Sapiens
SATKEEDTV

SEQ ID NO: 5071 - protein, 9 aa, Homo Sapiens
GYYLNNCHV

SEQ ID NO: 5072 - protein, 9 aa, Homo Sapiens
EDKEGRTWV

SEQ ID NO: 5073 - protein, 9 aa, Homo Sapiens
VDIKKSSRL

SEQ ID NO: 5074 - protein, 9 aa, Homo Sapiens
DLGELSFSL

SEQ ID NO: 5075 - protein, 9 aa, Homo Sapiens
GQRINKSVA

SEQ ID NO: 5076 - protein, 9 aa, Homo Sapiens
VIFSPMVLT

SEQ ID NO: 5077 - protein, 9 aa, Homo Sapiens
YWEVDVSNK

SEQ ID NO: 5078 - protein, 9 aa, Homo Sapiens
YEDKEGRTW

SEQ ID NO: 5079 - protein, 9 aa, Homo Sapiens
QRDFLETYE

SEQ ID NO: 5080 - protein, 9 aa, Homo Sapiens
VPGIFQEKV

SEQ ID NO: 5081 - protein, 9 aa, Homo Sapiens
PTPLSLIGS

SEQ ID NO: 5082 - protein, 9 aa, Homo Sapiens
AEDQFSEIK

SEQ ID NO: 5083 - protein, 9 aa, Homo Sapiens
VPKMSHDTE

SEQ ID NO: 5084 - protein, 9 aa, Homo Sapiens
VTQKKQFKE

SEQ ID NO: 5085 - protein, 9 aa, Homo Sapiens
MVTKEEIQF

SEQ ID NO: 5086 - protein, 9 aa, Homo Sapiens
KKQRKIIFH

SEQ ID NO: 5087 - protein, 9 aa, Homo Sapiens
LNMLKGPSG

SEQ ID NO: 5088 - protein, 9 aa, Homo Sapiens
TKEEDTVEL

SEQ ID NO: 5089 - protein, 9 aa, Homo Sapiens
SNNLFHVAF

SEQ ID NO: 5090 - protein, 9 aa, Homo Sapiens
GNSSSLDKQ

SEQ ID NO: 5091 - protein, 9 aa, Homo Sapiens
SVHCAHMFT

SEQ ID NO: 5092 - protein, 9 aa, Homo Sapiens
KELGLYNLI

SEQ ID NO: 5093 - protein, 9 aa, Homo Sapiens
ADEMGLGKN

SEQ ID NO: 5094 - protein, 9 aa, Homo Sapiens
VSDNLDFSK

SEQ ID NO: 5095 - protein, 9 aa, Homo Sapiens
LQGMSVVEL

SEQ ID NO: 5096 - protein, 9 aa, Homo Sapiens
FICSLCVPP

SEQ ID NO: 5097 - protein, 9 aa, Homo Sapiens
RCHWHRFCA

SEQ ID NO: 5098 - protein, 9 aa, Homo Sapiens
QIWDLLTPP

SEQ ID NO: 5099 - protein, 9 aa, Homo Sapiens
GGHFTHPRE

SEQ ID NO: 5100 - protein, 9 aa, Homo Sapiens
YYSMPFTLV

SEQ ID NO: 5101 - protein, 9 aa, Homo Sapiens
ITLADGGEG

SEQ ID NO: 5102 - protein, 9 aa, Homo Sapiens
PAAEAEAKV

SEQ ID NO: 5103 - protein, 9 aa, Homo Sapiens
GRDHCNEML

SEQ ID NO: 5104 - protein, 9 aa, Homo Sapiens
RSLEEEGQK

SEQ ID NO: 5105 - protein, 9 aa, Homo Sapiens
LQVNVGGQA

SEQ ID NO: 5106 - protein, 9 aa, Homo Sapiens
TAKTCHPAR

SEQ ID NO: 5107 - protein, 9 aa, Homo Sapiens
SAHDPNVGS

SEQ ID NO: 5108 - protein, 9 aa, Homo Sapiens
EEEGQKLPQ

SEQ ID NO: 5109 - protein, 9 aa, Homo Sapiens
PTGAYPMKG

SEQ ID NO: 5110 - protein, 9 aa, Homo Sapiens
KKAKKISAA

SEQ ID NO: 5111 - protein, 9 aa, Homo Sapiens
WLIMVAFAG

SEQ ID NO: 5112 - protein, 9 aa, Homo Sapiens
KVFLAFRGA

SEQ ID NO: 5113 - protein, 9 aa, Homo Sapiens
NNLFHVAFQ

SEQ ID NO: 5114 - protein, 9 aa, Homo Sapiens
TFEEKKERP

SEQ ID NO: 5115 - protein, 9 aa, Homo Sapiens
VEPAFPGHH

SEQ ID NO: 5116 - protein, 9 aa, Homo Sapiens
SMPFTLVDS

SEQ ID NO: 5117 - protein, 9 aa, Homo Sapiens
ANLIVRGSP

SEQ ID NO: 5118 - protein, 9 aa, Homo Sapiens
TGEGLLYGR

SEQ ID NO: 5119 - protein, 9 aa, Homo Sapiens
TTKDCCVFQ

SEQ ID NO: 5120 - protein, 9 aa, Homo Sapiens
TFTCYSELE

SEQ ID NO: 5121 - protein, 9 aa, Homo Sapiens
KRQRPKVFS

SEQ ID NO: 5122 - protein, 9 aa, Homo Sapiens
RPEAQMPKG

SEQ ID NO: 5123 - protein, 9 aa, Homo Sapiens
DRELLMNQK

SEQ ID NO: 5124 - protein, 9 aa, Homo Sapiens
AAGDTARES

SEQ ID NO: 5125 - protein, 9 aa, Homo Sapiens
IKNPKVEVF

SEQ ID NO: 5126 - protein, 9 aa, Homo Sapiens
SACKQLHTA

SEQ ID NO: 5127 - protein, 9 aa, Homo Sapiens
VPHAELVST

SEQ ID NO: 5128 - protein, 9 aa, Homo Sapiens
QRSVSKESA

SEQ ID NO: 5129 - protein, 9 aa, Homo Sapiens
MSVVELSGL

SEQ ID NO: 5130 - protein, 9 aa, Homo Sapiens
AQGPSFRIC

SEQ ID NO: 5131 - protein, 9 aa, Homo Sapiens
PLLPERPLQ

SEQ ID NO: 5132 - protein, 9 aa, Homo Sapiens
LVLGEKSQD

SEQ ID NO: 5133 - protein, 9 aa, Homo Sapiens
THPREDRED

SEQ ID NO: 5134 - protein, 9 aa, Homo Sapiens
NRKTRTYGV

SEQ ID NO: 5135 - protein, 9 aa, Homo Sapiens
KATVPGISA

SEQ ID NO: 5136 - protein, 9 aa, Homo Sapiens
QDGETGHGA

SEQ ID NO: 5137 - protein, 9 aa, Homo Sapiens
VLVLGEKSQ

SEQ ID NO: 5138 - protein, 9 aa, Homo Sapiens
PKVFSDNMF

SEQ ID NO: 5139 - protein, 9 aa, Homo Sapiens
PSSVSDNLD

SEQ ID NO: 5140 - protein, 9 aa, Homo Sapiens
GGPQAGPRE

SEQ ID NO: 5141 - protein, 9 aa, Homo Sapiens
YFPNILTFF

SEQ ID NO: 5142 - protein, 9 aa, Homo Sapiens
HLLVDLVTS

SEQ ID NO: 5143 - protein, 9 aa, Homo Sapiens
LCVPPVRKL

SEQ ID NO: 5144 - protein, 9 aa, Homo Sapiens
GHYKVAQLL

SEQ ID NO: 5145 - protein, 9 aa, Homo Sapiens
SSAANLIVR

SEQ ID NO: 5146 - protein, 9 aa, Homo Sapiens
YKDEAKKQR

SEQ ID NO: 5147 - protein, 9 aa, Homo Sapiens
HQESKLEVH

SEQ ID NO: 5148 - protein, 9 aa, Homo Sapiens
MPASAANFG

SEQ ID NO: 5149 - protein, 9 aa, Homo Sapiens
YVVNSKLSC

SEQ ID NO: 5150 - protein, 9 aa, Homo Sapiens
EEGQKLPQS

SEQ ID NO: 5151 - protein, 9 aa, Homo Sapiens
FVTETPLEV

SEQ ID NO: 5152 - protein, 9 aa, Homo Sapiens
FLETYERYH

SEQ ID NO: 5153 - protein, 9 aa, Homo Sapiens
VETKDAGFY

SEQ ID NO: 5154 - protein, 9 aa, Homo Sapiens
PEPVKTQGP

SEQ ID NO: 5155 - protein, 9 aa, Homo Sapiens
EAAGLEPSS

SEQ ID NO: 5156 - protein, 9 aa, Homo Sapiens
RSQRLGGLR

SEQ ID NO: 5157 - protein, 9 aa, Homo Sapiens
KFDPDATEF

SEQ ID NO: 5158 - protein, 9 aa, Homo Sapiens
TEESGSAKP

SEQ ID NO: 5159 - protein, 9 aa, Homo Sapiens
SPNVENRGC

SEQ ID NO: 5160 - protein, 9 aa, Homo Sapiens
RGGPQAGPR

SEQ ID NO: 5161 - protein, 9 aa, Homo Sapiens
CKSGKRGSS

SEQ ID NO: 5162 - protein, 9 aa, Homo Sapiens
DNGSGGHFT

SEQ ID NO: 5163 - protein, 9 aa, Homo Sapiens
AFAYKALFA

SEQ ID NO: 5164 - protein, 9 aa, Homo Sapiens
SARSPSSVS

SEQ ID NO: 5165 - protein, 9 aa, Homo Sapiens
RISKRSVLD

SEQ ID NO: 5166 - protein, 9 aa, Homo Sapiens
CKYKQNIFD

SEQ ID NO: 5167 - protein, 9 aa, Homo Sapiens
LETYERYHT

SEQ ID NO: 5168 - protein, 9 aa, Homo Sapiens
LQEHIVQKN

SEQ ID NO: 5169 - protein, 9 aa, Homo Sapiens
EESGSAKPV

SEQ ID NO: 5170 - protein, 9 aa, Homo Sapiens
GLGRDHCNE

SEQ ID NO: 5171 - protein, 9 aa, Homo Sapiens
VMRVENNPH

SEQ ID NO: 5172 - protein, 9 aa, Homo Sapiens
AASFMSQVS

SEQ ID NO: 5173 - protein, 9 aa, Homo Sapiens
HIIFHSGEK

SEQ ID NO: 5174 - protein, 9 aa, Homo Sapiens
SISQLCPSG

SEQ ID NO: 5175 - protein, 9 aa, Homo Sapiens
CSPVSMFRR

SEQ ID NO: 5176 - protein, 9 aa, Homo Sapiens
VCTLKIQRT

SEQ ID NO: 5177 - protein, 9 aa, Homo Sapiens
YKGTIKESR

SEQ ID NO: 5178 - protein, 9 aa, Homo Sapiens
LQVIFVSLP

SEQ ID NO: 5179 - protein, 9 aa, Homo Sapiens
MGKVYRANR

SEQ ID NO: 5180 - protein, 9 aa, Homo Sapiens
GVETKDAGF

SEQ ID NO: 5181 - protein, 9 aa, Homo Sapiens
TDLEGSDID

SEQ ID NO: 5182 - protein, 9 aa, Homo Sapiens
PLDSSPAQL

SEQ ID NO: 5183 - protein, 9 aa, Homo Sapiens
LEVMLERME

SEQ ID NO: 5184 - protein, 9 aa, Homo Sapiens
PERVELAAQ

SEQ ID NO: 5185 - protein, 9 aa, Homo Sapiens
KLTHIPDTL

SEQ ID NO: 5186 - protein, 9 aa, Homo Sapiens
KPHLGNSSS

SEQ ID NO: 5187 - protein, 9 aa, Homo Sapiens
RRDWVPLSP

SEQ ID NO: 5188 - protein, 9 aa, Homo Sapiens
NMHPHSRLN

SEQ ID NO: 5189 - protein, 9 aa, Homo Sapiens
EMGKVYRAN

SEQ ID NO: 5190 - protein, 9 aa, Homo Sapiens
CEEGELLEY

SEQ ID NO: 5191 - protein, 9 aa, Homo Sapiens
TGSYKERVK

SEQ ID NO: 5192 - protein, 9 aa, Homo Sapiens
YFTHLSFSA

SEQ ID NO: 5193 - protein, 9 aa, Homo Sapiens
PGPYRQTIS

SEQ ID NO: 5194 - protein, 9 aa, Homo Sapiens
FVCPPGGIH

SEQ ID NO: 5195 - protein, 9 aa, Homo Sapiens
TAALPPPPR

SEQ ID NO: 5196 - protein, 9 aa, Homo Sapiens
GPPSFPGPY

SEQ ID NO: 5197 - protein, 9 aa, Homo Sapiens
NGSGGHFTH

SEQ ID NO: 5198 - protein, 9 aa, Homo Sapiens
EWALLDPFQ

SEQ ID NO: 5199 - protein, 9 aa, Homo Sapiens
RSVSKESAN

SEQ ID NO: 5200 - protein, 9 aa, Homo Sapiens
SLPSLVYMG

SEQ ID NO: 5201 - protein, 9 aa, Homo Sapiens
RGFHQESKL

SEQ ID NO: 5202 - protein, 9 aa, Homo Sapiens
EAKKQRKII

SEQ ID NO: 5203 - protein, 9 aa, Homo Sapiens
CQNMHPHSR

SEQ ID NO: 5204 - protein, 9 aa, Homo Sapiens
SKRSVLDPT

SEQ ID NO: 5205 - protein, 9 aa, Homo Sapiens
GPNHKEDAD

SEQ ID NO: 5206 - protein, 9 aa, Homo Sapiens
YLGKAMVVA

SEQ ID NO: 5207 - protein, 9 aa, Homo Sapiens
QLFKQYRRS

SEQ ID NO: 5208 - protein, 9 aa, Homo Sapiens
PHAELVSTE

SEQ ID NO: 5209 - protein, 9 aa, Homo Sapiens
HFTHPREDR

SEQ ID NO: 5210 - protein, 9 aa, Homo Sapiens
NPHFIIYLP

SEQ ID NO: 5211 - protein, 9 aa, Homo Sapiens
MHSPIRPGQ

SEQ ID NO: 5212 - protein, 9 aa, Homo Sapiens
VKATVPGIS

SEQ ID NO: 5213 - protein, 9 aa, Homo Sapiens
RQDGETGHG

SEQ ID NO: 5214 - protein, 9 aa, Homo Sapiens
QKRLYRSIM

SEQ ID NO: 5215 - protein, 9 aa, Homo Sapiens
EKFDPDATE

SEQ ID NO: 5216 - protein, 9 aa, Homo Sapiens
EVPGHGRNC

SEQ ID NO: 5217 - protein, 9 aa, Homo Sapiens
VRHHTEKIT

SEQ ID NO: 5218 - protein, 9 aa, Homo Sapiens
RIIDNSEIT

SEQ ID NO: 5219 - protein, 9 aa, Homo Sapiens
GELSFSLCY

SEQ ID NO: 5220 - protein, 9 aa, Homo Sapiens
RSFLTSEKT

SEQ ID NO: 5221 - protein, 9 aa, Homo Sapiens
RNKVNELKS

SEQ ID NO: 5222 - protein, 9 aa, Homo Sapiens
YKKTTPMEA

SEQ ID NO: 5223 - protein, 9 aa, Homo Sapiens
LILKAEGKG

SEQ ID NO: 5224 - protein, 9 aa, Homo Sapiens
KERVKRLSV

SEQ ID NO: 5225 - protein, 9 aa, Homo Sapiens
EKIPTPLSL

SEQ ID NO: 5226 - protein, 9 aa, Homo Sapiens
HYWEVDVSN

SEQ ID NO: 5227 - protein, 9 aa, Homo Sapiens
SPTVDKVLA

SEQ ID NO: 5228 - protein, 9 aa, Homo Sapiens
AGAATQAFL

SEQ ID NO: 5229 - protein, 9 aa, Homo Sapiens
KKTQEDAQA

SEQ ID NO: 5230 - protein, 9 aa, Homo Sapiens
SLNMLKGPS

SEQ ID NO: 5231 - protein, 9 aa, Homo Sapiens
SHNFKREEH

SEQ ID NO: 5232 - protein, 9 aa, Homo Sapiens
NSPPRPNTE

SEQ ID NO: 5233 - protein, 9 aa, Homo Sapiens
LSFSLCYLP

SEQ ID NO: 5234 - protein, 9 aa, Homo Sapiens
VSHFESRPN

SEQ ID NO: 5235 - protein, 9 aa, Homo Sapiens
SPNCMHSPI

SEQ ID NO: 5236 - protein, 9 aa, Homo Sapiens
GKAMVVASV

SEQ ID NO: 5237 - protein, 9 aa, Homo Sapiens
VSSAANLIV

SEQ ID NO: 5238 - protein, 9 aa, Homo Sapiens
ILQNRNIHL

SEQ ID NO: 5239 - protein, 9 aa, Homo Sapiens
TETPLEVDF

SEQ ID NO: 5240 - protein, 9 aa, Homo Sapiens
MEAASSGTR

SEQ ID NO: 5241 - protein, 9 aa, Homo Sapiens
YELLKVNEH

SEQ ID NO: 5242 - protein, 9 aa, Homo Sapiens
STGGLLELA

SEQ ID NO: 5243 - protein, 9 aa, Homo Sapiens
LLSNKPSSS

SEQ ID NO: 5244 - protein, 9 aa, Homo Sapiens
HLGNSSSLD

SEQ ID NO: 5245 - protein, 9 aa, Homo Sapiens
QRLGGLRPE

SEQ ID NO: 5246 - protein, 9 aa, Homo Sapiens
ARHRGGPQA

SEQ ID NO: 5247 - protein, 9 aa, Homo Sapiens
TNLIDHQRI

SEQ ID NO: 5248 - protein, 9 aa, Homo Sapiens
EVDVSNKTA

SEQ ID NO: 5249 - protein, 9 aa, Homo Sapiens
RRSQRLGGL

SEQ ID NO: 5250 - protein, 9 aa, Homo Sapiens
LRISKRSVL

SEQ ID NO: 5251 - protein, 9 aa, Homo Sapiens
TVETLLSVG

SEQ ID NO: 5252 - protein, 9 aa, Homo Sapiens
SYRVGFFLF

SEQ ID NO: 5253 - protein, 9 aa, Homo Sapiens
FLFTMLREQ

SEQ ID NO: 5254 - protein, 9 aa, Homo Sapiens
SPQYLKLIA

SEQ ID NO: 5255 - protein, 9 aa, Homo Sapiens
ATTLSFEGN

SEQ ID NO: 5256 - protein, 9 aa, Homo Sapiens
IVSQWMGYG

SEQ ID NO: 5257 - protein, 9 aa, Homo Sapiens
GAKGAPCPL

SEQ ID NO: 5258 - protein, 9 aa, Homo Sapiens
QRPGIYEDK

SEQ ID NO: 5259 - protein, 9 aa, Homo Sapiens
PGPNHKEDA

SEQ ID NO: 5260 - protein, 9 aa, Homo Sapiens
IMLENYQSL

SEQ ID NO: 5261 - protein, 9 aa, Homo Sapiens
ISKRSVLDP

SEQ ID NO: 5262 - protein, 9 aa, Homo Sapiens
RPNTEESGS

SEQ ID NO: 5263 - protein, 9 aa, Homo Sapiens
LVAYQRTHT

SEQ ID NO: 5264 - protein, 9 aa, Homo Sapiens
ELQEHIVQK

SEQ ID NO: 5265 - protein, 9 aa, Homo Sapiens
DGEGEEQGD

SEQ ID NO: 5266 - protein, 9 aa, Homo Sapiens
HPNCALQML

SEQ ID NO: 5267 - protein, 9 aa, Homo Sapiens
SYELLKVNE

SEQ ID NO: 5268 - protein, 9 aa, Homo Sapiens
TKYGLLSNK

SEQ ID NO: 5269 - protein, 9 aa, Homo Sapiens
RRNRKTRTY

SEQ ID NO: 5270 - protein, 9 aa, Homo Sapiens
VSTECQAVT

SEQ ID NO: 5271 - protein, 9 aa, Homo Sapiens
SSFKAECFE

SEQ ID NO: 5272 - protein, 9 aa, Homo Sapiens
RTDLEGSDI

SEQ ID NO: 5273 - protein, 9 aa, Homo Sapiens
DSSCPSFIK

SEQ ID NO: 5274 - protein, 9 aa, Homo Sapiens
EPETGVSAG

SEQ ID NO: 5275 - protein, 9 aa, Homo Sapiens
EAEAKVTLR

SEQ ID NO: 5276 - protein, 9 aa, Homo Sapiens
NLIVRGSPG

SEQ ID NO: 5277 - protein, 9 aa, Homo Sapiens
CGPARCHWH

SEQ ID NO: 5278 - protein, 9 aa, Homo Sapiens
FHLEGRDPD

SEQ ID NO: 5279 - protein, 9 aa, Homo Sapiens
ISHREAQGP

SEQ ID NO: 5280 - protein, 9 aa, Homo Sapiens
KSGFNCKSG

SEQ ID NO: 5281 - protein, 9 aa, Homo Sapiens
LLSETYLEV

SEQ ID NO: 5282 - protein, 9 aa, Homo Sapiens
QHSTKEHLR

SEQ ID NO: 5283 - protein, 9 aa, Homo Sapiens
DSETIRLPC

SEQ ID NO: 5284 - protein, 9 aa, Homo Sapiens
STECQAVTA

SEQ ID NO: 5285 - protein, 9 aa, Homo Sapiens
SHNDLVDEE

SEQ ID NO: 5286 - protein, 9 aa, Homo Sapiens
GYHQCMKNL

SEQ ID NO: 5287 - protein, 9 aa, Homo Sapiens
YSMPFTLVD

SEQ ID NO: 5288 - protein, 9 aa, Homo Sapiens
TMQGKKVIS

SEQ ID NO: 5289 - protein, 9 aa, Homo Sapiens
VFLAFRGAG

SEQ ID NO: 5290 - protein, 9 aa, Homo Sapiens
NLNLSNQET

SEQ ID NO: 5291 - protein, 9 aa, Homo Sapiens
ERVQDLTYS

SEQ ID NO: 5292 - protein, 9 aa, Homo Sapiens
VDTWSAKVF

SEQ ID NO: 5293 - protein, 9 aa, Homo Sapiens
KKVISTTCT

SEQ ID NO: 5294 - protein, 9 aa, Homo Sapiens
ETGVSAGTS

SEQ ID NO: 5295 - protein, 9 aa, Homo Sapiens
VGIKDPQIW

SEQ ID NO: 5296 - protein, 9 aa, Homo Sapiens
SDDKVFLAF

SEQ ID NO: 5297 - protein, 9 aa, Homo Sapiens
LKNLAKKAK

SEQ ID NO: 5298 - protein, 9 aa, Homo Sapiens
PLAAHCGVR

SEQ ID NO: 5299 - protein, 9 aa, Homo Sapiens
HCAHMFTTV

SEQ ID NO: 5300 - protein, 9 aa, Homo Sapiens
GELQEHIVQ

SEQ ID NO: 5301 - protein, 9 aa, Homo Sapiens
DLVSPQYLK

SEQ ID NO: 5302 - protein, 9 aa, Homo Sapiens
KLPGFKKIN

SEQ ID NO: 5303 - protein, 9 aa, Homo Sapiens
DAQAICSLC

SEQ ID NO: 5304 - protein, 9 aa, Homo Sapiens
NHKEDADSY

SEQ ID NO: 5305 - protein, 9 aa, Homo Sapiens
PASSAITLA

SEQ ID NO: 5306 - protein, 9 aa, Homo Sapiens
DSVSSAANL

SEQ ID NO: 5307 - protein, 9 aa, Homo Sapiens
VETLLSVGA

SEQ ID NO: 5308 - protein, 9 aa, Homo Sapiens
YPRMPAYIA

SEQ ID NO: 5309 - protein, 9 aa, Homo Sapiens
EQGDRDGET

SEQ ID NO: 5310 - protein, 9 aa, Homo Sapiens
KMQKGKDLA

SEQ ID NO: 5311 - protein, 9 aa, Homo Sapiens
VGLLSETYL

SEQ ID NO: 5312 - protein, 9 aa, Homo Sapiens
LQNIEIKLV

SEQ ID NO: 5313 - protein, 9 aa, Homo Sapiens
QETWVAETL

SEQ ID NO: 5314 - protein, 9 aa, Homo Sapiens
LEQQQKLVE

SEQ ID NO: 5315 - protein, 9 aa, Homo Sapiens
KDPTEWIAT

SEQ ID NO: 5316 - protein, 9 aa, Homo Sapiens
KVIILSPEI

SEQ ID NO: 5317 - protein, 9 aa, Homo Sapiens
SSTGSYKER

SEQ ID NO: 5318 - protein, 9 aa, Homo Sapiens
SQGAKGAPC

SEQ ID NO: 5319 - protein, 9 aa, Homo Sapiens
VTVAKSSSD

SEQ ID NO: 5320 - protein, 9 aa, Homo Sapiens
GMFLVHKST

SEQ ID NO: 5321 - protein, 9 aa, Homo Sapiens
ARTFTCYSE

SEQ ID NO: 5322 - protein, 9 aa, Homo Sapiens
DYYYSMPFT

SEQ ID NO: 5323 - protein, 9 aa, Homo Sapiens
PKPLAQLPG

SEQ ID NO: 5324 - protein, 9 aa, Homo Sapiens
KRKLEQQQK

SEQ ID NO: 5325 - protein, 9 aa, Homo Sapiens
KQPEQEPQP

SEQ ID NO: 5326 - protein, 9 aa, Homo Sapiens
QEHIVQKNQ

SEQ ID NO: 5327 - protein, 9 aa, Homo Sapiens
FLPLDSSPA

SEQ ID NO: 5328 - protein, 9 aa, Homo Sapiens
QLPGRPPIF

SEQ ID NO: 5329 - protein, 9 aa, Homo Sapiens
RPEGSVCTL

SEQ ID NO: 5330 - protein, 9 aa, Homo Sapiens
SVGLLSETY

SEQ ID NO: 5331 - protein, 9 aa, Homo Sapiens
KPSSSSTSR

SEQ ID NO: 5332 - protein, 9 aa, Homo Sapiens
SQHVNHVWS

SEQ ID NO: 5333 - protein, 9 aa, Homo Sapiens
KVLIGSHND

SEQ ID NO: 5334 - protein, 9 aa, Homo Sapiens
GALSVAAFA

SEQ ID NO: 5335 - protein, 9 aa, Homo Sapiens
YSELEAEEW

SEQ ID NO: 5336 - protein, 9 aa, Homo Sapiens
QPGPNHKED

SEQ ID NO: 5337 - protein, 9 aa, Homo Sapiens
HREAQGPSF

SEQ ID NO: 5338 - protein, 9 aa, Homo Sapiens
LAMPMADGG

SEQ ID NO: 5339 - protein, 9 aa, Homo Sapiens
VHISHREAQ

SEQ ID NO: 5340 - protein, 9 aa, Homo Sapiens
KPLAQLPGR

SEQ ID NO: 5341 - protein, 9 aa, Homo Sapiens
IRLPCEEGE

SEQ ID NO: 5342 - protein, 9 aa, Homo Sapiens
ADGGEFNLR

SEQ ID NO: 5343 - protein, 9 aa, Homo Sapiens
GILEKSSKT

SEQ ID NO: 5344 - protein, 9 aa, Homo Sapiens
ELVSTECQA

SEQ ID NO: 5345 - protein, 9 aa, Homo Sapiens
ALPERVELA

SEQ ID NO: 5346 - protein, 9 aa, Homo Sapiens
YSWDCSPVS

SEQ ID NO: 5347 - protein, 9 aa, Homo Sapiens
ETEYLESSQ

SEQ ID NO: 5348 - protein, 9 aa, Homo Sapiens
LDPFQKNLY

SEQ ID NO: 5349 - protein, 9 aa, Homo Sapiens
VDSVSSAAN

SEQ ID NO: 5350 - protein, 9 aa, Homo Sapiens
ECLSAILIH

SEQ ID NO: 5351 - protein, 9 aa, Homo Sapiens
HSEISSQSS

SEQ ID NO: 5352 - protein, 9 aa, Homo Sapiens
SAILIHGVD

SEQ ID NO: 5353 - protein, 9 aa, Homo Sapiens
FWKNKDPTE

SEQ ID NO: 5354 - protein, 9 aa, Homo Sapiens
CEALSHPNC

SEQ ID NO: 5355 - protein, 9 aa, Homo Sapiens
YSQALTLVF

SEQ ID NO: 5356 - protein, 9 aa, Homo Sapiens
GMPETFNEA

SEQ ID NO: 5357 - protein, 9 aa, Homo Sapiens
PRLLFGHYS

SEQ ID NO: 5358 - protein, 9 aa, Homo Sapiens
WFVSGTTNR

SEQ ID NO: 5359 - protein, 9 aa, Homo Sapiens
YFMLNSTLC

SEQ ID NO: 5360 - protein, 9 aa, Homo Sapiens
NSKTVENCV

SEQ ID NO: 5361 - protein, 9 aa, Homo Sapiens
SLERFSTCT

SEQ ID NO: 5362 - protein, 9 aa, Homo Sapiens
QFIFVAADE

SEQ ID NO: 5363 - protein, 9 aa, Homo Sapiens
AVLKYVGDY

SEQ ID NO: 5364 - protein, 9 aa, Homo Sapiens
AGFRAARAA

SEQ ID NO: 5365 - protein, 9 aa, Homo Sapiens
QSKRFYEPQ

SEQ ID NO: 5366 - protein, 9 aa, Homo Sapiens
SVSDPPRSW

SEQ ID NO: 5367 - protein, 9 aa, Homo Sapiens
DPGLPGALG

SEQ ID NO: 5368 - protein, 9 aa, Homo Sapiens
NSCMLPRDT

SEQ ID NO: 5369 - protein, 9 aa, Homo Sapiens
DLDVTAEGD

SEQ ID NO: 5370 - protein, 9 aa, Homo Sapiens
VSLFRSYLP

SEQ ID NO: 5371 - protein, 9 aa, Homo Sapiens
LRNREVFGR

SEQ ID NO: 5372 - protein, 9 aa, Homo Sapiens
PSLNYKKET

SEQ ID NO: 5373 - protein, 9 aa, Homo Sapiens
QKIDLLMHC

SEQ ID NO: 5374 - protein, 9 aa, Homo Sapiens
SPFLTKKWC

SEQ ID NO: 5375 - protein, 9 aa, Homo Sapiens
PHHVKYKIQ

SEQ ID NO: 5376 - protein, 9 aa, Homo Sapiens
FKFRLAKST

SEQ ID NO: 5377 - protein, 9 aa, Homo Sapiens
CASAEQSEG

SEQ ID NO: 5378 - protein, 9 aa, Homo Sapiens
RGGRSARRS

SEQ ID NO: 5379 - protein, 9 aa, Homo Sapiens
LSTAVFEDS

SEQ ID NO: 5380 - protein, 9 aa, Homo Sapiens
RRRDAQSRS

SEQ ID NO: 5381 - protein, 9 aa, Homo Sapiens
EKPTDLPGP

SEQ ID NO: 5382 - protein, 9 aa, Homo Sapiens
YKIQMDIDN

SEQ ID NO: 5383 - protein, 9 aa, Homo Sapiens
PSGMYRPSF

SEQ ID NO: 5384 - protein, 9 aa, Homo Sapiens
LLPSGMYRP

SEQ ID NO: 5385 - protein, 9 aa, Homo Sapiens
GRQFSIICL

SEQ ID NO: 5386 - protein, 9 aa, Homo Sapiens
QPPLPGRDG

SEQ ID NO: 5387 - protein, 9 aa, Homo Sapiens
TQSKRFYEP

SEQ ID NO: 5388 - protein, 9 aa, Homo Sapiens
NGLIFVHSG

SEQ ID NO: 5389 - protein, 9 aa, Homo Sapiens
LSRTETAGR

SEQ ID NO: 5390 - protein, 9 aa, Homo Sapiens
QLAVTGKKT

SEQ ID NO: 5391 - protein, 9 aa, Homo Sapiens
DQVTRQLCE

SEQ ID NO: 5392 - protein, 9 aa, Homo Sapiens
CCPWRRFCA

SEQ ID NO: 5393 - protein, 9 aa, Homo Sapiens
FKLIARTGL

SEQ ID NO: 5394 - protein, 9 aa, Homo Sapiens
AADEEQWKL

SEQ ID NO: 5395 - protein, 9 aa, Homo Sapiens
ELSNSQQSL

SEQ ID NO: 5396 - protein, 9 aa, Homo Sapiens
SLVDPTLAL

SEQ ID NO: 5397 - protein, 9 aa, Homo Sapiens
ERIRTLSDG

SEQ ID NO: 5398 - protein, 9 aa, Homo Sapiens
VANGGIICI

SEQ ID NO: 5399 - protein, 9 aa, Homo Sapiens
TDMYYIGNE

SEQ ID NO: 5400 - protein, 9 aa, Homo Sapiens
DSKYRLKHL

SEQ ID NO: 5401 - protein, 9 aa, Homo Sapiens
CAPTRQGGR

SEQ ID NO: 5402 - protein, 9 aa, Homo Sapiens
PVNENDIKV

SEQ ID NO: 5403 - protein, 9 aa, Homo Sapiens
NIRYEELRN

SEQ ID NO: 5404 - protein, 9 aa, Homo Sapiens
ELSEMITGD

SEQ ID NO: 5405 - protein, 9 aa, Homo Sapiens
PGGAPRSGQ

SEQ ID NO: 5406 - protein, 9 aa, Homo Sapiens
QLLQKVKAH

SEQ ID NO: 5407 - protein, 9 aa, Homo Sapiens
EKAKRLLYS

SEQ ID NO: 5408 - protein, 9 aa, Homo Sapiens
TYVKELEEV

SEQ ID NO: 5409 - protein, 9 aa, Homo Sapiens
NNKDDTNEY

SEQ ID NO: 5410 - protein, 9 aa, Homo Sapiens
PWIPQLQYD

SEQ ID NO: 5411 - protein, 9 aa, Homo Sapiens
LQKVKAHEI

SEQ ID NO: 5412 - protein, 9 aa, Homo Sapiens
KEELTPEGI

SEQ ID NO: 5413 - protein, 9 aa, Homo Sapiens
YYFVSHHFR

SEQ ID NO: 5414 - protein, 9 aa, Homo Sapiens
ELDLVSLVP

SEQ ID NO: 5415 - protein, 9 aa, Homo Sapiens
AGHPSYPRQ

SEQ ID NO: 5416 - protein, 9 aa, Homo Sapiens
RQLCEPLVM

SEQ ID NO: 5417 - protein, 9 aa, Homo Sapiens
FRYILGRDP

SEQ ID NO: 5418 - protein, 9 aa, Homo Sapiens
YNNDTGNIS

SEQ ID NO: 5419 - protein, 9 aa, Homo Sapiens
TSPSSPGAV

SEQ ID NO: 5420 - protein, 9 aa, Homo Sapiens
LGAIPSIMK

SEQ ID NO: 5421 - protein, 9 aa, Homo Sapiens
KRMAVKPSN

SEQ ID NO: 5422 - protein, 9 aa, Homo Sapiens
EPVADSLQG

SEQ ID NO: 5423 - protein, 9 aa, Homo Sapiens
LTLIDHSCK

SEQ ID NO: 5424 - protein, 9 aa, Homo Sapiens
VNSKPQCAT

SEQ ID NO: 5425 - protein, 9 aa, Homo Sapiens
CSFRTGQRS

SEQ ID NO: 5426 - protein, 9 aa, Homo Sapiens
VQSSYNVLP

SEQ ID NO: 5427 - protein, 9 aa, Homo Sapiens
AARAAEPEA

SEQ ID NO: 5428 - protein, 9 aa, Homo Sapiens
GTGAAEKPT

SEQ ID NO: 5429 - protein, 9 aa, Homo Sapiens
KHVPVESDL

SEQ ID NO: 5430 - protein, 9 aa, Homo Sapiens
LQSREGPSR

SEQ ID NO: 5431 - protein, 9 aa, Homo Sapiens
INTKNTSNK

SEQ ID NO: 5432 - protein, 9 aa, Homo Sapiens
RGARGGRGA

SEQ ID NO: 5433 - protein, 9 aa, Homo Sapiens
ALGPQGLPG

SEQ ID NO: 5434 - protein, 9 aa, Homo Sapiens
NYCLQISEK

SEQ ID NO: 5435 - protein, 9 aa, Homo Sapiens
GQDPAGAGR

SEQ ID NO: 5436 - protein, 9 aa, Homo Sapiens
DMSWVWARF

SEQ ID NO: 5437 - protein, 9 aa, Homo Sapiens
HSGSNLKET

SEQ ID NO: 5438 - protein, 9 aa, Homo Sapiens
RRDAQSRSR

SEQ ID NO: 5439 - protein, 9 aa, Homo Sapiens
TIVDSKYRL

SEQ ID NO: 5440 - protein, 9 aa, Homo Sapiens
HLTWGLIDP

SEQ ID NO: 5441 - protein, 9 aa, Homo Sapiens
DVTETTGLE

SEQ ID NO: 5442 - protein, 9 aa, Homo Sapiens
HHMQVREEV

SEQ ID NO: 5443 - protein, 9 aa, Homo Sapiens
MYECGHGRF

SEQ ID NO: 5444 - protein, 9 aa, Homo Sapiens
RLLEPVVTQ

SEQ ID NO: 5445 - protein, 9 aa, Homo Sapiens
PRAQKAIVY

SEQ ID NO: 5446 - protein, 9 aa, Homo Sapiens
VQQVAAEYG

SEQ ID NO: 5447 - protein, 9 aa, Homo Sapiens
RCKISSTRF

SEQ ID NO: 5448 - protein, 9 aa, Homo Sapiens
NSQQSLQTL

SEQ ID NO: 5449 - protein, 9 aa, Homo Sapiens
SGPGVDAAG

SEQ ID NO: 5450 - protein, 9 aa, Homo Sapiens
LLTQAGFES

SEQ ID NO: 5451 - protein, 9 aa, Homo Sapiens
THTICDQNH

SEQ ID NO: 5452 - protein, 9 aa, Homo Sapiens
QPDVCASPE

SEQ ID NO: 5453 - protein, 9 aa, Homo Sapiens
GAGGGTGAA

SEQ ID NO: 5454 - protein, 9 aa, Homo Sapiens
YSRGAGGGT

SEQ ID NO: 5455 - protein, 9 aa, Homo Sapiens
MHHTDFKFR

SEQ ID NO: 5456 - protein, 9 aa, Homo Sapiens
SIMKVLLVC

SEQ ID NO: 5457 - protein, 9 aa, Homo Sapiens
GSVVNSCML

SEQ ID NO: 5458 - protein, 9 aa, Homo Sapiens
LTGHTDCVY

SEQ ID NO: 5459 - protein, 9 aa, Homo Sapiens
FPLEPMLCR

SEQ ID NO: 5460 - protein, 9 aa, Homo Sapiens
QINNKDDTN

SEQ ID NO: 5461 - protein, 9 aa, Homo Sapiens
ERLLEPVVT

SEQ ID NO: 5462 - protein, 9 aa, Homo Sapiens
LSVPESKLI

SEQ ID NO: 5463 - protein, 9 aa, Homo Sapiens
HASHKLFPK

SEQ ID NO: 5464 - protein, 9 aa, Homo Sapiens
PICIQISWD

SEQ ID NO: 5465 - protein, 9 aa, Homo Sapiens
DPGKGNHKT

SEQ ID NO: 5466 - protein, 9 aa, Homo Sapiens
YEPQKLTTK

SEQ ID NO: 5467 - protein, 9 aa, Homo Sapiens
HNYDYWVEA

SEQ ID NO: 5468 - protein, 9 aa, Homo Sapiens
NDVTDRRAE

SEQ ID NO: 5469 - protein, 9 aa, Homo Sapiens
WVLGFSHEE

SEQ ID NO: 5470 - protein, 9 aa, Homo Sapiens
RCPEYSRGA

SEQ ID NO: 5471 - protein, 9 aa, Homo Sapiens
NHCQNRDVR

SEQ ID NO: 5472 - protein, 9 aa, Homo Sapiens
PPATKESID

SEQ ID NO: 5473 - protein, 9 aa, Homo Sapiens
AAARRRVAG

SEQ ID NO: 5474 - protein, 9 aa, Homo Sapiens
GPVSDRLTD

SEQ ID NO: 5475 - protein, 9 aa, Homo Sapiens
LHKCRPGFG

SEQ ID NO: 5476 - protein, 9 aa, Homo Sapiens
KSRSNPVLH

SEQ ID NO: 5477 - protein, 9 aa, Homo Sapiens
SRPPNHHSS

SEQ ID NO: 5478 - protein, 9 aa, Homo Sapiens
SWVHACSPC

SEQ ID NO: 5479 - protein, 9 aa, Homo Sapiens
TAEREIARD

SEQ ID NO: 5480 - protein, 9 aa, Homo Sapiens
EERLIEKTK

SEQ ID NO: 5481 - protein, 9 aa, Homo Sapiens
GEEIPYLRK

SEQ ID NO: 5482 - protein, 9 aa, Homo Sapiens
MYYIGNETP

SEQ ID NO: 5483 - protein, 9 aa, Homo Sapiens
TGNISSKVE

SEQ ID NO: 5484 - protein, 9 aa, Homo Sapiens
GFRAARAAE

SEQ ID NO: 5485 - protein, 9 aa, Homo Sapiens
DLIQHYRPH

SEQ ID NO: 5486 - protein, 9 aa, Homo Sapiens
EHTSQATRG

SEQ ID NO: 5487 - protein, 9 aa, Homo Sapiens
TIMYECGHG

SEQ ID NO: 5488 - protein, 9 aa, Homo Sapiens
RARCPEYSR

SEQ ID NO: 5489 - protein, 9 aa, Homo Sapiens
TPLVRISRL

SEQ ID NO: 5490 - protein, 9 aa, Homo Sapiens
GSVPVGKCA

SEQ ID NO: 5491 - protein, 9 aa, Homo Sapiens
SRDFIPYHH

SEQ ID NO: 5492 - protein, 9 aa, Homo Sapiens
RTKKMVNKV

SEQ ID NO: 5493 - protein, 9 aa, Homo Sapiens
DGWDHNYDY

SEQ ID NO: 5494 - protein, 9 aa, Homo Sapiens
QQAFQDGGQ

SEQ ID NO: 5495 - protein, 9 aa, Homo Sapiens
LARHASPSV

SEQ ID NO: 5496 - protein, 9 aa, Homo Sapiens
HRCCLAHHE

SEQ ID NO: 5497 - protein, 9 aa, Homo Sapiens
KYRLKHLTE

SEQ ID NO: 5498 - protein, 9 aa, Homo Sapiens
KTEPPLVGP

SEQ ID NO: 5499 - protein, 9 aa, Homo Sapiens
NYFINKELI

SEQ ID NO: 5500 - protein, 9 aa, Homo Sapiens
RHPGGGSAV

SEQ ID NO: 5501 - protein, 9 aa, Homo Sapiens
PSSLFKHVV

SEQ ID NO: 5502 - protein, 9 aa, Homo Sapiens
FPGVQSSYN

SEQ ID NO: 5503 - protein, 9 aa, Homo Sapiens
SDKLQPSPP

SEQ ID NO: 5504 - protein, 9 aa, Homo Sapiens
RLLLAAARR

SEQ ID NO: 5505 - protein, 9 aa, Homo Sapiens
DHNYDYWVE

SEQ ID NO: 5506 - protein, 9 aa, Homo Sapiens
APSRAGVPR

SEQ ID NO: 5507 - protein, 9 aa, Homo Sapiens
IDVNGILNV

SEQ ID NO: 5508 - protein, 9 aa, Homo Sapiens
GNETPAMAR

SEQ ID NO: 5509 - protein, 9 aa, Homo Sapiens
QGLIGGVEE

SEQ ID NO: 5510 - protein, 9 aa, Homo Sapiens
LSGASRGAP

SEQ ID NO: 5511 - protein, 9 aa, Homo Sapiens
GKCALSESG

SEQ ID NO: 5512 - protein, 9 aa, Homo Sapiens
TVIYRHVED

SEQ ID NO: 5513 - protein, 9 aa, Homo Sapiens
AEKPTDLPG

SEQ ID NO: 5514 - protein, 9 aa, Homo Sapiens
QKAIVYHPS

SEQ ID NO: 5515 - protein, 9 aa, Homo Sapiens
EMITGDWLE

SEQ ID NO: 5516 - protein, 9 aa, Homo Sapiens
SVYVHNNKL

SEQ ID NO: 5517 - protein, 9 aa, Homo Sapiens
EDKYFTGLS

SEQ ID NO: 5518 - protein, 9 aa, Homo Sapiens
RLAAGAPPP

SEQ ID NO: 5519 - protein, 9 aa, Homo Sapiens
PTDLPGPRG

SEQ ID NO: 5520 - protein, 9 aa, Homo Sapiens
AGLPARPGT

SEQ ID NO: 5521 - protein, 9 aa, Homo Sapiens
LPSGMYRPS

SEQ ID NO: 5522 - protein, 9 aa, Homo Sapiens
DPRLLFGHY

SEQ ID NO: 5523 - protein, 9 aa, Homo Sapiens
RNRRWNSRE

SEQ ID NO: 5524 - protein, 9 aa, Homo Sapiens
LTQAGFESA

SEQ ID NO: 5525 - protein, 9 aa, Homo Sapiens
SWVWARFFS

SEQ ID NO: 5526 - protein, 9 aa, Homo Sapiens
VPDCNELMN

SEQ ID NO: 5527 - protein, 9 aa, Homo Sapiens
LPTPRASPT

SEQ ID NO: 5528 - protein, 9 aa, Homo Sapiens
AGAPPPPAP

SEQ ID NO: 5529 - protein, 9 aa, Homo Sapiens
FFDHASVAL

SEQ ID NO: 5530 - protein, 9 aa, Homo Sapiens
PHSGASSPA

SEQ ID NO: 5531 - protein, 9 aa, Homo Sapiens
LQHASHKLF

SEQ ID NO: 5532 - protein, 9 aa, Homo Sapiens
SPPTSACWR

SEQ ID NO: 5533 - protein, 9 aa, Homo Sapiens
LKSRAHSVE

SEQ ID NO: 5534 - protein, 9 aa, Homo Sapiens
QVIRDLVVS

SEQ ID NO: 5535 - protein, 9 aa, Homo Sapiens
VVSSLLTQA

SEQ ID NO: 5536 - protein, 9 aa, Homo Sapiens
QATIDVYDD

SEQ ID NO: 5537 - protein, 9 aa, Homo Sapiens
EREVNEDIQ

SEQ ID NO: 5538 - protein, 9 aa, Homo Sapiens
TQAGFESAE

SEQ ID NO: 5539 - protein, 9 aa, Homo Sapiens
VSSLLTQAG

SEQ ID NO: 5540 - protein, 9 aa, Homo Sapiens
TSACWRARS

SEQ ID NO: 5541 - protein, 9 aa, Homo Sapiens
ATDFKVNAQ

SEQ ID NO: 5542 - protein, 9 aa, Homo Sapiens
TRQFCTEDV

SEQ ID NO: 5543 - protein, 9 aa, Homo Sapiens
ARFFSFSGS

SEQ ID NO: 5544 - protein, 9 aa, Homo Sapiens
GPSGPQLPD

SEQ ID NO: 5545 - protein, 9 aa, Homo Sapiens
EKIGWQKDA

SEQ ID NO: 5546 - protein, 9 aa, Homo Sapiens
VHAKDNTRT

SEQ ID NO: 5547 - protein, 9 aa, Homo Sapiens
PNLRAHMRT

SEQ ID NO: 5548 - protein, 9 aa, Homo Sapiens
QNHTWLPVS

SEQ ID NO: 5549 - protein, 9 aa, Homo Sapiens
IDIRCKISS

SEQ ID NO: 5550 - protein, 9 aa, Homo Sapiens
VPRDREPYT

SEQ ID NO: 5551 - protein, 9 aa, Homo Sapiens
LARSVDFMS

SEQ ID NO: 5552 - protein, 9 aa, Homo Sapiens
LGTVTGGPQ

SEQ ID NO: 5553 - protein, 9 aa, Homo Sapiens
TESVAAPHS

SEQ ID NO: 5554 - protein, 9 aa, Homo Sapiens
KMGYMGPFP

SEQ ID NO: 5555 - protein, 9 aa, Homo Sapiens
QYDFQDKNH

SEQ ID NO: 5556 - protein, 9 aa, Homo Sapiens
TLIDHSCKE

SEQ ID NO: 5557 - protein, 9 aa, Homo Sapiens
LGSLSKYAK

SEQ ID NO: 5558 - protein, 9 aa, Homo Sapiens
RLQSREGPS

SEQ ID NO: 5559 - protein, 9 aa, Homo Sapiens
AEFIVVREL

SEQ ID NO: 5560 - protein, 9 aa, Homo Sapiens
TAGRSSQPK

SEQ ID NO: 5561 - protein, 9 aa, Homo Sapiens
EDCMPAQSI

SEQ ID NO: 5562 - protein, 9 aa, Homo Sapiens
SENVGFKLI

SEQ ID NO: 5563 - protein, 9 aa, Homo Sapiens
HQYETIMYE

SEQ ID NO: 5564 - protein, 9 aa, Homo Sapiens
FNLTEDVYS

SEQ ID NO: 5565 - protein, 9 aa, Homo Sapiens
DFQKLPTRV

SEQ ID NO: 5566 - protein, 9 aa, Homo Sapiens
LWVLGFSHE

SEQ ID NO: 5567 - protein, 9 aa, Homo Sapiens
FLQHASHKL

SEQ ID NO: 5568 - protein, 9 aa, Homo Sapiens
QLLSVPLSE

SEQ ID NO: 5569 - protein, 9 aa, Homo Sapiens
ENVGFKLIA

SEQ ID NO: 5570 - protein, 9 aa, Homo Sapiens
DGRLVSPAG

SEQ ID NO: 5571 - protein, 9 aa, Homo Sapiens
ADTTKSRKA

SEQ ID NO: 5572 - protein, 9 aa, Homo Sapiens
EEDEEELRE

SEQ ID NO: 5573 - protein, 9 aa, Homo Sapiens
HECVNVQEF

SEQ ID NO: 5574 - protein, 9 aa, Homo Sapiens
ILSEELQRN

SEQ ID NO: 5575 - protein, 9 aa, Homo Sapiens
QYETIMYEC

SEQ ID NO: 5576 - protein, 9 aa, Homo Sapiens
CLQISEKTS

SEQ ID NO: 5577 - protein, 9 aa, Homo Sapiens
SPWPVRRQG

SEQ ID NO: 5578 - protein, 9 aa, Homo Sapiens
GHYSRAYFP

SEQ ID NO: 5579 - protein, 9 aa, Homo Sapiens
LKIDLDVTA

SEQ ID NO: 5580 - protein, 9 aa, Homo Sapiens
RQCECRPGY

SEQ ID NO: 5581 - protein, 9 aa, Homo Sapiens
CNELSTSGC

SEQ ID NO: 5582 - protein, 9 aa, Homo Sapiens
SPPCWRWTV

SEQ ID NO: 5583 - protein, 9 aa, Homo Sapiens
PFPPQSPAP

SEQ ID NO: 5584 - protein, 9 aa, Homo Sapiens
VHFFDHASV

SEQ ID NO: 5585 - protein, 9 aa, Homo Sapiens
KQKYKATYV

SEQ ID NO: 5586 - protein, 9 aa, Homo Sapiens
AEYGRACRL

SEQ ID NO: 5587 - protein, 9 aa, Homo Sapiens
SLQTLSLWL

SEQ ID NO: 5588 - protein, 9 aa, Homo Sapiens
RPGAAGFPA

SEQ ID NO: 5589 - protein, 9 aa, Homo Sapiens
PDASVVALV

SEQ ID NO: 5590 - protein, 9 aa, Homo Sapiens
VVPMMRSES

SEQ ID NO: 5591 - protein, 9 aa, Homo Sapiens
GSLSKYAKD

SEQ ID NO: 5592 - protein, 9 aa, Homo Sapiens
EMTLIPIKG

SEQ ID NO: 5593 - protein, 9 aa, Homo Sapiens
KHVVPMMRS

SEQ ID NO: 5594 - protein, 9 aa, Homo Sapiens
LPSSGDYRR

SEQ ID NO: 5595 - protein, 9 aa, Homo Sapiens
KRKNIRYEE

SEQ ID NO: 5596 - protein, 9 aa, Homo Sapiens
HGESSLASS

SEQ ID NO: 5597 - protein, 9 aa, Homo Sapiens
LREEERGQK

SEQ ID NO: 5598 - protein, 9 aa, Homo Sapiens
MEEFPFPHY

SEQ ID NO: 5599 - protein, 9 aa, Homo Sapiens
RLAPSSPPV

SEQ ID NO: 5600 - protein, 9 aa, Homo Sapiens
PQSPAPPLP

SEQ ID NO: 5601 - protein, 9 aa, Homo Sapiens
GLPGALGPQ

SEQ ID NO: 5602 - protein, 9 aa, Homo Sapiens
VAQLKQRVM

SEQ ID NO: 5603 - protein, 9 aa, Homo Sapiens
EFGTSLDKE

SEQ ID NO: 5604 - protein, 9 aa, Homo Sapiens
ARTSPPCWR

SEQ ID NO: 5605 - protein, 9 aa, Homo Sapiens
LSLNRLLLA

SEQ ID NO: 5606 - protein, 9 aa, Homo Sapiens
ESEAFLLNL

SEQ ID NO: 5607 - protein, 9 aa, Homo Sapiens
DRAGLSGAS

SEQ ID NO: 5608 - protein, 9 aa, Homo Sapiens
SCRCSIEEK

SEQ ID NO: 5609 - protein, 9 aa, Homo Sapiens
LPARPDRAG

SEQ ID NO: 5610 - protein, 9 aa, Homo Sapiens
SDLIQHYRP

SEQ ID NO: 5611 - protein, 9 aa, Homo Sapiens
QPQNKIQGM

SEQ ID NO: 5612 - protein, 9 aa, Homo Sapiens
DFEDKYFTG

SEQ ID NO: 5613 - protein, 9 aa, Homo Sapiens
MWPVICLIK

SEQ ID NO: 5614 - protein, 9 aa, Homo Sapiens
YSDRNQFIF

SEQ ID NO: 5615 - protein, 9 aa, Homo Sapiens
WTRQFCTED

SEQ ID NO: 5616 - protein, 9 aa, Homo Sapiens
EMVQCVSEL

SEQ ID NO: 5617 - protein, 9 aa, Homo Sapiens
GKLSVPESK

SEQ ID NO: 5618 - protein, 9 aa, Homo Sapiens
CNTRGKFFR

SEQ ID NO: 5619 - protein, 9 aa, Homo Sapiens
GKLSMWSCK

SEQ ID NO: 5620 - protein, 9 aa, Homo Sapiens
AWSSADTTK

SEQ ID NO: 5621 - protein, 9 aa, Homo Sapiens
RELQAVKRA

SEQ ID NO: 5622 - protein, 9 aa, Homo Sapiens
HHTDFKFRL

SEQ ID NO: 5623 - protein, 9 aa, Homo Sapiens
MLNSTLCFS

SEQ ID NO: 5624 - protein, 9 aa, Homo Sapiens
PNQCADCGK

SEQ ID NO: 5625 - protein, 9 aa, Homo Sapiens
AWVAWRNHC

SEQ ID NO: 5626 - protein, 9 aa, Homo Sapiens
AEREIARDI

SEQ ID NO: 5627 - protein, 9 aa, Homo Sapiens
GFKLIARTG

SEQ ID NO: 5628 - protein, 9 aa, Homo Sapiens
WVAWRNHCQ

SEQ ID NO: 5629 - protein, 9 aa, Homo Sapiens
RSWPGGCLA

SEQ ID NO: 5630 - protein, 9 aa, Homo Sapiens
VKEECREKG

SEQ ID NO: 5631 - protein, 9 aa, Homo Sapiens
PAGAGRGAR

SEQ ID NO: 5632 - protein, 9 aa, Homo Sapiens
NLQTVNSFG

SEQ ID NO: 5633 - protein, 9 aa, Homo Sapiens
RKVDFECIL

SEQ ID NO: 5634 - protein, 9 aa, Homo Sapiens
DLRPSLSTA

SEQ ID NO: 5635 - protein, 9 aa, Homo Sapiens
KPQCATYWP

SEQ ID NO: 5636 - protein, 9 aa, Homo Sapiens
LYCALCEVA

SEQ ID NO: 5637 - protein, 9 aa, Homo Sapiens
QDGGQSKGD

SEQ ID NO: 5638 - protein, 9 aa, Homo Sapiens
AFLLNLVVN

SEQ ID NO: 5639 - protein, 9 aa, Homo Sapiens
GLIGGVEEQ

SEQ ID NO: 5640 - protein, 9 aa, Homo Sapiens
FFIHGCYLV

SEQ ID NO: 5641 - protein, 9 aa, Homo Sapiens
SGPQLPDFS

SEQ ID NO: 5642 - protein, 9 aa, Homo Sapiens
AIKHVPVES

SEQ ID NO: 5643 - protein, 9 aa, Homo Sapiens
SPNRPPRCP

SEQ ID NO: 5644 - protein, 9 aa, Homo Sapiens
WTVIYRHVE

SEQ ID NO: 5645 - protein, 9 aa, Homo Sapiens
ISLPLCTMF

SEQ ID NO: 5646 - protein, 9 aa, Homo Sapiens
AAPHSGASS

SEQ ID NO: 5647 - protein, 9 aa, Homo Sapiens
RAWVAWRNH

SEQ ID NO: 5648 - protein, 9 aa, Homo Sapiens
DCMPAQSIE

SEQ ID NO: 5649 - protein, 9 aa, Homo Sapiens
DPPRSWVHA

SEQ ID NO: 5650 - protein, 9 aa, Homo Sapiens
TPVISNIRH

SEQ ID NO: 5651 - protein, 9 aa, Homo Sapiens
TQQDIECPW

SEQ ID NO: 5652 - protein, 9 aa, Homo Sapiens
RGTLLISKI

SEQ ID NO: 5653 - protein, 9 aa, Homo Sapiens
PPQWTRQFC

SEQ ID NO: 5654 - protein, 9 aa, Homo Sapiens
CRCPPQWTR

SEQ ID NO: 5655 - protein, 9 aa, Homo Sapiens
RKGRHTLQN

SEQ ID NO: 5656 - protein, 9 aa, Homo Sapiens
TWGLIDPKR

SEQ ID NO: 5657 - protein, 9 aa, Homo Sapiens
YKATYVKEL

SEQ ID NO: 5658 - protein, 9 aa, Homo Sapiens
VLTGHTDCV

SEQ ID NO: 5659 - protein, 9 aa, Homo Sapiens
TGNYCLQIS

SEQ ID NO: 5660 - protein, 9 aa, Homo Sapiens
RKVVSPQEF

SEQ ID NO: 5661 - protein, 9 aa, Homo Sapiens
IARTGLITT

SEQ ID NO: 5662 - protein, 9 aa, Homo Sapiens
RCAGFRAAR

SEQ ID NO: 5663 - protein, 9 aa, Homo Sapiens
CYLVPKRYR

SEQ ID NO: 5664 - protein, 9 aa, Homo Sapiens
SRSRWAGHP

SEQ ID NO: 5665 - protein, 9 aa, Homo Sapiens
KSVSGTDVK

SEQ ID NO: 5666 - protein, 9 aa, Homo Sapiens
PQGAHGESS

SEQ ID NO: 5667 - protein, 9 aa, Homo Sapiens
RSNTLSPPN

SEQ ID NO: 5668 - protein, 9 aa, Homo Sapiens
AQIYIPAAS

SEQ ID NO: 5669 - protein, 9 aa, Homo Sapiens
VRPKPRRED

SEQ ID NO: 5670 - protein, 9 aa, Homo Sapiens
GVQSSYNVL

SEQ ID NO: 5671 - protein, 9 aa, Homo Sapiens
LHTGERPNQ

SEQ ID NO: 5672 - protein, 9 aa, Homo Sapiens
VSGTTNRDD

SEQ ID NO: 5673 - protein, 9 aa, Homo Sapiens
CVAWSSADT

SEQ ID NO: 5674 - protein, 9 aa, Homo Sapiens
GYMGPFPSS

SEQ ID NO: 5675 - protein, 9 aa, Homo Sapiens
FHECVNVQE

SEQ ID NO: 5676 - protein, 9 aa, Homo Sapiens
QRKRRNTIY

SEQ ID NO: 5677 - protein, 9 aa, Homo Sapiens
QLPDFSSII

SEQ ID NO: 5678 - protein, 9 aa, Homo Sapiens
LDVLITPSL

SEQ ID NO: 5679 - protein, 9 aa, Homo Sapiens
HPSYPRQPW

SEQ ID NO: 5680 - protein, 9 aa, Homo Sapiens
FVGTCLNDP

SEQ ID NO: 5681 - protein, 9 aa, Homo Sapiens
GGRLLPPFP

SEQ ID NO: 5682 - protein, 9 aa, Homo Sapiens
KSWGEESLP

SEQ ID NO: 5683 - protein, 9 aa, Homo Sapiens
SACWRARSR

SEQ ID NO: 5684 - protein, 9 aa, Homo Sapiens
LCAPLHKCR

SEQ ID NO: 5685 - protein, 9 aa, Homo Sapiens
AFRHRSNLI

SEQ ID NO: 5686 - protein, 9 aa, Homo Sapiens
LRSVYVHNN

SEQ ID NO: 5687 - protein, 9 aa, Homo Sapiens
HASVALARK

SEQ ID NO: 5688 - protein, 9 aa, Homo Sapiens
NCHCRIGWD

SEQ ID NO: 5689 - protein, 9 aa, Homo Sapiens
YECNTRGKF

SEQ ID NO: 5690 - protein, 9 aa, Homo Sapiens
QCADCGKSF

SEQ ID NO: 5691 - protein, 9 aa, Homo Sapiens
VVNSCMLPR

SEQ ID NO: 5692 - protein, 9 aa, Homo Sapiens
PFSLMRISV

SEQ ID NO: 5693 - protein, 9 aa, Homo Sapiens
ALNGEIYVT

SEQ ID NO: 5694 - protein, 9 aa, Homo Sapiens
QTVNSFGFA

SEQ ID NO: 5695 - protein, 9 aa, Homo Sapiens
GPCHSGSNL

SEQ ID NO: 5696 - protein, 9 aa, Homo Sapiens
LLLLGLLPA

SEQ ID NO: 5697 - protein, 9 aa, Homo Sapiens
CRSRDFIPY

SEQ ID NO: 5698 - protein, 9 aa, Homo Sapiens
VDVCKRVNQ

SEQ ID NO: 5699 - protein, 9 aa, Homo Sapiens
RVLQKKNTI

SEQ ID NO: 5700 - protein, 9 aa, Homo Sapiens
PLSEQPARA

SEQ ID NO: 5701 - protein, 9 aa, Homo Sapiens
TAVFEDSLP

SEQ ID NO: 5702 - protein, 9 aa, Homo Sapiens
DPTLALLTR

SEQ ID NO: 5703 - protein, 9 aa, Homo Sapiens
KFSSFLNMS

SEQ ID NO: 5704 - protein, 9 aa, Homo Sapiens
TCLNDPSQF

SEQ ID NO: 5705 - protein, 9 aa, Homo Sapiens
FAKTEGPGD

SEQ ID NO: 5706 - protein, 9 aa, Homo Sapiens
KLSMWSCKS

SEQ ID NO: 5707 - protein, 9 aa, Homo Sapiens
IYRQSKELY

SEQ ID NO: 5708 - protein, 9 aa, Homo Sapiens
LSPGSSTAS

SEQ ID NO: 5709 - protein, 9 aa, Homo Sapiens
KFLQHASHK

SEQ ID NO: 5710 - protein, 9 aa, Homo Sapiens
PSAARKWKA

SEQ ID NO: 5711 - protein, 9 aa, Homo Sapiens
ESLWVLGFS

SEQ ID NO: 5712 - protein, 9 aa, Homo Sapiens
ENVDNFLDG

SEQ ID NO: 5713 - protein, 9 aa, Homo Sapiens
VLQKKNTIC

SEQ ID NO: 5714 - protein, 9 aa, Homo Sapiens
NQFLLKFTV

SEQ ID NO: 5715 - protein, 9 aa, Homo Sapiens
CEVAVNSLS

SEQ ID NO: 5716 - protein, 9 aa, Homo Sapiens
LLLPSGMYR

SEQ ID NO: 5717 - protein, 9 aa, Homo Sapiens
KMVNKVVQY

SEQ ID NO: 5718 - protein, 9 aa, Homo Sapiens
LVSPAGQSS

SEQ ID NO: 5719 - protein, 9 aa, Homo Sapiens
IRTLSDGNS

SEQ ID NO: 5720 - protein, 9 aa, Homo Sapiens
IYQKLTFRK

SEQ ID NO: 5721 - protein, 9 aa, Homo Sapiens
LTCRPEGHP

SEQ ID NO: 5722 - protein, 9 aa, Homo Sapiens
FTDSLELDE

SEQ ID NO: 5723 - protein, 9 aa, Homo Sapiens
FKHVVPMMR

SEQ ID NO: 5724 - protein, 9 aa, Homo Sapiens
WRNHCQNRD

SEQ ID NO: 5725 - protein, 9 aa, Homo Sapiens
NQFIFVAAD

SEQ ID NO: 5726 - protein, 9 aa, Homo Sapiens
QKDALHLLV

SEQ ID NO: 5727 - protein, 9 aa, Homo Sapiens
AHSVEDFQP

SEQ ID NO: 5728 - protein, 9 aa, Homo Sapiens
YWANLPTPR

SEQ ID NO: 5729 - protein, 9 aa, Homo Sapiens
SSPGAVACA

SEQ ID NO: 5730 - protein, 9 aa, Homo Sapiens
REEVVRRDK

SEQ ID NO: 5731 - protein, 9 aa, Homo Sapiens
VTAEGDLNI

SEQ ID NO: 5732 - protein, 9 aa, Homo Sapiens
ISWDRNPEA

SEQ ID NO: 5733 - protein, 9 aa, Homo Sapiens
LPGALGPQG

SEQ ID NO: 5734 - protein, 9 aa, Homo Sapiens
GAAGFPAWG

SEQ ID NO: 5735 - protein, 9 aa, Homo Sapiens
LGLDISNLS

SEQ ID NO: 5736 - protein, 9 aa, Homo Sapiens
GLDISNLSQ

SEQ ID NO: 5737 - protein, 9 aa, Homo Sapiens
AGSQRPGAA

SEQ ID NO: 5738 - protein, 9 aa, Homo Sapiens
PAGRCVLCP

SEQ ID NO: 5739 - protein, 9 aa, Homo Sapiens
AVKGLLSHE

SEQ ID NO: 5740 - protein, 9 aa, Homo Sapiens
CKEKIGWQK

SEQ ID NO: 5741 - protein, 9 aa, Homo Sapiens
WPVICLIKR

SEQ ID NO: 5742 - protein, 9 aa, Homo Sapiens
MQVREEVVR

SEQ ID NO: 5743 - protein, 9 aa, Homo Sapiens
GRLVSPAGQ

SEQ ID NO: 5744 - protein, 9 aa, Homo Sapiens
EDEEELREE

SEQ ID NO: 5745 - protein, 9 aa, Homo Sapiens
QSPAPPLPQ

SEQ ID NO: 5746 - protein, 9 aa, Homo Sapiens
SRTQQDIEC

SEQ ID NO: 5747 - protein, 9 aa, Homo Sapiens
LIGASCCPW

SEQ ID NO: 5748 - protein, 9 aa, Homo Sapiens
LSEMITGDW

SEQ ID NO: 5749 - protein, 9 aa, Homo Sapiens
FRRSVVVPY

SEQ ID NO: 5750 - protein, 9 aa, Homo Sapiens
CRIGWDPPL

SEQ ID NO: 5751 - protein, 9 aa, Homo Sapiens
SRAGVPRLP

SEQ ID NO: 5752 - protein, 9 aa, Homo Sapiens
DGNELTGVF

SEQ ID NO: 5753 - protein, 9 aa, Homo Sapiens
WDESIAQIY

SEQ ID NO: 5754 - protein, 9 aa, Homo Sapiens
AHSIDNVCI

SEQ ID NO: 5755 - protein, 9 aa, Homo Sapiens
PQPDCSFRT

SEQ ID NO: 5756 - protein, 9 aa, Homo Sapiens
LCFRHKPPV

SEQ ID NO: 5757 - protein, 9 aa, Homo Sapiens
EGKLSVPES

SEQ ID NO: 5758 - protein, 9 aa, Homo Sapiens
PGRSFGGGR

SEQ ID NO: 5759 - protein, 9 aa, Homo Sapiens
CLGHVRLKL

SEQ ID NO: 5760 - protein, 9 aa, Homo Sapiens
YETIMYECG

SEQ ID NO: 5761 - protein, 9 aa, Homo Sapiens
IEFGTSLDK

SEQ ID NO: 5762 - protein, 9 aa, Homo Sapiens
LCEVAVNSL

SEQ ID NO: 5763 - protein, 9 aa, Homo Sapiens
SPGSSTASS

SEQ ID NO: 5764 - protein, 9 aa, Homo Sapiens
RHTLQNFCF

SEQ ID NO: 5765 - protein, 9 aa, Homo Sapiens
LQVQHLTWG

SEQ ID NO: 5766 - protein, 9 aa, Homo Sapiens
PRVLQKKNT

SEQ ID NO: 5767 - protein, 9 aa, Homo Sapiens
SPTARTSPP

SEQ ID NO: 5768 - protein, 9 aa, Homo Sapiens
GTDGNELTG

SEQ ID NO: 5769 - protein, 9 aa, Homo Sapiens
PAPSRAGVP

SEQ ID NO: 5770 - protein, 9 aa, Homo Sapiens
NTRGKFFRY

SEQ ID NO: 5771 - protein, 9 aa, Homo Sapiens
ERFSTCTSD

SEQ ID NO: 5772 - protein, 9 aa, Homo Sapiens
RAHTAAPAQ

SEQ ID NO: 5773 - protein, 9 aa, Homo Sapiens
CPPQWTRQF

SEQ ID NO: 5774 - protein, 9 aa, Homo Sapiens
AETDGPVSD

SEQ ID NO: 5775 - protein, 9 aa, Homo Sapiens
SSNMAVLQV

SEQ ID NO: 5776 - protein, 9 aa, Homo Sapiens
YFVSHHFRD

SEQ ID NO: 5777 - protein, 9 aa, Homo Sapiens
GKAFRRFSY

SEQ ID NO: 5778 - protein, 9 aa, Homo Sapiens
IPSIMKVLL

SEQ ID NO: 5779 - protein, 9 aa, Homo Sapiens
GSSNTTEAM

SEQ ID NO: 5780 - protein, 9 aa, Homo Sapiens
PLPARPDRA

SEQ ID NO: 5781 - protein, 9 aa, Homo Sapiens
NEERLIEKT

SEQ ID NO: 5782 - protein, 9 aa, Homo Sapiens
GLLYMALLA

SEQ ID NO: 5783 - protein, 9 aa, Homo Sapiens
SRENKTNIP

SEQ ID NO: 5784 - protein, 9 aa, Homo Sapiens
VLGLDISNL

SEQ ID NO: 5785 - protein, 9 aa, Homo Sapiens
FACPHLMKL

SEQ ID NO: 5786 - protein, 9 aa, Homo Sapiens
WSSADTTKS

SEQ ID NO: 5787 - protein, 9 aa, Homo Sapiens
QFVGTCLND

SEQ ID NO: 5788 - protein, 9 aa, Homo Sapiens
FDGWDHNYD

SEQ ID NO: 5789 - protein, 9 aa, Homo Sapiens
PAPAPVPAP

SEQ ID NO: 5790 - protein, 9 aa, Homo Sapiens
KLSVPESKL

SEQ ID NO: 5791 - protein, 9 aa, Homo Sapiens
GYIQQPSSQ

SEQ ID NO: 5792 - protein, 9 aa, Homo Sapiens
MENVDNFLD

SEQ ID NO: 5793 - protein, 9 aa, Homo Sapiens
VYYFVSHHF

SEQ ID NO: 5794 - protein, 9 aa, Homo Sapiens
SGQDPAGAG

SEQ ID NO: 5795 - protein, 9 aa, Homo Sapiens
SGDYRRTPP

SEQ ID NO: 5796 - protein, 9 aa, Homo Sapiens
RPGYSGRQF

SEQ ID NO: 5797 - protein, 9 aa, Homo Sapiens
QDIECPWTE

SEQ ID NO: 5798 - protein, 9 aa, Homo Sapiens
PQPQNKIQG

SEQ ID NO: 5799 - protein, 9 aa, Homo Sapiens
LYSSLCKVA

SEQ ID NO: 5800 - protein, 9 aa, Homo Sapiens
LNSTLCFSY

SEQ ID NO: 5801 - protein, 9 aa, Homo Sapiens
EFFDSLKQY

SEQ ID NO: 5802 - protein, 9 aa, Homo Sapiens
LADEDCMPA

SEQ ID NO: 5803 - protein, 9 aa, Homo Sapiens
VGKCALSES

SEQ ID NO: 5804 - protein, 9 aa, Homo Sapiens
NTTEAMSGS

SEQ ID NO: 5805 - protein, 9 aa, Homo Sapiens
LLKFTVPQY

SEQ ID NO: 5806 - protein, 9 aa, Homo Sapiens
EDVTETTGL

SEQ ID NO: 5807 - protein, 9 aa, Homo Sapiens
SADTTKSRK

SEQ ID NO: 5808 - protein, 9 aa, Homo Sapiens
TRQGGRLLP

SEQ ID NO: 5809 - protein, 9 aa, Homo Sapiens
HSVEDFQPE

SEQ ID NO: 5810 - protein, 9 aa, Homo Sapiens
NTSDYNSKT

SEQ ID NO: 5811 - protein, 9 aa, Homo Sapiens
FRRFSYLTA

SEQ ID NO: 5812 - protein, 9 aa, Homo Sapiens
HLPPPAANT

SEQ ID NO: 5813 - protein, 9 aa, Homo Sapiens
RSFGGGRLA

SEQ ID NO: 5814 - protein, 9 aa, Homo Sapiens
DGAKYAEFI

SEQ ID NO: 5815 - protein, 9 aa, Homo Sapiens
SERGVPTSV

SEQ ID NO: 5816 - protein, 9 aa, Homo Sapiens
TMGYRAQST

SEQ ID NO: 5817 - protein, 9 aa, Homo Sapiens
RKVQINNKD

SEQ ID NO: 5818 - protein, 9 aa, Homo Sapiens
RIRTLSDGN

SEQ ID NO: 5819 - protein, 9 aa, Homo Sapiens
SSSSINPGI

SEQ ID NO: 5820 - protein, 9 aa, Homo Sapiens
LIGGVEEQL

SEQ ID NO: 5821 - protein, 9 aa, Homo Sapiens
PHTAEKPYQ

SEQ ID NO: 5822 - protein, 9 aa, Homo Sapiens
DSLQGSSVL

SEQ ID NO: 5823 - protein, 9 aa, Homo Sapiens
RMAVKPSNL

SEQ ID NO: 5824 - protein, 9 aa, Homo Sapiens
PEEKPLRTL

SEQ ID NO: 5825 - protein, 9 aa, Homo Sapiens
LLTQSKRFY

SEQ ID NO: 5826 - protein, 9 aa, Homo Sapiens
GEPGWAAPE

SEQ ID NO: 5827 - protein, 9 aa, Homo Sapiens
CIVIFTFLL

SEQ ID NO: 5828 - protein, 9 aa, Homo Sapiens
GKLFHIDFR

SEQ ID NO: 5829 - protein, 9 aa, Homo Sapiens
PDVCASPEE

SEQ ID NO: 5830 - protein, 9 aa, Homo Sapiens
TQVSEPFMK

SEQ ID NO: 5831 - protein, 9 aa, Homo Sapiens
ISTEGKLSV

SEQ ID NO: 5832 - protein, 9 aa, Homo Sapiens
PRSWVHACS

SEQ ID NO: 5833 - protein, 9 aa, Homo Sapiens
PVISNIRHR

SEQ ID NO: 5834 - protein, 9 aa, Homo Sapiens
FSLMRISVF

SEQ ID NO: 5835 - protein, 9 aa, Homo Sapiens
SDMSWVWAR

SEQ ID NO: 5836 - protein, 9 aa, Homo Sapiens
RIVNSKPQC

SEQ ID NO: 5837 - protein, 9 aa, Homo Sapiens
CPWTEPYTD

SEQ ID NO: 5838 - protein, 9 aa, Homo Sapiens
VKKALLQKF

SEQ ID NO: 5839 - protein, 9 aa, Homo Sapiens
RCNQTTRQC

SEQ ID NO: 5840 - protein, 9 aa, Homo Sapiens
TGLSFRIVN

SEQ ID NO: 5841 - protein, 9 aa, Homo Sapiens
TSGCDSHSE

SEQ ID NO: 5842 - protein, 9 aa, Homo Sapiens
YAKDIFGEL

SEQ ID NO: 5843 - protein, 9 aa, Homo Sapiens
SIAQIYIPA

SEQ ID NO: 5844 - protein, 9 aa, Homo Sapiens
PFSTVSEWL

SEQ ID NO: 5845 - protein, 9 aa, Homo Sapiens
GVQEAHFNG

SEQ ID NO: 5846 - protein, 9 aa, Homo Sapiens
WRWTVIYRH

SEQ ID NO: 5847 - protein, 9 aa, Homo Sapiens
EPGWAAPER

SEQ ID NO: 5848 - protein, 9 aa, Homo Sapiens
AGRSSQPKE

SEQ ID NO: 5849 - protein, 9 aa, Homo Sapiens
ELQRNRRWN

SEQ ID NO: 5850 - protein, 9 aa, Homo Sapiens
LTFRKVVSP

SEQ ID NO: 5851 - protein, 9 aa, Homo Sapiens
TTNRDDAKY

SEQ ID NO: 5852 - protein, 9 aa, Homo Sapiens
SVLALGTLA

SEQ ID NO: 5853 - protein, 9 aa, Homo Sapiens
HYINVLSRL

SEQ ID NO: 5854 - protein, 9 aa, Homo Sapiens
KAFRRFSYL

SEQ ID NO: 5855 - protein, 9 aa, Homo Sapiens
RENKTNIPE

SEQ ID NO: 5856 - protein, 9 aa, Homo Sapiens
SCSPDGCVL

SEQ ID NO: 5857 - protein, 9 aa, Homo Sapiens
LDPELDVLI

SEQ ID NO: 5858 - protein, 9 aa, Homo Sapiens
DFMSSAHVS

SEQ ID NO: 5859 - protein, 9 aa, Homo Sapiens
WAAPEREVP

SEQ ID NO: 5860 - protein, 9 aa, Homo Sapiens
NFPIATKRM

SEQ ID NO: 5861 - protein, 9 aa, Homo Sapiens
PCNLQTVNS

SEQ ID NO: 5862 - protein, 9 aa, Homo Sapiens
IFVAADEIS

SEQ ID NO: 5863 - protein, 9 aa, Homo Sapiens
DIRCKISST

SEQ ID NO: 5864 - protein, 9 aa, Homo Sapiens
ANGGIICIV

SEQ ID NO: 5865 - protein, 9 aa, Homo Sapiens
VTPEHTSQA

SEQ ID NO: 5866 - protein, 9 aa, Homo Sapiens
PQWTRQFCT

SEQ ID NO: 5867 - protein, 9 aa, Homo Sapiens
ALSSCVPDC

SEQ ID NO: 5868 - protein, 9 aa, Homo Sapiens
SNTLSPPNS

SEQ ID NO: 5869 - protein, 9 aa, Homo Sapiens
AHRCDHCRS

SEQ ID NO: 5870 - protein, 9 aa, Homo Sapiens
VVFDEAHSI

SEQ ID NO: 5871 - protein, 9 aa, Homo Sapiens
PGPRHPGGG

SEQ ID NO: 5872 - protein, 9 aa, Homo Sapiens
FQDGGQSKG

SEQ ID NO: 5873 - protein, 9 aa, Homo Sapiens
AHFNGLIFV

SEQ ID NO: 5874 - protein, 9 aa, Homo Sapiens
GAIPSIMKV

SEQ ID NO: 5875 - protein, 9 aa, Homo Sapiens
SFACPHLMK

SEQ ID NO: 5876 - protein, 9 aa, Homo Sapiens
DCKERIRTL

SEQ ID NO: 5877 - protein, 9 aa, Homo Sapiens
SAMATEFFD

SEQ ID NO: 5878 - protein, 9 aa, Homo Sapiens
WANLPTPRA

SEQ ID NO: 5879 - protein, 9 aa, Homo Sapiens
LQTLSLWLI

SEQ ID NO: 5880 - protein, 9 aa, Homo Sapiens
SKNVAKIIQ

SEQ ID NO: 5881 - protein, 9 aa, Homo Sapiens
NSQIGIAML

SEQ ID NO: 5882 - protein, 9 aa, Homo Sapiens
SLSKYAKDI

SEQ ID NO: 5883 - protein, 9 aa, Homo Sapiens
WKSRSNPVL

SEQ ID NO: 5884 - protein, 9 aa, Homo Sapiens
ARHASPSVI

SEQ ID NO: 5885 - protein, 9 aa, Homo Sapiens
CDMCTDQLF

SEQ ID NO: 5886 - protein, 9 aa, Homo Sapiens
NISSKVELE

SEQ ID NO: 5887 - protein, 9 aa, Homo Sapiens
HLAVHQRLQ

SEQ ID NO: 5888 - protein, 9 aa, Homo Sapiens
PEHIKGQTD

SEQ ID NO: 5889 - protein, 9 aa, Homo Sapiens
RQFSIICLK

SEQ ID NO: 5890 - protein, 9 aa, Homo Sapiens
NTRTGANSP

SEQ ID NO: 5891 - protein, 9 aa, Homo Sapiens
FRAARAAEP

SEQ ID NO: 5892 - protein, 9 aa, Homo Sapiens
SFFFITTSY

SEQ ID NO: 5893 - protein, 9 aa, Homo Sapiens
KSRAHSVED

SEQ ID NO: 5894 - protein, 9 aa, Homo Sapiens
GAPPPPAPL

SEQ ID NO: 5895 - protein, 9 aa, Homo Sapiens
FSKTCSTKV

SEQ ID NO: 5896 - protein, 9 aa, Homo Sapiens
IEKTKVTYL

SEQ ID NO: 5897 - protein, 9 aa, Homo Sapiens
PVTPEHTSQ

SEQ ID NO: 5898 - protein, 9 aa, Homo Sapiens
ICHRRIHSG

SEQ ID NO: 5899 - protein, 9 aa, Homo Sapiens
QWGPRGRGC

SEQ ID NO: 5900 - protein, 9 aa, Homo Sapiens
NLICHRRIH

SEQ ID NO: 5901 - protein, 9 aa, Homo Sapiens
PGRDGRLVS

SEQ ID NO: 5902 - protein, 9 aa, Homo Sapiens
REVNEDIQP

SEQ ID NO: 5903 - protein, 9 aa, Homo Sapiens
QVAQLKQRV

SEQ ID NO: 5904 - protein, 9 aa, Homo Sapiens
WVWARFFSF

SEQ ID NO: 5905 - protein, 9 aa, Homo Sapiens
KATISDTNN

SEQ ID NO: 5906 - protein, 9 aa, Homo Sapiens
NKEAPQDVS

SEQ ID NO: 5907 - protein, 9 aa, Homo Sapiens
MRTGRPPDP

SEQ ID NO: 5908 - protein, 9 aa, Homo Sapiens
GRTTSRPPN

SEQ ID NO: 5909 - protein, 9 aa, Homo Sapiens
DAQSRSRWA

SEQ ID NO: 5910 - protein, 9 aa, Homo Sapiens
QLTEDFKQQ

SEQ ID NO: 5911 - protein, 9 aa, Homo Sapiens
DAELILKNM

SEQ ID NO: 5912 - protein, 9 aa, Homo Sapiens
LQGSSVLSL

SEQ ID NO: 5913 - protein, 9 aa, Homo Sapiens
EDCGKAFRR

SEQ ID NO: 5914 - protein, 9 aa, Homo Sapiens
KKNTICLLS

SEQ ID NO: 5915 - protein, 9 aa, Homo Sapiens
SAFSAADEE

SEQ ID NO: 5916 - protein, 9 aa, Homo Sapiens
VNENDIKVD

SEQ ID NO: 5917 - protein, 9 aa, Homo Sapiens
ACGDCDKRF

SEQ ID NO: 5918 - protein, 9 aa, Homo Sapiens
ERAAGLPAR

SEQ ID NO: 5919 - protein, 9 aa, Homo Sapiens
EPEMVFEER

SEQ ID NO: 5920 - protein, 9 aa, Homo Sapiens
MVQCVSELA

SEQ ID NO: 5921 - protein, 9 aa, Homo Sapiens
NTVVENLPR

SEQ ID NO: 5922 - protein, 9 aa, Homo Sapiens
LQNRKLLQV

SEQ ID NO: 5923 - protein, 9 aa, Homo Sapiens
IQLTEDFKQ

SEQ ID NO: 5924 - protein, 9 aa, Homo Sapiens
QVTRQLCEP

SEQ ID NO: 5925 - protein, 9 aa, Homo Sapiens
ATKRMAVKP

SEQ ID NO: 5926 - protein, 9 aa, Homo Sapiens
GVDAAGRRQ

SEQ ID NO: 5927 - protein, 9 aa, Homo Sapiens
QFSIICLKN

SEQ ID NO: 5928 - protein, 9 aa, Homo Sapiens
LGPQGLPGP

SEQ ID NO: 5929 - protein, 9 aa, Homo Sapiens
MVTHPIASQ

SEQ ID NO: 5930 - protein, 9 aa, Homo Sapiens
LINTKNTSN

SEQ ID NO: 5931 - protein, 9 aa, Homo Sapiens
TSYAYILAA

SEQ ID NO: 5932 - protein, 9 aa, Homo Sapiens
TDCKERIRT

SEQ ID NO: 5933 - protein, 9 aa, Homo Sapiens
IQISWDRNP

SEQ ID NO: 5934 - protein, 9 aa, Homo Sapiens
DGLTCRPEG

SEQ ID NO: 5935 - protein, 9 aa, Homo Sapiens
PRHPGGGSA

SEQ ID NO: 5936 - protein, 9 aa, Homo Sapiens
QETLESLWV

SEQ ID NO: 5937 - protein, 9 aa, Homo Sapiens
RAARAAEPE

SEQ ID NO: 5938 - protein, 9 aa, Homo Sapiens
LSNSQQSLQ

SEQ ID NO: 5939 - protein, 9 aa, Homo Sapiens
LRPGQKIDL

SEQ ID NO: 5940 - protein, 9 aa, Homo Sapiens
WSCKSLIEG

SEQ ID NO: 5941 - protein, 9 aa, Homo Sapiens
HNNPKKGDT

SEQ ID NO: 5942 - protein, 9 aa, Homo Sapiens
RRNTIYEFK

SEQ ID NO: 5943 - protein, 9 aa, Homo Sapiens
LKAQLKELN

SEQ ID NO: 5944 - protein, 9 aa, Homo Sapiens
CAPLHKCRP

SEQ ID NO: 5945 - protein, 9 aa, Homo Sapiens
NLTEDVYSQ

SEQ ID NO: 5946 - protein, 9 aa, Homo Sapiens
CVLCPSTTP

SEQ ID NO: 5947 - protein, 9 aa, Homo Sapiens
ARAGRRARC

SEQ ID NO: 5948 - protein, 9 aa, Homo Sapiens
FCAQRGAFF

SEQ ID NO: 5949 - protein, 9 aa, Homo Sapiens
RDPVLSCRS

SEQ ID NO: 5950 - protein, 9 aa, Homo Sapiens
CALCEVAVN

SEQ ID NO: 5951 - protein, 9 aa, Homo Sapiens
ARDIKEKLC

SEQ ID NO: 5952 - protein, 9 aa, Homo Sapiens
MAVLQVPLL

SEQ ID NO: 5953 - protein, 9 aa, Homo Sapiens
CNELMNRQA

SEQ ID NO: 5954 - protein, 9 aa, Homo Sapiens
TKKMVNKVV

SEQ ID NO: 5955 - protein, 9 aa, Homo Sapiens
MGRSLSCPP

SEQ ID NO: 5956 - protein, 9 aa, Homo Sapiens
KTCSTKVKW

SEQ ID NO: 5957 - protein, 9 aa, Homo Sapiens
SCCPWRRFC

SEQ ID NO: 5958 - protein, 9 aa, Homo Sapiens
ASVVALVSK

SEQ ID NO: 5959 - protein, 9 aa, Homo Sapiens
QEPVADSLQ

SEQ ID NO: 5960 - protein, 9 aa, Homo Sapiens
QVAAEYGRA

SEQ ID NO: 5961 - protein, 9 aa, Homo Sapiens
HVKYKIQMD

SEQ ID NO: 5962 - protein, 9 aa, Homo Sapiens
PGYNNDTGN

SEQ ID NO: 5963 - protein, 9 aa, Homo Sapiens
NNDTGNISS

SEQ ID NO: 5964 - protein, 9 aa, Homo Sapiens
RVSQQLAVT

SEQ ID NO: 5965 - protein, 9 aa, Homo Sapiens
LQPSVQSMG

SEQ ID NO: 5966 - protein, 9 aa, Homo Sapiens
EYSRGAGGG

SEQ ID NO: 5967 - protein, 9 aa, Homo Sapiens
AIPSIMKVL

SEQ ID NO: 5968 - protein, 9 aa, Homo Sapiens
AAVFDALVS

SEQ ID NO: 5969 - protein, 9 aa, Homo Sapiens
NGLPATDFK

SEQ ID NO: 5970 - protein, 9 aa, Homo Sapiens
GESSLASSQ

SEQ ID NO: 5971 - protein, 9 aa, Homo Sapiens
EEKPLRTLF

SEQ ID NO: 5972 - protein, 9 aa, Homo Sapiens
VAMGRSLSC

SEQ ID NO: 5973 - protein, 9 aa, Homo Sapiens
QRLHSGEKS

SEQ ID NO: 5974 - protein, 9 aa, Homo Sapiens
SLTSCVPLC

SEQ ID NO: 5975 - protein, 9 aa, Homo Sapiens
DLVSLVPHI

SEQ ID NO: 5976 - protein, 9 aa, Homo Sapiens
YNSKTVENC

SEQ ID NO: 5977 - protein, 9 aa, Homo Sapiens
LSGEGSCQA

SEQ ID NO: 5978 - protein, 9 aa, Homo Sapiens
CHSGSNLKE

SEQ ID NO: 5979 - protein, 9 aa, Homo Sapiens
QIVAIKHVP

SEQ ID NO: 5980 - protein, 9 aa, Homo Sapiens
DAAGRRQWG

SEQ ID NO: 5981 - protein, 9 aa, Homo Sapiens
GASPWPVRR

SEQ ID NO: 5982 - protein, 9 aa, Homo Sapiens
PIPQPQNKI

SEQ ID NO: 5983 - protein, 9 aa, Homo Sapiens
VFDEAHSID

SEQ ID NO: 5984 - protein, 9 aa, Homo Sapiens
CDHCRSRDF

SEQ ID NO: 5985 - protein, 9 aa, Homo Sapiens
PPCWRWTVI

SEQ ID NO: 5986 - protein, 9 aa, Homo Sapiens
GRTGELGPG

SEQ ID NO: 5987 - protein, 9 aa, Homo Sapiens
FPFPHYIIL

SEQ ID NO: 5988 - protein, 9 aa, Homo Sapiens
RAHSVEDFQ

SEQ ID NO: 5989 - protein, 9 aa, Homo Sapiens
EEIPYLRKE

SEQ ID NO: 5990 - protein, 9 aa, Homo Sapiens
DMCTDQLFG

SEQ ID NO: 5991 - protein, 9 aa, Homo Sapiens
HMQVREEVV

SEQ ID NO: 5992 - protein, 9 aa, Homo Sapiens
LDDFEDKYF

SEQ ID NO: 5993 - protein, 9 aa, Homo Sapiens
EGSGCYIPR

SEQ ID NO: 5994 - protein, 9 aa, Homo Sapiens
LSKYAKDIF

SEQ ID NO: 5995 - protein, 9 aa, Homo Sapiens
RQGCRSGGL

SEQ ID NO: 5996 - protein, 9 aa, Homo Sapiens
DEEELREEE

SEQ ID NO: 5997 - protein, 9 aa, Homo Sapiens
KVAIFGGTD

SEQ ID NO: 5998 - protein, 9 aa, Homo Sapiens
DKSAMATEF

SEQ ID NO: 5999 - protein, 9 aa, Homo Sapiens
DVTAEGDLN

SEQ ID NO: 6000 - protein, 9 aa, Homo Sapiens
QSLQTLSLW

SEQ ID NO: 6001 - protein, 9 aa, Homo Sapiens
PLVRISRLS

SEQ ID NO: 6002 - protein, 9 aa, Homo Sapiens
GNTQLLQKV

SEQ ID NO: 6003 - protein, 9 aa, Homo Sapiens
AVTLTLIDH

SEQ ID NO: 6004 - protein, 9 aa, Homo Sapiens
ITGDWLEAN

SEQ ID NO: 6005 - protein, 9 aa, Homo Sapiens
CGDCDKRFS

SEQ ID NO: 6006 - protein, 9 aa, Homo Sapiens
AAPAQRCAG

SEQ ID NO: 6007 - protein, 9 aa, Homo Sapiens
CIQISWDRN

SEQ ID NO: 6008 - protein, 9 aa, Homo Sapiens
SLPSSGDYR

SEQ ID NO: 6009 - protein, 9 aa, Homo Sapiens
QHQHQHQQQ

SEQ ID NO: 6010 - protein, 9 aa, Homo Sapiens
LCEPLVMQL

SEQ ID NO: 6011 - protein, 9 aa, Homo Sapiens
NMSQLLEEM

SEQ ID NO: 6012 - protein, 9 aa, Homo Sapiens
HTTTPMVTH

SEQ ID NO: 6013 - protein, 9 aa, Homo Sapiens
ASVLTPYYR

SEQ ID NO: 6014 - protein, 9 aa, Homo Sapiens
QVHLLPDFL

SEQ ID NO: 6015 - protein, 9 aa, Homo Sapiens
LLYCALCEV

SEQ ID NO: 6016 - protein, 9 aa, Homo Sapiens
GSGRGTLLI

SEQ ID NO: 6017 - protein, 9 aa, Homo Sapiens
DPAGAGRGA

SEQ ID NO: 6018 - protein, 9 aa, Homo Sapiens
SDRNQFIFV

SEQ ID NO: 6019 - protein, 9 aa, Homo Sapiens
DILDYHFHE

SEQ ID NO: 6020 - protein, 9 aa, Homo Sapiens
LSEQPARAH

SEQ ID NO: 6021 - protein, 9 aa, Homo Sapiens
TPQPDCSFR

SEQ ID NO: 6022 - protein, 9 aa, Homo Sapiens
SARRSWPGG

SEQ ID NO: 6023 - protein, 9 aa, Homo Sapiens
RTLSDGNSP

SEQ ID NO: 6024 - protein, 9 aa, Homo Sapiens
LCKNDVTDR

SEQ ID NO: 6025 - protein, 9 aa, Homo Sapiens
ANPPATKES

SEQ ID NO: 6026 - protein, 9 aa, Homo Sapiens
YRFHYINVL

SEQ ID NO: 6027 - protein, 9 aa, Homo Sapiens
WGVLLLLGL

SEQ ID NO: 6028 - protein, 9 aa, Homo Sapiens
AGRFHLLYG

SEQ ID NO: 6029 - protein, 9 aa, Homo Sapiens
HVRLKLEDV

SEQ ID NO: 6030 - protein, 9 aa, Homo Sapiens
GGRTTSRPP

SEQ ID NO: 6031 - protein, 9 aa, Homo Sapiens
VSQQLAVTG

SEQ ID NO: 6032 - protein, 9 aa, Homo Sapiens
VFRLLEGRR

SEQ ID NO: 6033 - protein, 9 aa, Homo Sapiens
CVSELAGQA

SEQ ID NO: 6034 - protein, 9 aa, Homo Sapiens
DIECPWTEP

SEQ ID NO: 6035 - protein, 9 aa, Homo Sapiens
FMKSWGEES

SEQ ID NO: 6036 - protein, 9 aa, Homo Sapiens
MLILFAWGP

SEQ ID NO: 6037 - protein, 9 aa, Homo Sapiens
LAHYQVPDA

SEQ ID NO: 6038 - protein, 9 aa, Homo Sapiens
SELAGQALQ

SEQ ID NO: 6039 - protein, 9 aa, Homo Sapiens
CPWRRFCAT

SEQ ID NO: 6040 - protein, 9 aa, Homo Sapiens
HRSNLICHR

SEQ ID NO: 6041 - protein, 9 aa, Homo Sapiens
AARGAPGRS

SEQ ID NO: 6042 - protein, 9 aa, Homo Sapiens
GQKIDLLMH

SEQ ID NO: 6043 - protein, 9 aa, Homo Sapiens
LLQVGIYNG

SEQ ID NO: 6044 - protein, 9 aa, Homo Sapiens
FQKTEPPLV

SEQ ID NO: 6045 - protein, 9 aa, Homo Sapiens
RGRSNTLSP

SEQ ID NO: 6046 - protein, 9 aa, Homo Sapiens
DLTKKVHVT

SEQ ID NO: 6047 - protein, 9 aa, Homo Sapiens
QKYKATYVK

SEQ ID NO: 6048 - protein, 9 aa, Homo Sapiens
QLCEPLVMQ

SEQ ID NO: 6049 - protein, 9 aa, Homo Sapiens
AEVHPAGRC

SEQ ID NO: 6050 - protein, 9 aa, Homo Sapiens
KAIVYHPSA

SEQ ID NO: 6051 - protein, 9 aa, Homo Sapiens
RRSWPGGCL

SEQ ID NO: 6052 - protein, 9 aa, Homo Sapiens
PGWAAPERE

SEQ ID NO: 6053 - protein, 9 aa, Homo Sapiens
AFSAADEEQ

SEQ ID NO: 6054 - protein, 9 aa, Homo Sapiens
ASPEEKPLR

SEQ ID NO: 6055 - protein, 9 aa, Homo Sapiens
KYLRAIQAN

SEQ ID NO: 6056 - protein, 9 aa, Homo Sapiens
PCWRWTVIY

SEQ ID NO: 6057 - protein, 9 aa, Homo Sapiens
MYNRVVCRE

SEQ ID NO: 6058 - protein, 9 aa, Homo Sapiens
SAGGRTTSR

SEQ ID NO: 6059 - protein, 9 aa, Homo Sapiens
NECDMCTDQ

SEQ ID NO: 6060 - protein, 9 aa, Homo Sapiens
LIEKTKVTY

SEQ ID NO: 6061 - protein, 9 aa, Homo Sapiens
GYSGRQFSI

SEQ ID NO: 6062 - protein, 9 aa, Homo Sapiens
QIQGLIGGV

SEQ ID NO: 6063 - protein, 9 aa, Homo Sapiens
PPPAPLPAR

SEQ ID NO: 6064 - protein, 9 aa, Homo Sapiens
VNQDITTLI

SEQ ID NO: 6065 - protein, 9 aa, Homo Sapiens
IRYEELRNK

SEQ ID NO: 6066 - protein, 9 aa, Homo Sapiens
HLQQAFQDG

SEQ ID NO: 6067 - protein, 9 aa, Homo Sapiens
SNLICHRRI

SEQ ID NO: 6068 - protein, 9 aa, Homo Sapiens
PAAARGAPG

SEQ ID NO: 6069 - protein, 9 aa, Homo Sapiens
AAGSQRPGA

SEQ ID NO: 6070 - protein, 9 aa, Homo Sapiens
TSRPPNHHS

SEQ ID NO: 6071 - protein, 9 aa, Homo Sapiens
DHCRSRDFI

SEQ ID NO: 6072 - protein, 9 aa, Homo Sapiens
DHSCKEKCI

SEQ ID NO: 6073 - protein, 9 aa, Homo Sapiens
VKYKIQMDI

SEQ ID NO: 6074 - protein, 9 aa, Homo Sapiens
TDAIRIYRQ

SEQ ID NO: 6075 - protein, 9 aa, Homo Sapiens
RKGNKKKPV

SEQ ID NO: 6076 - protein, 9 aa, Homo Sapiens
TKRMAVKPS

SEQ ID NO: 6077 - protein, 9 aa, Homo Sapiens
IKRTRRSIE

SEQ ID NO: 6078 - protein, 9 aa, Homo Sapiens
LREFQVIRD

SEQ ID NO: 6079 - protein, 9 aa, Homo Sapiens
TFRRSVVVP

SEQ ID NO: 6080 - protein, 9 aa, Homo Sapiens
RGAPGRSFG

SEQ ID NO: 6081 - protein, 9 aa, Homo Sapiens
TRQCECRPG

SEQ ID NO: 6082 - protein, 9 aa, Homo Sapiens
GRSNTLSPP

SEQ ID NO: 6083 - protein, 9 aa, Homo Sapiens
SFSSFPGVQ

SEQ ID NO: 6084 - protein, 9 aa, Homo Sapiens
LKNMSQLLE

SEQ ID NO: 6085 - protein, 9 aa, Homo Sapiens
IQMDIDNVE

SEQ ID NO: 6086 - protein, 9 aa, Homo Sapiens
QPDCSFRTG

SEQ ID NO: 6087 - protein, 9 aa, Homo Sapiens
ASEDSPHCD

SEQ ID NO: 6088 - protein, 9 aa, Homo Sapiens
GGAPPRVRP

SEQ ID NO: 6089 - protein, 9 aa, Homo Sapiens
FHLLYGKRD

SEQ ID NO: 6090 - protein, 9 aa, Homo Sapiens
LLNLVVNKT

SEQ ID NO: 6091 - protein, 9 aa, Homo Sapiens
TGSVPVGKC

SEQ ID NO: 6092 - protein, 9 aa, Homo Sapiens
HSCKEKCIA

SEQ ID NO: 6093 - protein, 9 aa, Homo Sapiens
TPMVTHPIA

SEQ ID NO: 6094 - protein, 9 aa, Homo Sapiens
VNGILNVSA

SEQ ID NO: 6095 - protein, 9 aa, Homo Sapiens
LEDFTDSLE

SEQ ID NO: 6096 - protein, 9 aa, Homo Sapiens
NLKIDLDVT

SEQ ID NO: 6097 - protein, 9 aa, Homo Sapiens
RHRSNLICH

SEQ ID NO: 6098 - protein, 9 aa, Homo Sapiens
AQDPKKQLE

SEQ ID NO: 6099 - protein, 9 aa, Homo Sapiens
AGRGARGGR

SEQ ID NO: 6100 - protein, 9 aa, Homo Sapiens
REPRSGPGV

SEQ ID NO: 6101 - protein, 9 aa, Homo Sapiens
AVHGNLQKH

SEQ ID NO: 6102 - protein, 9 aa, Homo Sapiens
RKRRNTIYE

SEQ ID NO: 6103 - protein, 9 aa, Homo Sapiens
IHGCYLVPK

SEQ ID NO: 6104 - protein, 9 aa, Homo Sapiens
AEPEAGPVW

SEQ ID NO: 6105 - protein, 9 aa, Homo Sapiens
KAQLKELNI

SEQ ID NO: 6106 - protein, 9 aa, Homo Sapiens
AAARGAPGR

SEQ ID NO: 6107 - protein, 9 aa, Homo Sapiens
LVSLVPHIP

SEQ ID NO: 6108 - protein, 9 aa, Homo Sapiens
IQEMVQCVS

SEQ ID NO: 6109 - protein, 9 aa, Homo Sapiens
ICLGHVRLK

SEQ ID NO: 6110 - protein, 9 aa, Homo Sapiens
RYEELRNKN

SEQ ID NO: 6111 - protein, 9 aa, Homo Sapiens
LRIPSAARK

SEQ ID NO: 6112 - protein, 9 aa, Homo Sapiens
STGQPEDVT

SEQ ID NO: 6113 - protein, 9 aa, Homo Sapiens
VSDRLTDKR

SEQ ID NO: 6114 - protein, 9 aa, Homo Sapiens
FCGNLLCSQ

SEQ ID NO: 6115 - protein, 9 aa, Homo Sapiens
LDGNRVSAF

SEQ ID NO: 6116 - protein, 9 aa, Homo Sapiens
VDPTLALLT

SEQ ID NO: 6117 - protein, 9 aa, Homo Sapiens
PNIRWSDVA

SEQ ID NO: 6118 - protein, 9 aa, Homo Sapiens
FSAADEEQW

SEQ ID NO: 6119 - protein, 9 aa, Homo Sapiens
NLLCSQHRA

SEQ ID NO: 6120 - protein, 9 aa, Homo Sapiens
LDVDFQKLP

SEQ ID NO: 6121 - protein, 9 aa, Homo Sapiens
MTLIPIKGE

SEQ ID NO: 6122 - protein, 9 aa, Homo Sapiens
TNIPEHIKG

SEQ ID NO: 6123 - protein, 9 aa, Homo Sapiens
LTYNYFINK

SEQ ID NO: 6124 - protein, 9 aa, Homo Sapiens
DQNHTWLPV

SEQ ID NO: 6125 - protein, 9 aa, Homo Sapiens
DCHKKYGKV

SEQ ID NO: 6126 - protein, 9 aa, Homo Sapiens
TPRASPTAR

SEQ ID NO: 6127 - protein, 9 aa, Homo Sapiens
AHLQQAFQD

SEQ ID NO: 6128 - protein, 9 aa, Homo Sapiens
KKEELTPEG

SEQ ID NO: 6129 - protein, 9 aa, Homo Sapiens
PIATKRMAV

SEQ ID NO: 6130 - protein, 9 aa, Homo Sapiens
ISCSPDGCV

SEQ ID NO: 6131 - protein, 9 aa, Homo Sapiens
AELILKNMF

SEQ ID NO: 6132 - protein, 9 aa, Homo Sapiens
QGLLYMALL

SEQ ID NO: 6133 - protein, 9 aa, Homo Sapiens
ARKDLVLLD

SEQ ID NO: 6134 - protein, 9 aa, Homo Sapiens
HPQLLQPSV

SEQ ID NO: 6135 - protein, 9 aa, Homo Sapiens
SSLFKHVVP

SEQ ID NO: 6136 - protein, 9 aa, Homo Sapiens
VHPQLLQPS

SEQ ID NO: 6137 - protein, 9 aa, Homo Sapiens
LLGTVTGGP

SEQ ID NO: 6138 - protein, 9 aa, Homo Sapiens
ESPKRKNIR

SEQ ID NO: 6139 - protein, 9 aa, Homo Sapiens
DKYFTGLSF

SEQ ID NO: 6140 - protein, 9 aa, Homo Sapiens
STEGKLSVP

SEQ ID NO: 6141 - protein, 9 aa, Homo Sapiens
REPYTKVRT

SEQ ID NO: 6142 - protein, 9 aa, Homo Sapiens
RLLYCALCE

SEQ ID NO: 6143 - protein, 9 aa, Homo Sapiens
YNYFINKEL

SEQ ID NO: 6144 - protein, 9 aa, Homo Sapiens
EMVFEEREV

SEQ ID NO: 6145 - protein, 9 aa, Homo Sapiens
LVSVLALGT

SEQ ID NO: 6146 - protein, 9 aa, Homo Sapiens
SSCVPDCNE

SEQ ID NO: 6147 - protein, 9 aa, Homo Sapiens
TFPTASERG

SEQ ID NO: 6148 - protein, 9 aa, Homo Sapiens
ATIDVYDDE

SEQ ID NO: 6149 - protein, 9 aa, Homo Sapiens
AQLKELNIT

SEQ ID NO: 6150 - protein, 9 aa, Homo Sapiens
TGDWLEANF

SEQ ID NO: 6151 - protein, 9 aa, Homo Sapiens
VRRQGCRSG

SEQ ID NO: 6152 - protein, 9 aa, Homo Sapiens
VDNFLDGSD

SEQ ID NO: 6153 - protein, 9 aa, Homo Sapiens
SSLCKVAVN

SEQ ID NO: 6154 - protein, 9 aa, Homo Sapiens
RSPGEPGWA

SEQ ID NO: 6155 - protein, 9 aa, Homo Sapiens
FIVVRELDR

SEQ ID NO: 6156 - protein, 9 aa, Homo Sapiens
ITIVDSKYR

SEQ ID NO: 6157 - protein, 9 aa, Homo Sapiens
GRSFGGGRL

SEQ ID NO: 6158 - protein, 9 aa, Homo Sapiens
SSTREPRSG

SEQ ID NO: 6159 - protein, 9 aa, Homo Sapiens
EMEVRVSQQ

SEQ ID NO: 6160 - protein, 9 aa, Homo Sapiens
KRVNQDITT

SEQ ID NO: 6161 - protein, 9 aa, Homo Sapiens
YNRTVSFAC

SEQ ID NO: 6162 - protein, 9 aa, Homo Sapiens
PSGPQLPDF

SEQ ID NO: 6163 - protein, 9 aa, Homo Sapiens
SRGAGGGTG

SEQ ID NO: 6164 - protein, 9 aa, Homo Sapiens
LPARPGTGQ

SEQ ID NO: 6165 - protein, 9 aa, Homo Sapiens
TETAGRSSQ

SEQ ID NO: 6166 - protein, 9 aa, Homo Sapiens
PEAGPVWGD

SEQ ID NO: 6167 - protein, 9 aa, Homo Sapiens
KKPQKPIPQ

SEQ ID NO: 6168 - protein, 9 aa, Homo Sapiens
QFLLKFTVP

SEQ ID NO: 6169 - protein, 9 aa, Homo Sapiens
SLLVAMGRS

SEQ ID NO: 6170 - protein, 9 aa, Homo Sapiens
EELLDPELD

SEQ ID NO: 6171 - protein, 9 aa, Homo Sapiens
LPQLLSVPL

SEQ ID NO: 6172 - protein, 9 aa, Homo Sapiens
RWAGHPSYP

SEQ ID NO: 6173 - protein, 9 aa, Homo Sapiens
FNEERLIEK

SEQ ID NO: 6174 - protein, 9 aa, Homo Sapiens
YLRAIQANR

SEQ ID NO: 6175 - protein, 9 aa, Homo Sapiens
EKEELINTK

SEQ ID NO: 6176 - protein, 9 aa, Homo Sapiens
LQNFCFHAA

SEQ ID NO: 6177 - protein, 9 aa, Homo Sapiens
ATGRNECDM

SEQ ID NO: 6178 - protein, 9 aa, Homo Sapiens
RIPSAARKW

SEQ ID NO: 6179 - protein, 9 aa, Homo Sapiens
VLTPYYRKV

SEQ ID NO: 6180 - protein, 9 aa, Homo Sapiens
VYSQDSIDL

SEQ ID NO: 6181 - protein, 9 aa, Homo Sapiens
EGVPFSTVS

SEQ ID NO: 6182 - protein, 9 aa, Homo Sapiens
NRTVSFACP

SEQ ID NO: 6183 - protein, 9 aa, Homo Sapiens
KFNLTEDVY

SEQ ID NO: 6184 - protein, 9 aa, Homo Sapiens
VLSSLDLTK

SEQ ID NO: 6185 - protein, 9 aa, Homo Sapiens
ASERGVPTS

SEQ ID NO: 6186 - protein, 9 aa, Homo Sapiens
DYNSKTVEN

SEQ ID NO: 6187 - protein, 9 aa, Homo Sapiens
KNDVTDRRA

SEQ ID NO: 6188 - protein, 9 aa, Homo Sapiens
QQSLQTLSL

SEQ ID NO: 6189 - protein, 9 aa, Homo Sapiens
IQANRSQLH

SEQ ID NO: 6190 - protein, 9 aa, Homo Sapiens
KGFCMFDMD

SEQ ID NO: 6191 - protein, 9 aa, Homo Sapiens
HYQVPDASV

SEQ ID NO: 6192 - protein, 9 aa, Homo Sapiens
QSREGPSRC

SEQ ID NO: 6193 - protein, 9 aa, Homo Sapiens
LKQRVMTHV

SEQ ID NO: 6194 - protein, 9 aa, Homo Sapiens
VDFMSSAHV

SEQ ID NO: 6195 - protein, 9 aa, Homo Sapiens
TTPVISNIR

SEQ ID NO: 6196 - protein, 9 aa, Homo Sapiens
QKLPTRVDD

SEQ ID NO: 6197 - protein, 9 aa, Homo Sapiens
NLRSVYVHN

SEQ ID NO: 6198 - protein, 9 aa, Homo Sapiens
MCTDQLFGA

SEQ ID NO: 6199 - protein, 9 aa, Homo Sapiens
SLQDDGLTC

SEQ ID NO: 6200 - protein, 9 aa, Homo Sapiens
IYVTGGTTL

SEQ ID NO: 6201 - protein, 9 aa, Homo Sapiens
TTYLTYNYF

SEQ ID NO: 6202 - protein, 9 aa, Homo Sapiens
LQASIDTLI

SEQ ID NO: 6203 - protein, 9 aa, Homo Sapiens
EPYTKVRTC

SEQ ID NO: 6204 - protein, 9 aa, Homo Sapiens
WPGGCLAHR

SEQ ID NO: 6205 - protein, 9 aa, Homo Sapiens
FGGTDGNEL

SEQ ID NO: 6206 - protein, 9 aa, Homo Sapiens
YYIGNETPA

SEQ ID NO: 6207 - protein, 9 aa, Homo Sapiens
ASPSVISDL

SEQ ID NO: 6208 - protein, 9 aa, Homo Sapiens
HNELMVRNG

SEQ ID NO: 6209 - protein, 9 aa, Homo Sapiens
AIKNGLPAT

SEQ ID NO: 6210 - protein, 9 aa, Homo Sapiens
INNKDDTNE

SEQ ID NO: 6211 - protein, 9 aa, Homo Sapiens
LVRISRLSS

SEQ ID NO: 6212 - protein, 9 aa, Homo Sapiens
IQQPSSQMP

SEQ ID NO: 6213 - protein, 9 aa, Homo Sapiens
VSKNVAKII

SEQ ID NO: 6214 - protein, 9 aa, Homo Sapiens
CALVLVSVL

SEQ ID NO: 6215 - protein, 9 aa, Homo Sapiens
YRKVDFECI

SEQ ID NO: 6216 - protein, 9 aa, Homo Sapiens
IICIVIFTF

SEQ ID NO: 6217 - protein, 9 aa, Homo Sapiens
IAQLRPGQK

SEQ ID NO: 6218 - protein, 9 aa, Homo Sapiens
HGCYLVPKR

SEQ ID NO: 6219 - protein, 9 aa, Homo Sapiens
DTHSLMYKL

SEQ ID NO: 6220 - protein, 9 aa, Homo Sapiens
KNNLKDLQA

SEQ ID NO: 6221 - protein, 9 aa, Homo Sapiens
MVFEEREVN

SEQ ID NO: 6222 - protein, 9 aa, Homo Sapiens
GLREAALRI

SEQ ID NO: 6223 - protein, 9 aa, Homo Sapiens
SNMAVLQVP

SEQ ID NO: 6224 - protein, 9 aa, Homo Sapiens
KRRNTIYEF

SEQ ID NO: 6225 - protein, 9 aa, Homo Sapiens
HKCRPGFGV

SEQ ID NO: 6226 - protein, 9 aa, Homo Sapiens
TLSPGSSTA

SEQ ID NO: 6227 - protein, 9 aa, Homo Sapiens
SSNTTEAMS

SEQ ID NO: 6228 - protein, 9 aa, Homo Sapiens
IKVDEVLYE

SEQ ID NO: 6229 - protein, 9 aa, Homo Sapiens
FIHGCYLVP

SEQ ID NO: 6230 - protein, 9 aa, Homo Sapiens
KYKIQMDID

SEQ ID NO: 6231 - protein, 9 aa, Homo Sapiens
SGGSVVNSC

SEQ ID NO: 6232 - protein, 9 aa, Homo Sapiens
AQCWEPQGP

SEQ ID NO: 6233 - protein, 9 aa, Homo Sapiens
VLQVPLLSG

SEQ ID NO: 6234 - protein, 9 aa, Homo Sapiens
SLSSDPGKG

SEQ ID NO: 6235 - protein, 9 aa, Homo Sapiens
SVPLSEQPA

SEQ ID NO: 6236 - protein, 9 aa, Homo Sapiens
FTGLSFRIV

SEQ ID NO: 6237 - protein, 9 aa, Homo Sapiens
WYRFHYINV

SEQ ID NO: 6238 - protein, 9 aa, Homo Sapiens
VCASPEEKP

SEQ ID NO: 6239 - protein, 9 aa, Homo Sapiens
SPSSLFKHV

SEQ ID NO: 6240 - protein, 9 aa, Homo Sapiens
HHFRDHAKN

SEQ ID NO: 6241 - protein, 9 aa, Homo Sapiens
IFGGTDGNE

SEQ ID NO: 6242 - protein, 9 aa, Homo Sapiens
LFAWGPLLF

SEQ ID NO: 6243 - protein, 9 aa, Homo Sapiens
EAFLLNLVV

SEQ ID NO: 6244 - protein, 9 aa, Homo Sapiens
SEELQRNRR

SEQ ID NO: 6245 - protein, 9 aa, Homo Sapiens
VLVSVLALG

SEQ ID NO: 6246 - protein, 9 aa, Homo Sapiens
VACAPTRQG

SEQ ID NO: 6247 - protein, 9 aa, Homo Sapiens
LLEGRRPQT

SEQ ID NO: 6248 - protein, 9 aa, Homo Sapiens
TPEGIKQFY

SEQ ID NO: 6249 - protein, 9 aa, Homo Sapiens
SLNYKKETP

SEQ ID NO: 6250 - protein, 9 aa, Homo Sapiens
ATISDTNNA

SEQ ID NO: 6251 - protein, 9 aa, Homo Sapiens
NRHAGRFHL

SEQ ID NO: 6252 - protein, 9 aa, Homo Sapiens
LSGKKSSDS

SEQ ID NO: 6253 - protein, 9 aa, Homo Sapiens
TLCFSYTHM

SEQ ID NO: 6254 - protein, 9 aa, Homo Sapiens
LHHHMQVRE

SEQ ID NO: 6255 - protein, 9 aa, Homo Sapiens
CVPDCNELM

SEQ ID NO: 6256 - protein, 9 aa, Homo Sapiens
VSFFFITTS

SEQ ID NO: 6257 - protein, 9 aa, Homo Sapiens
GCDSHSEAS

SEQ ID NO: 6258 - protein, 9 aa, Homo Sapiens
RDAQSRSRW

SEQ ID NO: 6259 - protein, 9 aa, Homo Sapiens
YTELLAQVH

SEQ ID NO: 6260 - protein, 9 aa, Homo Sapiens
DPSLNYKKE

SEQ ID NO: 6261 - protein, 9 aa, Homo Sapiens
GAHGESSLA

SEQ ID NO: 6262 - protein, 9 aa, Homo Sapiens
GSEGVPFST

SEQ ID NO: 6263 - protein, 9 aa, Homo Sapiens
VNKVVQYSL

SEQ ID NO: 6264 - protein, 9 aa, Homo Sapiens
RVKKALLQK

SEQ ID NO: 6265 - protein, 9 aa, Homo Sapiens
KAEMTLIPI

SEQ ID NO: 6266 - protein, 9 aa, Homo Sapiens
TCVNTSDYN

SEQ ID NO: 6267 - protein, 9 aa, Homo Sapiens
HFDGWDHNY

SEQ ID NO: 6268 - protein, 9 aa, Homo Sapiens
VNSCMLPRD

SEQ ID NO: 6269 - protein, 9 aa, Homo Sapiens
VGTQPPQQQ

SEQ ID NO: 6270 - protein, 9 aa, Homo Sapiens
GRSARRSWP

SEQ ID NO: 6271 - protein, 9 aa, Homo Sapiens
HAKDNTRTG

SEQ ID NO: 6272 - protein, 9 aa, Homo Sapiens
VGTCLNDPS

SEQ ID NO: 6273 - protein, 9 aa, Homo Sapiens
SDYNSKTVE

SEQ ID NO: 6274 - protein, 9 aa, Homo Sapiens
SPPNSKNEK

SEQ ID NO: 6275 - protein, 9 aa, Homo Sapiens
VEEHNELMV

SEQ ID NO: 6276 - protein, 9 aa, Homo Sapiens
NSIRIEYDT

SEQ ID NO: 6277 - protein, 9 aa, Homo Sapiens
FVPRDREPY

SEQ ID NO: 6278 - protein, 9 aa, Homo Sapiens
PRQPWRGAS

SEQ ID NO: 6279 - protein, 9 aa, Homo Sapiens
FNGLIFVHS

SEQ ID NO: 6280 - protein, 9 aa, Homo Sapiens
EQSLRELQA

SEQ ID NO: 6281 - protein, 9 aa, Homo Sapiens
LAAGAPPPP

SEQ ID NO: 6282 - protein, 9 aa, Homo Sapiens
SAVYFCAGI

SEQ ID NO: 6283 - protein, 9 aa, Homo Sapiens
QKVKAHEIA

SEQ ID NO: 6284 - protein, 9 aa, Homo Sapiens
AYSDRNQFI

SEQ ID NO: 6285 - protein, 9 aa, Homo Sapiens
CEPLVMQLI

SEQ ID NO: 6286 - protein, 9 aa, Homo Sapiens
GYNNDTGNI

SEQ ID NO: 6287 - protein, 9 aa, Homo Sapiens
RRRVAGVAR

SEQ ID NO: 6288 - protein, 9 aa, Homo Sapiens
APPLPQLLS

SEQ ID NO: 6289 - protein, 9 aa, Homo Sapiens
KDLVLLDGN

SEQ ID NO: 6290 - protein, 9 aa, Homo Sapiens
LLYMALLAL

SEQ ID NO: 6291 - protein, 9 aa, Homo Sapiens
PAPVPAPAP

SEQ ID NO: 6292 - protein, 9 aa, Homo Sapiens
QQVAAEYGR

SEQ ID NO: 6293 - protein, 9 aa, Homo Sapiens
LTQSKRFYE

SEQ ID NO: 6294 - protein, 9 aa, Homo Sapiens
CKEESIVSS

SEQ ID NO: 6295 - protein, 9 aa, Homo Sapiens
CPEYSRGAG

SEQ ID NO: 6296 - protein, 9 aa, Homo Sapiens
TTAEREIAR

SEQ ID NO: 6297 - protein, 9 aa, Homo Sapiens
QLKQRVMTH

SEQ ID NO: 6298 - protein, 9 aa, Homo Sapiens
GSDPSLNYK

SEQ ID NO: 6299 - protein, 9 aa, Homo Sapiens
SLVPHIPVI

SEQ ID NO: 6300 - protein, 9 aa, Homo Sapiens
QSRSRWAGH

SEQ ID NO: 6301 - protein, 9 aa, Homo Sapiens
IVYHPSAAL

SEQ ID NO: 6302 - protein, 9 aa, Homo Sapiens
GAAGSQRPG

SEQ ID NO: 6303 - protein, 9 aa, Homo Sapiens
ASHKLFPKA

SEQ ID NO: 6304 - protein, 9 aa, Homo Sapiens
TRGKFFRYS

SEQ ID NO: 6305 - protein, 9 aa, Homo Sapiens
TMFIIFLVG

SEQ ID NO: 6306 - protein, 9 aa, Homo Sapiens
RDLVVSVLT

SEQ ID NO: 6307 - protein, 9 aa, Homo Sapiens
QEKEELINT

SEQ ID NO: 6308 - protein, 9 aa, Homo Sapiens
PYYRKVDFE

SEQ ID NO: 6309 - protein, 9 aa, Homo Sapiens
SLGRYLEVL

SEQ ID NO: 6310 - protein, 9 aa, Homo Sapiens
LDKEIILKA

SEQ ID NO: 6311 - protein, 9 aa, Homo Sapiens
RSVYVHNNK

SEQ ID NO: 6312 - protein, 9 aa, Homo Sapiens
TNREEPLLA

SEQ ID NO: 6313 - protein, 9 aa, Homo Sapiens
GCRLCAPLH

SEQ ID NO: 6314 - protein, 9 aa, Homo Sapiens
NTKEKFSSF

SEQ ID NO: 6315 - protein, 9 aa, Homo Sapiens
PGALGPQGL

SEQ ID NO: 6316 - protein, 9 aa, Homo Sapiens
VREEVVRRD

SEQ ID NO: 6317 - protein, 9 aa, Homo Sapiens
LIQQAVHGN

SEQ ID NO: 6318 - protein, 9 aa, Homo Sapiens
PRDPVLSCR

SEQ ID NO: 6319 - protein, 9 aa, Homo Sapiens
ETKTNQFLL

SEQ ID NO: 6320 - protein, 9 aa, Homo Sapiens
FSSFLNMSD

SEQ ID NO: 6321 - protein, 9 aa, Homo Sapiens
EYSKAECDE

SEQ ID NO: 6322 - protein, 9 aa, Homo Sapiens
LDDRNTFRR

SEQ ID NO: 6323 - protein, 9 aa, Homo Sapiens
QLARHASPS

SEQ ID NO: 6324 - protein, 9 aa, Homo Sapiens
AANTVVENL

SEQ ID NO: 6325 - protein, 9 aa, Homo Sapiens
AVFDALVSE

SEQ ID NO: 6326 - protein, 9 aa, Homo Sapiens
VSEVNVDVK

SEQ ID NO: 6327 - protein, 9 aa, Homo Sapiens
HASPSVISD

SEQ ID NO: 6328 - protein, 9 aa, Homo Sapiens
VLARSVDFM

SEQ ID NO: 6329 - protein, 9 aa, Homo Sapiens
GQPRTQPPL

SEQ ID NO: 6330 - protein, 9 aa, Homo Sapiens
TPELSEMIT

SEQ ID NO: 6331 - protein, 9 aa, Homo Sapiens
KKYTNREEP

SEQ ID NO: 6332 - protein, 9 aa, Homo Sapiens
LEPVVTQVT

SEQ ID NO: 6333 - protein, 9 aa, Homo Sapiens
PPLPGRDGR

SEQ ID NO: 6334 - protein, 9 aa, Homo Sapiens
QPEDVTETT

SEQ ID NO: 6335 - protein, 9 aa, Homo Sapiens
ICFTGDLAS

SEQ ID NO: 6336 - protein, 9 aa, Homo Sapiens
AQVHLLPDF

SEQ ID NO: 6337 - protein, 9 aa, Homo Sapiens
GRCVLCPST

SEQ ID NO: 6338 - protein, 9 aa, Homo Sapiens
SELLRGGSS

SEQ ID NO: 6339 - protein, 9 aa, Homo Sapiens
RQPWRGASV

SEQ ID NO: 6340 - protein, 9 aa, Homo Sapiens
RNECDMCTD

SEQ ID NO: 6341 - protein, 9 aa, Homo Sapiens
PVVTQVTTL

SEQ ID NO: 6342 - protein, 9 aa, Homo Sapiens
HRLESVEEH

SEQ ID NO: 6343 - protein, 9 aa, Homo Sapiens
LLSHERSHL

SEQ ID NO: 6344 - protein, 9 aa, Homo Sapiens
MVLAQGLLY

SEQ ID NO: 6345 - protein, 9 aa, Homo Sapiens
GDTEPESPD

SEQ ID NO: 6346 - protein, 9 aa, Homo Sapiens
ERGVPTSVA

SEQ ID NO: 6347 - protein, 9 aa, Homo Sapiens
RGAFFGPEG

SEQ ID NO: 6348 - protein, 9 aa, Homo Sapiens
KGNKKKPVK

SEQ ID NO: 6349 - protein, 9 aa, Homo Sapiens
HDPRLLFGH

SEQ ID NO: 6350 - protein, 9 aa, Homo Sapiens
PATKESIDG

SEQ ID NO: 6351 - protein, 9 aa, Homo Sapiens
SEKKYLRAI

SEQ ID NO: 6352 - protein, 9 aa, Homo Sapiens
VTRQLCEPL

SEQ ID NO: 6353 - protein, 9 aa, Homo Sapiens
QCVAWSSAD

SEQ ID NO: 6354 - protein, 9 aa, Homo Sapiens
RSPPTSACW

SEQ ID NO: 6355 - protein, 9 aa, Homo Sapiens
RLLFGHYSR

SEQ ID NO: 6356 - protein, 9 aa, Homo Sapiens
NREEPLLAL

SEQ ID NO: 6357 - protein, 9 aa, Homo Sapiens
GLPPRDPVL

SEQ ID NO: 6358 - protein, 9 aa, Homo Sapiens
MKVLLVCLI

SEQ ID NO: 6359 - protein, 9 aa, Homo Sapiens
QRNRRWNSR

SEQ ID NO: 6360 - protein, 9 aa, Homo Sapiens
TIDVYDDES

SEQ ID NO: 6361 - protein, 9 aa, Homo Sapiens
TGDLASHKK

SEQ ID NO: 6362 - protein, 9 aa, Homo Sapiens
DVYDDESTE

SEQ ID NO: 6363 - protein, 9 aa, Homo Sapiens
QVPDASVVA

SEQ ID NO: 6364 - protein, 9 aa, Homo Sapiens
VQINNKDDT

SEQ ID NO: 6365 - protein, 9 aa, Homo Sapiens
PTSACWRAR

SEQ ID NO: 6366 - protein, 9 aa, Homo Sapiens
DSAVYFCAG

SEQ ID NO: 6367 - protein, 9 aa, Homo Sapiens
GVEEQLAQL

SEQ ID NO: 6368 - protein, 9 aa, Homo Sapiens
EEREVNEDI

SEQ ID NO: 6369 - protein, 9 aa, Homo Sapiens
VFEEREVNE

SEQ ID NO: 6370 - protein, 9 aa, Homo Sapiens
FFFITTSYA

SEQ ID NO: 6371 - protein, 9 aa, Homo Sapiens
VTTAEREIA

SEQ ID NO: 6372 - protein, 9 aa, Homo Sapiens
GRPRVLQKK

SEQ ID NO: 6373 - protein, 9 aa, Homo Sapiens
LCTMFIIFL

SEQ ID NO: 6374 - protein, 9 aa, Homo Sapiens
TTSYAYILA

SEQ ID NO: 6375 - protein, 9 aa, Homo Sapiens
IWKSRSNPV

SEQ ID NO: 6376 - protein, 9 aa, Homo Sapiens
ELLRGGSSS

SEQ ID NO: 6377 - protein, 9 aa, Homo Sapiens
LNLVVNKTI

SEQ ID NO: 6378 - protein, 9 aa, Homo Sapiens
VTLTLIDHS

SEQ ID NO: 6379 - protein, 9 aa, Homo Sapiens
VSFACPHLM

SEQ ID NO: 6380 - protein, 9 aa, Homo Sapiens
CHCRIGWDP

SEQ ID NO: 6381 - protein, 9 aa, Homo Sapiens
LTEDFKQQM

SEQ ID NO: 6382 - protein, 9 aa, Homo Sapiens
GDCLTTASD

SEQ ID NO: 6383 - protein, 9 aa, Homo Sapiens
FGRTGELGP

SEQ ID NO: 6384 - protein, 9 aa, Homo Sapiens
SKTCSTKVK

SEQ ID NO: 6385 - protein, 9 aa, Homo Sapiens
GHPSYPRQP

SEQ ID NO: 6386 - protein, 9 aa, Homo Sapiens
QDDGLTCRP

SEQ ID NO: 6387 - protein, 9 aa, Homo Sapiens
SRKGRHTLQ

SEQ ID NO: 6388 - protein, 9 aa, Homo Sapiens
PEDEQKMLT

SEQ ID NO: 6389 - protein, 9 aa, Homo Sapiens
VAAPHSGAS

SEQ ID NO: 6390 - protein, 9 aa, Homo Sapiens
VWARFFSFS

SEQ ID NO: 6391 - protein, 9 aa, Homo Sapiens
ICALVLVSV

SEQ ID NO: 6392 - protein, 9 aa, Homo Sapiens
CRPGYSGRQ

SEQ ID NO: 6393 - protein, 9 aa, Homo Sapiens
LQTVNSFGF

SEQ ID NO: 6394 - protein, 9 aa, Homo Sapiens
TGQIVAIKH

SEQ ID NO: 6395 - protein, 9 aa, Homo Sapiens
LVAMGRSLS

SEQ ID NO: 6396 - protein, 9 aa, Homo Sapiens
SSADTTKSR

SEQ ID NO: 6397 - protein, 9 aa, Homo Sapiens
WTIQLTEDF

SEQ ID NO: 6398 - protein, 9 aa, Homo Sapiens
ACPANSHSN

SEQ ID NO: 6399 - protein, 9 aa, Homo Sapiens
EVKKSIDIR

SEQ ID NO: 6400 - protein, 9 aa, Homo Sapiens
HFNGLIFVH

SEQ ID NO: 6401 - protein, 9 aa, Homo Sapiens
ILEIKTVHR

SEQ ID NO: 6402 - protein, 9 aa, Homo Sapiens
ARPDRAGLS

SEQ ID NO: 6403 - protein, 9 aa, Homo Sapiens
TIQLTEDFK

SEQ ID NO: 6404 - protein, 9 aa, Homo Sapiens
DCSFRTGQR

SEQ ID NO: 6405 - protein, 9 aa, Homo Sapiens
CRMLIMSVH

SEQ ID NO: 6406 - protein, 9 aa, Homo Sapiens
VKELEEVLK

SEQ ID NO: 6407 - protein, 9 aa, Homo Sapiens
ASIDTLIGN

SEQ ID NO: 6408 - protein, 9 aa, Homo Sapiens
ATKESIDGL

SEQ ID NO: 6409 - protein, 9 aa, Homo Sapiens
IEGSDPSLN

SEQ ID NO: 6410 - protein, 9 aa, Homo Sapiens
SDLKAQLKE

SEQ ID NO: 6411 - protein, 9 aa, Homo Sapiens
YRLKHLTEE

SEQ ID NO: 6412 - protein, 9 aa, Homo Sapiens
NKDDTNEYK

SEQ ID NO: 6413 - protein, 9 aa, Homo Sapiens
IGNETPAMA

SEQ ID NO: 6414 - protein, 9 aa, Homo Sapiens
EQPARAHTA

SEQ ID NO: 6415 - protein, 9 aa, Homo Sapiens
ECDMCTDQL

SEQ ID NO: 6416 - protein, 9 aa, Homo Sapiens
DIKVDEVLY

SEQ ID NO: 6417 - protein, 9 aa, Homo Sapiens
RSGPGVDAA

SEQ ID NO: 6418 - protein, 9 aa, Homo Sapiens
LGNPMKKNS

SEQ ID NO: 6419 - protein, 9 aa, Homo Sapiens
DVSSRLPSC

SEQ ID NO: 6420 - protein, 9 aa, Homo Sapiens
DTEPESPDS

SEQ ID NO: 6421 - protein, 9 aa, Homo Sapiens
PRSGQDPAG

SEQ ID NO: 6422 - protein, 9 aa, Homo Sapiens
RCSIEEKVT

SEQ ID NO: 6423 - protein, 9 aa, Homo Sapiens
NNRRNCHCR

SEQ ID NO: 6424 - protein, 9 aa, Homo Sapiens
SYPRQPWRG

SEQ ID NO: 6425 - protein, 9 aa, Homo Sapiens
KDSHSSSEH

SEQ ID NO: 6426 - protein, 9 aa, Homo Sapiens
YVHNNKLAD

SEQ ID NO: 6427 - protein, 9 aa, Homo Sapiens
VTDRRAEYW

SEQ ID NO: 6428 - protein, 9 aa, Homo Sapiens
ANLPTPRAS

SEQ ID NO: 6429 - protein, 9 aa, Homo Sapiens
LGHVRLKLE

SEQ ID NO: 6430 - protein, 9 aa, Homo Sapiens
FYEPQKLTT

SEQ ID NO: 6431 - protein, 9 aa, Homo Sapiens
VPHIPVISI

SEQ ID NO: 6432 - protein, 9 aa, Homo Sapiens
LRKEAINFR

SEQ ID NO: 6433 - protein, 9 aa, Homo Sapiens
LKELNITAA

SEQ ID NO: 6434 - protein, 9 aa, Homo Sapiens
VHQRLQSRE

SEQ ID NO: 6435 - protein, 9 aa, Homo Sapiens
SVPVGKCAL

SEQ ID NO: 6436 - protein, 9 aa, Homo Sapiens
NETPAMART

SEQ ID NO: 6437 - protein, 9 aa, Homo Sapiens
RKWKAFSTC

SEQ ID NO: 6438 - protein, 9 aa, Homo Sapiens
GSPFLTKKW

SEQ ID NO: 6439 - protein, 9 aa, Homo Sapiens
EDFTDSLEL

SEQ ID NO: 6440 - protein, 9 aa, Homo Sapiens
GCYIPRKPF

SEQ ID NO: 6441 - protein, 9 aa, Homo Sapiens
SVVNSCMLP

SEQ ID NO: 6442 - protein, 9 aa, Homo Sapiens
FSTCTSDKD

SEQ ID NO: 6443 - protein, 9 aa, Homo Sapiens
SQHRATYRR

SEQ ID NO: 6444 - protein, 9 aa, Homo Sapiens
EGSCQACPA

SEQ ID NO: 6445 - protein, 9 aa, Homo Sapiens
LLEPVVTQV

SEQ ID NO: 6446 - protein, 9 aa, Homo Sapiens
LLCSQHRAT

SEQ ID NO: 6447 - protein, 9 aa, Homo Sapiens
VPVNENDIK

SEQ ID NO: 6448 - protein, 9 aa, Homo Sapiens
KKWCHTLRE

SEQ ID NO: 6449 - protein, 9 aa, Homo Sapiens
HQHQHQQQQ

SEQ ID NO: 6450 - protein, 9 aa, Homo Sapiens
TSCVPLCPS

SEQ ID NO: 6451 - protein, 9 aa, Homo Sapiens
QVPVNENDI

SEQ ID NO: 6452 - protein, 9 aa, Homo Sapiens
PLCPSPEPK

SEQ ID NO: 6453 - protein, 9 aa, Homo Sapiens
LLDGNRVSA

SEQ ID NO: 6454 - protein, 9 aa, Homo Sapiens
SFGGGRLAA

SEQ ID NO: 6455 - protein, 9 aa, Homo Sapiens
PPAPLPARP

SEQ ID NO: 6456 - protein, 9 aa, Homo Sapiens
NPVLHIDLR

SEQ ID NO: 6457 - protein, 9 aa, Homo Sapiens
PGPSGPQLP

SEQ ID NO: 6458 - protein, 9 aa, Homo Sapiens
ILDYHFHEC

SEQ ID NO: 6459 - protein, 9 aa, Homo Sapiens
PARLAPSSP

SEQ ID NO: 6460 - protein, 9 aa, Homo Sapiens
VSSRLPSCE

SEQ ID NO: 6461 - protein, 9 aa, Homo Sapiens
SRQSSGFGQ

SEQ ID NO: 6462 - protein, 9 aa, Homo Sapiens
ELSTSGCDS

SEQ ID NO: 6463 - protein, 9 aa, Homo Sapiens
DLKAQLKEL

SEQ ID NO: 6464 - protein, 9 aa, Homo Sapiens
RCDHCRSRD

SEQ ID NO: 6465 - protein, 9 aa, Homo Sapiens
RTGELGPGI

SEQ ID NO: 6466 - protein, 9 aa, Homo Sapiens
VNRCNQTTR

SEQ ID NO: 6467 - protein, 9 aa, Homo Sapiens
LSSCVPDCN

SEQ ID NO: 6468 - protein, 9 aa, Homo Sapiens
DPYKMIINL

SEQ ID NO: 6469 - protein, 9 aa, Homo Sapiens
KDIFGELFT

SEQ ID NO: 6470 - protein, 9 aa, Homo Sapiens
TFPFSLMRI

SEQ ID NO: 6471 - protein, 9 aa, Homo Sapiens
DCNELMNRQ

SEQ ID NO: 6472 - protein, 9 aa, Homo Sapiens
GQEPGPRHP

SEQ ID NO: 6473 - protein, 9 aa, Homo Sapiens
ARKWKAFST

SEQ ID NO: 6474 - protein, 9 aa, Homo Sapiens
TSPPCWRWT

SEQ ID NO: 6475 - protein, 9 aa, Homo Sapiens
SEQPARAHT

SEQ ID NO: 6476 - protein, 9 aa, Homo Sapiens
SNPVLHIDL

SEQ ID NO: 6477 - protein, 9 aa, Homo Sapiens
SSLDLTKKV

SEQ ID NO: 6478 - protein, 9 aa, Homo Sapiens
FSTVSEWLE

SEQ ID NO: 6479 - protein, 9 aa, Homo Sapiens
IGASCCPWR

SEQ ID NO: 6480 - protein, 9 aa, Homo Sapiens
YMGPFPSSL

SEQ ID NO: 6481 - protein, 9 aa, Homo Sapiens
FAETDGPVS

SEQ ID NO: 6482 - protein, 9 aa, Homo Sapiens
NAQLHLSGK

SEQ ID NO: 6483 - protein, 9 aa, Homo Sapiens
VTGGPQHWH

SEQ ID NO: 6484 - protein, 9 aa, Homo Sapiens
FEDKYFTGL

SEQ ID NO: 6485 - protein, 9 aa, Homo Sapiens
MSGSGVRGE

SEQ ID NO: 6486 - protein, 9 aa, Homo Sapiens
GIICIVIFT

SEQ ID NO: 6487 - protein, 9 aa, Homo Sapiens
PSSQMPACY

SEQ ID NO: 6488 - protein, 9 aa, Homo Sapiens
PLMLSVLTG

SEQ ID NO: 6489 - protein, 9 aa, Homo Sapiens
TRTGANSPE

SEQ ID NO: 6490 - protein, 9 aa, Homo Sapiens
HFHECVNVQ

SEQ ID NO: 6491 - protein, 9 aa, Homo Sapiens
MDCHKKYGK

SEQ ID NO: 6492 - protein, 9 aa, Homo Sapiens
TNNALQKNS

SEQ ID NO: 6493 - protein, 9 aa, Homo Sapiens
AQSRSRWAG

SEQ ID NO: 6494 - protein, 9 aa, Homo Sapiens
KTEGPGDVK

SEQ ID NO: 6495 - protein, 9 aa, Homo Sapiens
QDVSSRLPS

SEQ ID NO: 6496 - protein, 9 aa, Homo Sapiens
HLLPDFLSE

SEQ ID NO: 6497 - protein, 9 aa, Homo Sapiens
HYIILRDVN

SEQ ID NO: 6498 - protein, 9 aa, Homo Sapiens
CLIKRTRRS

SEQ ID NO: 6499 - protein, 9 aa, Homo Sapiens
LSSLDLTKK

SEQ ID NO: 6500 - protein, 9 aa, Homo Sapiens
ICLIKRTRR

SEQ ID NO: 6501 - protein, 9 aa, Homo Sapiens
LRAIQANRS

SEQ ID NO: 6502 - protein, 9 aa, Homo Sapiens
GLSRTETAG

SEQ ID NO: 6503 - protein, 9 aa, Homo Sapiens
VFCGNLLCS

SEQ ID NO: 6504 - protein, 9 aa, Homo Sapiens
PVGKCALSE

SEQ ID NO: 6505 - protein, 9 aa, Homo Sapiens
LDLVSLVPH

SEQ ID NO: 6506 - protein, 9 aa, Homo Sapiens
FPPQSPAPP

SEQ ID NO: 6507 - protein, 9 aa, Homo Sapiens
PQLPDFSSI

SEQ ID NO: 6508 - protein, 9 aa, Homo Sapiens
PKRKNIRYE

SEQ ID NO: 6509 - protein, 9 aa, Homo Sapiens
SSSEHFLEQ

SEQ ID NO: 6510 - protein, 9 aa, Homo Sapiens
SKPQCATYW

SEQ ID NO: 6511 - protein, 9 aa, Homo Sapiens
CAGFRAARA

SEQ ID NO: 6512 - protein, 9 aa, Homo Sapiens
ADEDCMPAQ

SEQ ID NO: 6513 - protein, 9 aa, Homo Sapiens
RNTIYEFKK

SEQ ID NO: 6514 - protein, 9 aa, Homo Sapiens
LEEMLLKQR

SEQ ID NO: 6515 - protein, 9 aa, Homo Sapiens
NVDVKDFLM

SEQ ID NO: 6516 - protein, 9 aa, Homo Sapiens
RDGSGQILE

SEQ ID NO: 6517 - protein, 9 aa, Homo Sapiens
QPARAHTAA

SEQ ID NO: 6518 - protein, 9 aa, Homo Sapiens
LAQVHLLPD

SEQ ID NO: 6519 - protein, 9 aa, Homo Sapiens
HKLFPKAIH

SEQ ID NO: 6520 - protein, 9 aa, Homo Sapiens
GPLLFYIGG

SEQ ID NO: 6521 - protein, 9 aa, Homo Sapiens
VQEAHFNGL

SEQ ID NO: 6522 - protein, 9 aa, Homo Sapiens
AGGRTTSRP

SEQ ID NO: 6523 - protein, 9 aa, Homo Sapiens
ECDKAFRLR

SEQ ID NO: 6524 - protein, 9 aa, Homo Sapiens
NSLGRYLEV

SEQ ID NO: 6525 - protein, 9 aa, Homo Sapiens
RAGVPRLPE

SEQ ID NO: 6526 - protein, 9 aa, Homo Sapiens
ARQMHHTDF

SEQ ID NO: 6527 - protein, 9 aa, Homo Sapiens
ESSPCNLQT

SEQ ID NO: 6528 - protein, 9 aa, Homo Sapiens
TQLLQKVKA

SEQ ID NO: 6529 - protein, 9 aa, Homo Sapiens
FTDAIRIYR

SEQ ID NO: 6530 - protein, 9 aa, Homo Sapiens
GGAPRSGQD

SEQ ID NO: 6531 - protein, 9 aa, Homo Sapiens
ENKTNIPEH

SEQ ID NO: 6532 - protein, 9 aa, Homo Sapiens
DIDVNGILN

SEQ ID NO: 6533 - protein, 9 aa, Homo Sapiens
VIRDLVVSV

SEQ ID NO: 6534 - protein, 9 aa, Homo Sapiens
AGRRARCPE

SEQ ID NO: 6535 - protein, 9 aa, Homo Sapiens
NSKPQCATY

SEQ ID NO: 6536 - protein, 9 aa, Homo Sapiens
FHIDFRYIL

SEQ ID NO: 6537 - protein, 9 aa, Homo Sapiens
IQHYRPHTA

SEQ ID NO: 6538 - protein, 9 aa, Homo Sapiens
ASGGSVVNS

SEQ ID NO: 6539 - protein, 9 aa, Homo Sapiens
ALKSRAHSV

SEQ ID NO: 6540 - protein, 9 aa, Homo Sapiens
SQQSLQTLS

SEQ ID NO: 6541 - protein, 9 aa, Homo Sapiens
LHVGLPPRD

SEQ ID NO: 6542 - protein, 9 aa, Homo Sapiens
TSLLVAMGR

SEQ ID NO: 6543 - protein, 9 aa, Homo Sapiens
KPNLRSVYV

SEQ ID NO: 6544 - protein, 9 aa, Homo Sapiens
QSVFCGNLL

SEQ ID NO: 6545 - protein, 9 aa, Homo Sapiens
LLDVLGLDI

SEQ ID NO: 6546 - protein, 9 aa, Homo Sapiens
YDSAFSAAD

SEQ ID NO: 6547 - protein, 9 aa, Homo Sapiens
QACPANSHS

SEQ ID NO: 6548 - protein, 9 aa, Homo Sapiens
SCVPDCNEL

SEQ ID NO: 6549 - protein, 9 aa, Homo Sapiens
VDQVTRQLC

SEQ ID NO: 6550 - protein, 9 aa, Homo Sapiens
DNFLDGSDV

SEQ ID NO: 6551 - protein, 9 aa, Homo Sapiens
GDPGLPGAL

SEQ ID NO: 6552 - protein, 9 aa, Homo Sapiens
PVICLIKRT

SEQ ID NO: 6553 - protein, 9 aa, Homo Sapiens
DMDCHKKYG

SEQ ID NO: 6554 - protein, 9 aa, Homo Sapiens
EKSFKCVEC

SEQ ID NO: 6555 - protein, 9 aa, Homo Sapiens
TLSDGNSPW

SEQ ID NO: 6556 - protein, 9 aa, Homo Sapiens
GAAEKPTDL

SEQ ID NO: 6557 - protein, 9 aa, Homo Sapiens
QRVMTHVSN

SEQ ID NO: 6558 - protein, 9 aa, Homo Sapiens
TTLSPGSST

SEQ ID NO: 6559 - protein, 9 aa, Homo Sapiens
GAGRGARGG

SEQ ID NO: 6560 - protein, 9 aa, Homo Sapiens
NMAVLQVPL

SEQ ID NO: 6561 - protein, 9 aa, Homo Sapiens
SFPGVQSSY

SEQ ID NO: 6562 - protein, 9 aa, Homo Sapiens
HPIASQSMR

SEQ ID NO: 6563 - protein, 9 aa, Homo Sapiens
LQKKNTICL

SEQ ID NO: 6564 - protein, 9 aa, Homo Sapiens
GVARAGRRA

SEQ ID NO: 6565 - protein, 9 aa, Homo Sapiens
TKTNQFLLK

SEQ ID NO: 6566 - protein, 9 aa, Homo Sapiens
IVNSKPQCA

SEQ ID NO: 6567 - protein, 9 aa, Homo Sapiens
GGEVPVGTQ

SEQ ID NO: 6568 - protein, 9 aa, Homo Sapiens
MGPFPSSLC

SEQ ID NO: 6569 - protein, 9 aa, Homo Sapiens
RQFCTEDVD

SEQ ID NO: 6570 - protein, 9 aa, Homo Sapiens
TRQLCEPLV

SEQ ID NO: 6571 - protein, 9 aa, Homo Sapiens
VFDALVSEA

SEQ ID NO: 6572 - protein, 9 aa, Homo Sapiens
EELQRNRRW

SEQ ID NO: 6573 - protein, 9 aa, Homo Sapiens
AKYAEFIVV

SEQ ID NO: 6574 - protein, 9 aa, Homo Sapiens
HCQNRDVRQ

SEQ ID NO: 6575 - protein, 9 aa, Homo Sapiens
MFIIFLVGN

SEQ ID NO: 6576 - protein, 9 aa, Homo Sapiens
HFAETDGPV

SEQ ID NO: 6577 - protein, 9 aa, Homo Sapiens
IQGLIGGVE

SEQ ID NO: 6578 - protein, 9 aa, Homo Sapiens
PLPQLLSVP

SEQ ID NO: 6579 - protein, 9 aa, Homo Sapiens
SGRGTLLIS

SEQ ID NO: 6580 - protein, 9 aa, Homo Sapiens
ARGGRGAAG

SEQ ID NO: 6581 - protein, 9 aa, Homo Sapiens
PQKPIPQPQ

SEQ ID NO: 6582 - protein, 9 aa, Homo Sapiens
WPVRRQGCR

SEQ ID NO: 6583 - protein, 9 aa, Homo Sapiens
LFNEERLIE

SEQ ID NO: 6584 - protein, 9 aa, Homo Sapiens
PPNSKNEKA

SEQ ID NO: 6585 - protein, 9 aa, Homo Sapiens
RCVLCPSTT

SEQ ID NO: 6586 - protein, 9 aa, Homo Sapiens
VPVGTQPPQ

SEQ ID NO: 6587 - protein, 9 aa, Homo Sapiens
LSEELQRNR

SEQ ID NO: 6588 - protein, 9 aa, Homo Sapiens
VSEAESGRQ

SEQ ID NO: 6589 - protein, 9 aa, Homo Sapiens
SPGAVACAP

SEQ ID NO: 6590 - protein, 9 aa, Homo Sapiens
AVHQRLQSR

SEQ ID NO: 6591 - protein, 9 aa, Homo Sapiens
TDRRAEYWV

SEQ ID NO: 6592 - protein, 9 aa, Homo Sapiens
PARPGTGQP

SEQ ID NO: 6593 - protein, 9 aa, Homo Sapiens
YIGNETPAM

SEQ ID NO: 6594 - protein, 9 aa, Homo Sapiens
YTNREEPLL

SEQ ID NO: 6595 - protein, 9 aa, Homo Sapiens
KPTDLPGPR

SEQ ID NO: 6596 - protein, 9 aa, Homo Sapiens
FPTASERGV

SEQ ID NO: 6597 - protein, 9 aa, Homo Sapiens
YDTHSLMYK

SEQ ID NO: 6598 - protein, 9 aa, Homo Sapiens
QPRTQPPLP

SEQ ID NO: 6599 - protein, 9 aa, Homo Sapiens
SPAPPLPQL

SEQ ID NO: 6600 - protein, 9 aa, Homo Sapiens
VICLIKRTR

SEQ ID NO: 6601 - protein, 9 aa, Homo Sapiens
EELINTKNT

SEQ ID NO: 6602 - protein, 9 aa, Homo Sapiens
EFIVVRELD

SEQ ID NO: 6603 - protein, 9 aa, Homo Sapiens
FDIDVNGIL

SEQ ID NO: 6604 - protein, 9 aa, Homo Sapiens
DSHSSSEHF

SEQ ID NO: 6605 - protein, 9 aa, Homo Sapiens
TSLDKEIIL

SEQ ID NO: 6606 - protein, 9 aa, Homo Sapiens
YKMIINLAL

SEQ ID NO: 6607 - protein, 9 aa, Homo Sapiens
PFPHYIILR

SEQ ID NO: 6608 - protein, 9 aa, Homo Sapiens
CQPLFMVLL

SEQ ID NO: 6609 - protein, 9 aa, Homo Sapiens
QQAVHGNLQ

SEQ ID NO: 6610 - protein, 9 aa, Homo Sapiens
KEGSPFLTK

SEQ ID NO: 6611 - protein, 9 aa, Homo Sapiens
LSPPNSKNE

SEQ ID NO: 6612 - protein, 9 aa, Homo Sapiens
PQDVSSRLP

SEQ ID NO: 6613 - protein, 9 aa, Homo Sapiens
QNRKLLQVG

SEQ ID NO: 6614 - protein, 9 aa, Homo Sapiens
DISNLSQYF

SEQ ID NO: 6615 - protein, 9 aa, Homo Sapiens
SGEGSCQAC

SEQ ID NO: 6616 - protein, 9 aa, Homo Sapiens
PFLTKKWCH

SEQ ID NO: 6617 - protein, 9 aa, Homo Sapiens
VSELAGQAL

SEQ ID NO: 6618 - protein, 9 aa, Homo Sapiens
STFAKTEGP

SEQ ID NO: 6619 - protein, 9 aa, Homo Sapiens
YLRKEAINF

SEQ ID NO: 6620 - protein, 9 aa, Homo Sapiens
RKLLQVGIY

SEQ ID NO: 6621 - protein, 9 aa, Homo Sapiens
CSSPNRPPR

SEQ ID NO: 6622 - protein, 9 aa, Homo Sapiens
KIIQLYSVK

SEQ ID NO: 6623 - protein, 9 aa, Homo Sapiens
SWPGGCLAH

SEQ ID NO: 6624 - protein, 9 aa, Homo Sapiens
CMPAQSIET

SEQ ID NO: 6625 - protein, 9 aa, Homo Sapiens
VAWRNHCQN

SEQ ID NO: 6626 - protein, 9 aa, Homo Sapiens
SIDNVCIDS

SEQ ID NO: 6627 - protein, 9 aa, Homo Sapiens
QAGFESAEK

SEQ ID NO: 6628 - protein, 9 aa, Homo Sapiens
NPMKKNSQI

SEQ ID NO: 6629 - protein, 9 aa, Homo Sapiens
GCYLVPKRY

SEQ ID NO: 6630 - protein, 9 aa, Homo Sapiens
AGGGTGAAE

SEQ ID NO: 6631 - protein, 9 aa, Homo Sapiens
LIPIKGEFS

SEQ ID NO: 6632 - protein, 9 aa, Homo Sapiens
RQMHHTDFK

SEQ ID NO: 6633 - protein, 9 aa, Homo Sapiens
NPPGAPPAR

SEQ ID NO: 6634 - protein, 9 aa, Homo Sapiens
VDESEAFLL

SEQ ID NO: 6635 - protein, 9 aa, Homo Sapiens
GVPFSTVSE

SEQ ID NO: 6636 - protein, 9 aa, Homo Sapiens
GKGNHKTPS

SEQ ID NO: 6637 - protein, 9 aa, Homo Sapiens
FWDESIAQI

SEQ ID NO: 6638 - protein, 9 aa, Homo Sapiens
KGRHTLQNF

SEQ ID NO: 6639 - protein, 9 aa, Homo Sapiens
FFITTSYAY

SEQ ID NO: 6640 - protein, 9 aa, Homo Sapiens
HPAGRCVLC

SEQ ID NO: 6641 - protein, 9 aa, Homo Sapiens
CISCSPDGC

SEQ ID NO: 6642 - protein, 9 aa, Homo Sapiens
STCTSDKDE

SEQ ID NO: 6643 - protein, 9 aa, Homo Sapiens
NQTTRQCEC

SEQ ID NO: 6644 - protein, 9 aa, Homo Sapiens
QGYIQQPSS

SEQ ID NO: 6645 - protein, 9 aa, Homo Sapiens
FLLNLVVNK

SEQ ID NO: 6646 - protein, 9 aa, Homo Sapiens
SDTNNALQK

SEQ ID NO: 6647 - protein, 9 aa, Homo Sapiens
PELDVLITP

SEQ ID NO: 6648 - protein, 9 aa, Homo Sapiens
LPGPRGGRS

SEQ ID NO: 6649 - protein, 9 aa, Homo Sapiens
IECPWTEPY

SEQ ID NO: 6650 - protein, 9 aa, Homo Sapiens
GASRGAPGG

SEQ ID NO: 6651 - protein, 9 aa, Homo Sapiens
VVCKEESIV

SEQ ID NO: 6652 - protein, 9 aa, Homo Sapiens
SSPNRPPRC

SEQ ID NO: 6653 - protein, 9 aa, Homo Sapiens
DTNNALQKN

SEQ ID NO: 6654 - protein, 9 aa, Homo Sapiens
EPLLALLNK

SEQ ID NO: 6655 - protein, 9 aa, Homo Sapiens
QHLTWGLID

SEQ ID NO: 6656 - protein, 9 aa, Homo Sapiens
PAGQSSTRE

SEQ ID NO: 6657 - protein, 9 aa, Homo Sapiens
NLRAHMRTG

SEQ ID NO: 6658 - protein, 9 aa, Homo Sapiens
GTDVKEECR

SEQ ID NO: 6659 - protein, 9 aa, Homo Sapiens
ESIAQIYIP

SEQ ID NO: 6660 - protein, 9 aa, Homo Sapiens
ASDKLQPSP

SEQ ID NO: 6661 - protein, 9 aa, Homo Sapiens
RKDLVLLDG

SEQ ID NO: 6662 - protein, 9 aa, Homo Sapiens
TTTYLTYNY

SEQ ID NO: 6663 - protein, 9 aa, Homo Sapiens
HLSGKKSSD

SEQ ID NO: 6664 - protein, 9 aa, Homo Sapiens
PVGTQPPQQ

SEQ ID NO: 6665 - protein, 9 aa, Homo Sapiens
VIQFVGTCL

SEQ ID NO: 6666 - protein, 9 aa, Homo Sapiens
HRCDHCRSR

SEQ ID NO: 6667 - protein, 9 aa, Homo Sapiens
MLCRMLIMS

SEQ ID NO: 6668 - protein, 9 aa, Homo Sapiens
RRAEYWVER

SEQ ID NO: 6669 - protein, 9 aa, Homo Sapiens
APLPARPDR

SEQ ID NO: 6670 - protein, 9 aa, Homo Sapiens
NTLSPPNSK

SEQ ID NO: 6671 - protein, 9 aa, Homo Sapiens
TGSGRGTLL

SEQ ID NO: 6672 - protein, 9 aa, Homo Sapiens
ELSEQSLRE

SEQ ID NO: 6673 - protein, 9 aa, Homo Sapiens
ERPNQCADC

SEQ ID NO: 6674 - protein, 9 aa, Homo Sapiens
DEAHSIDNV

SEQ ID NO: 6675 - protein, 9 aa, Homo Sapiens
VALARKKGK

SEQ ID NO: 6676 - protein, 9 aa, Homo Sapiens
CPSCQPLFM

SEQ ID NO: 6677 - protein, 9 aa, Homo Sapiens
GGSSSSINP

SEQ ID NO: 6678 - protein, 9 aa, Homo Sapiens
AIFGGTDGN

SEQ ID NO: 6679 - protein, 9 aa, Homo Sapiens
VVQYSLIEG

SEQ ID NO: 6680 - protein, 9 aa, Homo Sapiens
GLTCRPEGH

SEQ ID NO: 6681 - protein, 9 aa, Homo Sapiens
LVDPTLALL

SEQ ID NO: 6682 - protein, 9 aa, Homo Sapiens
SLDDFEDKY

SEQ ID NO: 6683 - protein, 9 aa, Homo Sapiens
PPGSGPQNS

SEQ ID NO: 6684 - protein, 9 aa, Homo Sapiens
KEELINTKN

SEQ ID NO: 6685 - protein, 9 aa, Homo Sapiens
HYRPHTAEK

SEQ ID NO: 6686 - protein, 9 aa, Homo Sapiens
QGSLCFRHK

SEQ ID NO: 6687 - protein, 9 aa, Homo Sapiens
TASERGVPT

SEQ ID NO: 6688 - protein, 9 aa, Homo Sapiens
PPRVRPKPR

SEQ ID NO: 6689 - protein, 9 aa, Homo Sapiens
LSHERSHLA

SEQ ID NO: 6690 - protein, 9 aa, Homo Sapiens
KECDKAFRL

SEQ ID NO: 6691 - protein, 9 aa, Homo Sapiens
GNYCLQISE

SEQ ID NO: 6692 - protein, 9 aa, Homo Sapiens
FGTSLDKEI

SEQ ID NO: 6693 - protein, 9 aa, Homo Sapiens
RFHYINVLS

SEQ ID NO: 6694 - protein, 9 aa, Homo Sapiens
IRWSDVAGL

SEQ ID NO: 6695 - protein, 9 aa, Homo Sapiens
PLEPMLCRM

SEQ ID NO: 6696 - protein, 9 aa, Homo Sapiens
EAHFNGLIF

SEQ ID NO: 6697 - protein, 9 aa, Homo Sapiens
QVPLLSGFR

SEQ ID NO: 6698 - protein, 9 aa, Homo Sapiens
GAPRSGQDP

SEQ ID NO: 6699 - protein, 9 aa, Homo Sapiens
NPKKGDTEP

SEQ ID NO: 6700 - protein, 9 aa, Homo Sapiens
VFGRTGELG

SEQ ID NO: 6701 - protein, 9 aa, Homo Sapiens
RSNLICHRR

SEQ ID NO: 6702 - protein, 9 aa, Homo Sapiens
YNRVVCREA

SEQ ID NO: 6703 - protein, 9 aa, Homo Sapiens
GERAAGLPA

SEQ ID NO: 6704 - protein, 9 aa, Homo Sapiens
PFMDIETCV

SEQ ID NO: 6705 - protein, 9 aa, Homo Sapiens
ATEFFDSLK

SEQ ID NO: 6706 - protein, 9 aa, Homo Sapiens
SSPRKGNKK

SEQ ID NO: 6707 - protein, 9 aa, Homo Sapiens
QLKELNITA

SEQ ID NO: 6708 - protein, 9 aa, Homo Sapiens
KAKRLLYSS

SEQ ID NO: 6709 - protein, 9 aa, Homo Sapiens
QQDIECPWT

SEQ ID NO: 6710 - protein, 9 aa, Homo Sapiens
GLPATDFKV

SEQ ID NO: 6711 - protein, 9 aa, Homo Sapiens
SSGDYRRTP

SEQ ID NO: 6712 - protein, 9 aa, Homo Sapiens
GRNECDMCT

SEQ ID NO: 6713 - protein, 9 aa, Homo Sapiens
GQILEIKTV

SEQ ID NO: 6714 - protein, 9 aa, Homo Sapiens
RIYRQSKEL

SEQ ID NO: 6715 - protein, 9 aa, Homo Sapiens
TDQPVTPEH

SEQ ID NO: 6716 - protein, 9 aa, Homo Sapiens
DVNGILNVS

SEQ ID NO: 6717 - protein, 9 aa, Homo Sapiens
QLHLSGKKS

SEQ ID NO: 6718 - protein, 9 aa, Homo Sapiens
VKDFLMSIN

SEQ ID NO: 6719 - protein, 9 aa, Homo Sapiens
CTGSVPVGK

SEQ ID NO: 6720 - protein, 9 aa, Homo Sapiens
QQKRIDLRP

SEQ ID NO: 6721 - protein, 9 aa, Homo Sapiens
EAPQDVSSR

SEQ ID NO: 6722 - protein, 9 aa, Homo Sapiens
GRGTLLISK

SEQ ID NO: 6723 - protein, 9 aa, Homo Sapiens
QQLAVTGKK

SEQ ID NO: 6724 - protein, 9 aa, Homo Sapiens
RNLKIDLDV

SEQ ID NO: 6725 - protein, 9 aa, Homo Sapiens
LGAQCWEPQ

SEQ ID NO: 6726 - protein, 9 aa, Homo Sapiens
DTTKSRKAY

SEQ ID NO: 6727 - protein, 9 aa, Homo Sapiens
FTGDLASHK

SEQ ID NO: 6728 - protein, 9 aa, Homo Sapiens
PIWRVKKAL

SEQ ID NO: 6729 - protein, 9 aa, Homo Sapiens
FGTGNYCLQ

SEQ ID NO: 6730 - protein, 9 aa, Homo Sapiens
EPGPRHPGG

SEQ ID NO: 6731 - protein, 9 aa, Homo Sapiens
SMWPVICLI

SEQ ID NO: 6732 - protein, 9 aa, Homo Sapiens
HFRDHAKNA

SEQ ID NO: 6733 - protein, 9 aa, Homo Sapiens
AVACAPTRQ

SEQ ID NO: 6734 - protein, 9 aa, Homo Sapiens
LSTSGCDSH

SEQ ID NO: 6735 - protein, 9 aa, Homo Sapiens
MRISVFKYV

SEQ ID NO: 6736 - protein, 9 aa, Homo Sapiens
KQRVMTHVS

SEQ ID NO: 6737 - protein, 9 aa, Homo Sapiens
VDVKDFLMS

SEQ ID NO: 6738 - protein, 9 aa, Homo Sapiens
PAHLQQAFQ

SEQ ID NO: 6739 - protein, 9 aa, Homo Sapiens
MRGGAPPRV

SEQ ID NO: 6740 - protein, 9 aa, Homo Sapiens
SHHFRDHAK

SEQ ID NO: 6741 - protein, 9 aa, Homo Sapiens
LCFSYTHMV

SEQ ID NO: 6742 - protein, 9 aa, Homo Sapiens
LTPEGIKQF

SEQ ID NO: 6743 - protein, 9 aa, Homo Sapiens
GRFHLLYGK

SEQ ID NO: 6744 - protein, 9 aa, Homo Sapiens
RTQQDIECP

SEQ ID NO: 6745 - protein, 9 aa, Homo Sapiens
RAGLSGASR

SEQ ID NO: 6746 - protein, 9 aa, Homo Sapiens
RAIQANRSQ

SEQ ID NO: 6747 - protein, 9 aa, Homo Sapiens
CFTGDLASH

SEQ ID NO: 6748 - protein, 9 aa, Homo Sapiens
VSAAVKGLL

SEQ ID NO: 6749 - protein, 9 aa, Homo Sapiens
IKGEFSRGL

SEQ ID NO: 6750 - protein, 9 aa, Homo Sapiens
PGPRGGRSA

SEQ ID NO: 6751 - protein, 9 aa, Homo Sapiens
KVVQYSLIE

SEQ ID NO: 6752 - protein, 9 aa, Homo Sapiens
KEKFSSFLN

SEQ ID NO: 6753 - protein, 9 aa, Homo Sapiens
EDLAKVVCK

SEQ ID NO: 6754 - protein, 9 aa, Homo Sapiens
GAPPRVRPK

SEQ ID NO: 6755 - protein, 9 aa, Homo Sapiens
LLFGHYSRA

SEQ ID NO: 6756 - protein, 9 aa, Homo Sapiens
SEHFLEQSH

SEQ ID NO: 6757 - protein, 9 aa, Homo Sapiens
RSVDFMSSA

SEQ ID NO: 6758 - protein, 9 aa, Homo Sapiens
VPVGKCALS

SEQ ID NO: 6759 - protein, 9 aa, Homo Sapiens
PCISCSPDG

SEQ ID NO: 6760 - protein, 9 aa, Homo Sapiens
FDMDCHKKY

SEQ ID NO: 6761 - protein, 9 aa, Homo Sapiens
QIEGSDPSL

SEQ ID NO: 6762 - protein, 9 aa, Homo Sapiens
KKYLRAIQA

SEQ ID NO: 6763 - protein, 9 aa, Homo Sapiens
TDGNELTGV

SEQ ID NO: 6764 - protein, 9 aa, Homo Sapiens
SKRSDLIQQ

SEQ ID NO: 6765 - protein, 9 aa, Homo Sapiens
VVVSSLLTQ

SEQ ID NO: 6766 - protein, 9 aa, Homo Sapiens
AGVPRLPEQ

SEQ ID NO: 6767 - protein, 9 aa, Homo Sapiens
SSFPGVQSS

SEQ ID NO: 6768 - protein, 9 aa, Homo Sapiens
KRSDLIQQK

SEQ ID NO: 6769 - protein, 9 aa, Homo Sapiens
RHRCCLAHH

SEQ ID NO: 6770 - protein, 9 aa, Homo Sapiens
DVCASPEEK

SEQ ID NO: 6771 - protein, 9 aa, Homo Sapiens
VSGTDVKEE

SEQ ID NO: 6772 - protein, 9 aa, Homo Sapiens
TEPPLVGPK

SEQ ID NO: 6773 - protein, 9 aa, Homo Sapiens
YKLSPEEYV

SEQ ID NO: 6774 - protein, 9 aa, Homo Sapiens
FLTKKWCHT

SEQ ID NO: 6775 - protein, 9 aa, Homo Sapiens
TISDTNNAL

SEQ ID NO: 6776 - protein, 9 aa, Homo Sapiens
NNLKDLQAS

SEQ ID NO: 6777 - protein, 9 aa, Homo Sapiens
SEAFLLNLV

SEQ ID NO: 6778 - protein, 9 aa, Homo Sapiens
AQLKQRVMT

SEQ ID NO: 6779 - protein, 9 aa, Homo Sapiens
SQSVFCGNL

SEQ ID NO: 6780 - protein, 9 aa, Homo Sapiens
TEPESPDSG

SEQ ID NO: 6781 - protein, 9 aa, Homo Sapiens
FPVQATIDV

SEQ ID NO: 6782 - protein, 9 aa, Homo Sapiens
RSQLCASAE

SEQ ID NO: 6783 - protein, 9 aa, Homo Sapiens
TATYWANLP

SEQ ID NO: 6784 - protein, 9 aa, Homo Sapiens
KDLQASIDT

SEQ ID NO: 6785 - protein, 9 aa, Homo Sapiens
PEMVFEERE

SEQ ID NO: 6786 - protein, 9 aa, Homo Sapiens
MTDPYKMII

SEQ ID NO: 6787 - protein, 9 aa, Homo Sapiens
SLRELQAVK

SEQ ID NO: 6788 - protein, 9 aa, Homo Sapiens
FLDVDFQKL

SEQ ID NO: 6789 - protein, 9 aa, Homo Sapiens
LCSSPNRPP

SEQ ID NO: 6790 - protein, 9 aa, Homo Sapiens
WRVKKALLQ

SEQ ID NO: 6791 - protein, 9 aa, Homo Sapiens
GSGQILEIK

SEQ ID NO: 6792 - protein, 9 aa, Homo Sapiens
MEVRVSQQL

SEQ ID NO: 6793 - protein, 9 aa, Homo Sapiens
SSTASSLGP

SEQ ID NO: 6794 - protein, 9 aa, Homo Sapiens
IQQKRIDLR

SEQ ID NO: 6795 - protein, 9 aa, Homo Sapiens
NRCNQTTRQ

SEQ ID NO: 6796 - protein, 9 aa, Homo Sapiens
KYTNREEPL

SEQ ID NO: 6797 - protein, 9 aa, Homo Sapiens
FPFSLMRIS

SEQ ID NO: 6798 - protein, 9 aa, Homo Sapiens
SDLIQQKRI

SEQ ID NO: 6799 - protein, 9 aa, Homo Sapiens
VIYRHVEDL

SEQ ID NO: 6800 - protein, 9 aa, Homo Sapiens
DVKEECREK

SEQ ID NO: 6801 - protein, 9 aa, Homo Sapiens
ETIMYECGH

SEQ ID NO: 6802 - protein, 9 aa, Homo Sapiens
INVLSRLPE

SEQ ID NO: 6803 - protein, 9 aa, Homo Sapiens
RIGWDPPLC

SEQ ID NO: 6804 - protein, 9 aa, Homo Sapiens
AGQSSTREP

SEQ ID NO: 6805 - protein, 9 aa, Homo Sapiens
LLQPSVQSM

SEQ ID NO: 6806 - protein, 9 aa, Homo Sapiens
PQLLQPSVQ

SEQ ID NO: 6807 - protein, 9 aa, Homo Sapiens
QCWEPQGPD

SEQ ID NO: 6808 - protein, 9 aa, Homo Sapiens
LPPFPPQSP

SEQ ID NO: 6809 - protein, 9 aa, Homo Sapiens
LEGNTQLLQ

SEQ ID NO: 6810 - protein, 9 aa, Homo Sapiens
AAGLPARPG

SEQ ID NO: 6811 - protein, 9 aa, Homo Sapiens
LMRISVFKY

SEQ ID NO: 6812 - protein, 9 aa, Homo Sapiens
ATHTICDQN

SEQ ID NO: 6813 - protein, 9 aa, Homo Sapiens
LTTASDKLQ

SEQ ID NO: 6814 - protein, 9 aa, Homo Sapiens
RRPQTPRRS

SEQ ID NO: 6815 - protein, 9 aa, Homo Sapiens
KPIPQPQNK

SEQ ID NO: 6816 - protein, 9 aa, Homo Sapiens
PGSTMGYRA

SEQ ID NO: 6817 - protein, 9 aa, Homo Sapiens
LKYVGDYPS

SEQ ID NO: 6818 - protein, 9 aa, Homo Sapiens
KVLLVCLIF

SEQ ID NO: 6819 - protein, 9 aa, Homo Sapiens
DESEAFLLN

SEQ ID NO: 6820 - protein, 9 aa, Homo Sapiens
PGYSGRQFS

SEQ ID NO: 6821 - protein, 9 aa, Homo Sapiens
TTPMVTHPI

SEQ ID NO: 6822 - protein, 9 aa, Homo Sapiens
RGAGGGTGA

SEQ ID NO: 6823 - protein, 9 aa, Homo Sapiens
IVIFTFLLI

SEQ ID NO: 6824 - protein, 9 aa, Homo Sapiens
KTNQFLLKF

SEQ ID NO: 6825 - protein, 9 aa, Homo Sapiens
RAGRRARCP

SEQ ID NO: 6826 - protein, 9 aa, Homo Sapiens
VPESKLIFS

SEQ ID NO: 6827 - protein, 9 aa, Homo Sapiens
DRGERAAGL

SEQ ID NO: 6828 - protein, 9 aa, Homo Sapiens
HSSSEHFLE

SEQ ID NO: 6829 - protein, 9 aa, Homo Sapiens
NENDIKVDE

SEQ ID NO: 6830 - protein, 9 aa, Homo Sapiens
SCQPLFMVL

SEQ ID NO: 6831 - protein, 9 aa, Homo Sapiens
LLAQVHLLP

SEQ ID NO: 6832 - protein, 9 aa, Homo Sapiens
AAVKGLLSH

SEQ ID NO: 6833 - protein, 9 aa, Homo Sapiens
PVADSLQGS

SEQ ID NO: 6834 - protein, 9 aa, Homo Sapiens
CKRVNQDIT

SEQ ID NO: 6835 - protein, 9 aa, Homo Sapiens
WAGHPSYPR

SEQ ID NO: 6836 - protein, 9 aa, Homo Sapiens
PRVRPKPRR

SEQ ID NO: 6837 - protein, 9 aa, Homo Sapiens
FEKLAQDPK

SEQ ID NO: 6838 - protein, 9 aa, Homo Sapiens
SQIQGLIGG

SEQ ID NO: 6839 - protein, 9 aa, Homo Sapiens
GPEDEQKML

SEQ ID NO: 6840 - protein, 9 aa, Homo Sapiens
DRNQFIFVA

SEQ ID NO: 6841 - protein, 9 aa, Homo Sapiens
STMGYRAQS

SEQ ID NO: 6842 - protein, 9 aa, Homo Sapiens
PSIMKVLLV

SEQ ID NO: 6843 - protein, 9 aa, Homo Sapiens
PPQSPAPPL

SEQ ID NO: 6844 - protein, 9 aa, Homo Sapiens
ASTGQPEDV

SEQ ID NO: 6845 - protein, 9 aa, Homo Sapiens
YWNRHAGRF

SEQ ID NO: 6846 - protein, 9 aa, Homo Sapiens
RAQSTQYEK

SEQ ID NO: 6847 - protein, 9 aa, Homo Sapiens
CASPEEKPL

SEQ ID NO: 6848 - protein, 9 aa, Homo Sapiens
QSSYNVLPG

SEQ ID NO: 6849 - protein, 9 aa, Homo Sapiens
YQKLTFRKV

SEQ ID NO: 6850 - protein, 9 aa, Homo Sapiens
GTTNRDDAK

SEQ ID NO: 6851 - protein, 9 aa, Homo Sapiens
TGGTTLDVV

SEQ ID NO: 6852 - protein, 9 aa, Homo Sapiens
TTSRPPNHH

SEQ ID NO: 6853 - protein, 9 aa, Homo Sapiens
REEERGQKR

SEQ ID NO: 6854 - protein, 9 aa, Homo Sapiens
LRPSLSTAV

SEQ ID NO: 6855 - protein, 9 aa, Homo Sapiens
PTLALLTRR

SEQ ID NO: 6856 - protein, 9 aa, Homo Sapiens
GLPARPGTG

SEQ ID NO: 6857 - protein, 9 aa, Homo Sapiens
EELREEERG

SEQ ID NO: 6858 - protein, 9 aa, Homo Sapiens
EGSDPSLNY

SEQ ID NO: 6859 - protein, 9 aa, Homo Sapiens
RTSPPCWRW

SEQ ID NO: 6860 - protein, 9 aa, Homo Sapiens
ASVGSPAAA

SEQ ID NO: 6861 - protein, 9 aa, Homo Sapiens
CLSLPSSGD

SEQ ID NO: 6862 - protein, 9 aa, Homo Sapiens
PDCNELMNR

SEQ ID NO: 6863 - protein, 9 aa, Homo Sapiens
APTRQGGRL

SEQ ID NO: 6864 - protein, 9 aa, Homo Sapiens
TKKVHVTEE

SEQ ID NO: 6865 - protein, 9 aa, Homo Sapiens
EYLIQQAVH

SEQ ID NO: 6866 - protein, 9 aa, Homo Sapiens
SVALARKKG

SEQ ID NO: 6867 - protein, 9 aa, Homo Sapiens
HFLEQSHSS

SEQ ID NO: 6868 - protein, 9 aa, Homo Sapiens
SLPLCTMFI

SEQ ID NO: 6869 - protein, 9 aa, Homo Sapiens
NTKNTSNKI

SEQ ID NO: 6870 - protein, 9 aa, Homo Sapiens
SPAGQSSTR

SEQ ID NO: 6871 - protein, 9 aa, Homo Sapiens
LTSCVPLCP

SEQ ID NO: 6872 - protein, 9 aa, Homo Sapiens
EFPFPHYII

SEQ ID NO: 6873 - protein, 9 aa, Homo Sapiens
ALLGTVTGG

SEQ ID NO: 6874 - protein, 9 aa, Homo Sapiens
PGTGQPRTQ

SEQ ID NO: 6875 - protein, 9 aa, Homo Sapiens
QSLRELQAV

SEQ ID NO: 6876 - protein, 9 aa, Homo Sapiens
PAQSIETYS

SEQ ID NO: 6877 - protein, 9 aa, Homo Sapiens
PGEPGWAAP

SEQ ID NO: 6878 - protein, 9 aa, Homo Sapiens
EAGPVWGDV

SEQ ID NO: 6879 - protein, 9 aa, Homo Sapiens
MGYMGPFPS

SEQ ID NO: 6880 - protein, 9 aa, Homo Sapiens
SRLSSGEGP

SEQ ID NO: 6881 - protein, 9 aa, Homo Sapiens
YRPSFDLRT

SEQ ID NO: 6882 - protein, 9 aa, Homo Sapiens
EPPPIWRVK

SEQ ID NO: 6883 - protein, 9 aa, Homo Sapiens
PARAHTAAP

SEQ ID NO: 6884 - protein, 9 aa, Homo Sapiens
APRSGQDPA

SEQ ID NO: 6885 - protein, 9 aa, Homo Sapiens
SVFCGNLLC

SEQ ID NO: 6886 - protein, 9 aa, Homo Sapiens
LGGGTGSGR

SEQ ID NO: 6887 - protein, 9 aa, Homo Sapiens
HTSQATRGR

SEQ ID NO: 6888 - protein, 9 aa, Homo Sapiens
VAIFGGTDG

SEQ ID NO: 6889 - protein, 9 aa, Homo Sapiens
FPSSLCFLW

SEQ ID NO: 6890 - protein, 9 aa, Homo Sapiens
QEAHFNGLI

SEQ ID NO: 6891 - protein, 9 aa, Homo Sapiens
SPGQGSLCF

SEQ ID NO: 6892 - protein, 9 aa, Homo Sapiens
ASQNSIRIE

SEQ ID NO: 6893 - protein, 9 aa, Homo Sapiens
SVDFMSSAH

SEQ ID NO: 6894 - protein, 9 aa, Homo Sapiens
QPLFMVLLL

SEQ ID NO: 6895 - protein, 9 aa, Homo Sapiens
SLSTAVFED

SEQ ID NO: 6896 - protein, 9 aa, Homo Sapiens
RGGAPPRVR

SEQ ID NO: 6897 - protein, 9 aa, Homo Sapiens
CSQHRATYR

SEQ ID NO: 6898 - protein, 9 aa, Homo Sapiens
RTQPPLPGR

SEQ ID NO: 6899 - protein, 9 aa, Homo Sapiens
RTETAGRSS

SEQ ID NO: 6900 - protein, 9 aa, Homo Sapiens
GKKSSDSKP

SEQ ID NO: 6901 - protein, 9 aa, Homo Sapiens
TFAKTEGPG

SEQ ID NO: 6902 - protein, 9 aa, Homo Sapiens
CVNTSDYNS

SEQ ID NO: 6903 - protein, 9 aa, Homo Sapiens
TLTLIDHSC

SEQ ID NO: 6904 - protein, 9 aa, Homo Sapiens
ARAAEPEAG

SEQ ID NO: 6905 - protein, 9 aa, Homo Sapiens
FIAVLKYVG

SEQ ID NO: 6906 - protein, 9 aa, Homo Sapiens
PYLRKEAIN

SEQ ID NO: 6907 - protein, 9 aa, Homo Sapiens
SHKLFPKAI

SEQ ID NO: 6908 - protein, 9 aa, Homo Sapiens
QQHQHQHQQ

SEQ ID NO: 6909 - protein, 9 aa, Homo Sapiens
PEGIKQFYI

SEQ ID NO: 6910 - protein, 9 aa, Homo Sapiens
DESIAQIYI

SEQ ID NO: 6911 - protein, 9 aa, Homo Sapiens
TEGPGDVKT

SEQ ID NO: 6912 - protein, 9 aa, Homo Sapiens
AGRRQWGPR

SEQ ID NO: 6913 - protein, 9 aa, Homo Sapiens
PVPAPAPAP

SEQ ID NO: 6914 - protein, 9 aa, Homo Sapiens
RAQKAIVYH

SEQ ID NO: 6915 - protein, 9 aa, Homo Sapiens
FPHYIILRD

SEQ ID NO: 6916 - protein, 9 aa, Homo Sapiens
DELEDFTDS

SEQ ID NO: 6917 - protein, 9 aa, Homo Sapiens
RVMTHVSNG

SEQ ID NO: 6918 - protein, 9 aa, Homo Sapiens
LPNLRAHMR

SEQ ID NO: 6919 - protein, 9 aa, Homo Sapiens
EKKYLRAIQ

SEQ ID NO: 6920 - protein, 9 aa, Homo Sapiens
EPRSGPGVD

SEQ ID NO: 6921 - protein, 9 aa, Homo Sapiens
NRIGFALTR

SEQ ID NO: 6922 - protein, 9 aa, Homo Sapiens
SSFLNMSDN

SEQ ID NO: 6923 - protein, 9 aa, Homo Sapiens
EKFLQHASH

SEQ ID NO: 6924 - protein, 9 aa, Homo Sapiens
SQRPGAAGF

SEQ ID NO: 6925 - protein, 9 aa, Homo Sapiens
AAEPEAGPV

SEQ ID NO: 6926 - protein, 9 aa, Homo Sapiens
AWTIQLTED

SEQ ID NO: 6927 - protein, 9 aa, Homo Sapiens
RRQGCRSGG

SEQ ID NO: 6928 - protein, 9 aa, Homo Sapiens
VLALGTLAE

SEQ ID NO: 6929 - protein, 9 aa, Homo Sapiens
WPQGAHGES

SEQ ID NO: 6930 - protein, 9 aa, Homo Sapiens
GAPPARLAP

SEQ ID NO: 6931 - protein, 9 aa, Homo Sapiens
LAAARRRVA

SEQ ID NO: 6932 - protein, 9 aa, Homo Sapiens
QEMVQCVSE

SEQ ID NO: 6933 - protein, 9 aa, Homo Sapiens
AAAAWGVLL

SEQ ID NO: 6934 - protein, 9 aa, Homo Sapiens
VSEPFMKSW

SEQ ID NO: 6935 - protein, 9 aa, Homo Sapiens
GRLAAGAPP

SEQ ID NO: 6936 - protein, 9 aa, Homo Sapiens
STSGCDSHS

SEQ ID NO: 6937 - protein, 9 aa, Homo Sapiens
GGGTGSGRG

SEQ ID NO: 6938 - protein, 9 aa, Homo Sapiens
GEEDEEELR

SEQ ID NO: 6939 - protein, 9 aa, Homo Sapiens
ISDTNNALQ

SEQ ID NO: 6940 - protein, 9 aa, Homo Sapiens
HRRRDAQSR

SEQ ID NO: 6941 - protein, 9 aa, Homo Sapiens
KILSEELQR

SEQ ID NO: 6942 - protein, 9 aa, Homo Sapiens
SGEKSFKCV

SEQ ID NO: 6943 - protein, 9 aa, Homo Sapiens
ECDEYCIQG

SEQ ID NO: 6944 - protein, 9 aa, Homo Sapiens
PGAAGFPAW

SEQ ID NO: 6945 - protein, 9 aa, Homo Sapiens
RLVSPAGQS

SEQ ID NO: 6946 - protein, 9 aa, Homo Sapiens
GPFPSSLCF

SEQ ID NO: 6947 - protein, 9 aa, Homo Sapiens
EVRVSQQLA

SEQ ID NO: 6948 - protein, 9 aa, Homo Sapiens
RAAGLPARP

SEQ ID NO: 6949 - protein, 9 aa, Homo Sapiens
KRFYEPQKL

SEQ ID NO: 6950 - protein, 9 aa, Homo Sapiens
MVSLFRSYL

SEQ ID NO: 6951 - protein, 9 aa, Homo Sapiens
QCVSELAGQ

SEQ ID NO: 6952 - protein, 9 aa, Homo Sapiens
AARRRVAGV

SEQ ID NO: 6953 - protein, 9 aa, Homo Sapiens
VDFQKLPTR

SEQ ID NO: 6954 - protein, 9 aa, Homo Sapiens
TGHTDCVYS

SEQ ID NO: 6955 - protein, 9 aa, Homo Sapiens
TPYYRKVDF

SEQ ID NO: 6956 - protein, 9 aa, Homo Sapiens
NALQKNSNP

SEQ ID NO: 6957 - protein, 9 aa, Homo Sapiens
LICHRRIHS

SEQ ID NO: 6958 - protein, 9 aa, Homo Sapiens
SLMYKLSPE

SEQ ID NO: 6959 - protein, 9 aa, Homo Sapiens
VQHLTWGLI

SEQ ID NO: 6960 - protein, 9 aa, Homo Sapiens
PLHKCRPGF

SEQ ID NO: 6961 - protein, 9 aa, Homo Sapiens
ISNLSQYFS

SEQ ID NO: 6962 - protein, 9 aa, Homo Sapiens
EHNELMVRN

SEQ ID NO: 6963 - protein, 9 aa, Homo Sapiens
AWRNHCQNR

SEQ ID NO: 6964 - protein, 9 aa, Homo Sapiens
PGVQSSYNV

SEQ ID NO: 6965 - protein, 9 aa, Homo Sapiens
FLADEDCMP

SEQ ID NO: 6966 - protein, 9 aa, Homo Sapiens
REAALRIFW

SEQ ID NO: 6967 - protein, 9 aa, Homo Sapiens
SWDRNPEAL

SEQ ID NO: 6968 - protein, 9 aa, Homo Sapiens
GSCQACPAN

SEQ ID NO: 6969 - protein, 9 aa, Homo Sapiens
APPPPAPLP

SEQ ID NO: 6970 - protein, 9 aa, Homo Sapiens
SGMYRPSFD

SEQ ID NO: 6971 - protein, 9 aa, Homo Sapiens
KIGWQKDAL

SEQ ID NO: 6972 - protein, 9 aa, Homo Sapiens
GNLLCSQHR

SEQ ID NO: 6973 - protein, 9 aa, Homo Sapiens
PTPQPDCSF

SEQ ID NO: 6974 - protein, 9 aa, Homo Sapiens
QMDIDNVER

SEQ ID NO: 6975 - protein, 9 aa, Homo Sapiens
EHFLEQSHS

SEQ ID NO: 6976 - protein, 9 aa, Homo Sapiens
RRVAGVARA

SEQ ID NO: 6977 - protein, 9 aa, Homo Sapiens
HHLPPPAAN

SEQ ID NO: 6978 - protein, 9 aa, Homo Sapiens
PPPIWRVKK

SEQ ID NO: 6979 - protein, 9 aa, Homo Sapiens
QLCASAEQS

SEQ ID NO: 6980 - protein, 9 aa, Homo Sapiens
SEVNVDVKD

SEQ ID NO: 6981 - protein, 9 aa, Homo Sapiens
LDVTAEGDL

SEQ ID NO: 6982 - protein, 9 aa, Homo Sapiens
GTCLNDPSQ

SEQ ID NO: 6983 - protein, 9 aa, Homo Sapiens
PTRQGGRLL

SEQ ID NO: 6984 - protein, 9 aa, Homo Sapiens
SCQACPANS

SEQ ID NO: 6985 - protein, 9 aa, Homo Sapiens
SLFKHVVPM

SEQ ID NO: 6986 - protein, 9 aa, Homo Sapiens
GSVSDPPRS

SEQ ID NO: 6987 - protein, 9 aa, Homo Sapiens
KYVGDYPSK

SEQ ID NO: 6988 - protein, 9 aa, Homo Sapiens
LDVLGLDIS

SEQ ID NO: 6989 - protein, 9 aa, Homo Sapiens
VHLLPDFLS

SEQ ID NO: 6990 - protein, 9 aa, Homo Sapiens
KERIRTLSD

SEQ ID NO: 6991 - protein, 9 aa, Homo Sapiens
SSLASSQAK

SEQ ID NO: 6992 - protein, 9 aa, Homo Sapiens
YLKNMSQLL

SEQ ID NO: 6993 - protein, 9 aa, Homo Sapiens
FGQHGSGSR

SEQ ID NO: 6994 - protein, 9 aa, Homo Sapiens
IGWQKDALH

SEQ ID NO: 6995 - protein, 9 aa, Homo Sapiens
DVDFQKLPT

SEQ ID NO: 6996 - protein, 9 aa, Homo Sapiens
CTMFIIFLV

SEQ ID NO: 6997 - protein, 9 aa, Homo Sapiens
RPGTGQPRT

SEQ ID NO: 6998 - protein, 9 aa, Homo Sapiens
LEPMLCRML

SEQ ID NO: 6999 - protein, 9 aa, Homo Sapiens
RPRVLQKKN

SEQ ID NO: 7000 - protein, 9 aa, Homo Sapiens
KELNITAAK

SEQ ID NO: 7001 - protein, 9 aa, Homo Sapiens
CDKRFSVSS

SEQ ID NO: 7002 - protein, 9 aa, Homo Sapiens
PGSGPQNSL

SEQ ID NO: 7003 - protein, 9 aa, Homo Sapiens
KLTFRKVVS

SEQ ID NO: 7004 - protein, 9 aa, Homo Sapiens
TLESLWVLG

SEQ ID NO: 7005 - protein, 9 aa, Homo Sapiens
LIQQKRIDL

SEQ ID NO: 7006 - protein, 9 aa, Homo Sapiens
ASAEQSEGH

SEQ ID NO: 7007 - protein, 9 aa, Homo Sapiens
PGQKIDLLM

SEQ ID NO: 7008 - protein, 9 aa, Homo Sapiens
PGDCLTTAS

SEQ ID NO: 7009 - protein, 9 aa, Homo Sapiens
QGGRLLPPF

SEQ ID NO: 7010 - protein, 9 aa, Homo Sapiens
QNSIRIEYD

SEQ ID NO: 7011 - protein, 9 aa, Homo Sapiens
DGPVSDRLT

SEQ ID NO: 7012 - protein, 9 aa, Homo Sapiens
RPDRAGLSG

SEQ ID NO: 7013 - protein, 9 aa, Homo Sapiens
AQRGAFFGP

SEQ ID NO: 7014 - protein, 9 aa, Homo Sapiens
IARDIKEKL

SEQ ID NO: 7015 - protein, 9 aa, Homo Sapiens
SFRTGQRSV

SEQ ID NO: 7016 - protein, 9 aa, Homo Sapiens
RSRWAGHPS

SEQ ID NO: 7017 - protein, 9 aa, Homo Sapiens
PTASERGVP

SEQ ID NO: 7018 - protein, 9 aa, Homo Sapiens
VSQSVFCGN

SEQ ID NO: 7019 - protein, 9 aa, Homo Sapiens
RPYECNTRG

SEQ ID NO: 7020 - protein, 9 aa, Homo Sapiens
TVNSFGFAN

SEQ ID NO: 7021 - protein, 9 aa, Homo Sapiens
ELLDPELDV

SEQ ID NO: 7022 - protein, 9 aa, Homo Sapiens
QMHHTDFKF

SEQ ID NO: 7023 - protein, 9 aa, Homo Sapiens
LQISEKTSV

SEQ ID NO: 7024 - protein, 9 aa, Homo Sapiens
LMYKLSPEE

SEQ ID NO: 7025 - protein, 9 aa, Homo Sapiens
TIYEFKKSA

SEQ ID NO: 7026 - protein, 9 aa, Homo Sapiens
HSIDNVCID

SEQ ID NO: 7027 - protein, 9 aa, Homo Sapiens
PRASPTART

SEQ ID NO: 7028 - protein, 9 aa, Homo Sapiens
MLSVLTGHT

SEQ ID NO: 7029 - protein, 9 aa, Homo Sapiens
CEDCGKAFR

SEQ ID NO: 7030 - protein, 9 aa, Homo Sapiens
EKFSSFLNM

SEQ ID NO: 7031 - protein, 9 aa, Homo Sapiens
KATYVKELE

SEQ ID NO: 7032 - protein, 9 aa, Homo Sapiens
PARPDRAGL

SEQ ID NO: 7033 - protein, 9 aa, Homo Sapiens
PQLLSVPLS

SEQ ID NO: 7034 - protein, 9 aa, Homo Sapiens
EQVAQLKQR

SEQ ID NO: 7035 - protein, 9 aa, Homo Sapiens
ARCPEYSRG

SEQ ID NO: 7036 - protein, 9 aa, Homo Sapiens
NTFRRSVVV

SEQ ID NO: 7037 - protein, 9 aa, Homo Sapiens
TVTGGPQHW

SEQ ID NO: 7038 - protein, 9 aa, Homo Sapiens
ELTPEGIKQ

SEQ ID NO: 7039 - protein, 9 aa, Homo Sapiens
CAQRGAFFG

SEQ ID NO: 7040 - protein, 9 aa, Homo Sapiens
GNKKKPVKV

SEQ ID NO: 7041 - protein, 9 aa, Homo Sapiens
GQPEDVTET

SEQ ID NO: 7042 - protein, 9 aa, Homo Sapiens
FWNVFSKTC

SEQ ID NO: 7043 - protein, 9 aa, Homo Sapiens
VKKEELTPE

SEQ ID NO: 7044 - protein, 9 aa, Homo Sapiens
AQLHLSGKK

SEQ ID NO: 7045 - protein, 9 aa, Homo Sapiens
SLLTQAGFE

SEQ ID NO: 7046 - protein, 9 aa, Homo Sapiens
LALLTRRAS

SEQ ID NO: 7047 - protein, 9 aa, Homo Sapiens
EVAVNSLSQ

SEQ ID NO: 7048 - protein, 9 aa, Homo Sapiens
NYDYWVEAD

SEQ ID NO: 7049 - protein, 9 aa, Homo Sapiens
RSRDFIPYH

SEQ ID NO: 7050 - protein, 9 aa, Homo Sapiens
ARLAPSSPP

SEQ ID NO: 7051 - protein, 9 aa, Homo Sapiens
SARKDLVLL

SEQ ID NO: 7052 - protein, 9 aa, Homo Sapiens
EGPGDVKTT

SEQ ID NO: 7053 - protein, 9 aa, Homo Sapiens
NYNRTVSFA

SEQ ID NO: 7054 - protein, 9 aa, Homo Sapiens
WTLRSPPTS

SEQ ID NO: 7055 - protein, 9 aa, Homo Sapiens
LKDLQASID

SEQ ID NO: 7056 - protein, 9 aa, Homo Sapiens
SFLNMSDNI

SEQ ID NO: 7057 - protein, 9 aa, Homo Sapiens
KIQMDIDNV

SEQ ID NO: 7058 - protein, 9 aa, Homo Sapiens
QVREEVVRR

SEQ ID NO: 7059 - protein, 9 aa, Homo Sapiens
VLAQGLLYM

SEQ ID NO: 7060 - protein, 9 aa, Homo Sapiens
LLAAARRRV

SEQ ID NO: 7061 - protein, 9 aa, Homo Sapiens
KEKIGWQKD

SEQ ID NO: 7062 - protein, 9 aa, Homo Sapiens
AHRRRDAQS

SEQ ID NO: 7063 - protein, 9 aa, Homo Sapiens
DLIQQKRID

SEQ ID NO: 7064 - protein, 9 aa, Homo Sapiens
DLVLLDGNR

SEQ ID NO: 7065 - protein, 9 aa, Homo Sapiens
ARSVDFMSS

SEQ ID NO: 7066 - protein, 9 aa, Homo Sapiens
LMLSVLTGH

SEQ ID NO: 7067 - protein, 9 aa, Homo Sapiens
KYAEFIVVR

SEQ ID NO: 7068 - protein, 9 aa, Homo Sapiens
VTETTGLEG

SEQ ID NO: 7069 - protein, 9 aa, Homo Sapiens
SLWVLGFSH

SEQ ID NO: 7070 - protein, 9 aa, Homo Sapiens
LPPPAANTV

SEQ ID NO: 7071 - protein, 9 aa, Homo Sapiens
RLCAPLHKC

SEQ ID NO: 7072 - protein, 9 aa, Homo Sapiens
DGSGQILEI

SEQ ID NO: 7073 - protein, 9 aa, Homo Sapiens
LQVGIYNGT

SEQ ID NO: 7074 - protein, 9 aa, Homo Sapiens
GRLLPPFPP

SEQ ID NO: 7075 - protein, 9 aa, Homo Sapiens
PGSSTASSL

SEQ ID NO: 7076 - protein, 9 aa, Homo Sapiens
PSVQSMGIP

SEQ ID NO: 7077 - protein, 9 aa, Homo Sapiens
AMSGSGVRG

SEQ ID NO: 7078 - protein, 9 aa, Homo Sapiens
RPQTPRRSR

SEQ ID NO: 7079 - protein, 9 aa, Homo Sapiens
VFSKTCSTK

SEQ ID NO: 7080 - protein, 9 aa, Homo Sapiens
PYECNTRGK

SEQ ID NO: 7081 - protein, 9 aa, Homo Sapiens
SQLCASAEQ

SEQ ID NO: 7082 - protein, 9 aa, Homo Sapiens
NNRIGFALT

SEQ ID NO: 7083 - protein, 9 aa, Homo Sapiens
FHYINVLSR

SEQ ID NO: 7084 - protein, 9 aa, Homo Sapiens
ERLIEKTKV

SEQ ID NO: 7085 - protein, 9 aa, Homo Sapiens
SQLLEEMLL

SEQ ID NO: 7086 - protein, 9 aa, Homo Sapiens
VPAPAPVPA

SEQ ID NO: 7087 - protein, 9 aa, Homo Sapiens
SKRFYEPQK

SEQ ID NO: 7088 - protein, 9 aa, Homo Sapiens
GHCPSCQPL

SEQ ID NO: 7089 - protein, 9 aa, Homo Sapiens
FPIATKRMA

SEQ ID NO: 7090 - protein, 9 aa, Homo Sapiens
INSQLARHA

SEQ ID NO: 7091 - protein, 9 aa, Homo Sapiens
AKDNTRTGA

SEQ ID NO: 7092 - protein, 9 aa, Homo Sapiens
SLDKEIILK

SEQ ID NO: 7093 - protein, 9 aa, Homo Sapiens
PSLSTAVFE

SEQ ID NO: 7094 - protein, 9 aa, Homo Sapiens
WEIWKSRSN

SEQ ID NO: 7095 - protein, 9 aa, Homo Sapiens
QRLQSREGP

SEQ ID NO: 7096 - protein, 9 aa, Homo Sapiens
GSPAAARGA

SEQ ID NO: 7097 - protein, 9 aa, Homo Sapiens
ARAHTAAPA

SEQ ID NO: 7098 - protein, 9 aa, Homo Sapiens
GSTMGYRAQ

SEQ ID NO: 7099 - protein, 9 aa, Homo Sapiens
LQVPLLSGF

SEQ ID NO: 7100 - protein, 9 aa, Homo Sapiens
RCCLAHHEH

SEQ ID NO: 7101 - protein, 9 aa, Homo Sapiens
NLKETGIAN

SEQ ID NO: 7102 - protein, 9 aa, Homo Sapiens
QKTEPPLVG

SEQ ID NO: 7103 - protein, 9 aa, Homo Sapiens
STREPRSGP

SEQ ID NO: 7104 - protein, 9 aa, Homo Sapiens
SFRIVNSKP

SEQ ID NO: 7105 - protein, 9 aa, Homo Sapiens
VPKRYRILL

SEQ ID NO: 7106 - protein, 9 aa, Homo Sapiens
GQGSLCFRH

SEQ ID NO: 7107 - protein, 9 aa, Homo Sapiens
LQQAFQDGG

SEQ ID NO: 7108 - protein, 9 aa, Homo Sapiens
YCLQISEKT

SEQ ID NO: 7109 - protein, 9 aa, Homo Sapiens
GTSLDKEII

SEQ ID NO: 7110 - protein, 9 aa, Homo Sapiens
TKKWCHTLR

SEQ ID NO: 7111 - protein, 9 aa, Homo Sapiens
IWRVKKALL

SEQ ID NO: 7112 - protein, 9 aa, Homo Sapiens
GRHTLQNFC

SEQ ID NO: 7113 - protein, 9 aa, Homo Sapiens
PPPPAPLPA

SEQ ID NO: 7114 - protein, 9 aa, Homo Sapiens
LIARTGLIT

SEQ ID NO: 7115 - protein, 9 aa, Homo Sapiens
NNALQKNSN

SEQ ID NO: 7116 - protein, 9 aa, Homo Sapiens
SPRKGNKKK

SEQ ID NO: 7117 - protein, 9 aa, Homo Sapiens
NPPATKESI

SEQ ID NO: 7118 - protein, 9 aa, Homo Sapiens
SKYRLKHLT

SEQ ID NO: 7119 - protein, 9 aa, Homo Sapiens
GSSTASSLG

SEQ ID NO: 7120 - protein, 9 aa, Homo Sapiens
YINVLSRLP

SEQ ID NO: 7121 - protein, 9 aa, Homo Sapiens
NRSQLCASA

SEQ ID NO: 7122 - protein, 9 aa, Homo Sapiens
DTTLSPGSS

SEQ ID NO: 7123 - protein, 9 aa, Homo Sapiens
RLLPPFPPQ

SEQ ID NO: 7124 - protein, 9 aa, Homo Sapiens
PLFMVLLLK

SEQ ID NO: 7125 - protein, 9 aa, Homo Sapiens
APAQRCAGF

SEQ ID NO: 7126 - protein, 9 aa, Homo Sapiens
FVYYFVSHH

SEQ ID NO: 7127 - protein, 9 aa, Homo Sapiens
KAGGEVPVG

SEQ ID NO: 7128 - protein, 9 aa, Homo Sapiens
NTPLVRISR

SEQ ID NO: 7129 - protein, 9 aa, Homo Sapiens
VLLDGNRVS

SEQ ID NO: 7130 - protein, 9 aa, Homo Sapiens
DSLELDEEG

SEQ ID NO: 7131 - protein, 9 aa, Homo Sapiens
AWGPLLFYI

SEQ ID NO: 7132 - protein, 9 aa, Homo Sapiens
AFIAVLKYV

SEQ ID NO: 7133 - protein, 9 aa, Homo Sapiens
FVSHHFRDH

SEQ ID NO: 7134 - protein, 9 aa, Homo Sapiens
HTAAPAQRC

SEQ ID NO: 7135 - protein, 9 aa, Homo Sapiens
CMFDMDCHK

SEQ ID NO: 7136 - protein, 9 aa, Homo Sapiens
SAADEEQWK

SEQ ID NO: 7137 - protein, 9 aa, Homo Sapiens
EKPNIRWSD

SEQ ID NO: 7138 - protein, 9 aa, Homo Sapiens
RHAGRFHLL

SEQ ID NO: 7139 - protein, 9 aa, Homo Sapiens
NVLSRLPET

SEQ ID NO: 7140 - protein, 9 aa, Homo Sapiens
AGVARAGRR

SEQ ID NO: 7141 - protein, 9 aa, Homo Sapiens
FRKVVSPQE

SEQ ID NO: 7142 - protein, 9 aa, Homo Sapiens
SGSRQSSGF

SEQ ID NO: 7143 - protein, 9 aa, Homo Sapiens
ETLESLWVL

SEQ ID NO: 7144 - protein, 9 aa, Homo Sapiens
ESVAAPHSG

SEQ ID NO: 7145 - protein, 9 aa, Homo Sapiens
LGPTQTLSP

SEQ ID NO: 7146 - protein, 9 aa, Homo Sapiens
GLSGASRGA

SEQ ID NO: 7147 - protein, 9 aa, Homo Sapiens
HFFCAQRGA

SEQ ID NO: 7148 - protein, 9 aa, Homo Sapiens
TNAQLHLSG

SEQ ID NO: 7149 - protein, 9 aa, Homo Sapiens
SQLARHASP

SEQ ID NO: 7150 - protein, 9 aa, Homo Sapiens
DRNTFRRSV

SEQ ID NO: 7151 - protein, 9 aa, Homo Sapiens
SGQILEIKT

SEQ ID NO: 7152 - protein, 9 aa, Homo Sapiens
NGEIYVTGG

SEQ ID NO: 7153 - protein, 9 aa, Homo Sapiens
LVSEAESGR

SEQ ID NO: 7154 - protein, 9 aa, Homo Sapiens
MYRPSFDLR

SEQ ID NO: 7155 - protein, 9 aa, Homo Sapiens
NLPTPRASP

SEQ ID NO: 7156 - protein, 9 aa, Homo Sapiens
KEIILKAPI

SEQ ID NO: 7157 - protein, 9 aa, Homo Sapiens
LSSDPGKGN

SEQ ID NO: 7158 - protein, 9 aa, Homo Sapiens
VLSRLPETL

SEQ ID NO: 7159 - protein, 9 aa, Homo Sapiens
AHQYETIMY

SEQ ID NO: 7160 - protein, 9 aa, Homo Sapiens
TKEKFSSFL

SEQ ID NO: 7161 - protein, 9 aa, Homo Sapiens
PEYSRGAGG

SEQ ID NO: 7162 - protein, 9 aa, Homo Sapiens
SEQSLRELQ

SEQ ID NO: 7163 - protein, 9 aa, Homo Sapiens
NREVFGRTG

SEQ ID NO: 7164 - protein, 9 aa, Homo Sapiens
SGTTNRDDA

SEQ ID NO: 7165 - protein, 9 aa, Homo Sapiens
LLPPFPPQS

SEQ ID NO: 7166 - protein, 9 aa, Homo Sapiens
TEDFKQQMG

SEQ ID NO: 7167 - protein, 9 aa, Homo Sapiens
DEEQWKLKE

SEQ ID NO: 7168 - protein, 9 aa, Homo Sapiens
GEKSFKCVE

SEQ ID NO: 7169 - protein, 9 aa, Homo Sapiens
YLTYNYFIN

SEQ ID NO: 7170 - protein, 9 aa, Homo Sapiens
SDPSLNYKK

SEQ ID NO: 7171 - protein, 9 aa, Homo Sapiens
AQGLLYMAL

SEQ ID NO: 7172 - protein, 9 aa, Homo Sapiens
DRRAEYWVE

SEQ ID NO: 7173 - protein, 9 aa, Homo Sapiens
SDPGKGNHK

SEQ ID NO: 7174 - protein, 9 aa, Homo Sapiens
LLQKVKAHE

SEQ ID NO: 7175 - protein, 9 aa, Homo Sapiens
RSVVVPYEP

SEQ ID NO: 7176 - protein, 9 aa, Homo Sapiens
AKDIFGELF

SEQ ID NO: 7177 - protein, 9 aa, Homo Sapiens
ASVALARKK

SEQ ID NO: 7178 - protein, 9 aa, Homo Sapiens
RTGANSPEM

SEQ ID NO: 7179 - protein, 9 aa, Homo Sapiens
SEPFMKSWG

SEQ ID NO: 7180 - protein, 9 aa, Homo Sapiens
NTIYEFKKS

SEQ ID NO: 7181 - protein, 9 aa, Homo Sapiens
GTGSGRGTL

SEQ ID NO: 7182 - protein, 9 aa, Homo Sapiens
GTGQPRTQP

SEQ ID NO: 7183 - protein, 9 aa, Homo Sapiens
GSLCFRHKP

SEQ ID NO: 7184 - protein, 9 aa, Homo Sapiens
KKSIDIRCK

SEQ ID NO: 7185 - protein, 9 aa, Homo Sapiens
TEGSGCYIP

SEQ ID NO: 7186 - protein, 9 aa, Homo Sapiens
DFRYILGRD

SEQ ID NO: 7187 - protein, 9 aa, Homo Sapiens
ATYVKELEE

SEQ ID NO: 7188 - protein, 9 aa, Homo Sapiens
CVIQFVGTC

SEQ ID NO: 7189 - protein, 9 aa, Homo Sapiens
FDFQKTEPP

SEQ ID NO: 7190 - protein, 9 aa, Homo Sapiens
IDFRYILGR

SEQ ID NO: 7191 - protein, 9 aa, Homo Sapiens
MASQNSIRI

SEQ ID NO: 7192 - protein, 9 aa, Homo Sapiens
ICIVIFTFL

SEQ ID NO: 7193 - protein, 9 aa, Homo Sapiens
GGGRLAAGA

SEQ ID NO: 7194 - protein, 9 aa, Homo Sapiens
VIRDGSGQI

SEQ ID NO: 7195 - protein, 9 aa, Homo Sapiens
KDNTRTGAN

SEQ ID NO: 7196 - protein, 9 aa, Homo Sapiens
PMKKNSQIG

SEQ ID NO: 7197 - protein, 9 aa, Homo Sapiens
KLIARTGLI

SEQ ID NO: 7198 - protein, 9 aa, Homo Sapiens
RWTVIYRHV

SEQ ID NO: 7199 - protein, 9 aa, Homo Sapiens
PWPVRRQGC

SEQ ID NO: 7200 - protein, 9 aa, Homo Sapiens
VQCVSELAG

SEQ ID NO: 7201 - protein, 9 aa, Homo Sapiens
ELPAPSRAG

SEQ ID NO: 7202 - protein, 9 aa, Homo Sapiens
GGVQEAHFN

SEQ ID NO: 7203 - protein, 9 aa, Homo Sapiens
CYIPRKPFP

SEQ ID NO: 7204 - protein, 9 aa, Homo Sapiens
CSPDGCVLV

SEQ ID NO: 7205 - protein, 9 aa, Homo Sapiens
SGRQFSIIC

SEQ ID NO: 7206 - protein, 9 aa, Homo Sapiens
NQDITTLIT

SEQ ID NO: 7207 - protein, 9 aa, Homo Sapiens
AMGRSLSCP

SEQ ID NO: 7208 - protein, 9 aa, Homo Sapiens
KTNIPEHIK

SEQ ID NO: 7209 - protein, 9 aa, Homo Sapiens
EDVYSQDSI

SEQ ID NO: 7210 - protein, 9 aa, Homo Sapiens
WARFFSFSG

SEQ ID NO: 7211 - protein, 9 aa, Homo Sapiens
NIPEHIKGQ

SEQ ID NO: 7212 - protein, 9 aa, Homo Sapiens
DVLGLDISN

SEQ ID NO: 7213 - protein, 9 aa, Homo Sapiens
VSPAGQSST

SEQ ID NO: 7214 - protein, 9 aa, Homo Sapiens
NASGGSVVN

SEQ ID NO: 7215 - protein, 9 aa, Homo Sapiens
RLIEKTKVT

SEQ ID NO: 7216 - protein, 9 aa, Homo Sapiens
ITSLLVAMG

SEQ ID NO: 7217 - protein, 9 aa, Homo Sapiens
AHYQVPDAS

SEQ ID NO: 7218 - protein, 9 aa, Homo Sapiens
TFDIDVNGI

SEQ ID NO: 7219 - protein, 9 aa, Homo Sapiens
LAKVVCKEE

SEQ ID NO: 7220 - protein, 9 aa, Homo Sapiens
VLREFQVIR

SEQ ID NO: 7221 - protein, 9 aa, Homo Sapiens
PPFPPQSPA

SEQ ID NO: 7222 - protein, 9 aa, Homo Sapiens
FIFVAADEI

SEQ ID NO: 7223 - protein, 9 aa, Homo Sapiens
TKNTSNKIA

SEQ ID NO: 7224 - protein, 9 aa, Homo Sapiens
IAQIYIPAA

SEQ ID NO: 7225 - protein, 9 aa, Homo Sapiens
GPGVDAAGR

SEQ ID NO: 7226 - protein, 9 aa, Homo Sapiens
PVRRQGCRS

SEQ ID NO: 7227 - protein, 9 aa, Homo Sapiens
YRPHTAEKP

SEQ ID NO: 7228 - protein, 9 aa, Homo Sapiens
SEMITGDWL

SEQ ID NO: 7229 - protein, 9 aa, Homo Sapiens
REFQVIRDL

SEQ ID NO: 7230 - protein, 9 aa, Homo Sapiens
ASPWPVRRQ

SEQ ID NO: 7231 - protein, 9 aa, Homo Sapiens
EPEAGPVWG

SEQ ID NO: 7232 - protein, 9 aa, Homo Sapiens
CGNLLCSQH

SEQ ID NO: 7233 - protein, 9 aa, Homo Sapiens
FGGGRLAAG

SEQ ID NO: 7234 - protein, 9 aa, Homo Sapiens
LPATDFKVN

SEQ ID NO: 7235 - protein, 9 aa, Homo Sapiens
WQKDALHLL

SEQ ID NO: 7236 - protein, 9 aa, Homo Sapiens
PFMKSWGEE

SEQ ID NO: 7237 - protein, 9 aa, Homo Sapiens
VQATIDVYD

SEQ ID NO: 7238 - protein, 9 aa, Homo Sapiens
APHSGASSP

SEQ ID NO: 7239 - protein, 9 aa, Homo Sapiens
YRAQSTQYE

SEQ ID NO: 7240 - protein, 9 aa, Homo Sapiens
PQLQYDFQD

SEQ ID NO: 7241 - protein, 9 aa, Homo Sapiens
TDGAKYAEF

SEQ ID NO: 7242 - protein, 9 aa, Homo Sapiens
LIDHSCKEK

SEQ ID NO: 7243 - protein, 9 aa, Homo Sapiens
PGGCLAHRR

SEQ ID NO: 7244 - protein, 9 aa, Homo Sapiens
AVYFCAGIG

SEQ ID NO: 7245 - protein, 9 aa, Homo Sapiens
LVLVSVLAL

SEQ ID NO: 7246 - protein, 9 aa, Homo Sapiens
TLSPPNSKN

SEQ ID NO: 7247 - protein, 9 aa, Homo Sapiens
HVGLPPRDP

SEQ ID NO: 7248 - protein, 9 aa, Homo Sapiens
ASCCPWRRF

SEQ ID NO: 7249 - protein, 9 aa, Homo Sapiens
KLFHIDFRY

SEQ ID NO: 7250 - protein, 9 aa, Homo Sapiens
PHYIILRDV

SEQ ID NO: 7251 - protein, 9 aa, Homo Sapiens
IPSAARKWK

SEQ ID NO: 7252 - protein, 9 aa, Homo Sapiens
QDITTLITY

SEQ ID NO: 7253 - protein, 9 aa, Homo Sapiens
PTPRASPTA

SEQ ID NO: 7254 - protein, 9 aa, Homo Sapiens
LTESVAAPH

SEQ ID NO: 7255 - protein, 9 aa, Homo Sapiens
NRKLLQVGI

SEQ ID NO: 7256 - protein, 9 aa, Homo Sapiens
SSPCNLQTV

SEQ ID NO: 7257 - protein, 9 aa, Homo Sapiens
LNGEIYVTG

SEQ ID NO: 7258 - protein, 9 aa, Homo Sapiens
FEEREVNED

SEQ ID NO: 7259 - protein, 9 aa, Homo Sapiens
VCTGSVPVG

SEQ ID NO: 7260 - protein, 9 aa, Homo Sapiens
PYACGDCDK

SEQ ID NO: 7261 - protein, 9 aa, Homo Sapiens
EPMLCRMLI

SEQ ID NO: 7262 - protein, 9 aa, Homo Sapiens
FSSFPGVQS

SEQ ID NO: 7263 - protein, 9 aa, Homo Sapiens
DSAFSAADE

SEQ ID NO: 7264 - protein, 9 aa, Homo Sapiens
GPRGRGCGS

SEQ ID NO: 7265 - protein, 9 aa, Homo Sapiens
QHASHKLFP

SEQ ID NO: 7266 - protein, 9 aa, Homo Sapiens
RGAPGGAPR

SEQ ID NO: 7267 - protein, 9 aa, Homo Sapiens
DFQDKNHLY

SEQ ID NO: 7268 - protein, 9 aa, Homo Sapiens
EEFPFPHYI

SEQ ID NO: 7269 - protein, 9 aa, Homo Sapiens
SHSSSEHFL

SEQ ID NO: 7270 - protein, 9 aa, Homo Sapiens
FRIVNSKPQ

SEQ ID NO: 7271 - protein, 9 aa, Homo Sapiens
WVPAPAPVP

SEQ ID NO: 7272 - protein, 9 aa, Homo Sapiens
NELSTSGCD

SEQ ID NO: 7273 - protein, 9 aa, Homo Sapiens
ARRSWPGGC

SEQ ID NO: 7274 - protein, 9 aa, Homo Sapiens
KVVSPQEFK

SEQ ID NO: 7275 - protein, 9 aa, Homo Sapiens
LESVEEHNE

SEQ ID NO: 7276 - protein, 9 aa, Homo Sapiens
PPRDPVLSC

SEQ ID NO: 7277 - protein, 9 aa, Homo Sapiens
AAGAPPPPA

SEQ ID NO: 7278 - protein, 9 aa, Homo Sapiens
DCDKRFSVS

SEQ ID NO: 7279 - protein, 9 aa, Homo Sapiens
HLLLPSGMY

SEQ ID NO: 7280 - protein, 9 aa, Homo Sapiens
ISRLSSGEG

SEQ ID NO: 7281 - protein, 9 aa, Homo Sapiens
NRLLLAAAR

SEQ ID NO: 7282 - protein, 9 aa, Homo Sapiens
VVVFDEAHS

SEQ ID NO: 7283 - protein, 9 aa, Homo Sapiens
NLKDLQASI

SEQ ID NO: 7284 - protein, 9 aa, Homo Sapiens
SEGVPFSTV

SEQ ID NO: 7285 - protein, 9 aa, Homo Sapiens
CVPLCPSPE

SEQ ID NO: 7286 - protein, 9 aa, Homo Sapiens
ICDQNHTWL

SEQ ID NO: 7287 - protein, 9 aa, Homo Sapiens
VHPAGRCVL

SEQ ID NO: 7288 - protein, 9 aa, Homo Sapiens
IPQPQNKIQ

SEQ ID NO: 7289 - protein, 9 aa, Homo Sapiens
CFRHKPPVE

SEQ ID NO: 7290 - protein, 9 aa, Homo Sapiens
VAIKHVPVE

SEQ ID NO: 7291 - protein, 9 aa, Homo Sapiens
NIRWSDVAG

SEQ ID NO: 7292 - protein, 9 aa, Homo Sapiens
GEVPVGTQP

SEQ ID NO: 7293 - protein, 9 aa, Homo Sapiens
GSSSSINPG

SEQ ID NO: 7294 - protein, 9 aa, Homo Sapiens
GGRSARRSW

SEQ ID NO: 7295 - protein, 9 aa, Homo Sapiens
AHMRTGRPP

SEQ ID NO: 7296 - protein, 9 aa, Homo Sapiens
ECNTRGKFF

SEQ ID NO: 7297 - protein, 9 aa, Homo Sapiens
QPVTPEHTS

SEQ ID NO: 7298 - protein, 9 aa, Homo Sapiens
AGGEVPVGT

SEQ ID NO: 7299 - protein, 9 aa, Homo Sapiens
SGKLSMWSC

SEQ ID NO: 7300 - protein, 9 aa, Homo Sapiens
PPPAANTVV

SEQ ID NO: 7301 - protein, 9 aa, Homo Sapiens
GGTGSGRGT

SEQ ID NO: 7302 - protein, 9 aa, Homo Sapiens
NKTNIPEHI

SEQ ID NO: 7303 - protein, 9 aa, Homo Sapiens
ENDIKVDEV

SEQ ID NO: 7304 - protein, 9 aa, Homo Sapiens
SGCYIPRKP

SEQ ID NO: 7305 - protein, 9 aa, Homo Sapiens
LQYDFQDKN

SEQ ID NO: 7306 - protein, 9 aa, Homo Sapiens
LIASEDSPH

SEQ ID NO: 7307 - protein, 9 aa, Homo Sapiens
LTKKWCHTL

SEQ ID NO: 7308 - protein, 9 aa, Homo Sapiens
IPEHIKGQT

SEQ ID NO: 7309 - protein, 9 aa, Homo Sapiens
WNRHAGRFH

SEQ ID NO: 7310 - protein, 9 aa, Homo Sapiens
TGQPEDVTE

SEQ ID NO: 7311 - protein, 9 aa, Homo Sapiens
TGAAEKPTD

SEQ ID NO: 7312 - protein, 9 aa, Homo Sapiens
DPELDVLIT

SEQ ID NO: 7313 - protein, 9 aa, Homo Sapiens
PTSPSSPGA

SEQ ID NO: 7314 - protein, 9 aa, Homo Sapiens
DDFEDKYFT

SEQ ID NO: 7315 - protein, 9 aa, Homo Sapiens
SPCNLQTVN

SEQ ID NO: 7316 - protein, 9 aa, Homo Sapiens
STAVFEDSL

SEQ ID NO: 7317 - protein, 9 aa, Homo Sapiens
LLVAMGRSL

SEQ ID NO: 7318 - protein, 9 aa, Homo Sapiens
PLLFYIGGH

SEQ ID NO: 7319 - protein, 9 aa, Homo Sapiens
SGTDVKEEC

SEQ ID NO: 7320 - protein, 9 aa, Homo Sapiens
ASLERFSTC

SEQ ID NO: 7321 - protein, 9 aa, Homo Sapiens
SHDPRLLFG

SEQ ID NO: 7322 - protein, 9 aa, Homo Sapiens
NVAKIIQLY

SEQ ID NO: 7323 - protein, 9 aa, Homo Sapiens
LRIFWNFPG

SEQ ID NO: 7324 - protein, 9 aa, Homo Sapiens
SLDLTKKVH

SEQ ID NO: 7325 - protein, 9 aa, Homo Sapiens
FRTGQRSVQ

SEQ ID NO: 7326 - protein, 9 aa, Homo Sapiens
PLCTMFIIF

SEQ ID NO: 7327 - protein, 9 aa, Homo Sapiens
LFKHVVPMM

SEQ ID NO: 7328 - protein, 9 aa, Homo Sapiens
AIQANRSQL

SEQ ID NO: 7329 - protein, 9 aa, Homo Sapiens
LRAHMRTGR

SEQ ID NO: 7330 - protein, 9 aa, Homo Sapiens
DNTRTGANS

SEQ ID NO: 7331 - protein, 9 aa, Homo Sapiens
ETDGPVSDR

SEQ ID NO: 7332 - protein, 9 aa, Homo Sapiens
TRALLGTVT

SEQ ID NO: 7333 - protein, 9 aa, Homo Sapiens
FMSSAHVSH

SEQ ID NO: 7334 - protein, 9 aa, Homo Sapiens
LAHRRRDAQ

SEQ ID NO: 7335 - protein, 9 aa, Homo Sapiens
FQVIRDLVV

SEQ ID NO: 7336 - protein, 9 aa, Homo Sapiens
SDPPRSWVH

SEQ ID NO: 7337 - protein, 9 aa, Homo Sapiens
SVPESKLIF

SEQ ID NO: 7338 - protein, 9 aa, Homo Sapiens
GSSNMAVLQ

SEQ ID NO: 7339 - protein, 9 aa, Homo Sapiens
AGAGRGARG

SEQ ID NO: 7340 - protein, 9 aa, Homo Sapiens
VRLKLEDVA

SEQ ID NO: 7341 - protein, 9 aa, Homo Sapiens
TLRSPPTSA

SEQ ID NO: 7342 - protein, 9 aa, Homo Sapiens
YCALCEVAV

SEQ ID NO: 7343 - protein, 9 aa, Homo Sapiens
GPQNSLGRY

SEQ ID NO: 7344 - protein, 9 aa, Homo Sapiens
PEHFFCAQR

SEQ ID NO: 7345 - protein, 9 aa, Homo Sapiens
LAKGGICFT

SEQ ID NO: 7346 - protein, 9 aa, Homo Sapiens
LLLAAARRR

SEQ ID NO: 7347 - protein, 9 aa, Homo Sapiens
KNSQIGIAM

SEQ ID NO: 7348 - protein, 9 aa, Homo Sapiens
SQQLAVTGK

SEQ ID NO: 7349 - protein, 9 aa, Homo Sapiens
FMRKVQINN

SEQ ID NO: 7350 - protein, 9 aa, Homo Sapiens
RVRPKPRRE

SEQ ID NO: 7351 - protein, 9 aa, Homo Sapiens
TARTSPPCW

SEQ ID NO: 7352 - protein, 9 aa, Homo Sapiens
VISNIRHRC

SEQ ID NO: 7353 - protein, 9 aa, Homo Sapiens
IRIEYDTFG

SEQ ID NO: 7354 - protein, 9 aa, Homo Sapiens
KSAMATEFF

SEQ ID NO: 7355 - protein, 9 aa, Homo Sapiens
TLQNFCFHA

SEQ ID NO: 7356 - protein, 9 aa, Homo Sapiens
WGLIDPKRT

SEQ ID NO: 7357 - protein, 9 aa, Homo Sapiens
QKRIDLRPR

SEQ ID NO: 7358 - protein, 9 aa, Homo Sapiens
VNTSDYNSK

SEQ ID NO: 7359 - protein, 9 aa, Homo Sapiens
CPGSTMGYR

SEQ ID NO: 7360 - protein, 9 aa, Homo Sapiens
SAAVKGLLS

SEQ ID NO: 7361 - protein, 9 aa, Homo Sapiens
FAWGPLLFY

SEQ ID NO: 7362 - protein, 9 aa, Homo Sapiens
DKAFRLRQK

SEQ ID NO: 7363 - protein, 9 aa, Homo Sapiens
SGKKSSDSK

SEQ ID NO: 7364 - protein, 9 aa, Homo Sapiens
PSRAGVPRL

SEQ ID NO: 7365 - protein, 9 aa, Homo Sapiens
AAGRRQWGP

SEQ ID NO: 7366 - protein, 9 aa, Homo Sapiens
FSLQDDGLT

SEQ ID NO: 7367 - protein, 9 aa, Homo Sapiens
SGSEGVPFS

SEQ ID NO: 7368 - protein, 9 aa, Homo Sapiens
RISRLSSGE

SEQ ID NO: 7369 - protein, 9 aa, Homo Sapiens
LAQDPKKQL

SEQ ID NO: 7370 - protein, 9 aa, Homo Sapiens
TTASDKLQP

SEQ ID NO: 7371 - protein, 9 aa, Homo Sapiens
ESVEEHNEL

SEQ ID NO: 7372 - protein, 9 aa, Homo Sapiens
LSVPLSEQP

SEQ ID NO: 7373 - protein, 9 aa, Homo Sapiens
APCISCSPD

SEQ ID NO: 7374 - protein, 9 aa, Homo Sapiens
RSWVHACSP

SEQ ID NO: 7375 - protein, 9 aa, Homo Sapiens
IPIKGEFSR

SEQ ID NO: 7376 - protein, 9 aa, Homo Sapiens
QVQHLTWGL

SEQ ID NO: 7377 - protein, 9 aa, Homo Sapiens
GVPRLPEQG

SEQ ID NO: 7378 - protein, 9 aa, Homo Sapiens
IYDTHSLMY

SEQ ID NO: 7379 - protein, 9 aa, Homo Sapiens
CRLCAPLHK

SEQ ID NO: 7380 - protein, 9 aa, Homo Sapiens
VCKEKIGWQ

SEQ ID NO: 7381 - protein, 9 aa, Homo Sapiens
CWRWTVIYR

SEQ ID NO: 7382 - protein, 9 aa, Homo Sapiens
PGFDAELIL

SEQ ID NO: 7383 - protein, 9 aa, Homo Sapiens
PPTSACWRA

SEQ ID NO: 7384 - protein, 9 aa, Homo Sapiens
IMKVLLVCL

SEQ ID NO: 7385 - protein, 9 aa, Homo Sapiens
RMLIMSVHL

SEQ ID NO: 7386 - protein, 9 aa, Homo Sapiens
ETAGRSSQP

SEQ ID NO: 7387 - protein, 9 aa, Homo Sapiens
QAFQDGGQS

SEQ ID NO: 7388 - protein, 9 aa, Homo Sapiens
TGANSPEMW

SEQ ID NO: 7389 - protein, 9 aa, Homo Sapiens
LSVLTGHTD

SEQ ID NO: 7390 - protein, 9 aa, Homo Sapiens
VAGVARAGR

SEQ ID NO: 7391 - protein, 9 aa, Homo Sapiens
EVNVDVKDF

SEQ ID NO: 7392 - protein, 9 aa, Homo Sapiens
FKFNLTEDV

SEQ ID NO: 7393 - protein, 9 aa, Homo Sapiens
TELLAQVHL

SEQ ID NO: 7394 - protein, 9 aa, Homo Sapiens
PQNSLGRYL

SEQ ID NO: 7395 - protein, 9 aa, Homo Sapiens
FPNRSQLCA

SEQ ID NO: 7396 - protein, 9 aa, Homo Sapiens
ECPWTEPYT

SEQ ID NO: 7397 - protein, 9 aa, Homo Sapiens
DAIRIYRQS

SEQ ID NO: 7398 - protein, 9 aa, Homo Sapiens
EVFGRTGEL

SEQ ID NO: 7399 - protein, 9 aa, Homo Sapiens
HCRSRDFIP

SEQ ID NO: 7400 - protein, 9 aa, Homo Sapiens
IKNGLPATD

SEQ ID NO: 7401 - protein, 9 aa, Homo Sapiens
KGDTEPESP

SEQ ID NO: 7402 - protein, 9 aa, Homo Sapiens
SVAAPHSGA

SEQ ID NO: 7403 - protein, 9 aa, Homo Sapiens
TVERLLEPV

SEQ ID NO: 7404 - protein, 9 aa, Homo Sapiens
ILKNMFTNQ

SEQ ID NO: 7405 - protein, 9 aa, Homo Sapiens
SPGEPGWAA

SEQ ID NO: 7406 - protein, 9 aa, Homo Sapiens
YECGHGRFQ

SEQ ID NO: 7407 - protein, 9 aa, Homo Sapiens
GFDAELILK

SEQ ID NO: 7408 - protein, 9 aa, Homo Sapiens
LCRMLIMSV

SEQ ID NO: 7409 - protein, 9 aa, Homo Sapiens
LVKKEELTP

SEQ ID NO: 7410 - protein, 9 aa, Homo Sapiens
AECDEYCIQ

SEQ ID NO: 7411 - protein, 9 aa, Homo Sapiens
MKKNSQIGI

SEQ ID NO: 7412 - protein, 9 aa, Homo Sapiens
EPPLVGPKA

SEQ ID NO: 7413 - protein, 9 aa, Homo Sapiens
HAGRFHLLY

SEQ ID NO: 7414 - protein, 9 aa, Homo Sapiens
HSPGQGSLC

SEQ ID NO: 7415 - protein, 9 aa, Homo Sapiens
TYNYFINKE

SEQ ID NO: 7416 - protein, 9 aa, Homo Sapiens
QFLDVDFQK

SEQ ID NO: 7417 - protein, 9 aa, Homo Sapiens
RGKFFRYSS

SEQ ID NO: 7418 - protein, 9 aa, Homo Sapiens
CRCSIEEKV

SEQ ID NO: 7419 - protein, 9 aa, Homo Sapiens
ASRGAPGGA

SEQ ID NO: 7420 - protein, 9 aa, Homo Sapiens
NVGFKLIAR

SEQ ID NO: 7421 - protein, 9 aa, Homo Sapiens
LSLPSSGDY

SEQ ID NO: 7422 - protein, 9 aa, Homo Sapiens
HVTEGSGCY

SEQ ID NO: 7423 - protein, 9 aa, Homo Sapiens
IDLDVTAEG

SEQ ID NO: 7424 - protein, 9 aa, Homo Sapiens
TDFKFRLAK

SEQ ID NO: 7425 - protein, 9 aa, Homo Sapiens
RQWGPRGRG

SEQ ID NO: 7426 - protein, 9 aa, Homo Sapiens
GASVGSPAA

SEQ ID NO: 7427 - protein, 9 aa, Homo Sapiens
MGYRAQSTQ

SEQ ID NO: 7428 - protein, 9 aa, Homo Sapiens
PYKMIINLA

SEQ ID NO: 7429 - protein, 9 aa, Homo Sapiens
AHTAAPAQR

SEQ ID NO: 7430 - protein, 9 aa, Homo Sapiens
YVKELEEVL

SEQ ID NO: 7431 - protein, 9 aa, Homo Sapiens
RGASVGSPA

SEQ ID NO: 7432 - protein, 9 aa, Homo Sapiens
NSQLARHAS

SEQ ID NO: 7433 - protein, 9 aa, Homo Sapiens
SCNELSTSG

SEQ ID NO: 7434 - protein, 9 aa, Homo Sapiens
SVLTPYYRK

SEQ ID NO: 7435 - protein, 9 aa, Homo Sapiens
VERLLEPVV

SEQ ID NO: 7436 - protein, 9 aa, Homo Sapiens
FLLKFTVPQ

SEQ ID NO: 7437 - protein, 9 aa, Homo Sapiens
QLLEEMLLK

SEQ ID NO: 7438 - protein, 9 aa, Homo Sapiens
EREIARDIK

SEQ ID NO: 7439 - protein, 9 aa, Homo Sapiens
MAVKPSNLY

SEQ ID NO: 7440 - protein, 9 aa, Homo Sapiens
NDTGNISSK

SEQ ID NO: 7441 - protein, 9 aa, Homo Sapiens
LLSVPLSEQ

SEQ ID NO: 7442 - protein, 9 aa, Homo Sapiens
SLNRLLLAA

SEQ ID NO: 7443 - protein, 9 aa, Homo Sapiens
FRHRSNLIC

SEQ ID NO: 7444 - protein, 9 aa, Homo Sapiens
SLQGSSVLS

SEQ ID NO: 7445 - protein, 9 aa, Homo Sapiens
LYMALLALC

SEQ ID NO: 7446 - protein, 9 aa, Homo Sapiens
LPAPSRAGV

SEQ ID NO: 7447 - protein, 9 aa, Homo Sapiens
QNSLGRYLE

SEQ ID NO: 7448 - protein, 9 aa, Homo Sapiens
SMLLCSSPN

SEQ ID NO: 7449 - protein, 9 aa, Homo Sapiens
MKSWGEESL

SEQ ID NO: 7450 - protein, 9 aa, Homo Sapiens
EEHNELMVR

SEQ ID NO: 7451 - protein, 9 aa, Homo Sapiens
NKVVQYSLI

SEQ ID NO: 7452 - protein, 9 aa, Homo Sapiens
DEDCMPAQS

SEQ ID NO: 7453 - protein, 9 aa, Homo Sapiens
RFEKLAQDP

SEQ ID NO: 7454 - protein, 9 aa, Homo Sapiens
PAWGDRGER

SEQ ID NO: 7455 - protein, 9 aa, Homo Sapiens
ATALKSRAH

SEQ ID NO: 7456 - protein, 9 aa, Homo Sapiens
PRDREPYTK

SEQ ID NO: 7457 - protein, 9 aa, Homo Sapiens
PGQGSLCFR

SEQ ID NO: 7458 - protein, 9 aa, Homo Sapiens
PCHSGSNLK

SEQ ID NO: 7459 - protein, 9 aa, Homo Sapiens
GASCCPWRR

SEQ ID NO: 7460 - protein, 9 aa, Homo Sapiens
PWRRFCATL

SEQ ID NO: 7461 - protein, 9 aa, Homo Sapiens
PFPSSLCFL

SEQ ID NO: 7462 - protein, 9 aa, Homo Sapiens
YMEEFPFPH

SEQ ID NO: 7463 - protein, 9 aa, Homo Sapiens
QKKNTICLL

SEQ ID NO: 7464 - protein, 9 aa, Homo Sapiens
HVPVESDLQ

SEQ ID NO: 7465 - protein, 9 aa, Homo Sapiens
RSGQDPAGA

SEQ ID NO: 7466 - protein, 9 aa, Homo Sapiens
HTICDQNHT

SEQ ID NO: 7467 - protein, 9 aa, Homo Sapiens
LERFSTCTS

SEQ ID NO: 7468 - protein, 9 aa, Homo Sapiens
FGHYSRAYF

SEQ ID NO: 7469 - protein, 9 aa, Homo Sapiens
ALIASEDSP

SEQ ID NO: 7470 - protein, 9 aa, Homo Sapiens
VELSEQSLR

SEQ ID NO: 7471 - protein, 9 aa, Homo Sapiens
EQEPVADSL

SEQ ID NO: 7472 - protein, 9 aa, Homo Sapiens
NVFSKTCST

SEQ ID NO: 7473 - protein, 9 aa, Homo Sapiens
ADSLQGSSV

SEQ ID NO: 7474 - protein, 9 aa, Homo Sapiens
VYDDESTES

SEQ ID NO: 7475 - protein, 9 aa, Homo Sapiens
CFSYTHMVC

SEQ ID NO: 7476 - protein, 9 aa, Homo Sapiens
SCVPLCPSP

SEQ ID NO: 7477 - protein, 9 aa, Homo Sapiens
IVDSKYRLK

SEQ ID NO: 7478 - protein, 9 aa, Homo Sapiens
STLCFSYTH

SEQ ID NO: 7479 - protein, 9 aa, Homo Sapiens
MRKVQINNK

SEQ ID NO: 7480 - protein, 9 aa, Homo Sapiens
GGVEEQLAQ

SEQ ID NO: 7481 - protein, 9 aa, Homo Sapiens
GGSVVNSCM

SEQ ID NO: 7482 - protein, 9 aa, Homo Sapiens
ICIQISWDR

SEQ ID NO: 7483 - protein, 9 aa, Homo Sapiens
VADSLQGSS

SEQ ID NO: 7484 - protein, 9 aa, Homo Sapiens
LLRGGSSSS

SEQ ID NO: 7485 - protein, 9 aa, Homo Sapiens
KGLSRTETA

SEQ ID NO: 7486 - protein, 9 aa, Homo Sapiens
YEFKKSAKT

SEQ ID NO: 7487 - protein, 9 aa, Homo Sapiens
GGRLAAGAP

SEQ ID NO: 7488 - protein, 9 aa, Homo Sapiens
QPSVQSMGI

SEQ ID NO: 7489 - protein, 9 aa, Homo Sapiens
IYEFKKSAK

SEQ ID NO: 7490 - protein, 9 aa, Homo Sapiens
SVQSMGIPA

SEQ ID NO: 7491 - protein, 9 aa, Homo Sapiens
TICDQNHTW

SEQ ID NO: 7492 - protein, 9 aa, Homo Sapiens
VTFDIDVNG

SEQ ID NO: 7493 - protein, 9 aa, Homo Sapiens
PCVIQFVGT

SEQ ID NO: 7494 - protein, 9 aa, Homo Sapiens
MSWVWARFF

SEQ ID NO: 7495 - protein, 9 aa, Homo Sapiens
LTKKVHVTE

SEQ ID NO: 7496 - protein, 9 aa, Homo Sapiens
DPKKQLEIL

SEQ ID NO: 7497 - protein, 9 aa, Homo Sapiens
PAANTVVEN

SEQ ID NO: 7498 - protein, 9 aa, Homo Sapiens
AFQDGGQSK

SEQ ID NO: 7499 - protein, 9 aa, Homo Sapiens
ELINTKNTS

SEQ ID NO: 7500 - protein, 9 aa, Homo Sapiens
VYHPSAALM

SEQ ID NO: 7501 - protein, 9 aa, Homo Sapiens
GGCLAHRRR

SEQ ID NO: 7502 - protein, 9 aa, Homo Sapiens
DVCKRVNQD

SEQ ID NO: 7503 - protein, 9 aa, Homo Sapiens
YACGDCDKR

SEQ ID NO: 7504 - protein, 9 aa, Homo Sapiens
PDRAGLSGA

SEQ ID NO: 7505 - protein, 9 aa, Homo Sapiens
TLALLTRRA

SEQ ID NO: 7506 - protein, 9 aa, Homo Sapiens
SEYLIQQAV

SEQ ID NO: 7507 - protein, 9 aa, Homo Sapiens
PPLPQLLSV

SEQ ID NO: 7508 - protein, 9 aa, Homo Sapiens
VDAAGRRQW

SEQ ID NO: 7509 - protein, 9 aa, Homo Sapiens
PWRGASVGS

SEQ ID NO: 7510 - protein, 9 aa, Homo Sapiens
PVQATIDVY

SEQ ID NO: 7511 - protein, 9 aa, Homo Sapiens
DKRFSVSSN

SEQ ID NO: 7512 - protein, 9 aa, Homo Sapiens
IASEDSPHC

SEQ ID NO: 7513 - protein, 9 aa, Homo Sapiens
QQQHQHQHQ

SEQ ID NO: 7514 - protein, 9 aa, Homo Sapiens
VPDASVVAL

SEQ ID NO: 7515 - protein, 9 aa, Homo Sapiens
YQVPDASVV

SEQ ID NO: 7516 - protein, 9 aa, Homo Sapiens
ARRRVAGVA

SEQ ID NO: 7517 - protein, 9 aa, Homo Sapiens
IRDLVVSVL

SEQ ID NO: 7518 - protein, 9 aa, Homo Sapiens
RLLYSSLCK

SEQ ID NO: 7519 - protein, 9 aa, Homo Sapiens
KAECDEYCI

SEQ ID NO: 7520 - protein, 9 aa, Homo Sapiens
FDAELILKN

SEQ ID NO: 7521 - protein, 9 aa, Homo Sapiens
RLHSGEKSF

SEQ ID NO: 7522 - protein, 9 aa, Homo Sapiens
PPARLAPSS

SEQ ID NO: 7523 - protein, 9 aa, Homo Sapiens
KSIDIRCKI

SEQ ID NO: 7524 - protein, 9 aa, Homo Sapiens
REIARDIKE

SEQ ID NO: 7525 - protein, 9 aa, Homo Sapiens
IGGVEEQLA

SEQ ID NO: 7526 - protein, 9 aa, Homo Sapiens
GGTDGNELT

SEQ ID NO: 7527 - protein, 9 aa, Homo Sapiens
DDRNTFRRS

SEQ ID NO: 7528 - protein, 9 aa, Homo Sapiens
LKFTVPQYV

SEQ ID NO: 7529 - protein, 9 aa, Homo Sapiens
CKERIRTLS

SEQ ID NO: 7530 - protein, 9 aa, Homo Sapiens
KAPCISCSP

SEQ ID NO: 7531 - protein, 9 aa, Homo Sapiens
GFSLQDDGL

SEQ ID NO: 7532 - protein, 9 aa, Homo Sapiens
RLESVEEHN

SEQ ID NO: 7533 - protein, 9 aa, Homo Sapiens
KSFKCVECG

SEQ ID NO: 7534 - protein, 9 aa, Homo Sapiens
YVTGGTTLD

SEQ ID NO: 7535 - protein, 9 aa, Homo Sapiens
LFGHYSRAY

SEQ ID NO: 7536 - protein, 9 aa, Homo Sapiens
IATKRMAVK

SEQ ID NO: 7537 - protein, 9 aa, Homo Sapiens
PMVTHPIAS

SEQ ID NO: 7538 - protein, 9 aa, Homo Sapiens
SLCFRHKPP

SEQ ID NO: 7539 - protein, 9 aa, Homo Sapiens
AKIIQLYSV

SEQ ID NO: 7540 - protein, 9 aa, Homo Sapiens
EGNTQLLQK

SEQ ID NO: 7541 - protein, 9 aa, Homo Sapiens
VKKSIDIRC

SEQ ID NO: 7542 - protein, 9 aa, Homo Sapiens
SKYAKDIFG

SEQ ID NO: 7543 - protein, 9 aa, Homo Sapiens
FDEAHSIDN

SEQ ID NO: 7544 - protein, 9 aa, Homo Sapiens
LCPSPEPKV

SEQ ID NO: 7545 - protein, 9 aa, Homo Sapiens
DCLTTASDK

SEQ ID NO: 7546 - protein, 9 aa, Homo Sapiens
CKSLIEGPD

SEQ ID NO: 7547 - protein, 9 aa, Homo Sapiens
DLAKVVCKE

SEQ ID NO: 7548 - protein, 9 aa, Homo Sapiens
VSDPPRSWV

SEQ ID NO: 7549 - protein, 9 aa, Homo Sapiens
VSVLALGTL

SEQ ID NO: 7550 - protein, 9 aa, Homo Sapiens
RRQWGPRGR

SEQ ID NO: 7551 - protein, 9 aa, Homo Sapiens
TCTSDKDEN

SEQ ID NO: 7552 - protein, 9 aa, Homo Sapiens
AHGESSLAS

SEQ ID NO: 7553 - protein, 9 aa, Homo Sapiens
SPAAARGAP

SEQ ID NO: 7554 - protein, 9 aa, Homo Sapiens
TASDKLQPS

SEQ ID NO: 7555 - protein, 9 aa, Homo Sapiens
GSSEYSKAE

SEQ ID NO: 7556 - protein, 9 aa, Homo Sapiens
ILFAWGPLL

SEQ ID NO: 7557 - protein, 9 aa, Homo Sapiens
SCLSLPSSG

SEQ ID NO: 7558 - protein, 9 aa, Homo Sapiens
SVSEVNVDV

SEQ ID NO: 7559 - protein, 9 aa, Homo Sapiens
TPLMLSVLT

SEQ ID NO: 7560 - protein, 9 aa, Homo Sapiens
SMWSCKSLI

SEQ ID NO: 7561 - protein, 9 aa, Homo Sapiens
DREPYTKVR

SEQ ID NO: 7562 - protein, 9 aa, Homo Sapiens
FLNMSDNIT

SEQ ID NO: 7563 - protein, 9 aa, Homo Sapiens
GGIICIVIF

SEQ ID NO: 7564 - protein, 9 aa, Homo Sapiens
EVTFDIDVN

SEQ ID NO: 7565 - protein, 9 aa, Homo Sapiens
KGNHKTPSS

SEQ ID NO: 7566 - protein, 9 aa, Homo Sapiens
VTGGTTLDV

SEQ ID NO: 7567 - protein, 9 aa, Homo Sapiens
QRPGAAGFP

SEQ ID NO: 7568 - protein, 9 aa, Homo Sapiens
GDCDKRFSV

SEQ ID NO: 7569 - protein, 9 aa, Homo Sapiens
GPRGGRSAR

SEQ ID NO: 7570 - protein, 9 aa, Homo Sapiens
VCKEESIVS

SEQ ID NO: 7571 - protein, 9 aa, Homo Sapiens
NRDDAKYMY

SEQ ID NO: 7572 - protein, 9 aa, Homo Sapiens
PYTKVRTCM

SEQ ID NO: 7573 - protein, 9 aa, Homo Sapiens
TFRKVVSPQ

SEQ ID NO: 7574 - protein, 9 aa, Homo Sapiens
VLRIPSAAR

SEQ ID NO: 7575 - protein, 9 aa, Homo Sapiens
RSNPVLHID

SEQ ID NO: 7576 - protein, 9 aa, Homo Sapiens
LSFRIVNSK

SEQ ID NO: 7577 - protein, 9 aa, Homo Sapiens
ARPGTGQPR

SEQ ID NO: 7578 - protein, 9 aa, Homo Sapiens
GRRQWGPRG

SEQ ID NO: 7579 - protein, 9 aa, Homo Sapiens
KYFTGLSFR

SEQ ID NO: 7580 - protein, 9 aa, Homo Sapiens
TGRNECDMC

SEQ ID NO: 7581 - protein, 9 aa, Homo Sapiens
AAGFPAWGD

SEQ ID NO: 7582 - protein, 9 aa, Homo Sapiens
RWSDVAGLE

SEQ ID NO: 7583 - protein, 9 aa, Homo Sapiens
LSEQSLREL

SEQ ID NO: 7584 - protein, 9 aa, Homo Sapiens
AKTEGPGDV

SEQ ID NO: 7585 - protein, 9 aa, Homo Sapiens
SLHHHMQVR

SEQ ID NO: 7586 - protein, 9 aa, Homo Sapiens
QQPSSQMPA

SEQ ID NO: 7587 - protein, 9 aa, Homo Sapiens
YVGDYPSKR

SEQ ID NO: 7588 - protein, 9 aa, Homo Sapiens
GAAVFDALV

SEQ ID NO: 7589 - protein, 9 aa, Homo Sapiens
SSSINPGIG

SEQ ID NO: 7590 - protein, 9 aa, Homo Sapiens
PHIPVISIV

SEQ ID NO: 7591 - protein, 9 aa, Homo Sapiens
WGDRGERAA

SEQ ID NO: 7592 - protein, 9 aa, Homo Sapiens
NFLDGSDVS

SEQ ID NO: 7593 - protein, 9 aa, Homo Sapiens
VGFKLIART

SEQ ID NO: 7594 - protein, 9 aa, Homo Sapiens
DVGQEPGPR

SEQ ID NO: 7595 - protein, 9 aa, Homo Sapiens
AQRCAGFRA

SEQ ID NO: 7596 - protein, 9 aa, Homo Sapiens
KIDLDVTAE

SEQ ID NO: 7597 - protein, 9 aa, Homo Sapiens
EHFFCAQRG

SEQ ID NO: 7598 - protein, 9 aa, Homo Sapiens
APGRSFGGG

SEQ ID NO: 7599 - protein, 9 aa, Homo Sapiens
ELDVLITPS

SEQ ID NO: 7600 - protein, 9 aa, Homo Sapiens
RFYEPQKLT

SEQ ID NO: 7601 - protein, 9 aa, Homo Sapiens
LLCSSPNRP

SEQ ID NO: 7602 - protein, 9 aa, Homo Sapiens
ACAPTRQGG

SEQ ID NO: 7603 - protein, 9 aa, Homo Sapiens
FLFDFQKTE

SEQ ID NO: 7604 - protein, 9 aa, Homo Sapiens
SIEEKVTEM

SEQ ID NO: 7605 - protein, 9 aa, Homo Sapiens
AFRRFSYLT

SEQ ID NO: 7606 - protein, 9 aa, Homo Sapiens
RPNQCADCG

SEQ ID NO: 7607 - protein, 9 aa, Homo Sapiens
EFQVIRDLV

SEQ ID NO: 7608 - protein, 9 aa, Homo Sapiens
VSLVPHIPV

SEQ ID NO: 7609 - protein, 9 aa, Homo Sapiens
GAPGGAPRS

SEQ ID NO: 7610 - protein, 9 aa, Homo Sapiens
YAEFIVVRE

SEQ ID NO: 7611 - protein, 9 aa, Homo Sapiens
RIFWNFPGI

SEQ ID NO: 7612 - protein, 9 aa, Homo Sapiens
KNIRYEELR

SEQ ID NO: 7613 - protein, 9 aa, Homo Sapiens
GNISSKVEL

SEQ ID NO: 7614 - protein, 9 aa, Homo Sapiens
DYHFHECVN

SEQ ID NO: 7615 - protein, 9 aa, Homo Sapiens
KKMVNKVVQ

SEQ ID NO: 7616 - protein, 9 aa, Homo Sapiens
YSKAECDEY

SEQ ID NO: 7617 - protein, 9 aa, Homo Sapiens
QTTRQCECR

SEQ ID NO: 7618 - protein, 9 aa, Homo Sapiens
CDQNHTWLP

SEQ ID NO: 7619 - protein, 9 aa, Homo Sapiens
LATHTICDQ

SEQ ID NO: 7620 - protein, 9 aa, Homo Sapiens
TYWANLPTP

SEQ ID NO: 7621 - protein, 9 aa, Homo Sapiens
SNTTEAMSG

SEQ ID NO: 7622 - protein, 9 aa, Homo Sapiens
AKRLLYSSL

SEQ ID NO: 7623 - protein, 9 aa, Homo Sapiens
NRPPRCPLV

SEQ ID NO: 7624 - protein, 9 aa, Homo Sapiens
GAPGRSFGG

SEQ ID NO: 7625 - protein, 9 aa, Homo Sapiens
SNTPLVRIS

SEQ ID NO: 7626 - protein, 9 aa, Homo Sapiens
YLVPKRYRI

SEQ ID NO: 7627 - protein, 9 aa, Homo Sapiens
FLDGSDVSE

SEQ ID NO: 7628 - protein, 9 aa, Homo Sapiens
QAVHGNLQK

SEQ ID NO: 7629 - protein, 9 aa, Homo Sapiens
YHPSAALMA

SEQ ID NO: 7630 - protein, 9 aa, Homo Sapiens
GRGAAGSQR

SEQ ID NO: 7631 - protein, 9 aa, Homo Sapiens
TDSLELDEE

SEQ ID NO: 7632 - protein, 9 aa, Homo Sapiens
TEAMSGSGV

SEQ ID NO: 7633 - protein, 9 aa, Homo Sapiens
LLIGASCCP

SEQ ID NO: 7634 - protein, 9 aa, Homo Sapiens
DQPVTPEHT

SEQ ID NO: 7635 - protein, 9 aa, Homo Sapiens
GSQRPGAAG

SEQ ID NO: 7636 - protein, 9 aa, Homo Sapiens
TEGKLSVPE

SEQ ID NO: 7637 - protein, 9 aa, Homo Sapiens
VPLCPSPEP

SEQ ID NO: 7638 - protein, 9 aa, Homo Sapiens
SSEYSKAEC

SEQ ID NO: 7639 - protein, 9 aa, Homo Sapiens
LQRNRRWNS

SEQ ID NO: 7640 - protein, 9 aa, Homo Sapiens
PAPPLPQLL

SEQ ID NO: 7641 - protein, 9 aa, Homo Sapiens
CTSDKDENK

SEQ ID NO: 7642 - protein, 9 aa, Homo Sapiens
KRLLYSSLC

SEQ ID NO: 7643 - protein, 9 aa, Homo Sapiens
WGPRGRGCG

SEQ ID NO: 7644 - protein, 9 aa, Homo Sapiens
GRDGRLVSP

SEQ ID NO: 7645 - protein, 9 aa, Homo Sapiens
IMYECGHGR

SEQ ID NO: 7646 - protein, 9 aa, Homo Sapiens
PALIASEDS

SEQ ID NO: 7647 - protein, 9 aa, Homo Sapiens
ESSPRKGNK

SEQ ID NO: 7648 - protein, 9 aa, Homo Sapiens
MNLQNRKLL

SEQ ID NO: 7649 - protein, 9 aa, Homo Sapiens
SSQMPACYC

SEQ ID NO: 7650 - protein, 9 aa, Homo Sapiens
ECVNVQEFE

SEQ ID NO: 7651 - protein, 9 aa, Homo Sapiens
LNYKKETPL

SEQ ID NO: 7652 - protein, 9 aa, Homo Sapiens
VARAGRRAR

SEQ ID NO: 7653 - protein, 9 aa, Homo Sapiens
VGLPPRDPV

SEQ ID NO: 7654 - protein, 9 aa, Homo Sapiens
AWGVLLLLG

SEQ ID NO: 7655 - protein, 9 aa, Homo Sapiens
EIPYLRKEA

SEQ ID NO: 7656 - protein, 9 aa, Homo Sapiens
RTTSRPPNH

SEQ ID NO: 7657 - protein, 9 aa, Homo Sapiens
CQACPANSH

SEQ ID NO: 7658 - protein, 9 aa, Homo Sapiens
TEFFDSLKQ

SEQ ID NO: 7659 - protein, 9 aa, Homo Sapiens
AIVYHPSAA

SEQ ID NO: 7660 - protein, 9 aa, Homo Sapiens
PGLPGALGP

SEQ ID NO: 7661 - protein, 9 aa, Homo Sapiens
CNQTTRQCE

SEQ ID NO: 7662 - protein, 9 aa, Homo Sapiens
RASPTARTS

SEQ ID NO: 7663 - protein, 9 aa, Homo Sapiens
YYRKVDFEC

SEQ ID NO: 7664 - protein, 9 aa, Homo Sapiens
IQFVGTCLN

SEQ ID NO: 7665 - protein, 9 aa, Homo Sapiens
LVPHIPVIS

SEQ ID NO: 7666 - protein, 9 aa, Homo Sapiens
TCSTKVKWE

SEQ ID NO: 7667 - protein, 9 aa, Homo Sapiens
LDISNLSQY

SEQ ID NO: 7668 - protein, 9 aa, Homo Sapiens
KEAPQDVSS

SEQ ID NO: 7669 - protein, 9 aa, Homo Sapiens
VAKIIQLYS

SEQ ID NO: 7670 - protein, 9 aa, Homo Sapiens
VDSKYRLKH

SEQ ID NO: 7671 - protein, 9 aa, Homo Sapiens
VGHCPSCQP

SEQ ID NO: 7672 - protein, 9 aa, Homo Sapiens
EIYVTGGTT

SEQ ID NO: 7673 - protein, 9 aa, Homo Sapiens
LTEDVYSQD

SEQ ID NO: 7674 - protein, 9 aa, Homo Sapiens
PAFTDAIRI

SEQ ID NO: 7675 - protein, 9 aa, Homo Sapiens
WIPQLQYDF

SEQ ID NO: 7676 - protein, 9 aa, Homo Sapiens
LCSQHRATY

SEQ ID NO: 7677 - protein, 9 aa, Homo Sapiens
VSTFAKTEG

SEQ ID NO: 7678 - protein, 9 aa, Homo Sapiens
GTGNYCLQI

SEQ ID NO: 7679 - protein, 9 aa, Homo Sapiens
TDFKVNAQF

SEQ ID NO: 7680 - protein, 9 aa, Homo Sapiens
AVSKNVAKI

SEQ ID NO: 7681 - protein, 9 aa, Homo Sapiens
GAVACAPTR

SEQ ID NO: 7682 - protein, 9 aa, Homo Sapiens
GEIYVTGGT

SEQ ID NO: 7683 - protein, 9 aa, Homo Sapiens
SRWAGHPSY

SEQ ID NO: 7684 - protein, 9 aa, Homo Sapiens
EQFLDVDFQ

SEQ ID NO: 7685 - protein, 9 aa, Homo Sapiens
SPEEKPLRT

SEQ ID NO: 7686 - protein, 9 aa, Homo Sapiens
RNCHCRIGW

SEQ ID NO: 7687 - protein, 9 aa, Homo Sapiens
GERPNQCAD

SEQ ID NO: 7688 - protein, 9 aa, Homo Sapiens
TAAPAQRCA

SEQ ID NO: 7689 - protein, 9 aa, Homo Sapiens
LEGRRPQTP

SEQ ID NO: 7690 - protein, 9 aa, Homo Sapiens
RFHLLYGKR

SEQ ID NO: 7691 - protein, 9 aa, Homo Sapiens
GGGTGAAEK

SEQ ID NO: 7692 - protein, 9 aa, Homo Sapiens
FQETLESLW

SEQ ID NO: 7693 - protein, 9 aa, Homo Sapiens
KLAQDPKKQ

SEQ ID NO: 7694 - protein, 9 aa, Homo Sapiens
ETPAMARTS

SEQ ID NO: 7695 - protein, 9 aa, Homo Sapiens
AMATEFFDS

SEQ ID NO: 7696 - protein, 9 aa, Homo Sapiens
YGRACRLKS

SEQ ID NO: 7697 - protein, 9 aa, Homo Sapiens
MSQLLEEML

SEQ ID NO: 7698 - protein, 9 aa, Homo Sapiens
THPIASQSM

SEQ ID NO: 7699 - protein, 9 aa, Homo Sapiens
SGASRGAPG

SEQ ID NO: 7700 - protein, 9 aa, Homo Sapiens
CSIEEKVTE

SEQ ID NO: 7701 - protein, 9 aa, Homo Sapiens
RNHCQNRDV

SEQ ID NO: 7702 - protein, 9 aa, Homo Sapiens
RNREVFGRT

SEQ ID NO: 7703 - protein, 9 aa, Homo Sapiens
NPICIQISW

SEQ ID NO: 7704 - protein, 9 aa, Homo Sapiens
PSMPALIAS

SEQ ID NO: 7705 - protein, 9 aa, Homo Sapiens
RVNQDITTL

SEQ ID NO: 7706 - protein, 9 aa, Homo Sapiens
FMLNSTLCF

SEQ ID NO: 7707 - protein, 9 aa, Homo Sapiens
EIWKSRSNP

SEQ ID NO: 7708 - protein, 9 aa, Homo Sapiens
GWDHNYDYW

SEQ ID NO: 7709 - protein, 9 aa, Homo Sapiens
IDHSCKEKC

SEQ ID NO: 7710 - protein, 9 aa, Homo Sapiens
SGSNLKETG

SEQ ID NO: 7711 - protein, 9 aa, Homo Sapiens
RDGRLVSPA

SEQ ID NO: 7712 - protein, 9 aa, Homo Sapiens
SPSSPGAVA

SEQ ID NO: 7713 - protein, 9 aa, Homo Sapiens
KNVAKIIQL

SEQ ID NO: 7714 - protein, 9 aa, Homo Sapiens
FFDSLKQYE

SEQ ID NO: 7715 - protein, 9 aa, Homo Sapiens
AARKWKAFS

SEQ ID NO: 7716 - protein, 9 aa, Homo Sapiens
ALVSEAESG

SEQ ID NO: 7717 - protein, 9 aa, Homo Sapiens
YHFHECVNV

SEQ ID NO: 7718 - protein, 9 aa, Homo Sapiens
HTLQNFCFH

SEQ ID NO: 7719 - protein, 9 aa, Homo Sapiens
QKPIPQPQN

SEQ ID NO: 7720 - protein, 9 aa, Homo Sapiens
GSGPQNSLG

SEQ ID NO: 7721 - protein, 9 aa, Homo Sapiens
RFFSFSGSG

SEQ ID NO: 7722 - protein, 9 aa, Homo Sapiens
DVYSQDSID

SEQ ID NO: 7723 - protein, 9 aa, Homo Sapiens
DVKDFLMSI

SEQ ID NO: 7724 - protein, 9 aa, Homo Sapiens
DLQASIDTL

SEQ ID NO: 7725 - protein, 9 aa, Homo Sapiens
SVEEHNELM

SEQ ID NO: 7726 - protein, 9 aa, Homo Sapiens
ESSLASSQA

SEQ ID NO: 7727 - protein, 9 aa, Homo Sapiens
HGPCHSGSN

SEQ ID NO: 7728 - protein, 9 aa, Homo Sapiens
VKGLLSHER

SEQ ID NO: 7729 - protein, 9 aa, Homo Sapiens
EVANPPATK

SEQ ID NO: 7730 - protein, 9 aa, Homo Sapiens
RNTFRRSVV

SEQ ID NO: 7731 - protein, 9 aa, Homo Sapiens
TQPPLPGRD

SEQ ID NO: 7732 - protein, 9 aa, Homo Sapiens
EYGRACRLK

SEQ ID NO: 7733 - protein, 9 aa, Homo Sapiens
EKLAQDPKK

SEQ ID NO: 7734 - protein, 9 aa, Homo Sapiens
RPSLSTAVF

SEQ ID NO: 7735 - protein, 9 aa, Homo Sapiens
SPDGCVLVG

SEQ ID NO: 7736 - protein, 9 aa, Homo Sapiens
TGGPQHWHD

SEQ ID NO: 7737 - protein, 9 aa, Homo Sapiens
PKKQLEILQ

SEQ ID NO: 7738 - protein, 9 aa, Homo Sapiens
LLTRRASQS

SEQ ID NO: 7739 - protein, 9 aa, Homo Sapiens
GYRAQSTQY

SEQ ID NO: 7740 - protein, 9 aa, Homo Sapiens
RYILGRDPK

SEQ ID NO: 7741 - protein, 9 aa, Homo Sapiens
REEPLLALL

SEQ ID NO: 7742 - protein, 9 aa, Homo Sapiens
LPDFSSIIQ

SEQ ID NO: 7743 - protein, 9 aa, Homo Sapiens
AQLRPGQKI

SEQ ID NO: 7744 - protein, 9 aa, Homo Sapiens
FDALVSEAE

SEQ ID NO: 7745 - protein, 9 aa, Homo Sapiens
SSLLTQAGF

SEQ ID NO: 7746 - protein, 9 aa, Homo Sapiens
NTQLLQKVK

SEQ ID NO: 7747 - protein, 9 aa, Homo Sapiens
FPAWGDRGE

SEQ ID NO: 7748 - protein, 9 aa, Homo Sapiens
GRACRLKST

SEQ ID NO: 7749 - protein, 9 aa, Homo Sapiens
GWAAPEREV

SEQ ID NO: 7750 - protein, 9 aa, Homo Sapiens
MGPEDEQKM

SEQ ID NO: 7751 - protein, 9 aa, Homo Sapiens
EVPVGTQPP

SEQ ID NO: 7752 - protein, 9 aa, Homo Sapiens
SIRIEYDTF

SEQ ID NO: 7753 - protein, 9 aa, Homo Sapiens
LTWGLIDPK

SEQ ID NO: 7754 - protein, 9 aa, Homo Sapiens
NLQNRKLLQ

SEQ ID NO: 7755 - protein, 9 aa, Homo Sapiens
GTVTGGPQH

SEQ ID NO: 7756 - protein, 9 aa, Homo Sapiens
YLIQQAVHG

SEQ ID NO: 7757 - protein, 9 aa, Homo Sapiens
GSRQSSGFG

SEQ ID NO: 7758 - protein, 9 aa, Homo Sapiens
ERSPGEPGW

SEQ ID NO: 7759 - protein, 9 aa, Homo Sapiens
DTGNISSKV

SEQ ID NO: 7760 - protein, 9 aa, Homo Sapiens
GMYRPSFDL

SEQ ID NO: 7761 - protein, 9 aa, Homo Sapiens
GRGARGGRG

SEQ ID NO: 7762 - protein, 9 aa, Homo Sapiens
RAHMRTGRP

SEQ ID NO: 7763 - protein, 9 aa, Homo Sapiens
YFINKELIL

SEQ ID NO: 7764 - protein, 9 aa, Homo Sapiens
QEDLAKVVC

SEQ ID NO: 7765 - protein, 9 aa, Homo Sapiens
PKKGDTEPE

SEQ ID NO: 7766 - protein, 9 aa, Homo Sapiens
LVSFFFITT

SEQ ID NO: 7767 - protein, 9 aa, Homo Sapiens
MVNKVVQYS

SEQ ID NO: 7768 - protein, 9 aa, Homo Sapiens
GSGCYIPRK

SEQ ID NO: 7769 - protein, 9 aa, Homo Sapiens
DPVLSCRSN

SEQ ID NO: 7770 - protein, 9 aa, Homo Sapiens
SQMPACYCA

SEQ ID NO: 7771 - protein, 9 aa, Homo Sapiens
KNKEAPQDV

SEQ ID NO: 7772 - protein, 9 aa, Homo Sapiens
ELILKNMFT

SEQ ID NO: 7773 - protein, 9 aa, Homo Sapiens
HQRLQSREG

SEQ ID NO: 7774 - protein, 9 aa, Homo Sapiens
FQKLPTRVD

SEQ ID NO: 7775 - protein, 9 aa, Homo Sapiens
SVGSPAAAR

SEQ ID NO: 7776 - protein, 9 aa, Homo Sapiens
PAPLPARPD

SEQ ID NO: 7777 - protein, 9 aa, Homo Sapiens
TGEEIPYLR

SEQ ID NO: 7778 - protein, 9 aa, Homo Sapiens
RFSTCTSDK

SEQ ID NO: 7779 - protein, 9 aa, Homo Sapiens
WRGASVGSP

SEQ ID NO: 7780 - protein, 9 aa, Homo Sapiens
HTDFKFRLA

SEQ ID NO: 7781 - protein, 9 aa, Homo Sapiens
TKESIDGLP

SEQ ID NO: 7782 - protein, 9 aa, Homo Sapiens
NRRNCHCRI

SEQ ID NO: 7783 - protein, 9 aa, Homo Sapiens
CKNDVTDRR

SEQ ID NO: 7784 - protein, 9 aa, Homo Sapiens
KIDLLMHCV

SEQ ID NO: 7785 - protein, 9 aa, Homo Sapiens
HVVPMMRSE

SEQ ID NO: 7786 - protein, 9 aa, Homo Sapiens
GARGGRGAA

SEQ ID NO: 7787 - protein, 9 aa, Homo Sapiens
SRAHSVEDF

SEQ ID NO: 7788 - protein, 9 aa, Homo Sapiens
VAWTIQLTE

SEQ ID NO: 7789 - protein, 9 aa, Homo Sapiens
VTHPIASQS

SEQ ID NO: 7790 - protein, 9 aa, Homo Sapiens
FCMFDMDCH

SEQ ID NO: 7791 - protein, 9 aa, Homo Sapiens
PPIWRVKKA

SEQ ID NO: 7792 - protein, 9 aa, Homo Sapiens
SVSGTDVKE

SEQ ID NO: 7793 - protein, 9 aa, Homo Sapiens
TPEHTSQAT

SEQ ID NO: 7794 - protein, 9 aa, Homo Sapiens
CLAHRRRDA

SEQ ID NO: 7795 - protein, 9 aa, Homo Sapiens
LREAALRIF

SEQ ID NO: 7796 - protein, 9 aa, Homo Sapiens
QRGAFFGPE

SEQ ID NO: 7797 - protein, 9 aa, Homo Sapiens
LRELQAVKR

SEQ ID NO: 7798 - protein, 9 aa, Homo Sapiens
TDPYKMIIN

SEQ ID NO: 7799 - protein, 9 aa, Homo Sapiens
PATDFKVNA

SEQ ID NO: 7800 - protein, 9 aa, Homo Sapiens
PSSPGAVAC

SEQ ID NO: 7801 - protein, 9 aa, Homo Sapiens
FFCAQRGAF

SEQ ID NO: 7802 - protein, 9 aa, Homo Sapiens
APQDVSSRL

SEQ ID NO: 7803 - protein, 9 aa, Homo Sapiens
RPHTAEKPY

SEQ ID NO: 7804 - protein, 9 aa, Homo Sapiens
SGLGAQCWE

SEQ ID NO: 7805 - protein, 9 aa, Homo Sapiens
DALVSEAES

SEQ ID NO: 7806 - protein, 9 aa, Homo Sapiens
HCPSCQPLF

SEQ ID NO: 7807 - protein, 9 aa, Homo Sapiens
IDVYDDEST

SEQ ID NO: 7808 - protein, 9 aa, Homo Sapiens
YFTGLSFRI

SEQ ID NO: 7809 - protein, 9 aa, Homo Sapiens
DFKFRLAKS

SEQ ID NO: 7810 - protein, 9 aa, Homo Sapiens
LSMWSCKSL

SEQ ID NO: 7811 - protein, 9 aa, Homo Sapiens
TTEAMSGSG

SEQ ID NO: 7812 - protein, 9 aa, Homo Sapiens
GDRGERAAG

SEQ ID NO: 7813 - protein, 9 aa, Homo Sapiens
LIQHYRPHT

SEQ ID NO: 7814 - protein, 9 aa, Homo Sapiens
KNTICLLSQ

SEQ ID NO: 7815 - protein, 9 aa, Homo Sapiens
GEGSCQACP

SEQ ID NO: 7816 - protein, 9 aa, Homo Sapiens
IPQLQYDFQ

SEQ ID NO: 7817 - protein, 9 aa, Homo Sapiens
HSLMYKLSP

SEQ ID NO: 7818 - protein, 9 aa, Homo Sapiens
RQGGRLLPP

SEQ ID NO: 7819 - protein, 9 aa, Homo Sapiens
YSGRQFSII

SEQ ID NO: 7820 - protein, 9 aa, Homo Sapiens
DVLITPSLR

SEQ ID NO: 7821 - protein, 9 aa, Homo Sapiens
QASIDTLIG

SEQ ID NO: 7822 - protein, 9 aa, Homo Sapiens
VGDYPSKRT

SEQ ID NO: 7823 - protein, 9 aa, Homo Sapiens
ADEEQWKLK

SEQ ID NO: 7824 - protein, 9 aa, Homo Sapiens
IQQAVHGNL

SEQ ID NO: 7825 - protein, 9 aa, Homo Sapiens
TDGPVSDRL

SEQ ID NO: 7826 - protein, 9 aa, Homo Sapiens
VAAEYGRAC

SEQ ID NO: 7827 - protein, 9 aa, Homo Sapiens
LRGGSSSSI

SEQ ID NO: 7828 - protein, 9 aa, Homo Sapiens
VAWSSADTT

SEQ ID NO: 7829 - protein, 9 aa, Homo Sapiens
NGGIICIVI

SEQ ID NO: 7830 - protein, 9 aa, Homo Sapiens
RSARRSWPG

SEQ ID NO: 7831 - protein, 9 aa, Homo Sapiens
LHLSGKKSS

SEQ ID NO: 7832 - protein, 9 aa, Homo Sapiens
MATEFFDSL

SEQ ID NO: 7833 - protein, 9 aa, Homo Sapiens
GRSLSCPPK

SEQ ID NO: 7834 - protein, 9 aa, Homo Sapiens
APPRVRPKP

SEQ ID NO: 7835 - protein, 9 aa, Homo Sapiens
EAALRIFWN

SEQ ID NO: 7836 - protein, 9 aa, Homo Sapiens
MLGPTQTLS

SEQ ID NO: 7837 - protein, 9 aa, Homo Sapiens
WGPLLFYIG

SEQ ID NO: 7838 - protein, 9 aa, Homo Sapiens
QLRPGQKID

SEQ ID NO: 7839 - protein, 9 aa, Homo Sapiens
GLLSHERSH

SEQ ID NO: 7840 - protein, 9 aa, Homo Sapiens
IKHVPVESD

SEQ ID NO: 7841 - protein, 9 aa, Homo Sapiens
GWFVSGTTN

SEQ ID NO: 7842 - protein, 9 aa, Homo Sapiens
IRCKISSTR

SEQ ID NO: 7843 - protein, 9 aa, Homo Sapiens
SQNSIRIEY

SEQ ID NO: 7844 - protein, 9 aa, Homo Sapiens
RPYACGDCD

SEQ ID NO: 7845 - protein, 9 aa, Homo Sapiens
AWVPAPAPV

SEQ ID NO: 7846 - protein, 9 aa, Homo Sapiens
VGSPAAARG

SEQ ID NO: 7847 - protein, 9 aa, Homo Sapiens
RALLGTVTG

SEQ ID NO: 7848 - protein, 9 aa, Homo Sapiens
LNRLLLAAA

SEQ ID NO: 7849 - protein, 9 aa, Homo Sapiens
ANTVVENLP

SEQ ID NO: 7850 - protein, 9 aa, Homo Sapiens
RAAEPEAGP

SEQ ID NO: 7851 - protein, 9 aa, Homo Sapiens
QKLTFRKVV

SEQ ID NO: 7852 - protein, 9 aa, Homo Sapiens
IRIYRQSKE

SEQ ID NO: 7853 - protein, 9 aa, Homo Sapiens
WDHNYDYWV

SEQ ID NO: 7854 - protein, 9 aa, Homo Sapiens
RKNIRYEEL

SEQ ID NO: 7855 - protein, 9 aa, Homo Sapiens
LAQGLLYMA

SEQ ID NO: 7856 - protein, 9 aa, Homo Sapiens
VHGNLQKHT

SEQ ID NO: 7857 - protein, 9 aa, Homo Sapiens
SNSQQSLQT

SEQ ID NO: 7858 - protein, 9 aa, Homo Sapiens
SFKCVECGK

SEQ ID NO: 7859 - protein, 9 aa, Homo Sapiens
LCASAEQSE

SEQ ID NO: 7860 - protein, 9 aa, Homo Sapiens
KPNIRWSDV

SEQ ID NO: 7861 - protein, 9 aa, Homo Sapiens
KYAKDIFGE

SEQ ID NO: 7862 - protein, 9 aa, Homo Sapiens
GPGDVKTTD

SEQ ID NO: 7863 - protein, 9 aa, Homo Sapiens
IAVLKYVGD

SEQ ID NO: 7864 - protein, 9 aa, Homo Sapiens
YDFQDKNHL

SEQ ID NO: 7865 - protein, 9 aa, Homo Sapiens
PVSDRLTDK

SEQ ID NO: 7866 - protein, 9 aa, Homo Sapiens
VTEGSGCYI

SEQ ID NO: 7867 - protein, 9 aa, Homo Sapiens
LAVHQRLQS

SEQ ID NO: 7868 - protein, 9 aa, Homo Sapiens
CTFPTASER

SEQ ID NO: 7869 - protein, 9 aa, Homo Sapiens
VRVSQQLAV

SEQ ID NO: 7870 - protein, 9 aa, Homo Sapiens
KEECREKGG

SEQ ID NO: 7871 - protein, 9 aa, Homo Sapiens
KVVCKEESI

SEQ ID NO: 7872 - protein, 9 aa, Homo Sapiens
QRCAGFRAA

SEQ ID NO: 7873 - protein, 9 aa, Homo Sapiens
AQKAIVYHP

SEQ ID NO: 7874 - protein, 9 aa, Homo Sapiens
ALCEVAVNS

SEQ ID NO: 7875 - protein, 9 aa, Homo Sapiens
ALVLVSVLA

SEQ ID NO: 7876 - protein, 9 aa, Homo Sapiens
KNMSQLLEE

SEQ ID NO: 7877 - protein, 9 aa, Homo Sapiens
PRSGPGVDA

SEQ ID NO: 7878 - protein, 9 aa, Homo Sapiens
GFCMFDMDC

SEQ ID NO: 7879 - protein, 9 aa, Homo Sapiens
IIQLYSVKS

SEQ ID NO: 7880 - protein, 9 aa, Homo Sapiens
MPALIASED

SEQ ID NO: 7881 - protein, 9 aa, Homo Sapiens
EPFMKSWGE

SEQ ID NO: 7882 - protein, 9 aa, Homo Sapiens
CDKAFRLRQ

SEQ ID NO: 7883 - protein, 9 aa, Homo Sapiens
PELSEMITG

SEQ ID NO: 7884 - protein, 9 aa, Homo Sapiens
PEDVTETTG

SEQ ID NO: 7885 - protein, 9 aa, Homo Sapiens
VSLTSCVPL

SEQ ID NO: 7886 - protein, 9 aa, Homo Sapiens
PQCATYWPI

SEQ ID NO: 7887 - protein, 9 aa, Homo Sapiens
GRRPQTPRR

SEQ ID NO: 7888 - protein, 9 aa, Homo Sapiens
ARGAPGRSF

SEQ ID NO: 7889 - protein, 9 aa, Homo Sapiens
KPQKPIPQP

SEQ ID NO: 7890 - protein, 9 aa, Homo Sapiens
SGCDSHSEA

SEQ ID NO: 7891 - protein, 9 aa, Homo Sapiens
GQIVAIKHV

SEQ ID NO: 7892 - protein, 9 aa, Homo Sapiens
QILEIKTVH

SEQ ID NO: 7893 - protein, 9 aa, Homo Sapiens
EGRRPQTPR

SEQ ID NO: 7894 - protein, 9 aa, Homo Sapiens
ERPYECNTR

SEQ ID NO: 7895 - protein, 9 aa, Homo Sapiens
QLQYDFQDK

SEQ ID NO: 7896 - protein, 9 aa, Homo Sapiens
NSDLKAQLK

SEQ ID NO: 7897 - protein, 9 aa, Homo Sapiens
EGSPFLTKK

SEQ ID NO: 7898 - protein, 9 aa, Homo Sapiens
PSCQPLFMV

SEQ ID NO: 7899 - protein, 9 aa, Homo Sapiens
LDYHFHECV

SEQ ID NO: 7900 - protein, 9 aa, Homo Sapiens
QWTRQFCTE

SEQ ID NO: 7901 - protein, 9 aa, Homo Sapiens
SEDSPHCDL

SEQ ID NO: 7902 - protein, 9 aa, Homo Sapiens
DHASVALAR

SEQ ID NO: 7903 - protein, 9 aa, Homo Sapiens
RPPNHHSSA

SEQ ID NO: 7904 - protein, 9 aa, Homo Sapiens
PGAPPARLA

SEQ ID NO: 7905 - protein, 9 aa, Homo Sapiens
YTKVRTCMH

SEQ ID NO: 7906 - protein, 9 aa, Homo Sapiens
MLLCSSPNR

SEQ ID NO: 7907 - protein, 9 aa, Homo Sapiens
VPFSTVSEW

SEQ ID NO: 7908 - protein, 9 aa, Homo Sapiens
IEVTFDIDV

SEQ ID NO: 7909 - protein, 9 aa, Homo Sapiens
EEELREEER

SEQ ID NO: 7910 - protein, 9 aa, Homo Sapiens
GWQKDALHL

SEQ ID NO: 7911 - protein, 9 aa, Homo Sapiens
NNPKKGDTE

SEQ ID NO: 7912 - protein, 9 aa, Homo Sapiens
HMRTGRPPD

SEQ ID NO: 7913 - protein, 9 aa, Homo Sapiens
TGQPRTQPP

SEQ ID NO: 7914 - protein, 9 aa, Homo Sapiens
QHYRPHTAE

SEQ ID NO: 7915 - protein, 9 aa, Homo Sapiens
SRTETAGRS

SEQ ID NO: 7916 - protein, 9 aa, Homo Sapiens
PGKGNHKTP

SEQ ID NO: 7917 - protein, 9 aa, Homo Sapiens
AKGGICFTG

SEQ ID NO: 7918 - protein, 9 aa, Homo Sapiens
GGTGAAEKP

SEQ ID NO: 7919 - protein, 9 aa, Homo Sapiens
ITTSYAYIL

SEQ ID NO: 7920 - protein, 9 aa, Homo Sapiens
WNVFSKTCS

SEQ ID NO: 7921 - protein, 9 aa, Homo Sapiens
RNQFIFVAA

SEQ ID NO: 7922 - protein, 9 aa, Homo Sapiens
GALGPQGLP

SEQ ID NO: 7923 - protein, 9 aa, Homo Sapiens
KYKATYVKE

SEQ ID NO: 7924 - protein, 9 aa, Homo Sapiens
LLEEMLLKQ

SEQ ID NO: 7925 - protein, 9 aa, Homo Sapiens
SNLKETGIA

SEQ ID NO: 7926 - protein, 9 aa, Homo Sapiens
SMPALIASE

SEQ ID NO: 7927 - protein, 9 aa, Homo Sapiens
QDPKKQLEI

SEQ ID NO: 7928 - protein, 9 aa, Homo Sapiens
GHVRLKLED

SEQ ID NO: 7929 - protein, 9 aa, Homo Sapiens
STVSEWLES

SEQ ID NO: 7930 - protein, 9 aa, Homo Sapiens
YDLRPSLST

SEQ ID NO: 7931 - protein, 9 aa, Homo Sapiens
TEDVYSQDS

SEQ ID NO: 7932 - protein, 9 aa, Homo Sapiens
EPVVTQVTT

SEQ ID NO: 7933 - protein, 9 aa, Homo Sapiens
TYLTYNYFI

SEQ ID NO: 7934 - protein, 9 aa, Homo Sapiens
PPRSWVHAC

SEQ ID NO: 7935 - protein, 9 aa, Homo Sapiens
RCPPQWTRQ

SEQ ID NO: 7936 - protein, 9 aa, Homo Sapiens
ELREEERGQ

SEQ ID NO: 7937 - protein, 9 aa, Homo Sapiens
SKAECDEYC

SEQ ID NO: 7938 - protein, 9 aa, Homo Sapiens
TGERPNQCA

SEQ ID NO: 7939 - protein, 9 aa, Homo Sapiens
QEPGPRHPG

SEQ ID NO: 7940 - protein, 9 aa, Homo Sapiens
PTARTSPPC

SEQ ID NO: 7941 - protein, 9 aa, Homo Sapiens
KKNSQIGIA

SEQ ID NO: 7942 - protein, 9 aa, Homo Sapiens
KVKSCRCSI

SEQ ID NO: 7943 - protein, 9 aa, Homo Sapiens
GNHKTPSSE

SEQ ID NO: 7944 - protein, 9 aa, Homo Sapiens
PNLRSVYVH

SEQ ID NO: 7945 - protein, 9 aa, Homo Sapiens
GICFTGDLA

SEQ ID NO: 7946 - protein, 9 aa, Homo Sapiens
AGLSGASRG

SEQ ID NO: 7947 - protein, 9 aa, Homo Sapiens
EFGTGNYCL

SEQ ID NO: 7948 - protein, 9 aa, Homo Sapiens
TREPRSGPG

SEQ ID NO: 7949 - protein, 9 aa, Homo Sapiens
ELEDFTDSL

SEQ ID NO: 7950 - protein, 9 aa, Homo Sapiens
HHHMQVREE

SEQ ID NO: 7951 - protein, 9 aa, Homo Sapiens
FRLLEGRRP

SEQ ID NO: 7952 - protein, 9 aa, Homo Sapiens
PRTQPPLPG

SEQ ID NO: 7953 - protein, 9 aa, Homo Sapiens
PSYPRQPWR

SEQ ID NO: 7954 - protein, 9 aa, Homo Sapiens
ARMASQNSI

SEQ ID NO: 7955 - protein, 9 aa, Homo Sapiens
NVLSSLDLT

SEQ ID NO: 7956 - protein, 9 aa, Homo Sapiens
TLIPIKGEF

SEQ ID NO: 7957 - protein, 9 aa, Homo Sapiens
MFDMDCHKK

SEQ ID NO: 7958 - protein, 9 aa, Homo Sapiens
LVLLDGNRV

SEQ ID NO: 7959 - protein, 9 aa, Homo Sapiens
STASSLGPE

SEQ ID NO: 7960 - protein, 9 aa, Homo Sapiens
LPPRDPVLS

SEQ ID NO: 7961 - protein, 9 aa, Homo Sapiens
LESLWVLGF

SEQ ID NO: 7962 - protein, 9 aa, Homo Sapiens
SIDIRCKIS

SEQ ID NO: 7963 - protein, 9 aa, Homo Sapiens
IYFWDESIA

SEQ ID NO: 7964 - protein, 9 aa, Homo Sapiens
CLTTASDKL

SEQ ID NO: 7965 - protein, 9 aa, Homo Sapiens
QPSSQMPAC

SEQ ID NO: 7966 - protein, 9 aa, Homo Sapiens
AALRIFWNF

SEQ ID NO: 7967 - protein, 9 aa, Homo Sapiens
SAARKWKAF

SEQ ID NO: 7968 - protein, 9 aa, Homo Sapiens
ASPTARTSP

SEQ ID NO: 7969 - protein, 9 aa, Homo Sapiens
RDREPYTKV

SEQ ID NO: 7970 - protein, 9 aa, Homo Sapiens
QPWRGASVG

SEQ ID NO: 7971 - protein, 9 aa, Homo Sapiens
LVPKRYRIL

SEQ ID NO: 7972 - protein, 9 aa, Homo Sapiens
PGAVACAPT

SEQ ID NO: 7973 - protein, 9 aa, Homo Sapiens
PMLCRMLIM

SEQ ID NO: 7974 - protein, 9 aa, Homo Sapiens
SVLTGHTDC

SEQ ID NO: 7975 - protein, 9 aa, Homo Sapiens
GPQLPDFSS

SEQ ID NO: 7976 - protein, 9 aa, Homo Sapiens
YPRQPWRGA

SEQ ID NO: 7977 - protein, 9 aa, Homo Sapiens
AGFPAWGDR

SEQ ID NO: 7978 - protein, 9 aa, Homo Sapiens
RRSVVVPYE

SEQ ID NO: 7979 - protein, 9 aa, Homo Sapiens
SRSNPVLHI

SEQ ID NO: 7980 - protein, 9 aa, Homo Sapiens
NQCADCGKS

SEQ ID NO: 7981 - protein, 9 aa, Homo Sapiens
PLPGRDGRL

SEQ ID NO: 7982 - protein, 9 aa, Homo Sapiens
SSDPGKGNH

SEQ ID NO: 7983 - protein, 9 aa, Homo Sapiens
GPRHPGGGS

SEQ ID NO: 7984 - protein, 9 aa, Homo Sapiens
RGVPTSVAF

SEQ ID NO: 7985 - protein, 9 aa, Homo Sapiens
VHFDGWDHN

SEQ ID NO: 7986 - protein, 9 aa, Homo Sapiens
LLYSSLCKV

SEQ ID NO: 7987 - protein, 9 aa, Homo Sapiens
DVTDRRAEY

SEQ ID NO: 7988 - protein, 9 aa, Homo Sapiens
IRHRCCLAH

SEQ ID NO: 7989 - protein, 9 aa, Homo Sapiens
CSTKVKWES

SEQ ID NO: 7990 - protein, 9 aa, Homo Sapiens
SLELDEEGA

SEQ ID NO: 7991 - protein, 9 aa, Homo Sapiens
HHVKYKIQM

SEQ ID NO: 7992 - protein, 9 aa, Homo Sapiens
AFTDAIRIY

SEQ ID NO: 7993 - protein, 9 aa, Homo Sapiens
VRISRLSSG

SEQ ID NO: 7994 - protein, 9 aa, Homo Sapiens
CKAPCISCS

SEQ ID NO: 7995 - protein, 9 aa, Homo Sapiens
VANPPATKE

SEQ ID NO: 7996 - protein, 9 aa, Homo Sapiens
REVFGRTGE

SEQ ID NO: 7997 - protein, 9 aa, Homo Sapiens
VPLSEQPAR

SEQ ID NO: 7998 - protein, 9 aa, Homo Sapiens
PGVDAAGRR

SEQ ID NO: 7999 - protein, 9 aa, Homo Sapiens
VVTQVTTLV

SEQ ID NO: 8000 - protein, 9 aa, Homo Sapiens
LICLGHVRL

SEQ ID NO: 8001 - protein, 9 aa, Homo Sapiens
MAAAAWGVL

SEQ ID NO: 8002 - protein, 9 aa, Homo Sapiens
TDVKEECRE

SEQ ID NO: 8003 - protein, 9 aa, Homo Sapiens
MWSCKSLIE

SEQ ID NO: 8004 - protein, 9 aa, Homo Sapiens
VGQEPGPRH

SEQ ID NO: 8005 - protein, 9 aa, Homo Sapiens
GAKYAEFIV

SEQ ID NO: 8006 - protein, 9 aa, Homo Sapiens
GLGAQCWEP

SEQ ID NO: 8007 - protein, 9 aa, Homo Sapiens
MITGDWLEA

SEQ ID NO: 8008 - protein, 9 aa, Homo Sapiens
NDIKVDEVL

SEQ ID NO: 8009 - protein, 9 aa, Homo Sapiens
APGGAPRSG

SEQ ID NO: 8010 - protein, 9 aa, Homo Sapiens
KKGDTEPES

SEQ ID NO: 8011 - protein, 9 aa, Homo Sapiens
RVAGVARAG

SEQ ID NO: 8012 - protein, 9 aa, Homo Sapiens
VNVDVKDFL

SEQ ID NO: 8013 - protein, 9 aa, Homo Sapiens
VLKYVGDYP

SEQ ID NO: 8014 - protein, 9 aa, Homo Sapiens
PSSGDYRRT

SEQ ID NO: 8015 - protein, 9 aa, Homo Sapiens
LHVTEGSGC

SEQ ID NO: 8016 - protein, 9 aa, Homo Sapiens
PNRPPRCPL

SEQ ID NO: 8017 - protein, 9 aa, Homo Sapiens
FDHASVALA

SEQ ID NO: 8018 - protein, 9 aa, Homo Sapiens
QQQQHQHQH

SEQ ID NO: 8019 - protein, 9 aa, Homo Sapiens
KLLQVGIYN

SEQ ID NO: 8020 - protein, 9 aa, Homo Sapiens
VHNNKLADA

SEQ ID NO: 8021 - protein, 9 aa, Homo Sapiens
RSDLIQQKR

SEQ ID NO: 8022 - protein, 9 aa, Homo Sapiens
PEHTSQATR

SEQ ID NO: 8023 - protein, 9 aa, Homo Sapiens
YFWDESIAQ

SEQ ID NO: 8024 - protein, 9 aa, Homo Sapiens
PRKGNKKKP

SEQ ID NO: 8025 - protein, 9 aa, Homo Sapiens
RGERAAGLP

SEQ ID NO: 8026 - protein, 9 aa, Homo Sapiens
RHASPSVIS

SEQ ID NO: 8027 - protein, 9 aa, Homo Sapiens
EDFKQQMGS

SEQ ID NO: 8028 - protein, 9 aa, Homo Sapiens
CNLQTVNSF

SEQ ID NO: 8029 - protein, 9 aa, Homo Sapiens
DKEIILKAP

SEQ ID NO: 8030 - protein, 9 aa, Homo Sapiens
VSHHFRDHA

SEQ ID NO: 8031 - protein, 9 aa, Homo Sapiens
LLDPELDVL

SEQ ID NO: 8032 - protein, 9 aa, Homo Sapiens
EKTKVTYLK

SEQ ID NO: 8033 - protein, 9 aa, Homo Sapiens
HTGERPNQC

SEQ ID NO: 8034 - protein, 9 aa, Homo Sapiens
AKVVCKEES

SEQ ID NO: 8035 - protein, 9 aa, Homo Sapiens
HSGASSPAA

SEQ ID NO: 8036 - protein, 9 aa, Homo Sapiens
TDLPGPRGG

SEQ ID NO: 8037 - protein, 9 aa, Homo Sapiens
DKMGYMGPF

SEQ ID NO: 8038 - protein, 9 aa, Homo Sapiens
PPAANTVVE

SEQ ID NO: 8039 - protein, 9 aa, Homo Sapiens
TNQFLLKFT

SEQ ID NO: 8040 - protein, 9 aa, Homo Sapiens
TTRQCECRP

SEQ ID NO: 8041 - protein, 9 aa, Homo Sapiens
FKAGGEVPV

SEQ ID NO: 8042 - protein, 9 aa, Homo Sapiens
ATYWANLPT

SEQ ID NO: 8043 - protein, 9 aa, Homo Sapiens
DCGKAFRRF

SEQ ID NO: 8044 - protein, 9 aa, Homo Sapiens
VLLLLGLLP

SEQ ID NO: 8045 - protein, 9 aa, Homo Sapiens
THSLMYKLS

SEQ ID NO: 8046 - protein, 9 aa, Homo Sapiens
PLLALLNKN

SEQ ID NO: 8047 - protein, 9 aa, Homo Sapiens
KKALLQKFT

SEQ ID NO: 8048 - protein, 9 aa, Homo Sapiens
LIKRTRRSI

SEQ ID NO: 8049 - protein, 9 aa, Homo Sapiens
QSSTREPRS

SEQ ID NO: 8050 - protein, 9 aa, Homo Sapiens
MESSPRKGN

SEQ ID NO: 8051 - protein, 9 aa, Homo Sapiens
DDGLTCRPE

SEQ ID NO: 8052 - protein, 9 aa, Homo Sapiens
KGGICFTGD

SEQ ID NO: 8053 - protein, 9 aa, Homo Sapiens
KGLLSHERS

SEQ ID NO: 8054 - protein, 9 aa, Homo Sapiens
APPARLAPS

SEQ ID NO: 8055 - protein, 9 aa, Homo Sapiens
TALKSRAHS

SEQ ID NO: 8056 - protein, 9 aa, Homo Sapiens
DFTDSLELD

SEQ ID NO: 8057 - protein, 9 aa, Homo Sapiens
QLLQPSVQS

SEQ ID NO: 8058 - protein, 9 aa, Homo Sapiens
KNGLPATDF

SEQ ID NO: 8059 - protein, 9 aa, Homo Sapiens
AGRCVLCPS

SEQ ID NO: 8060 - protein, 9 aa, Homo Sapiens
GQSSTREPR

SEQ ID NO: 8061 - protein, 9 aa, Homo Sapiens
QNFCFHAAL

SEQ ID NO: 8062 - protein, 9 aa, Homo Sapiens
NVDNFLDGS

SEQ ID NO: 8063 - protein, 9 aa, Homo Sapiens
RGGSSSSIN

SEQ ID NO: 8064 - protein, 9 aa, Homo Sapiens
RRARCPEYS

SEQ ID NO: 8065 - protein, 9 aa, Homo Sapiens
LDLTKKVHV

SEQ ID NO: 8066 - protein, 9 aa, Homo Sapiens
PLPNLRAHM

SEQ ID NO: 8067 - protein, 9 aa, Homo Sapiens
NSTLCFSYT

SEQ ID NO: 8068 - protein, 9 aa, Homo Sapiens
VEVANPPAT

SEQ ID NO: 8069 - protein, 9 aa, Homo Sapiens
GSNLKETGI

SEQ ID NO: 8070 - protein, 9 aa, Homo Sapiens
VKSCRCSIE

SEQ ID NO: 8071 - protein, 9 aa, Homo Sapiens
IPYLRKEAI

SEQ ID NO: 8072 - protein, 9 aa, Homo Sapiens
QGAHGESSL

SEQ ID NO: 8073 - protein, 9 aa, Homo Sapiens
KVQINNKDD

SEQ ID NO: 8074 - protein, 9 aa, Homo Sapiens
DMYYIGNET

SEQ ID NO: 8075 - protein, 9 aa, Homo Sapiens
LPGRDGRLV

SEQ ID NO: 8076 - protein, 9 aa, Homo Sapiens
GGICFTGDL

SEQ ID NO: 8077 - protein, 9 aa, Homo Sapiens
YSSLCKVAV

SEQ ID NO: 8078 - protein, 9 aa, Homo Sapiens
LQDDGLTCR

SEQ ID NO: 8079 - protein, 9 aa, Homo Sapiens
QVSEPFMKS

SEQ ID NO: 8080 - protein, 9 aa, Homo Sapiens
NKKKPVKVE

SEQ ID NO: 8081 - protein, 9 aa, Homo Sapiens
MEKPNIRWS

SEQ ID NO: 8082 - protein, 9 aa, Homo Sapiens
QISWDRNPE

SEQ ID NO: 8083 - protein, 9 aa, Homo Sapiens
GLSFRIVNS

SEQ ID NO: 8084 - protein, 9 aa, Homo Sapiens
IVAIKHVPV

SEQ ID NO: 8085 - protein, 9 aa, Homo Sapiens
LKNMFTNQD

SEQ ID NO: 8086 - protein, 9 aa, Homo Sapiens
RQSSGFGQH

SEQ ID NO: 8087 - protein, 9 aa, Homo Sapiens
RGAAGSQRP

SEQ ID NO: 8088 - protein, 9 aa, Homo Sapiens
PNRSQLCAS

SEQ ID NO: 8089 - protein, 9 aa, Homo Sapiens
YIQQPSSQM

SEQ ID NO: 8090 - protein, 9 aa, Homo Sapiens
AWGDRGERA

SEQ ID NO: 8091 - protein, 9 aa, Homo Sapiens
HFFDHASVA

SEQ ID NO: 8092 - protein, 9 aa, Homo Sapiens
AAEKPTDLP

SEQ ID NO: 8093 - protein, 9 aa, Homo Sapiens
RLKHLTEEK

SEQ ID NO: 8094 - protein, 9 aa, Homo Sapiens
PAQRCAGFR

SEQ ID NO: 8095 - protein, 9 aa, Homo Sapiens
RRFSYLTAH

SEQ ID NO: 8096 - protein, 9 aa, Homo Sapiens
TNRDDAKYM

SEQ ID NO: 8097 - protein, 9 aa, Homo Sapiens
TTTPMVTHP

SEQ ID NO: 8098 - protein, 9 aa, Homo Sapiens
DASVVALVS

SEQ ID NO: 8099 - protein, 9 aa, Homo Sapiens
PDFSSIIQT

SEQ ID NO: 8100 - protein, 9 aa, Homo Sapiens
PDCSFRTGQ

SEQ ID NO: 8101 - protein, 9 aa, Homo Sapiens
HCRIGWDPP

SEQ ID NO: 8102 - protein, 9 aa, Homo Sapiens
TSDYNSKTV

SEQ ID NO: 8103 - protein, 9 aa, Homo Sapiens
GNPICIQIS

SEQ ID NO: 8104 - protein, 9 aa, Homo Sapiens
LILFAWGPL

SEQ ID NO: 8105 - protein, 9 aa, Homo Sapiens
AVLQVPLLS

SEQ ID NO: 8106 - protein, 9 aa, Homo Sapiens
ALLTRRASQ

SEQ ID NO: 8107 - protein, 9 aa, Homo Sapiens
SNIRHRCCL

SEQ ID NO: 8108 - protein, 9 aa, Homo Sapiens
FIIFLVGNL

SEQ ID NO: 8109 - protein, 9 aa, Homo Sapiens
LHSGEKSFK

SEQ ID NO: 8110 - protein, 9 aa, Homo Sapiens
LFDFQKTEP

SEQ ID NO: 8111 - protein, 9 aa, Homo Sapiens
IEEKVTEMK

SEQ ID NO: 8112 - protein, 9 aa, Homo Sapiens
MPAQSIETY

SEQ ID NO: 8113 - protein, 9 aa, Homo Sapiens
INYNRTVSF

SEQ ID NO: 8114 - protein, 9 aa, Homo Sapiens
GFPAWGDRG

SEQ ID NO: 8115 - protein, 9 aa, Homo Sapiens
RLLEGRRPQ

SEQ ID NO: 8116 - protein, 9 aa, Homo Sapiens
LRSPPTSAC

SEQ ID NO: 8117 - protein, 9 aa, Homo Sapiens
RRNCHCRIG

SEQ ID NO: 8118 - protein, 9 aa, Homo Sapiens
EVHPAGRCV

SEQ ID NO: 8119 - protein, 9 aa, Homo Sapiens
PPGAPPARL

SEQ ID NO: 8120 - protein, 9 aa, Homo Sapiens
GLICLGHVR

SEQ ID NO: 8121 - protein, 9 aa, Homo Sapiens
RLKLEDVAL

SEQ ID NO: 8122 - protein, 9 aa, Homo Sapiens
RTVSFACPH

SEQ ID NO: 8123 - protein, 9 aa, Homo Sapiens
APLHKCRPG

SEQ ID NO: 8124 - protein, 9 aa, Homo Sapiens
EAMSGSGVR

SEQ ID NO: 8125 - protein, 9 aa, Homo Sapiens
AIRIYRQSK

SEQ ID NO: 8126 - protein, 9 aa, Homo Sapiens
FVSGTTNRD

SEQ ID NO: 8127 - protein, 9 aa, Homo Sapiens
SEYSKAECD

SEQ ID NO: 8128 - protein, 9 aa, Homo Sapiens
KSCRCSIEE

SEQ ID NO: 8129 - protein, 9 aa, Homo Sapiens
EIARDIKEK

SEQ ID NO: 8130 - protein, 9 aa, Homo Sapiens
AAEYGRACR

SEQ ID NO: 8131 - protein, 9 aa, Homo Sapiens
PIKGEFSRG

SEQ ID NO: 8132 - protein, 9 aa, Homo Sapiens
AEMTLIPIK

SEQ ID NO: 8133 - protein, 9 aa, Homo Sapiens
HIDFRYILG

SEQ ID NO: 8134 - protein, 9 aa, Homo Sapiens
PRGRGCGSH

SEQ ID NO: 8135 - protein, 9 aa, Homo Sapiens
GRRARCPEY

SEQ ID NO: 8136 - protein, 9 aa, Homo Sapiens
SCKSLIEGP

SEQ ID NO: 8137 - protein, 9 aa, Homo Sapiens
VYVHNNKLA

SEQ ID NO: 8138 - protein, 9 aa, Homo Sapiens
HLQVQHLTW

SEQ ID NO: 8139 - protein, 9 aa, Homo Sapiens
EAHSIDNVC

SEQ ID NO: 8140 - protein, 9 aa, Homo Sapiens
ALRIFWNFP

SEQ ID NO: 8141 - protein, 9 aa, Homo Sapiens
YMALLALCW

SEQ ID NO: 8142 - protein, 9 aa, Homo Sapiens
SRGAPGGAP

SEQ ID NO: 8143 - protein, 9 aa, Homo Sapiens
GCLAHRRRD

SEQ ID NO: 8144 - protein, 9 aa, Homo Sapiens
SQIGIAMLV

SEQ ID NO: 8145 - protein, 9 aa, Homo Sapiens
PRGGRSARR

SEQ ID NO: 8146 - protein, 9 aa, Homo Sapiens
SLMRISVFK

SEQ ID NO: 8147 - protein, 9 aa, Homo Sapiens
AAWGVLLLL

SEQ ID NO: 8148 - protein, 9 aa, Homo Sapiens
FITTSYAYI

SEQ ID NO: 8149 - protein, 9 aa, Homo Sapiens
GAQCWEPQG

SEQ ID NO: 8150 - protein, 9 aa, Homo Sapiens
EEPLLALLN

SEQ ID NO: 8151 - protein, 9 aa, Homo Sapiens
VCKRVNQDI

SEQ ID NO: 8152 - protein, 9 aa, Homo Sapiens
TVSFACPHL

SEQ ID NO: 8153 - protein, 9 aa, Homo Sapiens
RMASQNSIR

SEQ ID NO: 8154 - protein, 9 aa, Homo Sapiens
GNPMKKNSQ

SEQ ID NO: 8155 - protein, 9 aa, Homo Sapiens
MSSAHVSHL

SEQ ID NO: 8156 - protein, 9 aa, Homo Sapiens
MYKLSPEEY

SEQ ID NO: 8157 - protein, 9 aa, Homo Sapiens
LPLCTMFII

SEQ ID NO: 8158 - protein, 9 aa, Homo Sapiens
SGPQNSLGR

SEQ ID NO: 8159 - protein, 9 aa, Homo Sapiens
QDPAGAGRG

SEQ ID NO: 8160 - protein, 9 aa, Homo Sapiens
SPKRKNIRY

SEQ ID NO: 8161 - protein, 9 aa, Homo Sapiens
LFHIDFRYI

SEQ ID NO: 8162 - protein, 9 aa, Homo Sapiens
EELTPEGIK

SEQ ID NO: 8163 - protein, 9 aa, Homo Sapiens
RPGQKIDLL

SEQ ID NO: 8164 - protein, 9 aa, Homo Sapiens
DFQKTEPPL

SEQ ID NO: 8165 - protein, 9 aa, Homo Sapiens
GDYRRTPPR

SEQ ID NO: 8166 - protein, 9 aa, Homo Sapiens
ISNIRHRCC

SEQ ID NO: 8167 - protein, 9 aa, Homo Sapiens
SSEHFLEQS

SEQ ID NO: 8168 - protein, 9 aa, Homo Sapiens
DLPGPRGGR

SEQ ID NO: 8169 - protein, 9 aa, Homo Sapiens
RKEAINFRH

SEQ ID NO: 8170 - protein, 9 aa, Homo Sapiens
LILKNMFTN

SEQ ID NO: 8171 - protein, 9 aa, Homo Sapiens
LTPYYRKVD

SEQ ID NO: 8172 - protein, 9 aa, Homo Sapiens
ELLAQVHLL

SEQ ID NO: 8173 - protein, 9 aa, Homo Sapiens
IRDGSGQIL

SEQ ID NO: 8174 - protein, 9 aa, Homo Sapiens
NIRHRCCLA

SEQ ID NO: 8175 - protein, 9 aa, Homo Sapiens
TYGNQILYL

SEQ ID NO: 8176 - protein, 9 aa, Homo Sapiens
RSRVLSPTR

SEQ ID NO: 8177 - protein, 9 aa, Homo Sapiens
RFPADKASI

SEQ ID NO: 8178 - protein, 9 aa, Homo Sapiens
LQPGPQGGA

SEQ ID NO: 8179 - protein, 9 aa, Homo Sapiens
IGKITGLDA

SEQ ID NO: 8180 - protein, 9 aa, Homo Sapiens
RGQLYASEH

SEQ ID NO: 8181 - protein, 9 aa, Homo Sapiens
DETPTNNLQ

SEQ ID NO: 8182 - protein, 9 aa, Homo Sapiens
PFMVLDILC

SEQ ID NO: 8183 - protein, 9 aa, Homo Sapiens
KTQPVKPSA

SEQ ID NO: 8184 - protein, 9 aa, Homo Sapiens
TIQRNTKPY

SEQ ID NO: 8185 - protein, 9 aa, Homo Sapiens
ETFCSDIGT

SEQ ID NO: 8186 - protein, 9 aa, Homo Sapiens
IKANPGTNW

SEQ ID NO: 8187 - protein, 9 aa, Homo Sapiens
SYSGSVDIA

SEQ ID NO: 8188 - protein, 9 aa, Homo Sapiens
VPSEESNLV

SEQ ID NO: 8189 - protein, 9 aa, Homo Sapiens
LDVCAQASG

SEQ ID NO: 8190 - protein, 9 aa, Homo Sapiens
PQNTVFERG

SEQ ID NO: 8191 - protein, 9 aa, Homo Sapiens
YKATGEQFV

SEQ ID NO: 8192 - protein, 9 aa, Homo Sapiens
SEEVLDMTK

SEQ ID NO: 8193 - protein, 9 aa, Homo Sapiens
DRSEEVLDM

SEQ ID NO: 8194 - protein, 9 aa, Homo Sapiens
FNKVSGLRI

SEQ ID NO: 8195 - protein, 9 aa, Homo Sapiens
CKKLGGLCV

SEQ ID NO: 8196 - protein, 9 aa, Homo Sapiens
CKPEVTDLE

SEQ ID NO: 8197 - protein, 9 aa, Homo Sapiens
KSLIMYRLQ

SEQ ID NO: 8198 - protein, 9 aa, Homo Sapiens
LCVTALDGY

SEQ ID NO: 8199 - protein, 9 aa, Homo Sapiens
VFRCNFTPT

SEQ ID NO: 8200 - protein, 9 aa, Homo Sapiens
RMIFYKMAA

SEQ ID NO: 8201 - protein, 9 aa, Homo Sapiens
PYGDSTGPS

SEQ ID NO: 8202 - protein, 9 aa, Homo Sapiens
VSEQRPGTL

SEQ ID NO: 8203 - protein, 9 aa, Homo Sapiens
CEVEGLVDE

SEQ ID NO: 8204 - protein, 9 aa, Homo Sapiens
LKMVEHILN

SEQ ID NO: 8205 - protein, 9 aa, Homo Sapiens
RITIHKSKN

SEQ ID NO: 8206 - protein, 9 aa, Homo Sapiens
VVIKLQEIP

SEQ ID NO: 8207 - protein, 9 aa, Homo Sapiens
LFSKLPEVN

SEQ ID NO: 8208 - protein, 9 aa, Homo Sapiens
CSLTASLHA

SEQ ID NO: 8209 - protein, 9 aa, Homo Sapiens
IREVDIKSV

SEQ ID NO: 8210 - protein, 9 aa, Homo Sapiens
FLPLAKSQP

SEQ ID NO: 8211 - protein, 9 aa, Homo Sapiens
ENSMETRPP

SEQ ID NO: 8212 - protein, 9 aa, Homo Sapiens
NLQLGSPSM

SEQ ID NO: 8213 - protein, 9 aa, Homo Sapiens
KEGNYGNNW

SEQ ID NO: 8214 - protein, 9 aa, Homo Sapiens
QLCMNFTNE

SEQ ID NO: 8215 - protein, 9 aa, Homo Sapiens
GERFLKMVE

SEQ ID NO: 8216 - protein, 9 aa, Homo Sapiens
LRIINVAPS

SEQ ID NO: 8217 - protein, 9 aa, Homo Sapiens
RNLVALGYE

SEQ ID NO: 8218 - protein, 9 aa, Homo Sapiens
PLHVTHRFM

SEQ ID NO: 8219 - protein, 9 aa, Homo Sapiens
PPESCQPFQ

SEQ ID NO: 8220 - protein, 9 aa, Homo Sapiens
SKLPEVNST

SEQ ID NO: 8221 - protein, 9 aa, Homo Sapiens
GGRSFCPPG

SEQ ID NO: 8222 - protein, 9 aa, Homo Sapiens
YSRMSYALE

SEQ ID NO: 8223 - protein, 9 aa, Homo Sapiens
RTKAISENL

SEQ ID NO: 8224 - protein, 9 aa, Homo Sapiens
CKTTCCRTT

SEQ ID NO: 8225 - protein, 9 aa, Homo Sapiens
FVRSHSFRF

SEQ ID NO: 8226 - protein, 9 aa, Homo Sapiens
TPALPSDDL

SEQ ID NO: 8227 - protein, 9 aa, Homo Sapiens
ALQYDINKL

SEQ ID NO: 8228 - protein, 9 aa, Homo Sapiens
DRESTSGTE

SEQ ID NO: 8229 - protein, 9 aa, Homo Sapiens
ERLLQTTCT

SEQ ID NO: 8230 - protein, 9 aa, Homo Sapiens
LQTQLMISG

SEQ ID NO: 8231 - protein, 9 aa, Homo Sapiens
VASLAAASV

SEQ ID NO: 8232 - protein, 9 aa, Homo Sapiens
SPLVLIAWD

SEQ ID NO: 8233 - protein, 9 aa, Homo Sapiens
CCKTTCCRT

SEQ ID NO: 8234 - protein, 9 aa, Homo Sapiens
KTTCCRTTC

SEQ ID NO: 8235 - protein, 9 aa, Homo Sapiens
NDLALCLAR

SEQ ID NO: 8236 - protein, 9 aa, Homo Sapiens
HATVWIINI

SEQ ID NO: 8237 - protein, 9 aa, Homo Sapiens
REQAQRPEE

SEQ ID NO: 8238 - protein, 9 aa, Homo Sapiens
QSLQPLYRS

SEQ ID NO: 8239 - protein, 9 aa, Homo Sapiens
PYWGIDGLA

SEQ ID NO: 8240 - protein, 9 aa, Homo Sapiens
SPPEQHAMP

SEQ ID NO: 8241 - protein, 9 aa, Homo Sapiens
ELCSTKYIS

SEQ ID NO: 8242 - protein, 9 aa, Homo Sapiens
ESNLVGTLK

SEQ ID NO: 8243 - protein, 9 aa, Homo Sapiens
NKRGQLYAS

SEQ ID NO: 8244 - protein, 9 aa, Homo Sapiens
AFFSLFSHR

SEQ ID NO: 8245 - protein, 9 aa, Homo Sapiens
RICSLTASL

SEQ ID NO: 8246 - protein, 9 aa, Homo Sapiens
PCKPEVTDL

SEQ ID NO: 8247 - protein, 9 aa, Homo Sapiens
CCRPSCCKT

SEQ ID NO: 8248 - protein, 9 aa, Homo Sapiens
QEIVDMIQQ

SEQ ID NO: 8249 - protein, 9 aa, Homo Sapiens
LVALGYELC

SEQ ID NO: 8250 - protein, 9 aa, Homo Sapiens
VPYWGIDGL

SEQ ID NO: 8251 - protein, 9 aa, Homo Sapiens
EEQVIMEAM

SEQ ID NO: 8252 - protein, 9 aa, Homo Sapiens
PDCMASLIL

SEQ ID NO: 8253 - protein, 9 aa, Homo Sapiens
ENMARICVK

SEQ ID NO: 8254 - protein, 9 aa, Homo Sapiens
QVPLLPVPR

SEQ ID NO: 8255 - protein, 9 aa, Homo Sapiens
QALVPLKTP

SEQ ID NO: 8256 - protein, 9 aa, Homo Sapiens
HAARRMIRH

SEQ ID NO: 8257 - protein, 9 aa, Homo Sapiens
GVTKRGKTL

SEQ ID NO: 8258 - protein, 9 aa, Homo Sapiens
LRKIKWEQM

SEQ ID NO: 8259 - protein, 9 aa, Homo Sapiens
YRPFVRSHS

SEQ ID NO: 8260 - protein, 9 aa, Homo Sapiens
ILRQPTEKV

SEQ ID NO: 8261 - protein, 9 aa, Homo Sapiens
ELIMNVQWS

SEQ ID NO: 8262 - protein, 9 aa, Homo Sapiens
VLQALVPLK

SEQ ID NO: 8263 - protein, 9 aa, Homo Sapiens
GLIGAVKLK

SEQ ID NO: 8264 - protein, 9 aa, Homo Sapiens
RPPESCQPF

SEQ ID NO: 8265 - protein, 9 aa, Homo Sapiens
QSGSTPLHV

SEQ ID NO: 8266 - protein, 9 aa, Homo Sapiens
LLPVPRQPR

SEQ ID NO: 8267 - protein, 9 aa, Homo Sapiens
WIINIYKEG

SEQ ID NO: 8268 - protein, 9 aa, Homo Sapiens
HQGIDKIYH

SEQ ID NO: 8269 - protein, 9 aa, Homo Sapiens
LPPRPPKSS

SEQ ID NO: 8270 - protein, 9 aa, Homo Sapiens
QISKRRRLS

SEQ ID NO: 8271 - protein, 9 aa, Homo Sapiens
LIPLSPAST

SEQ ID NO: 8272 - protein, 9 aa, Homo Sapiens
CVTRSEGGC

SEQ ID NO: 8273 - protein, 9 aa, Homo Sapiens
IVTVHTKDG

SEQ ID NO: 8274 - protein, 9 aa, Homo Sapiens
VTFEHPLDD

SEQ ID NO: 8275 - protein, 9 aa, Homo Sapiens
YSCHCCLGF

SEQ ID NO: 8276 - protein, 9 aa, Homo Sapiens
GGPGMELGP

SEQ ID NO: 8277 - protein, 9 aa, Homo Sapiens
PGERNASWV

SEQ ID NO: 8278 - protein, 9 aa, Homo Sapiens
KLGAEMVIH

SEQ ID NO: 8279 - protein, 9 aa, Homo Sapiens
SGSVDIANT

SEQ ID NO: 8280 - protein, 9 aa, Homo Sapiens
EVNSTSERF

SEQ ID NO: 8281 - protein, 9 aa, Homo Sapiens
QREDKLTFI

SEQ ID NO: 8282 - protein, 9 aa, Homo Sapiens
GSASPSFSV

SEQ ID NO: 8283 - protein, 9 aa, Homo Sapiens
LLIGVTLAG

SEQ ID NO: 8284 - protein, 9 aa, Homo Sapiens
RGLQADGVS

SEQ ID NO: 8285 - protein, 9 aa, Homo Sapiens
TGLGMPPEN

SEQ ID NO: 8286 - protein, 9 aa, Homo Sapiens
SADEFQRGN

SEQ ID NO: 8287 - protein, 9 aa, Homo Sapiens
GAGSSPVEN

SEQ ID NO: 8288 - protein, 9 aa, Homo Sapiens
KDGTQKRGR

SEQ ID NO: 8289 - protein, 9 aa, Homo Sapiens
LPCKPEVTD

SEQ ID NO: 8290 - protein, 9 aa, Homo Sapiens
LALNRYLCI

SEQ ID NO: 8291 - protein, 9 aa, Homo Sapiens
NNWNYGQVT

SEQ ID NO: 8292 - protein, 9 aa, Homo Sapiens
QGASGSQDL

SEQ ID NO: 8293 - protein, 9 aa, Homo Sapiens
HSSLATATK

SEQ ID NO: 8294 - protein, 9 aa, Homo Sapiens
GAVKLKAIP

SEQ ID NO: 8295 - protein, 9 aa, Homo Sapiens
FTSGSETIT

SEQ ID NO: 8296 - protein, 9 aa, Homo Sapiens
GVIDLIFQK

SEQ ID NO: 8297 - protein, 9 aa, Homo Sapiens
QGVTRITIH

SEQ ID NO: 8298 - protein, 9 aa, Homo Sapiens
YALEEIKKF

SEQ ID NO: 8299 - protein, 9 aa, Homo Sapiens
EVDKHMESV

SEQ ID NO: 8300 - protein, 9 aa, Homo Sapiens
EQRPGTLGP

SEQ ID NO: 8301 - protein, 9 aa, Homo Sapiens
CCYLYYFKS

SEQ ID NO: 8302 - protein, 9 aa, Homo Sapiens
RRNFSRRLS

SEQ ID NO: 8303 - protein, 9 aa, Homo Sapiens
LHFQEQFRD

SEQ ID NO: 8304 - protein, 9 aa, Homo Sapiens
DTSKVSIVT

SEQ ID NO: 8305 - protein, 9 aa, Homo Sapiens
QGIDKIYHC

SEQ ID NO: 8306 - protein, 9 aa, Homo Sapiens
TKIKFGKYK

SEQ ID NO: 8307 - protein, 9 aa, Homo Sapiens
LGSASPSFS

SEQ ID NO: 8308 - protein, 9 aa, Homo Sapiens
ENPQESVQI

SEQ ID NO: 8309 - protein, 9 aa, Homo Sapiens
LELQIKRLS

SEQ ID NO: 8310 - protein, 9 aa, Homo Sapiens
DLPCKPEVT

SEQ ID NO: 8311 - protein, 9 aa, Homo Sapiens
DKLTFIKSA

SEQ ID NO: 8312 - protein, 9 aa, Homo Sapiens
PCVPSTKEE

SEQ ID NO: 8313 - protein, 9 aa, Homo Sapiens
NLVALGYEL

SEQ ID NO: 8314 - protein, 9 aa, Homo Sapiens
PDNPRSSSL

SEQ ID NO: 8315 - protein, 9 aa, Homo Sapiens
LETFCSDIG

SEQ ID NO: 8316 - protein, 9 aa, Homo Sapiens
DISIHDFTC

SEQ ID NO: 8317 - protein, 9 aa, Homo Sapiens
VKGKLGVCF

SEQ ID NO: 8318 - protein, 9 aa, Homo Sapiens
TGIKEEEER

SEQ ID NO: 8319 - protein, 9 aa, Homo Sapiens
SGSQDLGKP

SEQ ID NO: 8320 - protein, 9 aa, Homo Sapiens
EQAIAELLD

SEQ ID NO: 8321 - protein, 9 aa, Homo Sapiens
LWPVPHGLQ

SEQ ID NO: 8322 - protein, 9 aa, Homo Sapiens
RAKTSKMKV

SEQ ID NO: 8323 - protein, 9 aa, Homo Sapiens
EFQRGNQLF

SEQ ID NO: 8324 - protein, 9 aa, Homo Sapiens
LCTHENQVA

SEQ ID NO: 8325 - protein, 9 aa, Homo Sapiens
SYANIAWQD

SEQ ID NO: 8326 - protein, 9 aa, Homo Sapiens
NKVSGLRII

SEQ ID NO: 8327 - protein, 9 aa, Homo Sapiens
DFLEANYIN

SEQ ID NO: 8328 - protein, 9 aa, Homo Sapiens
WWQSQNGIP

SEQ ID NO: 8329 - protein, 9 aa, Homo Sapiens
RLQQLSVQS

SEQ ID NO: 8330 - protein, 9 aa, Homo Sapiens
KVSSESFIF

SEQ ID NO: 8331 - protein, 9 aa, Homo Sapiens
YLAGLGPYR

SEQ ID NO: 8332 - protein, 9 aa, Homo Sapiens
PGASSVGKA

SEQ ID NO: 8333 - protein, 9 aa, Homo Sapiens
SYTHPSSLC

SEQ ID NO: 8334 - protein, 9 aa, Homo Sapiens
IEEKLTPVP

SEQ ID NO: 8335 - protein, 9 aa, Homo Sapiens
LLTVGTLEI

SEQ ID NO: 8336 - protein, 9 aa, Homo Sapiens
HVRSLHFQE

SEQ ID NO: 8337 - protein, 9 aa, Homo Sapiens
QKTQRLELI

SEQ ID NO: 8338 - protein, 9 aa, Homo Sapiens
CMTVRSETP

SEQ ID NO: 8339 - protein, 9 aa, Homo Sapiens
FGRGLSLGF

SEQ ID NO: 8340 - protein, 9 aa, Homo Sapiens
QRHAARRMI

SEQ ID NO: 8341 - protein, 9 aa, Homo Sapiens
EFKTQPVKP

SEQ ID NO: 8342 - protein, 9 aa, Homo Sapiens
HENQVACHH

SEQ ID NO: 8343 - protein, 9 aa, Homo Sapiens
RPEELLKTV

SEQ ID NO: 8344 - protein, 9 aa, Homo Sapiens
FSYANIAWQ

SEQ ID NO: 8345 - protein, 9 aa, Homo Sapiens
PQVPQKTTA

SEQ ID NO: 8346 - protein, 9 aa, Homo Sapiens
YINLQRSYT

SEQ ID NO: 8347 - protein, 9 aa, Homo Sapiens
VSVLGFFII

SEQ ID NO: 8348 - protein, 9 aa, Homo Sapiens
VNESHKSQF

SEQ ID NO: 8349 - protein, 9 aa, Homo Sapiens
MEIQFILLG

SEQ ID NO: 8350 - protein, 9 aa, Homo Sapiens
YLGSLSKDQ

SEQ ID NO: 8351 - protein, 9 aa, Homo Sapiens
AREQAQRPE

SEQ ID NO: 8352 - protein, 9 aa, Homo Sapiens
QVIMEAMAE

SEQ ID NO: 8353 - protein, 9 aa, Homo Sapiens
CSCKAGGSC

SEQ ID NO: 8354 - protein, 9 aa, Homo Sapiens
GGLCVTALD

SEQ ID NO: 8355 - protein, 9 aa, Homo Sapiens
LVTNECHPD

SEQ ID NO: 8356 - protein, 9 aa, Homo Sapiens
PGTLGPPPP

SEQ ID NO: 8357 - protein, 9 aa, Homo Sapiens
FSLFSHRFG

SEQ ID NO: 8358 - protein, 9 aa, Homo Sapiens
LPCQETYRC

SEQ ID NO: 8359 - protein, 9 aa, Homo Sapiens
HLCDPQNTV

SEQ ID NO: 8360 - protein, 9 aa, Homo Sapiens
LTQDTALTQ

SEQ ID NO: 8361 - protein, 9 aa, Homo Sapiens
FKTQPVKPS

SEQ ID NO: 8362 - protein, 9 aa, Homo Sapiens
NLRKEVSRV

SEQ ID NO: 8363 - protein, 9 aa, Homo Sapiens
VVRKQAESC

SEQ ID NO: 8364 - protein, 9 aa, Homo Sapiens
QRPEELLKT

SEQ ID NO: 8365 - protein, 9 aa, Homo Sapiens
SEFKTQPVK

SEQ ID NO: 8366 - protein, 9 aa, Homo Sapiens
QYDINKLSI

SEQ ID NO: 8367 - protein, 9 aa, Homo Sapiens
YNETKIKFG

SEQ ID NO: 8368 - protein, 9 aa, Homo Sapiens
SEFEDSDVE

SEQ ID NO: 8369 - protein, 9 aa, Homo Sapiens
SEANDLALC

SEQ ID NO: 8370 - protein, 9 aa, Homo Sapiens
YANIAWQDI

SEQ ID NO: 8371 - protein, 9 aa, Homo Sapiens
VINTLNGLR

SEQ ID NO: 8372 - protein, 9 aa, Homo Sapiens
IDFEFLSSY

SEQ ID NO: 8373 - protein, 9 aa, Homo Sapiens
GTHKIGKIT

SEQ ID NO: 8374 - protein, 9 aa, Homo Sapiens
LILARQGMG

SEQ ID NO: 8375 - protein, 9 aa, Homo Sapiens
PVTRGIKIT

SEQ ID NO: 8376 - protein, 9 aa, Homo Sapiens
VEFHYFQRI

SEQ ID NO: 8377 - protein, 9 aa, Homo Sapiens
THENQVACH

SEQ ID NO: 8378 - protein, 9 aa, Homo Sapiens
QGNSNTVDR

SEQ ID NO: 8379 - protein, 9 aa, Homo Sapiens
PPYGDSTGP

SEQ ID NO: 8380 - protein, 9 aa, Homo Sapiens
ERKTQSDMA

SEQ ID NO: 8381 - protein, 9 aa, Homo Sapiens
EPPPQIVPQ

SEQ ID NO: 8382 - protein, 9 aa, Homo Sapiens
ELITIIPNF

SEQ ID NO: 8383 - protein, 9 aa, Homo Sapiens
ENLEPNAKF

SEQ ID NO: 8384 - protein, 9 aa, Homo Sapiens
GFISHNDRR

SEQ ID NO: 8385 - protein, 9 aa, Homo Sapiens
LDMTKGNLT

SEQ ID NO: 8386 - protein, 9 aa, Homo Sapiens
DSEETVAPA

SEQ ID NO: 8387 - protein, 9 aa, Homo Sapiens
CSTKYISDG

SEQ ID NO: 8388 - protein, 9 aa, Homo Sapiens
CKDYGGDVQ

SEQ ID NO: 8389 - protein, 9 aa, Homo Sapiens
ISTDLQAEN

SEQ ID NO: 8390 - protein, 9 aa, Homo Sapiens
NFDRMIFYK

SEQ ID NO: 8391 - protein, 9 aa, Homo Sapiens
RRLQQLSVQ

SEQ ID NO: 8392 - protein, 9 aa, Homo Sapiens
STDLQAENL

SEQ ID NO: 8393 - protein, 9 aa, Homo Sapiens
VGFCLPFMV

SEQ ID NO: 8394 - protein, 9 aa, Homo Sapiens
KHKIIYTGK

SEQ ID NO: 8395 - protein, 9 aa, Homo Sapiens
CKECTQRVQ

SEQ ID NO: 8396 - protein, 9 aa, Homo Sapiens
ESSYFTTIL

SEQ ID NO: 8397 - protein, 9 aa, Homo Sapiens
DEYIGALAM

SEQ ID NO: 8398 - protein, 9 aa, Homo Sapiens
DDLGMNVTI

SEQ ID NO: 8399 - protein, 9 aa, Homo Sapiens
EHTTIISTD

SEQ ID NO: 8400 - protein, 9 aa, Homo Sapiens
ARTIQRNTK

SEQ ID NO: 8401 - protein, 9 aa, Homo Sapiens
AASYHGQPG

SEQ ID NO: 8402 - protein, 9 aa, Homo Sapiens
GSVDIANTT

SEQ ID NO: 8403 - protein, 9 aa, Homo Sapiens
SGSTPLHVT

SEQ ID NO: 8404 - protein, 9 aa, Homo Sapiens
TLSRQPGKN

SEQ ID NO: 8405 - protein, 9 aa, Homo Sapiens
RKKKKKNVC

SEQ ID NO: 8406 - protein, 9 aa, Homo Sapiens
GSGKQVWHS

SEQ ID NO: 8407 - protein, 9 aa, Homo Sapiens
WGPRARAKT

SEQ ID NO: 8408 - protein, 9 aa, Homo Sapiens
KWNLVCHSH

SEQ ID NO: 8409 - protein, 9 aa, Homo Sapiens
KDLIDFEFL

SEQ ID NO: 8410 - protein, 9 aa, Homo Sapiens
EQHAMPIGR

SEQ ID NO: 8411 - protein, 9 aa, Homo Sapiens
AVYRYMDTC

SEQ ID NO: 8412 - protein, 9 aa, Homo Sapiens
MHCASLQGL

SEQ ID NO: 8413 - protein, 9 aa, Homo Sapiens
QELIMNVQW

SEQ ID NO: 8414 - protein, 9 aa, Homo Sapiens
SKGLVLPFS

SEQ ID NO: 8415 - protein, 9 aa, Homo Sapiens
LTGKFVCLD

SEQ ID NO: 8416 - protein, 9 aa, Homo Sapiens
GLSLKSCES

SEQ ID NO: 8417 - protein, 9 aa, Homo Sapiens
KHMESVIPK

SEQ ID NO: 8418 - protein, 9 aa, Homo Sapiens
SLCKHMKVH

SEQ ID NO: 8419 - protein, 9 aa, Homo Sapiens
DGTQKRGRG

SEQ ID NO: 8420 - protein, 9 aa, Homo Sapiens
AGAIGLINN

SEQ ID NO: 8421 - protein, 9 aa, Homo Sapiens
KKRKKKKKN

SEQ ID NO: 8422 - protein, 9 aa, Homo Sapiens
DPNCSCKAG

SEQ ID NO: 8423 - protein, 9 aa, Homo Sapiens
GDRVTHTVP

SEQ ID NO: 8424 - protein, 9 aa, Homo Sapiens
YSAPGKDLG

SEQ ID NO: 8425 - protein, 9 aa, Homo Sapiens
ENQVACHHV

SEQ ID NO: 8426 - protein, 9 aa, Homo Sapiens
KLISDEYIG

SEQ ID NO: 8427 - protein, 9 aa, Homo Sapiens
SQFIELRKW

SEQ ID NO: 8428 - protein, 9 aa, Homo Sapiens
EGGCNFEGH

SEQ ID NO: 8429 - protein, 9 aa, Homo Sapiens
GRLGLVTLR

SEQ ID NO: 8430 - protein, 9 aa, Homo Sapiens
TRSEGGCNF

SEQ ID NO: 8431 - protein, 9 aa, Homo Sapiens
SEMTTVFTS

SEQ ID NO: 8432 - protein, 9 aa, Homo Sapiens
TSKVSIVTV

SEQ ID NO: 8433 - protein, 9 aa, Homo Sapiens
PLETGRNLR

SEQ ID NO: 8434 - protein, 9 aa, Homo Sapiens
CLGFRPAED

SEQ ID NO: 8435 - protein, 9 aa, Homo Sapiens
FTPTEAFQR

SEQ ID NO: 8436 - protein, 9 aa, Homo Sapiens
TAHTRIHTR

SEQ ID NO: 8437 - protein, 9 aa, Homo Sapiens
DTALTQNDD

SEQ ID NO: 8438 - protein, 9 aa, Homo Sapiens
AWVLGTMEM

SEQ ID NO: 8439 - protein, 9 aa, Homo Sapiens
TVGTLEISS

SEQ ID NO: 8440 - protein, 9 aa, Homo Sapiens
GNCRETEDP

SEQ ID NO: 8441 - protein, 9 aa, Homo Sapiens
LGYELCKPE

SEQ ID NO: 8442 - protein, 9 aa, Homo Sapiens
LPGFPKPES

SEQ ID NO: 8443 - protein, 9 aa, Homo Sapiens
AYSRMSYAL

SEQ ID NO: 8444 - protein, 9 aa, Homo Sapiens
ISVFELDYN

SEQ ID NO: 8445 - protein, 9 aa, Homo Sapiens
ATNAVSALK

SEQ ID NO: 8446 - protein, 9 aa, Homo Sapiens
TGPCVPSTK

SEQ ID NO: 8447 - protein, 9 aa, Homo Sapiens
GIKEEEERA

SEQ ID NO: 8448 - protein, 9 aa, Homo Sapiens
LSLGFKYLE

SEQ ID NO: 8449 - protein, 9 aa, Homo Sapiens
PNCSCKAGG

SEQ ID NO: 8450 - protein, 9 aa, Homo Sapiens
PLSRLSSDS

SEQ ID NO: 8451 - protein, 9 aa, Homo Sapiens
VDLNIPDNP

SEQ ID NO: 8452 - protein, 9 aa, Homo Sapiens
DDDLGMNVT

SEQ ID NO: 8453 - protein, 9 aa, Homo Sapiens
VGTLEISSR

SEQ ID NO: 8454 - protein, 9 aa, Homo Sapiens
ISSWATCGM

SEQ ID NO: 8455 - protein, 9 aa, Homo Sapiens
KIYHCQGLL

SEQ ID NO: 8456 - protein, 9 aa, Homo Sapiens
LLQTTCTLQ

SEQ ID NO: 8457 - protein, 9 aa, Homo Sapiens
YTAVESAGT

SEQ ID NO: 8458 - protein, 9 aa, Homo Sapiens
SHISAGAIG

SEQ ID NO: 8459 - protein, 9 aa, Homo Sapiens
DLQAENLMC

SEQ ID NO: 8460 - protein, 9 aa, Homo Sapiens
MAKRCSVTS

SEQ ID NO: 8461 - protein, 9 aa, Homo Sapiens
SSVGKAPSN

SEQ ID NO: 8462 - protein, 9 aa, Homo Sapiens
AQRPEELLK

SEQ ID NO: 8463 - protein, 9 aa, Homo Sapiens
QQLEHRVAR

SEQ ID NO: 8464 - protein, 9 aa, Homo Sapiens
QEEEEEEGD

SEQ ID NO: 8465 - protein, 9 aa, Homo Sapiens
IFYKMAAKF

SEQ ID NO: 8466 - protein, 9 aa, Homo Sapiens
PPPPRVAWV

SEQ ID NO: 8467 - protein, 9 aa, Homo Sapiens
STHKIIHNG

SEQ ID NO: 8468 - protein, 9 aa, Homo Sapiens
SCHCCLGFR

SEQ ID NO: 8469 - protein, 9 aa, Homo Sapiens
GIVMDSGDR

SEQ ID NO: 8470 - protein, 9 aa, Homo Sapiens
VCKDYGGDV

SEQ ID NO: 8471 - protein, 9 aa, Homo Sapiens
DLTGIKEEE

SEQ ID NO: 8472 - protein, 9 aa, Homo Sapiens
GLCVTALDG

SEQ ID NO: 8473 - protein, 9 aa, Homo Sapiens
AEAGPAGGP

SEQ ID NO: 8474 - protein, 9 aa, Homo Sapiens
VRSHSFRFH

SEQ ID NO: 8475 - protein, 9 aa, Homo Sapiens
WPSLPESGL

SEQ ID NO: 8476 - protein, 9 aa, Homo Sapiens
LQATNAVSA

SEQ ID NO: 8477 - protein, 9 aa, Homo Sapiens
EQFVKIAGG

SEQ ID NO: 8478 - protein, 9 aa, Homo Sapiens
ANDLALCLA

SEQ ID NO: 8479 - protein, 9 aa, Homo Sapiens
SPTSHMHCA

SEQ ID NO: 8480 - protein, 9 aa, Homo Sapiens
EFHYFQRIS

SEQ ID NO: 8481 - protein, 9 aa, Homo Sapiens
HPNIILVLT

SEQ ID NO: 8482 - protein, 9 aa, Homo Sapiens
CMASLILAR

SEQ ID NO: 8483 - protein, 9 aa, Homo Sapiens
SFFNVVYWL

SEQ ID NO: 8484 - protein, 9 aa, Homo Sapiens
HAGASLFVR

SEQ ID NO: 8485 - protein, 9 aa, Homo Sapiens
CYQGFEAPQ

SEQ ID NO: 8486 - protein, 9 aa, Homo Sapiens
KGLSLKSCE

SEQ ID NO: 8487 - protein, 9 aa, Homo Sapiens
GQLYASEHY

SEQ ID NO: 8488 - protein, 9 aa, Homo Sapiens
TFSFFNVVY

SEQ ID NO: 8489 - protein, 9 aa, Homo Sapiens
ETYRCPIRG

SEQ ID NO: 8490 - protein, 9 aa, Homo Sapiens
PEPQWCEVE

SEQ ID NO: 8491 - protein, 9 aa, Homo Sapiens
NPQESVQIE

SEQ ID NO: 8492 - protein, 9 aa, Homo Sapiens
NHLGLVEPR

SEQ ID NO: 8493 - protein, 9 aa, Homo Sapiens
SRMSYALEE

SEQ ID NO: 8494 - protein, 9 aa, Homo Sapiens
QRDRRNIHP

SEQ ID NO: 8495 - protein, 9 aa, Homo Sapiens
DKHMESVIP

SEQ ID NO: 8496 - protein, 9 aa, Homo Sapiens
GSKLHTFCG

SEQ ID NO: 8497 - protein, 9 aa, Homo Sapiens
GRSFCPPGH

SEQ ID NO: 8498 - protein, 9 aa, Homo Sapiens
DDDDLGMNV

SEQ ID NO: 8499 - protein, 9 aa, Homo Sapiens
CTYGNQILY

SEQ ID NO: 8500 - protein, 9 aa, Homo Sapiens
QEKPHCERD

SEQ ID NO: 8501 - protein, 9 aa, Homo Sapiens
PLPEINNVV

SEQ ID NO: 8502 - protein, 9 aa, Homo Sapiens
CASLQGLTI

SEQ ID NO: 8503 - protein, 9 aa, Homo Sapiens
LDLDVGNCR

SEQ ID NO: 8504 - protein, 9 aa, Homo Sapiens
GQSLQPLYR

SEQ ID NO: 8505 - protein, 9 aa, Homo Sapiens
ISGVSVLGF

SEQ ID NO: 8506 - protein, 9 aa, Homo Sapiens
SMDRYIGVS

SEQ ID NO: 8507 - protein, 9 aa, Homo Sapiens
HTRIHTREK

SEQ ID NO: 8508 - protein, 9 aa, Homo Sapiens
NLTAHTRIH

SEQ ID NO: 8509 - protein, 9 aa, Homo Sapiens
FTVDKNVVR

SEQ ID NO: 8510 - protein, 9 aa, Homo Sapiens
RLLQTQLMI

SEQ ID NO: 8511 - protein, 9 aa, Homo Sapiens
SSVTFEHPL

SEQ ID NO: 8512 - protein, 9 aa, Homo Sapiens
NTVDRESTS

SEQ ID NO: 8513 - protein, 9 aa, Homo Sapiens
FAGFTHSDL

SEQ ID NO: 8514 - protein, 9 aa, Homo Sapiens
LRKSQEFFQ

SEQ ID NO: 8515 - protein, 9 aa, Homo Sapiens
WDLTGIKEE

SEQ ID NO: 8516 - protein, 9 aa, Homo Sapiens
LRGEHTLTG

SEQ ID NO: 8517 - protein, 9 aa, Homo Sapiens
LLLDKLRKI

SEQ ID NO: 8518 - protein, 9 aa, Homo Sapiens
RGIKITVNY

SEQ ID NO: 8519 - protein, 9 aa, Homo Sapiens
ILLNEWSGS

SEQ ID NO: 8520 - protein, 9 aa, Homo Sapiens
TTDPGASSV

SEQ ID NO: 8521 - protein, 9 aa, Homo Sapiens
RELCSTKYI

SEQ ID NO: 8522 - protein, 9 aa, Homo Sapiens
QDLLNPIGV

SEQ ID NO: 8523 - protein, 9 aa, Homo Sapiens
VMDSGDRVT

SEQ ID NO: 8524 - protein, 9 aa, Homo Sapiens
VLEARTIQR

SEQ ID NO: 8525 - protein, 9 aa, Homo Sapiens
NSDRSEEVL

SEQ ID NO: 8526 - protein, 9 aa, Homo Sapiens
LGPPPPEGA

SEQ ID NO: 8527 - protein, 9 aa, Homo Sapiens
LNCFNLKGL

SEQ ID NO: 8528 - protein, 9 aa, Homo Sapiens
SDETPTNNL

SEQ ID NO: 8529 - protein, 9 aa, Homo Sapiens
LRKEVSRVL

SEQ ID NO: 8530 - protein, 9 aa, Homo Sapiens
PVENGFVNS

SEQ ID NO: 8531 - protein, 9 aa, Homo Sapiens
RKHKIIYTG

SEQ ID NO: 8532 - protein, 9 aa, Homo Sapiens
NIKANPGTN

SEQ ID NO: 8533 - protein, 9 aa, Homo Sapiens
AISGVSVLG

SEQ ID NO: 8534 - protein, 9 aa, Homo Sapiens
NSNTVDRES

SEQ ID NO: 8535 - protein, 9 aa, Homo Sapiens
VSNDPVVIK

SEQ ID NO: 8536 - protein, 9 aa, Homo Sapiens
GLVWDSEHC

SEQ ID NO: 8537 - protein, 9 aa, Homo Sapiens
DIKSVFRYC

SEQ ID NO: 8538 - protein, 9 aa, Homo Sapiens
QETYRCPIR

SEQ ID NO: 8539 - protein, 9 aa, Homo Sapiens
HRFLKRRLQ

SEQ ID NO: 8540 - protein, 9 aa, Homo Sapiens
RRYRPFVRS

SEQ ID NO: 8541 - protein, 9 aa, Homo Sapiens
ILQQPLQPG

SEQ ID NO: 8542 - protein, 9 aa, Homo Sapiens
FLKRRLQQL

SEQ ID NO: 8543 - protein, 9 aa, Homo Sapiens
FQRDRRNIH

SEQ ID NO: 8544 - protein, 9 aa, Homo Sapiens
ERNASWVMK

SEQ ID NO: 8545 - protein, 9 aa, Homo Sapiens
AKTSKMKVL

SEQ ID NO: 8546 - protein, 9 aa, Homo Sapiens
YRPAWPPYG

SEQ ID NO: 8547 - protein, 9 aa, Homo Sapiens
KVSIVTVHT

SEQ ID NO: 8548 - protein, 9 aa, Homo Sapiens
VLNEVDKHM

SEQ ID NO: 8549 - protein, 9 aa, Homo Sapiens
CWTSSHCQT

SEQ ID NO: 8550 - protein, 9 aa, Homo Sapiens
RCNFTPTEA

SEQ ID NO: 8551 - protein, 9 aa, Homo Sapiens
QAAASYHGQ

SEQ ID NO: 8552 - protein, 9 aa, Homo Sapiens
FQRRWSVGS

SEQ ID NO: 8553 - protein, 9 aa, Homo Sapiens
INLQRSYTV

SEQ ID NO: 8554 - protein, 9 aa, Homo Sapiens
GIVVFQRRW

SEQ ID NO: 8555 - protein, 9 aa, Homo Sapiens
SLHATVWII

SEQ ID NO: 8556 - protein, 9 aa, Homo Sapiens
RVAYLLQHI

SEQ ID NO: 8557 - protein, 9 aa, Homo Sapiens
HLKKEKAEI

SEQ ID NO: 8558 - protein, 9 aa, Homo Sapiens
GQQPAGAGS

SEQ ID NO: 8559 - protein, 9 aa, Homo Sapiens
IMGLCIISM

SEQ ID NO: 8560 - protein, 9 aa, Homo Sapiens
WGNSTNIKA

SEQ ID NO: 8561 - protein, 9 aa, Homo Sapiens
VDKHMESVI

SEQ ID NO: 8562 - protein, 9 aa, Homo Sapiens
ALQLKVSSE

SEQ ID NO: 8563 - protein, 9 aa, Homo Sapiens
VIMEAMAEH

SEQ ID NO: 8564 - protein, 9 aa, Homo Sapiens
SPLLQAFAQ

SEQ ID NO: 8565 - protein, 9 aa, Homo Sapiens
LQRICNHLG

SEQ ID NO: 8566 - protein, 9 aa, Homo Sapiens
NDDDDDLGM

SEQ ID NO: 8567 - protein, 9 aa, Homo Sapiens
LDMAKRCSV

SEQ ID NO: 8568 - protein, 9 aa, Homo Sapiens
KIEEKLTPV

SEQ ID NO: 8569 - protein, 9 aa, Homo Sapiens
THKIGKITG

SEQ ID NO: 8570 - protein, 9 aa, Homo Sapiens
MNFTNEKLQ

SEQ ID NO: 8571 - protein, 9 aa, Homo Sapiens
KENLEPNAK

SEQ ID NO: 8572 - protein, 9 aa, Homo Sapiens
VSPPLPAIS

SEQ ID NO: 8573 - protein, 9 aa, Homo Sapiens
QGGPGMELG

SEQ ID NO: 8574 - protein, 9 aa, Homo Sapiens
MYSAPGKDL

SEQ ID NO: 8575 - protein, 9 aa, Homo Sapiens
GVSVLGFFI

SEQ ID NO: 8576 - protein, 9 aa, Homo Sapiens
NVQFTVDKN

SEQ ID NO: 8577 - protein, 9 aa, Homo Sapiens
SKRRRLSSL

SEQ ID NO: 8578 - protein, 9 aa, Homo Sapiens
QLKSKERKT

SEQ ID NO: 8579 - protein, 9 aa, Homo Sapiens
VPHGLQDLL

SEQ ID NO: 8580 - protein, 9 aa, Homo Sapiens
LHATVWIIN

SEQ ID NO: 8581 - protein, 9 aa, Homo Sapiens
KDYGGDVQA

SEQ ID NO: 8582 - protein, 9 aa, Homo Sapiens
LIFQKAISE

SEQ ID NO: 8583 - protein, 9 aa, Homo Sapiens
VQVGCRELC

SEQ ID NO: 8584 - protein, 9 aa, Homo Sapiens
DLGMNVTIF

SEQ ID NO: 8585 - protein, 9 aa, Homo Sapiens
HNDRRFVIQ

SEQ ID NO: 8586 - protein, 9 aa, Homo Sapiens
AVKLKAIPS

SEQ ID NO: 8587 - protein, 9 aa, Homo Sapiens
SGSETITPS

SEQ ID NO: 8588 - protein, 9 aa, Homo Sapiens
HSHALKPMA

SEQ ID NO: 8589 - protein, 9 aa, Homo Sapiens
TTCTLQEME

SEQ ID NO: 8590 - protein, 9 aa, Homo Sapiens
AIRVAYLLQ

SEQ ID NO: 8591 - protein, 9 aa, Homo Sapiens
DCMASLILA

SEQ ID NO: 8592 - protein, 9 aa, Homo Sapiens
WENMARICV

SEQ ID NO: 8593 - protein, 9 aa, Homo Sapiens
MYRLQSYKC

SEQ ID NO: 8594 - protein, 9 aa, Homo Sapiens
EFEDSDVEN

SEQ ID NO: 8595 - protein, 9 aa, Homo Sapiens
ISENLSQEA

SEQ ID NO: 8596 - protein, 9 aa, Homo Sapiens
VTRGIKITV

SEQ ID NO: 8597 - protein, 9 aa, Homo Sapiens
LTGIKEEEE

SEQ ID NO: 8598 - protein, 9 aa, Homo Sapiens
EMTTVFTSG

SEQ ID NO: 8599 - protein, 9 aa, Homo Sapiens
GSLHATVWI

SEQ ID NO: 8600 - protein, 9 aa, Homo Sapiens
TTQEKPHCE

SEQ ID NO: 8601 - protein, 9 aa, Homo Sapiens
LGLVEPRHP

SEQ ID NO: 8602 - protein, 9 aa, Homo Sapiens
HPKGSLSLQ

SEQ ID NO: 8603 - protein, 9 aa, Homo Sapiens
QGFEAPQDG

SEQ ID NO: 8604 - protein, 9 aa, Homo Sapiens
HLGLVEPRH

SEQ ID NO: 8605 - protein, 9 aa, Homo Sapiens
SGKQVWHSE

SEQ ID NO: 8606 - protein, 9 aa, Homo Sapiens
YTGKTYSGY

SEQ ID NO: 8607 - protein, 9 aa, Homo Sapiens
PWGLCTHEN

SEQ ID NO: 8608 - protein, 9 aa, Homo Sapiens
PITFSFFNV

SEQ ID NO: 8609 - protein, 9 aa, Homo Sapiens
NEAYVMAGV

SEQ ID NO: 8610 - protein, 9 aa, Homo Sapiens
CDCHPKGSL

SEQ ID NO: 8611 - protein, 9 aa, Homo Sapiens
ALGYELCKP

SEQ ID NO: 8612 - protein, 9 aa, Homo Sapiens
KSSSVSLVS

SEQ ID NO: 8613 - protein, 9 aa, Homo Sapiens
FDTEGDCIS

SEQ ID NO: 8614 - protein, 9 aa, Homo Sapiens
NQILYLGSL

SEQ ID NO: 8615 - protein, 9 aa, Homo Sapiens
VLAQHRAEQ

SEQ ID NO: 8616 - protein, 9 aa, Homo Sapiens
FIRFPADKA

SEQ ID NO: 8617 - protein, 9 aa, Homo Sapiens
SVTFEHPLD

SEQ ID NO: 8618 - protein, 9 aa, Homo Sapiens
PTLVIIILY

SEQ ID NO: 8619 - protein, 9 aa, Homo Sapiens
RIINVAPSD

SEQ ID NO: 8620 - protein, 9 aa, Homo Sapiens
TFHWCCQVS

SEQ ID NO: 8621 - protein, 9 aa, Homo Sapiens
QFVKIAGGT

SEQ ID NO: 8622 - protein, 9 aa, Homo Sapiens
YQDRGGQQP

SEQ ID NO: 8623 - protein, 9 aa, Homo Sapiens
LDQLKSKER

SEQ ID NO: 8624 - protein, 9 aa, Homo Sapiens
SVLGFFIIA

SEQ ID NO: 8625 - protein, 9 aa, Homo Sapiens
KVSGLRIIN

SEQ ID NO: 8626 - protein, 9 aa, Homo Sapiens
HNYEDLPCK

SEQ ID NO: 8627 - protein, 9 aa, Homo Sapiens
QVVRLKGQV

SEQ ID NO: 8628 - protein, 9 aa, Homo Sapiens
HFQEQFRDH

SEQ ID NO: 8629 - protein, 9 aa, Homo Sapiens
ASRTTHNEE

SEQ ID NO: 8630 - protein, 9 aa, Homo Sapiens
KEKRQEQIS

SEQ ID NO: 8631 - protein, 9 aa, Homo Sapiens
TSGSETITP

SEQ ID NO: 8632 - protein, 9 aa, Homo Sapiens
GERNASWVM

SEQ ID NO: 8633 - protein, 9 aa, Homo Sapiens
PEQAQALGV

SEQ ID NO: 8634 - protein, 9 aa, Homo Sapiens
KPESENLEL

SEQ ID NO: 8635 - protein, 9 aa, Homo Sapiens
GGDHKTEST

SEQ ID NO: 8636 - protein, 9 aa, Homo Sapiens
KDLGMEPHR

SEQ ID NO: 8637 - protein, 9 aa, Homo Sapiens
YHGQPGNAY

SEQ ID NO: 8638 - protein, 9 aa, Homo Sapiens
QWCEVEGLV

SEQ ID NO: 8639 - protein, 9 aa, Homo Sapiens
SPVENGFVN

SEQ ID NO: 8640 - protein, 9 aa, Homo Sapiens
ITIHKSKNI

SEQ ID NO: 8641 - protein, 9 aa, Homo Sapiens
DCHPKGSLS

SEQ ID NO: 8642 - protein, 9 aa, Homo Sapiens
QRPGTLGPP

SEQ ID NO: 8643 - protein, 9 aa, Homo Sapiens
GAEMVIHTS

SEQ ID NO: 8644 - protein, 9 aa, Homo Sapiens
IKFGKYKAE

SEQ ID NO: 8645 - protein, 9 aa, Homo Sapiens
TLVIIILYS

SEQ ID NO: 8646 - protein, 9 aa, Homo Sapiens
QFILLGLTD

SEQ ID NO: 8647 - protein, 9 aa, Homo Sapiens
CRPSCCKTT

SEQ ID NO: 8648 - protein, 9 aa, Homo Sapiens
ELQIKRLSK

SEQ ID NO: 8649 - protein, 9 aa, Homo Sapiens
EISEFEDSD

SEQ ID NO: 8650 - protein, 9 aa, Homo Sapiens
ERPYRCLVC

SEQ ID NO: 8651 - protein, 9 aa, Homo Sapiens
EANYINLQR

SEQ ID NO: 8652 - protein, 9 aa, Homo Sapiens
DFLPLAKSQ

SEQ ID NO: 8653 - protein, 9 aa, Homo Sapiens
LQQLEHRVA

SEQ ID NO: 8654 - protein, 9 aa, Homo Sapiens
ECTQRVQRE

SEQ ID NO: 8655 - protein, 9 aa, Homo Sapiens
EQGGPGMEL

SEQ ID NO: 8656 - protein, 9 aa, Homo Sapiens
QDRGGQQPA

SEQ ID NO: 8657 - protein, 9 aa, Homo Sapiens
QQFPLSRLS

SEQ ID NO: 8658 - protein, 9 aa, Homo Sapiens
QAQRPEELL

SEQ ID NO: 8659 - protein, 9 aa, Homo Sapiens
RSFCPPGHP

SEQ ID NO: 8660 - protein, 9 aa, Homo Sapiens
MGSAFCTSK

SEQ ID NO: 8661 - protein, 9 aa, Homo Sapiens
PVPHGLQDL

SEQ ID NO: 8662 - protein, 9 aa, Homo Sapiens
TKRGKTLSW

SEQ ID NO: 8663 - protein, 9 aa, Homo Sapiens
RCPIRGMKE

SEQ ID NO: 8664 - protein, 9 aa, Homo Sapiens
TRITIHKSK

SEQ ID NO: 8665 - protein, 9 aa, Homo Sapiens
DPVVIKLQE

SEQ ID NO: 8666 - protein, 9 aa, Homo Sapiens
HCQTVCPCP

SEQ ID NO: 8667 - protein, 9 aa, Homo Sapiens
EAAGGDHKT

SEQ ID NO: 8668 - protein, 9 aa, Homo Sapiens
GEAYSRMSY

SEQ ID NO: 8669 - protein, 9 aa, Homo Sapiens
LQYDINKLS

SEQ ID NO: 8670 - protein, 9 aa, Homo Sapiens
VPQVPQKTT

SEQ ID NO: 8671 - protein, 9 aa, Homo Sapiens
NNVVSGKTS

SEQ ID NO: 8672 - protein, 9 aa, Homo Sapiens
DSDILLNEW

SEQ ID NO: 8673 - protein, 9 aa, Homo Sapiens
KLRRSQRLK

SEQ ID NO: 8674 - protein, 9 aa, Homo Sapiens
HHLCDPQNT

SEQ ID NO: 8675 - protein, 9 aa, Homo Sapiens
GWGNSTNIK

SEQ ID NO: 8676 - protein, 9 aa, Homo Sapiens
PVKPSAPKL

SEQ ID NO: 8677 - protein, 9 aa, Homo Sapiens
GNQLFRMRA

SEQ ID NO: 8678 - protein, 9 aa, Homo Sapiens
LAMNKRGQL

SEQ ID NO: 8679 - protein, 9 aa, Homo Sapiens
RYRPFVRSH

SEQ ID NO: 8680 - protein, 9 aa, Homo Sapiens
CELPGQVML

SEQ ID NO: 8681 - protein, 9 aa, Homo Sapiens
QTTCTLQEM

SEQ ID NO: 8682 - protein, 9 aa, Homo Sapiens
ISHNDRRFV

SEQ ID NO: 8683 - protein, 9 aa, Homo Sapiens
TNECHPDQT

SEQ ID NO: 8684 - protein, 9 aa, Homo Sapiens
CSDIGTNHT

SEQ ID NO: 8685 - protein, 9 aa, Homo Sapiens
YRYMDTCLI

SEQ ID NO: 8686 - protein, 9 aa, Homo Sapiens
LVENSMETR

SEQ ID NO: 8687 - protein, 9 aa, Homo Sapiens
EKLRRSQRL

SEQ ID NO: 8688 - protein, 9 aa, Homo Sapiens
NGGSSVTFE

SEQ ID NO: 8689 - protein, 9 aa, Homo Sapiens
VGKAPSNSG

SEQ ID NO: 8690 - protein, 9 aa, Homo Sapiens
GPRARAKTS

SEQ ID NO: 8691 - protein, 9 aa, Homo Sapiens
SETPSAWSP

SEQ ID NO: 8692 - protein, 9 aa, Homo Sapiens
HRSIKYCIW

SEQ ID NO: 8693 - protein, 9 aa, Homo Sapiens
TLGSKLHTF

SEQ ID NO: 8694 - protein, 9 aa, Homo Sapiens
FFNKVSGLR

SEQ ID NO: 8695 - protein, 9 aa, Homo Sapiens
ARCCYLYYF

SEQ ID NO: 8696 - protein, 9 aa, Homo Sapiens
IREIAPQRI

SEQ ID NO: 8697 - protein, 9 aa, Homo Sapiens
HVDLSGDSE

SEQ ID NO: 8698 - protein, 9 aa, Homo Sapiens
PALPSDDLI

SEQ ID NO: 8699 - protein, 9 aa, Homo Sapiens
TGKTYSGYW

SEQ ID NO: 8700 - protein, 9 aa, Homo Sapiens
NGVTKRGKT

SEQ ID NO: 8701 - protein, 9 aa, Homo Sapiens
LSGDSEETV

SEQ ID NO: 8702 - protein, 9 aa, Homo Sapiens
LNRYLCIAV

SEQ ID NO: 8703 - protein, 9 aa, Homo Sapiens
GKYKAEKSH

SEQ ID NO: 8704 - protein, 9 aa, Homo Sapiens
LDWQRHAAR

SEQ ID NO: 8705 - protein, 9 aa, Homo Sapiens
PADKASIQA

SEQ ID NO: 8706 - protein, 9 aa, Homo Sapiens
DLNIPDNPR

SEQ ID NO: 8707 - protein, 9 aa, Homo Sapiens
FTLQGSGYA

SEQ ID NO: 8708 - protein, 9 aa, Homo Sapiens
TVWIINIYK

SEQ ID NO: 8709 - protein, 9 aa, Homo Sapiens
CRRNFSRRL

SEQ ID NO: 8710 - protein, 9 aa, Homo Sapiens
DGSLHATVW

SEQ ID NO: 8711 - protein, 9 aa, Homo Sapiens
ALRKHKIIY

SEQ ID NO: 8712 - protein, 9 aa, Homo Sapiens
IVPQVPQKT

SEQ ID NO: 8713 - protein, 9 aa, Homo Sapiens
KDFGRGLSL

SEQ ID NO: 8714 - protein, 9 aa, Homo Sapiens
NDISIHDFT

SEQ ID NO: 8715 - protein, 9 aa, Homo Sapiens
FQASVRSLG

SEQ ID NO: 8716 - protein, 9 aa, Homo Sapiens
LGFSESENK

SEQ ID NO: 8717 - protein, 9 aa, Homo Sapiens
LIGVTLAGH

SEQ ID NO: 8718 - protein, 9 aa, Homo Sapiens
LKQRQNCKG

SEQ ID NO: 8719 - protein, 9 aa, Homo Sapiens
LRSCYYVTR

SEQ ID NO: 8720 - protein, 9 aa, Homo Sapiens
KIKWEQMWR

SEQ ID NO: 8721 - protein, 9 aa, Homo Sapiens
CTHENQVAC

SEQ ID NO: 8722 - protein, 9 aa, Homo Sapiens
RAGLIGAVK

SEQ ID NO: 8723 - protein, 9 aa, Homo Sapiens
SRLSSDSAA

SEQ ID NO: 8724 - protein, 9 aa, Homo Sapiens
FCLPFMVLD

SEQ ID NO: 8725 - protein, 9 aa, Homo Sapiens
EPNAKFDKR

SEQ ID NO: 8726 - protein, 9 aa, Homo Sapiens
MTAEDLLLI

SEQ ID NO: 8727 - protein, 9 aa, Homo Sapiens
VENSMETRP

SEQ ID NO: 8728 - protein, 9 aa, Homo Sapiens
QIALIPLSP

SEQ ID NO: 8729 - protein, 9 aa, Homo Sapiens
QKEGNYGNN

SEQ ID NO: 8730 - protein, 9 aa, Homo Sapiens
NNRFSYANI

SEQ ID NO: 8731 - protein, 9 aa, Homo Sapiens
KVINTLNGL

SEQ ID NO: 8732 - protein, 9 aa, Homo Sapiens
RLKGQVLSV

SEQ ID NO: 8733 - protein, 9 aa, Homo Sapiens
GATVHELSQ

SEQ ID NO: 8734 - protein, 9 aa, Homo Sapiens
ENLSQEAIL

SEQ ID NO: 8735 - protein, 9 aa, Homo Sapiens
QSSAFTLQG

SEQ ID NO: 8736 - protein, 9 aa, Homo Sapiens
PKDAEKVIN

SEQ ID NO: 8737 - protein, 9 aa, Homo Sapiens
PSSLCKHMK

SEQ ID NO: 8738 - protein, 9 aa, Homo Sapiens
QRGNQLFRM

SEQ ID NO: 8739 - protein, 9 aa, Homo Sapiens
LVTLRDAFI

SEQ ID NO: 8740 - protein, 9 aa, Homo Sapiens
WCEVEGLVD

SEQ ID NO: 8741 - protein, 9 aa, Homo Sapiens
RPYRCLVCG

SEQ ID NO: 8742 - protein, 9 aa, Homo Sapiens
IPHSSLATA

SEQ ID NO: 8743 - protein, 9 aa, Homo Sapiens
EEVLAQHRA

SEQ ID NO: 8744 - protein, 9 aa, Homo Sapiens
GRNLRKEVS

SEQ ID NO: 8745 - protein, 9 aa, Homo Sapiens
VTRITIHKS

SEQ ID NO: 8746 - protein, 9 aa, Homo Sapiens
SFQAIYTAV

SEQ ID NO: 8747 - protein, 9 aa, Homo Sapiens
RPAWPPYGD

SEQ ID NO: 8748 - protein, 9 aa, Homo Sapiens
KRGQLYASE

SEQ ID NO: 8749 - protein, 9 aa, Homo Sapiens
KSKERKTQS

SEQ ID NO: 8750 - protein, 9 aa, Homo Sapiens
GYSCHCCLG

SEQ ID NO: 8751 - protein, 9 aa, Homo Sapiens
YILVTNECH

SEQ ID NO: 8752 - protein, 9 aa, Homo Sapiens
RRICRTNTV

SEQ ID NO: 8753 - protein, 9 aa, Homo Sapiens
LQIKRLSKL

SEQ ID NO: 8754 - protein, 9 aa, Homo Sapiens
KSQEFFQTC

SEQ ID NO: 8755 - protein, 9 aa, Homo Sapiens
GTQKRGRGR

SEQ ID NO: 8756 - protein, 9 aa, Homo Sapiens
STNIKANPG

SEQ ID NO: 8757 - protein, 9 aa, Homo Sapiens
GIKITVNYL

SEQ ID NO: 8758 - protein, 9 aa, Homo Sapiens
ESENLELTY

SEQ ID NO: 8759 - protein, 9 aa, Homo Sapiens
YFLYMFVYY

SEQ ID NO: 8760 - protein, 9 aa, Homo Sapiens
TQEKPHCER

SEQ ID NO: 8761 - protein, 9 aa, Homo Sapiens
GMVFVKGKL

SEQ ID NO: 8762 - protein, 9 aa, Homo Sapiens
AQELIMNVQ

SEQ ID NO: 8763 - protein, 9 aa, Homo Sapiens
TKAISENLS

SEQ ID NO: 8764 - protein, 9 aa, Homo Sapiens
CDPQNTVFE

SEQ ID NO: 8765 - protein, 9 aa, Homo Sapiens
LCKKLGGLC

SEQ ID NO: 8766 - protein, 9 aa, Homo Sapiens
NCSCKAGGS

SEQ ID NO: 8767 - protein, 9 aa, Homo Sapiens
RSQRLKQRQ

SEQ ID NO: 8768 - protein, 9 aa, Homo Sapiens
EQYILVTNE

SEQ ID NO: 8769 - protein, 9 aa, Homo Sapiens
GKQVWHSEE

SEQ ID NO: 8770 - protein, 9 aa, Homo Sapiens
ADKASIQAL

SEQ ID NO: 8771 - protein, 9 aa, Homo Sapiens
PYRPAWPPY

SEQ ID NO: 8772 - protein, 9 aa, Homo Sapiens
YTPAFFSLF

SEQ ID NO: 8773 - protein, 9 aa, Homo Sapiens
AHTRIHTRE

SEQ ID NO: 8774 - protein, 9 aa, Homo Sapiens
DVRLEATKE

SEQ ID NO: 8775 - protein, 9 aa, Homo Sapiens
ITRSRYFLY

SEQ ID NO: 8776 - protein, 9 aa, Homo Sapiens
MTVRSETPS

SEQ ID NO: 8777 - protein, 9 aa, Homo Sapiens
AVGQSLQPL

SEQ ID NO: 8778 - protein, 9 aa, Homo Sapiens
IDLIFQKAI

SEQ ID NO: 8779 - protein, 9 aa, Homo Sapiens
THNEEQSGD

SEQ ID NO: 8780 - protein, 9 aa, Homo Sapiens
PRPPKSSSV

SEQ ID NO: 8781 - protein, 9 aa, Homo Sapiens
AGGDHKTES

SEQ ID NO: 8782 - protein, 9 aa, Homo Sapiens
PGKNGSIVT

SEQ ID NO: 8783 - protein, 9 aa, Homo Sapiens
ATGPCVPST

SEQ ID NO: 8784 - protein, 9 aa, Homo Sapiens
TTNSNSSFS

SEQ ID NO: 8785 - protein, 9 aa, Homo Sapiens
TERLRSCYY

SEQ ID NO: 8786 - protein, 9 aa, Homo Sapiens
NDNGGSSVT

SEQ ID NO: 8787 - protein, 9 aa, Homo Sapiens
AIREVDIKS

SEQ ID NO: 8788 - protein, 9 aa, Homo Sapiens
TGKFVCLDD

SEQ ID NO: 8789 - protein, 9 aa, Homo Sapiens
TVARAKILQ

SEQ ID NO: 8790 - protein, 9 aa, Homo Sapiens
QAESCDCLQ

SEQ ID NO: 8791 - protein, 9 aa, Homo Sapiens
TKQQFPLSR

SEQ ID NO: 8792 - protein, 9 aa, Homo Sapiens
CCQVSCRNC

SEQ ID NO: 8793 - protein, 9 aa, Homo Sapiens
RCLVCGKGF

SEQ ID NO: 8794 - protein, 9 aa, Homo Sapiens
YQGFEAPQD

SEQ ID NO: 8795 - protein, 9 aa, Homo Sapiens
IALIPLSPA

SEQ ID NO: 8796 - protein, 9 aa, Homo Sapiens
CVVRYTGKT

SEQ ID NO: 8797 - protein, 9 aa, Homo Sapiens
LSQDKKKDT

SEQ ID NO: 8798 - protein, 9 aa, Homo Sapiens
EVGPLELQI

SEQ ID NO: 8799 - protein, 9 aa, Homo Sapiens
CYYVTRKLF

SEQ ID NO: 8800 - protein, 9 aa, Homo Sapiens
TPLHVTHRF

SEQ ID NO: 8801 - protein, 9 aa, Homo Sapiens
SSTNLTAHT

SEQ ID NO: 8802 - protein, 9 aa, Homo Sapiens
SSHCQTVCP

SEQ ID NO: 8803 - protein, 9 aa, Homo Sapiens
HRTTVEVKP

SEQ ID NO: 8804 - protein, 9 aa, Homo Sapiens
EMVIHTSGK

SEQ ID NO: 8805 - protein, 9 aa, Homo Sapiens
FISHNDRRF

SEQ ID NO: 8806 - protein, 9 aa, Homo Sapiens
LLQSADEQA

SEQ ID NO: 8807 - protein, 9 aa, Homo Sapiens
TKEIYLTPV

SEQ ID NO: 8808 - protein, 9 aa, Homo Sapiens
DTEGDCISL

SEQ ID NO: 8809 - protein, 9 aa, Homo Sapiens
QRNTKPYRK

SEQ ID NO: 8810 - protein, 9 aa, Homo Sapiens
VDKNVVRTD

SEQ ID NO: 8811 - protein, 9 aa, Homo Sapiens
PKGSLSLQC

SEQ ID NO: 8812 - protein, 9 aa, Homo Sapiens
STNLTAHTR

SEQ ID NO: 8813 - protein, 9 aa, Homo Sapiens
MDTCLIDVD

SEQ ID NO: 8814 - protein, 9 aa, Homo Sapiens
NSNSSFSSD

SEQ ID NO: 8815 - protein, 9 aa, Homo Sapiens
TYRCPIRGM

SEQ ID NO: 8816 - protein, 9 aa, Homo Sapiens
EFDTEGDCI

SEQ ID NO: 8817 - protein, 9 aa, Homo Sapiens
INNVVSGKT

SEQ ID NO: 8818 - protein, 9 aa, Homo Sapiens
PLLQAFAQA

SEQ ID NO: 8819 - protein, 9 aa, Homo Sapiens
GVTRITIHK

SEQ ID NO: 8820 - protein, 9 aa, Homo Sapiens
ALIPLSPAS

SEQ ID NO: 8821 - protein, 9 aa, Homo Sapiens
CGAQLHAGA

SEQ ID NO: 8822 - protein, 9 aa, Homo Sapiens
MPPENVGEV

SEQ ID NO: 8823 - protein, 9 aa, Homo Sapiens
YFTTILPGI

SEQ ID NO: 8824 - protein, 9 aa, Homo Sapiens
DEFQRGNQL

SEQ ID NO: 8825 - protein, 9 aa, Homo Sapiens
HYFQRISSW

SEQ ID NO: 8826 - protein, 9 aa, Homo Sapiens
EYKDDFEKD

SEQ ID NO: 8827 - protein, 9 aa, Homo Sapiens
VHELSQDKK

SEQ ID NO: 8828 - protein, 9 aa, Homo Sapiens
SGQSSAFTL

SEQ ID NO: 8829 - protein, 9 aa, Homo Sapiens
VFEQNFLST

SEQ ID NO: 8830 - protein, 9 aa, Homo Sapiens
FCSDIGTNH

SEQ ID NO: 8831 - protein, 9 aa, Homo Sapiens
EKVINTLNG

SEQ ID NO: 8832 - protein, 9 aa, Homo Sapiens
RSEEVLDMT

SEQ ID NO: 8833 - protein, 9 aa, Homo Sapiens
ELCKPEVIA

SEQ ID NO: 8834 - protein, 9 aa, Homo Sapiens
SVFELDYNY

SEQ ID NO: 8835 - protein, 9 aa, Homo Sapiens
IVVFQRRWS

SEQ ID NO: 8836 - protein, 9 aa, Homo Sapiens
THRTTVEVK

SEQ ID NO: 8837 - protein, 9 aa, Homo Sapiens
RARVLSLLD

SEQ ID NO: 8838 - protein, 9 aa, Homo Sapiens
MTERLRSCY

SEQ ID NO: 8839 - protein, 9 aa, Homo Sapiens
FVPSEESNL

SEQ ID NO: 8840 - protein, 9 aa, Homo Sapiens
ANYINLQRS

SEQ ID NO: 8841 - protein, 9 aa, Homo Sapiens
THSDLNGKT

SEQ ID NO: 8842 - protein, 9 aa, Homo Sapiens
HTLTGKFVC

SEQ ID NO: 8843 - protein, 9 aa, Homo Sapiens
ILYLGSLSK

SEQ ID NO: 8844 - protein, 9 aa, Homo Sapiens
ESEISEFED

SEQ ID NO: 8845 - protein, 9 aa, Homo Sapiens
IDPKDAEKV

SEQ ID NO: 8846 - protein, 9 aa, Homo Sapiens
IHRSIKYCI

SEQ ID NO: 8847 - protein, 9 aa, Homo Sapiens
SPSFSVRLG

SEQ ID NO: 8848 - protein, 9 aa, Homo Sapiens
DSRSRVLSP

SEQ ID NO: 8849 - protein, 9 aa, Homo Sapiens
SFHLTATIF

SEQ ID NO: 8850 - protein, 9 aa, Homo Sapiens
MENPFVHSM

SEQ ID NO: 8851 - protein, 9 aa, Homo Sapiens
DYKAQREDK

SEQ ID NO: 8852 - protein, 9 aa, Homo Sapiens
LCSTKYISD

SEQ ID NO: 8853 - protein, 9 aa, Homo Sapiens
ASDEEEFDT

SEQ ID NO: 8854 - protein, 9 aa, Homo Sapiens
DIGTNHTHL

SEQ ID NO: 8855 - protein, 9 aa, Homo Sapiens
DEEEFDTEG

SEQ ID NO: 8856 - protein, 9 aa, Homo Sapiens
EQFRDHIEM

SEQ ID NO: 8857 - protein, 9 aa, Homo Sapiens
ATVHELSQD

SEQ ID NO: 8858 - protein, 9 aa, Homo Sapiens
NSPEGAVGQ

SEQ ID NO: 8859 - protein, 9 aa, Homo Sapiens
GMPPENVGE

SEQ ID NO: 8860 - protein, 9 aa, Homo Sapiens
VKGMVFVKG

SEQ ID NO: 8861 - protein, 9 aa, Homo Sapiens
TTIISTDLQ

SEQ ID NO: 8862 - protein, 9 aa, Homo Sapiens
QTTNSNSSF

SEQ ID NO: 8863 - protein, 9 aa, Homo Sapiens
HDFTCDEEN

SEQ ID NO: 8864 - protein, 9 aa, Homo Sapiens
HLTATIFNY

SEQ ID NO: 8865 - protein, 9 aa, Homo Sapiens
YNYVQIPYE

SEQ ID NO: 8866 - protein, 9 aa, Homo Sapiens
IHKSKNILF

SEQ ID NO: 8867 - protein, 9 aa, Homo Sapiens
NSTSERFLQ

SEQ ID NO: 8868 - protein, 9 aa, Homo Sapiens
TGRNLRKEV

SEQ ID NO: 8869 - protein, 9 aa, Homo Sapiens
PSVFEQNFL

SEQ ID NO: 8870 - protein, 9 aa, Homo Sapiens
SLHFQEQFR

SEQ ID NO: 8871 - protein, 9 aa, Homo Sapiens
ATGEQFVKI

SEQ ID NO: 8872 - protein, 9 aa, Homo Sapiens
SVVLQALVP

SEQ ID NO: 8873 - protein, 9 aa, Homo Sapiens
NSTNIKANP

SEQ ID NO: 8874 - protein, 9 aa, Homo Sapiens
TGEVPYWGI

SEQ ID NO: 8875 - protein, 9 aa, Homo Sapiens
VTNECHPDQ

SEQ ID NO: 8876 - protein, 9 aa, Homo Sapiens
DFVFRCNFT

SEQ ID NO: 8877 - protein, 9 aa, Homo Sapiens
MARICVKTQ

SEQ ID NO: 8878 - protein, 9 aa, Homo Sapiens
RSCYYVTRK

SEQ ID NO: 8879 - protein, 9 aa, Homo Sapiens
RYLCIAVLP

SEQ ID NO: 8880 - protein, 9 aa, Homo Sapiens
RQPTEKVLA

SEQ ID NO: 8881 - protein, 9 aa, Homo Sapiens
GGSSVTFEH

SEQ ID NO: 8882 - protein, 9 aa, Homo Sapiens
FDRMIFYKM

SEQ ID NO: 8883 - protein, 9 aa, Homo Sapiens
VCGAQLHAG

SEQ ID NO: 8884 - protein, 9 aa, Homo Sapiens
ATSPLVLIA

SEQ ID NO: 8885 - protein, 9 aa, Homo Sapiens
NYVQIPYEV

SEQ ID NO: 8886 - protein, 9 aa, Homo Sapiens
IYTAVESAG

SEQ ID NO: 8887 - protein, 9 aa, Homo Sapiens
NVCAPRGPR

SEQ ID NO: 8888 - protein, 9 aa, Homo Sapiens
GTICYPNPS

SEQ ID NO: 8889 - protein, 9 aa, Homo Sapiens
ASFQAIYTA

SEQ ID NO: 8890 - protein, 9 aa, Homo Sapiens
TIHLAQELI

SEQ ID NO: 8891 - protein, 9 aa, Homo Sapiens
QLQQLEHRV

SEQ ID NO: 8892 - protein, 9 aa, Homo Sapiens
CDLTEAVVR

SEQ ID NO: 8893 - protein, 9 aa, Homo Sapiens
TVHELSQDK

SEQ ID NO: 8894 - protein, 9 aa, Homo Sapiens
YTHPSSLCK

SEQ ID NO: 8895 - protein, 9 aa, Homo Sapiens
KKSEEYKDD

SEQ ID NO: 8896 - protein, 9 aa, Homo Sapiens
AQREDKLTF

SEQ ID NO: 8897 - protein, 9 aa, Homo Sapiens
SDRSEEVLD

SEQ ID NO: 8898 - protein, 9 aa, Homo Sapiens
RGESFHLTA

SEQ ID NO: 8899 - protein, 9 aa, Homo Sapiens
VGNCRETED

SEQ ID NO: 8900 - protein, 9 aa, Homo Sapiens
ASLAAASVD

SEQ ID NO: 8901 - protein, 9 aa, Homo Sapiens
KQQFPLSRL

SEQ ID NO: 8902 - protein, 9 aa, Homo Sapiens
RAQIALIPL

SEQ ID NO: 8903 - protein, 9 aa, Homo Sapiens
IQEEVLAQH

SEQ ID NO: 8904 - protein, 9 aa, Homo Sapiens
RSASRTTHN

SEQ ID NO: 8905 - protein, 9 aa, Homo Sapiens
LTGEVPYWG

SEQ ID NO: 8906 - protein, 9 aa, Homo Sapiens
PHGLQDLLN

SEQ ID NO: 8907 - protein, 9 aa, Homo Sapiens
LCDPQNTVF

SEQ ID NO: 8908 - protein, 9 aa, Homo Sapiens
DFAGFTHSD

SEQ ID NO: 8909 - protein, 9 aa, Homo Sapiens
PQWCEVEGL

SEQ ID NO: 8910 - protein, 9 aa, Homo Sapiens
DDLITNILD

SEQ ID NO: 8911 - protein, 9 aa, Homo Sapiens
NNLQLGSPS

SEQ ID NO: 8912 - protein, 9 aa, Homo Sapiens
SSAFTLQGS

SEQ ID NO: 8913 - protein, 9 aa, Homo Sapiens
VVRLKGQVL

SEQ ID NO: 8914 - protein, 9 aa, Homo Sapiens
TQPVKPSAP

SEQ ID NO: 8915 - protein, 9 aa, Homo Sapiens
APYLLSAEA

SEQ ID NO: 8916 - protein, 9 aa, Homo Sapiens
ISEFEDSDV

SEQ ID NO: 8917 - protein, 9 aa, Homo Sapiens
LPAISQSDK

SEQ ID NO: 8918 - protein, 9 aa, Homo Sapiens
ADEFQRGNQ

SEQ ID NO: 8919 - protein, 9 aa, Homo Sapiens
VTSSNSVDF

SEQ ID NO: 8920 - protein, 9 aa, Homo Sapiens
REDKLTFIK

SEQ ID NO: 8921 - protein, 9 aa, Homo Sapiens
FFPITFSFF

SEQ ID NO: 8922 - protein, 9 aa, Homo Sapiens
GVSERTVIQ

SEQ ID NO: 8923 - protein, 9 aa, Homo Sapiens
MDRYIGVSY

SEQ ID NO: 8924 - protein, 9 aa, Homo Sapiens
PKPESENLE

SEQ ID NO: 8925 - protein, 9 aa, Homo Sapiens
DILLNEWSG

SEQ ID NO: 8926 - protein, 9 aa, Homo Sapiens
RFLKRRLQQ

SEQ ID NO: 8927 - protein, 9 aa, Homo Sapiens
LGPYRPAWP

SEQ ID NO: 8928 - protein, 9 aa, Homo Sapiens
NSMETRPPP

SEQ ID NO: 8929 - protein, 9 aa, Homo Sapiens
ARVHPGERN

SEQ ID NO: 8930 - protein, 9 aa, Homo Sapiens
QEQFRDHIE

SEQ ID NO: 8931 - protein, 9 aa, Homo Sapiens
EALQLKVSS

SEQ ID NO: 8932 - protein, 9 aa, Homo Sapiens
SQRLKQRQN

SEQ ID NO: 8933 - protein, 9 aa, Homo Sapiens
SAFCTSKGL

SEQ ID NO: 8934 - protein, 9 aa, Homo Sapiens
YWGIDGLAV

SEQ ID NO: 8935 - protein, 9 aa, Homo Sapiens
NIAWQDIDF

SEQ ID NO: 8936 - protein, 9 aa, Homo Sapiens
IFQKAISEP

SEQ ID NO: 8937 - protein, 9 aa, Homo Sapiens
SGDSEETVA

SEQ ID NO: 8938 - protein, 9 aa, Homo Sapiens
LQTTCTLQE

SEQ ID NO: 8939 - protein, 9 aa, Homo Sapiens
KQAESCDCL

SEQ ID NO: 8940 - protein, 9 aa, Homo Sapiens
SERTVIQII

SEQ ID NO: 8941 - protein, 9 aa, Homo Sapiens
PVDSDILLN

SEQ ID NO: 8942 - protein, 9 aa, Homo Sapiens
VPEDNSMNV

SEQ ID NO: 8943 - protein, 9 aa, Homo Sapiens
LFFIPTLVI

SEQ ID NO: 8944 - protein, 9 aa, Homo Sapiens
GLRIINVAP

SEQ ID NO: 8945 - protein, 9 aa, Homo Sapiens
TSSNSVDFL

SEQ ID NO: 8946 - protein, 9 aa, Homo Sapiens
MKQIREIAP

SEQ ID NO: 8947 - protein, 9 aa, Homo Sapiens
EEYKDDFEK

SEQ ID NO: 8948 - protein, 9 aa, Homo Sapiens
ENVGEVYGV

SEQ ID NO: 8949 - protein, 9 aa, Homo Sapiens
GSTPLHVTH

SEQ ID NO: 8950 - protein, 9 aa, Homo Sapiens
EHCDLTEAV

SEQ ID NO: 8951 - protein, 9 aa, Homo Sapiens
KEKAEIQAE

SEQ ID NO: 8952 - protein, 9 aa, Homo Sapiens
MILQQPLQP

SEQ ID NO: 8953 - protein, 9 aa, Homo Sapiens
SEQRPGTLG

SEQ ID NO: 8954 - protein, 9 aa, Homo Sapiens
IMENPFVHS

SEQ ID NO: 8955 - protein, 9 aa, Homo Sapiens
SPEGAVGQS

SEQ ID NO: 8956 - protein, 9 aa, Homo Sapiens
VQIEIEFSK

SEQ ID NO: 8957 - protein, 9 aa, Homo Sapiens
YRCPIRGMK

SEQ ID NO: 8958 - protein, 9 aa, Homo Sapiens
IGLINNLLQ

SEQ ID NO: 8959 - protein, 9 aa, Homo Sapiens
TAVESAGTE

SEQ ID NO: 8960 - protein, 9 aa, Homo Sapiens
NETKIKFGK

SEQ ID NO: 8961 - protein, 9 aa, Homo Sapiens
DRGGQQPAG

SEQ ID NO: 8962 - protein, 9 aa, Homo Sapiens
SLDLDVGNC

SEQ ID NO: 8963 - protein, 9 aa, Homo Sapiens
FLEANYINL

SEQ ID NO: 8964 - protein, 9 aa, Homo Sapiens
IQEIVDMIQ

SEQ ID NO: 8965 - protein, 9 aa, Homo Sapiens
PRVAWVLGT

SEQ ID NO: 8966 - protein, 9 aa, Homo Sapiens
LRRSQRLKQ

SEQ ID NO: 8967 - protein, 9 aa, Homo Sapiens
HQHQQQHQQ

SEQ ID NO: 8968 - protein, 9 aa, Homo Sapiens
ENGFVNSRA

SEQ ID NO: 8969 - protein, 9 aa, Homo Sapiens
NMARICVKT

SEQ ID NO: 8970 - protein, 9 aa, Homo Sapiens
NKSMEIQFI

SEQ ID NO: 8971 - protein, 9 aa, Homo Sapiens
LAQELIMNV

SEQ ID NO: 8972 - protein, 9 aa, Homo Sapiens
RTTHNEEQS

SEQ ID NO: 8973 - protein, 9 aa, Homo Sapiens
KKNVCAPRG

SEQ ID NO: 8974 - protein, 9 aa, Homo Sapiens
RGLSLGFKY

SEQ ID NO: 8975 - protein, 9 aa, Homo Sapiens
GGQQPAGAG

SEQ ID NO: 8976 - protein, 9 aa, Homo Sapiens
VSPPEQHAM

SEQ ID NO: 8977 - protein, 9 aa, Homo Sapiens
ISKRRRLSS

SEQ ID NO: 8978 - protein, 9 aa, Homo Sapiens
HKSQFIELR

SEQ ID NO: 8979 - protein, 9 aa, Homo Sapiens
GLSLGFKYL

SEQ ID NO: 8980 - protein, 9 aa, Homo Sapiens
LNEGFISHN

SEQ ID NO: 8981 - protein, 9 aa, Homo Sapiens
PCQETYRCP

SEQ ID NO: 8982 - protein, 9 aa, Homo Sapiens
NIHPNIILV

SEQ ID NO: 8983 - protein, 9 aa, Homo Sapiens
MAEHPIVIV

SEQ ID NO: 8984 - protein, 9 aa, Homo Sapiens
AQLHAGASL

SEQ ID NO: 8985 - protein, 9 aa, Homo Sapiens
SQEFFQTCD

SEQ ID NO: 8986 - protein, 9 aa, Homo Sapiens
CHSHALKPM

SEQ ID NO: 8987 - protein, 9 aa, Homo Sapiens
GYELCKPEV

SEQ ID NO: 8988 - protein, 9 aa, Homo Sapiens
LSENPQESV

SEQ ID NO: 8989 - protein, 9 aa, Homo Sapiens
PNAKFDKRT

SEQ ID NO: 8990 - protein, 9 aa, Homo Sapiens
SEGGCNFEG

SEQ ID NO: 8991 - protein, 9 aa, Homo Sapiens
QQLPPRPPK

SEQ ID NO: 8992 - protein, 9 aa, Homo Sapiens
WHSEETIFL

SEQ ID NO: 8993 - protein, 9 aa, Homo Sapiens
PTSHMHCAS

SEQ ID NO: 8994 - protein, 9 aa, Homo Sapiens
EGFISHNDR

SEQ ID NO: 8995 - protein, 9 aa, Homo Sapiens
HELSQDKKK

SEQ ID NO: 8996 - protein, 9 aa, Homo Sapiens
YMDTCLIDV

SEQ ID NO: 8997 - protein, 9 aa, Homo Sapiens
DKIYHCQGL

SEQ ID NO: 8998 - protein, 9 aa, Homo Sapiens
KKEKAEIQA

SEQ ID NO: 8999 - protein, 9 aa, Homo Sapiens
HCDLTEAVV

SEQ ID NO: 9000 - protein, 9 aa, Homo Sapiens
LRMGTICYP

SEQ ID NO: 9001 - protein, 9 aa, Homo Sapiens
EANDLALCL

SEQ ID NO: 9002 - protein, 9 aa, Homo Sapiens
LNEVDKHME

SEQ ID NO: 9003 - protein, 9 aa, Homo Sapiens
MVIHTSGKY

SEQ ID NO: 9004 - protein, 9 aa, Homo Sapiens
NTVFERGGL

SEQ ID NO: 9005 - protein, 9 aa, Homo Sapiens
ASLILARQG

SEQ ID NO: 9006 - protein, 9 aa, Homo Sapiens
GTLEISSRD

SEQ ID NO: 9007 - protein, 9 aa, Homo Sapiens
SSCELPGQV

SEQ ID NO: 9008 - protein, 9 aa, Homo Sapiens
TSSHCQTVC

SEQ ID NO: 9009 - protein, 9 aa, Homo Sapiens
GLQDLLNPI

SEQ ID NO: 9010 - protein, 9 aa, Homo Sapiens
CQVSCRNCT

SEQ ID NO: 9011 - protein, 9 aa, Homo Sapiens
RARAKTSKM

SEQ ID NO: 9012 - protein, 9 aa, Homo Sapiens
FCTSKGLVL

SEQ ID NO: 9013 - protein, 9 aa, Homo Sapiens
NEWSGSALP

SEQ ID NO: 9014 - protein, 9 aa, Homo Sapiens
HCERDTGIS

SEQ ID NO: 9015 - protein, 9 aa, Homo Sapiens
LGSKLHTFC

SEQ ID NO: 9016 - protein, 9 aa, Homo Sapiens
RVHPGERNA

SEQ ID NO: 9017 - protein, 9 aa, Homo Sapiens
QYILVTNEC

SEQ ID NO: 9018 - protein, 9 aa, Homo Sapiens
ICVKTQRLD

SEQ ID NO: 9019 - protein, 9 aa, Homo Sapiens
ELSQDKKKD

SEQ ID NO: 9020 - protein, 9 aa, Homo Sapiens
SCGGGRSFC

SEQ ID NO: 9021 - protein, 9 aa, Homo Sapiens
SAPGKDLGM

SEQ ID NO: 9022 - protein, 9 aa, Homo Sapiens
SASRTTHNE

SEQ ID NO: 9023 - protein, 9 aa, Homo Sapiens
WQRHAARRM

SEQ ID NO: 9024 - protein, 9 aa, Homo Sapiens
AVESAGTEA

SEQ ID NO: 9025 - protein, 9 aa, Homo Sapiens
STGPSPSYL

SEQ ID NO: 9026 - protein, 9 aa, Homo Sapiens
SFQQVVRLK

SEQ ID NO: 9027 - protein, 9 aa, Homo Sapiens
TNVDQIVQK

SEQ ID NO: 9028 - protein, 9 aa, Homo Sapiens
LSLLRHQKL

SEQ ID NO: 9029 - protein, 9 aa, Homo Sapiens
IRFPADKAS

SEQ ID NO: 9030 - protein, 9 aa, Homo Sapiens
LCIISMDRY

SEQ ID NO: 9031 - protein, 9 aa, Homo Sapiens
KHYEAVRDA

SEQ ID NO: 9032 - protein, 9 aa, Homo Sapiens
QRRWSVGSD

SEQ ID NO: 9033 - protein, 9 aa, Homo Sapiens
SALKEQIMA

SEQ ID NO: 9034 - protein, 9 aa, Homo Sapiens
NYGNNWNYG

SEQ ID NO: 9035 - protein, 9 aa, Homo Sapiens
ALPSDDLIT

SEQ ID NO: 9036 - protein, 9 aa, Homo Sapiens
ASPSFSVRL

SEQ ID NO: 9037 - protein, 9 aa, Homo Sapiens
MVFVKGKLG

SEQ ID NO: 9038 - protein, 9 aa, Homo Sapiens
NEGFISHND

SEQ ID NO: 9039 - protein, 9 aa, Homo Sapiens
KFGKYKAEK

SEQ ID NO: 9040 - protein, 9 aa, Homo Sapiens
ICSLTASLH

SEQ ID NO: 9041 - protein, 9 aa, Homo Sapiens
EKLTPVPED

SEQ ID NO: 9042 - protein, 9 aa, Homo Sapiens
CRELCSTKY

SEQ ID NO: 9043 - protein, 9 aa, Homo Sapiens
DGKGLDMAK

SEQ ID NO: 9044 - protein, 9 aa, Homo Sapiens
KVNGRMKRS

SEQ ID NO: 9045 - protein, 9 aa, Homo Sapiens
SGWGNSTNI

SEQ ID NO: 9046 - protein, 9 aa, Homo Sapiens
DLITNILDS

SEQ ID NO: 9047 - protein, 9 aa, Homo Sapiens
RLLSPLLQA

SEQ ID NO: 9048 - protein, 9 aa, Homo Sapiens
EHTLTGKFV

SEQ ID NO: 9049 - protein, 9 aa, Homo Sapiens
IVDMIQQNG

SEQ ID NO: 9050 - protein, 9 aa, Homo Sapiens
MVLNEVDKH

SEQ ID NO: 9051 - protein, 9 aa, Homo Sapiens
EVEGLVDER

SEQ ID NO: 9052 - protein, 9 aa, Homo Sapiens
LYLGSLSKD

SEQ ID NO: 9053 - protein, 9 aa, Homo Sapiens
LGIPLPEIN

SEQ ID NO: 9054 - protein, 9 aa, Homo Sapiens
GQSSAFTLQ

SEQ ID NO: 9055 - protein, 9 aa, Homo Sapiens
PPRPPKSSS

SEQ ID NO: 9056 - protein, 9 aa, Homo Sapiens
QNFLSTLTS

SEQ ID NO: 9057 - protein, 9 aa, Homo Sapiens
EKRQEQISK

SEQ ID NO: 9058 - protein, 9 aa, Homo Sapiens
LQDLLNPIG

SEQ ID NO: 9059 - protein, 9 aa, Homo Sapiens
LIMYRLQSY

SEQ ID NO: 9060 - protein, 9 aa, Homo Sapiens
YSGSVDIAN

SEQ ID NO: 9061 - protein, 9 aa, Homo Sapiens
NSSFSSDVS

SEQ ID NO: 9062 - protein, 9 aa, Homo Sapiens
QHQQQHQQQ

SEQ ID NO: 9063 - protein, 9 aa, Homo Sapiens
CRETEDPEA

SEQ ID NO: 9064 - protein, 9 aa, Homo Sapiens
KRCSVTSME

SEQ ID NO: 9065 - protein, 9 aa, Homo Sapiens
IISTDLQAE

SEQ ID NO: 9066 - protein, 9 aa, Homo Sapiens
SDIGTNHTH

SEQ ID NO: 9067 - protein, 9 aa, Homo Sapiens
CERDTGISS

SEQ ID NO: 9068 - protein, 9 aa, Homo Sapiens
PGIVVFQRR

SEQ ID NO: 9069 - protein, 9 aa, Homo Sapiens
AYDVVCKDY

SEQ ID NO: 9070 - protein, 9 aa, Homo Sapiens
QIVPQVPQK

SEQ ID NO: 9071 - protein, 9 aa, Homo Sapiens
LPGQVMLDS

SEQ ID NO: 9072 - protein, 9 aa, Homo Sapiens
GVLDWQRHA

SEQ ID NO: 9073 - protein, 9 aa, Homo Sapiens
LQQLSVQSV

SEQ ID NO: 9074 - protein, 9 aa, Homo Sapiens
IQFILLGLT

SEQ ID NO: 9075 - protein, 9 aa, Homo Sapiens
QQLSVQSVE

SEQ ID NO: 9076 - protein, 9 aa, Homo Sapiens
VCHSHALKP

SEQ ID NO: 9077 - protein, 9 aa, Homo Sapiens
GSAFCTSKG

SEQ ID NO: 9078 - protein, 9 aa, Homo Sapiens
LRKHKIIYT

SEQ ID NO: 9079 - protein, 9 aa, Homo Sapiens
LAAASVDHP

SEQ ID NO: 9080 - protein, 9 aa, Homo Sapiens
VSGLRIINV

SEQ ID NO: 9081 - protein, 9 aa, Homo Sapiens
IPLSPASTP

SEQ ID NO: 9082 - protein, 9 aa, Homo Sapiens
YLLSAEAGP

SEQ ID NO: 9083 - protein, 9 aa, Homo Sapiens
LGAEMVIHT

SEQ ID NO: 9084 - protein, 9 aa, Homo Sapiens
FFSLFSHRF

SEQ ID NO: 9085 - protein, 9 aa, Homo Sapiens
HPSSLCKHM

SEQ ID NO: 9086 - protein, 9 aa, Homo Sapiens
KIKFGKYKA

SEQ ID NO: 9087 - protein, 9 aa, Homo Sapiens
EATKEIYLT

SEQ ID NO: 9088 - protein, 9 aa, Homo Sapiens
VMDVVRKQA

SEQ ID NO: 9089 - protein, 9 aa, Homo Sapiens
FEHCKPTTR

SEQ ID NO: 9090 - protein, 9 aa, Homo Sapiens
VYKATGEQF

SEQ ID NO: 9091 - protein, 9 aa, Homo Sapiens
CTFHWCCQV

SEQ ID NO: 9092 - protein, 9 aa, Homo Sapiens
AQGITLTPE

SEQ ID NO: 9093 - protein, 9 aa, Homo Sapiens
DRMIFYKMA

SEQ ID NO: 9094 - protein, 9 aa, Homo Sapiens
KESAERSEP

SEQ ID NO: 9095 - protein, 9 aa, Homo Sapiens
FIPTLVIII

SEQ ID NO: 9096 - protein, 9 aa, Homo Sapiens
VSMKSLIMY

SEQ ID NO: 9097 - protein, 9 aa, Homo Sapiens
VWPSLPESG

SEQ ID NO: 9098 - protein, 9 aa, Homo Sapiens
EEFDTEGDC

SEQ ID NO: 9099 - protein, 9 aa, Homo Sapiens
VRSETPSAW

SEQ ID NO: 9100 - protein, 9 aa, Homo Sapiens
KRKKKKKNV

SEQ ID NO: 9101 - protein, 9 aa, Homo Sapiens
PDGERFLKM

SEQ ID NO: 9102 - protein, 9 aa, Homo Sapiens
DINKLSIMT

SEQ ID NO: 9103 - protein, 9 aa, Homo Sapiens
PENVGEVYG

SEQ ID NO: 9104 - protein, 9 aa, Homo Sapiens
RRNIHPNII

SEQ ID NO: 9105 - protein, 9 aa, Homo Sapiens
LDYNYVQIP

SEQ ID NO: 9106 - protein, 9 aa, Homo Sapiens
KRGKTLSWL

SEQ ID NO: 9107 - protein, 9 aa, Homo Sapiens
SRYFLYMFV

SEQ ID NO: 9108 - protein, 9 aa, Homo Sapiens
FNSFEQLCM

SEQ ID NO: 9109 - protein, 9 aa, Homo Sapiens
RSETPSAWS

SEQ ID NO: 9110 - protein, 9 aa, Homo Sapiens
KLPEVNSTS

SEQ ID NO: 9111 - protein, 9 aa, Homo Sapiens
VVRGESFHL

SEQ ID NO: 9112 - protein, 9 aa, Homo Sapiens
NIPHSSLAT

SEQ ID NO: 9113 - protein, 9 aa, Homo Sapiens
NDPVVIKLQ

SEQ ID NO: 9114 - protein, 9 aa, Homo Sapiens
CGFEHCKPT

SEQ ID NO: 9115 - protein, 9 aa, Homo Sapiens
VFDARCCYL

SEQ ID NO: 9116 - protein, 9 aa, Homo Sapiens
SLLDVCAQA

SEQ ID NO: 9117 - protein, 9 aa, Homo Sapiens
RNVSNDPVV

SEQ ID NO: 9118 - protein, 9 aa, Homo Sapiens
SQDLGKPRV

SEQ ID NO: 9119 - protein, 9 aa, Homo Sapiens
HSEETIFLP

SEQ ID NO: 9120 - protein, 9 aa, Homo Sapiens
QGYSCHCCL

SEQ ID NO: 9121 - protein, 9 aa, Homo Sapiens
TSHMHCASL

SEQ ID NO: 9122 - protein, 9 aa, Homo Sapiens
FRCNFTPTE

SEQ ID NO: 9123 - protein, 9 aa, Homo Sapiens
PQESVQIEI

SEQ ID NO: 9124 - protein, 9 aa, Homo Sapiens
CIAVLPLLT

SEQ ID NO: 9125 - protein, 9 aa, Homo Sapiens
PHCERDTGI

SEQ ID NO: 9126 - protein, 9 aa, Homo Sapiens
PGMELGPAD

SEQ ID NO: 9127 - protein, 9 aa, Homo Sapiens
KERKTQSDM

SEQ ID NO: 9128 - protein, 9 aa, Homo Sapiens
NESHKSQFI

SEQ ID NO: 9129 - protein, 9 aa, Homo Sapiens
HSDLNGKTN

SEQ ID NO: 9130 - protein, 9 aa, Homo Sapiens
SSPVENGFV

SEQ ID NO: 9131 - protein, 9 aa, Homo Sapiens
EHKCVVRYT

SEQ ID NO: 9132 - protein, 9 aa, Homo Sapiens
DVVCKDYGG

SEQ ID NO: 9133 - protein, 9 aa, Homo Sapiens
IKEEEERAQ

SEQ ID NO: 9134 - protein, 9 aa, Homo Sapiens
HCASLQGLT

SEQ ID NO: 9135 - protein, 9 aa, Homo Sapiens
KITGLDAAG

SEQ ID NO: 9136 - protein, 9 aa, Homo Sapiens
KDDFEKDLE

SEQ ID NO: 9137 - protein, 9 aa, Homo Sapiens
QVSCRNCTH

SEQ ID NO: 9138 - protein, 9 aa, Homo Sapiens
SGDRVTHTV

SEQ ID NO: 9139 - protein, 9 aa, Homo Sapiens
PLRRYRPFV

SEQ ID NO: 9140 - protein, 9 aa, Homo Sapiens
HMHCASLQG

SEQ ID NO: 9141 - protein, 9 aa, Homo Sapiens
MAVWPSLPE

SEQ ID NO: 9142 - protein, 9 aa, Homo Sapiens
DPKDAEKVI

SEQ ID NO: 9143 - protein, 9 aa, Homo Sapiens
FQRISSWAT

SEQ ID NO: 9144 - protein, 9 aa, Homo Sapiens
KCVVRYTGK

SEQ ID NO: 9145 - protein, 9 aa, Homo Sapiens
FEQLCMNFT

SEQ ID NO: 9146 - protein, 9 aa, Homo Sapiens
DSKKSEEYK

SEQ ID NO: 9147 - protein, 9 aa, Homo Sapiens
RVAWVLGTM

SEQ ID NO: 9148 - protein, 9 aa, Homo Sapiens
PSEESNLVG

SEQ ID NO: 9149 - protein, 9 aa, Homo Sapiens
LITNILDSI

SEQ ID NO: 9150 - protein, 9 aa, Homo Sapiens
QTQSPRKVN

SEQ ID NO: 9151 - protein, 9 aa, Homo Sapiens
AQHRAEQQR

SEQ ID NO: 9152 - protein, 9 aa, Homo Sapiens
QQPAGAGSP

SEQ ID NO: 9153 - protein, 9 aa, Homo Sapiens
FGKYKAEKS

SEQ ID NO: 9154 - protein, 9 aa, Homo Sapiens
TVCGAQLHA

SEQ ID NO: 9155 - protein, 9 aa, Homo Sapiens
IKWEQMWRL

SEQ ID NO: 9156 - protein, 9 aa, Homo Sapiens
LQKLMDRSS

SEQ ID NO: 9157 - protein, 9 aa, Homo Sapiens
IVMDSGDRV

SEQ ID NO: 9158 - protein, 9 aa, Homo Sapiens
DLGKPRVGK

SEQ ID NO: 9159 - protein, 9 aa, Homo Sapiens
NTVARAKIL

SEQ ID NO: 9160 - protein, 9 aa, Homo Sapiens
RDRRNIHPN

SEQ ID NO: 9161 - protein, 9 aa, Homo Sapiens
RQPGKNGSI

SEQ ID NO: 9162 - protein, 9 aa, Homo Sapiens
QHAMPIGRI

SEQ ID NO: 9163 - protein, 9 aa, Homo Sapiens
PPPRVAWVL

SEQ ID NO: 9164 - protein, 9 aa, Homo Sapiens
EEALVENSM

SEQ ID NO: 9165 - protein, 9 aa, Homo Sapiens
TRSRYFLYM

SEQ ID NO: 9166 - protein, 9 aa, Homo Sapiens
HKIGKITGL

SEQ ID NO: 9167 - protein, 9 aa, Homo Sapiens
FFIPTLVII

SEQ ID NO: 9168 - protein, 9 aa, Homo Sapiens
DYNYVQIPY

SEQ ID NO: 9169 - protein, 9 aa, Homo Sapiens
TNLTAHTRI

SEQ ID NO: 9170 - protein, 9 aa, Homo Sapiens
LLDVCAQAS

SEQ ID NO: 9171 - protein, 9 aa, Homo Sapiens
EPQWCEVEG

SEQ ID NO: 9172 - protein, 9 aa, Homo Sapiens
QNGIPAVTI

SEQ ID NO: 9173 - protein, 9 aa, Homo Sapiens
PHSSLATAT

SEQ ID NO: 9174 - protein, 9 aa, Homo Sapiens
QTVCPCPHG

SEQ ID NO: 9175 - protein, 9 aa, Homo Sapiens
LSRQPGKNG

SEQ ID NO: 9176 - protein, 9 aa, Homo Sapiens
AALLPVASL

SEQ ID NO: 9177 - protein, 9 aa, Homo Sapiens
ATRQKESAE

SEQ ID NO: 9178 - protein, 9 aa, Homo Sapiens
CQPFQASVR

SEQ ID NO: 9179 - protein, 9 aa, Homo Sapiens
QNTVFERGG

SEQ ID NO: 9180 - protein, 9 aa, Homo Sapiens
FPLSRLSSD

SEQ ID NO: 9181 - protein, 9 aa, Homo Sapiens
EVPYWGIDG

SEQ ID NO: 9182 - protein, 9 aa, Homo Sapiens
SADEQAIAE

SEQ ID NO: 9183 - protein, 9 aa, Homo Sapiens
MSLLMAVWP

SEQ ID NO: 9184 - protein, 9 aa, Homo Sapiens
RMGTICYPN

SEQ ID NO: 9185 - protein, 9 aa, Homo Sapiens
DQLKSKERK

SEQ ID NO: 9186 - protein, 9 aa, Homo Sapiens
LESSYFTTI

SEQ ID NO: 9187 - protein, 9 aa, Homo Sapiens
ECHPDQTKH

SEQ ID NO: 9188 - protein, 9 aa, Homo Sapiens
LLPVASLAA

SEQ ID NO: 9189 - protein, 9 aa, Homo Sapiens
GPCVPSTKE

SEQ ID NO: 9190 - protein, 9 aa, Homo Sapiens
LSLLDVCAQ

SEQ ID NO: 9191 - protein, 9 aa, Homo Sapiens
AFWPHPPGP

SEQ ID NO: 9192 - protein, 9 aa, Homo Sapiens
SYALEEIKK

SEQ ID NO: 9193 - protein, 9 aa, Homo Sapiens
ASYHGQPGN

SEQ ID NO: 9194 - protein, 9 aa, Homo Sapiens
FPKPESENL

SEQ ID NO: 9195 - protein, 9 aa, Homo Sapiens
VDIKSVFRY

SEQ ID NO: 9196 - protein, 9 aa, Homo Sapiens
FQAIYTAVE

SEQ ID NO: 9197 - protein, 9 aa, Homo Sapiens
CMNFTNEKL

SEQ ID NO: 9198 - protein, 9 aa, Homo Sapiens
SSFSSDVST

SEQ ID NO: 9199 - protein, 9 aa, Homo Sapiens
LGMPPENVG

SEQ ID NO: 9200 - protein, 9 aa, Homo Sapiens
PAVLATGPC

SEQ ID NO: 9201 - protein, 9 aa, Homo Sapiens
LEISSRDID

SEQ ID NO: 9202 - protein, 9 aa, Homo Sapiens
AKFDKRTEF

SEQ ID NO: 9203 - protein, 9 aa, Homo Sapiens
LISDEYIGA

SEQ ID NO: 9204 - protein, 9 aa, Homo Sapiens
LIMNVQWSG

SEQ ID NO: 9205 - protein, 9 aa, Homo Sapiens
KGLDMAKRC

SEQ ID NO: 9206 - protein, 9 aa, Homo Sapiens
IKSVFRYCN

SEQ ID NO: 9207 - protein, 9 aa, Homo Sapiens
PGQVMLDSL

SEQ ID NO: 9208 - protein, 9 aa, Homo Sapiens
SCKAGGSCA

SEQ ID NO: 9209 - protein, 9 aa, Homo Sapiens
FQKEGNYGN

SEQ ID NO: 9210 - protein, 9 aa, Homo Sapiens
GQLVMLRKS

SEQ ID NO: 9211 - protein, 9 aa, Homo Sapiens
KEEEERAQE

SEQ ID NO: 9212 - protein, 9 aa, Homo Sapiens
YDINKLSIM

SEQ ID NO: 9213 - protein, 9 aa, Homo Sapiens
QRVQREVSM

SEQ ID NO: 9214 - protein, 9 aa, Homo Sapiens
CRLLSPLLQ

SEQ ID NO: 9215 - protein, 9 aa, Homo Sapiens
GKITGLDAA

SEQ ID NO: 9216 - protein, 9 aa, Homo Sapiens
TLTGKFVCL

SEQ ID NO: 9217 - protein, 9 aa, Homo Sapiens
ESFHLTATI

SEQ ID NO: 9218 - protein, 9 aa, Homo Sapiens
KRRLQQLSV

SEQ ID NO: 9219 - protein, 9 aa, Homo Sapiens
GDFLEANYI

SEQ ID NO: 9220 - protein, 9 aa, Homo Sapiens
KPHCERDTG

SEQ ID NO: 9221 - protein, 9 aa, Homo Sapiens
CCLGFRPAE

SEQ ID NO: 9222 - protein, 9 aa, Homo Sapiens
CNHLGLVEP

SEQ ID NO: 9223 - protein, 9 aa, Homo Sapiens
KMAAKFLEF

SEQ ID NO: 9224 - protein, 9 aa, Homo Sapiens
SVVRGESFH

SEQ ID NO: 9225 - protein, 9 aa, Homo Sapiens
SVSPPEQHA

SEQ ID NO: 9226 - protein, 9 aa, Homo Sapiens
FHLTATIFN

SEQ ID NO: 9227 - protein, 9 aa, Homo Sapiens
YDVVCKDYG

SEQ ID NO: 9228 - protein, 9 aa, Homo Sapiens
SENLSQEAI

SEQ ID NO: 9229 - protein, 9 aa, Homo Sapiens
YLAMNKRGQ

SEQ ID NO: 9230 - protein, 9 aa, Homo Sapiens
LQAFAQAAA

SEQ ID NO: 9231 - protein, 9 aa, Homo Sapiens
RLSLLRHQK

SEQ ID NO: 9232 - protein, 9 aa, Homo Sapiens
PQLPAQLQQ

SEQ ID NO: 9233 - protein, 9 aa, Homo Sapiens
FELDYNYVQ

SEQ ID NO: 9234 - protein, 9 aa, Homo Sapiens
GGTHKIGKI

SEQ ID NO: 9235 - protein, 9 aa, Homo Sapiens
AMRLSVVLQ

SEQ ID NO: 9236 - protein, 9 aa, Homo Sapiens
NYINLQRSY

SEQ ID NO: 9237 - protein, 9 aa, Homo Sapiens
PTNNLQLGS

SEQ ID NO: 9238 - protein, 9 aa, Homo Sapiens
GASSVGKAP

SEQ ID NO: 9239 - protein, 9 aa, Homo Sapiens
EKPHCERDT

SEQ ID NO: 9240 - protein, 9 aa, Homo Sapiens
ADGVSERTV

SEQ ID NO: 9241 - protein, 9 aa, Homo Sapiens
PPRVAWVLG

SEQ ID NO: 9242 - protein, 9 aa, Homo Sapiens
PSCCKTTCC

SEQ ID NO: 9243 - protein, 9 aa, Homo Sapiens
FCRAQIALI

SEQ ID NO: 9244 - protein, 9 aa, Homo Sapiens
HNEEQSGDS

SEQ ID NO: 9245 - protein, 9 aa, Homo Sapiens
RGEHTLTGK

SEQ ID NO: 9246 - protein, 9 aa, Homo Sapiens
CLCYQGFEA

SEQ ID NO: 9247 - protein, 9 aa, Homo Sapiens
QDKKKDTVP

SEQ ID NO: 9248 - protein, 9 aa, Homo Sapiens
AALQYDINK

SEQ ID NO: 9249 - protein, 9 aa, Homo Sapiens
EVYKATGEQ

SEQ ID NO: 9250 - protein, 9 aa, Homo Sapiens
THPSSLCKH

SEQ ID NO: 9251 - protein, 9 aa, Homo Sapiens
VTNIPHSSL

SEQ ID NO: 9252 - protein, 9 aa, Homo Sapiens
DRRNIHPNI

SEQ ID NO: 9253 - protein, 9 aa, Homo Sapiens
QPGKNGSIV

SEQ ID NO: 9254 - protein, 9 aa, Homo Sapiens
LQGSGYANA

SEQ ID NO: 9255 - protein, 9 aa, Homo Sapiens
QVWHSEETI

SEQ ID NO: 9256 - protein, 9 aa, Homo Sapiens
RPGTLGPPP

SEQ ID NO: 9257 - protein, 9 aa, Homo Sapiens
AFCTSKGLV

SEQ ID NO: 9258 - protein, 9 aa, Homo Sapiens
RISSWATCG

SEQ ID NO: 9259 - protein, 9 aa, Homo Sapiens
SHCQTVCPC

SEQ ID NO: 9260 - protein, 9 aa, Homo Sapiens
RSIKYCIWC

SEQ ID NO: 9261 - protein, 9 aa, Homo Sapiens
GEHTLTGKF

SEQ ID NO: 9262 - protein, 9 aa, Homo Sapiens
TARVHPGER

SEQ ID NO: 9263 - protein, 9 aa, Homo Sapiens
HMESVIPKT

SEQ ID NO: 9264 - protein, 9 aa, Homo Sapiens
KEILNEAYV

SEQ ID NO: 9265 - protein, 9 aa, Homo Sapiens
LRQPTEKVL

SEQ ID NO: 9266 - protein, 9 aa, Homo Sapiens
PEQHAMPIG

SEQ ID NO: 9267 - protein, 9 aa, Homo Sapiens
SENLELTYE

SEQ ID NO: 9268 - protein, 9 aa, Homo Sapiens
FQPAIRVAY

SEQ ID NO: 9269 - protein, 9 aa, Homo Sapiens
AEDLLLIGV

SEQ ID NO: 9270 - protein, 9 aa, Homo Sapiens
TAMYSAPGK

SEQ ID NO: 9271 - protein, 9 aa, Homo Sapiens
KANKEILNE

SEQ ID NO: 9272 - protein, 9 aa, Homo Sapiens
NSFEQLCMN

SEQ ID NO: 9273 - protein, 9 aa, Homo Sapiens
SRQPGKNGS

SEQ ID NO: 9274 - protein, 9 aa, Homo Sapiens
SVDIANTTD

SEQ ID NO: 9275 - protein, 9 aa, Homo Sapiens
RRSQRLKQR

SEQ ID NO: 9276 - protein, 9 aa, Homo Sapiens
SNLVGTLKI

SEQ ID NO: 9277 - protein, 9 aa, Homo Sapiens
ASSVGKAPS

SEQ ID NO: 9278 - protein, 9 aa, Homo Sapiens
LEARTIQRN

SEQ ID NO: 9279 - protein, 9 aa, Homo Sapiens
QRLKQRQNC

SEQ ID NO: 9280 - protein, 9 aa, Homo Sapiens
LLGFSESEN

SEQ ID NO: 9281 - protein, 9 aa, Homo Sapiens
CKPTTRDWA

SEQ ID NO: 9282 - protein, 9 aa, Homo Sapiens
LQLKVSSES

SEQ ID NO: 9283 - protein, 9 aa, Homo Sapiens
SSYFTTILP

SEQ ID NO: 9284 - protein, 9 aa, Homo Sapiens
LPILRQPTE

SEQ ID NO: 9285 - protein, 9 aa, Homo Sapiens
DNPRSSSLL

SEQ ID NO: 9286 - protein, 9 aa, Homo Sapiens
RKVNGRMKR

SEQ ID NO: 9287 - protein, 9 aa, Homo Sapiens
KRQEQISKR

SEQ ID NO: 9288 - protein, 9 aa, Homo Sapiens
TLGPPPPEG

SEQ ID NO: 9289 - protein, 9 aa, Homo Sapiens
LPFMVLDIL

SEQ ID NO: 9290 - protein, 9 aa, Homo Sapiens
QQPLQPGPQ

SEQ ID NO: 9291 - protein, 9 aa, Homo Sapiens
ANKEILNEA

SEQ ID NO: 9292 - protein, 9 aa, Homo Sapiens
HKTESTSDK

SEQ ID NO: 9293 - protein, 9 aa, Homo Sapiens
TLEISSRDI

SEQ ID NO: 9294 - protein, 9 aa, Homo Sapiens
PLQPGPQGG

SEQ ID NO: 9295 - protein, 9 aa, Homo Sapiens
GIPLPEINN

SEQ ID NO: 9296 - protein, 9 aa, Homo Sapiens
GLVTLRDAF

SEQ ID NO: 9297 - protein, 9 aa, Homo Sapiens
LRDAFITAI

SEQ ID NO: 9298 - protein, 9 aa, Homo Sapiens
SVSMKSLIM

SEQ ID NO: 9299 - protein, 9 aa, Homo Sapiens
LNEAYVMAG

SEQ ID NO: 9300 - protein, 9 aa, Homo Sapiens
KAEIQAELE

SEQ ID NO: 9301 - protein, 9 aa, Homo Sapiens
TTVFTSGSE

SEQ ID NO: 9302 - protein, 9 aa, Homo Sapiens
WGLCTHENQ

SEQ ID NO: 9303 - protein, 9 aa, Homo Sapiens
RFSYANIAW

SEQ ID NO: 9304 - protein, 9 aa, Homo Sapiens
HYEAVRDAG

SEQ ID NO: 9305 - protein, 9 aa, Homo Sapiens
LGFKYLEYE

SEQ ID NO: 9306 - protein, 9 aa, Homo Sapiens
AKRCSVTSM

SEQ ID NO: 9307 - protein, 9 aa, Homo Sapiens
IPDNPRSSS

SEQ ID NO: 9308 - protein, 9 aa, Homo Sapiens
PKSSSVSLV

SEQ ID NO: 9309 - protein, 9 aa, Homo Sapiens
LTVGTLEIS

SEQ ID NO: 9310 - protein, 9 aa, Homo Sapiens
SRTTHNEEQ

SEQ ID NO: 9311 - protein, 9 aa, Homo Sapiens
RLLQSADEQ

SEQ ID NO: 9312 - protein, 9 aa, Homo Sapiens
RQKESAERS

SEQ ID NO: 9313 - protein, 9 aa, Homo Sapiens
PRARAKTSK

SEQ ID NO: 9314 - protein, 9 aa, Homo Sapiens
LCLARQFRG

SEQ ID NO: 9315 - protein, 9 aa, Homo Sapiens
LLSQRICSL

SEQ ID NO: 9316 - protein, 9 aa, Homo Sapiens
EQLCMNFTN

SEQ ID NO: 9317 - protein, 9 aa, Homo Sapiens
FWDLTGIKE

SEQ ID NO: 9318 - protein, 9 aa, Homo Sapiens
VTRSEGGCN

SEQ ID NO: 9319 - protein, 9 aa, Homo Sapiens
QFIRFPADK

SEQ ID NO: 9320 - protein, 9 aa, Homo Sapiens
TNIPHSSLA

SEQ ID NO: 9321 - protein, 9 aa, Homo Sapiens
SVQIEIEFS

SEQ ID NO: 9322 - protein, 9 aa, Homo Sapiens
KPCDCHPKG

SEQ ID NO: 9323 - protein, 9 aa, Homo Sapiens
QSADEQAIA

SEQ ID NO: 9324 - protein, 9 aa, Homo Sapiens
ICRTNTVAR

SEQ ID NO: 9325 - protein, 9 aa, Homo Sapiens
GKTLSWLKS

SEQ ID NO: 9326 - protein, 9 aa, Homo Sapiens
RDSFQQVVR

SEQ ID NO: 9327 - protein, 9 aa, Homo Sapiens
ARICVKTQR

SEQ ID NO: 9328 - protein, 9 aa, Homo Sapiens
PLPAISQSD

SEQ ID NO: 9329 - protein, 9 aa, Homo Sapiens
AGFTHSDLN

SEQ ID NO: 9330 - protein, 9 aa, Homo Sapiens
NLPILRQPT

SEQ ID NO: 9331 - protein, 9 aa, Homo Sapiens
WQTQSPRKV

SEQ ID NO: 9332 - protein, 9 aa, Homo Sapiens
HCQGLLPPP

SEQ ID NO: 9333 - protein, 9 aa, Homo Sapiens
RHAARRMIR

SEQ ID NO: 9334 - protein, 9 aa, Homo Sapiens
IIYTGKKPY

SEQ ID NO: 9335 - protein, 9 aa, Homo Sapiens
LCMNFTNEK

SEQ ID NO: 9336 - protein, 9 aa, Homo Sapiens
GLGMPPENV

SEQ ID NO: 9337 - protein, 9 aa, Homo Sapiens
SNSSFSSDV

SEQ ID NO: 9338 - protein, 9 aa, Homo Sapiens
PVASLAAAS

SEQ ID NO: 9339 - protein, 9 aa, Homo Sapiens
DWQRHAARR

SEQ ID NO: 9340 - protein, 9 aa, Homo Sapiens
MKNKSMEIQ

SEQ ID NO: 9341 - protein, 9 aa, Homo Sapiens
ETCSKSEIH

SEQ ID NO: 9342 - protein, 9 aa, Homo Sapiens
QEQISKRRR

SEQ ID NO: 9343 - protein, 9 aa, Homo Sapiens
LAYDVVCKD

SEQ ID NO: 9344 - protein, 9 aa, Homo Sapiens
FQEQFRDHI

SEQ ID NO: 9345 - protein, 9 aa, Homo Sapiens
RICVKTQRL

SEQ ID NO: 9346 - protein, 9 aa, Homo Sapiens
LALCLARQF

SEQ ID NO: 9347 - protein, 9 aa, Homo Sapiens
QIMENPFVH

SEQ ID NO: 9348 - protein, 9 aa, Homo Sapiens
VARAKILQD

SEQ ID NO: 9349 - protein, 9 aa, Homo Sapiens
ATKEIYLTP

SEQ ID NO: 9350 - protein, 9 aa, Homo Sapiens
ETKIKFGKY

SEQ ID NO: 9351 - protein, 9 aa, Homo Sapiens
GERPYRCLV

SEQ ID NO: 9352 - protein, 9 aa, Homo Sapiens
SKKSEEYKD

SEQ ID NO: 9353 - protein, 9 aa, Homo Sapiens
EGAVGQSLQ

SEQ ID NO: 9354 - protein, 9 aa, Homo Sapiens
HVTHRFMVW

SEQ ID NO: 9355 - protein, 9 aa, Homo Sapiens
TGEQFVKIA

SEQ ID NO: 9356 - protein, 9 aa, Homo Sapiens
EAMAEHPIV

SEQ ID NO: 9357 - protein, 9 aa, Homo Sapiens
YMFVYYTPK

SEQ ID NO: 9358 - protein, 9 aa, Homo Sapiens
EVDIKSVFR

SEQ ID NO: 9359 - protein, 9 aa, Homo Sapiens
VWDSEHCDL

SEQ ID NO: 9360 - protein, 9 aa, Homo Sapiens
QHRAEQQRR

SEQ ID NO: 9361 - protein, 9 aa, Homo Sapiens
TAEDLLLIG

SEQ ID NO: 9362 - protein, 9 aa, Homo Sapiens
EALVENSME

SEQ ID NO: 9363 - protein, 9 aa, Homo Sapiens
VLDMTKGNL

SEQ ID NO: 9364 - protein, 9 aa, Homo Sapiens
ICNHLGLVE

SEQ ID NO: 9365 - protein, 9 aa, Homo Sapiens
ARAKTSKMK

SEQ ID NO: 9366 - protein, 9 aa, Homo Sapiens
SFEQLCMNF

SEQ ID NO: 9367 - protein, 9 aa, Homo Sapiens
EFTLGSKLH

SEQ ID NO: 9368 - protein, 9 aa, Homo Sapiens
LLETFCSDI

SEQ ID NO: 9369 - protein, 9 aa, Homo Sapiens
FNLKGLSLK

SEQ ID NO: 9370 - protein, 9 aa, Homo Sapiens
VRYTGKTYS

SEQ ID NO: 9371 - protein, 9 aa, Homo Sapiens
NPRSSSLLY

SEQ ID NO: 9372 - protein, 9 aa, Homo Sapiens
EEKLTPVPE

SEQ ID NO: 9373 - protein, 9 aa, Homo Sapiens
EEVGPLELQ

SEQ ID NO: 9374 - protein, 9 aa, Homo Sapiens
QIVQKTQRL

SEQ ID NO: 9375 - protein, 9 aa, Homo Sapiens
KQVWHSEET

SEQ ID NO: 9376 - protein, 9 aa, Homo Sapiens
SENKSYFSY

SEQ ID NO: 9377 - protein, 9 aa, Homo Sapiens
FSRRLSLLR

SEQ ID NO: 9378 - protein, 9 aa, Homo Sapiens
CREALQLKV

SEQ ID NO: 9379 - protein, 9 aa, Homo Sapiens
PVPEDNSMN

SEQ ID NO: 9380 - protein, 9 aa, Homo Sapiens
QEATSPLVL

SEQ ID NO: 9381 - protein, 9 aa, Homo Sapiens
RSRYFLYMF

SEQ ID NO: 9382 - protein, 9 aa, Homo Sapiens
VGPLELQIK

SEQ ID NO: 9383 - protein, 9 aa, Homo Sapiens
GPLELQIKR

SEQ ID NO: 9384 - protein, 9 aa, Homo Sapiens
ASSCELPGQ

SEQ ID NO: 9385 - protein, 9 aa, Homo Sapiens
CIISMDRYI

SEQ ID NO: 9386 - protein, 9 aa, Homo Sapiens
FLYMFVYYT

SEQ ID NO: 9387 - protein, 9 aa, Homo Sapiens
DMAKRCSVT

SEQ ID NO: 9388 - protein, 9 aa, Homo Sapiens
ALCLARQFR

SEQ ID NO: 9389 - protein, 9 aa, Homo Sapiens
CLIDVDVQP

SEQ ID NO: 9390 - protein, 9 aa, Homo Sapiens
NCTFHWCCQ

SEQ ID NO: 9391 - protein, 9 aa, Homo Sapiens
TIISTDLQA

SEQ ID NO: 9392 - protein, 9 aa, Homo Sapiens
MVLDILCSW

SEQ ID NO: 9393 - protein, 9 aa, Homo Sapiens
SQNGIPAVT

SEQ ID NO: 9394 - protein, 9 aa, Homo Sapiens
KFDKRTEFI

SEQ ID NO: 9395 - protein, 9 aa, Homo Sapiens
VDFLPLAKS

SEQ ID NO: 9396 - protein, 9 aa, Homo Sapiens
AVLATGPCV

SEQ ID NO: 9397 - protein, 9 aa, Homo Sapiens
AISQSDKLC

SEQ ID NO: 9398 - protein, 9 aa, Homo Sapiens
AVWPSLPES

SEQ ID NO: 9399 - protein, 9 aa, Homo Sapiens
LSQRICSLT

SEQ ID NO: 9400 - protein, 9 aa, Homo Sapiens
VDSDILLNE

SEQ ID NO: 9401 - protein, 9 aa, Homo Sapiens
RPSCCKTTC

SEQ ID NO: 9402 - protein, 9 aa, Homo Sapiens
MGLCIISMD

SEQ ID NO: 9403 - protein, 9 aa, Homo Sapiens
YGDSTGPSP

SEQ ID NO: 9404 - protein, 9 aa, Homo Sapiens
RNASWVMKG

SEQ ID NO: 9405 - protein, 9 aa, Homo Sapiens
CTLQEMEAE

SEQ ID NO: 9406 - protein, 9 aa, Homo Sapiens
RLSVVLQAL

SEQ ID NO: 9407 - protein, 9 aa, Homo Sapiens
LLMAVWPSL

SEQ ID NO: 9408 - protein, 9 aa, Homo Sapiens
PAISQSDKL

SEQ ID NO: 9409 - protein, 9 aa, Homo Sapiens
EDLPCKPEV

SEQ ID NO: 9410 - protein, 9 aa, Homo Sapiens
VRKQAESCD

SEQ ID NO: 9411 - protein, 9 aa, Homo Sapiens
RGGQQPAGA

SEQ ID NO: 9412 - protein, 9 aa, Homo Sapiens
LLDKLRKIK

SEQ ID NO: 9413 - protein, 9 aa, Homo Sapiens
TQNDDSDEY

SEQ ID NO: 9414 - protein, 9 aa, Homo Sapiens
KLRMGTICY

SEQ ID NO: 9415 - protein, 9 aa, Homo Sapiens
PGKDLGMEP

SEQ ID NO: 9416 - protein, 9 aa, Homo Sapiens
GSQDLGKPR

SEQ ID NO: 9417 - protein, 9 aa, Homo Sapiens
VRSLHFQEQ

SEQ ID NO: 9418 - protein, 9 aa, Homo Sapiens
YFQRISSWA

SEQ ID NO: 9419 - protein, 9 aa, Homo Sapiens
LPTPSVFEQ

SEQ ID NO: 9420 - protein, 9 aa, Homo Sapiens
SGVSVLGFF

SEQ ID NO: 9421 - protein, 9 aa, Homo Sapiens
SNDISIHDF

SEQ ID NO: 9422 - protein, 9 aa, Homo Sapiens
HWCCQVSCR

SEQ ID NO: 9423 - protein, 9 aa, Homo Sapiens
MELGPADGG

SEQ ID NO: 9424 - protein, 9 aa, Homo Sapiens
QFTVDKNVV

SEQ ID NO: 9425 - protein, 9 aa, Homo Sapiens
SHVDLSGDS

SEQ ID NO: 9426 - protein, 9 aa, Homo Sapiens
DPLLSQRIC

SEQ ID NO: 9427 - protein, 9 aa, Homo Sapiens
LKRRLQQLS

SEQ ID NO: 9428 - protein, 9 aa, Homo Sapiens
MNVTIFPED

SEQ ID NO: 9429 - protein, 9 aa, Homo Sapiens
LKKEKAEIQ

SEQ ID NO: 9430 - protein, 9 aa, Homo Sapiens
ERAGLIGAV

SEQ ID NO: 9431 - protein, 9 aa, Homo Sapiens
RLEATKEIY

SEQ ID NO: 9432 - protein, 9 aa, Homo Sapiens
EERLLQTTC

SEQ ID NO: 9433 - protein, 9 aa, Homo Sapiens
KLGGLCVTA

SEQ ID NO: 9434 - protein, 9 aa, Homo Sapiens
RPPPPRVAW

SEQ ID NO: 9435 - protein, 9 aa, Homo Sapiens
ASVSPPLPA

SEQ ID NO: 9436 - protein, 9 aa, Homo Sapiens
TRIHTREKP

SEQ ID NO: 9437 - protein, 9 aa, Homo Sapiens
FHWCCQVSC

SEQ ID NO: 9438 - protein, 9 aa, Homo Sapiens
SYFTTILPG

SEQ ID NO: 9439 - protein, 9 aa, Homo Sapiens
LYMFVYYTP

SEQ ID NO: 9440 - protein, 9 aa, Homo Sapiens
GRGEATRQK

SEQ ID NO: 9441 - protein, 9 aa, Homo Sapiens
EIQFILLGL

SEQ ID NO: 9442 - protein, 9 aa, Homo Sapiens
WCCQVSCRN

SEQ ID NO: 9443 - protein, 9 aa, Homo Sapiens
LEENLPILR

SEQ ID NO: 9444 - protein, 9 aa, Homo Sapiens
YKMAAKFLE

SEQ ID NO: 9445 - protein, 9 aa, Homo Sapiens
ESENKSYFS

SEQ ID NO: 9446 - protein, 9 aa, Homo Sapiens
EEVLDMTKG

SEQ ID NO: 9447 - protein, 9 aa, Homo Sapiens
SMEIQFILL

SEQ ID NO: 9448 - protein, 9 aa, Homo Sapiens
ADEQAIAEL

SEQ ID NO: 9449 - protein, 9 aa, Homo Sapiens
EDFAGFTHS

SEQ ID NO: 9450 - protein, 9 aa, Homo Sapiens
ILPCQETYR

SEQ ID NO: 9451 - protein, 9 aa, Homo Sapiens
DTCLIDVDV

SEQ ID NO: 9452 - protein, 9 aa, Homo Sapiens
IICMTVRSE

SEQ ID NO: 9453 - protein, 9 aa, Homo Sapiens
SAFTLQGSG

SEQ ID NO: 9454 - protein, 9 aa, Homo Sapiens
KIIYTGKKP

SEQ ID NO: 9455 - protein, 9 aa, Homo Sapiens
EQVIMEAMA

SEQ ID NO: 9456 - protein, 9 aa, Homo Sapiens
SQCVTRSEG

SEQ ID NO: 9457 - protein, 9 aa, Homo Sapiens
YHCQGLLPP

SEQ ID NO: 9458 - protein, 9 aa, Homo Sapiens
LLQTQLMIS

SEQ ID NO: 9459 - protein, 9 aa, Homo Sapiens
LPEVNSTSE

SEQ ID NO: 9460 - protein, 9 aa, Homo Sapiens
ALNCFNLKG

SEQ ID NO: 9461 - protein, 9 aa, Homo Sapiens
HQQQHQQQQ

SEQ ID NO: 9462 - protein, 9 aa, Homo Sapiens
KQEKDGTQK

SEQ ID NO: 9463 - protein, 9 aa, Homo Sapiens
HPGERNASW

SEQ ID NO: 9464 - protein, 9 aa, Homo Sapiens
RVQREVSMV

SEQ ID NO: 9465 - protein, 9 aa, Homo Sapiens
ISMDRYIGV

SEQ ID NO: 9466 - protein, 9 aa, Homo Sapiens
TTILPGILS

SEQ ID NO: 9467 - protein, 9 aa, Homo Sapiens
LARQGMGDM

SEQ ID NO: 9468 - protein, 9 aa, Homo Sapiens
VRGESFHLT

SEQ ID NO: 9469 - protein, 9 aa, Homo Sapiens
YGNNWNYGQ

SEQ ID NO: 9470 - protein, 9 aa, Homo Sapiens
VTVHTKDGS

SEQ ID NO: 9471 - protein, 9 aa, Homo Sapiens
LCKHMKVHE

SEQ ID NO: 9472 - protein, 9 aa, Homo Sapiens
KLHTFCGSP

SEQ ID NO: 9473 - protein, 9 aa, Homo Sapiens
LTPVPEDNS

SEQ ID NO: 9474 - protein, 9 aa, Homo Sapiens
MEAMAEHPI

SEQ ID NO: 9475 - protein, 9 aa, Homo Sapiens
IPTLVIIIL

SEQ ID NO: 9476 - protein, 9 aa, Homo Sapiens
VLATGPCVP

SEQ ID NO: 9477 - protein, 9 aa, Homo Sapiens
PQIVPQVPQ

SEQ ID NO: 9478 - protein, 9 aa, Homo Sapiens
PEELLKTVS

SEQ ID NO: 9479 - protein, 9 aa, Homo Sapiens
KLLTVGTLE

SEQ ID NO: 9480 - protein, 9 aa, Homo Sapiens
PVPAFWPHP

SEQ ID NO: 9481 - protein, 9 aa, Homo Sapiens
AVRDAGNDS

SEQ ID NO: 9482 - protein, 9 aa, Homo Sapiens
LEPNAKFDK

SEQ ID NO: 9483 - protein, 9 aa, Homo Sapiens
LETGRNLRK

SEQ ID NO: 9484 - protein, 9 aa, Homo Sapiens
ERFLKMVEH

SEQ ID NO: 9485 - protein, 9 aa, Homo Sapiens
AKGESDTHR

SEQ ID NO: 9486 - protein, 9 aa, Homo Sapiens
TNSNSSFSS

SEQ ID NO: 9487 - protein, 9 aa, Homo Sapiens
LQSADEQAI

SEQ ID NO: 9488 - protein, 9 aa, Homo Sapiens
SVDFLPLAK

SEQ ID NO: 9489 - protein, 9 aa, Homo Sapiens
RCLCYQGFE

SEQ ID NO: 9490 - protein, 9 aa, Homo Sapiens
TVRSETPSA

SEQ ID NO: 9491 - protein, 9 aa, Homo Sapiens
DTHRTTVEV

SEQ ID NO: 9492 - protein, 9 aa, Homo Sapiens
GMNVTIFPE

SEQ ID NO: 9493 - protein, 9 aa, Homo Sapiens
LSSYTMRVE

SEQ ID NO: 9494 - protein, 9 aa, Homo Sapiens
MDPNCSCKA

SEQ ID NO: 9495 - protein, 9 aa, Homo Sapiens
RLKQRQNCK

SEQ ID NO: 9496 - protein, 9 aa, Homo Sapiens
PPEQHAMPI

SEQ ID NO: 9497 - protein, 9 aa, Homo Sapiens
QLKVSSESF

SEQ ID NO: 9498 - protein, 9 aa, Homo Sapiens
VDMIQQNGD

SEQ ID NO: 9499 - protein, 9 aa, Homo Sapiens
SNDPVVIKL

SEQ ID NO: 9500 - protein, 9 aa, Homo Sapiens
SCELPGQVM

SEQ ID NO: 9501 - protein, 9 aa, Homo Sapiens
GSSVTFEHP

SEQ ID NO: 9502 - protein, 9 aa, Homo Sapiens
GAQLHAGAS

SEQ ID NO: 9503 - protein, 9 aa, Homo Sapiens
SLILARQGM

SEQ ID NO: 9504 - protein, 9 aa, Homo Sapiens
GKNGSIVTC

SEQ ID NO: 9505 - protein, 9 aa, Homo Sapiens
YDTGIRLLQ

SEQ ID NO: 9506 - protein, 9 aa, Homo Sapiens
PGFPKPESE

SEQ ID NO: 9507 - protein, 9 aa, Homo Sapiens
FDARCCYLY

SEQ ID NO: 9508 - protein, 9 aa, Homo Sapiens
YELCKPEVI

SEQ ID NO: 9509 - protein, 9 aa, Homo Sapiens
SVMDVVRKQ

SEQ ID NO: 9510 - protein, 9 aa, Homo Sapiens
RICNHLGLV

SEQ ID NO: 9511 - protein, 9 aa, Homo Sapiens
AARRMIRHY

SEQ ID NO: 9512 - protein, 9 aa, Homo Sapiens
TPEQAQALG

SEQ ID NO: 9513 - protein, 9 aa, Homo Sapiens
DAKGESDTH

SEQ ID NO: 9514 - protein, 9 aa, Homo Sapiens
IMNVQWSGG

SEQ ID NO: 9515 - protein, 9 aa, Homo Sapiens
SAEAGPAGG

SEQ ID NO: 9516 - protein, 9 aa, Homo Sapiens
AEKELITII

SEQ ID NO: 9517 - protein, 9 aa, Homo Sapiens
VHSMLSNPD

SEQ ID NO: 9518 - protein, 9 aa, Homo Sapiens
VERAGLIGA

SEQ ID NO: 9519 - protein, 9 aa, Homo Sapiens
CHCCLGFRP

SEQ ID NO: 9520 - protein, 9 aa, Homo Sapiens
PPENVGEVY

SEQ ID NO: 9521 - protein, 9 aa, Homo Sapiens
VQFTVDKNV

SEQ ID NO: 9522 - protein, 9 aa, Homo Sapiens
QAIAELLDE

SEQ ID NO: 9523 - protein, 9 aa, Homo Sapiens
QPLQPGPQG

SEQ ID NO: 9524 - protein, 9 aa, Homo Sapiens
KYCIWCSTE

SEQ ID NO: 9525 - protein, 9 aa, Homo Sapiens
RWFVFDARC

SEQ ID NO: 9526 - protein, 9 aa, Homo Sapiens
IVQKTQRLE

SEQ ID NO: 9527 - protein, 9 aa, Homo Sapiens
VDFVPSEES

SEQ ID NO: 9528 - protein, 9 aa, Homo Sapiens
LIQVEEVSE

SEQ ID NO: 9529 - protein, 9 aa, Homo Sapiens
LVLIAWDNQ

SEQ ID NO: 9530 - protein, 9 aa, Homo Sapiens
PTPSVFEQN

SEQ ID NO: 9531 - protein, 9 aa, Homo Sapiens
DLIFQKAIS

SEQ ID NO: 9532 - protein, 9 aa, Homo Sapiens
GGCNFEGHQ

SEQ ID NO: 9533 - protein, 9 aa, Homo Sapiens
SESENKSYF

SEQ ID NO: 9534 - protein, 9 aa, Homo Sapiens
GEATRQKES

SEQ ID NO: 9535 - protein, 9 aa, Homo Sapiens
FAALQYDIN

SEQ ID NO: 9536 - protein, 9 aa, Homo Sapiens
VRDAGNDSG

SEQ ID NO: 9537 - protein, 9 aa, Homo Sapiens
IKYCIWCST

SEQ ID NO: 9538 - protein, 9 aa, Homo Sapiens
PSFSVRLGS

SEQ ID NO: 9539 - protein, 9 aa, Homo Sapiens
IHDFTCDEE

SEQ ID NO: 9540 - protein, 9 aa, Homo Sapiens
FEFLSSYTM

SEQ ID NO: 9541 - protein, 9 aa, Homo Sapiens
YKDDFEKDL

SEQ ID NO: 9542 - protein, 9 aa, Homo Sapiens
MKLLTVGTL

SEQ ID NO: 9543 - protein, 9 aa, Homo Sapiens
QQNGDVEKC

SEQ ID NO: 9544 - protein, 9 aa, Homo Sapiens
VHPGERNAS

SEQ ID NO: 9545 - protein, 9 aa, Homo Sapiens
LVWDSEHCD

SEQ ID NO: 9546 - protein, 9 aa, Homo Sapiens
VFTSGSETI

SEQ ID NO: 9547 - protein, 9 aa, Homo Sapiens
PFVRSHSFR

SEQ ID NO: 9548 - protein, 9 aa, Homo Sapiens
VIHTSGKYG

SEQ ID NO: 9549 - protein, 9 aa, Homo Sapiens
VTLRDAFIT

SEQ ID NO: 9550 - protein, 9 aa, Homo Sapiens
KGSLSLQCK

SEQ ID NO: 9551 - protein, 9 aa, Homo Sapiens
AEMVIHTSG

SEQ ID NO: 9552 - protein, 9 aa, Homo Sapiens
SSLATATKV

SEQ ID NO: 9553 - protein, 9 aa, Homo Sapiens
LIGAVKLKA

SEQ ID NO: 9554 - protein, 9 aa, Homo Sapiens
LPVASLAAA

SEQ ID NO: 9555 - protein, 9 aa, Homo Sapiens
TSKGLVLPF

SEQ ID NO: 9556 - protein, 9 aa, Homo Sapiens
DVCAQASGS

SEQ ID NO: 9557 - protein, 9 aa, Homo Sapiens
EINNVVSGK

SEQ ID NO: 9558 - protein, 9 aa, Homo Sapiens
HLESSYFTT

SEQ ID NO: 9559 - protein, 9 aa, Homo Sapiens
KPSAPKLEG

SEQ ID NO: 9560 - protein, 9 aa, Homo Sapiens
KSEEYKDDF

SEQ ID NO: 9561 - protein, 9 aa, Homo Sapiens
QQHQHQQQH

SEQ ID NO: 9562 - protein, 9 aa, Homo Sapiens
PGTVVALLA

SEQ ID NO: 9563 - protein, 9 aa, Homo Sapiens
LEATKEIYL

SEQ ID NO: 9564 - protein, 9 aa, Homo Sapiens
LRRYRPFVR

SEQ ID NO: 9565 - protein, 9 aa, Homo Sapiens
IQVEEVSET

SEQ ID NO: 9566 - protein, 9 aa, Homo Sapiens
PYRCLVCGK

SEQ ID NO: 9567 - protein, 9 aa, Homo Sapiens
TVFTSGSET

SEQ ID NO: 9568 - protein, 9 aa, Homo Sapiens
RKSQEFFQT

SEQ ID NO: 9569 - protein, 9 aa, Homo Sapiens
AQLQQLEHR

SEQ ID NO: 9570 - protein, 9 aa, Homo Sapiens
TLQGSGYAN

SEQ ID NO: 9571 - protein, 9 aa, Homo Sapiens
FQQVVRLKG

SEQ ID NO: 9572 - protein, 9 aa, Homo Sapiens
NRFSYANIA

SEQ ID NO: 9573 - protein, 9 aa, Homo Sapiens
LKVSSESFI

SEQ ID NO: 9574 - protein, 9 aa, Homo Sapiens
MDSGDRVTH

SEQ ID NO: 9575 - protein, 9 aa, Homo Sapiens
DLALCLARQ

SEQ ID NO: 9576 - protein, 9 aa, Homo Sapiens
PPKSSSVSL

SEQ ID NO: 9577 - protein, 9 aa, Homo Sapiens
NCFNLKGLS

SEQ ID NO: 9578 - protein, 9 aa, Homo Sapiens
SEISEFEDS

SEQ ID NO: 9579 - protein, 9 aa, Homo Sapiens
EILNEAYVM

SEQ ID NO: 9580 - protein, 9 aa, Homo Sapiens
TDLQAENLM

SEQ ID NO: 9581 - protein, 9 aa, Homo Sapiens
SASPSFSVR

SEQ ID NO: 9582 - protein, 9 aa, Homo Sapiens
FTTILPGIL

SEQ ID NO: 9583 - protein, 9 aa, Homo Sapiens
VPLLPVPRQ

SEQ ID NO: 9584 - protein, 9 aa, Homo Sapiens
QFPLSRLSS

SEQ ID NO: 9585 - protein, 9 aa, Homo Sapiens
DLDVGNCRE

SEQ ID NO: 9586 - protein, 9 aa, Homo Sapiens
VMLRKSQEF

SEQ ID NO: 9587 - protein, 9 aa, Homo Sapiens
ESDTHRTTV

SEQ ID NO: 9588 - protein, 9 aa, Homo Sapiens
KVKGMVFVK

SEQ ID NO: 9589 - protein, 9 aa, Homo Sapiens
SCCKTTCCR

SEQ ID NO: 9590 - protein, 9 aa, Homo Sapiens
NVVRTDRNN

SEQ ID NO: 9591 - protein, 9 aa, Homo Sapiens
LKGLSLKSC

SEQ ID NO: 9592 - protein, 9 aa, Homo Sapiens
VGCRELCST

SEQ ID NO: 9593 - protein, 9 aa, Homo Sapiens
LDVGNCRET

SEQ ID NO: 9594 - protein, 9 aa, Homo Sapiens
CKPCDCHPK

SEQ ID NO: 9595 - protein, 9 aa, Homo Sapiens
EAYSRMSYA

SEQ ID NO: 9596 - protein, 9 aa, Homo Sapiens
QVPQKTTAS

SEQ ID NO: 9597 - protein, 9 aa, Homo Sapiens
EATSPLVLI

SEQ ID NO: 9598 - protein, 9 aa, Homo Sapiens
GNNWNYGQV

SEQ ID NO: 9599 - protein, 9 aa, Homo Sapiens
RPFVRSHSF

SEQ ID NO: 9600 - protein, 9 aa, Homo Sapiens
IHPNIILVL

SEQ ID NO: 9601 - protein, 9 aa, Homo Sapiens
TPVPEDNSM

SEQ ID NO: 9602 - protein, 9 aa, Homo Sapiens
RAAWWQSQN

SEQ ID NO: 9603 - protein, 9 aa, Homo Sapiens
DFVPSEESN

SEQ ID NO: 9604 - protein, 9 aa, Homo Sapiens
VFQRRWSVG

SEQ ID NO: 9605 - protein, 9 aa, Homo Sapiens
TVDKNVVRT

SEQ ID NO: 9606 - protein, 9 aa, Homo Sapiens
GFTHSDLNG

SEQ ID NO: 9607 - protein, 9 aa, Homo Sapiens
KLTPVPEDN

SEQ ID NO: 9608 - protein, 9 aa, Homo Sapiens
LLGSASPSF

SEQ ID NO: 9609 - protein, 9 aa, Homo Sapiens
LLSAEAGPA

SEQ ID NO: 9610 - protein, 9 aa, Homo Sapiens
PSDDLITNI

SEQ ID NO: 9611 - protein, 9 aa, Homo Sapiens
CVPSTKEEL

SEQ ID NO: 9612 - protein, 9 aa, Homo Sapiens
VQKTQRLEL

SEQ ID NO: 9613 - protein, 9 aa, Homo Sapiens
RYTGKTYSG

SEQ ID NO: 9614 - protein, 9 aa, Homo Sapiens
QCREALQLK

SEQ ID NO: 9615 - protein, 9 aa, Homo Sapiens
GNCGFEHCK

SEQ ID NO: 9616 - protein, 9 aa, Homo Sapiens
HGQPGNAYD

SEQ ID NO: 9617 - protein, 9 aa, Homo Sapiens
RMSCGGGRS

SEQ ID NO: 9618 - protein, 9 aa, Homo Sapiens
NVSNDPVVI

SEQ ID NO: 9619 - protein, 9 aa, Homo Sapiens
ISAGAIGLI

SEQ ID NO: 9620 - protein, 9 aa, Homo Sapiens
WFVFDARCC

SEQ ID NO: 9621 - protein, 9 aa, Homo Sapiens
GMELGPADG

SEQ ID NO: 9622 - protein, 9 aa, Homo Sapiens
SIKYCIWCS

SEQ ID NO: 9623 - protein, 9 aa, Homo Sapiens
VLDWQRHAA

SEQ ID NO: 9624 - protein, 9 aa, Homo Sapiens
YEAVRDAGN

SEQ ID NO: 9625 - protein, 9 aa, Homo Sapiens
LNIPDNPRS

SEQ ID NO: 9626 - protein, 9 aa, Homo Sapiens
KAGGSCACA

SEQ ID NO: 9627 - protein, 9 aa, Homo Sapiens
RYFLYMFVY

SEQ ID NO: 9628 - protein, 9 aa, Homo Sapiens
IQQNGDVEK

SEQ ID NO: 9629 - protein, 9 aa, Homo Sapiens
KNVVRTDRN

SEQ ID NO: 9630 - protein, 9 aa, Homo Sapiens
MAISGVSVL

SEQ ID NO: 9631 - protein, 9 aa, Homo Sapiens
AMNKRGQLY

SEQ ID NO: 9632 - protein, 9 aa, Homo Sapiens
NQEATSPLV

SEQ ID NO: 9633 - protein, 9 aa, Homo Sapiens
HRAEQQRRE

SEQ ID NO: 9634 - protein, 9 aa, Homo Sapiens
VNGRMKRSL

SEQ ID NO: 9635 - protein, 9 aa, Homo Sapiens
PPPYGDSTG

SEQ ID NO: 9636 - protein, 9 aa, Homo Sapiens
DVVRKQAES

SEQ ID NO: 9637 - protein, 9 aa, Homo Sapiens
GEAAGGDHK

SEQ ID NO: 9638 - protein, 9 aa, Homo Sapiens
PTVCGAQLH

SEQ ID NO: 9639 - protein, 9 aa, Homo Sapiens
KKLGGLCVT

SEQ ID NO: 9640 - protein, 9 aa, Homo Sapiens
GDSEETVAP

SEQ ID NO: 9641 - protein, 9 aa, Homo Sapiens
VSETCSKSE

SEQ ID NO: 9642 - protein, 9 aa, Homo Sapiens
SYHGQPGNA

SEQ ID NO: 9643 - protein, 9 aa, Homo Sapiens
SAGAIGLIN

SEQ ID NO: 9644 - protein, 9 aa, Homo Sapiens
SFSVRLGSF

SEQ ID NO: 9645 - protein, 9 aa, Homo Sapiens
ICYPNPSGT

SEQ ID NO: 9646 - protein, 9 aa, Homo Sapiens
LLAYDVVCK

SEQ ID NO: 9647 - protein, 9 aa, Homo Sapiens
LMAVWPSLP

SEQ ID NO: 9648 - protein, 9 aa, Homo Sapiens
IPLPEINNV

SEQ ID NO: 9649 - protein, 9 aa, Homo Sapiens
DHKTESTSD

SEQ ID NO: 9650 - protein, 9 aa, Homo Sapiens
ILVTNECHP

SEQ ID NO: 9651 - protein, 9 aa, Homo Sapiens
PRKVNGRMK

SEQ ID NO: 9652 - protein, 9 aa, Homo Sapiens
AAWWQSQNG

SEQ ID NO: 9653 - protein, 9 aa, Homo Sapiens
PRQPRPAVG

SEQ ID NO: 9654 - protein, 9 aa, Homo Sapiens
VDRESTSGT

SEQ ID NO: 9655 - protein, 9 aa, Homo Sapiens
LHVTHRFMV

SEQ ID NO: 9656 - protein, 9 aa, Homo Sapiens
KLRKIKWEQ

SEQ ID NO: 9657 - protein, 9 aa, Homo Sapiens
KLNEGFISH

SEQ ID NO: 9658 - protein, 9 aa, Homo Sapiens
EGNYGNNWN

SEQ ID NO: 9659 - protein, 9 aa, Homo Sapiens
SSSLLYGCH

SEQ ID NO: 9660 - protein, 9 aa, Homo Sapiens
REVDIKSVF

SEQ ID NO: 9661 - protein, 9 aa, Homo Sapiens
GCRELCSTK

SEQ ID NO: 9662 - protein, 9 aa, Homo Sapiens
LIDFEFLSS

SEQ ID NO: 9663 - protein, 9 aa, Homo Sapiens
SSLLYGCHS

SEQ ID NO: 9664 - protein, 9 aa, Homo Sapiens
HLAQELIMN

SEQ ID NO: 9665 - protein, 9 aa, Homo Sapiens
DGVSERTVI

SEQ ID NO: 9666 - protein, 9 aa, Homo Sapiens
TPSVFEQNF

SEQ ID NO: 9667 - protein, 9 aa, Homo Sapiens
SGLRIINVA

SEQ ID NO: 9668 - protein, 9 aa, Homo Sapiens
RLQRICNHL

SEQ ID NO: 9669 - protein, 9 aa, Homo Sapiens
ELPGQVMLD

SEQ ID NO: 9670 - protein, 9 aa, Homo Sapiens
SDEYIGALA

SEQ ID NO: 9671 - protein, 9 aa, Homo Sapiens
TDPVTRGIK

SEQ ID NO: 9672 - protein, 9 aa, Homo Sapiens
NFSRRLSLL

SEQ ID NO: 9673 - protein, 9 aa, Homo Sapiens
GDHKTESTS

SEQ ID NO: 9674 - protein, 9 aa, Homo Sapiens
VRLKGQVLS

SEQ ID NO: 9675 - protein, 9 aa, Homo Sapiens
GNSNTVDRE

SEQ ID NO: 9676 - protein, 9 aa, Homo Sapiens
RLGHLKKEK

SEQ ID NO: 9677 - protein, 9 aa, Homo Sapiens
PCDCHPKGS

SEQ ID NO: 9678 - protein, 9 aa, Homo Sapiens
YTGKKPYKC

SEQ ID NO: 9679 - protein, 9 aa, Homo Sapiens
GTLGPPPPE

SEQ ID NO: 9680 - protein, 9 aa, Homo Sapiens
TPTEAFQRD

SEQ ID NO: 9681 - protein, 9 aa, Homo Sapiens
VVRYTGKTY

SEQ ID NO: 9682 - protein, 9 aa, Homo Sapiens
SHMHCASLQ

SEQ ID NO: 9683 - protein, 9 aa, Homo Sapiens
PLLPVPRQP

SEQ ID NO: 9684 - protein, 9 aa, Homo Sapiens
LQLGSPSMP

SEQ ID NO: 9685 - protein, 9 aa, Homo Sapiens
QIREIAPQR

SEQ ID NO: 9686 - protein, 9 aa, Homo Sapiens
EDKLTFIKS

SEQ ID NO: 9687 - protein, 9 aa, Homo Sapiens
LNQEATSPL

SEQ ID NO: 9688 - protein, 9 aa, Homo Sapiens
SIHDFTCDE

SEQ ID NO: 9689 - protein, 9 aa, Homo Sapiens
ISDEYIGAL

SEQ ID NO: 9690 - protein, 9 aa, Homo Sapiens
ALLPVASLA

SEQ ID NO: 9691 - protein, 9 aa, Homo Sapiens
ALVENSMET

SEQ ID NO: 9692 - protein, 9 aa, Homo Sapiens
TQSPRKVNG

SEQ ID NO: 9693 - protein, 9 aa, Homo Sapiens
HTFCGSPPY

SEQ ID NO: 9694 - protein, 9 aa, Homo Sapiens
YKAQREDKL

SEQ ID NO: 9695 - protein, 9 aa, Homo Sapiens
RGNQLFRMR

SEQ ID NO: 9696 - protein, 9 aa, Homo Sapiens
RSLHFQEQF

SEQ ID NO: 9697 - protein, 9 aa, Homo Sapiens
AMYSAPGKD

SEQ ID NO: 9698 - protein, 9 aa, Homo Sapiens
SYTPAFFSL

SEQ ID NO: 9699 - protein, 9 aa, Homo Sapiens
QEEVLAQHR

SEQ ID NO: 9700 - protein, 9 aa, Homo Sapiens
SFSSDVSTH

SEQ ID NO: 9701 - protein, 9 aa, Homo Sapiens
APGKDLGME

SEQ ID NO: 9702 - protein, 9 aa, Homo Sapiens
KYLPKLISD

SEQ ID NO: 9703 - protein, 9 aa, Homo Sapiens
GESFHLTAT

SEQ ID NO: 9704 - protein, 9 aa, Homo Sapiens
LAEKELITI

SEQ ID NO: 9705 - protein, 9 aa, Homo Sapiens
PHHLCDPQN

SEQ ID NO: 9706 - protein, 9 aa, Homo Sapiens
QPFQASVRS

SEQ ID NO: 9707 - protein, 9 aa, Homo Sapiens
EFLAEKELI

SEQ ID NO: 9708 - protein, 9 aa, Homo Sapiens
NLVCHSHAL

SEQ ID NO: 9709 - protein, 9 aa, Homo Sapiens
SLATATKVH

SEQ ID NO: 9710 - protein, 9 aa, Homo Sapiens
KQIREIAPQ

SEQ ID NO: 9711 - protein, 9 aa, Homo Sapiens
GQVMLDSLD

SEQ ID NO: 9712 - protein, 9 aa, Homo Sapiens
FSFFNVVYW

SEQ ID NO: 9713 - protein, 9 aa, Homo Sapiens
RLLQTTCTL

SEQ ID NO: 9714 - protein, 9 aa, Homo Sapiens
SNTVDREST

SEQ ID NO: 9715 - protein, 9 aa, Homo Sapiens
REIAPQRIP

SEQ ID NO: 9716 - protein, 9 aa, Homo Sapiens
AKWNLVCHS

SEQ ID NO: 9717 - protein, 9 aa, Homo Sapiens
TCTLQEMEA

SEQ ID NO: 9718 - protein, 9 aa, Homo Sapiens
CLPFMVLDI

SEQ ID NO: 9719 - protein, 9 aa, Homo Sapiens
QAFAQAAAF

SEQ ID NO: 9720 - protein, 9 aa, Homo Sapiens
CKAGGSCAC

SEQ ID NO: 9721 - protein, 9 aa, Homo Sapiens
IAVLPLLTR

SEQ ID NO: 9722 - protein, 9 aa, Homo Sapiens
RLRSCYYVT

SEQ ID NO: 9723 - protein, 9 aa, Homo Sapiens
GNYGNNWNY

SEQ ID NO: 9724 - protein, 9 aa, Homo Sapiens
TDPGASSVG

SEQ ID NO: 9725 - protein, 9 aa, Homo Sapiens
FTHSDLNGK

SEQ ID NO: 9726 - protein, 9 aa, Homo Sapiens
TEDFAGFTH

SEQ ID NO: 9727 - protein, 9 aa, Homo Sapiens
VSALKEQIM

SEQ ID NO: 9728 - protein, 9 aa, Homo Sapiens
FSSDVSTHS

SEQ ID NO: 9729 - protein, 9 aa, Homo Sapiens
VNWLQKLMD

SEQ ID NO: 9730 - protein, 9 aa, Homo Sapiens
CGGGRSFCP

SEQ ID NO: 9731 - protein, 9 aa, Homo Sapiens
QMTAEDLLL

SEQ ID NO: 9732 - protein, 9 aa, Homo Sapiens
QLPPRPPKS

SEQ ID NO: 9733 - protein, 9 aa, Homo Sapiens
FVFDARCCY

SEQ ID NO: 9734 - protein, 9 aa, Homo Sapiens
KDAEKVINT

SEQ ID NO: 9735 - protein, 9 aa, Homo Sapiens
VIIILYSKI

SEQ ID NO: 9736 - protein, 9 aa, Homo Sapiens
TVDRESTSG

SEQ ID NO: 9737 - protein, 9 aa, Homo Sapiens
PQEGPCSCV

SEQ ID NO: 9738 - protein, 9 aa, Homo Sapiens
EARTIQRNT

SEQ ID NO: 9739 - protein, 9 aa, Homo Sapiens
QGITLTPEQ

SEQ ID NO: 9740 - protein, 9 aa, Homo Sapiens
LQQPLQPGP

SEQ ID NO: 9741 - protein, 9 aa, Homo Sapiens
DNESEISEF

SEQ ID NO: 9742 - protein, 9 aa, Homo Sapiens
FVKGKLGVC

SEQ ID NO: 9743 - protein, 9 aa, Homo Sapiens
ISIHDFTCD

SEQ ID NO: 9744 - protein, 9 aa, Homo Sapiens
ICMTVRSET

SEQ ID NO: 9745 - protein, 9 aa, Homo Sapiens
YGNQILYLG

SEQ ID NO: 9746 - protein, 9 aa, Homo Sapiens
PEVNSTSER

SEQ ID NO: 9747 - protein, 9 aa, Homo Sapiens
IGGTHKIGK

SEQ ID NO: 9748 - protein, 9 aa, Homo Sapiens
ILARQGMGD

SEQ ID NO: 9749 - protein, 9 aa, Homo Sapiens
TNTVARAKI

SEQ ID NO: 9750 - protein, 9 aa, Homo Sapiens
GEVPYWGID

SEQ ID NO: 9751 - protein, 9 aa, Homo Sapiens
DSFQQVVRL

SEQ ID NO: 9752 - protein, 9 aa, Homo Sapiens
FKHYEAVRD

SEQ ID NO: 9753 - protein, 9 aa, Homo Sapiens
NKEILNEAY

SEQ ID NO: 9754 - protein, 9 aa, Homo Sapiens
DPQNTVFER

SEQ ID NO: 9755 - protein, 9 aa, Homo Sapiens
WLQKLMDRS

SEQ ID NO: 9756 - protein, 9 aa, Homo Sapiens
GLINNLLQV

SEQ ID NO: 9757 - protein, 9 aa, Homo Sapiens
INFMKQIRE

SEQ ID NO: 9758 - protein, 9 aa, Homo Sapiens
DDDDDLGMN

SEQ ID NO: 9759 - protein, 9 aa, Homo Sapiens
QFIELRKWL

SEQ ID NO: 9760 - protein, 9 aa, Homo Sapiens
LATATKVHH

SEQ ID NO: 9761 - protein, 9 aa, Homo Sapiens
VNSTSERFL

SEQ ID NO: 9762 - protein, 9 aa, Homo Sapiens
PAFFSLFSH

SEQ ID NO: 9763 - protein, 9 aa, Homo Sapiens
PPDGERFLK

SEQ ID NO: 9764 - protein, 9 aa, Homo Sapiens
QRICSLTAS

SEQ ID NO: 9765 - protein, 9 aa, Homo Sapiens
LSTHKIIHN

SEQ ID NO: 9766 - protein, 9 aa, Homo Sapiens
NAKFDKRTE

SEQ ID NO: 9767 - protein, 9 aa, Homo Sapiens
YEDLPCKPE

SEQ ID NO: 9768 - protein, 9 aa, Homo Sapiens
VPAFWPHPP

SEQ ID NO: 9769 - protein, 9 aa, Homo Sapiens
TQKRGRGRP

SEQ ID NO: 9770 - protein, 9 aa, Homo Sapiens
RRLSLLRHQ

SEQ ID NO: 9771 - protein, 9 aa, Homo Sapiens
NQLFRMRAV

SEQ ID NO: 9772 - protein, 9 aa, Homo Sapiens
RYMDTCLID

SEQ ID NO: 9773 - protein, 9 aa, Homo Sapiens
FWPHPPGPF

SEQ ID NO: 9774 - protein, 9 aa, Homo Sapiens
NWLQKLMDR

SEQ ID NO: 9775 - protein, 9 aa, Homo Sapiens
SKERKTQSD

SEQ ID NO: 9776 - protein, 9 aa, Homo Sapiens
GAVGQSLQP

SEQ ID NO: 9777 - protein, 9 aa, Homo Sapiens
YHNYEDLPC

SEQ ID NO: 9778 - protein, 9 aa, Homo Sapiens
ESVQIEIEF

SEQ ID NO: 9779 - protein, 9 aa, Homo Sapiens
NLSQEAILE

SEQ ID NO: 9780 - protein, 9 aa, Homo Sapiens
KNDNGGSSV

SEQ ID NO: 9781 - protein, 9 aa, Homo Sapiens
IQRNTKPYR

SEQ ID NO: 9782 - protein, 9 aa, Homo Sapiens
PGNCGFEHC

SEQ ID NO: 9783 - protein, 9 aa, Homo Sapiens
RSEGGCNFE

SEQ ID NO: 9784 - protein, 9 aa, Homo Sapiens
QSQNGIPAV

SEQ ID NO: 9785 - protein, 9 aa, Homo Sapiens
GLQADGVSE

SEQ ID NO: 9786 - protein, 9 aa, Homo Sapiens
QDTALTQND

SEQ ID NO: 9787 - protein, 9 aa, Homo Sapiens
RNGVTKRGK

SEQ ID NO: 9788 - protein, 9 aa, Homo Sapiens
GVNESHKSQ

SEQ ID NO: 9789 - protein, 9 aa, Homo Sapiens
GFSESENKS

SEQ ID NO: 9790 - protein, 9 aa, Homo Sapiens
ELCKKLGGL

SEQ ID NO: 9791 - protein, 9 aa, Homo Sapiens
AGLGPYRPA

SEQ ID NO: 9792 - protein, 9 aa, Homo Sapiens
HCKPTTRDW

SEQ ID NO: 9793 - protein, 9 aa, Homo Sapiens
IRVAYLLQH

SEQ ID NO: 9794 - protein, 9 aa, Homo Sapiens
DSEHCDLTE

SEQ ID NO: 9795 - protein, 9 aa, Homo Sapiens
SVSPPLPAI

SEQ ID NO: 9796 - protein, 9 aa, Homo Sapiens
SENPQESVQ

SEQ ID NO: 9797 - protein, 9 aa, Homo Sapiens
GLCTHENQV

SEQ ID NO: 9798 - protein, 9 aa, Homo Sapiens
ASGSQDLGK

SEQ ID NO: 9799 - protein, 9 aa, Homo Sapiens
KKKKNVCAP

SEQ ID NO: 9800 - protein, 9 aa, Homo Sapiens
WNLVCHSHA

SEQ ID NO: 9801 - protein, 9 aa, Homo Sapiens
QVMLDSLDS

SEQ ID NO: 9802 - protein, 9 aa, Homo Sapiens
EVLDMTKGN

SEQ ID NO: 9803 - protein, 9 aa, Homo Sapiens
RICRTNTVA

SEQ ID NO: 9804 - protein, 9 aa, Homo Sapiens
REALQLKVS

SEQ ID NO: 9805 - protein, 9 aa, Homo Sapiens
MFFPITFSF

SEQ ID NO: 9806 - protein, 9 aa, Homo Sapiens
AGLIGAVKL

SEQ ID NO: 9807 - protein, 9 aa, Homo Sapiens
NESEISEFE

SEQ ID NO: 9808 - protein, 9 aa, Homo Sapiens
KGVIDLIFQ

SEQ ID NO: 9809 - protein, 9 aa, Homo Sapiens
PLVLIAWDN

SEQ ID NO: 9810 - protein, 9 aa, Homo Sapiens
YLLQHITQM

SEQ ID NO: 9811 - protein, 9 aa, Homo Sapiens
RKTQSDMAI

SEQ ID NO: 9812 - protein, 9 aa, Homo Sapiens
IRLLQTQLM

SEQ ID NO: 9813 - protein, 9 aa, Homo Sapiens
HCCLGFRPA

SEQ ID NO: 9814 - protein, 9 aa, Homo Sapiens
GHLKKEKAE

SEQ ID NO: 9815 - protein, 9 aa, Homo Sapiens
WVLGTMEMG

SEQ ID NO: 9816 - protein, 9 aa, Homo Sapiens
HSMLSNPDL

SEQ ID NO: 9817 - protein, 9 aa, Homo Sapiens
FHYFQRISS

SEQ ID NO: 9818 - protein, 9 aa, Homo Sapiens
FVFRCNFTP

SEQ ID NO: 9819 - protein, 9 aa, Homo Sapiens
DEQAIAELL

SEQ ID NO: 9820 - protein, 9 aa, Homo Sapiens
ALTQNDDSD

SEQ ID NO: 9821 - protein, 9 aa, Homo Sapiens
RRAAWWQSQ

SEQ ID NO: 9822 - protein, 9 aa, Homo Sapiens
GPGMELGPA

SEQ ID NO: 9823 - protein, 9 aa, Homo Sapiens
LQADGVSER

SEQ ID NO: 9824 - protein, 9 aa, Homo Sapiens
RTNTVARAK

SEQ ID NO: 9825 - protein, 9 aa, Homo Sapiens
EEEFDTEGD

SEQ ID NO: 9826 - protein, 9 aa, Homo Sapiens
ITIIPNFSL

SEQ ID NO: 9827 - protein, 9 aa, Homo Sapiens
PESCQPFQA

SEQ ID NO: 9828 - protein, 9 aa, Homo Sapiens
LHTFCGSPP

SEQ ID NO: 9829 - protein, 9 aa, Homo Sapiens
QKAISEPNF

SEQ ID NO: 9830 - protein, 9 aa, Homo Sapiens
TQRVQREVS

SEQ ID NO: 9831 - protein, 9 aa, Homo Sapiens
QNDDSDEYE

SEQ ID NO: 9832 - protein, 9 aa, Homo Sapiens
IISMDRYIG

SEQ ID NO: 9833 - protein, 9 aa, Homo Sapiens
SRRLSLLRH

SEQ ID NO: 9834 - protein, 9 aa, Homo Sapiens
GNSTNIKAN

SEQ ID NO: 9835 - protein, 9 aa, Homo Sapiens
QAIYTAVES

SEQ ID NO: 9836 - protein, 9 aa, Homo Sapiens
QRICNHLGL

SEQ ID NO: 9837 - protein, 9 aa, Homo Sapiens
QADGVSERT

SEQ ID NO: 9838 - protein, 9 aa, Homo Sapiens
LSVVLQALV

SEQ ID NO: 9839 - protein, 9 aa, Homo Sapiens
THKIIHNGE

SEQ ID NO: 9840 - protein, 9 aa, Homo Sapiens
RFLKMVEHI

SEQ ID NO: 9841 - protein, 9 aa, Homo Sapiens
TPAFFSLFS

SEQ ID NO: 9842 - protein, 9 aa, Homo Sapiens
SRSASRTTH

SEQ ID NO: 9843 - protein, 9 aa, Homo Sapiens
VSPTSHMHC

SEQ ID NO: 9844 - protein, 9 aa, Homo Sapiens
LFSHRFGEH

SEQ ID NO: 9845 - protein, 9 aa, Homo Sapiens
DIHRSIKYC

SEQ ID NO: 9846 - protein, 9 aa, Homo Sapiens
TGIRLLQTQ

SEQ ID NO: 9847 - protein, 9 aa, Homo Sapiens
LSAEAGPAG

SEQ ID NO: 9848 - protein, 9 aa, Homo Sapiens
ESCQPFQAS

SEQ ID NO: 9849 - protein, 9 aa, Homo Sapiens
LKSKERKTQ

SEQ ID NO: 9850 - protein, 9 aa, Homo Sapiens
LPKLISDEY

SEQ ID NO: 9851 - protein, 9 aa, Homo Sapiens
EQISKRRRL

SEQ ID NO: 9852 - protein, 9 aa, Homo Sapiens
LPEINNVVS

SEQ ID NO: 9853 - protein, 9 aa, Homo Sapiens
VYRYMDTCL

SEQ ID NO: 9854 - protein, 9 aa, Homo Sapiens
IMEAMAEHP

SEQ ID NO: 9855 - protein, 9 aa, Homo Sapiens
QPAGAGSPS

SEQ ID NO: 9856 - protein, 9 aa, Homo Sapiens
QLVMLRKSQ

SEQ ID NO: 9857 - protein, 9 aa, Homo Sapiens
SSLCKHMKV

SEQ ID NO: 9858 - protein, 9 aa, Homo Sapiens
LEANYINLQ

SEQ ID NO: 9859 - protein, 9 aa, Homo Sapiens
DQEEEEEEG

SEQ ID NO: 9860 - protein, 9 aa, Homo Sapiens
VPRQPRPAV

SEQ ID NO: 9861 - protein, 9 aa, Homo Sapiens
RNFSRRLSL

SEQ ID NO: 9862 - protein, 9 aa, Homo Sapiens
PEINNVVSG

SEQ ID NO: 9863 - protein, 9 aa, Homo Sapiens
VENGFVNSR

SEQ ID NO: 9864 - protein, 9 aa, Homo Sapiens
CNFTPTEAF

SEQ ID NO: 9865 - protein, 9 aa, Homo Sapiens
DKASIQALK

SEQ ID NO: 9866 - protein, 9 aa, Homo Sapiens
ILNEAYVMA

SEQ ID NO: 9867 - protein, 9 aa, Homo Sapiens
KECTQRVQR

SEQ ID NO: 9868 - protein, 9 aa, Homo Sapiens
ENPFVHSML

SEQ ID NO: 9869 - protein, 9 aa, Homo Sapiens
NRYLCIAVL

SEQ ID NO: 9870 - protein, 9 aa, Homo Sapiens
MRLSVVLQA

SEQ ID NO: 9871 - protein, 9 aa, Homo Sapiens
PVVIKLQEI

SEQ ID NO: 9872 - protein, 9 aa, Homo Sapiens
ACKECTQRV

SEQ ID NO: 9873 - protein, 9 aa, Homo Sapiens
FSKLPEVNS

SEQ ID NO: 9874 - protein, 9 aa, Homo Sapiens
RKQAESCDC

SEQ ID NO: 9875 - protein, 9 aa, Homo Sapiens
KSVFRYCNT

SEQ ID NO: 9876 - protein, 9 aa, Homo Sapiens
TRQKESAER

SEQ ID NO: 9877 - protein, 9 aa, Homo Sapiens
VVLQALVPL

SEQ ID NO: 9878 - protein, 9 aa, Homo Sapiens
VTKRGKTLS

SEQ ID NO: 9879 - protein, 9 aa, Homo Sapiens
DLSGDSEET

SEQ ID NO: 9880 - protein, 9 aa, Homo Sapiens
QEGPCSCVR

SEQ ID NO: 9881 - protein, 9 aa, Homo Sapiens
FEQNFLSTL

SEQ ID NO: 9882 - protein, 9 aa, Homo Sapiens
EKAEIQAEL

SEQ ID NO: 9883 - protein, 9 aa, Homo Sapiens
DPVTRGIKI

SEQ ID NO: 9884 - protein, 9 aa, Homo Sapiens
QESVQIEIE

SEQ ID NO: 9885 - protein, 9 aa, Homo Sapiens
FPITFSFFN

SEQ ID NO: 9886 - protein, 9 aa, Homo Sapiens
PLLSQRICS

SEQ ID NO: 9887 - protein, 9 aa, Homo Sapiens
LGHLKKEKA

SEQ ID NO: 9888 - protein, 9 aa, Homo Sapiens
ALKEQIMAF

SEQ ID NO: 9889 - protein, 9 aa, Homo Sapiens
QVGCRELCS

SEQ ID NO: 9890 - protein, 9 aa, Homo Sapiens
DSTGPSPSY

SEQ ID NO: 9891 - protein, 9 aa, Homo Sapiens
MVSVSPPEQ

SEQ ID NO: 9892 - protein, 9 aa, Homo Sapiens
NPFVHSMLS

SEQ ID NO: 9893 - protein, 9 aa, Homo Sapiens
QPGPQGGAQ

SEQ ID NO: 9894 - protein, 9 aa, Homo Sapiens
ADEQGGPGM

SEQ ID NO: 9895 - protein, 9 aa, Homo Sapiens
RQEQISKRR

SEQ ID NO: 9896 - protein, 9 aa, Homo Sapiens
KSMEIQFIL

SEQ ID NO: 9897 - protein, 9 aa, Homo Sapiens
LTQNDDSDE

SEQ ID NO: 9898 - protein, 9 aa, Homo Sapiens
EAPYLLSAE

SEQ ID NO: 9899 - protein, 9 aa, Homo Sapiens
FVHSMLSNP

SEQ ID NO: 9900 - protein, 9 aa, Homo Sapiens
LSRLSSDSA

SEQ ID NO: 9901 - protein, 9 aa, Homo Sapiens
HKCVVRYTG

SEQ ID NO: 9902 - protein, 9 aa, Homo Sapiens
LNEWSGSAL

SEQ ID NO: 9903 - protein, 9 aa, Homo Sapiens
SLIMYRLQS

SEQ ID NO: 9904 - protein, 9 aa, Homo Sapiens
FSVRLGSFR

SEQ ID NO: 9905 - protein, 9 aa, Homo Sapiens
DSGDRVTHT

SEQ ID NO: 9906 - protein, 9 aa, Homo Sapiens
RTIQRNTKP

SEQ ID NO: 9907 - protein, 9 aa, Homo Sapiens
FLKMVEHIL

SEQ ID NO: 9908 - protein, 9 aa, Homo Sapiens
IKITVNYLG

SEQ ID NO: 9909 - protein, 9 aa, Homo Sapiens
TVHTKDGSA

SEQ ID NO: 9910 - protein, 9 aa, Homo Sapiens
GSSPVENGF

SEQ ID NO: 9911 - protein, 9 aa, Homo Sapiens
SVGKAPSNS

SEQ ID NO: 9912 - protein, 9 aa, Homo Sapiens
LLQAFAQAA

SEQ ID NO: 9913 - protein, 9 aa, Homo Sapiens
ITLTPEQAQ

SEQ ID NO: 9914 - protein, 9 aa, Homo Sapiens
KLTFIKSAI

SEQ ID NO: 9915 - protein, 9 aa, Homo Sapiens
FPADKASIQ

SEQ ID NO: 9916 - protein, 9 aa, Homo Sapiens
NKSYFSYFF

SEQ ID NO: 9917 - protein, 9 aa, Homo Sapiens
NFTPTEAFQ

SEQ ID NO: 9918 - protein, 9 aa, Homo Sapiens
EHCKPTTRD

SEQ ID NO: 9919 - protein, 9 aa, Homo Sapiens
RNLRKEVSR

SEQ ID NO: 9920 - protein, 9 aa, Homo Sapiens
QILYLGSLS

SEQ ID NO: 9921 - protein, 9 aa, Homo Sapiens
IANTTDGCH

SEQ ID NO: 9922 - protein, 9 aa, Homo Sapiens
RNIHPNIIL

SEQ ID NO: 9923 - protein, 9 aa, Homo Sapiens
LSPLLQAFA

SEQ ID NO: 9924 - protein, 9 aa, Homo Sapiens
VDQIVQKTQ

SEQ ID NO: 9925 - protein, 9 aa, Homo Sapiens
DNGGSSVTF

SEQ ID NO: 9926 - protein, 9 aa, Homo Sapiens
ADVRLEATK

SEQ ID NO: 9927 - protein, 9 aa, Homo Sapiens
SFCPPGHPL

SEQ ID NO: 9928 - protein, 9 aa, Homo Sapiens
PYLLSAEAG

SEQ ID NO: 9929 - protein, 9 aa, Homo Sapiens
VWIINIYKE

SEQ ID NO: 9930 - protein, 9 aa, Homo Sapiens
QRISSWATC

SEQ ID NO: 9931 - protein, 9 aa, Homo Sapiens
EFLSSYTMR

SEQ ID NO: 9932 - protein, 9 aa, Homo Sapiens
TNAVSALKE

SEQ ID NO: 9933 - protein, 9 aa, Homo Sapiens
IAWQDIDFA

SEQ ID NO: 9934 - protein, 9 aa, Homo Sapiens
TGPSPSYLG

SEQ ID NO: 9935 - protein, 9 aa, Homo Sapiens
VWENMARIC

SEQ ID NO: 9936 - protein, 9 aa, Homo Sapiens
PQGYSCHCC

SEQ ID NO: 9937 - protein, 9 aa, Homo Sapiens
LPAQLQQLE

SEQ ID NO: 9938 - protein, 9 aa, Homo Sapiens
DQIVQKTQR

SEQ ID NO: 9939 - protein, 9 aa, Homo Sapiens
LVMLRKSQE

SEQ ID NO: 9940 - protein, 9 aa, Homo Sapiens
SSDSRSRVL

SEQ ID NO: 9941 - protein, 9 aa, Homo Sapiens
SVFRYCNTW

SEQ ID NO: 9942 - protein, 9 aa, Homo Sapiens
GNQILYLGS

SEQ ID NO: 9943 - protein, 9 aa, Homo Sapiens
MGTICYPNP

SEQ ID NO: 9944 - protein, 9 aa, Homo Sapiens
QEKDGTQKR

SEQ ID NO: 9945 - protein, 9 aa, Homo Sapiens
SQRICSLTA

SEQ ID NO: 9946 - protein, 9 aa, Homo Sapiens
TQDTALTQN

SEQ ID NO: 9947 - protein, 9 aa, Homo Sapiens
EKDGTQKRG

SEQ ID NO: 9948 - protein, 9 aa, Homo Sapiens
PFQASVRSL

SEQ ID NO: 9949 - protein, 9 aa, Homo Sapiens
GLCIISMDR

SEQ ID NO: 9950 - protein, 9 aa, Homo Sapiens
RKIKWEQMW

SEQ ID NO: 9951 - protein, 9 aa, Homo Sapiens
QSPRKVNGR

SEQ ID NO: 9952 - protein, 9 aa, Homo Sapiens
TFCSDIGTN

SEQ ID NO: 9953 - protein, 9 aa, Homo Sapiens
IYHCQGLLP

SEQ ID NO: 9954 - protein, 9 aa, Homo Sapiens
SDTHRTTVE

SEQ ID NO: 9955 - protein, 9 aa, Homo Sapiens
EEVSETCSK

SEQ ID NO: 9956 - protein, 9 aa, Homo Sapiens
RDAGNDSGH

SEQ ID NO: 9957 - protein, 9 aa, Homo Sapiens
SVFEQNFLS

SEQ ID NO: 9958 - protein, 9 aa, Homo Sapiens
VLSLLDVCA

SEQ ID NO: 9959 - protein, 9 aa, Homo Sapiens
KKKNVCAPR

SEQ ID NO: 9960 - protein, 9 aa, Homo Sapiens
LTAHTRIHT

SEQ ID NO: 9961 - protein, 9 aa, Homo Sapiens
PPQIVPQVP

SEQ ID NO: 9962 - protein, 9 aa, Homo Sapiens
VSIVTVHTK

SEQ ID NO: 9963 - protein, 9 aa, Homo Sapiens
CRAQIALIP

SEQ ID NO: 9964 - protein, 9 aa, Homo Sapiens
EELLKTVSY

SEQ ID NO: 9965 - protein, 9 aa, Homo Sapiens
LTPEQAQAL

SEQ ID NO: 9966 - protein, 9 aa, Homo Sapiens
NCGFEHCKP

SEQ ID NO: 9967 - protein, 9 aa, Homo Sapiens
SMETRPPPW

SEQ ID NO: 9968 - protein, 9 aa, Homo Sapiens
SRNVSNDPV

SEQ ID NO: 9969 - protein, 9 aa, Homo Sapiens
VTLSRQPGK

SEQ ID NO: 9970 - protein, 9 aa, Homo Sapiens
EVLAQHRAE

SEQ ID NO: 9971 - protein, 9 aa, Homo Sapiens
YFWDLTGIK

SEQ ID NO: 9972 - protein, 9 aa, Homo Sapiens
EESNLVGTL

SEQ ID NO: 9973 - protein, 9 aa, Homo Sapiens
IMYRLQSYK

SEQ ID NO: 9974 - protein, 9 aa, Homo Sapiens
DFTCDEENV

SEQ ID NO: 9975 - protein, 9 aa, Homo Sapiens
NCRETEDPE

SEQ ID NO: 9976 - protein, 9 aa, Homo Sapiens
LGGLCVTAL

SEQ ID NO: 9977 - protein, 9 aa, Homo Sapiens
CIWCSTEHG

SEQ ID NO: 9978 - protein, 9 aa, Homo Sapiens
KAQREDKLT

SEQ ID NO: 9979 - protein, 9 aa, Homo Sapiens
LLLIGVTLA

SEQ ID NO: 9980 - protein, 9 aa, Homo Sapiens
KIGKITGLD

SEQ ID NO: 9981 - protein, 9 aa, Homo Sapiens
TLTPEQAQA

SEQ ID NO: 9982 - protein, 9 aa, Homo Sapiens
IDKIYHCQG

SEQ ID NO: 9983 - protein, 9 aa, Homo Sapiens
PQAAASYHG

SEQ ID NO: 9984 - protein, 9 aa, Homo Sapiens
DFEFLSSYT

SEQ ID NO: 9985 - protein, 9 aa, Homo Sapiens
APWGLCTHE

SEQ ID NO: 9986 - protein, 9 aa, Homo Sapiens
VVFQRRWSV

SEQ ID NO: 9987 - protein, 9 aa, Homo Sapiens
PRSSSLLYG

SEQ ID NO: 9988 - protein, 9 aa, Homo Sapiens
DLIDFEFLS

SEQ ID NO: 9989 - protein, 9 aa, Homo Sapiens
SHNDRRFVI

SEQ ID NO: 9990 - protein, 9 aa, Homo Sapiens
NAVSALKEQ

SEQ ID NO: 9991 - protein, 9 aa, Homo Sapiens
SLFSHRFGE

SEQ ID NO: 9992 - protein, 9 aa, Homo Sapiens
ELDYNYVQI

SEQ ID NO: 9993 - protein, 9 aa, Homo Sapiens
KTLSWLKSR

SEQ ID NO: 9994 - protein, 9 aa, Homo Sapiens
MIQQNGDVE

SEQ ID NO: 9995 - protein, 9 aa, Homo Sapiens
GESDTHRTT

SEQ ID NO: 9996 - protein, 9 aa, Homo Sapiens
MLRKSQEFF

SEQ ID NO: 9997 - protein, 9 aa, Homo Sapiens
NPPDGERFL

SEQ ID NO: 9998 - protein, 9 aa, Homo Sapiens
PPLPAISQS

SEQ ID NO: 9999 - protein, 9 aa, Homo Sapiens
CLARQFRGH

SEQ ID NO: 10000 - protein, 9 aa, Homo Sapiens
QPVKPSAPK

SEQ ID NO: 10001 - protein, 9 aa, Homo Sapiens
AVSALKEQI

SEQ ID NO: 10002 - protein, 9 aa, Homo Sapiens
AAASYHGQP

SEQ ID NO: 10003 - protein, 9 aa, Homo Sapiens
KTSKMKVLE

SEQ ID NO: 10004 - protein, 9 aa, Homo Sapiens
SHKSQFIEL

SEQ ID NO: 10005 - protein, 9 aa, Homo Sapiens
FSESENKSY

SEQ ID NO: 10006 - protein, 9 aa, Homo Sapiens
SDSRSRVLS

SEQ ID NO: 10007 - protein, 9 aa, Homo Sapiens
MIFYKMAAK

SEQ ID NO: 10008 - protein, 9 aa, Homo Sapiens
TLRDAFITA

SEQ ID NO: 10009 - protein, 9 aa, Homo Sapiens
SPRKVNGRM

SEQ ID NO: 10010 - protein, 9 aa, Homo Sapiens
VRLEATKEI

SEQ ID NO: 10011 - protein, 9 aa, Homo Sapiens
LAGLGPYRP

SEQ ID NO: 10012 - protein, 9 aa, Homo Sapiens
APGTVVALL

SEQ ID NO: 10013 - protein, 9 aa, Homo Sapiens
SCYYVTRKL

SEQ ID NO: 10014 - protein, 9 aa, Homo Sapiens
PYQDRGGQQ

SEQ ID NO: 10015 - protein, 9 aa, Homo Sapiens
KNKSMEIQF

SEQ ID NO: 10016 - protein, 9 aa, Homo Sapiens
AFTLQGSGY

SEQ ID NO: 10017 - protein, 9 aa, Homo Sapiens
EQNFLSTLT

SEQ ID NO: 10018 - protein, 9 aa, Homo Sapiens
DVGNCRETE

SEQ ID NO: 10019 - protein, 9 aa, Homo Sapiens
QIKRLSKLI

SEQ ID NO: 10020 - protein, 9 aa, Homo Sapiens
EAPQDGQGC

SEQ ID NO: 10021 - protein, 9 aa, Homo Sapiens
VKPSAPKLE

SEQ ID NO: 10022 - protein, 9 aa, Homo Sapiens
VEGLVDERP

SEQ ID NO: 10023 - protein, 9 aa, Homo Sapiens
KTESTSDKE

SEQ ID NO: 10024 - protein, 9 aa, Homo Sapiens
IHTSGKYGY

SEQ ID NO: 10025 - protein, 9 aa, Homo Sapiens
KNVCAPRGP

SEQ ID NO: 10026 - protein, 9 aa, Homo Sapiens
FLAEKELIT

SEQ ID NO: 10027 - protein, 9 aa, Homo Sapiens
GPYRPAWPP

SEQ ID NO: 10028 - protein, 9 aa, Homo Sapiens
KEIYLTPVQ

SEQ ID NO: 10029 - protein, 9 aa, Homo Sapiens
RESTSGTED

SEQ ID NO: 10030 - protein, 9 aa, Homo Sapiens
TSPLVLIAW

SEQ ID NO: 10031 - protein, 9 aa, Homo Sapiens
MSCGGGRSF

SEQ ID NO: 10032 - protein, 9 aa, Homo Sapiens
VFVKGKLGV

SEQ ID NO: 10033 - protein, 9 aa, Homo Sapiens
GPPPYGDST

SEQ ID NO: 10034 - protein, 9 aa, Homo Sapiens
FMVLDILCS

SEQ ID NO: 10035 - protein, 9 aa, Homo Sapiens
SEESNLVGT

SEQ ID NO: 10036 - protein, 9 aa, Homo Sapiens
PKANKEILN

SEQ ID NO: 10037 - protein, 9 aa, Homo Sapiens
SDDLITNIL

SEQ ID NO: 10038 - protein, 9 aa, Homo Sapiens
AAGGDHKTE

SEQ ID NO: 10039 - protein, 9 aa, Homo Sapiens
GMGSAFCTS

SEQ ID NO: 10040 - protein, 9 aa, Homo Sapiens
KGESDTHRT

SEQ ID NO: 10041 - protein, 9 aa, Homo Sapiens
PILRQPTEK

SEQ ID NO: 10042 - protein, 9 aa, Homo Sapiens
EDLLLIGVT

SEQ ID NO: 10043 - protein, 9 aa, Homo Sapiens
DGERFLKMV

SEQ ID NO: 10044 - protein, 9 aa, Homo Sapiens
NGAGSSPVE

SEQ ID NO: 10045 - protein, 9 aa, Homo Sapiens
AISENLSQE

SEQ ID NO: 10046 - protein, 9 aa, Homo Sapiens
KATGEQFVK

SEQ ID NO: 10047 - protein, 9 aa, Homo Sapiens
LGMNVTIFP

SEQ ID NO: 10048 - protein, 9 aa, Homo Sapiens
VDLSGDSEE

SEQ ID NO: 10049 - protein, 9 aa, Homo Sapiens
DTGIRLLQT

SEQ ID NO: 10050 - protein, 9 aa, Homo Sapiens
GITLTPEQA

SEQ ID NO: 10051 - protein, 9 aa, Homo Sapiens
QVEEVSETC

SEQ ID NO: 10052 - protein, 9 aa, Homo Sapiens
AWWQSQNGI

SEQ ID NO: 10053 - protein, 9 aa, Homo Sapiens
GAIGLINNL

SEQ ID NO: 10054 - protein, 9 aa, Homo Sapiens
NSVDFLPLA

SEQ ID NO: 10055 - protein, 9 aa, Homo Sapiens
CTGLGMPPE

SEQ ID NO: 10056 - protein, 9 aa, Homo Sapiens
EGLVDERPF

SEQ ID NO: 10057 - protein, 9 aa, Homo Sapiens
YVGFCLPFM

SEQ ID NO: 10058 - protein, 9 aa, Homo Sapiens
MSYALEEIK

SEQ ID NO: 10059 - protein, 9 aa, Homo Sapiens
GGGRSFCPP

SEQ ID NO: 10060 - protein, 9 aa, Homo Sapiens
TPTNNLQLG

SEQ ID NO: 10061 - protein, 9 aa, Homo Sapiens
PPPQIVPQV

SEQ ID NO: 10062 - protein, 9 aa, Homo Sapiens
VALGYELCK

SEQ ID NO: 10063 - protein, 9 aa, Homo Sapiens
GFEHCKPTT

SEQ ID NO: 10064 - protein, 9 aa, Homo Sapiens
VDIANTTDG

SEQ ID NO: 10065 - protein, 9 aa, Homo Sapiens
HINFMKQIR

SEQ ID NO: 10066 - protein, 9 aa, Homo Sapiens
QCVTRSEGG

SEQ ID NO: 10067 - protein, 9 aa, Homo Sapiens
DAEKVINTL

SEQ ID NO: 10068 - protein, 9 aa, Homo Sapiens
KELITIIPN

SEQ ID NO: 10069 - protein, 9 aa, Homo Sapiens
EIVDMIQQN

SEQ ID NO: 10070 - protein, 9 aa, Homo Sapiens
LWGPRARAK

SEQ ID NO: 10071 - protein, 9 aa, Homo Sapiens
QLPAQLQQL

SEQ ID NO: 10072 - protein, 9 aa, Homo Sapiens
TEGDCISLP

SEQ ID NO: 10073 - protein, 9 aa, Homo Sapiens
IIILYSKIF

SEQ ID NO: 10074 - protein, 9 aa, Homo Sapiens
EENLPILRQ

SEQ ID NO: 10075 - protein, 9 aa, Homo Sapiens
SLAAASVDH

SEQ ID NO: 10076 - protein, 9 aa, Homo Sapiens
GRGLSLGFK

SEQ ID NO: 10077 - protein, 9 aa, Homo Sapiens
VVCKDYGGD

SEQ ID NO: 10078 - protein, 9 aa, Homo Sapiens
ETPTNNLQL

SEQ ID NO: 10079 - protein, 9 aa, Homo Sapiens
GASGSQDLG

SEQ ID NO: 10080 - protein, 9 aa, Homo Sapiens
EGSGKQVWH

SEQ ID NO: 10081 - protein, 9 aa, Homo Sapiens
IHLAQELIM

SEQ ID NO: 10082 - protein, 9 aa, Homo Sapiens
RSSSLLYGC

SEQ ID NO: 10083 - protein, 9 aa, Homo Sapiens
TTHNEEQSG

SEQ ID NO: 10084 - protein, 9 aa, Homo Sapiens
SLGFKYLEY

SEQ ID NO: 10085 - protein, 9 aa, Homo Sapiens
RKEVSRVLC

SEQ ID NO: 10086 - protein, 9 aa, Homo Sapiens
VFELDYNYV

SEQ ID NO: 10087 - protein, 9 aa, Homo Sapiens
PVPRQPRPA

SEQ ID NO: 10088 - protein, 9 aa, Homo Sapiens
SEHCDLTEA

SEQ ID NO: 10089 - protein, 9 aa, Homo Sapiens
LGKPRVGKK

SEQ ID NO: 10090 - protein, 9 aa, Homo Sapiens
TRGIKITVN

SEQ ID NO: 10091 - protein, 9 aa, Homo Sapiens
QATNAVSAL

SEQ ID NO: 10092 - protein, 9 aa, Homo Sapiens
MFAALQYDI

SEQ ID NO: 10093 - protein, 9 aa, Homo Sapiens
LQALVPLKT

SEQ ID NO: 10094 - protein, 9 aa, Homo Sapiens
AQIALIPLS

SEQ ID NO: 10095 - protein, 9 aa, Homo Sapiens
WVDLNIPDN

SEQ ID NO: 10096 - protein, 9 aa, Homo Sapiens
ALNRYLCIA

SEQ ID NO: 10097 - protein, 9 aa, Homo Sapiens
NLKGLSLKS

SEQ ID NO: 10098 - protein, 9 aa, Homo Sapiens
VAYLLQHIT

SEQ ID NO: 10099 - protein, 9 aa, Homo Sapiens
RGEATRQKE

SEQ ID NO: 10100 - protein, 9 aa, Homo Sapiens
NFMKQIREI

SEQ ID NO: 10101 - protein, 9 aa, Homo Sapiens
QQVVRLKGQ

SEQ ID NO: 10102 - protein, 9 aa, Homo Sapiens
LPSDDLITN

SEQ ID NO: 10103 - protein, 9 aa, Homo Sapiens
QLYASEHYS

SEQ ID NO: 10104 - protein, 9 aa, Homo Sapiens
YCIWCSTEH

SEQ ID NO: 10105 - protein, 9 aa, Homo Sapiens
LVCHSHALK

SEQ ID NO: 10106 - protein, 9 aa, Homo Sapiens
NLEPNAKFD

SEQ ID NO: 10107 - protein, 9 aa, Homo Sapiens
LFKHYEAVR

SEQ ID NO: 10108 - protein, 9 aa, Homo Sapiens
QHQHQQQHQ

SEQ ID NO: 10109 - protein, 9 aa, Homo Sapiens
ENLPILRQP

SEQ ID NO: 10110 - protein, 9 aa, Homo Sapiens
VAKWNLVCH

SEQ ID NO: 10111 - protein, 9 aa, Homo Sapiens
EQAQRPEEL

SEQ ID NO: 10112 - protein, 9 aa, Homo Sapiens
DFGRGLSLG

SEQ ID NO: 10113 - protein, 9 aa, Homo Sapiens
AYLLQHITQ

SEQ ID NO: 10114 - protein, 9 aa, Homo Sapiens
VAWVLGTME

SEQ ID NO: 10115 - protein, 9 aa, Homo Sapiens
GKGLDMAKR

SEQ ID NO: 10116 - protein, 9 aa, Homo Sapiens
SKLHTFCGS

SEQ ID NO: 10117 - protein, 9 aa, Homo Sapiens
WDSEHCDLT

SEQ ID NO: 10118 - protein, 9 aa, Homo Sapiens
ENKSYFSYF

SEQ ID NO: 10119 - protein, 9 aa, Homo Sapiens
PESENLELT

SEQ ID NO: 10120 - protein, 9 aa, Homo Sapiens
DRVTHTVPI

SEQ ID NO: 10121 - protein, 9 aa, Homo Sapiens
SMKSLIMYR

SEQ ID NO: 10122 - protein, 9 aa, Homo Sapiens
RVTHTVPIY

SEQ ID NO: 10123 - protein, 9 aa, Homo Sapiens
RMSYALEEI

SEQ ID NO: 10124 - protein, 9 aa, Homo Sapiens
DEQGGPGME

SEQ ID NO: 10125 - protein, 9 aa, Homo Sapiens
LLNEWSGSA

SEQ ID NO: 10126 - protein, 9 aa, Homo Sapiens
ETGRNLRKE

SEQ ID NO: 10127 - protein, 9 aa, Homo Sapiens
GLDMAKRCS

SEQ ID NO: 10128 - protein, 9 aa, Homo Sapiens
LCIAVLPLL

SEQ ID NO: 10129 - protein, 9 aa, Homo Sapiens
HTSGKYGYK

SEQ ID NO: 10130 - protein, 9 aa, Homo Sapiens
SDILLNEWS

SEQ ID NO: 10131 - protein, 9 aa, Homo Sapiens
ERLRSCYYV

SEQ ID NO: 10132 - protein, 9 aa, Homo Sapiens
MMFAALQYD

SEQ ID NO: 10133 - protein, 9 aa, Homo Sapiens
VWHSEETIF

SEQ ID NO: 10134 - protein, 9 aa, Homo Sapiens
SEEYKDDFE

SEQ ID NO: 10135 - protein, 9 aa, Homo Sapiens
ESHKSQFIE

SEQ ID NO: 10136 - protein, 9 aa, Homo Sapiens
METRPPPWL

SEQ ID NO: 10137 - protein, 9 aa, Homo Sapiens
QKESAERSE

SEQ ID NO: 10138 - protein, 9 aa, Homo Sapiens
TVCPCPHGM

SEQ ID NO: 10139 - protein, 9 aa, Homo Sapiens
FEDSDVENL

SEQ ID NO: 10140 - protein, 9 aa, Homo Sapiens
GLGPYRPAW

SEQ ID NO: 10141 - protein, 9 aa, Homo Sapiens
FQKAISEPN

SEQ ID NO: 10142 - protein, 9 aa, Homo Sapiens
DPGASSVGK

SEQ ID NO: 10143 - protein, 9 aa, Homo Sapiens
VIDLIFQKA

SEQ ID NO: 10144 - protein, 9 aa, Homo Sapiens
LAQHRAEQQ

SEQ ID NO: 10145 - protein, 9 aa, Homo Sapiens
RPPKSSSVS

SEQ ID NO: 10146 - protein, 9 aa, Homo Sapiens
EAVRDAGND

SEQ ID NO: 10147 - protein, 9 aa, Homo Sapiens
AMAEHPIVI

SEQ ID NO: 10148 - protein, 9 aa, Homo Sapiens
PEGAVGQSL

SEQ ID NO: 10149 - protein, 9 aa, Homo Sapiens
ITFSFFNVV

SEQ ID NO: 10150 - protein, 9 aa, Homo Sapiens
GKDLGMEPH

SEQ ID NO: 10151 - protein, 9 aa, Homo Sapiens
NYEDLPCKP

SEQ ID NO: 10152 - protein, 9 aa, Homo Sapiens
KITVNYLGI

SEQ ID NO: 10153 - protein, 9 aa, Homo Sapiens
DIANTTDGC

SEQ ID NO: 10154 - protein, 9 aa, Homo Sapiens
STPLHVTHR

SEQ ID NO: 10155 - protein, 9 aa, Homo Sapiens
YLPKLISDE

SEQ ID NO: 10156 - protein, 9 aa, Homo Sapiens
EQAQALGVP

SEQ ID NO: 10157 - protein, 9 aa, Homo Sapiens
SQDKKKDTV

SEQ ID NO: 10158 - protein, 9 aa, Homo Sapiens
DARCCYLYY

SEQ ID NO: 10159 - protein, 9 aa, Homo Sapiens
AIYTAVESA

SEQ ID NO: 10160 - protein, 9 aa, Homo Sapiens
DLLLIGVTL

SEQ ID NO: 10161 - protein, 9 aa, Homo Sapiens
HISAGAIGL

SEQ ID NO: 10162 - protein, 9 aa, Homo Sapiens
KNGSIVTCG

SEQ ID NO: 10163 - protein, 9 aa, Homo Sapiens
HTTIISTDL

SEQ ID NO: 10164 - protein, 9 aa, Homo Sapiens
EATRQKESA

SEQ ID NO: 10165 - protein, 9 aa, Homo Sapiens
RQPRPAVGP

SEQ ID NO: 10166 - protein, 9 aa, Homo Sapiens
ANIAWQDID

SEQ ID NO: 10167 - protein, 9 aa, Homo Sapiens
RGKTLSWLK

SEQ ID NO: 10168 - protein, 9 aa, Homo Sapiens
DACKECTQR

SEQ ID NO: 10169 - protein, 9 aa, Homo Sapiens
RCCYLYYFK

SEQ ID NO: 10170 - protein, 9 aa, Homo Sapiens
QLEHRVARR

SEQ ID NO: 10171 - protein, 9 aa, Homo Sapiens
MNKRGQLYA

SEQ ID NO: 10172 - protein, 9 aa, Homo Sapiens
WQSQNGIPA

SEQ ID NO: 10173 - protein, 9 aa, Homo Sapiens
SCQPFQASV

SEQ ID NO: 10174 - protein, 9 aa, Homo Sapiens
TALTQNDDS

SEQ ID NO: 10175 - protein, 9 aa, Homo Sapiens
LHAGASLFV

SEQ ID NO: 10176 - protein, 9 aa, Homo Sapiens
VSERTVIQI

SEQ ID NO: 10177 - protein, 9 aa, Homo Sapiens
YPNPSGTKT

SEQ ID NO: 10178 - protein, 9 aa, Homo Sapiens
NEVDKHMES

SEQ ID NO: 10179 - protein, 9 aa, Homo Sapiens
LLSPLLQAF

SEQ ID NO: 10180 - protein, 9 aa, Homo Sapiens
LVIIILYSK

SEQ ID NO: 10181 - protein, 9 aa, Homo Sapiens
GFEAPQDGQ

SEQ ID NO: 10182 - protein, 9 aa, Homo Sapiens
TCLIDVDVQ

SEQ ID NO: 10183 - protein, 9 aa, Homo Sapiens
PFVHSMLSN

SEQ ID NO: 10184 - protein, 9 aa, Homo Sapiens
ERDTGISSS

SEQ ID NO: 10185 - protein, 9 aa, Homo Sapiens
PLELQIKRL

SEQ ID NO: 10186 - protein, 9 aa, Homo Sapiens
PGPQGGAQR

SEQ ID NO: 10187 - protein, 9 aa, Homo Sapiens
CYPNPSGTK

SEQ ID NO: 10188 - protein, 9 aa, Homo Sapiens
LPVPRQPRP

SEQ ID NO: 10189 - protein, 9 aa, Homo Sapiens
RVLSLLDVC

SEQ ID NO: 10190 - protein, 9 aa, Homo Sapiens
FTLGSKLHT

SEQ ID NO: 10191 - protein, 9 aa, Homo Sapiens
QTQLMISGL

SEQ ID NO: 10192 - protein, 9 aa, Homo Sapiens
GIRLLQTQL

SEQ ID NO: 10193 - protein, 9 aa, Homo Sapiens
MTTVFTSGS

SEQ ID NO: 10194 - protein, 9 aa, Homo Sapiens
IGAVKLKAI

SEQ ID NO: 10195 - protein, 9 aa, Homo Sapiens
CQETYRCPI

SEQ ID NO: 10196 - protein, 9 aa, Homo Sapiens
SETCSKSEI

SEQ ID NO: 10197 - protein, 9 aa, Homo Sapiens
AGSSPVENG

SEQ ID NO: 10198 - protein, 9 aa, Homo Sapiens
AEKVINTLN

SEQ ID NO: 10199 - protein, 9 aa, Homo Sapiens
WTSSHCQTV

SEQ ID NO: 10200 - protein, 9 aa, Homo Sapiens
CQTVCPCPH

SEQ ID NO: 10201 - protein, 9 aa, Homo Sapiens
DMIQQNGDV

SEQ ID NO: 10202 - protein, 9 aa, Homo Sapiens
FQRGNQLFR

SEQ ID NO: 10203 - protein, 9 aa, Homo Sapiens
ARVLSLLDV

SEQ ID NO: 10204 - protein, 9 aa, Homo Sapiens
TNNLQLGSP

SEQ ID NO: 10205 - protein, 9 aa, Homo Sapiens
MASLILARQ

SEQ ID NO: 10206 - protein, 9 aa, Homo Sapiens
GFPKPESEN

SEQ ID NO: 10207 - protein, 9 aa, Homo Sapiens
QDLGKPRVG

SEQ ID NO: 10208 - protein, 9 aa, Homo Sapiens
MPVPAFWPH

SEQ ID NO: 10209 - protein, 9 aa, Homo Sapiens
HKIIYTGKK

SEQ ID NO: 10210 - protein, 9 aa, Homo Sapiens
LLTGEVPYW

SEQ ID NO: 10211 - protein, 9 aa, Homo Sapiens
TNIKANPGT

SEQ ID NO: 10212 - protein, 9 aa, Homo Sapiens
FFNVVYWLY

SEQ ID NO: 10213 - protein, 9 aa, Homo Sapiens
LITIIPNFS

SEQ ID NO: 10214 - protein, 9 aa, Homo Sapiens
SKQEKDGTQ

SEQ ID NO: 10215 - protein, 9 aa, Homo Sapiens
WGIDGLAVA

SEQ ID NO: 10216 - protein, 9 aa, Homo Sapiens
KASIQALKD

SEQ ID NO: 10217 - protein, 9 aa, Homo Sapiens
LGLVTLRDA

SEQ ID NO: 10218 - protein, 9 aa, Homo Sapiens
YRCLVCGKG

SEQ ID NO: 10219 - protein, 9 aa, Homo Sapiens
AVWENMARI

SEQ ID NO: 10220 - protein, 9 aa, Homo Sapiens
KSQFIELRK

SEQ ID NO: 10221 - protein, 9 aa, Homo Sapiens
KAISENLSQ

SEQ ID NO: 10222 - protein, 9 aa, Homo Sapiens
GIDKIYHCQ

SEQ ID NO: 10223 - protein, 9 aa, Homo Sapiens
SEETVAPAQ

SEQ ID NO: 10224 - protein, 9 aa, Homo Sapiens
IYTGKKPYK

SEQ ID NO: 10225 - protein, 9 aa, Homo Sapiens
CHPKGSLSL

SEQ ID NO: 10226 - protein, 9 aa, Homo Sapiens
FLSSYTMRV

SEQ ID NO: 10227 - protein, 9 aa, Homo Sapiens
PAQLQQLEH

SEQ ID NO: 10228 - protein, 9 aa, Homo Sapiens
YLCIAVLPL

SEQ ID NO: 10229 - protein, 9 aa, Homo Sapiens
SSNSVDFLP

SEQ ID NO: 10230 - protein, 9 aa, Homo Sapiens
GFCLPFMVL

SEQ ID NO: 10231 - protein, 9 aa, Homo Sapiens
LDKLRKIKW

SEQ ID NO: 10232 - protein, 9 aa, Homo Sapiens
SNSVDFLPL

SEQ ID NO: 10233 - protein, 9 aa, Homo Sapiens
QKLMDRSSA

SEQ ID NO: 10234 - protein, 9 aa, Homo Sapiens
QPAIRVAYL

SEQ ID NO: 10235 - protein, 9 aa, Homo Sapiens
TICYPNPSG

SEQ ID NO: 10236 - protein, 9 aa, Homo Sapiens
FMKQIREIA

SEQ ID NO: 10237 - protein, 9 aa, Homo Sapiens
QLHAGASLF

SEQ ID NO: 10238 - protein, 9 aa, Homo Sapiens
WPVPHGLQD

SEQ ID NO: 10239 - protein, 9 aa, Homo Sapiens
CKHMKVHES

SEQ ID NO: 10240 - protein, 9 aa, Homo Sapiens
DKNVVRTDR

SEQ ID NO: 10241 - protein, 9 aa, Homo Sapiens
MKSLIMYRL

SEQ ID NO: 10242 - protein, 9 aa, Homo Sapiens
KSNDISIHD

SEQ ID NO: 10243 - protein, 9 aa, Homo Sapiens
SKVKGMVFV

SEQ ID NO: 10244 - protein, 9 aa, Homo Sapiens
FTKQQFPLS

SEQ ID NO: 10245 - protein, 9 aa, Homo Sapiens
TIHKSKNIL

SEQ ID NO: 10246 - protein, 9 aa, Homo Sapiens
PKLISDEYI

SEQ ID NO: 10247 - protein, 9 aa, Homo Sapiens
ETPSAWSPL

SEQ ID NO: 10248 - protein, 9 aa, Homo Sapiens
CRTNTVARA

SEQ ID NO: 10249 - protein, 9 aa, Homo Sapiens
HGLQDLLNP

SEQ ID NO: 10250 - protein, 9 aa, Homo Sapiens
PAIRVAYLL

SEQ ID NO: 10251 - protein, 9 aa, Homo Sapiens
GKFVCLDDS

SEQ ID NO: 10252 - protein, 9 aa, Homo Sapiens
DKLRKIKWE

SEQ ID NO: 10253 - protein, 9 aa, Homo Sapiens
PAFWPHPPG

SEQ ID NO: 10254 - protein, 9 aa, Homo Sapiens
SIVTVHTKD

SEQ ID NO: 10255 - protein, 9 aa, Homo Sapiens
KGMVFVKGK

SEQ ID NO: 10256 - protein, 9 aa, Homo Sapiens
TRTKAISEN

SEQ ID NO: 10257 - protein, 9 aa, Homo Sapiens
CFNLKGLSL

SEQ ID NO: 10258 - protein, 9 aa, Homo Sapiens
LATGPCVPS

SEQ ID NO: 10259 - protein, 9 aa, Homo Sapiens
KKKKKNVCA

SEQ ID NO: 10260 - protein, 9 aa, Homo Sapiens
MPGIVVFQR

SEQ ID NO: 10261 - protein, 9 aa, Homo Sapiens
RLLETFCSD

SEQ ID NO: 10262 - protein, 9 aa, Homo Sapiens
VSVSPPEQH

SEQ ID NO: 10263 - protein, 9 aa, Homo Sapiens
SPPLPAISQ

SEQ ID NO: 10264 - protein, 9 aa, Homo Sapiens
MDVVRKQAE

SEQ ID NO: 10265 - protein, 9 aa, Homo Sapiens
RLGLVTLRD

SEQ ID NO: 10266 - protein, 9 aa, Homo Sapiens
VEEVSETCS

SEQ ID NO: 10267 - protein, 9 aa, Homo Sapiens
ATVWIINIY

SEQ ID NO: 10268 - protein, 9 aa, Homo Sapiens
GDSTGPSPS

SEQ ID NO: 10269 - protein, 9 aa, Homo Sapiens
NECHPDQTK

SEQ ID NO: 10270 - protein, 9 aa, Homo Sapiens
GEQFVKIAG

SEQ ID NO: 10271 - protein, 9 aa, Homo Sapiens
LMSLLMAVW

SEQ ID NO: 10272 - protein, 9 aa, Homo Sapiens
VGQSLQPLY

SEQ ID NO: 10273 - protein, 9 aa, Homo Sapiens
SKVSIVTVH

SEQ ID NO: 10274 - protein, 9 aa, Homo Sapiens
EVSETCSKS

SEQ ID NO: 10275 - protein, 9 aa, Homo Sapiens
TMTERLRSC

SEQ ID NO: 10276 - protein, 9 aa, Homo Sapiens
CGRLGLVTL

SEQ ID NO: 10277 - protein, 9 aa, Homo Sapiens
NIPDNPRSS

SEQ ID NO: 10278 - protein, 9 aa, Homo Sapiens
HPQAAASYH

SEQ ID NO: 10279 - protein, 9 aa, Homo Sapiens
LCYQGFEAP

SEQ ID NO: 10280 - protein, 9 aa, Homo Sapiens
SLLMAVWPS

SEQ ID NO: 10281 - protein, 9 aa, Homo Sapiens
EKELITIIP

SEQ ID NO: 10282 - protein, 9 aa, Homo Sapiens
AIGLINNLL

SEQ ID NO: 10283 - protein, 9 aa, Homo Sapiens
SEAPYLLSA

SEQ ID NO: 10284 - protein, 9 aa, Homo Sapiens
FEAPQDGQG

SEQ ID NO: 10285 - protein, 9 aa, Homo Sapiens
SDEEEFDTE

SEQ ID NO: 10286 - protein, 9 aa, Homo Sapiens
FYKMAAKFL

SEQ ID NO: 10287 - protein, 9 aa, Homo Sapiens
NVDQIVQKT

SEQ ID NO: 10288 - protein, 9 aa, Homo Sapiens
SRSRVLSPT

SEQ ID NO: 10289 - protein, 9 aa, Homo Sapiens
VTHRFMVWN

SEQ ID NO: 10290 - protein, 9 aa, Homo Sapiens
CTQRVQREV

SEQ ID NO: 10291 - protein, 9 aa, Homo Sapiens
ANTTDGCHE

SEQ ID NO: 10292 - protein, 9 aa, Homo Sapiens
PHLESSYFT

SEQ ID NO: 10293 - protein, 9 aa, Homo Sapiens
HKSKNILFV

SEQ ID NO: 10294 - protein, 9 aa, Homo Sapiens
VVLEARTIQ

SEQ ID NO: 10295 - protein, 9 aa, Homo Sapiens
KASDADDPT

SEQ ID NO: 10296 - protein, 9 aa, Homo Sapiens
WGQLGDPTQ

SEQ ID NO: 10297 - protein, 9 aa, Homo Sapiens
RTSVQPWDV

SEQ ID NO: 10298 - protein, 9 aa, Homo Sapiens
QEVGMTTIQ

SEQ ID NO: 10299 - protein, 9 aa, Homo Sapiens
SEPEGVRKA

SEQ ID NO: 10300 - protein, 9 aa, Homo Sapiens
CRTPVQLLS

SEQ ID NO: 10301 - protein, 9 aa, Homo Sapiens
KHRRTYAGL

SEQ ID NO: 10302 - protein, 9 aa, Homo Sapiens
YDGDSPSAF

SEQ ID NO: 10303 - protein, 9 aa, Homo Sapiens
KKTNDGNIL

SEQ ID NO: 10304 - protein, 9 aa, Homo Sapiens
HIYLPTKLF

SEQ ID NO: 10305 - protein, 9 aa, Homo Sapiens
KEKKQASTS

SEQ ID NO: 10306 - protein, 9 aa, Homo Sapiens
EQDLAKVIE

SEQ ID NO: 10307 - protein, 9 aa, Homo Sapiens
LPVQATDRG

SEQ ID NO: 10308 - protein, 9 aa, Homo Sapiens
QAGYKKKLW

SEQ ID NO: 10309 - protein, 9 aa, Homo Sapiens
HSTHPHFVR

SEQ ID NO: 10310 - protein, 9 aa, Homo Sapiens
LFVVIMYQC

SEQ ID NO: 10311 - protein, 9 aa, Homo Sapiens
KEHYKYTVV

SEQ ID NO: 10312 - protein, 9 aa, Homo Sapiens
DNMVSLFYS

SEQ ID NO: 10313 - protein, 9 aa, Homo Sapiens
NNFDPVQIE

SEQ ID NO: 10314 - protein, 9 aa, Homo Sapiens
QCVSPSCTS

SEQ ID NO: 10315 - protein, 9 aa, Homo Sapiens
NWTQMHNAG

SEQ ID NO: 10316 - protein, 9 aa, Homo Sapiens
SPRSPSSKG

SEQ ID NO: 10317 - protein, 9 aa, Homo Sapiens
FRHSVVVPC

SEQ ID NO: 10318 - protein, 9 aa, Homo Sapiens
DSCTFMKKF

SEQ ID NO: 10319 - protein, 9 aa, Homo Sapiens
RAQEKDSTS

SEQ ID NO: 10320 - protein, 9 aa, Homo Sapiens
VDVSQISRA

SEQ ID NO: 10321 - protein, 9 aa, Homo Sapiens
SAGGPPGRS

SEQ ID NO: 10322 - protein, 9 aa, Homo Sapiens
KYALQDQNN

SEQ ID NO: 10323 - protein, 9 aa, Homo Sapiens
EGVRKALRR

SEQ ID NO: 10324 - protein, 9 aa, Homo Sapiens
SLVVSPQVY

SEQ ID NO: 10325 - protein, 9 aa, Homo Sapiens
WGAKVPKEE

SEQ ID NO: 10326 - protein, 9 aa, Homo Sapiens
MVSLFYSLV

SEQ ID NO: 10327 - protein, 9 aa, Homo Sapiens
DVLKVTPQE

SEQ ID NO: 10328 - protein, 9 aa, Homo Sapiens
YVQCCRTQE

SEQ ID NO: 10329 - protein, 9 aa, Homo Sapiens
VKASDADDP

SEQ ID NO: 10330 - protein, 9 aa, Homo Sapiens
TEETIKEKE

SEQ ID NO: 10331 - protein, 9 aa, Homo Sapiens
KIQNSNMPI

SEQ ID NO: 10332 - protein, 9 aa, Homo Sapiens
KYIPLSLNV

SEQ ID NO: 10333 - protein, 9 aa, Homo Sapiens
PPPSPRLRC

SEQ ID NO: 10334 - protein, 9 aa, Homo Sapiens
EKKQASTSH

SEQ ID NO: 10335 - protein, 9 aa, Homo Sapiens
INRERWGAK

SEQ ID NO: 10336 - protein, 9 aa, Homo Sapiens
DPTQDSNWT

SEQ ID NO: 10337 - protein, 9 aa, Homo Sapiens
VPPGVQIKE

SEQ ID NO: 10338 - protein, 9 aa, Homo Sapiens
IDCSYVQCC

SEQ ID NO: 10339 - protein, 9 aa, Homo Sapiens
RLKFLIKNK

SEQ ID NO: 10340 - protein, 9 aa, Homo Sapiens
RQAGYKKKL

SEQ ID NO: 10341 - protein, 9 aa, Homo Sapiens
PFLKLAKTL

SEQ ID NO: 10342 - protein, 9 aa, Homo Sapiens
VQIKEEPVS

SEQ ID NO: 10343 - protein, 9 aa, Homo Sapiens
DGLTLNWTQ

SEQ ID NO: 10344 - protein, 9 aa, Homo Sapiens
RCIMESYFR

SEQ ID NO: 10345 - protein, 9 aa, Homo Sapiens
MPIECIRHF

SEQ ID NO: 10346 - protein, 9 aa, Homo Sapiens
AQKVYERAV

SEQ ID NO: 10347 - protein, 9 aa, Homo Sapiens
DAKKWQTYR

SEQ ID NO: 10348 - protein, 9 aa, Homo Sapiens
NLGNLAARP

SEQ ID NO: 10349 - protein, 9 aa, Homo Sapiens
FKVPKISMP

SEQ ID NO: 10350 - protein, 9 aa, Homo Sapiens
EKKECNTIL

SEQ ID NO: 10351 - protein, 9 aa, Homo Sapiens
FSGIGGLGQ

SEQ ID NO: 10352 - protein, 9 aa, Homo Sapiens
SSKGPSLHR

SEQ ID NO: 10353 - protein, 9 aa, Homo Sapiens
QMRTTQLGP

SEQ ID NO: 10354 - protein, 9 aa, Homo Sapiens
PVQATDRGS

SEQ ID NO: 10355 - protein, 9 aa, Homo Sapiens
RDRTSVQPW

SEQ ID NO: 10356 - protein, 9 aa, Homo Sapiens
SRPAQLWRW

SEQ ID NO: 10357 - protein, 9 aa, Homo Sapiens
DVSQISRAS

SEQ ID NO: 10358 - protein, 9 aa, Homo Sapiens
SPSSACAAA

SEQ ID NO: 10359 - protein, 9 aa, Homo Sapiens
DFQQEGSEE

SEQ ID NO: 10360 - protein, 9 aa, Homo Sapiens
GFVIIQGSP

SEQ ID NO: 10361 - protein, 9 aa, Homo Sapiens
VICKGFVED

SEQ ID NO: 10362 - protein, 9 aa, Homo Sapiens
PAVPPGVQI

SEQ ID NO: 10363 - protein, 9 aa, Homo Sapiens
MHLQLEAVP

SEQ ID NO: 10364 - protein, 9 aa, Homo Sapiens
KTDAEERPY

SEQ ID NO: 10365 - protein, 9 aa, Homo Sapiens
WLKYIPLSL

SEQ ID NO: 10366 - protein, 9 aa, Homo Sapiens
HDEKCLKKE

SEQ ID NO: 10367 - protein, 9 aa, Homo Sapiens
CMHLQLEAV

SEQ ID NO: 10368 - protein, 9 aa, Homo Sapiens
NSGSHAKTR

SEQ ID NO: 10369 - protein, 9 aa, Homo Sapiens
CPESCVDTT

SEQ ID NO: 10370 - protein, 9 aa, Homo Sapiens
YIPLSLNVR

SEQ ID NO: 10371 - protein, 9 aa, Homo Sapiens
EPEGVRKAL

SEQ ID NO: 10372 - protein, 9 aa, Homo Sapiens
PIECIRHFF

SEQ ID NO: 10373 - protein, 9 aa, Homo Sapiens
AKTLSSLTP

SEQ ID NO: 10374 - protein, 9 aa, Homo Sapiens
TLSSLTPLI

SEQ ID NO: 10375 - protein, 9 aa, Homo Sapiens
NCRQQMRTT

SEQ ID NO: 10376 - protein, 9 aa, Homo Sapiens
GQLGDPTQD

SEQ ID NO: 10377 - protein, 9 aa, Homo Sapiens
LKQAASTVS

SEQ ID NO: 10378 - protein, 9 aa, Homo Sapiens
HIYLPVQQP

SEQ ID NO: 10379 - protein, 9 aa, Homo Sapiens
GYWVEKKEC

SEQ ID NO: 10380 - protein, 9 aa, Homo Sapiens
TFMKKFFVT

SEQ ID NO: 10381 - protein, 9 aa, Homo Sapiens
DQEASKNHV

SEQ ID NO: 10382 - protein, 9 aa, Homo Sapiens
MGYDLYVAI

SEQ ID NO: 10383 - protein, 9 aa, Homo Sapiens
QLLESSSEA

SEQ ID NO: 10384 - protein, 9 aa, Homo Sapiens
CVSPSCTSS

SEQ ID NO: 10385 - protein, 9 aa, Homo Sapiens
TLKEHYKYT

SEQ ID NO: 10386 - protein, 9 aa, Homo Sapiens
DRRAIVESI

SEQ ID NO: 10387 - protein, 9 aa, Homo Sapiens
SCTFMKKFF

SEQ ID NO: 10388 - protein, 9 aa, Homo Sapiens
IPEILLLTM

SEQ ID NO: 10389 - protein, 9 aa, Homo Sapiens
KTLSSLTPL

SEQ ID NO: 10390 - protein, 9 aa, Homo Sapiens
VSPQSSLET

SEQ ID NO: 10391 - protein, 9 aa, Homo Sapiens
SSLETKESK

SEQ ID NO: 10392 - protein, 9 aa, Homo Sapiens
FCRPGPKGQ

SEQ ID NO: 10393 - protein, 9 aa, Homo Sapiens
RQQMRTTQL

SEQ ID NO: 10394 - protein, 9 aa, Homo Sapiens
SCSFPHNFV

SEQ ID NO: 10395 - protein, 9 aa, Homo Sapiens
PGFVIIQGS

SEQ ID NO: 10396 - protein, 9 aa, Homo Sapiens
AKKWQTYRG

SEQ ID NO: 10397 - protein, 9 aa, Homo Sapiens
KERLYGLLQ

SEQ ID NO: 10398 - protein, 9 aa, Homo Sapiens
QNSNMPIEC

SEQ ID NO: 10399 - protein, 9 aa, Homo Sapiens
ERLYGLLQA

SEQ ID NO: 10400 - protein, 9 aa, Homo Sapiens
QFFQWIFFK

SEQ ID NO: 10401 - protein, 9 aa, Homo Sapiens
SLCQRARDD

SEQ ID NO: 10402 - protein, 9 aa, Homo Sapiens
STVSLRVLN

SEQ ID NO: 10403 - protein, 9 aa, Homo Sapiens
RGGHMNSGS

SEQ ID NO: 10404 - protein, 9 aa, Homo Sapiens
CKSLCQRAR

SEQ ID NO: 10405 - protein, 9 aa, Homo Sapiens
KHQKTDAEE

SEQ ID NO: 10406 - protein, 9 aa, Homo Sapiens
NRERWGAKV

SEQ ID NO: 10407 - protein, 9 aa, Homo Sapiens
CGLWVRRQA

SEQ ID NO: 10408 - protein, 9 aa, Homo Sapiens
KKAIFTEET

SEQ ID NO: 10409 - protein, 9 aa, Homo Sapiens
MHFKVPKIS

SEQ ID NO: 10410 - protein, 9 aa, Homo Sapiens
CFKGGKYMQ

SEQ ID NO: 10411 - protein, 9 aa, Homo Sapiens
LKEHYKYTV

SEQ ID NO: 10412 - protein, 9 aa, Homo Sapiens
GFDQYRALQ

SEQ ID NO: 10413 - protein, 9 aa, Homo Sapiens
VTEKVRCIM

SEQ ID NO: 10414 - protein, 9 aa, Homo Sapiens
SGIGGLGQL

SEQ ID NO: 10415 - protein, 9 aa, Homo Sapiens
YALQDQNNF

SEQ ID NO: 10416 - protein, 9 aa, Homo Sapiens
SSAIAPKTV

SEQ ID NO: 10417 - protein, 9 aa, Homo Sapiens
ADVSVRGER

SEQ ID NO: 10418 - protein, 9 aa, Homo Sapiens
LDKHQKTDA

SEQ ID NO: 10419 - protein, 9 aa, Homo Sapiens
QQEGSEELD

SEQ ID NO: 10420 - protein, 9 aa, Homo Sapiens
EKCLKKEQI

SEQ ID NO: 10421 - protein, 9 aa, Homo Sapiens
KVRCIMESY

SEQ ID NO: 10422 - protein, 9 aa, Homo Sapiens
AIAPKTVAA

SEQ ID NO: 10423 - protein, 9 aa, Homo Sapiens
DPQKEFIEF

SEQ ID NO: 10424 - protein, 9 aa, Homo Sapiens
STSKIGQTN

SEQ ID NO: 10425 - protein, 9 aa, Homo Sapiens
EPGFVIIQG

SEQ ID NO: 10426 - protein, 9 aa, Homo Sapiens
ALQEQFRRE

SEQ ID NO: 10427 - protein, 9 aa, Homo Sapiens
LWAEPGFVI

SEQ ID NO: 10428 - protein, 9 aa, Homo Sapiens
FSDGLTLNW

SEQ ID NO: 10429 - protein, 9 aa, Homo Sapiens
GTVCFKGGK

SEQ ID NO: 10430 - protein, 9 aa, Homo Sapiens
YDFQQEGSE

SEQ ID NO: 10431 - protein, 9 aa, Homo Sapiens
RLYGLLQAY

SEQ ID NO: 10432 - protein, 9 aa, Homo Sapiens
RVPRCGSAY

SEQ ID NO: 10433 - protein, 9 aa, Homo Sapiens
EFEVSPQSS

SEQ ID NO: 10434 - protein, 9 aa, Homo Sapiens
LIAVMGYDL

SEQ ID NO: 10435 - protein, 9 aa, Homo Sapiens
CRCQFPSKE

SEQ ID NO: 10436 - protein, 9 aa, Homo Sapiens
QACFLSRDR

SEQ ID NO: 10437 - protein, 9 aa, Homo Sapiens
LPPTKLNGV

SEQ ID NO: 10438 - protein, 9 aa, Homo Sapiens
DITWHKDRR

SEQ ID NO: 10439 - protein, 9 aa, Homo Sapiens
NPTAAPITL

SEQ ID NO: 10440 - protein, 9 aa, Homo Sapiens
QKGQGSVKV

SEQ ID NO: 10441 - protein, 9 aa, Homo Sapiens
QKTDAEERP

SEQ ID NO: 10442 - protein, 9 aa, Homo Sapiens
CGECHPLLL

SEQ ID NO: 10443 - protein, 9 aa, Homo Sapiens
IDRVYTLQA

SEQ ID NO: 10444 - protein, 9 aa, Homo Sapiens
YTLKEHYKY

SEQ ID NO: 10445 - protein, 9 aa, Homo Sapiens
SAIAPKTVA

SEQ ID NO: 10446 - protein, 9 aa, Homo Sapiens
LVRRAQKRL

SEQ ID NO: 10447 - protein, 9 aa, Homo Sapiens
LNGVIRKYT

SEQ ID NO: 10448 - protein, 9 aa, Homo Sapiens
KGQLAATAL

SEQ ID NO: 10449 - protein, 9 aa, Homo Sapiens
MYQCVSPSC

SEQ ID NO: 10450 - protein, 9 aa, Homo Sapiens
GECHPLLLE

SEQ ID NO: 10451 - protein, 9 aa, Homo Sapiens
NVTEKVRCI

SEQ ID NO: 10452 - protein, 9 aa, Homo Sapiens
PDITWHKDR

SEQ ID NO: 10453 - protein, 9 aa, Homo Sapiens
RCGSAYLYS

SEQ ID NO: 10454 - protein, 9 aa, Homo Sapiens
QDSRVLVGQ

SEQ ID NO: 10455 - protein, 9 aa, Homo Sapiens
ERAQEKDST

SEQ ID NO: 10456 - protein, 9 aa, Homo Sapiens
RHSVVVPCE

SEQ ID NO: 10457 - protein, 9 aa, Homo Sapiens
FEVSPQSSL

SEQ ID NO: 10458 - protein, 9 aa, Homo Sapiens
MVICKGFVE

SEQ ID NO: 10459 - protein, 9 aa, Homo Sapiens
HQKTDAEER

SEQ ID NO: 10460 - protein, 9 aa, Homo Sapiens
KVTPQEYAG

SEQ ID NO: 10461 - protein, 9 aa, Homo Sapiens
AEVKENRNL

SEQ ID NO: 10462 - protein, 9 aa, Homo Sapiens
RERAQEKDS

SEQ ID NO: 10463 - protein, 9 aa, Homo Sapiens
GQGSVKVID

SEQ ID NO: 10464 - protein, 9 aa, Homo Sapiens
LQAESINER

SEQ ID NO: 10465 - protein, 9 aa, Homo Sapiens
VRKALRRAF

SEQ ID NO: 10466 - protein, 9 aa, Homo Sapiens
PSPRLRCRT

SEQ ID NO: 10467 - protein, 9 aa, Homo Sapiens
TMGGPAIYM

SEQ ID NO: 10468 - protein, 9 aa, Homo Sapiens
PTKLNGVIR

SEQ ID NO: 10469 - protein, 9 aa, Homo Sapiens
LMTNLHSTH

SEQ ID NO: 10470 - protein, 9 aa, Homo Sapiens
GSHAKTRPA

SEQ ID NO: 10471 - protein, 9 aa, Homo Sapiens
IAVMGYDLY

SEQ ID NO: 10472 - protein, 9 aa, Homo Sapiens
PGVQIKEEP

SEQ ID NO: 10473 - protein, 9 aa, Homo Sapiens
YQCVSPSCT

SEQ ID NO: 10474 - protein, 9 aa, Homo Sapiens
RERWGAKVP

SEQ ID NO: 10475 - protein, 9 aa, Homo Sapiens
YWVEKKECN

SEQ ID NO: 10476 - protein, 9 aa, Homo Sapiens
KCNCRQQMR

SEQ ID NO: 10477 - protein, 9 aa, Homo Sapiens
WLPPTKLNG

SEQ ID NO: 10478 - protein, 9 aa, Homo Sapiens
QPSSPSSAC

SEQ ID NO: 10479 - protein, 9 aa, Homo Sapiens
PSEPEGVRK

SEQ ID NO: 10480 - protein, 9 aa, Homo Sapiens
TPQEYAGQI

SEQ ID NO: 10481 - protein, 9 aa, Homo Sapiens
DHGADVSVR

SEQ ID NO: 10482 - protein, 9 aa, Homo Sapiens
YSLDAKKWQ

SEQ ID NO: 10483 - protein, 9 aa, Homo Sapiens
SSACAAADS

SEQ ID NO: 10484 - protein, 9 aa, Homo Sapiens
VHINRERWG

SEQ ID NO: 10485 - protein, 9 aa, Homo Sapiens
AMSSATSSV

SEQ ID NO: 10486 - protein, 9 aa, Homo Sapiens
DVSVRGERG

SEQ ID NO: 10487 - protein, 9 aa, Homo Sapiens
MKKFFVTSC

SEQ ID NO: 10488 - protein, 9 aa, Homo Sapiens
GLGQLLESS

SEQ ID NO: 10489 - protein, 9 aa, Homo Sapiens
SGNNPTAAP

SEQ ID NO: 10490 - protein, 9 aa, Homo Sapiens
KKQASTSHC

SEQ ID NO: 10491 - protein, 9 aa, Homo Sapiens
IHDEKCLKK

SEQ ID NO: 10492 - protein, 9 aa, Homo Sapiens
DMVICKGFV

SEQ ID NO: 10493 - protein, 9 aa, Homo Sapiens
SQPSSPSSA

SEQ ID NO: 10494 - protein, 9 aa, Homo Sapiens
VYTLQAESI

SEQ ID NO: 10495 - protein, 9 aa, Homo Sapiens
TLNWTQMHN

SEQ ID NO: 10496 - protein, 9 aa, Homo Sapiens
QEKVPESPQ

SEQ ID NO: 10497 - protein, 9 aa, Homo Sapiens
DAEERPYKC

SEQ ID NO: 10498 - protein, 9 aa, Homo Sapiens
PVQQPESEE

SEQ ID NO: 10499 - protein, 9 aa, Homo Sapiens
CRQQMRTTQ

SEQ ID NO: 10500 - protein, 9 aa, Homo Sapiens
FPVPKHDSH

SEQ ID NO: 10501 - protein, 9 aa, Homo Sapiens
IVKEKGTVC

SEQ ID NO: 10502 - protein, 9 aa, Homo Sapiens
YMASPMSIP

SEQ ID NO: 10503 - protein, 9 aa, Homo Sapiens
NNESSDEIS

SEQ ID NO: 10504 - protein, 9 aa, Homo Sapiens
LQDQNNFDP

SEQ ID NO: 10505 - protein, 9 aa, Homo Sapiens
HDSHRVITF

SEQ ID NO: 10506 - protein, 9 aa, Homo Sapiens
YLPVQQPES

SEQ ID NO: 10507 - protein, 9 aa, Homo Sapiens
AHAQKVYER

SEQ ID NO: 10508 - protein, 9 aa, Homo Sapiens
VVPCEPPEV

SEQ ID NO: 10509 - protein, 9 aa, Homo Sapiens
GIDCSYVQC

SEQ ID NO: 10510 - protein, 9 aa, Homo Sapiens
ENRYKAITF

SEQ ID NO: 10511 - protein, 9 aa, Homo Sapiens
LLCRCQFPS

SEQ ID NO: 10512 - protein, 9 aa, Homo Sapiens
YQKGQGSVK

SEQ ID NO: 10513 - protein, 9 aa, Homo Sapiens
AFKQSLTLT

SEQ ID NO: 10514 - protein, 9 aa, Homo Sapiens
GHMNSGSHA

SEQ ID NO: 10515 - protein, 9 aa, Homo Sapiens
GPSCSFPHN

SEQ ID NO: 10516 - protein, 9 aa, Homo Sapiens
LRLKFLIKN

SEQ ID NO: 10517 - protein, 9 aa, Homo Sapiens
LLQAYLRQN

SEQ ID NO: 10518 - protein, 9 aa, Homo Sapiens
QGAHREVVD

SEQ ID NO: 10519 - protein, 9 aa, Homo Sapiens
KKECNTILW

SEQ ID NO: 10520 - protein, 9 aa, Homo Sapiens
PPTKLNGVI

SEQ ID NO: 10521 - protein, 9 aa, Homo Sapiens
QKEFIEFLM

SEQ ID NO: 10522 - protein, 9 aa, Homo Sapiens
LQACGECHP

SEQ ID NO: 10523 - protein, 9 aa, Homo Sapiens
KGPSLHRLG

SEQ ID NO: 10524 - protein, 9 aa, Homo Sapiens
QEYAGQITL

SEQ ID NO: 10525 - protein, 9 aa, Homo Sapiens
LKVTPQEYA

SEQ ID NO: 10526 - protein, 9 aa, Homo Sapiens
VGQEVGMTT

SEQ ID NO: 10527 - protein, 9 aa, Homo Sapiens
NMPIECIRH

SEQ ID NO: 10528 - protein, 9 aa, Homo Sapiens
LHVQNVHIY

SEQ ID NO: 10529 - protein, 9 aa, Homo Sapiens
FMKKFFVTS

SEQ ID NO: 10530 - protein, 9 aa, Homo Sapiens
QGWGQLGDP

SEQ ID NO: 10531 - protein, 9 aa, Homo Sapiens
KESTYYMEG

SEQ ID NO: 10532 - protein, 9 aa, Homo Sapiens
SLDAKKWQT

SEQ ID NO: 10533 - protein, 9 aa, Homo Sapiens
WTQMHNAGF

SEQ ID NO: 10534 - protein, 9 aa, Homo Sapiens
FKESTYYME

SEQ ID NO: 10535 - protein, 9 aa, Homo Sapiens
MGGPAIYMA

SEQ ID NO: 10536 - protein, 9 aa, Homo Sapiens
VQRSIETGR

SEQ ID NO: 10537 - protein, 9 aa, Homo Sapiens
VLVGQEVGM

SEQ ID NO: 10538 - protein, 9 aa, Homo Sapiens
LLTVYDFQQ

SEQ ID NO: 10539 - protein, 9 aa, Homo Sapiens
LLDHGADVS

SEQ ID NO: 10540 - protein, 9 aa, Homo Sapiens
TVCFKGGKY

SEQ ID NO: 10541 - protein, 9 aa, Homo Sapiens
GSVKVIDFG

SEQ ID NO: 10542 - protein, 9 aa, Homo Sapiens
HSVVVPCEP

SEQ ID NO: 10543 - protein, 9 aa, Homo Sapiens
NRNLGNLAA

SEQ ID NO: 10544 - protein, 9 aa, Homo Sapiens
VYDFQQEGS

SEQ ID NO: 10545 - protein, 9 aa, Homo Sapiens
KQFFQWIFF

SEQ ID NO: 10546 - protein, 9 aa, Homo Sapiens
GKLVRRAQK

SEQ ID NO: 10547 - protein, 9 aa, Homo Sapiens
SRVLVGQEV

SEQ ID NO: 10548 - protein, 9 aa, Homo Sapiens
AVPPGVQIK

SEQ ID NO: 10549 - protein, 9 aa, Homo Sapiens
AIYMASPMS

SEQ ID NO: 10550 - protein, 9 aa, Homo Sapiens
WDPQKEFIE

SEQ ID NO: 10551 - protein, 9 aa, Homo Sapiens
HRQPAMPGS

SEQ ID NO: 10552 - protein, 9 aa, Homo Sapiens
TAGALQRIC

SEQ ID NO: 10553 - protein, 9 aa, Homo Sapiens
PQKEFIEFL

SEQ ID NO: 10554 - protein, 9 aa, Homo Sapiens
IYMASPMSI

SEQ ID NO: 10555 - protein, 9 aa, Homo Sapiens
IMYQCVSPS

SEQ ID NO: 10556 - protein, 9 aa, Homo Sapiens
FQQEGSEEL

SEQ ID NO: 10557 - protein, 9 aa, Homo Sapiens
PPSPRLRCR

SEQ ID NO: 10558 - protein, 9 aa, Homo Sapiens
NRYKAITFS

SEQ ID NO: 10559 - protein, 9 aa, Homo Sapiens
EFGARVPRC

SEQ ID NO: 10560 - protein, 9 aa, Homo Sapiens
VVVLDMVIC

SEQ ID NO: 10561 - protein, 9 aa, Homo Sapiens
PPGRSNGGP

SEQ ID NO: 10562 - protein, 9 aa, Homo Sapiens
IEFLMTNEE

SEQ ID NO: 10563 - protein, 9 aa, Homo Sapiens
GLPSSLVVS

SEQ ID NO: 10564 - protein, 9 aa, Homo Sapiens
ANKVVMAMS

SEQ ID NO: 10565 - protein, 9 aa, Homo Sapiens
TVSLRVLND

SEQ ID NO: 10566 - protein, 9 aa, Homo Sapiens
CLKKEQILT

SEQ ID NO: 10567 - protein, 9 aa, Homo Sapiens
VKENRNLGN

SEQ ID NO: 10568 - protein, 9 aa, Homo Sapiens
KQSLTLTTH

SEQ ID NO: 10569 - protein, 9 aa, Homo Sapiens
KQAASTVSL

SEQ ID NO: 10570 - protein, 9 aa, Homo Sapiens
TLQAESINE

SEQ ID NO: 10571 - protein, 9 aa, Homo Sapiens
LKFLIKNKM

SEQ ID NO: 10572 - protein, 9 aa, Homo Sapiens
AQKRLKEVV

SEQ ID NO: 10573 - protein, 9 aa, Homo Sapiens
FTEETIKEK

SEQ ID NO: 10574 - protein, 9 aa, Homo Sapiens
GPKGQLAAT

SEQ ID NO: 10575 - protein, 9 aa, Homo Sapiens
QDLAKVIEL

SEQ ID NO: 10576 - protein, 9 aa, Homo Sapiens
FLIKNKMQL

SEQ ID NO: 10577 - protein, 9 aa, Homo Sapiens
KSLCQRARD

SEQ ID NO: 10578 - protein, 9 aa, Homo Sapiens
KFLIKNKMQ

SEQ ID NO: 10579 - protein, 9 aa, Homo Sapiens
QQDNMVSLF

SEQ ID NO: 10580 - protein, 9 aa, Homo Sapiens
SSLVVSPQV

SEQ ID NO: 10581 - protein, 9 aa, Homo Sapiens
TWHKDRRAI

SEQ ID NO: 10582 - protein, 9 aa, Homo Sapiens
AFKERLYGL

SEQ ID NO: 10583 - protein, 9 aa, Homo Sapiens
SPQSSLETK

SEQ ID NO: 10584 - protein, 9 aa, Homo Sapiens
WAEPGFVII

SEQ ID NO: 10585 - protein, 9 aa, Homo Sapiens
PGPKGQLAA

SEQ ID NO: 10586 - protein, 9 aa, Homo Sapiens
TLGKKQKRN

SEQ ID NO: 10587 - protein, 9 aa, Homo Sapiens
SHRQPAMPG

SEQ ID NO: 10588 - protein, 9 aa, Homo Sapiens
VRRQAGYKK

SEQ ID NO: 10589 - protein, 9 aa, Homo Sapiens
RSIETGRSL

SEQ ID NO: 10590 - protein, 9 aa, Homo Sapiens
RCRTPVQLL

SEQ ID NO: 10591 - protein, 9 aa, Homo Sapiens
YHSPQQDNM

SEQ ID NO: 10592 - protein, 9 aa, Homo Sapiens
QKVYERAVE

SEQ ID NO: 10593 - protein, 9 aa, Homo Sapiens
GSLSHEQDL

SEQ ID NO: 10594 - protein, 9 aa, Homo Sapiens
EKTPTYHLP

SEQ ID NO: 10595 - protein, 9 aa, Homo Sapiens
GKKQKRNNE

SEQ ID NO: 10596 - protein, 9 aa, Homo Sapiens
IFFKEKKQA

SEQ ID NO: 10597 - protein, 9 aa, Homo Sapiens
HRRTYAGLR

SEQ ID NO: 10598 - protein, 9 aa, Homo Sapiens
KEKGTVCFK

SEQ ID NO: 10599 - protein, 9 aa, Homo Sapiens
ILFSPVGIL

SEQ ID NO: 10600 - protein, 9 aa, Homo Sapiens
METLPDTMT

SEQ ID NO: 10601 - protein, 9 aa, Homo Sapiens
ILLLTMNRN

SEQ ID NO: 10602 - protein, 9 aa, Homo Sapiens
FPHNFVLLV

SEQ ID NO: 10603 - protein, 9 aa, Homo Sapiens
GGPAIYMAS

SEQ ID NO: 10604 - protein, 9 aa, Homo Sapiens
PAQEKVPES

SEQ ID NO: 10605 - protein, 9 aa, Homo Sapiens
LIHDEKCLK

SEQ ID NO: 10606 - protein, 9 aa, Homo Sapiens
DTMTAGALQ

SEQ ID NO: 10607 - protein, 9 aa, Homo Sapiens
PPGVQIKEE

SEQ ID NO: 10608 - protein, 9 aa, Homo Sapiens
YGLLQAYLR

SEQ ID NO: 10609 - protein, 9 aa, Homo Sapiens
SWLPPTKLN

SEQ ID NO: 10610 - protein, 9 aa, Homo Sapiens
KALRRAFLS

SEQ ID NO: 10611 - protein, 9 aa, Homo Sapiens
HPLLLEARA

SEQ ID NO: 10612 - protein, 9 aa, Homo Sapiens
IKPCKSLCQ

SEQ ID NO: 10613 - protein, 9 aa, Homo Sapiens
RWGAKVPKE

SEQ ID NO: 10614 - protein, 9 aa, Homo Sapiens
RKKAIFTEE

SEQ ID NO: 10615 - protein, 9 aa, Homo Sapiens
SQISRASLW

SEQ ID NO: 10616 - protein, 9 aa, Homo Sapiens
DMHFKVPKI

SEQ ID NO: 10617 - protein, 9 aa, Homo Sapiens
TVRCMHLQL

SEQ ID NO: 10618 - protein, 9 aa, Homo Sapiens
EVSPQSSLE

SEQ ID NO: 10619 - protein, 9 aa, Homo Sapiens
SLETKESKS

SEQ ID NO: 10620 - protein, 9 aa, Homo Sapiens
KKQKRNNES

SEQ ID NO: 10621 - protein, 9 aa, Homo Sapiens
EHIYLPVQQ

SEQ ID NO: 10622 - protein, 9 aa, Homo Sapiens
VVVPCEPPE

SEQ ID NO: 10623 - protein, 9 aa, Homo Sapiens
DPIKPCKSL

SEQ ID NO: 10624 - protein, 9 aa, Homo Sapiens
GYDLYVAIC

SEQ ID NO: 10625 - protein, 9 aa, Homo Sapiens
LNKLMTNLH

SEQ ID NO: 10626 - protein, 9 aa, Homo Sapiens
AYFAHAQKV

SEQ ID NO: 10627 - protein, 9 aa, Homo Sapiens
VVLDMVICK

SEQ ID NO: 10628 - protein, 9 aa, Homo Sapiens
KLNGVIRKY

SEQ ID NO: 10629 - protein, 9 aa, Homo Sapiens
QRSIETGRS

SEQ ID NO: 10630 - protein, 9 aa, Homo Sapiens
SLTLTTHKR

SEQ ID NO: 10631 - protein, 9 aa, Homo Sapiens
YLRLKFLIK

SEQ ID NO: 10632 - protein, 9 aa, Homo Sapiens
KAFKQSLTL

SEQ ID NO: 10633 - protein, 9 aa, Homo Sapiens
TLPDTMTAG

SEQ ID NO: 10634 - protein, 9 aa, Homo Sapiens
LQLEAVPAV

SEQ ID NO: 10635 - protein, 9 aa, Homo Sapiens
RNNESSDEI

SEQ ID NO: 10636 - protein, 9 aa, Homo Sapiens
EWLKYIPLS

SEQ ID NO: 10637 - protein, 9 aa, Homo Sapiens
SPSSKGPSL

SEQ ID NO: 10638 - protein, 9 aa, Homo Sapiens
DGSLSHEQD

SEQ ID NO: 10639 - protein, 9 aa, Homo Sapiens
IPLSLNVRG

SEQ ID NO: 10640 - protein, 9 aa, Homo Sapiens
LLLTMNRNP

SEQ ID NO: 10641 - protein, 9 aa, Homo Sapiens
ENRNLGNLA

SEQ ID NO: 10642 - protein, 9 aa, Homo Sapiens
GLLLLLLVT

SEQ ID NO: 10643 - protein, 9 aa, Homo Sapiens
IPRVGDFKE

SEQ ID NO: 10644 - protein, 9 aa, Homo Sapiens
GDFKESTYY

SEQ ID NO: 10645 - protein, 9 aa, Homo Sapiens
ERWGAKVPK

SEQ ID NO: 10646 - protein, 9 aa, Homo Sapiens
PAAPGPSEQ

SEQ ID NO: 10647 - protein, 9 aa, Homo Sapiens
SSRPAQLWR

SEQ ID NO: 10648 - protein, 9 aa, Homo Sapiens
RVYTLQAES

SEQ ID NO: 10649 - protein, 9 aa, Homo Sapiens
MNKAEMGRF

SEQ ID NO: 10650 - protein, 9 aa, Homo Sapiens
SHAKTRPAC

SEQ ID NO: 10651 - protein, 9 aa, Homo Sapiens
PSSPSSACA

SEQ ID NO: 10652 - protein, 9 aa, Homo Sapiens
QKRNNESSD

SEQ ID NO: 10653 - protein, 9 aa, Homo Sapiens
PDTMTAGAL

SEQ ID NO: 10654 - protein, 9 aa, Homo Sapiens
RQPAMPGSS

SEQ ID NO: 10655 - protein, 9 aa, Homo Sapiens
LKTLHMDFE

SEQ ID NO: 10656 - protein, 9 aa, Homo Sapiens
VVMAMSSAT

SEQ ID NO: 10657 - protein, 9 aa, Homo Sapiens
HIDRVYTLQ

SEQ ID NO: 10658 - protein, 9 aa, Homo Sapiens
NVRENRYKA

SEQ ID NO: 10659 - protein, 9 aa, Homo Sapiens
PAIYMASPM

SEQ ID NO: 10660 - protein, 9 aa, Homo Sapiens
PYTLKEHYK

SEQ ID NO: 10661 - protein, 9 aa, Homo Sapiens
CIMESYFRL

SEQ ID NO: 10662 - protein, 9 aa, Homo Sapiens
YHLPVQATD

SEQ ID NO: 10663 - protein, 9 aa, Homo Sapiens
SRDRTSVQP

SEQ ID NO: 10664 - protein, 9 aa, Homo Sapiens
DGQHPAQEK

SEQ ID NO: 10665 - protein, 9 aa, Homo Sapiens
VCFKGGKYM

SEQ ID NO: 10666 - protein, 9 aa, Homo Sapiens
TSVMQVKAS

SEQ ID NO: 10667 - protein, 9 aa, Homo Sapiens
GYSSAIAPK

SEQ ID NO: 10668 - protein, 9 aa, Homo Sapiens
FLKLAKTLS

SEQ ID NO: 10669 - protein, 9 aa, Homo Sapiens
PKGQLAATA

SEQ ID NO: 10670 - protein, 9 aa, Homo Sapiens
KTPTYHLPV

SEQ ID NO: 10671 - protein, 9 aa, Homo Sapiens
FKEKKQAST

SEQ ID NO: 10672 - protein, 9 aa, Homo Sapiens
NSNMPIECI

SEQ ID NO: 10673 - protein, 9 aa, Homo Sapiens
FVIIQGSPV

SEQ ID NO: 10674 - protein, 9 aa, Homo Sapiens
LPDTMTAGA

SEQ ID NO: 10675 - protein, 9 aa, Homo Sapiens
HFKVPKISM

SEQ ID NO: 10676 - protein, 9 aa, Homo Sapiens
YKAITFSAN

SEQ ID NO: 10677 - protein, 9 aa, Homo Sapiens
CNCRQQMRT

SEQ ID NO: 10678 - protein, 9 aa, Homo Sapiens
GGLGQLLES

SEQ ID NO: 10679 - protein, 9 aa, Homo Sapiens
MAMSSATSS

SEQ ID NO: 10680 - protein, 9 aa, Homo Sapiens
LPSSLVVSP

SEQ ID NO: 10681 - protein, 9 aa, Homo Sapiens
TDQEFQNLK

SEQ ID NO: 10682 - protein, 9 aa, Homo Sapiens
VRCMHLQLE

SEQ ID NO: 10683 - protein, 9 aa, Homo Sapiens
HVQNVHIYL

SEQ ID NO: 10684 - protein, 9 aa, Homo Sapiens
FQNLKTLHM

SEQ ID NO: 10685 - protein, 9 aa, Homo Sapiens
WIFFKEKKQ

SEQ ID NO: 10686 - protein, 9 aa, Homo Sapiens
LAKTLSSLT

SEQ ID NO: 10687 - protein, 9 aa, Homo Sapiens
KTNDGNILF

SEQ ID NO: 10688 - protein, 9 aa, Homo Sapiens
RTYAGLRPY

SEQ ID NO: 10689 - protein, 9 aa, Homo Sapiens
VVQRSIETG

SEQ ID NO: 10690 - protein, 9 aa, Homo Sapiens
SPQQDNMVS

SEQ ID NO: 10691 - protein, 9 aa, Homo Sapiens
CGSAYLYSY

SEQ ID NO: 10692 - protein, 9 aa, Homo Sapiens
PGLPSSLVV

SEQ ID NO: 10693 - protein, 9 aa, Homo Sapiens
MTAGALQRI

SEQ ID NO: 10694 - protein, 9 aa, Homo Sapiens
MNRNPEKSQ

SEQ ID NO: 10695 - protein, 9 aa, Homo Sapiens
KRNNESSDE

SEQ ID NO: 10696 - protein, 9 aa, Homo Sapiens
TMNRNPEKS

SEQ ID NO: 10697 - protein, 9 aa, Homo Sapiens
KCLKKEQIL

SEQ ID NO: 10698 - protein, 9 aa, Homo Sapiens
TVVVLDMVI

SEQ ID NO: 10699 - protein, 9 aa, Homo Sapiens
PGRSNGGPR

SEQ ID NO: 10700 - protein, 9 aa, Homo Sapiens
NKVVMAMSS

SEQ ID NO: 10701 - protein, 9 aa, Homo Sapiens
GTSVMQVKA

SEQ ID NO: 10702 - protein, 9 aa, Homo Sapiens
LCQRARDDC

SEQ ID NO: 10703 - protein, 9 aa, Homo Sapiens
PRCGSAYLY

SEQ ID NO: 10704 - protein, 9 aa, Homo Sapiens
VLDMVICKG

SEQ ID NO: 10705 - protein, 9 aa, Homo Sapiens
SEQPSQELP

SEQ ID NO: 10706 - protein, 9 aa, Homo Sapiens
YSHRQPAMP

SEQ ID NO: 10707 - protein, 9 aa, Homo Sapiens
RCQFPSKEA

SEQ ID NO: 10708 - protein, 9 aa, Homo Sapiens
ICKGFVEDL

SEQ ID NO: 10709 - protein, 9 aa, Homo Sapiens
RVGDFKEST

SEQ ID NO: 10710 - protein, 9 aa, Homo Sapiens
HEQDLAKVI

SEQ ID NO: 10711 - protein, 9 aa, Homo Sapiens
CTFMKKFFV

SEQ ID NO: 10712 - protein, 9 aa, Homo Sapiens
DRTSVQPWD

SEQ ID NO: 10713 - protein, 9 aa, Homo Sapiens
TTVRCMHLQ

SEQ ID NO: 10714 - protein, 9 aa, Homo Sapiens
PFCRPGPKG

SEQ ID NO: 10715 - protein, 9 aa, Homo Sapiens
VQNVHIYLP

SEQ ID NO: 10716 - protein, 9 aa, Homo Sapiens
SGIDCSYVQ

SEQ ID NO: 10717 - protein, 9 aa, Homo Sapiens
LDMVICKGF

SEQ ID NO: 10718 - protein, 9 aa, Homo Sapiens
KLMTNLHST

SEQ ID NO: 10719 - protein, 9 aa, Homo Sapiens
SKNHVAATG

SEQ ID NO: 10720 - protein, 9 aa, Homo Sapiens
YLFPVPKHD

SEQ ID NO: 10721 - protein, 9 aa, Homo Sapiens
QNNFDPVQI

SEQ ID NO: 10722 - protein, 9 aa, Homo Sapiens
DSPSAFQLG

SEQ ID NO: 10723 - protein, 9 aa, Homo Sapiens
RRTYAGLRP

SEQ ID NO: 10724 - protein, 9 aa, Homo Sapiens
GPSLHRLGK

SEQ ID NO: 10725 - protein, 9 aa, Homo Sapiens
MPDMHFKVP

SEQ ID NO: 10726 - protein, 9 aa, Homo Sapiens
RITDQEASK

SEQ ID NO: 10727 - protein, 9 aa, Homo Sapiens
AHREVVDPS

SEQ ID NO: 10728 - protein, 9 aa, Homo Sapiens
PCKSLCQRA

SEQ ID NO: 10729 - protein, 9 aa, Homo Sapiens
LTVYDFQQE

SEQ ID NO: 10730 - protein, 9 aa, Homo Sapiens
VTPQEYAGQ

SEQ ID NO: 10731 - protein, 9 aa, Homo Sapiens
AQEKDSTSK

SEQ ID NO: 10732 - protein, 9 aa, Homo Sapiens
VPKHDSHRV

SEQ ID NO: 10733 - protein, 9 aa, Homo Sapiens
ASQPSSPSS

SEQ ID NO: 10734 - protein, 9 aa, Homo Sapiens
VHIYLPTKL

SEQ ID NO: 10735 - protein, 9 aa, Homo Sapiens
FQWIFFKEK

SEQ ID NO: 10736 - protein, 9 aa, Homo Sapiens
HLLTVYDFQ

SEQ ID NO: 10737 - protein, 9 aa, Homo Sapiens
KECNTILWV

SEQ ID NO: 10738 - protein, 9 aa, Homo Sapiens
SQFVSGNNP

SEQ ID NO: 10739 - protein, 9 aa, Homo Sapiens
GADVSVRGE

SEQ ID NO: 10740 - protein, 9 aa, Homo Sapiens
QCCRTQEHA

SEQ ID NO: 10741 - protein, 9 aa, Homo Sapiens
SASYSHRQP

SEQ ID NO: 10742 - protein, 9 aa, Homo Sapiens
IQNSNMPIE

SEQ ID NO: 10743 - protein, 9 aa, Homo Sapiens
QLIHDEKCL

SEQ ID NO: 10744 - protein, 9 aa, Homo Sapiens
GTTLKYCRY

SEQ ID NO: 10745 - protein, 9 aa, Homo Sapiens
GGHMNSGSH

SEQ ID NO: 10746 - protein, 9 aa, Homo Sapiens
EKDSTSKIG

SEQ ID NO: 10747 - protein, 9 aa, Homo Sapiens
VQGAHREVV

SEQ ID NO: 10748 - protein, 9 aa, Homo Sapiens
TSEHIYLPV

SEQ ID NO: 10749 - protein, 9 aa, Homo Sapiens
KNKMQLYVP

SEQ ID NO: 10750 - protein, 9 aa, Homo Sapiens
IGGLGQLLE

SEQ ID NO: 10751 - protein, 9 aa, Homo Sapiens
HPFLKLAKT

SEQ ID NO: 10752 - protein, 9 aa, Homo Sapiens
LRCRTPVQL

SEQ ID NO: 10753 - protein, 9 aa, Homo Sapiens
QEFQNLKTL

SEQ ID NO: 10754 - protein, 9 aa, Homo Sapiens
SGKLVRRAQ

SEQ ID NO: 10755 - protein, 9 aa, Homo Sapiens
CSFPHNFVL

SEQ ID NO: 10756 - protein, 9 aa, Homo Sapiens
AIFTEETIK

SEQ ID NO: 10757 - protein, 9 aa, Homo Sapiens
KENRNLGNL

SEQ ID NO: 10758 - protein, 9 aa, Homo Sapiens
FAHAQKVYE

SEQ ID NO: 10759 - protein, 9 aa, Homo Sapiens
FDVLKVTPQ

SEQ ID NO: 10760 - protein, 9 aa, Homo Sapiens
KVVMAMSSA

SEQ ID NO: 10761 - protein, 9 aa, Homo Sapiens
YNVTEKVRC

SEQ ID NO: 10762 - protein, 9 aa, Homo Sapiens
HGADVSVRG

SEQ ID NO: 10763 - protein, 9 aa, Homo Sapiens
HREVVDPSG

SEQ ID NO: 10764 - protein, 9 aa, Homo Sapiens
RNLGNLAAR

SEQ ID NO: 10765 - protein, 9 aa, Homo Sapiens
SSPSSACAA

SEQ ID NO: 10766 - protein, 9 aa, Homo Sapiens
PVDVSQISR

SEQ ID NO: 10767 - protein, 9 aa, Homo Sapiens
ERKKAIFTE

SEQ ID NO: 10768 - protein, 9 aa, Homo Sapiens
RPGPKGQLA

SEQ ID NO: 10769 - protein, 9 aa, Homo Sapiens
RAQKRLKEV

SEQ ID NO: 10770 - protein, 9 aa, Homo Sapiens
KKYALQDQN

SEQ ID NO: 10771 - protein, 9 aa, Homo Sapiens
SDGSLSHEQ

SEQ ID NO: 10772 - protein, 9 aa, Homo Sapiens
DGSEFSGTT

SEQ ID NO: 10773 - protein, 9 aa, Homo Sapiens
SPRLRCRTP

SEQ ID NO: 10774 - protein, 9 aa, Homo Sapiens
ITDQEASKN

SEQ ID NO: 10775 - protein, 9 aa, Homo Sapiens
SSASYSHRQ

SEQ ID NO: 10776 - protein, 9 aa, Homo Sapiens
PVPKHDSHR

SEQ ID NO: 10777 - protein, 9 aa, Homo Sapiens
PSSACAAAD

SEQ ID NO: 10778 - protein, 9 aa, Homo Sapiens
VIMYQCVSP

SEQ ID NO: 10779 - protein, 9 aa, Homo Sapiens
GPPGRSNGG

SEQ ID NO: 10780 - protein, 9 aa, Homo Sapiens
DKHQKTDAE

SEQ ID NO: 10781 - protein, 9 aa, Homo Sapiens
DQEFQNLKT

SEQ ID NO: 10782 - protein, 9 aa, Homo Sapiens
VSGNNPTAA

SEQ ID NO: 10783 - protein, 9 aa, Homo Sapiens
DEKCLKKEQ

SEQ ID NO: 10784 - protein, 9 aa, Homo Sapiens
PGPSEQPSQ

SEQ ID NO: 10785 - protein, 9 aa, Homo Sapiens
PRSPSSKGP

SEQ ID NO: 10786 - protein, 9 aa, Homo Sapiens
EKVRCIMES

SEQ ID NO: 10787 - protein, 9 aa, Homo Sapiens
HSPQQDNMV

SEQ ID NO: 10788 - protein, 9 aa, Homo Sapiens
CFLSRDRTS

SEQ ID NO: 10789 - protein, 9 aa, Homo Sapiens
HCGLWVRRQ

SEQ ID NO: 10790 - protein, 9 aa, Homo Sapiens
KGQGSVKVI

SEQ ID NO: 10791 - protein, 9 aa, Homo Sapiens
RCMHLQLEA

SEQ ID NO: 10792 - protein, 9 aa, Homo Sapiens
TLWAEPGFV

SEQ ID NO: 10793 - protein, 9 aa, Homo Sapiens
KPCKSLCQR

SEQ ID NO: 10794 - protein, 9 aa, Homo Sapiens
PSVQGAHRE

SEQ ID NO: 10795 - protein, 9 aa, Homo Sapiens
PQQDNMVSL

SEQ ID NO: 10796 - protein, 9 aa, Homo Sapiens
SVRGERGKT

SEQ ID NO: 10797 - protein, 9 aa, Homo Sapiens
KVVQRSIET

SEQ ID NO: 10798 - protein, 9 aa, Homo Sapiens
PQSSLETKE

SEQ ID NO: 10799 - protein, 9 aa, Homo Sapiens
LVGQEVGMT

SEQ ID NO: 10800 - protein, 9 aa, Homo Sapiens
AGGPPGRSN

SEQ ID NO: 10801 - protein, 9 aa, Homo Sapiens
LPVQQPESE

SEQ ID NO: 10802 - protein, 9 aa, Homo Sapiens
PTQDSNWTP

SEQ ID NO: 10803 - protein, 9 aa, Homo Sapiens
DSRVLVGQE

SEQ ID NO: 10804 - protein, 9 aa, Homo Sapiens
VRENRYKAI

SEQ ID NO: 10805 - protein, 9 aa, Homo Sapiens
SASQPSSPS

SEQ ID NO: 10806 - protein, 9 aa, Homo Sapiens
PRVGDFKES

SEQ ID NO: 10807 - protein, 9 aa, Homo Sapiens
PLSLNVRGF

SEQ ID NO: 10808 - protein, 9 aa, Homo Sapiens
RLRCRTPVQ

SEQ ID NO: 10809 - protein, 9 aa, Homo Sapiens
LSHEQDLAK

SEQ ID NO: 10810 - protein, 9 aa, Homo Sapiens
DSTSKIGQT

SEQ ID NO: 10811 - protein, 9 aa, Homo Sapiens
ASPSVQGAH

SEQ ID NO: 10812 - protein, 9 aa, Homo Sapiens
VSLRVLNDS

SEQ ID NO: 10813 - protein, 9 aa, Homo Sapiens
EFIEFLMTN

SEQ ID NO: 10814 - protein, 9 aa, Homo Sapiens
LSRDRTSVQ

SEQ ID NO: 10815 - protein, 9 aa, Homo Sapiens
DCSYVQCCR

SEQ ID NO: 10816 - protein, 9 aa, Homo Sapiens
QHPAQEKVP

SEQ ID NO: 10817 - protein, 9 aa, Homo Sapiens
KRKCNCRQQ

SEQ ID NO: 10818 - protein, 9 aa, Homo Sapiens
FFKEKKQAS

SEQ ID NO: 10819 - protein, 9 aa, Homo Sapiens
KLVRRAQKR

SEQ ID NO: 10820 - protein, 9 aa, Homo Sapiens
VSPQVYAPS

SEQ ID NO: 10821 - protein, 9 aa, Homo Sapiens
KLDKHQKTD

SEQ ID NO: 10822 - protein, 9 aa, Homo Sapiens
TNLHSTHPH

SEQ ID NO: 10823 - protein, 9 aa, Homo Sapiens
SVQGAHREV

SEQ ID NO: 10824 - protein, 9 aa, Homo Sapiens
KHAYFAHAQ

SEQ ID NO: 10825 - protein, 9 aa, Homo Sapiens
LLTMNRNPE

SEQ ID NO: 10826 - protein, 9 aa, Homo Sapiens
LGQLLESSS

SEQ ID NO: 10827 - protein, 9 aa, Homo Sapiens
MSSATSSVS

SEQ ID NO: 10828 - protein, 9 aa, Homo Sapiens
APAAPGPSE

SEQ ID NO: 10829 - protein, 9 aa, Homo Sapiens
CHPLLLEAR

SEQ ID NO: 10830 - protein, 9 aa, Homo Sapiens
TYAGLRPYS

SEQ ID NO: 10831 - protein, 9 aa, Homo Sapiens
QDNMVSLFY

SEQ ID NO: 10832 - protein, 9 aa, Homo Sapiens
MPYTLKEHY

SEQ ID NO: 10833 - protein, 9 aa, Homo Sapiens
IVLYQKGQG

SEQ ID NO: 10834 - protein, 9 aa, Homo Sapiens
MNSGSHAKT

SEQ ID NO: 10835 - protein, 9 aa, Homo Sapiens
LPFCRPGPK

SEQ ID NO: 10836 - protein, 9 aa, Homo Sapiens
VGDFKESTY

SEQ ID NO: 10837 - protein, 9 aa, Homo Sapiens
VYDGDSPSA

SEQ ID NO: 10838 - protein, 9 aa, Homo Sapiens
VRCIMESYF

SEQ ID NO: 10839 - protein, 9 aa, Homo Sapiens
SFPHNFVLL

SEQ ID NO: 10840 - protein, 9 aa, Homo Sapiens
TEWLKYIPL

SEQ ID NO: 10841 - protein, 9 aa, Homo Sapiens
GNILFSPVG

SEQ ID NO: 10842 - protein, 9 aa, Homo Sapiens
SPSVQGAHR

SEQ ID NO: 10843 - protein, 9 aa, Homo Sapiens
IETGRSLDD

SEQ ID NO: 10844 - protein, 9 aa, Homo Sapiens
EILLLTMNR

SEQ ID NO: 10845 - protein, 9 aa, Homo Sapiens
DTSEHIYLP

SEQ ID NO: 10846 - protein, 9 aa, Homo Sapiens
EKGTVCFKG

SEQ ID NO: 10847 - protein, 9 aa, Homo Sapiens
IMYSLDAKK

SEQ ID NO: 10848 - protein, 9 aa, Homo Sapiens
TVYDFQQEG

SEQ ID NO: 10849 - protein, 9 aa, Homo Sapiens
CQFPSKEAL

SEQ ID NO: 10850 - protein, 9 aa, Homo Sapiens
KEFIEFLMT

SEQ ID NO: 10851 - protein, 9 aa, Homo Sapiens
YAGLRPYSC

SEQ ID NO: 10852 - protein, 9 aa, Homo Sapiens
ALQDQNNFD

SEQ ID NO: 10853 - protein, 9 aa, Homo Sapiens
SYSHRQPAM

SEQ ID NO: 10854 - protein, 9 aa, Homo Sapiens
EFLMTNEET

SEQ ID NO: 10855 - protein, 9 aa, Homo Sapiens
QFVSGNNPT

SEQ ID NO: 10856 - protein, 9 aa, Homo Sapiens
VPRCGSAYL

SEQ ID NO: 10857 - protein, 9 aa, Homo Sapiens
KAIFTEETI

SEQ ID NO: 10858 - protein, 9 aa, Homo Sapiens
QLEAVPAVA

SEQ ID NO: 10859 - protein, 9 aa, Homo Sapiens
DQNNFDPVQ

SEQ ID NO: 10860 - protein, 9 aa, Homo Sapiens
GAKVPKEEK

SEQ ID NO: 10861 - protein, 9 aa, Homo Sapiens
GLTLNWTQM

SEQ ID NO: 10862 - protein, 9 aa, Homo Sapiens
STDQEFQNL

SEQ ID NO: 10863 - protein, 9 aa, Homo Sapiens
LYGLLQAYL

SEQ ID NO: 10864 - protein, 9 aa, Homo Sapiens
PQEYAGQIT

SEQ ID NO: 10865 - protein, 9 aa, Homo Sapiens
YRALQEQFR

SEQ ID NO: 10866 - protein, 9 aa, Homo Sapiens
KQKRNNESS

SEQ ID NO: 10867 - protein, 9 aa, Homo Sapiens
HIPRVGDFK

SEQ ID NO: 10868 - protein, 9 aa, Homo Sapiens
EASKNHVAA

SEQ ID NO: 10869 - protein, 9 aa, Homo Sapiens
SPSAFQLGR

SEQ ID NO: 10870 - protein, 9 aa, Homo Sapiens
AQEKVPESP

SEQ ID NO: 10871 - protein, 9 aa, Homo Sapiens
AITFSANVS

SEQ ID NO: 10872 - protein, 9 aa, Homo Sapiens
APGPSEQPS

SEQ ID NO: 10873 - protein, 9 aa, Homo Sapiens
RSNGGPRAL

SEQ ID NO: 10874 - protein, 9 aa, Homo Sapiens
DGNILFSPV

SEQ ID NO: 10875 - protein, 9 aa, Homo Sapiens
TDAEERPYK

SEQ ID NO: 10876 - protein, 9 aa, Homo Sapiens
GAHREVVDP

SEQ ID NO: 10877 - protein, 9 aa, Homo Sapiens
GIGGLGQLL

SEQ ID NO: 10878 - protein, 9 aa, Homo Sapiens
CGKAFKQSL

SEQ ID NO: 10879 - protein, 9 aa, Homo Sapiens
KDRRAIVES

SEQ ID NO: 10880 - protein, 9 aa, Homo Sapiens
QVKASDADD

SEQ ID NO: 10881 - protein, 9 aa, Homo Sapiens
LKYIPLSLN

SEQ ID NO: 10882 - protein, 9 aa, Homo Sapiens
FIEFLMTNE

SEQ ID NO: 10883 - protein, 9 aa, Homo Sapiens
PSEQPSQEL

SEQ ID NO: 10884 - protein, 9 aa, Homo Sapiens
MYSLDAKKW

SEQ ID NO: 10885 - protein, 9 aa, Homo Sapiens
ASYSHRQPA

SEQ ID NO: 10886 - protein, 9 aa, Homo Sapiens
SVVVPCEPP

SEQ ID NO: 10887 - protein, 9 aa, Homo Sapiens
ACLLCRCQF

SEQ ID NO: 10888 - protein, 9 aa, Homo Sapiens
PIKPCKSLC

SEQ ID NO: 10889 - protein, 9 aa, Homo Sapiens
YTLQAESIN

SEQ ID NO: 10890 - protein, 9 aa, Homo Sapiens
GLLQAYLRQ

SEQ ID NO: 10891 - protein, 9 aa, Homo Sapiens
GDPTQDSNW

SEQ ID NO: 10892 - protein, 9 aa, Homo Sapiens
QWIFFKEKK

SEQ ID NO: 10893 - protein, 9 aa, Homo Sapiens
AAPGPSEQP

SEQ ID NO: 10894 - protein, 9 aa, Homo Sapiens
KNHVAATGS

SEQ ID NO: 10895 - protein, 9 aa, Homo Sapiens
CSYVQCCRT

SEQ ID NO: 10896 - protein, 9 aa, Homo Sapiens
SIETGRSLD

SEQ ID NO: 10897 - protein, 9 aa, Homo Sapiens
FDSCTFMKK

SEQ ID NO: 10898 - protein, 9 aa, Homo Sapiens
QNLKTLHMD

SEQ ID NO: 10899 - protein, 9 aa, Homo Sapiens
VLKVTPQEY

SEQ ID NO: 10900 - protein, 9 aa, Homo Sapiens
ACPESCVDT

SEQ ID NO: 10901 - protein, 9 aa, Homo Sapiens
TEKVRCIME

SEQ ID NO: 10902 - protein, 9 aa, Homo Sapiens
PTLWAEPGF

SEQ ID NO: 10903 - protein, 9 aa, Homo Sapiens
LQVYDGDSP

SEQ ID NO: 10904 - protein, 9 aa, Homo Sapiens
SNMPIECIR

SEQ ID NO: 10905 - protein, 9 aa, Homo Sapiens
VSWLPPTKL

SEQ ID NO: 10906 - protein, 9 aa, Homo Sapiens
ASKNHVAAT

SEQ ID NO: 10907 - protein, 9 aa, Homo Sapiens
VVIMYQCVS

SEQ ID NO: 10908 - protein, 9 aa, Homo Sapiens
GQEVGMTTI

SEQ ID NO: 10909 - protein, 9 aa, Homo Sapiens
RYKAITFSA

SEQ ID NO: 10910 - protein, 9 aa, Homo Sapiens
PHNFVLLVQ

SEQ ID NO: 10911 - protein, 9 aa, Homo Sapiens
YFAHAQKVY

SEQ ID NO: 10912 - protein, 9 aa, Homo Sapiens
ARVPRCGSA

SEQ ID NO: 10913 - protein, 9 aa, Homo Sapiens
PEGVRKALR

SEQ ID NO: 10914 - protein, 9 aa, Homo Sapiens
SYVQCCRTQ

SEQ ID NO: 10915 - protein, 9 aa, Homo Sapiens
QGSVKVIDF

SEQ ID NO: 10916 - protein, 9 aa, Homo Sapiens
DRVYTLQAE

SEQ ID NO: 10917 - protein, 9 aa, Homo Sapiens
SLSHEQDLA

SEQ ID NO: 10918 - protein, 9 aa, Homo Sapiens
RYLFPVPKH

SEQ ID NO: 10919 - protein, 9 aa, Homo Sapiens
GPSEQPSQE

SEQ ID NO: 10920 - protein, 9 aa, Homo Sapiens
FGARVPRCG

SEQ ID NO: 10921 - protein, 9 aa, Homo Sapiens
QEASKNHVA

SEQ ID NO: 10922 - protein, 9 aa, Homo Sapiens
HQGPSCSFP

SEQ ID NO: 10923 - protein, 9 aa, Homo Sapiens
FDQYRALQE

SEQ ID NO: 10924 - protein, 9 aa, Homo Sapiens
FIIMYSLDA

SEQ ID NO: 10925 - protein, 9 aa, Homo Sapiens
QVYDGDSPS

SEQ ID NO: 10926 - protein, 9 aa, Homo Sapiens
EFQNLKTLH

SEQ ID NO: 10927 - protein, 9 aa, Homo Sapiens
GWGQLGDPT

SEQ ID NO: 10928 - protein, 9 aa, Homo Sapiens
KMPDMHFKV

SEQ ID NO: 10929 - protein, 9 aa, Homo Sapiens
EETIKEKER

SEQ ID NO: 10930 - protein, 9 aa, Homo Sapiens
WPVDVSQIS

SEQ ID NO: 10931 - protein, 9 aa, Homo Sapiens
EKVPESPQT

SEQ ID NO: 10932 - protein, 9 aa, Homo Sapiens
GGPPGRSNG

SEQ ID NO: 10933 - protein, 9 aa, Homo Sapiens
SEHIYLPVQ

SEQ ID NO: 10934 - protein, 9 aa, Homo Sapiens
GPAIYMASP

SEQ ID NO: 10935 - protein, 9 aa, Homo Sapiens
TLKYCRYRD

SEQ ID NO: 10936 - protein, 9 aa, Homo Sapiens
GSEFSGTTL

SEQ ID NO: 10937 - protein, 9 aa, Homo Sapiens
QDQNNFDPV

SEQ ID NO: 10938 - protein, 9 aa, Homo Sapiens
LACLLCRCQ

SEQ ID NO: 10939 - protein, 9 aa, Homo Sapiens
FRKHRRTYA

SEQ ID NO: 10940 - protein, 9 aa, Homo Sapiens
AEPGFVIIQ

SEQ ID NO: 10941 - protein, 9 aa, Homo Sapiens
LGKKQKRNN

SEQ ID NO: 10942 - protein, 9 aa, Homo Sapiens
LFSPVGILT

SEQ ID NO: 10943 - protein, 9 aa, Homo Sapiens
NLHSTHPHF

SEQ ID NO: 10944 - protein, 9 aa, Homo Sapiens
QNVHIYLPT

SEQ ID NO: 10945 - protein, 9 aa, Homo Sapiens
EVKENRNLG

SEQ ID NO: 10946 - protein, 9 aa, Homo Sapiens
VSVRGERGK

SEQ ID NO: 10947 - protein, 9 aa, Homo Sapiens
VMGYDLYVA

SEQ ID NO: 10948 - protein, 9 aa, Homo Sapiens
TPTYHLPVQ

SEQ ID NO: 10949 - protein, 9 aa, Homo Sapiens
RENRYKAIT

SEQ ID NO: 10950 - protein, 9 aa, Homo Sapiens
DGDSPSAFQ

SEQ ID NO: 10951 - protein, 9 aa, Homo Sapiens
HLPVQATDR

SEQ ID NO: 10952 - protein, 9 aa, Homo Sapiens
GNNPTAAPI

SEQ ID NO: 10953 - protein, 9 aa, Homo Sapiens
RVLVGQEVG

SEQ ID NO: 10954 - protein, 9 aa, Homo Sapiens
PTYHLPVQA

SEQ ID NO: 10955 - protein, 9 aa, Homo Sapiens
RSPSSKGPS

SEQ ID NO: 10956 - protein, 9 aa, Homo Sapiens
SGSHAKTRP

SEQ ID NO: 10957 - protein, 9 aa, Homo Sapiens
PSCSFPHNF

SEQ ID NO: 10958 - protein, 9 aa, Homo Sapiens
KLAKTLSSL

SEQ ID NO: 10959 - protein, 9 aa, Homo Sapiens
HLQLEAVPA

SEQ ID NO: 10960 - protein, 9 aa, Homo Sapiens
RKHRRTYAG

SEQ ID NO: 10961 - protein, 9 aa, Homo Sapiens
FVSGNNPTA

SEQ ID NO: 10962 - protein, 9 aa, Homo Sapiens
EFSGTTLKY

SEQ ID NO: 10963 - protein, 9 aa, Homo Sapiens
CEPPEVGSD

SEQ ID NO: 10964 - protein, 9 aa, Homo Sapiens
LVVSPQVYA

SEQ ID NO: 10965 - protein, 9 aa, Homo Sapiens
PKHDSHRVI

SEQ ID NO: 10966 - protein, 9 aa, Homo Sapiens
HMNSGSHAK

SEQ ID NO: 10967 - protein, 9 aa, Homo Sapiens
PEILLLTMN

SEQ ID NO: 10968 - protein, 9 aa, Homo Sapiens
VPAVPPGVQ

SEQ ID NO: 10969 - protein, 9 aa, Homo Sapiens
FLSRDRTSV

SEQ ID NO: 10970 - protein, 9 aa, Homo Sapiens
NDGNILFSP

SEQ ID NO: 10971 - protein, 9 aa, Homo Sapiens
ECNTILWVK

SEQ ID NO: 10972 - protein, 9 aa, Homo Sapiens
KLACLLCRC

SEQ ID NO: 10973 - protein, 9 aa, Homo Sapiens
GARVPRCGS

SEQ ID NO: 10974 - protein, 9 aa, Homo Sapiens
VFRKHRRTY

SEQ ID NO: 10975 - protein, 9 aa, Homo Sapiens
RRAIVESIR

SEQ ID NO: 10976 - protein, 9 aa, Homo Sapiens
TKLNGVIRK

SEQ ID NO: 10977 - protein, 9 aa, Homo Sapiens
QAESINERT

SEQ ID NO: 10978 - protein, 9 aa, Homo Sapiens
NKLMTNLHS

SEQ ID NO: 10979 - protein, 9 aa, Homo Sapiens
LTMNRNPEK

SEQ ID NO: 10980 - protein, 9 aa, Homo Sapiens
LGNLAARPP

SEQ ID NO: 10981 - protein, 9 aa, Homo Sapiens
VSQISRASL

SEQ ID NO: 10982 - protein, 9 aa, Homo Sapiens
KVPESPQTS

SEQ ID NO: 10983 - protein, 9 aa, Homo Sapiens
VVSPQVYAP

SEQ ID NO: 10984 - protein, 9 aa, Homo Sapiens
WVEKKECNT

SEQ ID NO: 10985 - protein, 9 aa, Homo Sapiens
RKCNCRQQM

SEQ ID NO: 10986 - protein, 9 aa, Homo Sapiens
VQCCRTQEH

SEQ ID NO: 10987 - protein, 9 aa, Homo Sapiens
RRAQKRLKE

SEQ ID NO: 10988 - protein, 9 aa, Homo Sapiens
PSSKGPSLH

SEQ ID NO: 10989 - protein, 9 aa, Homo Sapiens
GKAFKQSLT

SEQ ID NO: 10990 - protein, 9 aa, Homo Sapiens
QIKEEPVSE

SEQ ID NO: 10991 - protein, 9 aa, Homo Sapiens
VRRAQKRLK

SEQ ID NO: 10992 - protein, 9 aa, Homo Sapiens
ACGECHPLL

SEQ ID NO: 10993 - protein, 9 aa, Homo Sapiens
NKAEMGRFS

SEQ ID NO: 10994 - protein, 9 aa, Homo Sapiens
PTAAPITLP

SEQ ID NO: 10995 - protein, 9 aa, Homo Sapiens
QEKDSTSKI

SEQ ID NO: 10996 - protein, 9 aa, Homo Sapiens
VKEKGTVCF

SEQ ID NO: 10997 - protein, 9 aa, Homo Sapiens
KDSTSKIGQ

SEQ ID NO: 10998 - protein, 9 aa, Homo Sapiens
AASTVSLRV

SEQ ID NO: 10999 - protein, 9 aa, Homo Sapiens
LWVRRQAGY

SEQ ID NO: 11000 - protein, 9 aa, Homo Sapiens
VEKKECNTI

SEQ ID NO: 11001 - protein, 9 aa, Homo Sapiens
IIMYSLDAK

SEQ ID NO: 11002 - protein, 9 aa, Homo Sapiens
MTNLHSTHP

SEQ ID NO: 11003 - protein, 9 aa, Homo Sapiens
QGPSCSFPH

SEQ ID NO: 11004 - protein, 9 aa, Homo Sapiens
LFPVPKHDS

SEQ ID NO: 11005 - protein, 9 aa, Homo Sapiens
RALQEQFRR

SEQ ID NO: 11006 - protein, 9 aa, Homo Sapiens
LTLTTHKRI

SEQ ID NO: 11007 - protein, 9 aa, Homo Sapiens
FKERLYGLL

SEQ ID NO: 11008 - protein, 9 aa, Homo Sapiens
AFDSCTFMK

SEQ ID NO: 11009 - protein, 9 aa, Homo Sapiens
TTLKYCRYR

SEQ ID NO: 11010 - protein, 9 aa, Homo Sapiens
EHYKYTVVM

SEQ ID NO: 11011 - protein, 9 aa, Homo Sapiens
ELHVQNVHI

SEQ ID NO: 11012 - protein, 9 aa, Homo Sapiens
DQYRALQEQ

SEQ ID NO: 11013 - protein, 9 aa, Homo Sapiens
WVRRQAGYK

SEQ ID NO: 11014 - protein, 9 aa, Homo Sapiens
TNDGNILFS

SEQ ID NO: 11015 - protein, 9 aa, Homo Sapiens
GGLLLLLLV

SEQ ID NO: 11016 - protein, 9 aa, Homo Sapiens
LGDPTQDSN

SEQ ID NO: 11017 - protein, 9 aa, Homo Sapiens
LKLAKTLSS

SEQ ID NO: 11018 - protein, 9 aa, Homo Sapiens
DFKESTYYM

SEQ ID NO: 11019 - protein, 9 aa, Homo Sapiens
ACFLSRDRT

SEQ ID NO: 11020 - protein, 9 aa, Homo Sapiens
MAACPESCV

SEQ ID NO: 11021 - protein, 9 aa, Homo Sapiens
NILFSPVGI

SEQ ID NO: 11022 - protein, 9 aa, Homo Sapiens
EQPSQELPQ

SEQ ID NO: 11023 - protein, 9 aa, Homo Sapiens
GQHPAQEKV

SEQ ID NO: 11024 - protein, 9 aa, Homo Sapiens
SVMQVKASD

SEQ ID NO: 11025 - protein, 9 aa, Homo Sapiens
HPAQEKVPE

SEQ ID NO: 11026 - protein, 9 aa, Homo Sapiens
WHKDRRAIV

SEQ ID NO: 11027 - protein, 9 aa, Homo Sapiens
LDAKKWQTY

SEQ ID NO: 11028 - protein, 9 aa, Homo Sapiens
ASTVSLRVL

SEQ ID NO: 11029 - protein, 9 aa, Homo Sapiens
ETLPDTMTA

SEQ ID NO: 11030 - protein, 9 aa, Homo Sapiens
NVHIYLPTK

SEQ ID NO: 11031 - protein, 9 aa, Homo Sapiens
NLKTLHMDF

SEQ ID NO: 11032 - protein, 9 aa, Homo Sapiens
AAFDSCTFM

SEQ ID NO: 11033 - protein, 9 aa, Homo Sapiens
VLYQKGQGS

SEQ ID NO: 11034 - protein, 9 aa, Homo Sapiens
HKDRRAIVE

SEQ ID NO: 11035 - protein, 9 aa, Homo Sapiens
TDQEASKNH

SEQ ID NO: 11036 - protein, 9 aa, Homo Sapiens
GVRKALRRA

SEQ ID NO: 11037 - protein, 9 aa, Homo Sapiens
SHEQDLAKV

SEQ ID NO: 11038 - protein, 9 aa, Homo Sapiens
RRQAGYKKK

SEQ ID NO: 11039 - protein, 9 aa, Homo Sapiens
FFQWIFFKE

SEQ ID NO: 11040 - protein, 9 aa, Homo Sapiens
PSAFQLGRF

SEQ ID NO: 11041 - protein, 9 aa, Homo Sapiens
FSGTTLKYC

SEQ ID NO: 11042 - protein, 9 aa, Homo Sapiens
NNPTAAPIT

SEQ ID NO: 11043 - protein, 9 aa, Homo Sapiens
VMQVKASDA

SEQ ID NO: 11044 - protein, 9 aa, Homo Sapiens
LCRCQFPSK

SEQ ID NO: 11045 - protein, 9 aa, Homo Sapiens
IFTEETIKE

SEQ ID NO: 11046 - protein, 9 aa, Homo Sapiens
AVMGYDLYV

SEQ ID NO: 11047 - protein, 9 aa, Homo Sapiens
ITWHKDRRA

SEQ ID NO: 11048 - protein, 9 aa, Homo Sapiens
SDGLTLNWT

SEQ ID NO: 11049 - protein, 9 aa, Homo Sapiens
IQLIHDEKC

SEQ ID NO: 11050 - protein, 9 aa, Homo Sapiens
TGTSVMQVK

SEQ ID NO: 11051 - protein, 9 aa, Homo Sapiens
IYLPVQQPE

SEQ ID NO: 11052 - protein, 9 aa, Homo Sapiens
YSSAIAPKT

SEQ ID NO: 11053 - protein, 9 aa, Homo Sapiens
GVQIKEEPV

SEQ ID NO: 11054 - protein, 9 aa, Homo Sapiens
PMPYTLKEH

SEQ ID NO: 11055 - protein, 9 aa, Homo Sapiens
MQVKASDAD

SEQ ID NO: 11056 - protein, 9 aa, Homo Sapiens
SGTTLKYCR

SEQ ID NO: 11057 - protein, 9 aa, Homo Sapiens
HAYFAHAQK

SEQ ID NO: 11058 - protein, 9 aa, Homo Sapiens
GQLLESSSE

SEQ ID NO: 11059 - protein, 9 aa, Homo Sapiens
IECIRHFFR

SEQ ID NO: 11060 - protein, 9 aa, Homo Sapiens
SEFSGTTLK

SEQ ID NO: 11061 - protein, 9 aa, Homo Sapiens
VMAMSSATS

SEQ ID NO: 11062 - protein, 9 aa, Homo Sapiens
LIKNKMQLY

SEQ ID NO: 11063 - protein, 9 aa, Homo Sapiens
FKQSLTLTT

SEQ ID NO: 11064 - protein, 9 aa, Homo Sapiens
GRSNGGPRA

SEQ ID NO: 11065 - protein, 9 aa, Homo Sapiens
VPMPYTLKE

SEQ ID NO: 11066 - protein, 9 aa, Homo Sapiens
AACPESCVD

SEQ ID NO: 11067 - protein, 9 aa, Homo Sapiens
QQMRTTQLG

SEQ ID NO: 11068 - protein, 9 aa, Homo Sapiens
TMTAGALQR

SEQ ID NO: 11069 - protein, 9 aa, Homo Sapiens
IAPKTVAAL

SEQ ID NO: 11070 - protein, 9 aa, Homo Sapiens
LTLNWTQMH

SEQ ID NO: 11071 - protein, 9 aa, Homo Sapiens
QAASTVSLR

SEQ ID NO: 11072 - protein, 9 aa, Homo Sapiens
VPCEPPEVG

SEQ ID NO: 11073 - protein, 9 aa, Homo Sapiens
LNWTQMHNA

SEQ ID NO: 11074 - protein, 9 aa, Homo Sapiens
TLKQAASTV

SEQ ID NO: 11075 - protein, 9 aa, Homo Sapiens
PSSLVVSPQ

SEQ ID NO: 11076 - protein, 9 aa, Homo Sapiens
PCEPPEVGS

SEQ ID NO: 11077 - protein, 9 aa, Homo Sapiens
QSSLETKES

SEQ ID NO: 11078 - protein, 9 aa, Homo Sapiens
LLQACGECH

SEQ ID NO: 11079 - protein, 9 aa, Homo Sapiens
CLLCRCQFP

SEQ ID NO: 11080 - protein, 9 aa, Homo Sapiens
NMVSLFYSL

SEQ ID NO: 11081 - protein, 9 aa, Homo Sapiens
LYQKGQGSV

SEQ ID NO: 11082 - protein, 9 aa, Homo Sapiens
FVVIMYQCV

SEQ ID NO: 11083 - protein, 9 aa, Homo Sapiens
LSLNVRGFM

SEQ ID NO: 11084 - protein, 9 aa, Homo Sapiens
QLGDPTQDS

SEQ ID NO: 11085 - protein, 9 aa, Homo Sapiens
IYLPTKLFQ

SEQ ID NO: 11086 - protein, 9 aa, Homo Sapiens
KAITFSANV

SEQ ID NO: 11087 - protein, 9 aa, Homo Sapiens
IKNKMQLYV

SEQ ID NO: 11088 - protein, 9 aa, Homo Sapiens
LHSTHPHFV

SEQ ID NO: 11089 - protein, 9 aa, Homo Sapiens
EANKVVMAM

SEQ ID NO: 11090 - protein, 9 aa, Homo Sapiens
SKGPSLHRL

SEQ ID NO: 11091 - protein, 9 aa, Homo Sapiens
PDMHFKVPK

SEQ ID NO: 11092 - protein, 9 aa, Homo Sapiens
RPAQLWRWS

SEQ ID NO: 11093 - protein, 9 aa, Homo Sapiens
QACGECHPL

SEQ ID NO: 11094 - protein, 9 aa, Homo Sapiens
QKRLKEVVL

SEQ ID NO: 11095 - protein, 9 aa, Homo Sapiens
CRPGPKGQL

SEQ ID NO: 11096 - protein, 9 aa, Homo Sapiens
TYHLPVQAT

SEQ ID NO: 11097 - protein, 9 aa, Homo Sapiens
ETGRSLDDA

SEQ ID NO: 11098 - protein, 9 aa, Homo Sapiens
LDHGADVSV

SEQ ID NO: 11099 - protein, 9 aa, Homo Sapiens
ASSASYSHR

SEQ ID NO: 11100 - protein, 9 aa, Homo Sapiens
GDSPSAFQL

SEQ ID NO: 11101 - protein, 9 aa, Homo Sapiens
KGTVCFKGG

SEQ ID NO: 11102 - protein, 9 aa, Homo Sapiens
PRLRCRTPV

SEQ ID NO: 11103 - protein, 9 aa, Homo Sapiens
HAQKVYERA

SEQ ID NO: 11104 - protein, 9 aa, Homo Sapiens
FTMGGPAIY

SEQ ID NO: 11105 - protein, 9 aa, Homo Sapiens
QYRALQEQF

SEQ ID NO: 11106 - protein, 9 aa, Homo Sapiens
TGRSLDDAR

SEQ ID NO: 11107 - protein, 9 aa, Homo Sapiens
ECHPLLLEA

SEQ ID NO: 11108 - protein, 9 aa, Homo Sapiens
CNTILWVKE

SEQ ID NO: 11109 - protein, 9 aa, Homo Sapiens
HINRERWGA

SEQ ID NO: 11110 - protein, 9 aa, Homo Sapiens
GLWVRRQAG

SEQ ID NO: 11111 - protein, 9 aa, Homo Sapiens
KHDSHRVIT

SEQ ID NO: 11112 - protein, 9 aa, Homo Sapiens
RKALRRAFL

SEQ ID NO: 11113 - protein, 9 aa, Homo Sapiens
VYNEDIGYC

SEQ ID NO: 11114 - protein, 9 aa, Homo Sapiens
LRKTDLRYT

SEQ ID NO: 11115 - protein, 9 aa, Homo Sapiens
DVDGHVTFT

SEQ ID NO: 11116 - protein, 9 aa, Homo Sapiens
PPPSGRMRS

SEQ ID NO: 11117 - protein, 9 aa, Homo Sapiens
KLTPGVDHS

SEQ ID NO: 11118 - protein, 9 aa, Homo Sapiens
ATCLEGSLK

SEQ ID NO: 11119 - protein, 9 aa, Homo Sapiens
YIFLDAQRP

SEQ ID NO: 11120 - protein, 9 aa, Homo Sapiens
QESCGPRSL

SEQ ID NO: 11121 - protein, 9 aa, Homo Sapiens
AGASIDNEN

SEQ ID NO: 11122 - protein, 9 aa, Homo Sapiens
LACYASICQ

SEQ ID NO: 11123 - protein, 9 aa, Homo Sapiens
VSKIFRNCQ

SEQ ID NO: 11124 - protein, 9 aa, Homo Sapiens
MHQSEEDEE

SEQ ID NO: 11125 - protein, 9 aa, Homo Sapiens
IHVALAQKD

SEQ ID NO: 11126 - protein, 9 aa, Homo Sapiens
QGRWVLLLG

SEQ ID NO: 11127 - protein, 9 aa, Homo Sapiens
QTPLAMHQS

SEQ ID NO: 11128 - protein, 9 aa, Homo Sapiens
IEWNLRREE

SEQ ID NO: 11129 - protein, 9 aa, Homo Sapiens
NFMVPVGGV

SEQ ID NO: 11130 - protein, 9 aa, Homo Sapiens
NLGCLYADL

SEQ ID NO: 11131 - protein, 9 aa, Homo Sapiens
WGSRGNPSG

SEQ ID NO: 11132 - protein, 9 aa, Homo Sapiens
NTGMANILV

SEQ ID NO: 11133 - protein, 9 aa, Homo Sapiens
ATVKAWPSV

SEQ ID NO: 11134 - protein, 9 aa, Homo Sapiens
QYNALNEAK

SEQ ID NO: 11135 - protein, 9 aa, Homo Sapiens
HTMEMMKIF

SEQ ID NO: 11136 - protein, 9 aa, Homo Sapiens
PKVCKTDAG

SEQ ID NO: 11137 - protein, 9 aa, Homo Sapiens
AGEIELFDG

SEQ ID NO: 11138 - protein, 9 aa, Homo Sapiens
SVHGAMPPL

SEQ ID NO: 11139 - protein, 9 aa, Homo Sapiens
EHSQNGCGH

SEQ ID NO: 11140 - protein, 9 aa, Homo Sapiens
DIVNWKQRL

SEQ ID NO: 11141 - protein, 9 aa, Homo Sapiens
LTYYEGEVN

SEQ ID NO: 11142 - protein, 9 aa, Homo Sapiens
ITWVPSNSN

SEQ ID NO: 11143 - protein, 9 aa, Homo Sapiens
YISGTVSIY

SEQ ID NO: 11144 - protein, 9 aa, Homo Sapiens
QSLSFPHTM

SEQ ID NO: 11145 - protein, 9 aa, Homo Sapiens
KTDAGLYVA

SEQ ID NO: 11146 - protein, 9 aa, Homo Sapiens
MKRHMVSQL

SEQ ID NO: 11147 - protein, 9 aa, Homo Sapiens
RGLGPRGAG

SEQ ID NO: 11148 - protein, 9 aa, Homo Sapiens
GEVNAGRIG

SEQ ID NO: 11149 - protein, 9 aa, Homo Sapiens
LKNVRLPLL

SEQ ID NO: 11150 - protein, 9 aa, Homo Sapiens
TSFFGALHV

SEQ ID NO: 11151 - protein, 9 aa, Homo Sapiens
DALLNSDST

SEQ ID NO: 11152 - protein, 9 aa, Homo Sapiens
ETESLRDAL

SEQ ID NO: 11153 - protein, 9 aa, Homo Sapiens
LSPWLALGA

SEQ ID NO: 11154 - protein, 9 aa, Homo Sapiens
PEPEDVAVL

SEQ ID NO: 11155 - protein, 9 aa, Homo Sapiens
ALLNSDSTK

SEQ ID NO: 11156 - protein, 9 aa, Homo Sapiens
YSNWLLARN

SEQ ID NO: 11157 - protein, 9 aa, Homo Sapiens
FWPNFYQLI

SEQ ID NO: 11158 - protein, 9 aa, Homo Sapiens
PATQAAWQA

SEQ ID NO: 11159 - protein, 9 aa, Homo Sapiens
MQLFSLNPQ

SEQ ID NO: 11160 - protein, 9 aa, Homo Sapiens
EALLDVIPT

SEQ ID NO: 11161 - protein, 9 aa, Homo Sapiens
QSSLSVRWA

SEQ ID NO: 11162 - protein, 9 aa, Homo Sapiens
WQAACTIVE

SEQ ID NO: 11163 - protein, 9 aa, Homo Sapiens
CSLYRCDQD

SEQ ID NO: 11164 - protein, 9 aa, Homo Sapiens
GKEALLDVI

SEQ ID NO: 11165 - protein, 9 aa, Homo Sapiens
HGGTAFKDG

SEQ ID NO: 11166 - protein, 9 aa, Homo Sapiens
SRLRFNSTI

SEQ ID NO: 11167 - protein, 9 aa, Homo Sapiens
WSSVLIKHQ

SEQ ID NO: 11168 - protein, 9 aa, Homo Sapiens
ALDALLNSD

SEQ ID NO: 11169 - protein, 9 aa, Homo Sapiens
THYSVHGAM

SEQ ID NO: 11170 - protein, 9 aa, Homo Sapiens
GFSQNDGLK

SEQ ID NO: 11171 - protein, 9 aa, Homo Sapiens
GGFPPRGPW

SEQ ID NO: 11172 - protein, 9 aa, Homo Sapiens
MDPMNQYNA

SEQ ID NO: 11173 - protein, 9 aa, Homo Sapiens
RHPIHVSRR

SEQ ID NO: 11174 - protein, 9 aa, Homo Sapiens
RHMVSQLQN

SEQ ID NO: 11175 - protein, 9 aa, Homo Sapiens
LYISGTVSI

SEQ ID NO: 11176 - protein, 9 aa, Homo Sapiens
CLEGSLKIK

SEQ ID NO: 11177 - protein, 9 aa, Homo Sapiens
YVRGRGQGK

SEQ ID NO: 11178 - protein, 9 aa, Homo Sapiens
DIYLGVSRE

SEQ ID NO: 11179 - protein, 9 aa, Homo Sapiens
TESCSVAQA

SEQ ID NO: 11180 - protein, 9 aa, Homo Sapiens
TGTRPLNLA

SEQ ID NO: 11181 - protein, 9 aa, Homo Sapiens
SSLSVRWAS

SEQ ID NO: 11182 - protein, 9 aa, Homo Sapiens
PELVQYLLD

SEQ ID NO: 11183 - protein, 9 aa, Homo Sapiens
DCYYNLGCL

SEQ ID NO: 11184 - protein, 9 aa, Homo Sapiens
EARRQDREK

SEQ ID NO: 11185 - protein, 9 aa, Homo Sapiens
RTATALPVL

SEQ ID NO: 11186 - protein, 9 aa, Homo Sapiens
NSMKRHMVS

SEQ ID NO: 11187 - protein, 9 aa, Homo Sapiens
TVNMLTSFF

SEQ ID NO: 11188 - protein, 9 aa, Homo Sapiens
LTPGVDHSL

SEQ ID NO: 11189 - protein, 9 aa, Homo Sapiens
PRQGRWVLL

SEQ ID NO: 11190 - protein, 9 aa, Homo Sapiens
KSSSPKATN

SEQ ID NO: 11191 - protein, 9 aa, Homo Sapiens
YYSHSALLP

SEQ ID NO: 11192 - protein, 9 aa, Homo Sapiens
CTVPGSTMK

SEQ ID NO: 11193 - protein, 9 aa, Homo Sapiens
SLYNTLTYY

SEQ ID NO: 11194 - protein, 9 aa, Homo Sapiens
SRERDEKAG

SEQ ID NO: 11195 - protein, 9 aa, Homo Sapiens
VCSLYRCDQ

SEQ ID NO: 11196 - protein, 9 aa, Homo Sapiens
GDGPTQESC

SEQ ID NO: 11197 - protein, 9 aa, Homo Sapiens
QDRPDQDND

SEQ ID NO: 11198 - protein, 9 aa, Homo Sapiens
QPDRPCQPH

SEQ ID NO: 11199 - protein, 9 aa, Homo Sapiens
KSWPRTVPF

SEQ ID NO: 11200 - protein, 9 aa, Homo Sapiens
EQNKTEVWE

SEQ ID NO: 11201 - protein, 9 aa, Homo Sapiens
LRYTCQREF

SEQ ID NO: 11202 - protein, 9 aa, Homo Sapiens
DHSLQPQEL

SEQ ID NO: 11203 - protein, 9 aa, Homo Sapiens
SCVCACPSS

SEQ ID NO: 11204 - protein, 9 aa, Homo Sapiens
GVDHSLQPQ

SEQ ID NO: 11205 - protein, 9 aa, Homo Sapiens
SNVCSLYRC

SEQ ID NO: 11206 - protein, 9 aa, Homo Sapiens
MPQIVATAS

SEQ ID NO: 11207 - protein, 9 aa, Homo Sapiens
DIFFFGMCA

SEQ ID NO: 11208 - protein, 9 aa, Homo Sapiens
ESYMDPMNQ

SEQ ID NO: 11209 - protein, 9 aa, Homo Sapiens
QDNDLRLAQ

SEQ ID NO: 11210 - protein, 9 aa, Homo Sapiens
MLPQSPANI

SEQ ID NO: 11211 - protein, 9 aa, Homo Sapiens
SNSMKRHMV

SEQ ID NO: 11212 - protein, 9 aa, Homo Sapiens
SWKIALPMG

SEQ ID NO: 11213 - protein, 9 aa, Homo Sapiens
RWVLLLGSQ

SEQ ID NO: 11214 - protein, 9 aa, Homo Sapiens
GIPVAKVEW

SEQ ID NO: 11215 - protein, 9 aa, Homo Sapiens
SIIHGGTAF

SEQ ID NO: 11216 - protein, 9 aa, Homo Sapiens
KMMRDFSIL

SEQ ID NO: 11217 - protein, 9 aa, Homo Sapiens
TGEQSYKCK

SEQ ID NO: 11218 - protein, 9 aa, Homo Sapiens
RQKPRQGRW

SEQ ID NO: 11219 - protein, 9 aa, Homo Sapiens
CQCWEDRRK

SEQ ID NO: 11220 - protein, 9 aa, Homo Sapiens
MAEGGAAHL

SEQ ID NO: 11221 - protein, 9 aa, Homo Sapiens
LYRCDQDVC

SEQ ID NO: 11222 - protein, 9 aa, Homo Sapiens
RNPGMQIRH

SEQ ID NO: 11223 - protein, 9 aa, Homo Sapiens
QKPRQGRWV

SEQ ID NO: 11224 - protein, 9 aa, Homo Sapiens
PCTVPGSTM

SEQ ID NO: 11225 - protein, 9 aa, Homo Sapiens
DLTIDLKKA

SEQ ID NO: 11226 - protein, 9 aa, Homo Sapiens
YNRLRPLSY

SEQ ID NO: 11227 - protein, 9 aa, Homo Sapiens
LTLAEHLAG

SEQ ID NO: 11228 - protein, 9 aa, Homo Sapiens
PDCYYNLGC

SEQ ID NO: 11229 - protein, 9 aa, Homo Sapiens
MANILVVFA

SEQ ID NO: 11230 - protein, 9 aa, Homo Sapiens
FFFETESCS

SEQ ID NO: 11231 - protein, 9 aa, Homo Sapiens
RSRRARQSK

SEQ ID NO: 11232 - protein, 9 aa, Homo Sapiens
LRDALLSSR

SEQ ID NO: 11233 - protein, 9 aa, Homo Sapiens
LEGSLKIKE

SEQ ID NO: 11234 - protein, 9 aa, Homo Sapiens
GSGVRFPEL

SEQ ID NO: 11235 - protein, 9 aa, Homo Sapiens
METHVLHLK

SEQ ID NO: 11236 - protein, 9 aa, Homo Sapiens
LKKANAAAA

SEQ ID NO: 11237 - protein, 9 aa, Homo Sapiens
FSQPSHLTK

SEQ ID NO: 11238 - protein, 9 aa, Homo Sapiens
IIHGGTAFK

SEQ ID NO: 11239 - protein, 9 aa, Homo Sapiens
PAPIAPPSS

SEQ ID NO: 11240 - protein, 9 aa, Homo Sapiens
YNTLTYYSR

SEQ ID NO: 11241 - protein, 9 aa, Homo Sapiens
TEVGQPTCC

SEQ ID NO: 11242 - protein, 9 aa, Homo Sapiens
YKLTPGVDH

SEQ ID NO: 11243 - protein, 9 aa, Homo Sapiens
HLSPWLALG

SEQ ID NO: 11244 - protein, 9 aa, Homo Sapiens
RYLSLYNTL

SEQ ID NO: 11245 - protein, 9 aa, Homo Sapiens
IDNENCWHL

SEQ ID NO: 11246 - protein, 9 aa, Homo Sapiens
EMLPQSPAN

SEQ ID NO: 11247 - protein, 9 aa, Homo Sapiens
KRHMVSQLQ

SEQ ID NO: 11248 - protein, 9 aa, Homo Sapiens
ALPMGFGAH

SEQ ID NO: 11249 - protein, 9 aa, Homo Sapiens
GMVLLNYLG

SEQ ID NO: 11250 - protein, 9 aa, Homo Sapiens
GPTQESCGP

SEQ ID NO: 11251 - protein, 9 aa, Homo Sapiens
IVSKIFRNC

SEQ ID NO: 11252 - protein, 9 aa, Homo Sapiens
TFWPNFYQL

SEQ ID NO: 11253 - protein, 9 aa, Homo Sapiens
SGVRFPELV

SEQ ID NO: 11254 - protein, 9 aa, Homo Sapiens
GGVIIAGFN

SEQ ID NO: 11255 - protein, 9 aa, Homo Sapiens
QYSNWLLAR

SEQ ID NO: 11256 - protein, 9 aa, Homo Sapiens
IKSIIHGGT

SEQ ID NO: 11257 - protein, 9 aa, Homo Sapiens
TQTPLAMHQ

SEQ ID NO: 11258 - protein, 9 aa, Homo Sapiens
NDFAYMKNR

SEQ ID NO: 11259 - protein, 9 aa, Homo Sapiens
NRLRPLSYP

SEQ ID NO: 11260 - protein, 9 aa, Homo Sapiens
AQAIASCGS

SEQ ID NO: 11261 - protein, 9 aa, Homo Sapiens
KVEWLKNED

SEQ ID NO: 11262 - protein, 9 aa, Homo Sapiens
NTLTYYSRR

SEQ ID NO: 11263 - protein, 9 aa, Homo Sapiens
PMNQYNALN

SEQ ID NO: 11264 - protein, 9 aa, Homo Sapiens
SQPSHLTKH

SEQ ID NO: 11265 - protein, 9 aa, Homo Sapiens
LTGMIPANA

SEQ ID NO: 11266 - protein, 9 aa, Homo Sapiens
EVLKNCDIV

SEQ ID NO: 11267 - protein, 9 aa, Homo Sapiens
CDQDVCKTI

SEQ ID NO: 11268 - protein, 9 aa, Homo Sapiens
PVAKVEWLK

SEQ ID NO: 11269 - protein, 9 aa, Homo Sapiens
WEHSQNGCG

SEQ ID NO: 11270 - protein, 9 aa, Homo Sapiens
VDIFFFGMC

SEQ ID NO: 11271 - protein, 9 aa, Homo Sapiens
PQIVATASK

SEQ ID NO: 11272 - protein, 9 aa, Homo Sapiens
TTAASSGQP

SEQ ID NO: 11273 - protein, 9 aa, Homo Sapiens
HGDIFSSWN

SEQ ID NO: 11274 - protein, 9 aa, Homo Sapiens
PVGGVIIAG

SEQ ID NO: 11275 - protein, 9 aa, Homo Sapiens
TAGASIDNE

SEQ ID NO: 11276 - protein, 9 aa, Homo Sapiens
TWEQINTWD

SEQ ID NO: 11277 - protein, 9 aa, Homo Sapiens
LGPRGAGRR

SEQ ID NO: 11278 - protein, 9 aa, Homo Sapiens
GDIFSSWNI

SEQ ID NO: 11279 - protein, 9 aa, Homo Sapiens
YQLIFEVIT

SEQ ID NO: 11280 - protein, 9 aa, Homo Sapiens
AEEEGSLKL

SEQ ID NO: 11281 - protein, 9 aa, Homo Sapiens
MVSQLQNDL

SEQ ID NO: 11282 - protein, 9 aa, Homo Sapiens
NYATCLEGS

SEQ ID NO: 11283 - protein, 9 aa, Homo Sapiens
FAYMKNREE

SEQ ID NO: 11284 - protein, 9 aa, Homo Sapiens
YMKNREEEM

SEQ ID NO: 11285 - protein, 9 aa, Homo Sapiens
HISIYSGLT

SEQ ID NO: 11286 - protein, 9 aa, Homo Sapiens
HAVLRKTDL

SEQ ID NO: 11287 - protein, 9 aa, Homo Sapiens
RTMPCTVPG

SEQ ID NO: 11288 - protein, 9 aa, Homo Sapiens
LCQLTASTT

SEQ ID NO: 11289 - protein, 9 aa, Homo Sapiens
RCDQDVCKT

SEQ ID NO: 11290 - protein, 9 aa, Homo Sapiens
RNLALSPTG

SEQ ID NO: 11291 - protein, 9 aa, Homo Sapiens
FPRADPAPI

SEQ ID NO: 11292 - protein, 9 aa, Homo Sapiens
TINGHFLKK

SEQ ID NO: 11293 - protein, 9 aa, Homo Sapiens
SPGSGASQP

SEQ ID NO: 11294 - protein, 9 aa, Homo Sapiens
IDLKKANAA

SEQ ID NO: 11295 - protein, 9 aa, Homo Sapiens
TSFSSMMAK

SEQ ID NO: 11296 - protein, 9 aa, Homo Sapiens
YTSFSSMMA

SEQ ID NO: 11297 - protein, 9 aa, Homo Sapiens
CEKGFSQND

SEQ ID NO: 11298 - protein, 9 aa, Homo Sapiens
AWQAACTIV

SEQ ID NO: 11299 - protein, 9 aa, Homo Sapiens
GTWTFWILP

SEQ ID NO: 11300 - protein, 9 aa, Homo Sapiens
RNRCVITSR

SEQ ID NO: 11301 - protein, 9 aa, Homo Sapiens
TESLRDALL

SEQ ID NO: 11302 - protein, 9 aa, Homo Sapiens
QIRHWETLS

SEQ ID NO: 11303 - protein, 9 aa, Homo Sapiens
AMHQSEEDE

SEQ ID NO: 11304 - protein, 9 aa, Homo Sapiens
EWNLRREEG

SEQ ID NO: 11305 - protein, 9 aa, Homo Sapiens
IWSSVLIKH

SEQ ID NO: 11306 - protein, 9 aa, Homo Sapiens
LVDVDGHVT

SEQ ID NO: 11307 - protein, 9 aa, Homo Sapiens
WKIALPMGF

SEQ ID NO: 11308 - protein, 9 aa, Homo Sapiens
LSFPHTMEM

SEQ ID NO: 11309 - protein, 9 aa, Homo Sapiens
SWPRTVPFS

SEQ ID NO: 11310 - protein, 9 aa, Homo Sapiens
LEQNKTEVW

SEQ ID NO: 11311 - protein, 9 aa, Homo Sapiens
PIHVSRRLL

SEQ ID NO: 11312 - protein, 9 aa, Homo Sapiens
YLGVSREVF

SEQ ID NO: 11313 - protein, 9 aa, Homo Sapiens
GVRFPELVQ

SEQ ID NO: 11314 - protein, 9 aa, Homo Sapiens
ASPGSPGSP

SEQ ID NO: 11315 - protein, 9 aa, Homo Sapiens
FWEHSQNGC

SEQ ID NO: 11316 - protein, 9 aa, Homo Sapiens
RSRTMPCTV

SEQ ID NO: 11317 - protein, 9 aa, Homo Sapiens
VQEMLPQSP

SEQ ID NO: 11318 - protein, 9 aa, Homo Sapiens
LAEHLAGCT

SEQ ID NO: 11319 - protein, 9 aa, Homo Sapiens
RGPWGSRGN

SEQ ID NO: 11320 - protein, 9 aa, Homo Sapiens
PRTVPFSLE

SEQ ID NO: 11321 - protein, 9 aa, Homo Sapiens
LPMGFGAHI

SEQ ID NO: 11322 - protein, 9 aa, Homo Sapiens
FNSTIKILT

SEQ ID NO: 11323 - protein, 9 aa, Homo Sapiens
TAASSGQPD

SEQ ID NO: 11324 - protein, 9 aa, Homo Sapiens
LLMALDALL

SEQ ID NO: 11325 - protein, 9 aa, Homo Sapiens
TCGHGDIFS

SEQ ID NO: 11326 - protein, 9 aa, Homo Sapiens
LCVFWEHSQ

SEQ ID NO: 11327 - protein, 9 aa, Homo Sapiens
EGSLKIKEI

SEQ ID NO: 11328 - protein, 9 aa, Homo Sapiens
CKAYSVYNE

SEQ ID NO: 11329 - protein, 9 aa, Homo Sapiens
ASSNNSSSD

SEQ ID NO: 11330 - protein, 9 aa, Homo Sapiens
SHEALASSN

SEQ ID NO: 11331 - protein, 9 aa, Homo Sapiens
PLRCSSRRQ

SEQ ID NO: 11332 - protein, 9 aa, Homo Sapiens
EDLTIDLKK

SEQ ID NO: 11333 - protein, 9 aa, Homo Sapiens
ALRGILRPL

SEQ ID NO: 11334 - protein, 9 aa, Homo Sapiens
SMGGMVLLN

SEQ ID NO: 11335 - protein, 9 aa, Homo Sapiens
AKVEWLKNE

SEQ ID NO: 11336 - protein, 9 aa, Homo Sapiens
KPYIFLDAQ

SEQ ID NO: 11337 - protein, 9 aa, Homo Sapiens
KRVTILVEA

SEQ ID NO: 11338 - protein, 9 aa, Homo Sapiens
FIPKVCKTD

SEQ ID NO: 11339 - protein, 9 aa, Homo Sapiens
ALTLAEHLA

SEQ ID NO: 11340 - protein, 9 aa, Homo Sapiens
GQGKYICEE

SEQ ID NO: 11341 - protein, 9 aa, Homo Sapiens
KSIIHGGTA

SEQ ID NO: 11342 - protein, 9 aa, Homo Sapiens
RRQSITSHH

SEQ ID NO: 11343 - protein, 9 aa, Homo Sapiens
SGQPDRPCQ

SEQ ID NO: 11344 - protein, 9 aa, Homo Sapiens
SRRARQSKE

SEQ ID NO: 11345 - protein, 9 aa, Homo Sapiens
LDALLNSDS

SEQ ID NO: 11346 - protein, 9 aa, Homo Sapiens
RVLHTYQDS

SEQ ID NO: 11347 - protein, 9 aa, Homo Sapiens
KCMVGYVTA

SEQ ID NO: 11348 - protein, 9 aa, Homo Sapiens
SMKRHMVSQ

SEQ ID NO: 11349 - protein, 9 aa, Homo Sapiens
SSVLIKHQR

SEQ ID NO: 11350 - protein, 9 aa, Homo Sapiens
KAYSVYNED

SEQ ID NO: 11351 - protein, 9 aa, Homo Sapiens
LRGILRPLK

SEQ ID NO: 11352 - protein, 9 aa, Homo Sapiens
EALASSNNS

SEQ ID NO: 11353 - protein, 9 aa, Homo Sapiens
GYPGCTGAM

SEQ ID NO: 11354 - protein, 9 aa, Homo Sapiens
LLDVIPTDI

SEQ ID NO: 11355 - protein, 9 aa, Homo Sapiens
VEAGEIELF

SEQ ID NO: 11356 - protein, 9 aa, Homo Sapiens
IFFFGMCAL

SEQ ID NO: 11357 - protein, 9 aa, Homo Sapiens
AEHLAGCTF

SEQ ID NO: 11358 - protein, 9 aa, Homo Sapiens
WTFWILPIL

SEQ ID NO: 11359 - protein, 9 aa, Homo Sapiens
QAAWQAACT

SEQ ID NO: 11360 - protein, 9 aa, Homo Sapiens
SKIFRNCQC

SEQ ID NO: 11361 - protein, 9 aa, Homo Sapiens
GCLYADLNR

SEQ ID NO: 11362 - protein, 9 aa, Homo Sapiens
GEQSYKCKE

SEQ ID NO: 11363 - protein, 9 aa, Homo Sapiens
TDLRYTCQR

SEQ ID NO: 11364 - protein, 9 aa, Homo Sapiens
AASSGQPDR

SEQ ID NO: 11365 - protein, 9 aa, Homo Sapiens
MPCTVPGST

SEQ ID NO: 11366 - protein, 9 aa, Homo Sapiens
LLARNLALS

SEQ ID NO: 11367 - protein, 9 aa, Homo Sapiens
NGHFLKKPF

SEQ ID NO: 11368 - protein, 9 aa, Homo Sapiens
AVLGGVDLL

SEQ ID NO: 11369 - protein, 9 aa, Homo Sapiens
SNNSSSDHS

SEQ ID NO: 11370 - protein, 9 aa, Homo Sapiens
MKMMRDFSI

SEQ ID NO: 11371 - protein, 9 aa, Homo Sapiens
GRWVLLLGS

SEQ ID NO: 11372 - protein, 9 aa, Homo Sapiens
LFSLNPQNG

SEQ ID NO: 11373 - protein, 9 aa, Homo Sapiens
GTRPLNLAN

SEQ ID NO: 11374 - protein, 9 aa, Homo Sapiens
KFLYISGTV

SEQ ID NO: 11375 - protein, 9 aa, Homo Sapiens
ASIDNENCW

SEQ ID NO: 11376 - protein, 9 aa, Homo Sapiens
LLEHLSPWL

SEQ ID NO: 11377 - protein, 9 aa, Homo Sapiens
ETQTPLAMH

SEQ ID NO: 11378 - protein, 9 aa, Homo Sapiens
RKTDLRYTC

SEQ ID NO: 11379 - protein, 9 aa, Homo Sapiens
LKKPFPEST

SEQ ID NO: 11380 - protein, 9 aa, Homo Sapiens
ETESCSVAQ

SEQ ID NO: 11381 - protein, 9 aa, Homo Sapiens
LARFLSHLL

SEQ ID NO: 11382 - protein, 9 aa, Homo Sapiens
GAAHLDTQR

SEQ ID NO: 11383 - protein, 9 aa, Homo Sapiens
ILWRQDIYL

SEQ ID NO: 11384 - protein, 9 aa, Homo Sapiens
VFIPKVCKT

SEQ ID NO: 11385 - protein, 9 aa, Homo Sapiens
LIFEVITSG

SEQ ID NO: 11386 - protein, 9 aa, Homo Sapiens
NSTIKILTL

SEQ ID NO: 11387 - protein, 9 aa, Homo Sapiens
PYCEKGFSQ

SEQ ID NO: 11388 - protein, 9 aa, Homo Sapiens
TGMIPANAP

SEQ ID NO: 11389 - protein, 9 aa, Homo Sapiens
STCGHGDIF

SEQ ID NO: 11390 - protein, 9 aa, Homo Sapiens
CKFSGNHIS

SEQ ID NO: 11391 - protein, 9 aa, Homo Sapiens
SFSSMMAKS

SEQ ID NO: 11392 - protein, 9 aa, Homo Sapiens
GERSRTMPC

SEQ ID NO: 11393 - protein, 9 aa, Homo Sapiens
GQPDRPCQP

SEQ ID NO: 11394 - protein, 9 aa, Homo Sapiens
KKYYSHSAL

SEQ ID NO: 11395 - protein, 9 aa, Homo Sapiens
PMGFGAHIQ

SEQ ID NO: 11396 - protein, 9 aa, Homo Sapiens
WVPSNSNLA

SEQ ID NO: 11397 - protein, 9 aa, Homo Sapiens
FTPATQAAW

SEQ ID NO: 11398 - protein, 9 aa, Homo Sapiens
QEDYNRLRP

SEQ ID NO: 11399 - protein, 9 aa, Homo Sapiens
VDHSLQPQE

SEQ ID NO: 11400 - protein, 9 aa, Homo Sapiens
GETIFEINP

SEQ ID NO: 11401 - protein, 9 aa, Homo Sapiens
CMVGYVTAS

SEQ ID NO: 11402 - protein, 9 aa, Homo Sapiens
FPHTMEMMK

SEQ ID NO: 11403 - protein, 9 aa, Homo Sapiens
VLGGVDLLT

SEQ ID NO: 11404 - protein, 9 aa, Homo Sapiens
ESCGPRSLG

SEQ ID NO: 11405 - protein, 9 aa, Homo Sapiens
TILVEAGEI

SEQ ID NO: 11406 - protein, 9 aa, Homo Sapiens
RGILRPLKV

SEQ ID NO: 11407 - protein, 9 aa, Homo Sapiens
LVEAGEIEL

SEQ ID NO: 11408 - protein, 9 aa, Homo Sapiens
QLIFEVITS

SEQ ID NO: 11409 - protein, 9 aa, Homo Sapiens
NTIILVDVD

SEQ ID NO: 11410 - protein, 9 aa, Homo Sapiens
YRCDQDVCK

SEQ ID NO: 11411 - protein, 9 aa, Homo Sapiens
SLARFLSHL

SEQ ID NO: 11412 - protein, 9 aa, Homo Sapiens
GFPPRGPWG

SEQ ID NO: 11413 - protein, 9 aa, Homo Sapiens
PHTMEMMKI

SEQ ID NO: 11414 - protein, 9 aa, Homo Sapiens
QVITEVGQP

SEQ ID NO: 11415 - protein, 9 aa, Homo Sapiens
FLDAQRPSS

SEQ ID NO: 11416 - protein, 9 aa, Homo Sapiens
NQYNALNEA

SEQ ID NO: 11417 - protein, 9 aa, Homo Sapiens
DYNRLRPLS

SEQ ID NO: 11418 - protein, 9 aa, Homo Sapiens
WPNFYQLIF

SEQ ID NO: 11419 - protein, 9 aa, Homo Sapiens
YPGCTGAMA

SEQ ID NO: 11420 - protein, 9 aa, Homo Sapiens
HMETHVLHL

SEQ ID NO: 11421 - protein, 9 aa, Homo Sapiens
CSSRRQSIT

SEQ ID NO: 11422 - protein, 9 aa, Homo Sapiens
ELVQYLLDV

SEQ ID NO: 11423 - protein, 9 aa, Homo Sapiens
SSSPKATNR

SEQ ID NO: 11424 - protein, 9 aa, Homo Sapiens
CTGAMAESH

SEQ ID NO: 11425 - protein, 9 aa, Homo Sapiens
MGFGAHIQF

SEQ ID NO: 11426 - protein, 9 aa, Homo Sapiens
NRIGNTSGS

SEQ ID NO: 11427 - protein, 9 aa, Homo Sapiens
CACPSSKME

SEQ ID NO: 11428 - protein, 9 aa, Homo Sapiens
SSSPRTATA

SEQ ID NO: 11429 - protein, 9 aa, Homo Sapiens
ATALPVLTS

SEQ ID NO: 11430 - protein, 9 aa, Homo Sapiens
EPEDVAVLG

SEQ ID NO: 11431 - protein, 9 aa, Homo Sapiens
PEGIPVAKV

SEQ ID NO: 11432 - protein, 9 aa, Homo Sapiens
SFFGALHVC

SEQ ID NO: 11433 - protein, 9 aa, Homo Sapiens
SLSFPHTME

SEQ ID NO: 11434 - protein, 9 aa, Homo Sapiens
TKLCGQHRL

SEQ ID NO: 11435 - protein, 9 aa, Homo Sapiens
STTPYVRDV

SEQ ID NO: 11436 - protein, 9 aa, Homo Sapiens
WPRTVPFSL

SEQ ID NO: 11437 - protein, 9 aa, Homo Sapiens
DGPTQESCG

SEQ ID NO: 11438 - protein, 9 aa, Homo Sapiens
RQGRWVLLL

SEQ ID NO: 11439 - protein, 9 aa, Homo Sapiens
YATCLEGSL

SEQ ID NO: 11440 - protein, 9 aa, Homo Sapiens
HEALASSNN

SEQ ID NO: 11441 - protein, 9 aa, Homo Sapiens
LKTHYSVHG

SEQ ID NO: 11442 - protein, 9 aa, Homo Sapiens
YYEGEVNAG

SEQ ID NO: 11443 - protein, 9 aa, Homo Sapiens
FFGMCALEM

SEQ ID NO: 11444 - protein, 9 aa, Homo Sapiens
LLTKLCGQH

SEQ ID NO: 11445 - protein, 9 aa, Homo Sapiens
SRTMPCTVP

SEQ ID NO: 11446 - protein, 9 aa, Homo Sapiens
EDVAVLGGV

SEQ ID NO: 11447 - protein, 9 aa, Homo Sapiens
SQNGCGHWA

SEQ ID NO: 11448 - protein, 9 aa, Homo Sapiens
NIEWNLRRE

SEQ ID NO: 11449 - protein, 9 aa, Homo Sapiens
ALACYASIC

SEQ ID NO: 11450 - protein, 9 aa, Homo Sapiens
PGCTGAMAE

SEQ ID NO: 11451 - protein, 9 aa, Homo Sapiens
QGKYICEEC

SEQ ID NO: 11452 - protein, 9 aa, Homo Sapiens
VDVDGHVTF

SEQ ID NO: 11453 - protein, 9 aa, Homo Sapiens
AIASCGSAV

SEQ ID NO: 11454 - protein, 9 aa, Homo Sapiens
TYQDSRIHV

SEQ ID NO: 11455 - protein, 9 aa, Homo Sapiens
ILVEAGEIE

SEQ ID NO: 11456 - protein, 9 aa, Homo Sapiens
TAQAIASCG

SEQ ID NO: 11457 - protein, 9 aa, Homo Sapiens
SSSCVCACP

SEQ ID NO: 11458 - protein, 9 aa, Homo Sapiens
EGIPVAKVE

SEQ ID NO: 11459 - protein, 9 aa, Homo Sapiens
SLYRCDQDV

SEQ ID NO: 11460 - protein, 9 aa, Homo Sapiens
INTWDKPML

SEQ ID NO: 11461 - protein, 9 aa, Homo Sapiens
LNLANNTIL

SEQ ID NO: 11462 - protein, 9 aa, Homo Sapiens
RFLSHLLRR

SEQ ID NO: 11463 - protein, 9 aa, Homo Sapiens
SSLARFLSH

SEQ ID NO: 11464 - protein, 9 aa, Homo Sapiens
ANIEWNLRR

SEQ ID NO: 11465 - protein, 9 aa, Homo Sapiens
FIWSSVLIK

SEQ ID NO: 11466 - protein, 9 aa, Homo Sapiens
YYNLGCLYA

SEQ ID NO: 11467 - protein, 9 aa, Homo Sapiens
VHALTLAEH

SEQ ID NO: 11468 - protein, 9 aa, Homo Sapiens
AEITWVPSN

SEQ ID NO: 11469 - protein, 9 aa, Homo Sapiens
SLNPQNGSL

SEQ ID NO: 11470 - protein, 9 aa, Homo Sapiens
NCQCWEDRR

SEQ ID NO: 11471 - protein, 9 aa, Homo Sapiens
RADPAPIAP

SEQ ID NO: 11472 - protein, 9 aa, Homo Sapiens
RQSKEQAPL

SEQ ID NO: 11473 - protein, 9 aa, Homo Sapiens
DRYLSLYNT

SEQ ID NO: 11474 - protein, 9 aa, Homo Sapiens
TWDKPMLDQ

SEQ ID NO: 11475 - protein, 9 aa, Homo Sapiens
EKLMPQIVA

SEQ ID NO: 11476 - protein, 9 aa, Homo Sapiens
VCKTDAGLY

SEQ ID NO: 11477 - protein, 9 aa, Homo Sapiens
SSGQPDRPC

SEQ ID NO: 11478 - protein, 9 aa, Homo Sapiens
GSLKIKEIT

SEQ ID NO: 11479 - protein, 9 aa, Homo Sapiens
RDALLSSRS

SEQ ID NO: 11480 - protein, 9 aa, Homo Sapiens
NNSSSDHSG

SEQ ID NO: 11481 - protein, 9 aa, Homo Sapiens
GTAFKDGRL

SEQ ID NO: 11482 - protein, 9 aa, Homo Sapiens
AVIVQVITE

SEQ ID NO: 11483 - protein, 9 aa, Homo Sapiens
NVCSLYRCD

SEQ ID NO: 11484 - protein, 9 aa, Homo Sapiens
IFEINPHLQ

SEQ ID NO: 11485 - protein, 9 aa, Homo Sapiens
VEDLTIDLK

SEQ ID NO: 11486 - protein, 9 aa, Homo Sapiens
QHRLLRRLQ

SEQ ID NO: 11487 - protein, 9 aa, Homo Sapiens
LASSNNSSS

SEQ ID NO: 11488 - protein, 9 aa, Homo Sapiens
QPSHLTKHK

SEQ ID NO: 11489 - protein, 9 aa, Homo Sapiens
NPGMQIRHW

SEQ ID NO: 11490 - protein, 9 aa, Homo Sapiens
KPFPESTDN

SEQ ID NO: 11491 - protein, 9 aa, Homo Sapiens
DPMNQYNAL

SEQ ID NO: 11492 - protein, 9 aa, Homo Sapiens
FWILPILGG

SEQ ID NO: 11493 - protein, 9 aa, Homo Sapiens
AAWQAACTI

SEQ ID NO: 11494 - protein, 9 aa, Homo Sapiens
ALPVLTSTA

SEQ ID NO: 11495 - protein, 9 aa, Homo Sapiens
FKKYYSHSA

SEQ ID NO: 11496 - protein, 9 aa, Homo Sapiens
TLTYYSRRT

SEQ ID NO: 11497 - protein, 9 aa, Homo Sapiens
HTYQDSRIH

SEQ ID NO: 11498 - protein, 9 aa, Homo Sapiens
FMVPVGGVI

SEQ ID NO: 11499 - protein, 9 aa, Homo Sapiens
VAKVEWLKN

SEQ ID NO: 11500 - protein, 9 aa, Homo Sapiens
SCGSAVTHI

SEQ ID NO: 11501 - protein, 9 aa, Homo Sapiens
QLTASTTPY

SEQ ID NO: 11502 - protein, 9 aa, Homo Sapiens
MALDALLNS

SEQ ID NO: 11503 - protein, 9 aa, Homo Sapiens
PPLRCSSRR

SEQ ID NO: 11504 - protein, 9 aa, Homo Sapiens
VTASLSVFR

SEQ ID NO: 11505 - protein, 9 aa, Homo Sapiens
EIYEGTSKI

SEQ ID NO: 11506 - protein, 9 aa, Homo Sapiens
GMQIRHWET

SEQ ID NO: 11507 - protein, 9 aa, Homo Sapiens
PDRPCQPHA

SEQ ID NO: 11508 - protein, 9 aa, Homo Sapiens
IASCGSAVT

SEQ ID NO: 11509 - protein, 9 aa, Homo Sapiens
PYGHMETHV

SEQ ID NO: 11510 - protein, 9 aa, Homo Sapiens
VIVQVITEV

SEQ ID NO: 11511 - protein, 9 aa, Homo Sapiens
DPKPYIFLD

SEQ ID NO: 11512 - protein, 9 aa, Homo Sapiens
SLLMALDAL

SEQ ID NO: 11513 - protein, 9 aa, Homo Sapiens
ALLDVIPTD

SEQ ID NO: 11514 - protein, 9 aa, Homo Sapiens
WILPILGGQ

SEQ ID NO: 11515 - protein, 9 aa, Homo Sapiens
FPPRGPWGS

SEQ ID NO: 11516 - protein, 9 aa, Homo Sapiens
IVQEMLPQS

SEQ ID NO: 11517 - protein, 9 aa, Homo Sapiens
PLAMHQSEE

SEQ ID NO: 11518 - protein, 9 aa, Homo Sapiens
RFHEIHVAL

SEQ ID NO: 11519 - protein, 9 aa, Homo Sapiens
FHEIHVALA

SEQ ID NO: 11520 - protein, 9 aa, Homo Sapiens
WVLLLGSQQ

SEQ ID NO: 11521 - protein, 9 aa, Homo Sapiens
QDREKNGNE

SEQ ID NO: 11522 - protein, 9 aa, Homo Sapiens
RERDEKAGD

SEQ ID NO: 11523 - protein, 9 aa, Homo Sapiens
NHISIYSGL

SEQ ID NO: 11524 - protein, 9 aa, Homo Sapiens
SVYNEDIGY

SEQ ID NO: 11525 - protein, 9 aa, Homo Sapiens
TSKIQRLVI

SEQ ID NO: 11526 - protein, 9 aa, Homo Sapiens
LTASTTPYV

SEQ ID NO: 11527 - protein, 9 aa, Homo Sapiens
WNLRREEGI

SEQ ID NO: 11528 - protein, 9 aa, Homo Sapiens
TPATQAAWQ

SEQ ID NO: 11529 - protein, 9 aa, Homo Sapiens
SSPKATNRI

SEQ ID NO: 11530 - protein, 9 aa, Homo Sapiens
IHHLMKMMR

SEQ ID NO: 11531 - protein, 9 aa, Homo Sapiens
VITEVGQPT

SEQ ID NO: 11532 - protein, 9 aa, Homo Sapiens
VNMLTSFFG

SEQ ID NO: 11533 - protein, 9 aa, Homo Sapiens
EDYNRLRPL

SEQ ID NO: 11534 - protein, 9 aa, Homo Sapiens
DPLYTSFSS

SEQ ID NO: 11535 - protein, 9 aa, Homo Sapiens
DDPLYTSFS

SEQ ID NO: 11536 - protein, 9 aa, Homo Sapiens
HMVSQLQND

SEQ ID NO: 11537 - protein, 9 aa, Homo Sapiens
QINTWDKPM

SEQ ID NO: 11538 - protein, 9 aa, Homo Sapiens
TGAMAESHL

SEQ ID NO: 11539 - protein, 9 aa, Homo Sapiens
VGYVTASLS

SEQ ID NO: 11540 - protein, 9 aa, Homo Sapiens
TMPCTVPGS

SEQ ID NO: 11541 - protein, 9 aa, Homo Sapiens
TWQQSSLSV

SEQ ID NO: 11542 - protein, 9 aa, Homo Sapiens
RGETIFEIN

SEQ ID NO: 11543 - protein, 9 aa, Homo Sapiens
YQDSRIHVC

SEQ ID NO: 11544 - protein, 9 aa, Homo Sapiens
LCGQHRLLR

SEQ ID NO: 11545 - protein, 9 aa, Homo Sapiens
RRARQSKEQ

SEQ ID NO: 11546 - protein, 9 aa, Homo Sapiens
GHMETHVLH

SEQ ID NO: 11547 - protein, 9 aa, Homo Sapiens
QDSRIHVCL

SEQ ID NO: 11548 - protein, 9 aa, Homo Sapiens
AGYPGCTGA

SEQ ID NO: 11549 - protein, 9 aa, Homo Sapiens
VGGVIIAGF

SEQ ID NO: 11550 - protein, 9 aa, Homo Sapiens
SPRTATALP

SEQ ID NO: 11551 - protein, 9 aa, Homo Sapiens
KEALLDVIP

SEQ ID NO: 11552 - protein, 9 aa, Homo Sapiens
MQIRHWETL

SEQ ID NO: 11553 - protein, 9 aa, Homo Sapiens
LAMHQSEED

SEQ ID NO: 11554 - protein, 9 aa, Homo Sapiens
HLMKMMRDF

SEQ ID NO: 11555 - protein, 9 aa, Homo Sapiens
NPGTWTFWI

SEQ ID NO: 11556 - protein, 9 aa, Homo Sapiens
PEDVAVLGG

SEQ ID NO: 11557 - protein, 9 aa, Homo Sapiens
YLSLYNTLT

SEQ ID NO: 11558 - protein, 9 aa, Homo Sapiens
TDAGLYVAR

SEQ ID NO: 11559 - protein, 9 aa, Homo Sapiens
VLCVFWEHS

SEQ ID NO: 11560 - protein, 9 aa, Homo Sapiens
QLFSLNPQN

SEQ ID NO: 11561 - protein, 9 aa, Homo Sapiens
PPRGPWGSR

SEQ ID NO: 11562 - protein, 9 aa, Homo Sapiens
PKPYIFLDA

SEQ ID NO: 11563 - protein, 9 aa, Homo Sapiens
GPWGSRGNP

SEQ ID NO: 11564 - protein, 9 aa, Homo Sapiens
NMLTSFFGA

SEQ ID NO: 11565 - protein, 9 aa, Homo Sapiens
RRVLHTYQD

SEQ ID NO: 11566 - protein, 9 aa, Homo Sapiens
QGLRNPGMQ

SEQ ID NO: 11567 - protein, 9 aa, Homo Sapiens
LLGSTCGHG

SEQ ID NO: 11568 - protein, 9 aa, Homo Sapiens
DALLSSRSH

SEQ ID NO: 11569 - protein, 9 aa, Homo Sapiens
CVCACPSSK

SEQ ID NO: 11570 - protein, 9 aa, Homo Sapiens
YMDPMNQYN

SEQ ID NO: 11571 - protein, 9 aa, Homo Sapiens
DDRFHEIHV

SEQ ID NO: 11572 - protein, 9 aa, Homo Sapiens
TATALPVLT

SEQ ID NO: 11573 - protein, 9 aa, Homo Sapiens
SNWLLARNL

SEQ ID NO: 11574 - protein, 9 aa, Homo Sapiens
SQETESLRD

SEQ ID NO: 11575 - protein, 9 aa, Homo Sapiens
SNSNLAHAI

SEQ ID NO: 11576 - protein, 9 aa, Homo Sapiens
RGQGKYICE

SEQ ID NO: 11577 - protein, 9 aa, Homo Sapiens
SLSRERDEK

SEQ ID NO: 11578 - protein, 9 aa, Homo Sapiens
LDAQRPSSF

SEQ ID NO: 11579 - protein, 9 aa, Homo Sapiens
ANALACYAS

SEQ ID NO: 11580 - protein, 9 aa, Homo Sapiens
EVKPKAEEE

SEQ ID NO: 11581 - protein, 9 aa, Homo Sapiens
GVIIAGFND

SEQ ID NO: 11582 - protein, 9 aa, Homo Sapiens
LSVRWASRL

SEQ ID NO: 11583 - protein, 9 aa, Homo Sapiens
TGKEALLDV

SEQ ID NO: 11584 - protein, 9 aa, Homo Sapiens
PGMQIRHWE

SEQ ID NO: 11585 - protein, 9 aa, Homo Sapiens
TIFEINPHL

SEQ ID NO: 11586 - protein, 9 aa, Homo Sapiens
GTAVDIFFF

SEQ ID NO: 11587 - protein, 9 aa, Homo Sapiens
AALQKKTCG

SEQ ID NO: 11588 - protein, 9 aa, Homo Sapiens
VAVLGGVDL

SEQ ID NO: 11589 - protein, 9 aa, Homo Sapiens
PLNLANNTI

SEQ ID NO: 11590 - protein, 9 aa, Homo Sapiens
MVLLNYLGK

SEQ ID NO: 11591 - protein, 9 aa, Homo Sapiens
RRQDREKNG

SEQ ID NO: 11592 - protein, 9 aa, Homo Sapiens
KNREEEMVI

SEQ ID NO: 11593 - protein, 9 aa, Homo Sapiens
ICKAYSVYN

SEQ ID NO: 11594 - protein, 9 aa, Homo Sapiens
AYSVYNEDI

SEQ ID NO: 11595 - protein, 9 aa, Homo Sapiens
VPSNSNLAH

SEQ ID NO: 11596 - protein, 9 aa, Homo Sapiens
ATQAAWQAA

SEQ ID NO: 11597 - protein, 9 aa, Homo Sapiens
CKTDAGLYV

SEQ ID NO: 11598 - protein, 9 aa, Homo Sapiens
ERDEKAGDR

SEQ ID NO: 11599 - protein, 9 aa, Homo Sapiens
HGAMPPLRV

SEQ ID NO: 11600 - protein, 9 aa, Homo Sapiens
FFFFETESC

SEQ ID NO: 11601 - protein, 9 aa, Homo Sapiens
EDFKKYYSH

SEQ ID NO: 11602 - protein, 9 aa, Homo Sapiens
HLAGCTFQD

SEQ ID NO: 11603 - protein, 9 aa, Homo Sapiens
IFLDAQRPS

SEQ ID NO: 11604 - protein, 9 aa, Homo Sapiens
GSTCGHGDI

SEQ ID NO: 11605 - protein, 9 aa, Homo Sapiens
LGCLYADLN

SEQ ID NO: 11606 - protein, 9 aa, Homo Sapiens
VLRKTDLRY

SEQ ID NO: 11607 - protein, 9 aa, Homo Sapiens
AVDIFFFGM

SEQ ID NO: 11608 - protein, 9 aa, Homo Sapiens
DILWRQDIY

SEQ ID NO: 11609 - protein, 9 aa, Homo Sapiens
ENANALACY

SEQ ID NO: 11610 - protein, 9 aa, Homo Sapiens
SIDNENCWH

SEQ ID NO: 11611 - protein, 9 aa, Homo Sapiens
LHTYQDSRI

SEQ ID NO: 11612 - protein, 9 aa, Homo Sapiens
QSKEQAPLV

SEQ ID NO: 11613 - protein, 9 aa, Homo Sapiens
AGQEDYNRL

SEQ ID NO: 11614 - protein, 9 aa, Homo Sapiens
SHLTKHKRM

SEQ ID NO: 11615 - protein, 9 aa, Homo Sapiens
DEKAGDRGD

SEQ ID NO: 11616 - protein, 9 aa, Homo Sapiens
LEHLSPWLA

SEQ ID NO: 11617 - protein, 9 aa, Homo Sapiens
PANAPAQWR

SEQ ID NO: 11618 - protein, 9 aa, Homo Sapiens
FLKKPFPES

SEQ ID NO: 11619 - protein, 9 aa, Homo Sapiens
VHGAMPPLR

SEQ ID NO: 11620 - protein, 9 aa, Homo Sapiens
GGAAHLDTQ

SEQ ID NO: 11621 - protein, 9 aa, Homo Sapiens
PEDFKKYYS

SEQ ID NO: 11622 - protein, 9 aa, Homo Sapiens
SFLFFFFFF

SEQ ID NO: 11623 - protein, 9 aa, Homo Sapiens
MNQYNALNE

SEQ ID NO: 11624 - protein, 9 aa, Homo Sapiens
ACYASICQQ

SEQ ID NO: 11625 - protein, 9 aa, Homo Sapiens
SSRRQSITS

SEQ ID NO: 11626 - protein, 9 aa, Homo Sapiens
ARRQDREKN

SEQ ID NO: 11627 - protein, 9 aa, Homo Sapiens
LSKATVKAW

SEQ ID NO: 11628 - protein, 9 aa, Homo Sapiens
SQNDGLKMH

SEQ ID NO: 11629 - protein, 9 aa, Homo Sapiens
NLTGMIPAN

SEQ ID NO: 11630 - protein, 9 aa, Homo Sapiens
TPYVRDVGD

SEQ ID NO: 11631 - protein, 9 aa, Homo Sapiens
STIKILTLN

SEQ ID NO: 11632 - protein, 9 aa, Homo Sapiens
SPGSPGSGA

SEQ ID NO: 11633 - protein, 9 aa, Homo Sapiens
QQSSLSVRW

SEQ ID NO: 11634 - protein, 9 aa, Homo Sapiens
CGSAVTHIR

SEQ ID NO: 11635 - protein, 9 aa, Homo Sapiens
QNDGLKMHI

SEQ ID NO: 11636 - protein, 9 aa, Homo Sapiens
RQDREKNGN

SEQ ID NO: 11637 - protein, 9 aa, Homo Sapiens
FSGNHISIY

SEQ ID NO: 11638 - protein, 9 aa, Homo Sapiens
TPLAMHQSE

SEQ ID NO: 11639 - protein, 9 aa, Homo Sapiens
KLEKLMPQI

SEQ ID NO: 11640 - protein, 9 aa, Homo Sapiens
HHLMKMMRD

SEQ ID NO: 11641 - protein, 9 aa, Homo Sapiens
LIQDRPDQD

SEQ ID NO: 11642 - protein, 9 aa, Homo Sapiens
DFKKYYSHS

SEQ ID NO: 11643 - protein, 9 aa, Homo Sapiens
IILVDVDGH

SEQ ID NO: 11644 - protein, 9 aa, Homo Sapiens
WLIQDRPDQ

SEQ ID NO: 11645 - protein, 9 aa, Homo Sapiens
NRCVITSRP

SEQ ID NO: 11646 - protein, 9 aa, Homo Sapiens
RFPELVQYL

SEQ ID NO: 11647 - protein, 9 aa, Homo Sapiens
SSLSRERDE

SEQ ID NO: 11648 - protein, 9 aa, Homo Sapiens
ISGTVSIYL

SEQ ID NO: 11649 - protein, 9 aa, Homo Sapiens
VDSSSCVCA

SEQ ID NO: 11650 - protein, 9 aa, Homo Sapiens
ADPAPIAPP

SEQ ID NO: 11651 - protein, 9 aa, Homo Sapiens
FFGALHVCF

SEQ ID NO: 11652 - protein, 9 aa, Homo Sapiens
IYLGVSREV

SEQ ID NO: 11653 - protein, 9 aa, Homo Sapiens
LQKKTCGQR

SEQ ID NO: 11654 - protein, 9 aa, Homo Sapiens
MVPVGGVII

SEQ ID NO: 11655 - protein, 9 aa, Homo Sapiens
ASSGQPDRP

SEQ ID NO: 11656 - protein, 9 aa, Homo Sapiens
EALRHPIHV

SEQ ID NO: 11657 - protein, 9 aa, Homo Sapiens
FFETESCSV

SEQ ID NO: 11658 - protein, 9 aa, Homo Sapiens
GCTGAMAES

SEQ ID NO: 11659 - protein, 9 aa, Homo Sapiens
LGSTCGHGD

SEQ ID NO: 11660 - protein, 9 aa, Homo Sapiens
HPIHVSRRL

SEQ ID NO: 11661 - protein, 9 aa, Homo Sapiens
VYIVQEMLP

SEQ ID NO: 11662 - protein, 9 aa, Homo Sapiens
KKPFPESTD

SEQ ID NO: 11663 - protein, 9 aa, Homo Sapiens
KTDLRYTCQ

SEQ ID NO: 11664 - protein, 9 aa, Homo Sapiens
MGGMVLLNY

SEQ ID NO: 11665 - protein, 9 aa, Homo Sapiens
VRIRNRCVI

SEQ ID NO: 11666 - protein, 9 aa, Homo Sapiens
VFWEHSQNG

SEQ ID NO: 11667 - protein, 9 aa, Homo Sapiens
GRGQGKYIC

SEQ ID NO: 11668 - protein, 9 aa, Homo Sapiens
DRFHEIHVA

SEQ ID NO: 11669 - protein, 9 aa, Homo Sapiens
KKANAAAAA

SEQ ID NO: 11670 - protein, 9 aa, Homo Sapiens
LSSLARFLS

SEQ ID NO: 11671 - protein, 9 aa, Homo Sapiens
YNLGCLYAD

SEQ ID NO: 11672 - protein, 9 aa, Homo Sapiens
HYSVHGAMP

SEQ ID NO: 11673 - protein, 9 aa, Homo Sapiens
VLKNCDIVN

SEQ ID NO: 11674 - protein, 9 aa, Homo Sapiens
EGTSKIQRL

SEQ ID NO: 11675 - protein, 9 aa, Homo Sapiens
HSQNGCGHW

SEQ ID NO: 11676 - protein, 9 aa, Homo Sapiens
PVYIVQEML

SEQ ID NO: 11677 - protein, 9 aa, Homo Sapiens
YVYVRGRGQ

SEQ ID NO: 11678 - protein, 9 aa, Homo Sapiens
TTGKEALLD

SEQ ID NO: 11679 - protein, 9 aa, Homo Sapiens
RVTILVEAG

SEQ ID NO: 11680 - protein, 9 aa, Homo Sapiens
KNCDIVNWK

SEQ ID NO: 11681 - protein, 9 aa, Homo Sapiens
EKLEKLMPQ

SEQ ID NO: 11682 - protein, 9 aa, Homo Sapiens
TASTTPYVR

SEQ ID NO: 11683 - protein, 9 aa, Homo Sapiens
TFWILPILG

SEQ ID NO: 11684 - protein, 9 aa, Homo Sapiens
EIEARRQDR

SEQ ID NO: 11685 - protein, 9 aa, Homo Sapiens
KAWPSVLWC

SEQ ID NO: 11686 - protein, 9 aa, Homo Sapiens
KLMPQIVAT

SEQ ID NO: 11687 - protein, 9 aa, Homo Sapiens
IVQVITEVG

SEQ ID NO: 11688 - protein, 9 aa, Homo Sapiens
AEIEARRQD

SEQ ID NO: 11689 - protein, 9 aa, Homo Sapiens
TAFKDGRLR

SEQ ID NO: 11690 - protein, 9 aa, Homo Sapiens
LCLEQNKTE

SEQ ID NO: 11691 - protein, 9 aa, Homo Sapiens
PKATNRIGN

SEQ ID NO: 11692 - protein, 9 aa, Homo Sapiens
EAGEIELFD

SEQ ID NO: 11693 - protein, 9 aa, Homo Sapiens
ASCGSAVTH

SEQ ID NO: 11694 - protein, 9 aa, Homo Sapiens
ERSRTMPCT

SEQ ID NO: 11695 - protein, 9 aa, Homo Sapiens
THVLHLKPQ

SEQ ID NO: 11696 - protein, 9 aa, Homo Sapiens
EQSYKCKEC

SEQ ID NO: 11697 - protein, 9 aa, Homo Sapiens
YTGTRPLNL

SEQ ID NO: 11698 - protein, 9 aa, Homo Sapiens
FYQLIFEVI

SEQ ID NO: 11699 - protein, 9 aa, Homo Sapiens
ALASSNNSS

SEQ ID NO: 11700 - protein, 9 aa, Homo Sapiens
LTSFFGALH

SEQ ID NO: 11701 - protein, 9 aa, Homo Sapiens
NCDIVNWKQ

SEQ ID NO: 11702 - protein, 9 aa, Homo Sapiens
KLCGQHRLL

SEQ ID NO: 11703 - protein, 9 aa, Homo Sapiens
FGALHVCFI

SEQ ID NO: 11704 - protein, 9 aa, Homo Sapiens
VYVRGRGQG

SEQ ID NO: 11705 - protein, 9 aa, Homo Sapiens
CDIVNWKQR

SEQ ID NO: 11706 - protein, 9 aa, Homo Sapiens
NPHLQERVD

SEQ ID NO: 11707 - protein, 9 aa, Homo Sapiens
VKAWPSVLW

SEQ ID NO: 11708 - protein, 9 aa, Homo Sapiens
PPSGRMRSY

SEQ ID NO: 11709 - protein, 9 aa, Homo Sapiens
KGFSQNDGL

SEQ ID NO: 11710 - protein, 9 aa, Homo Sapiens
SCKFSGNHI

SEQ ID NO: 11711 - protein, 9 aa, Homo Sapiens
FPELVQYLL

SEQ ID NO: 11712 - protein, 9 aa, Homo Sapiens
NFYQLIFEV

SEQ ID NO: 11713 - protein, 9 aa, Homo Sapiens
PSNSNLAHA

SEQ ID NO: 11714 - protein, 9 aa, Homo Sapiens
QETESLRDA

SEQ ID NO: 11715 - protein, 9 aa, Homo Sapiens
AVLRKTDLR

SEQ ID NO: 11716 - protein, 9 aa, Homo Sapiens
TWVPSNSNL

SEQ ID NO: 11717 - protein, 9 aa, Homo Sapiens
MALRGILRP

SEQ ID NO: 11718 - protein, 9 aa, Homo Sapiens
ETIFEINPH

SEQ ID NO: 11719 - protein, 9 aa, Homo Sapiens
SSPRTATAL

SEQ ID NO: 11720 - protein, 9 aa, Homo Sapiens
KPKAEEEGS

SEQ ID NO: 11721 - protein, 9 aa, Homo Sapiens
TLAEHLAGC

SEQ ID NO: 11722 - protein, 9 aa, Homo Sapiens
GKFLYISGT

SEQ ID NO: 11723 - protein, 9 aa, Homo Sapiens
LNPQNGSLV

SEQ ID NO: 11724 - protein, 9 aa, Homo Sapiens
SGTVSIYLG

SEQ ID NO: 11725 - protein, 9 aa, Homo Sapiens
EIHVALAQK

SEQ ID NO: 11726 - protein, 9 aa, Homo Sapiens
QDIYLGVSR

SEQ ID NO: 11727 - protein, 9 aa, Homo Sapiens
GASIDNENC

SEQ ID NO: 11728 - protein, 9 aa, Homo Sapiens
EKGFSQNDG

SEQ ID NO: 11729 - protein, 9 aa, Homo Sapiens
VANIEWNLR

SEQ ID NO: 11730 - protein, 9 aa, Homo Sapiens
EQINTWDKP

SEQ ID NO: 11731 - protein, 9 aa, Homo Sapiens
PQNGSLVTA

SEQ ID NO: 11732 - protein, 9 aa, Homo Sapiens
YEGTSKIQR

SEQ ID NO: 11733 - protein, 9 aa, Homo Sapiens
SRRQSITSH

SEQ ID NO: 11734 - protein, 9 aa, Homo Sapiens
RIRNRCVIT

SEQ ID NO: 11735 - protein, 9 aa, Homo Sapiens
SKATVKAWP

SEQ ID NO: 11736 - protein, 9 aa, Homo Sapiens
GTVSIYLGL

SEQ ID NO: 11737 - protein, 9 aa, Homo Sapiens
MKNREEEMV

SEQ ID NO: 11738 - protein, 9 aa, Homo Sapiens
SPKATNRIG

SEQ ID NO: 11739 - protein, 9 aa, Homo Sapiens
AAHLDTQRS

SEQ ID NO: 11740 - protein, 9 aa, Homo Sapiens
FETESCSVA

SEQ ID NO: 11741 - protein, 9 aa, Homo Sapiens
SLSVRWASR

SEQ ID NO: 11742 - protein, 9 aa, Homo Sapiens
SLRDALLSS

SEQ ID NO: 11743 - protein, 9 aa, Homo Sapiens
ALQKKTCGQ

SEQ ID NO: 11744 - protein, 9 aa, Homo Sapiens
LYTSFSSMM

SEQ ID NO: 11745 - protein, 9 aa, Homo Sapiens
VLHLKPQVF

SEQ ID NO: 11746 - protein, 9 aa, Homo Sapiens
MLTSFFGAL

SEQ ID NO: 11747 - protein, 9 aa, Homo Sapiens
NAPAQWRAE

SEQ ID NO: 11748 - protein, 9 aa, Homo Sapiens
SFPHTMEMM

SEQ ID NO: 11749 - protein, 9 aa, Homo Sapiens
FEINPHLQE

SEQ ID NO: 11750 - protein, 9 aa, Homo Sapiens
AWPSVLWCY

SEQ ID NO: 11751 - protein, 9 aa, Homo Sapiens
EEVLKNCDI

SEQ ID NO: 11752 - protein, 9 aa, Homo Sapiens
ARFLSHLLR

SEQ ID NO: 11753 - protein, 9 aa, Homo Sapiens
QENANALAC

SEQ ID NO: 11754 - protein, 9 aa, Homo Sapiens
VVDSSSCVC

SEQ ID NO: 11755 - protein, 9 aa, Homo Sapiens
YVLKNVRLP

SEQ ID NO: 11756 - protein, 9 aa, Homo Sapiens
ANILVVFAR

SEQ ID NO: 11757 - protein, 9 aa, Homo Sapiens
LRCSSRRQS

SEQ ID NO: 11758 - protein, 9 aa, Homo Sapiens
AGVSMGGMV

SEQ ID NO: 11759 - protein, 9 aa, Homo Sapiens
VRGRGQGKY

SEQ ID NO: 11760 - protein, 9 aa, Homo Sapiens
GYVTASLSV

SEQ ID NO: 11761 - protein, 9 aa, Homo Sapiens
DLPEVKPKA

SEQ ID NO: 11762 - protein, 9 aa, Homo Sapiens
ELLEHLSPW

SEQ ID NO: 11763 - protein, 9 aa, Homo Sapiens
RASPGSPGS

SEQ ID NO: 11764 - protein, 9 aa, Homo Sapiens
QSYKCKECG

SEQ ID NO: 11765 - protein, 9 aa, Homo Sapiens
KETQTPLAM

SEQ ID NO: 11766 - protein, 9 aa, Homo Sapiens
YVTASLSVF

SEQ ID NO: 11767 - protein, 9 aa, Homo Sapiens
VSMGGMVLL

SEQ ID NO: 11768 - protein, 9 aa, Homo Sapiens
FFFGMCALE

SEQ ID NO: 11769 - protein, 9 aa, Homo Sapiens
ALRHPIHVS

SEQ ID NO: 11770 - protein, 9 aa, Homo Sapiens
TPGVDHSLQ

SEQ ID NO: 11771 - protein, 9 aa, Homo Sapiens
DNENCWHLD

SEQ ID NO: 11772 - protein, 9 aa, Homo Sapiens
MMRDFSILF

SEQ ID NO: 11773 - protein, 9 aa, Homo Sapiens
WQQSSLSVR

SEQ ID NO: 11774 - protein, 9 aa, Homo Sapiens
EHLAGCTFQ

SEQ ID NO: 11775 - protein, 9 aa, Homo Sapiens
CVITSRPRG

SEQ ID NO: 11776 - protein, 9 aa, Homo Sapiens
RNCQCWEDR

SEQ ID NO: 11777 - protein, 9 aa, Homo Sapiens
CVFWEHSQN

SEQ ID NO: 11778 - protein, 9 aa, Homo Sapiens
NWLLARNLA

SEQ ID NO: 11779 - protein, 9 aa, Homo Sapiens
DSSSCVCAC

SEQ ID NO: 11780 - protein, 9 aa, Homo Sapiens
ILVDVDGHV

SEQ ID NO: 11781 - protein, 9 aa, Homo Sapiens
TIDLKKANA

SEQ ID NO: 11782 - protein, 9 aa, Homo Sapiens
CSWKIALPM

SEQ ID NO: 11783 - protein, 9 aa, Homo Sapiens
TQESCGPRS

SEQ ID NO: 11784 - protein, 9 aa, Homo Sapiens
CQLTASTTP

SEQ ID NO: 11785 - protein, 9 aa, Homo Sapiens
GQEDYNRLR

SEQ ID NO: 11786 - protein, 9 aa, Homo Sapiens
HSLQPQELR

SEQ ID NO: 11787 - protein, 9 aa, Homo Sapiens
INTGMANIL

SEQ ID NO: 11788 - protein, 9 aa, Homo Sapiens
YIVQEMLPQ

SEQ ID NO: 11789 - protein, 9 aa, Homo Sapiens
DLKKANAAA

SEQ ID NO: 11790 - protein, 9 aa, Homo Sapiens
IQDRPDQDN

SEQ ID NO: 11791 - protein, 9 aa, Homo Sapiens
LSHLLRRPP

SEQ ID NO: 11792 - protein, 9 aa, Homo Sapiens
TKHKRMHTG

SEQ ID NO: 11793 - protein, 9 aa, Homo Sapiens
KIALPMGFG

SEQ ID NO: 11794 - protein, 9 aa, Homo Sapiens
ASPEDFKKY

SEQ ID NO: 11795 - protein, 9 aa, Homo Sapiens
PWGSRGNPS

SEQ ID NO: 11796 - protein, 9 aa, Homo Sapiens
EGEVNAGRI

SEQ ID NO: 11797 - protein, 9 aa, Homo Sapiens
GGTAFKDGR

SEQ ID NO: 11798 - protein, 9 aa, Homo Sapiens
CLYADLNRH

SEQ ID NO: 11799 - protein, 9 aa, Homo Sapiens
HFLKKPFPE

SEQ ID NO: 11800 - protein, 9 aa, Homo Sapiens
QTDDRFHEI

SEQ ID NO: 11801 - protein, 9 aa, Homo Sapiens
KVCKTDAGL

SEQ ID NO: 11802 - protein, 9 aa, Homo Sapiens
ETAQAIASC

SEQ ID NO: 11803 - protein, 9 aa, Homo Sapiens
MIPANAPAQ

SEQ ID NO: 11804 - protein, 9 aa, Homo Sapiens
IHVSRRLLS

SEQ ID NO: 11805 - protein, 9 aa, Homo Sapiens
IPKVCKTDA

SEQ ID NO: 11806 - protein, 9 aa, Homo Sapiens
GFPRADPAP

SEQ ID NO: 11807 - protein, 9 aa, Homo Sapiens
DFAYMKNRE

SEQ ID NO: 11808 - protein, 9 aa, Homo Sapiens
PYIFLDAQR

SEQ ID NO: 11809 - protein, 9 aa, Homo Sapiens
GILRPLKVR

SEQ ID NO: 11810 - protein, 9 aa, Homo Sapiens
MEMMKIFHK

SEQ ID NO: 11811 - protein, 9 aa, Homo Sapiens
KEQAPLVES

SEQ ID NO: 11812 - protein, 9 aa, Homo Sapiens
LEKLMPQIV

SEQ ID NO: 11813 - protein, 9 aa, Homo Sapiens
SLKIKEITY

SEQ ID NO: 11814 - protein, 9 aa, Homo Sapiens
TYYEGEVNA

SEQ ID NO: 11815 - protein, 9 aa, Homo Sapiens
GLRNPGMQI

SEQ ID NO: 11816 - protein, 9 aa, Homo Sapiens
TCLEGSLKI

SEQ ID NO: 11817 - protein, 9 aa, Homo Sapiens
TEIYEGTSK

SEQ ID NO: 11818 - protein, 9 aa, Homo Sapiens
TIILVDVDG

SEQ ID NO: 11819 - protein, 9 aa, Homo Sapiens
NLQTVNVNE

SEQ ID NO: 11820 - protein, 9 aa, Homo Sapiens
WLALGAMAG

SEQ ID NO: 11821 - protein, 9 aa, Homo Sapiens
TVKAWPSVL

SEQ ID NO: 11822 - protein, 9 aa, Homo Sapiens
EGGAAHLDT

SEQ ID NO: 11823 - protein, 9 aa, Homo Sapiens
SPWLALGAM

SEQ ID NO: 11824 - protein, 9 aa, Homo Sapiens
GLGPRGAGR

SEQ ID NO: 11825 - protein, 9 aa, Homo Sapiens
PGSPGSGAS

SEQ ID NO: 11826 - protein, 9 aa, Homo Sapiens
LVQYLLDVH

SEQ ID NO: 11827 - protein, 9 aa, Homo Sapiens
HLTKHKRMH

SEQ ID NO: 11828 - protein, 9 aa, Homo Sapiens
SEEVLKNCD

SEQ ID NO: 11829 - protein, 9 aa, Homo Sapiens
VLKNVRLPL

SEQ ID NO: 11830 - protein, 9 aa, Homo Sapiens
PGVDHSLQP

SEQ ID NO: 11831 - protein, 9 aa, Homo Sapiens
FSQNDGLKM

SEQ ID NO: 11832 - protein, 9 aa, Homo Sapiens
PTAGASIDN

SEQ ID NO: 11833 - protein, 9 aa, Homo Sapiens
CVANIEWNL

SEQ ID NO: 11834 - protein, 9 aa, Homo Sapiens
ITSRPRGVK

SEQ ID NO: 11835 - protein, 9 aa, Homo Sapiens
WLLARNLAL

SEQ ID NO: 11836 - protein, 9 aa, Homo Sapiens
AEGGAAHLD

SEQ ID NO: 11837 - protein, 9 aa, Homo Sapiens
TVPFSLEAL

SEQ ID NO: 11838 - protein, 9 aa, Homo Sapiens
IPVAKVEWL

SEQ ID NO: 11839 - protein, 9 aa, Homo Sapiens
GGMVLLNYL

SEQ ID NO: 11840 - protein, 9 aa, Homo Sapiens
VPVGGVIIA

SEQ ID NO: 11841 - protein, 9 aa, Homo Sapiens
SCVANIEWN

SEQ ID NO: 11842 - protein, 9 aa, Homo Sapiens
KTHYSVHGA

SEQ ID NO: 11843 - protein, 9 aa, Homo Sapiens
IALPMGFGA

SEQ ID NO: 11844 - protein, 9 aa, Homo Sapiens
VRFPELVQY

SEQ ID NO: 11845 - protein, 9 aa, Homo Sapiens
FSLNPQNGS

SEQ ID NO: 11846 - protein, 9 aa, Homo Sapiens
HLDTQRSDI

SEQ ID NO: 11847 - protein, 9 aa, Homo Sapiens
MRDFSILFY

SEQ ID NO: 11848 - protein, 9 aa, Homo Sapiens
TIKILTLNS

SEQ ID NO: 11849 - protein, 9 aa, Homo Sapiens
LRFNSTIKI

SEQ ID NO: 11850 - protein, 9 aa, Homo Sapiens
DREKNGNEE

SEQ ID NO: 11851 - protein, 9 aa, Homo Sapiens
ANAPAQWRA

SEQ ID NO: 11852 - protein, 9 aa, Homo Sapiens
QEMLPQSPA

SEQ ID NO: 11853 - protein, 9 aa, Homo Sapiens
VQVITEVGQ

SEQ ID NO: 11854 - protein, 9 aa, Homo Sapiens
CYYNLGCLY

SEQ ID NO: 11855 - protein, 9 aa, Homo Sapiens
VDGHVTFTE

SEQ ID NO: 11856 - protein, 9 aa, Homo Sapiens
EVGQPTCCR

SEQ ID NO: 11857 - protein, 9 aa, Homo Sapiens
WRYTGTRPL

SEQ ID NO: 11858 - protein, 9 aa, Homo Sapiens
LPQSPANIY

SEQ ID NO: 11859 - protein, 9 aa, Homo Sapiens
KNVRLPLLD

SEQ ID NO: 11860 - protein, 9 aa, Homo Sapiens
KFSGNHISI

SEQ ID NO: 11861 - protein, 9 aa, Homo Sapiens
EGKFLYISG

SEQ ID NO: 11862 - protein, 9 aa, Homo Sapiens
HVSRRLLSR

SEQ ID NO: 11863 - protein, 9 aa, Homo Sapiens
ETHVLHLKP

SEQ ID NO: 11864 - protein, 9 aa, Homo Sapiens
PFSLEALVG

SEQ ID NO: 11865 - protein, 9 aa, Homo Sapiens
MAALQKKTC

SEQ ID NO: 11866 - protein, 9 aa, Homo Sapiens
TNRIGNTSG

SEQ ID NO: 11867 - protein, 9 aa, Homo Sapiens
LSRERDEKA

SEQ ID NO: 11868 - protein, 9 aa, Homo Sapiens
QAIASCGSA

SEQ ID NO: 11869 - protein, 9 aa, Homo Sapiens
PEVKPKAEE

SEQ ID NO: 11870 - protein, 9 aa, Homo Sapiens
PRGPWGSRG

SEQ ID NO: 11871 - protein, 9 aa, Homo Sapiens
PLSSLARFL

SEQ ID NO: 11872 - protein, 9 aa, Homo Sapiens
GMANILVVF

SEQ ID NO: 11873 - protein, 9 aa, Homo Sapiens
AGDGPTQES

SEQ ID NO: 11874 - protein, 9 aa, Homo Sapiens
LSLYNTLTY

SEQ ID NO: 11875 - protein, 9 aa, Homo Sapiens
ARNLALSPT

SEQ ID NO: 11876 - protein, 9 aa, Homo Sapiens
TDPKPYIFL

SEQ ID NO: 11877 - protein, 9 aa, Homo Sapiens
YCEKGFSQN

SEQ ID NO: 11878 - protein, 9 aa, Homo Sapiens
TQAAWQAAC

SEQ ID NO: 11879 - protein, 9 aa, Homo Sapiens
KIQRLVIAG

SEQ ID NO: 11880 - protein, 9 aa, Homo Sapiens
PRTATALPV

SEQ ID NO: 11881 - protein, 9 aa, Homo Sapiens
PTQESCGPR

SEQ ID NO: 11882 - protein, 9 aa, Homo Sapiens
LTKLCGQHR

SEQ ID NO: 11883 - protein, 9 aa, Homo Sapiens
HALTLAEHL

SEQ ID NO: 11884 - protein, 9 aa, Homo Sapiens
SCGPRSLGS

SEQ ID NO: 11885 - protein, 9 aa, Homo Sapiens
CLLPYVLKN

SEQ ID NO: 11886 - protein, 9 aa, Homo Sapiens
TAVDIFFFG

SEQ ID NO: 11887 - protein, 9 aa, Homo Sapiens
WEQINTWDK

SEQ ID NO: 11888 - protein, 9 aa, Homo Sapiens
GVSMGGMVL

SEQ ID NO: 11889 - protein, 9 aa, Homo Sapiens
CSLLMALDA

SEQ ID NO: 11890 - protein, 9 aa, Homo Sapiens
LMALDALLN

SEQ ID NO: 11891 - protein, 9 aa, Homo Sapiens
SAEITWVPS

SEQ ID NO: 11892 - protein, 9 aa, Homo Sapiens
AHLDTQRSD

SEQ ID NO: 11893 - protein, 9 aa, Homo Sapiens
SKINTGMAN

SEQ ID NO: 11894 - protein, 9 aa, Homo Sapiens
RPDQDNDLR

SEQ ID NO: 11895 - protein, 9 aa, Homo Sapiens
HQAGYPGCT

SEQ ID NO: 11896 - protein, 9 aa, Homo Sapiens
HEIHVALAQ

SEQ ID NO: 11897 - protein, 9 aa, Homo Sapiens
WPSVLWCYK

SEQ ID NO: 11898 - protein, 9 aa, Homo Sapiens
VKPKAEEEG

SEQ ID NO: 11899 - protein, 9 aa, Homo Sapiens
NREEEMVIP

SEQ ID NO: 11900 - protein, 9 aa, Homo Sapiens
LKNCDIVNW

SEQ ID NO: 11901 - protein, 9 aa, Homo Sapiens
ITEVGQPTC

SEQ ID NO: 11902 - protein, 9 aa, Homo Sapiens
PLYTSFSSM

SEQ ID NO: 11903 - protein, 9 aa, Homo Sapiens
RSSLSRERD

SEQ ID NO: 11904 - protein, 9 aa, Homo Sapiens
GAMPPLRVQ

SEQ ID NO: 11905 - protein, 9 aa, Homo Sapiens
KNLQTVNVN

SEQ ID NO: 11906 - protein, 9 aa, Homo Sapiens
LWRQDIYLG

SEQ ID NO: 11907 - protein, 9 aa, Homo Sapiens
KINTGMANI

SEQ ID NO: 11908 - protein, 9 aa, Homo Sapiens
YEGEVNAGR

SEQ ID NO: 11909 - protein, 9 aa, Homo Sapiens
VCACPSSKM

SEQ ID NO: 11910 - protein, 9 aa, Homo Sapiens
ASTTPYVRD

SEQ ID NO: 11911 - protein, 9 aa, Homo Sapiens
TMEMMKIFH

SEQ ID NO: 11912 - protein, 9 aa, Homo Sapiens
GSPGSGASQ

SEQ ID NO: 11913 - protein, 9 aa, Homo Sapiens
DRPDQDNDL

SEQ ID NO: 11914 - protein, 9 aa, Homo Sapiens
ATNRIGNTS

SEQ ID NO: 11915 - protein, 9 aa, Homo Sapiens
TAGQEDYNR

SEQ ID NO: 11916 - protein, 9 aa, Homo Sapiens
GNHISIYSG

SEQ ID NO: 11917 - protein, 9 aa, Homo Sapiens
LRNPGMQIR

SEQ ID NO: 11918 - protein, 9 aa, Homo Sapiens
VLLNYLGKI

SEQ ID NO: 11919 - protein, 9 aa, Homo Sapiens
VPFSLEALV

SEQ ID NO: 11920 - protein, 9 aa, Homo Sapiens
VLHTYQDSR

SEQ ID NO: 11921 - protein, 9 aa, Homo Sapiens
RQSITSHHS

SEQ ID NO: 11922 - protein, 9 aa, Homo Sapiens
LYNTLTYYS

SEQ ID NO: 11923 - protein, 9 aa, Homo Sapiens
RTVPFSLEA

SEQ ID NO: 11924 - protein, 9 aa, Homo Sapiens
PDQDNDLRL

SEQ ID NO: 11925 - protein, 9 aa, Homo Sapiens
YNEDIGYCQ

SEQ ID NO: 11926 - protein, 9 aa, Homo Sapiens
ESLRDALLS

SEQ ID NO: 11927 - protein, 9 aa, Homo Sapiens
RCVITSRPR

SEQ ID NO: 11928 - protein, 9 aa, Homo Sapiens
NANALACYA

SEQ ID NO: 11929 - protein, 9 aa, Homo Sapiens
RGRGQGKYI

SEQ ID NO: 11930 - protein, 9 aa, Homo Sapiens
CGQHRLLRR

SEQ ID NO: 11931 - protein, 9 aa, Homo Sapiens
YSVHGAMPP

SEQ ID NO: 11932 - protein, 9 aa, Homo Sapiens
KPRQGRWVL

SEQ ID NO: 11933 - protein, 9 aa, Homo Sapiens
GSPGSPGSG

SEQ ID NO: 11934 - protein, 9 aa, Homo Sapiens
KATNRIGNT

SEQ ID NO: 11935 - protein, 9 aa, Homo Sapiens
PSHLTKHKR

SEQ ID NO: 11936 - protein, 9 aa, Homo Sapiens
WDKPMLDQA

SEQ ID NO: 11937 - protein, 9 aa, Homo Sapiens
IRRVLHTYQ

SEQ ID NO: 11938 - protein, 9 aa, Homo Sapiens
VTILVEAGE

SEQ ID NO: 11939 - protein, 9 aa, Homo Sapiens
KECGKAFGW

SEQ ID NO: 11940 - protein, 9 aa, Homo Sapiens
VRWASRLRA

SEQ ID NO: 11941 - protein, 9 aa, Homo Sapiens
LARNLALSP

SEQ ID NO: 11942 - protein, 9 aa, Homo Sapiens
GSNSMKRHM

SEQ ID NO: 11943 - protein, 9 aa, Homo Sapiens
GMIPANAPA

SEQ ID NO: 11944 - protein, 9 aa, Homo Sapiens
QIVATASKV

SEQ ID NO: 11945 - protein, 9 aa, Homo Sapiens
IFRNCQCWE

SEQ ID NO: 11946 - protein, 9 aa, Homo Sapiens
IHGGTAFKD

SEQ ID NO: 11947 - protein, 9 aa, Homo Sapiens
ILTYYEGEV

SEQ ID NO: 11948 - protein, 9 aa, Homo Sapiens
TWTFWILPI

SEQ ID NO: 11949 - protein, 9 aa, Homo Sapiens
CLEQNKTEV

SEQ ID NO: 11950 - protein, 9 aa, Homo Sapiens
EDDPLYTSF

SEQ ID NO: 11951 - protein, 9 aa, Homo Sapiens
LMPQIVATA

SEQ ID NO: 11952 - protein, 9 aa, Homo Sapiens
RCSSRRQSI

SEQ ID NO: 11953 - protein, 9 aa, Homo Sapiens
AYMKNREEE

SEQ ID NO: 11954 - protein, 9 aa, Homo Sapiens
YSVYNEDIG

SEQ ID NO: 11955 - protein, 9 aa, Homo Sapiens
RDEKAGDRG

SEQ ID NO: 11956 - protein, 9 aa, Homo Sapiens
TTPYVRDVG

SEQ ID NO: 11957 - protein, 9 aa, Homo Sapiens
CYASICQQN

SEQ ID NO: 11958 - protein, 9 aa, Homo Sapiens
TASLSVFRI

SEQ ID NO: 11959 - protein, 9 aa, Homo Sapiens
LRHPIHVSR

SEQ ID NO: 11960 - protein, 9 aa, Homo Sapiens
LEALRHPIH

SEQ ID NO: 11961 - protein, 9 aa, Homo Sapiens
SGNHISIYS

SEQ ID NO: 11962 - protein, 9 aa, Homo Sapiens
KYYSHSALL

SEQ ID NO: 11963 - protein, 9 aa, Homo Sapiens
EITWVPSNS

SEQ ID NO: 11964 - protein, 9 aa, Homo Sapiens
WRQDIYLGV

SEQ ID NO: 11965 - protein, 9 aa, Homo Sapiens
PKAEEEGSL

SEQ ID NO: 11966 - protein, 9 aa, Homo Sapiens
ISIYSGLTS

SEQ ID NO: 11967 - protein, 9 aa, Homo Sapiens
SVRWASRLR

SEQ ID NO: 11968 - protein, 9 aa, Homo Sapiens
ILRPLKVRR

SEQ ID NO: 11969 - protein, 9 aa, Homo Sapiens
LTIDLKKAN

SEQ ID NO: 11970 - protein, 9 aa, Homo Sapiens
RLRFNSTIK

SEQ ID NO: 11971 - protein, 9 aa, Homo Sapiens
YGHMETHVL

SEQ ID NO: 11972 - protein, 9 aa, Homo Sapiens
QKKTCGQRM

SEQ ID NO: 11973 - protein, 9 aa, Homo Sapiens
IEARRQDRE

SEQ ID NO: 11974 - protein, 9 aa, Homo Sapiens
RQDIYLGVS

SEQ ID NO: 11975 - protein, 9 aa, Homo Sapiens
SKIQRLVIA

SEQ ID NO: 11976 - protein, 9 aa, Homo Sapiens
NILVVFARG

SEQ ID NO: 11977 - protein, 9 aa, Homo Sapiens
MATTGKEAL

SEQ ID NO: 11978 - protein, 9 aa, Homo Sapiens
LQTVNVNEN

SEQ ID NO: 11979 - protein, 9 aa, Homo Sapiens
KHKRMHTGE

SEQ ID NO: 11980 - protein, 9 aa, Homo Sapiens
GHGDIFSSW

SEQ ID NO: 11981 - protein, 9 aa, Homo Sapiens
IYEGTSKIQ

SEQ ID NO: 11982 - protein, 9 aa, Homo Sapiens
INPHLQERV

SEQ ID NO: 11983 - protein, 9 aa, Homo Sapiens
TRPLNLANN

SEQ ID NO: 11984 - protein, 9 aa, Homo Sapiens
RARQSKEQA

SEQ ID NO: 11985 - protein, 9 aa, Homo Sapiens
VITSRPRGV

SEQ ID NO: 11986 - protein, 9 aa, Homo Sapiens
PNFYQLIFE

SEQ ID NO: 11987 - protein, 9 aa, Homo Sapiens
PYVLKNVRL

SEQ ID NO: 11988 - protein, 9 aa, Homo Sapiens
ELCLEQNKT

SEQ ID NO: 11989 - protein, 9 aa, Homo Sapiens
QNKTEVWER

SEQ ID NO: 11990 - protein, 9 aa, Homo Sapiens
IKILTLNSN

SEQ ID NO: 11991 - protein, 9 aa, Homo Sapiens
SSCVCACPS

SEQ ID NO: 11992 - protein, 9 aa, Homo Sapiens
LLPYVLKNV

SEQ ID NO: 11993 - protein, 9 aa, Homo Sapiens
GHFLKKPFP

SEQ ID NO: 11994 - protein, 9 aa, Homo Sapiens
MVGYVTASL

SEQ ID NO: 11995 - protein, 9 aa, Homo Sapiens
VIIAGFNDS

SEQ ID NO: 11996 - protein, 9 aa, Homo Sapiens
TNTIILVDV

SEQ ID NO: 11997 - protein, 9 aa, Homo Sapiens
RNPGTWTFW

SEQ ID NO: 11998 - protein, 9 aa, Homo Sapiens
EHLSPWLAL

SEQ ID NO: 11999 - protein, 9 aa, Homo Sapiens
CGHGDIFSS

SEQ ID NO: 12000 - protein, 9 aa, Homo Sapiens
PPEGIPVAK

SEQ ID NO: 12001 - protein, 9 aa, Homo Sapiens
DLRYTCQRE

SEQ ID NO: 12002 - protein, 9 aa, Homo Sapiens
PWLALGAMA

SEQ ID NO: 12003 - protein, 9 aa, Homo Sapiens
IRNRCVITS

SEQ ID NO: 12004 - protein, 9 aa, Homo Sapiens
SKEQAPLVE

SEQ ID NO: 12005 - protein, 9 aa, Homo Sapiens
NEDIGYCQG

SEQ ID NO: 12006 - protein, 9 aa, Homo Sapiens
QNGSLVTAG

SEQ ID NO: 12007 - protein, 9 aa, Homo Sapiens
ASCVANIEW

SEQ ID NO: 12008 - protein, 9 aa, Homo Sapiens
DPAPIAPPS

SEQ ID NO: 12009 - protein, 9 aa, Homo Sapiens
FLSHLLRRP

SEQ ID NO: 12010 - protein, 9 aa, Homo Sapiens
TALPVLTST

SEQ ID NO: 12011 - protein, 9 aa, Homo Sapiens
FRNCQCWED

SEQ ID NO: 12012 - protein, 9 aa, Homo Sapiens
NPQNGSLVT

SEQ ID NO: 12013 - protein, 9 aa, Homo Sapiens
QKCMVGYVT

SEQ ID NO: 12014 - protein, 9 aa, Homo Sapiens
QAGYPGCTG

SEQ ID NO: 12015 - protein, 9 aa, Homo Sapiens
GTSKIQRLV

SEQ ID NO: 12016 - protein, 9 aa, Homo Sapiens
IPANAPAQW

SEQ ID NO: 12017 - protein, 9 aa, Homo Sapiens
SSNNSSSDH

SEQ ID NO: 12018 - protein, 9 aa, Homo Sapiens
NENCWHLDE

SEQ ID NO: 12019 - protein, 9 aa, Homo Sapiens
LGGVDLLTL

SEQ ID NO: 12020 - protein, 9 aa, Homo Sapiens
LCLLPYVLK

SEQ ID NO: 12021 - protein, 9 aa, Homo Sapiens
GQHRLLRRL

SEQ ID NO: 12022 - protein, 9 aa, Homo Sapiens
DVAVLGGVD

SEQ ID NO: 12023 - protein, 9 aa, Homo Sapiens
DGTAVDIFF

SEQ ID NO: 12024 - protein, 9 aa, Homo Sapiens
EINPHLQER

SEQ ID NO: 12025 - protein, 9 aa, Homo Sapiens
KAEEEGSLK

SEQ ID NO: 12026 - protein, 9 aa, Homo Sapiens
QIHHLMKMM

SEQ ID NO: 12027 - protein, 9 aa, Homo Sapiens
VNDFAYMKN

SEQ ID NO: 12028 - protein, 9 aa, Homo Sapiens
DKPMLDQAV

SEQ ID NO: 12029 - protein, 9 aa, Homo Sapiens
MRGLGPRGA

SEQ ID NO: 12030 - protein, 9 aa, Homo Sapiens
AELCLEQNK

SEQ ID NO: 12031 - protein, 9 aa, Homo Sapiens
SPEDFKKYY

SEQ ID NO: 12032 - protein, 9 aa, Homo Sapiens
FSSMMAKSC

SEQ ID NO: 12033 - protein, 9 aa, Homo Sapiens
HRLLRRLQE

SEQ ID NO: 12034 - protein, 9 aa, Homo Sapiens
FSLEALVGL

SEQ ID NO: 12035 - protein, 9 aa, Homo Sapiens
INGHFLKKP

SEQ ID NO: 12036 - protein, 9 aa, Homo Sapiens
HVLHLKPQV

SEQ ID NO: 12037 - protein, 9 aa, Homo Sapiens
ARQSKEQAP

SEQ ID NO: 12038 - protein, 9 aa, Homo Sapiens
FLYISGTVS

SEQ ID NO: 12039 - protein, 9 aa, Homo Sapiens
RPLNLANNT

SEQ ID NO: 12040 - protein, 9 aa, Homo Sapiens
TGMANILVV

SEQ ID NO: 12041 - protein, 9 aa, Homo Sapiens
KATVKAWPS

SEQ ID NO: 12042 - protein, 9 aa, Homo Sapiens
SYMDPMNQY

SEQ ID NO: 12043 - protein, 9 aa, Homo Sapiens
KIFRNCQCW

SEQ ID NO: 12044 - protein, 9 aa, Homo Sapiens
PRADPAPIA

SEQ ID NO: 12045 - protein, 9 aa, Homo Sapiens
LPYVLKNVR

SEQ ID NO: 12046 - protein, 9 aa, Homo Sapiens
ATTGKEALL

SEQ ID NO: 12047 - protein, 9 aa, Homo Sapiens
NALACYASI

SEQ ID NO: 12048 - protein, 9 aa, Homo Sapiens
RYTGTRPLN

SEQ ID NO: 12049 - protein, 9 aa, Homo Sapiens
NTWDKPMLD

SEQ ID NO: 12050 - protein, 9 aa, Homo Sapiens
LPEVKPKAE

SEQ ID NO: 12051 - protein, 9 aa, Homo Sapiens
RFNSTIKIL

SEQ ID NO: 12052 - protein, 9 aa, Homo Sapiens
LTKHKRMHT

SEQ ID NO: 12053 - protein, 9 aa, Homo Sapiens
TDDRFHEIH

SEQ ID NO: 12054 - protein, 9 aa, Homo Sapiens
LMKMMRDFS

SEQ ID NO: 12055 - protein, 9 aa, Homo Sapiens
DQDNDLRLA

SEQ ID NO: 12056 - protein, 9 aa, Homo Sapiens
PGTWTFWIL

SEQ ID NO: 12057 - protein, 9 aa, Homo Sapiens
TDARSLKRH

SEQ ID NO: 12058 - protein, 9 aa, Homo Sapiens
TTLHLACQK

SEQ ID NO: 12059 - protein, 9 aa, Homo Sapiens
MTIKDSKVQ

SEQ ID NO: 12060 - protein, 9 aa, Homo Sapiens
IWLLILSYV

SEQ ID NO: 12061 - protein, 9 aa, Homo Sapiens
YKREILERG

SEQ ID NO: 12062 - protein, 9 aa, Homo Sapiens
QERSQAEED

SEQ ID NO: 12063 - protein, 9 aa, Homo Sapiens
AQMARRLHP

SEQ ID NO: 12064 - protein, 9 aa, Homo Sapiens
TCGVAWTDA

SEQ ID NO: 12065 - protein, 9 aa, Homo Sapiens
GGRGSPESE

SEQ ID NO: 12066 - protein, 9 aa, Homo Sapiens
LGSHFEFPN

SEQ ID NO: 12067 - protein, 9 aa, Homo Sapiens
EEPRGEIRN

SEQ ID NO: 12068 - protein, 9 aa, Homo Sapiens
SENYNELLE

SEQ ID NO: 12069 - protein, 9 aa, Homo Sapiens
CHLGLTAEP

SEQ ID NO: 12070 - protein, 9 aa, Homo Sapiens
IPVPHGRKG

SEQ ID NO: 12071 - protein, 9 aa, Homo Sapiens
NVQKQKRSF

SEQ ID NO: 12072 - protein, 9 aa, Homo Sapiens
RRKRTNRIF

SEQ ID NO: 12073 - protein, 9 aa, Homo Sapiens
LLEEPRGEI

SEQ ID NO: 12074 - protein, 9 aa, Homo Sapiens
DLLEILMEA

SEQ ID NO: 12075 - protein, 9 aa, Homo Sapiens
ATQAPPPPP

SEQ ID NO: 12076 - protein, 9 aa, Homo Sapiens
NDDDSDDRD

SEQ ID NO: 12077 - protein, 9 aa, Homo Sapiens
QSMDRGNRQ

SEQ ID NO: 12078 - protein, 9 aa, Homo Sapiens
HRELCFGVD

SEQ ID NO: 12079 - protein, 9 aa, Homo Sapiens
PVRVTSSIQ

SEQ ID NO: 12080 - protein, 9 aa, Homo Sapiens
YAARDKSEL

SEQ ID NO: 12081 - protein, 9 aa, Homo Sapiens
LGAGLVLSL

SEQ ID NO: 12082 - protein, 9 aa, Homo Sapiens
TDYHGATTL

SEQ ID NO: 12083 - protein, 9 aa, Homo Sapiens
KNPLYLHVG

SEQ ID NO: 12084 - protein, 9 aa, Homo Sapiens
IGHTAKKLG

SEQ ID NO: 12085 - protein, 9 aa, Homo Sapiens
HTVALYTGL

SEQ ID NO: 12086 - protein, 9 aa, Homo Sapiens
TEDQCFPQL

SEQ ID NO: 12087 - protein, 9 aa, Homo Sapiens
CLRKLNARR

SEQ ID NO: 12088 - protein, 9 aa, Homo Sapiens
ELTFSNATK

SEQ ID NO: 12089 - protein, 9 aa, Homo Sapiens
DIDEIRKSY

SEQ ID NO: 12090 - protein, 9 aa, Homo Sapiens
PLAKMAQMA

SEQ ID NO: 12091 - protein, 9 aa, Homo Sapiens
TSPVEDHGS

SEQ ID NO: 12092 - protein, 9 aa, Homo Sapiens
KLWKNICQE

SEQ ID NO: 12093 - protein, 9 aa, Homo Sapiens
ERRGFRWWV

SEQ ID NO: 12094 - protein, 9 aa, Homo Sapiens
PGAQAPQEL

SEQ ID NO: 12095 - protein, 9 aa, Homo Sapiens
FWYLEQIRR

SEQ ID NO: 12096 - protein, 9 aa, Homo Sapiens
SIGHTAKKL

SEQ ID NO: 12097 - protein, 9 aa, Homo Sapiens
AYAARDKSE

SEQ ID NO: 12098 - protein, 9 aa, Homo Sapiens
GLTAEPELY

SEQ ID NO: 12099 - protein, 9 aa, Homo Sapiens
KQCEMIKAR

SEQ ID NO: 12100 - protein, 9 aa, Homo Sapiens
GSCLDLLEI

SEQ ID NO: 12101 - protein, 9 aa, Homo Sapiens
VTSSIQPLP

SEQ ID NO: 12102 - protein, 9 aa, Homo Sapiens
VPGLGNVCG

SEQ ID NO: 12103 - protein, 9 aa, Homo Sapiens
SHICTDNVN

SEQ ID NO: 12104 - protein, 9 aa, Homo Sapiens
FCSIVPLGI

SEQ ID NO: 12105 - protein, 9 aa, Homo Sapiens
RRLLGKQMG

SEQ ID NO: 12106 - protein, 9 aa, Homo Sapiens
AWQSDSSSA

SEQ ID NO: 12107 - protein, 9 aa, Homo Sapiens
LAPLTEAQK

SEQ ID NO: 12108 - protein, 9 aa, Homo Sapiens
DQCFPQLRL

SEQ ID NO: 12109 - protein, 9 aa, Homo Sapiens
ERSQAEEDI

SEQ ID NO: 12110 - protein, 9 aa, Homo Sapiens
KVAAGARFT

SEQ ID NO: 12111 - protein, 9 aa, Homo Sapiens
ELCFGVDLP

SEQ ID NO: 12112 - protein, 9 aa, Homo Sapiens
AVAATPALP

SEQ ID NO: 12113 - protein, 9 aa, Homo Sapiens
EKPFEYNKC

SEQ ID NO: 12114 - protein, 9 aa, Homo Sapiens
FHLGNLREV

SEQ ID NO: 12115 - protein, 9 aa, Homo Sapiens
TPGAQAPQE

SEQ ID NO: 12116 - protein, 9 aa, Homo Sapiens
LRNINLRFN

SEQ ID NO: 12117 - protein, 9 aa, Homo Sapiens
CDEKAFVFS

SEQ ID NO: 12118 - protein, 9 aa, Homo Sapiens
NDLISKMEK

SEQ ID NO: 12119 - protein, 9 aa, Homo Sapiens
SSGVRRSFC

SEQ ID NO: 12120 - protein, 9 aa, Homo Sapiens
CVSYQQEIF

SEQ ID NO: 12121 - protein, 9 aa, Homo Sapiens
SPVEDHGSL

SEQ ID NO: 12122 - protein, 9 aa, Homo Sapiens
QSDSSSASR

SEQ ID NO: 12123 - protein, 9 aa, Homo Sapiens
GYKERISTA

SEQ ID NO: 12124 - protein, 9 aa, Homo Sapiens
DGMTIKDSK

SEQ ID NO: 12125 - protein, 9 aa, Homo Sapiens
HICTDNVNT

SEQ ID NO: 12126 - protein, 9 aa, Homo Sapiens
RELCFGVDL

SEQ ID NO: 12127 - protein, 9 aa, Homo Sapiens
EVLRFCSIV

SEQ ID NO: 12128 - protein, 9 aa, Homo Sapiens
VALYTGLLL

SEQ ID NO: 12129 - protein, 9 aa, Homo Sapiens
LYTGLLLLA

SEQ ID NO: 12130 - protein, 9 aa, Homo Sapiens
NLKIKGQLL

SEQ ID NO: 12131 - protein, 9 aa, Homo Sapiens
TKCGVDTNN

SEQ ID NO: 12132 - protein, 9 aa, Homo Sapiens
VRVTSSIQP

SEQ ID NO: 12133 - protein, 9 aa, Homo Sapiens
RRVCPRPRA

SEQ ID NO: 12134 - protein, 9 aa, Homo Sapiens
GAGLVLSLW

SEQ ID NO: 12135 - protein, 9 aa, Homo Sapiens
PELNVQKQK

SEQ ID NO: 12136 - protein, 9 aa, Homo Sapiens
EDYAVVVCR

SEQ ID NO: 12137 - protein, 9 aa, Homo Sapiens
ADEPTPGAQ

SEQ ID NO: 12138 - protein, 9 aa, Homo Sapiens
LDLLEILME

SEQ ID NO: 12139 - protein, 9 aa, Homo Sapiens
TFNLKIKGQ

SEQ ID NO: 12140 - protein, 9 aa, Homo Sapiens
QKLKRLEGG

SEQ ID NO: 12141 - protein, 9 aa, Homo Sapiens
PLYLHVGMD

SEQ ID NO: 12142 - protein, 9 aa, Homo Sapiens
GFWYLEQIR

SEQ ID NO: 12143 - protein, 9 aa, Homo Sapiens
SSFCGGALE

SEQ ID NO: 12144 - protein, 9 aa, Homo Sapiens
CEMIKARHQ

SEQ ID NO: 12145 - protein, 9 aa, Homo Sapiens
LDAFVPVQS

SEQ ID NO: 12146 - protein, 9 aa, Homo Sapiens
FEYNKCGKT

SEQ ID NO: 12147 - protein, 9 aa, Homo Sapiens
LFGLCPTRA

SEQ ID NO: 12148 - protein, 9 aa, Homo Sapiens
YCIYIYKVL

SEQ ID NO: 12149 - protein, 9 aa, Homo Sapiens
LKNKFGTDY

SEQ ID NO: 12150 - protein, 9 aa, Homo Sapiens
YDRDKLFGL

SEQ ID NO: 12151 - protein, 9 aa, Homo Sapiens
QLAATPKKA

SEQ ID NO: 12152 - protein, 9 aa, Homo Sapiens
KSELIQLGI

SEQ ID NO: 12153 - protein, 9 aa, Homo Sapiens
PALRNINLR

SEQ ID NO: 12154 - protein, 9 aa, Homo Sapiens
GLGNVCGIC

SEQ ID NO: 12155 - protein, 9 aa, Homo Sapiens
YGNSLLEEP

SEQ ID NO: 12156 - protein, 9 aa, Homo Sapiens
EPTPGAQAP

SEQ ID NO: 12157 - protein, 9 aa, Homo Sapiens
VKTLFVVEI

SEQ ID NO: 12158 - protein, 9 aa, Homo Sapiens
GNSLLEEPR

SEQ ID NO: 12159 - protein, 9 aa, Homo Sapiens
MLSSFCGGA

SEQ ID NO: 12160 - protein, 9 aa, Homo Sapiens
SQILPFPNP

SEQ ID NO: 12161 - protein, 9 aa, Homo Sapiens
EELLNVCRE

SEQ ID NO: 12162 - protein, 9 aa, Homo Sapiens
MTPQKLWKN

SEQ ID NO: 12163 - protein, 9 aa, Homo Sapiens
GSHFEFPNY

SEQ ID NO: 12164 - protein, 9 aa, Homo Sapiens
TPLMLSSFC

SEQ ID NO: 12165 - protein, 9 aa, Homo Sapiens
AGGETKEVT

SEQ ID NO: 12166 - protein, 9 aa, Homo Sapiens
ADIPEFLFQ

SEQ ID NO: 12167 - protein, 9 aa, Homo Sapiens
RNLAPLTEA

SEQ ID NO: 12168 - protein, 9 aa, Homo Sapiens
QHLSSSSEV

SEQ ID NO: 12169 - protein, 9 aa, Homo Sapiens
QILPFPNPE

SEQ ID NO: 12170 - protein, 9 aa, Homo Sapiens
QVWQKLKRL

SEQ ID NO: 12171 - protein, 9 aa, Homo Sapiens
NPHLTEDQC

SEQ ID NO: 12172 - protein, 9 aa, Homo Sapiens
EDDNDDDSD

SEQ ID NO: 12173 - protein, 9 aa, Homo Sapiens
AADGMTIKD

SEQ ID NO: 12174 - protein, 9 aa, Homo Sapiens
LHTVALYTG

SEQ ID NO: 12175 - protein, 9 aa, Homo Sapiens
YKERISTAK

SEQ ID NO: 12176 - protein, 9 aa, Homo Sapiens
FEFPNYCTP

SEQ ID NO: 12177 - protein, 9 aa, Homo Sapiens
SSASRALDE

SEQ ID NO: 12178 - protein, 9 aa, Homo Sapiens
FKVDSSAQS

SEQ ID NO: 12179 - protein, 9 aa, Homo Sapiens
IKDSKVQVS

SEQ ID NO: 12180 - protein, 9 aa, Homo Sapiens
NQRRKRTNR

SEQ ID NO: 12181 - protein, 9 aa, Homo Sapiens
AGRDSHIQS

SEQ ID NO: 12182 - protein, 9 aa, Homo Sapiens
EGGRGSPES

SEQ ID NO: 12183 - protein, 9 aa, Homo Sapiens
SFCKSPEHP

SEQ ID NO: 12184 - protein, 9 aa, Homo Sapiens
QMARRLHPP

SEQ ID NO: 12185 - protein, 9 aa, Homo Sapiens
CTKCGVDTN

SEQ ID NO: 12186 - protein, 9 aa, Homo Sapiens
GPRTAALRL

SEQ ID NO: 12187 - protein, 9 aa, Homo Sapiens
AGGSENYNE

SEQ ID NO: 12188 - protein, 9 aa, Homo Sapiens
RAATAPCSS

SEQ ID NO: 12189 - protein, 9 aa, Homo Sapiens
AGLGAGLVL

SEQ ID NO: 12190 - protein, 9 aa, Homo Sapiens
LERGGWPAT

SEQ ID NO: 12191 - protein, 9 aa, Homo Sapiens
NVNTGIANT

SEQ ID NO: 12192 - protein, 9 aa, Homo Sapiens
PSSQDPVAG

SEQ ID NO: 12193 - protein, 9 aa, Homo Sapiens
GFTPLMLSS

SEQ ID NO: 12194 - protein, 9 aa, Homo Sapiens
ALRLLLLCA

SEQ ID NO: 12195 - protein, 9 aa, Homo Sapiens
SKILKKAEK

SEQ ID NO: 12196 - protein, 9 aa, Homo Sapiens
FGLCPTRAD

SEQ ID NO: 12197 - protein, 9 aa, Homo Sapiens
TNGLCIWLL

SEQ ID NO: 12198 - protein, 9 aa, Homo Sapiens
QAEEDIDEI

SEQ ID NO: 12199 - protein, 9 aa, Homo Sapiens
SQAEEDIDE

SEQ ID NO: 12200 - protein, 9 aa, Homo Sapiens
RKESYCIYI

SEQ ID NO: 12201 - protein, 9 aa, Homo Sapiens
ISTAKVAEP

SEQ ID NO: 12202 - protein, 9 aa, Homo Sapiens
TPTLDTMGL

SEQ ID NO: 12203 - protein, 9 aa, Homo Sapiens
HGTSPVEDH

SEQ ID NO: 12204 - protein, 9 aa, Homo Sapiens
GKIDVKTLF

SEQ ID NO: 12205 - protein, 9 aa, Homo Sapiens
EAKVAAGAR

SEQ ID NO: 12206 - protein, 9 aa, Homo Sapiens
RISTAKVAE

SEQ ID NO: 12207 - protein, 9 aa, Homo Sapiens
CRIRASSPR

SEQ ID NO: 12208 - protein, 9 aa, Homo Sapiens
HGRKGKKVK

SEQ ID NO: 12209 - protein, 9 aa, Homo Sapiens
HIQSCQDLT

SEQ ID NO: 12210 - protein, 9 aa, Homo Sapiens
LCIWLLILS

SEQ ID NO: 12211 - protein, 9 aa, Homo Sapiens
TPSSQDPVA

SEQ ID NO: 12212 - protein, 9 aa, Homo Sapiens
NINLRFNPL

SEQ ID NO: 12213 - protein, 9 aa, Homo Sapiens
DKSELIQLG

SEQ ID NO: 12214 - protein, 9 aa, Homo Sapiens
TFSNATKSA

SEQ ID NO: 12215 - protein, 9 aa, Homo Sapiens
PVKKAKKQL

SEQ ID NO: 12216 - protein, 9 aa, Homo Sapiens
LLLLCVSYQ

SEQ ID NO: 12217 - protein, 9 aa, Homo Sapiens
EEEEEDDND

SEQ ID NO: 12218 - protein, 9 aa, Homo Sapiens
DSKVQVSFC

SEQ ID NO: 12219 - protein, 9 aa, Homo Sapiens
LEQIRREQY

SEQ ID NO: 12220 - protein, 9 aa, Homo Sapiens
EHPGLSIGH

SEQ ID NO: 12221 - protein, 9 aa, Homo Sapiens
EEEEDDNDD

SEQ ID NO: 12222 - protein, 9 aa, Homo Sapiens
RKAKVEAKV

SEQ ID NO: 12223 - protein, 9 aa, Homo Sapiens
NVCRELMSV

SEQ ID NO: 12224 - protein, 9 aa, Homo Sapiens
LKKAEKDGF

SEQ ID NO: 12225 - protein, 9 aa, Homo Sapiens
KKAKKQLAA

SEQ ID NO: 12226 - protein, 9 aa, Homo Sapiens
LEEELLNVC

SEQ ID NO: 12227 - protein, 9 aa, Homo Sapiens
DKQCEMIKA

SEQ ID NO: 12228 - protein, 9 aa, Homo Sapiens
CPRPRAATA

SEQ ID NO: 12229 - protein, 9 aa, Homo Sapiens
TPALPEESE

SEQ ID NO: 12230 - protein, 9 aa, Homo Sapiens
DDNDDDSDD

SEQ ID NO: 12231 - protein, 9 aa, Homo Sapiens
ATTLHLACQ

SEQ ID NO: 12232 - protein, 9 aa, Homo Sapiens
ERGGWPATR

SEQ ID NO: 12233 - protein, 9 aa, Homo Sapiens
TCHLGLTAE

SEQ ID NO: 12234 - protein, 9 aa, Homo Sapiens
VSTPSSQDP

SEQ ID NO: 12235 - protein, 9 aa, Homo Sapiens
MTNGLCIWL

SEQ ID NO: 12236 - protein, 9 aa, Homo Sapiens
HLKNKFGTD

SEQ ID NO: 12237 - protein, 9 aa, Homo Sapiens
TDNVNTGIA

SEQ ID NO: 12238 - protein, 9 aa, Homo Sapiens
CIWLLILSY

SEQ ID NO: 12239 - protein, 9 aa, Homo Sapiens
LCPTRADST

SEQ ID NO: 12240 - protein, 9 aa, Homo Sapiens
KHIVRSLPI

SEQ ID NO: 12241 - protein, 9 aa, Homo Sapiens
NYNELLENL

SEQ ID NO: 12242 - protein, 9 aa, Homo Sapiens
EDHGSLVRI

SEQ ID NO: 12243 - protein, 9 aa, Homo Sapiens
SHLVYIVIF

SEQ ID NO: 12244 - protein, 9 aa, Homo Sapiens
DNDDDSDDR

SEQ ID NO: 12245 - protein, 9 aa, Homo Sapiens
ERISTAKVA

SEQ ID NO: 12246 - protein, 9 aa, Homo Sapiens
QISIKSLLK

SEQ ID NO: 12247 - protein, 9 aa, Homo Sapiens
ILDAVAATP

SEQ ID NO: 12248 - protein, 9 aa, Homo Sapiens
TGEKPFEYN

SEQ ID NO: 12249 - protein, 9 aa, Homo Sapiens
KRLEGGRGS

SEQ ID NO: 12250 - protein, 9 aa, Homo Sapiens
RLQVWQKLK

SEQ ID NO: 12251 - protein, 9 aa, Homo Sapiens
KNKFGTDYL

SEQ ID NO: 12252 - protein, 9 aa, Homo Sapiens
EILERGGWP

SEQ ID NO: 12253 - protein, 9 aa, Homo Sapiens
AAPALMSKD

SEQ ID NO: 12254 - protein, 9 aa, Homo Sapiens
DKLFGLCPT

SEQ ID NO: 12255 - protein, 9 aa, Homo Sapiens
RTAALRLLL

SEQ ID NO: 12256 - protein, 9 aa, Homo Sapiens
GATTLHLAC

SEQ ID NO: 12257 - protein, 9 aa, Homo Sapiens
GGILLDVNT

SEQ ID NO: 12258 - protein, 9 aa, Homo Sapiens
DIYANLCDE

SEQ ID NO: 12259 - protein, 9 aa, Homo Sapiens
AQAPQELGA

SEQ ID NO: 12260 - protein, 9 aa, Homo Sapiens
AEKDGFLHE

SEQ ID NO: 12261 - protein, 9 aa, Homo Sapiens
AARDKSELI

SEQ ID NO: 12262 - protein, 9 aa, Homo Sapiens
SGVRRSFCK

SEQ ID NO: 12263 - protein, 9 aa, Homo Sapiens
HLGNLREVR

SEQ ID NO: 12264 - protein, 9 aa, Homo Sapiens
ICNDLISKM

SEQ ID NO: 12265 - protein, 9 aa, Homo Sapiens
SGLSIPVPH

SEQ ID NO: 12266 - protein, 9 aa, Homo Sapiens
KEASHHEAC

SEQ ID NO: 12267 - protein, 9 aa, Homo Sapiens
PAGRDSHIQ

SEQ ID NO: 12268 - protein, 9 aa, Homo Sapiens
VVVCRIRAS

SEQ ID NO: 12269 - protein, 9 aa, Homo Sapiens
TPVKKAKKQ

SEQ ID NO: 12270 - protein, 9 aa, Homo Sapiens
EEEDDNDDD

SEQ ID NO: 12271 - protein, 9 aa, Homo Sapiens
RQTFGNSQN

SEQ ID NO: 12272 - protein, 9 aa, Homo Sapiens
TKLLLLCVS

SEQ ID NO: 12273 - protein, 9 aa, Homo Sapiens
TKEASHHEA

SEQ ID NO: 12274 - protein, 9 aa, Homo Sapiens
KRRPSPFLK

SEQ ID NO: 12275 - protein, 9 aa, Homo Sapiens
VQKQKRSFK

SEQ ID NO: 12276 - protein, 9 aa, Homo Sapiens
SSQDPVAGD

SEQ ID NO: 12277 - protein, 9 aa, Homo Sapiens
EFPNYCTPE

SEQ ID NO: 12278 - protein, 9 aa, Homo Sapiens
QKQKRSFKA

SEQ ID NO: 12279 - protein, 9 aa, Homo Sapiens
AVRSPRAHY

SEQ ID NO: 12280 - protein, 9 aa, Homo Sapiens
NRPLAKMAQ

SEQ ID NO: 12281 - protein, 9 aa, Homo Sapiens
GWPATRLQV

SEQ ID NO: 12282 - protein, 9 aa, Homo Sapiens
LSSHLVYIV

SEQ ID NO: 12283 - protein, 9 aa, Homo Sapiens
APLTEAQKN

SEQ ID NO: 12284 - protein, 9 aa, Homo Sapiens
LFNTTFETK

SEQ ID NO: 12285 - protein, 9 aa, Homo Sapiens
GNVCGICSK

SEQ ID NO: 12286 - protein, 9 aa, Homo Sapiens
MIKARHQEL

SEQ ID NO: 12287 - protein, 9 aa, Homo Sapiens
LAAMPALRN

SEQ ID NO: 12288 - protein, 9 aa, Homo Sapiens
GERRGFRWW

SEQ ID NO: 12289 - protein, 9 aa, Homo Sapiens
QDSVFFQIS

SEQ ID NO: 12290 - protein, 9 aa, Homo Sapiens
LNARRKLKG

SEQ ID NO: 12291 - protein, 9 aa, Homo Sapiens
DYNQRRKRT

SEQ ID NO: 12292 - protein, 9 aa, Homo Sapiens
QSAEAACDI

SEQ ID NO: 12293 - protein, 9 aa, Homo Sapiens
EDQCFPQLR

SEQ ID NO: 12294 - protein, 9 aa, Homo Sapiens
CFPQLRLSQ

SEQ ID NO: 12295 - protein, 9 aa, Homo Sapiens
HLVYIVIFP

SEQ ID NO: 12296 - protein, 9 aa, Homo Sapiens
HLGLTAEPE

SEQ ID NO: 12297 - protein, 9 aa, Homo Sapiens
WYLSSHLVY

SEQ ID NO: 12298 - protein, 9 aa, Homo Sapiens
DNLTYCVFY

SEQ ID NO: 12299 - protein, 9 aa, Homo Sapiens
PATRLQVWQ

SEQ ID NO: 12300 - protein, 9 aa, Homo Sapiens
ESYCIYIYK

SEQ ID NO: 12301 - protein, 9 aa, Homo Sapiens
SQDPVAGDI

SEQ ID NO: 12302 - protein, 9 aa, Homo Sapiens
GAQAPQELG

SEQ ID NO: 12303 - protein, 9 aa, Homo Sapiens
ICTDNVNTG

SEQ ID NO: 12304 - protein, 9 aa, Homo Sapiens
LFTGDVNYL

SEQ ID NO: 12305 - protein, 9 aa, Homo Sapiens
DLNGGILLD

SEQ ID NO: 12306 - protein, 9 aa, Homo Sapiens
LTAEPELYL

SEQ ID NO: 12307 - protein, 9 aa, Homo Sapiens
KPFEYNKCG

SEQ ID NO: 12308 - protein, 9 aa, Homo Sapiens
QCFPQLRLS

SEQ ID NO: 12309 - protein, 9 aa, Homo Sapiens
TPQKLWKNI

SEQ ID NO: 12310 - protein, 9 aa, Homo Sapiens
GKQMGLTQS

SEQ ID NO: 12311 - protein, 9 aa, Homo Sapiens
SMDRGNRQT

SEQ ID NO: 12312 - protein, 9 aa, Homo Sapiens
ELLNVCREL

SEQ ID NO: 12313 - protein, 9 aa, Homo Sapiens
ETVECLRKL

SEQ ID NO: 12314 - protein, 9 aa, Homo Sapiens
QGHGTSPVE

SEQ ID NO: 12315 - protein, 9 aa, Homo Sapiens
FCKSPEHPV

SEQ ID NO: 12316 - protein, 9 aa, Homo Sapiens
LCVSYQQEI

SEQ ID NO: 12317 - protein, 9 aa, Homo Sapiens
SLQDSVFFQ

SEQ ID NO: 12318 - protein, 9 aa, Homo Sapiens
IDVKTLFVV

SEQ ID NO: 12319 - protein, 9 aa, Homo Sapiens
PHLTEDQCF

SEQ ID NO: 12320 - protein, 9 aa, Homo Sapiens
ATRLQVWQK

SEQ ID NO: 12321 - protein, 9 aa, Homo Sapiens
CGVAWTDAR

SEQ ID NO: 12322 - protein, 9 aa, Homo Sapiens
LTRICNDLI

SEQ ID NO: 12323 - protein, 9 aa, Homo Sapiens
AMPALRNIN

SEQ ID NO: 12324 - protein, 9 aa, Homo Sapiens
RPRAATAPC

SEQ ID NO: 12325 - protein, 9 aa, Homo Sapiens
SSSASRALD

SEQ ID NO: 12326 - protein, 9 aa, Homo Sapiens
RKLNARRKL

SEQ ID NO: 12327 - protein, 9 aa, Homo Sapiens
KLFGLCPTR

SEQ ID NO: 12328 - protein, 9 aa, Homo Sapiens
PTLDTMGLR

SEQ ID NO: 12329 - protein, 9 aa, Homo Sapiens
YHGATTLHL

SEQ ID NO: 12330 - protein, 9 aa, Homo Sapiens
HESQILPFP

SEQ ID NO: 12331 - protein, 9 aa, Homo Sapiens
PHGRKGKKV

SEQ ID NO: 12332 - protein, 9 aa, Homo Sapiens
LPIQLITKN

SEQ ID NO: 12333 - protein, 9 aa, Homo Sapiens
RDKLFGLCP

SEQ ID NO: 12334 - protein, 9 aa, Homo Sapiens
IKGQLLETS

SEQ ID NO: 12335 - protein, 9 aa, Homo Sapiens
KVDSSAQSA

SEQ ID NO: 12336 - protein, 9 aa, Homo Sapiens
KTLFVVEIA

SEQ ID NO: 12337 - protein, 9 aa, Homo Sapiens
KIDVKTLFV

SEQ ID NO: 12338 - protein, 9 aa, Homo Sapiens
LDAVAATPA

SEQ ID NO: 12339 - protein, 9 aa, Homo Sapiens
LSIGHTAKK

SEQ ID NO: 12340 - protein, 9 aa, Homo Sapiens
FQISIKSLL

SEQ ID NO: 12341 - protein, 9 aa, Homo Sapiens
VVCRIRASS

SEQ ID NO: 12342 - protein, 9 aa, Homo Sapiens
GGETKEVTV

SEQ ID NO: 12343 - protein, 9 aa, Homo Sapiens
EYNKCGKTF

SEQ ID NO: 12344 - protein, 9 aa, Homo Sapiens
DSVFFQISI

SEQ ID NO: 12345 - protein, 9 aa, Homo Sapiens
DIPEFLFQH

SEQ ID NO: 12346 - protein, 9 aa, Homo Sapiens
AEARNLAPL

SEQ ID NO: 12347 - protein, 9 aa, Homo Sapiens
QELTFSNAT

SEQ ID NO: 12348 - protein, 9 aa, Homo Sapiens
DVTPTLDTM

SEQ ID NO: 12349 - protein, 9 aa, Homo Sapiens
NPLYLHVGM

SEQ ID NO: 12350 - protein, 9 aa, Homo Sapiens
SLNSQELTF

SEQ ID NO: 12351 - protein, 9 aa, Homo Sapiens
DVIEHYFGV

SEQ ID NO: 12352 - protein, 9 aa, Homo Sapiens
RLLLLCAAA

SEQ ID NO: 12353 - protein, 9 aa, Homo Sapiens
GSENYNELL

SEQ ID NO: 12354 - protein, 9 aa, Homo Sapiens
QATKNPLYL

SEQ ID NO: 12355 - protein, 9 aa, Homo Sapiens
HTAKKLGEM

SEQ ID NO: 12356 - protein, 9 aa, Homo Sapiens
TKEVTVRGD

SEQ ID NO: 12357 - protein, 9 aa, Homo Sapiens
HEVLRFCSI

SEQ ID NO: 12358 - protein, 9 aa, Homo Sapiens
GDNLTYCVF

SEQ ID NO: 12359 - protein, 9 aa, Homo Sapiens
GVRRSFCKS

SEQ ID NO: 12360 - protein, 9 aa, Homo Sapiens
ALYTGLLLL

SEQ ID NO: 12361 - protein, 9 aa, Homo Sapiens
GAVPATQAP

SEQ ID NO: 12362 - protein, 9 aa, Homo Sapiens
LDVNTAEHS

SEQ ID NO: 12363 - protein, 9 aa, Homo Sapiens
RSPRAHYAQ

SEQ ID NO: 12364 - protein, 9 aa, Homo Sapiens
ATKNPLYLH

SEQ ID NO: 12365 - protein, 9 aa, Homo Sapiens
DAVAATPAL

SEQ ID NO: 12366 - protein, 9 aa, Homo Sapiens
AATAPCSSD

SEQ ID NO: 12367 - protein, 9 aa, Homo Sapiens
RSQAEEDID

SEQ ID NO: 12368 - protein, 9 aa, Homo Sapiens
MPALRNINL

SEQ ID NO: 12369 - protein, 9 aa, Homo Sapiens
REEREREKK

SEQ ID NO: 12370 - protein, 9 aa, Homo Sapiens
AKQEQLKRL

SEQ ID NO: 12371 - protein, 9 aa, Homo Sapiens
FNLKIKGQL

SEQ ID NO: 12372 - protein, 9 aa, Homo Sapiens
ATPALPEES

SEQ ID NO: 12373 - protein, 9 aa, Homo Sapiens
LNVCRELMS

SEQ ID NO: 12374 - protein, 9 aa, Homo Sapiens
MDRGNRQTF

SEQ ID NO: 12375 - protein, 9 aa, Homo Sapiens
YSAFHLGNL

SEQ ID NO: 12376 - protein, 9 aa, Homo Sapiens
QKAFDVIEH

SEQ ID NO: 12377 - protein, 9 aa, Homo Sapiens
EEELLNVCR

SEQ ID NO: 12378 - protein, 9 aa, Homo Sapiens
AFHLGNLRE

SEQ ID NO: 12379 - protein, 9 aa, Homo Sapiens
IQPLPLPND

SEQ ID NO: 12380 - protein, 9 aa, Homo Sapiens
LDKQCEMIK

SEQ ID NO: 12381 - protein, 9 aa, Homo Sapiens
EDIDEIRKS

SEQ ID NO: 12382 - protein, 9 aa, Homo Sapiens
PRPSVRAFN

SEQ ID NO: 12383 - protein, 9 aa, Homo Sapiens
DYSAFHLGN

SEQ ID NO: 12384 - protein, 9 aa, Homo Sapiens
RGGWPATRL

SEQ ID NO: 12385 - protein, 9 aa, Homo Sapiens
LHELTKLLL

SEQ ID NO: 12386 - protein, 9 aa, Homo Sapiens
VFFQISIKS

SEQ ID NO: 12387 - protein, 9 aa, Homo Sapiens
FNTTFETKE

SEQ ID NO: 12388 - protein, 9 aa, Homo Sapiens
DVKTLFVVE

SEQ ID NO: 12389 - protein, 9 aa, Homo Sapiens
HPGLSIGHT

SEQ ID NO: 12390 - protein, 9 aa, Homo Sapiens
TRICNDLIS

SEQ ID NO: 12391 - protein, 9 aa, Homo Sapiens
GLGAGLVLS

SEQ ID NO: 12392 - protein, 9 aa, Homo Sapiens
RGFRWWVTS

SEQ ID NO: 12393 - protein, 9 aa, Homo Sapiens
LLCVSYQQE

SEQ ID NO: 12394 - protein, 9 aa, Homo Sapiens
TPVAGGETK

SEQ ID NO: 12395 - protein, 9 aa, Homo Sapiens
VCPRPRAAT

SEQ ID NO: 12396 - protein, 9 aa, Homo Sapiens
AWTDARSLK

SEQ ID NO: 12397 - protein, 9 aa, Homo Sapiens
FPVSTPSSQ

SEQ ID NO: 12398 - protein, 9 aa, Homo Sapiens
AALRLLLLC

SEQ ID NO: 12399 - protein, 9 aa, Homo Sapiens
REILERGGW

SEQ ID NO: 12400 - protein, 9 aa, Homo Sapiens
VPATQAPPP

SEQ ID NO: 12401 - protein, 9 aa, Homo Sapiens
RTNRIFYSD

SEQ ID NO: 12402 - protein, 9 aa, Homo Sapiens
AISLFTGDV

SEQ ID NO: 12403 - protein, 9 aa, Homo Sapiens
AAAPALMSK

SEQ ID NO: 12404 - protein, 9 aa, Homo Sapiens
HPELNVQKQ

SEQ ID NO: 12405 - protein, 9 aa, Homo Sapiens
SSHRELCFG

SEQ ID NO: 12406 - protein, 9 aa, Homo Sapiens
GLSIGHTAK

SEQ ID NO: 12407 - protein, 9 aa, Homo Sapiens
IYQKAFDVI

SEQ ID NO: 12408 - protein, 9 aa, Homo Sapiens
EAISLFTGD

SEQ ID NO: 12409 - protein, 9 aa, Homo Sapiens
TTFETKEAS

SEQ ID NO: 12410 - protein, 9 aa, Homo Sapiens
VCGICSKGL

SEQ ID NO: 12411 - protein, 9 aa, Homo Sapiens
FLSSHRELC

SEQ ID NO: 12412 - protein, 9 aa, Homo Sapiens
CTDNVNTGI

SEQ ID NO: 12413 - protein, 9 aa, Homo Sapiens
FTPLMLSSF

SEQ ID NO: 12414 - protein, 9 aa, Homo Sapiens
ARRQAKQEQ

SEQ ID NO: 12415 - protein, 9 aa, Homo Sapiens
AFVPVQSSL

SEQ ID NO: 12416 - protein, 9 aa, Homo Sapiens
RVCPRPRAA

SEQ ID NO: 12417 - protein, 9 aa, Homo Sapiens
CGICSKGLT

SEQ ID NO: 12418 - protein, 9 aa, Homo Sapiens
TIKDSKVQV

SEQ ID NO: 12419 - protein, 9 aa, Homo Sapiens
KAEKDGFLH

SEQ ID NO: 12420 - protein, 9 aa, Homo Sapiens
IDIYANLCD

SEQ ID NO: 12421 - protein, 9 aa, Homo Sapiens
KKQLAATPK

SEQ ID NO: 12422 - protein, 9 aa, Homo Sapiens
TYCVFYTKE

SEQ ID NO: 12423 - protein, 9 aa, Homo Sapiens
CFGVDLPSG

SEQ ID NO: 12424 - protein, 9 aa, Homo Sapiens
YCVFYTKEG

SEQ ID NO: 12425 - protein, 9 aa, Homo Sapiens
SVRAFNPGM

SEQ ID NO: 12426 - protein, 9 aa, Homo Sapiens
SFKVDSSAQ

SEQ ID NO: 12427 - protein, 9 aa, Homo Sapiens
PGLGNVCGI

SEQ ID NO: 12428 - protein, 9 aa, Homo Sapiens
LMLSSFCGG

SEQ ID NO: 12429 - protein, 9 aa, Homo Sapiens
KRTRKESYC

SEQ ID NO: 12430 - protein, 9 aa, Homo Sapiens
DYHGATTLH

SEQ ID NO: 12431 - protein, 9 aa, Homo Sapiens
GTSPVEDHG

SEQ ID NO: 12432 - protein, 9 aa, Homo Sapiens
ITSGEAISL

SEQ ID NO: 12433 - protein, 9 aa, Homo Sapiens
AFRRLLGKQ

SEQ ID NO: 12434 - protein, 9 aa, Homo Sapiens
RQAKQEQLK

SEQ ID NO: 12435 - protein, 9 aa, Homo Sapiens
CLDLLEILM

SEQ ID NO: 12436 - protein, 9 aa, Homo Sapiens
ELTKLLLLC

SEQ ID NO: 12437 - protein, 9 aa, Homo Sapiens
CKSPEHPVD

SEQ ID NO: 12438 - protein, 9 aa, Homo Sapiens
QLHELTKLL

SEQ ID NO: 12439 - protein, 9 aa, Homo Sapiens
GEAISLFTG

SEQ ID NO: 12440 - protein, 9 aa, Homo Sapiens
EEREREKKG

SEQ ID NO: 12441 - protein, 9 aa, Homo Sapiens
SHRELCFGV

SEQ ID NO: 12442 - protein, 9 aa, Homo Sapiens
DRDKLFGLC

SEQ ID NO: 12443 - protein, 9 aa, Homo Sapiens
SIVPLGIFH

SEQ ID NO: 12444 - protein, 9 aa, Homo Sapiens
PVAGGETKE

SEQ ID NO: 12445 - protein, 9 aa, Homo Sapiens
KQEQLKRLH

SEQ ID NO: 12446 - protein, 9 aa, Homo Sapiens
TLGAVPATQ

SEQ ID NO: 12447 - protein, 9 aa, Homo Sapiens
SAQSAEAAC

SEQ ID NO: 12448 - protein, 9 aa, Homo Sapiens
AVPATQAPP

SEQ ID NO: 12449 - protein, 9 aa, Homo Sapiens
RDSHIQSCQ

SEQ ID NO: 12450 - protein, 9 aa, Homo Sapiens
AKVAAGARF

SEQ ID NO: 12451 - protein, 9 aa, Homo Sapiens
MAQMARRLH

SEQ ID NO: 12452 - protein, 9 aa, Homo Sapiens
KRTNRIFYS

SEQ ID NO: 12453 - protein, 9 aa, Homo Sapiens
EQIRREQYI

SEQ ID NO: 12454 - protein, 9 aa, Homo Sapiens
TFETKEASH

SEQ ID NO: 12455 - protein, 9 aa, Homo Sapiens
VRRSFCKSP

SEQ ID NO: 12456 - protein, 9 aa, Homo Sapiens
ARDKSELIQ

SEQ ID NO: 12457 - protein, 9 aa, Homo Sapiens
CLTCGVAWT

SEQ ID NO: 12458 - protein, 9 aa, Homo Sapiens
SELIQLGIT

SEQ ID NO: 12459 - protein, 9 aa, Homo Sapiens
DPAGRDSHI

SEQ ID NO: 12460 - protein, 9 aa, Homo Sapiens
DTNNRLHSV

SEQ ID NO: 12461 - protein, 9 aa, Homo Sapiens
EIDIYANLC

SEQ ID NO: 12462 - protein, 9 aa, Homo Sapiens
IFFPKRRPS

SEQ ID NO: 12463 - protein, 9 aa, Homo Sapiens
VRSPRAHYA

SEQ ID NO: 12464 - protein, 9 aa, Homo Sapiens
LLDVNTAEH

SEQ ID NO: 12465 - protein, 9 aa, Homo Sapiens
RSFCKSPEH

SEQ ID NO: 12466 - protein, 9 aa, Homo Sapiens
EEDDNDDDS

SEQ ID NO: 12467 - protein, 9 aa, Homo Sapiens
LGNVCGICS

SEQ ID NO: 12468 - protein, 9 aa, Homo Sapiens
DAFVPVQSS

SEQ ID NO: 12469 - protein, 9 aa, Homo Sapiens
FPNYCTPEL

SEQ ID NO: 12470 - protein, 9 aa, Homo Sapiens
LGPRTAALR

SEQ ID NO: 12471 - protein, 9 aa, Homo Sapiens
DEPTPGAQA

SEQ ID NO: 12472 - protein, 9 aa, Homo Sapiens
LGKQMGLTQ

SEQ ID NO: 12473 - protein, 9 aa, Homo Sapiens
WAVMTPQKL

SEQ ID NO: 12474 - protein, 9 aa, Homo Sapiens
WTDARSLKR

SEQ ID NO: 12475 - protein, 9 aa, Homo Sapiens
ILLDVNTAE

SEQ ID NO: 12476 - protein, 9 aa, Homo Sapiens
QALHESQIL

SEQ ID NO: 12477 - protein, 9 aa, Homo Sapiens
VRAFNPGME

SEQ ID NO: 12478 - protein, 9 aa, Homo Sapiens
DPERKHNGG

SEQ ID NO: 12479 - protein, 9 aa, Homo Sapiens
CRELMSVFM

SEQ ID NO: 12480 - protein, 9 aa, Homo Sapiens
SIQPLPLPN

SEQ ID NO: 12481 - protein, 9 aa, Homo Sapiens
LVLSLWVAL

SEQ ID NO: 12482 - protein, 9 aa, Homo Sapiens
EENGFWYLE

SEQ ID NO: 12483 - protein, 9 aa, Homo Sapiens
KGQLLETSG

SEQ ID NO: 12484 - protein, 9 aa, Homo Sapiens
ASRALDEVD

SEQ ID NO: 12485 - protein, 9 aa, Homo Sapiens
KDSKVQVSF

SEQ ID NO: 12486 - protein, 9 aa, Homo Sapiens
SGEAISLFT

SEQ ID NO: 12487 - protein, 9 aa, Homo Sapiens
CTFNLKIKG

SEQ ID NO: 12488 - protein, 9 aa, Homo Sapiens
REREKKGRS

SEQ ID NO: 12489 - protein, 9 aa, Homo Sapiens
NLHTVALYT

SEQ ID NO: 12490 - protein, 9 aa, Homo Sapiens
HELTKLLLL

SEQ ID NO: 12491 - protein, 9 aa, Homo Sapiens
SGKIDVKTL

SEQ ID NO: 12492 - protein, 9 aa, Homo Sapiens
VAATPALPE

SEQ ID NO: 12493 - protein, 9 aa, Homo Sapiens
EILMEADVS

SEQ ID NO: 12494 - protein, 9 aa, Homo Sapiens
SSHLVYIVI

SEQ ID NO: 12495 - protein, 9 aa, Homo Sapiens
SCLDLLEIL

SEQ ID NO: 12496 - protein, 9 aa, Homo Sapiens
KLLLLCVSY

SEQ ID NO: 12497 - protein, 9 aa, Homo Sapiens
PRAHYAQPP

SEQ ID NO: 12498 - protein, 9 aa, Homo Sapiens
NLREVRLFL

SEQ ID NO: 12499 - protein, 9 aa, Homo Sapiens
ALHESQILP

SEQ ID NO: 12500 - protein, 9 aa, Homo Sapiens
WQKLKRLEG

SEQ ID NO: 12501 - protein, 9 aa, Homo Sapiens
LTFSNATKS

SEQ ID NO: 12502 - protein, 9 aa, Homo Sapiens
KAFDVIEHY

SEQ ID NO: 12503 - protein, 9 aa, Homo Sapiens
EELTRICND

SEQ ID NO: 12504 - protein, 9 aa, Homo Sapiens
TKNPLYLHV

SEQ ID NO: 12505 - protein, 9 aa, Homo Sapiens
LLGKQMGLT

SEQ ID NO: 12506 - protein, 9 aa, Homo Sapiens
LRKLNARRK

SEQ ID NO: 12507 - protein, 9 aa, Homo Sapiens
GLVLSLWVA

SEQ ID NO: 12508 - protein, 9 aa, Homo Sapiens
PHGDNLTYC

SEQ ID NO: 12509 - protein, 9 aa, Homo Sapiens
PVPHGRKGK

SEQ ID NO: 12510 - protein, 9 aa, Homo Sapiens
MLDAFVPVQ

SEQ ID NO: 12511 - protein, 9 aa, Homo Sapiens
NEELTRICN

SEQ ID NO: 12512 - protein, 9 aa, Homo Sapiens
LLEILMEAD

SEQ ID NO: 12513 - protein, 9 aa, Homo Sapiens
YANLCDEKA

SEQ ID NO: 12514 - protein, 9 aa, Homo Sapiens
GRGSPESEL

SEQ ID NO: 12515 - protein, 9 aa, Homo Sapiens
DSSAQSAEA

SEQ ID NO: 12516 - protein, 9 aa, Homo Sapiens
LSSHRELCF

SEQ ID NO: 12517 - protein, 9 aa, Homo Sapiens
PLMLSSFCG

SEQ ID NO: 12518 - protein, 9 aa, Homo Sapiens
LNSQELTFS

SEQ ID NO: 12519 - protein, 9 aa, Homo Sapiens
EPELYLLNT

SEQ ID NO: 12520 - protein, 9 aa, Homo Sapiens
DGFTPLMLS

SEQ ID NO: 12521 - protein, 9 aa, Homo Sapiens
RGNRQTFGN

SEQ ID NO: 12522 - protein, 9 aa, Homo Sapiens
ENYNELLEN

SEQ ID NO: 12523 - protein, 9 aa, Homo Sapiens
IKARHQELL

SEQ ID NO: 12524 - protein, 9 aa, Homo Sapiens
GLCPTRADS

SEQ ID NO: 12525 - protein, 9 aa, Homo Sapiens
LFVVEIADW

SEQ ID NO: 12526 - protein, 9 aa, Homo Sapiens
KERISTAKV

SEQ ID NO: 12527 - protein, 9 aa, Homo Sapiens
FGTDYLLEI

SEQ ID NO: 12528 - protein, 9 aa, Homo Sapiens
NGGILLDVN

SEQ ID NO: 12529 - protein, 9 aa, Homo Sapiens
LILDAVAAT

SEQ ID NO: 12530 - protein, 9 aa, Homo Sapiens
NTGIANTLG

SEQ ID NO: 12531 - protein, 9 aa, Homo Sapiens
NYCTPELSE

SEQ ID NO: 12532 - protein, 9 aa, Homo Sapiens
YQKAFDVIE

SEQ ID NO: 12533 - protein, 9 aa, Homo Sapiens
LYQATKNPL

SEQ ID NO: 12534 - protein, 9 aa, Homo Sapiens
FLFQHLSSS

SEQ ID NO: 12535 - protein, 9 aa, Homo Sapiens
DGTIFFPKR

SEQ ID NO: 12536 - protein, 9 aa, Homo Sapiens
AGLVLSLWV

SEQ ID NO: 12537 - protein, 9 aa, Homo Sapiens
FRRLLGKQM

SEQ ID NO: 12538 - protein, 9 aa, Homo Sapiens
SYCIYIYKV

SEQ ID NO: 12539 - protein, 9 aa, Homo Sapiens
GQSMDRGNR

SEQ ID NO: 12540 - protein, 9 aa, Homo Sapiens
SDSSSASRA

SEQ ID NO: 12541 - protein, 9 aa, Homo Sapiens
LWYLSSHLV

SEQ ID NO: 12542 - protein, 9 aa, Homo Sapiens
LQVWQKLKR

SEQ ID NO: 12543 - protein, 9 aa, Homo Sapiens
GNRQTFGNS

SEQ ID NO: 12544 - protein, 9 aa, Homo Sapiens
PGLSIGHTA

SEQ ID NO: 12545 - protein, 9 aa, Homo Sapiens
STAKVAEPP

SEQ ID NO: 12546 - protein, 9 aa, Homo Sapiens
LGNLREVRL

SEQ ID NO: 12547 - protein, 9 aa, Homo Sapiens
LSIPVPHGR

SEQ ID NO: 12548 - protein, 9 aa, Homo Sapiens
LNVQKQKRS

SEQ ID NO: 12549 - protein, 9 aa, Homo Sapiens
LSSFCGGAL

SEQ ID NO: 12550 - protein, 9 aa, Homo Sapiens
TSGEAISLF

SEQ ID NO: 12551 - protein, 9 aa, Homo Sapiens
YNKCGKTFY

SEQ ID NO: 12552 - protein, 9 aa, Homo Sapiens
ADGTIFFPK

SEQ ID NO: 12553 - protein, 9 aa, Homo Sapiens
CVFYTKEGI

SEQ ID NO: 12554 - protein, 9 aa, Homo Sapiens
LAKMAQMAR

SEQ ID NO: 12555 - protein, 9 aa, Homo Sapiens
MQALHESQI

SEQ ID NO: 12556 - protein, 9 aa, Homo Sapiens
PVEDHGSLV

SEQ ID NO: 12557 - protein, 9 aa, Homo Sapiens
TVECLRKLN

SEQ ID NO: 12558 - protein, 9 aa, Homo Sapiens
GRDSHIQSC

SEQ ID NO: 12559 - protein, 9 aa, Homo Sapiens
TLFVVEIAD

SEQ ID NO: 12560 - protein, 9 aa, Homo Sapiens
GMTIKDSKV

SEQ ID NO: 12561 - protein, 9 aa, Homo Sapiens
EFLFQHLSS

SEQ ID NO: 12562 - protein, 9 aa, Homo Sapiens
HGATTLHLA

SEQ ID NO: 12563 - protein, 9 aa, Homo Sapiens
LFQHLSSSS

SEQ ID NO: 12564 - protein, 9 aa, Homo Sapiens
LTEDQCFPQ

SEQ ID NO: 12565 - protein, 9 aa, Homo Sapiens
ELNVQKQKR

SEQ ID NO: 12566 - protein, 9 aa, Homo Sapiens
LRLLLLCAA

SEQ ID NO: 12567 - protein, 9 aa, Homo Sapiens
RICNDLISK

SEQ ID NO: 12568 - protein, 9 aa, Homo Sapiens
VDVTPTLDT

SEQ ID NO: 12569 - protein, 9 aa, Homo Sapiens
TRKESYCIY

SEQ ID NO: 12570 - protein, 9 aa, Homo Sapiens
ARNLAPLTE

SEQ ID NO: 12571 - protein, 9 aa, Homo Sapiens
NELLENLQF

SEQ ID NO: 12572 - protein, 9 aa, Homo Sapiens
RNINLRFNP

SEQ ID NO: 12573 - protein, 9 aa, Homo Sapiens
ESKILKKAE

SEQ ID NO: 12574 - protein, 9 aa, Homo Sapiens
HGDNLTYCV

SEQ ID NO: 12575 - protein, 9 aa, Homo Sapiens
DNVNTGIAN

SEQ ID NO: 12576 - protein, 9 aa, Homo Sapiens
ILKKAEKDG

SEQ ID NO: 12577 - protein, 9 aa, Homo Sapiens
GTIFFPKRR

SEQ ID NO: 12578 - protein, 9 aa, Homo Sapiens
PALMSKDRG

SEQ ID NO: 12579 - protein, 9 aa, Homo Sapiens
VMTPQKLWK

SEQ ID NO: 12580 - protein, 9 aa, Homo Sapiens
QKLWKNICQ

SEQ ID NO: 12581 - protein, 9 aa, Homo Sapiens
NLAPLTEAQ

SEQ ID NO: 12582 - protein, 9 aa, Homo Sapiens
EMIKARHQE

SEQ ID NO: 12583 - protein, 9 aa, Homo Sapiens
QEQLKRLHR

SEQ ID NO: 12584 - protein, 9 aa, Homo Sapiens
VDSSAQSAE

SEQ ID NO: 12585 - protein, 9 aa, Homo Sapiens
PQPRPSVRA

SEQ ID NO: 12586 - protein, 9 aa, Homo Sapiens
VCTKCGVDT

SEQ ID NO: 12587 - protein, 9 aa, Homo Sapiens
KCGVDTNNR

SEQ ID NO: 12588 - protein, 9 aa, Homo Sapiens
WLLILSYVG

SEQ ID NO: 12589 - protein, 9 aa, Homo Sapiens
PQKLWKNIC

SEQ ID NO: 12590 - protein, 9 aa, Homo Sapiens
YQATKNPLY

SEQ ID NO: 12591 - protein, 9 aa, Homo Sapiens
AKMAQMARR

SEQ ID NO: 12592 - protein, 9 aa, Homo Sapiens
DMQALHESQ

SEQ ID NO: 12593 - protein, 9 aa, Homo Sapiens
ERKHNGGSS

SEQ ID NO: 12594 - protein, 9 aa, Homo Sapiens
AVMTPQKLW

SEQ ID NO: 12595 - protein, 9 aa, Homo Sapiens
RPLAKMAQM

SEQ ID NO: 12596 - protein, 9 aa, Homo Sapiens
GLSIPVPHG

SEQ ID NO: 12597 - protein, 9 aa, Homo Sapiens
FGERRGFRW

SEQ ID NO: 12598 - protein, 9 aa, Homo Sapiens
DRGNRQTFG

SEQ ID NO: 12599 - protein, 9 aa, Homo Sapiens
TIFFPKRRP

SEQ ID NO: 12600 - protein, 9 aa, Homo Sapiens
RSLPIQLIT

SEQ ID NO: 12601 - protein, 9 aa, Homo Sapiens
LGLTAEPEL

SEQ ID NO: 12602 - protein, 9 aa, Homo Sapiens
NGLCIWLLI

SEQ ID NO: 12603 - protein, 9 aa, Homo Sapiens
KEVTVRGDT

SEQ ID NO: 12604 - protein, 9 aa, Homo Sapiens
TSSIQPLPL

SEQ ID NO: 12605 - protein, 9 aa, Homo Sapiens
KQLAATPKK

SEQ ID NO: 12606 - protein, 9 aa, Homo Sapiens
RTRKESYCI

SEQ ID NO: 12607 - protein, 9 aa, Homo Sapiens
NLCDEKAFV

SEQ ID NO: 12608 - protein, 9 aa, Homo Sapiens
CNDLISKME

SEQ ID NO: 12609 - protein, 9 aa, Homo Sapiens
RRGFRWWVT

SEQ ID NO: 12610 - protein, 9 aa, Homo Sapiens
AEPELYLLN

SEQ ID NO: 12611 - protein, 9 aa, Homo Sapiens
LNGGILLDV

SEQ ID NO: 12612 - protein, 9 aa, Homo Sapiens
ECLRKLNAR

SEQ ID NO: 12613 - protein, 9 aa, Homo Sapiens
YNELLENLQ

SEQ ID NO: 12614 - protein, 9 aa, Homo Sapiens
VCRIRASSP

SEQ ID NO: 12615 - protein, 9 aa, Homo Sapiens
NRQTFGNSQ

SEQ ID NO: 12616 - protein, 9 aa, Homo Sapiens
VRSLPIQLI

SEQ ID NO: 12617 - protein, 9 aa, Homo Sapiens
NTTFETKEA

SEQ ID NO: 12618 - protein, 9 aa, Homo Sapiens
VWQKLKRLE

SEQ ID NO: 12619 - protein, 9 aa, Homo Sapiens
VAGGETKEV

SEQ ID NO: 12620 - protein, 9 aa, Homo Sapiens
LEGGRGSPE

SEQ ID NO: 12621 - protein, 9 aa, Homo Sapiens
SLLEEPRGE

SEQ ID NO: 12622 - protein, 9 aa, Homo Sapiens
YLEQIRREQ

SEQ ID NO: 12623 - protein, 9 aa, Homo Sapiens
TDPAGRDSH

SEQ ID NO: 12624 - protein, 9 aa, Homo Sapiens
TLDTMGLRE

SEQ ID NO: 12625 - protein, 9 aa, Homo Sapiens
ATDYHGATT

SEQ ID NO: 12626 - protein, 9 aa, Homo Sapiens
FPKRRPSPF

SEQ ID NO: 12627 - protein, 9 aa, Homo Sapiens
TCTFNLKIK

SEQ ID NO: 12628 - protein, 9 aa, Homo Sapiens
PERKHNGGS

SEQ ID NO: 12629 - protein, 9 aa, Homo Sapiens
YAVVVCRIR

SEQ ID NO: 12630 - protein, 9 aa, Homo Sapiens
KREILERGG

SEQ ID NO: 12631 - protein, 9 aa, Homo Sapiens
SPRAHYAQP

SEQ ID NO: 12632 - protein, 9 aa, Homo Sapiens
SHIQSCQDL

SEQ ID NO: 12633 - protein, 9 aa, Homo Sapiens
NSQELTFSN

SEQ ID NO: 12634 - protein, 9 aa, Homo Sapiens
LEEPRGEIR

SEQ ID NO: 12635 - protein, 9 aa, Homo Sapiens
PVPGLGNVC

SEQ ID NO: 12636 - protein, 9 aa, Homo Sapiens
VEDHGSLVR

SEQ ID NO: 12637 - protein, 9 aa, Homo Sapiens
SQELTFSNA

SEQ ID NO: 12638 - protein, 9 aa, Homo Sapiens
IPEFLFQHL

SEQ ID NO: 12639 - protein, 9 aa, Homo Sapiens
PKRRPSPFL

SEQ ID NO: 12640 - protein, 9 aa, Homo Sapiens
RDKSELIQL

SEQ ID NO: 12641 - protein, 9 aa, Homo Sapiens
SLPIQLITK

SEQ ID NO: 12642 - protein, 9 aa, Homo Sapiens
ETKEVTVRG

SEQ ID NO: 12643 - protein, 9 aa, Homo Sapiens
LLNVCRELM

SEQ ID NO: 12644 - protein, 9 aa, Homo Sapiens
HYAQPPSSV

SEQ ID NO: 12645 - protein, 9 aa, Homo Sapiens
VAWTDARSL

SEQ ID NO: 12646 - protein, 9 aa, Homo Sapiens
HLTEDQCFP

SEQ ID NO: 12647 - protein, 9 aa, Homo Sapiens
RVTSSIQPL

SEQ ID NO: 12648 - protein, 9 aa, Homo Sapiens
QLKRLHRAQ

SEQ ID NO: 12649 - protein, 9 aa, Homo Sapiens
GLCIWLLIL

SEQ ID NO: 12650 - protein, 9 aa, Homo Sapiens
LDTMGLRED

SEQ ID NO: 12651 - protein, 9 aa, Homo Sapiens
RRQAKQEQL

SEQ ID NO: 12652 - protein, 9 aa, Homo Sapiens
WRNLHTVAL

SEQ ID NO: 12653 - protein, 9 aa, Homo Sapiens
AQSAEAACD

SEQ ID NO: 12654 - protein, 9 aa, Homo Sapiens
PRTAALRLL

SEQ ID NO: 12655 - protein, 9 aa, Homo Sapiens
HEDYAVVVC

SEQ ID NO: 12656 - protein, 9 aa, Homo Sapiens
LAEARNLAP

SEQ ID NO: 12657 - protein, 9 aa, Homo Sapiens
QRRKRTNRI

SEQ ID NO: 12658 - protein, 9 aa, Homo Sapiens
TRLQVWQKL

SEQ ID NO: 12659 - protein, 9 aa, Homo Sapiens
SASRALDEV

SEQ ID NO: 12660 - protein, 9 aa, Homo Sapiens
LKIKGQLLE

SEQ ID NO: 12661 - protein, 9 aa, Homo Sapiens
TLHLACQKG

SEQ ID NO: 12662 - protein, 9 aa, Homo Sapiens
RAFNPGMED

SEQ ID NO: 12663 - protein, 9 aa, Homo Sapiens
PSVRAFNPG

SEQ ID NO: 12664 - protein, 9 aa, Homo Sapiens
TAALRLLLL

SEQ ID NO: 12665 - protein, 9 aa, Homo Sapiens
FQHLSSSSE

SEQ ID NO: 12666 - protein, 9 aa, Homo Sapiens
TVALYTGLL

SEQ ID NO: 12667 - protein, 9 aa, Homo Sapiens
PVSTPSSQD

SEQ ID NO: 12668 - protein, 9 aa, Homo Sapiens
KLNARRKLK

SEQ ID NO: 12669 - protein, 9 aa, Homo Sapiens
RRSFCKSPE

SEQ ID NO: 12670 - protein, 9 aa, Homo Sapiens
IQLITKNSK

SEQ ID NO: 12671 - protein, 9 aa, Homo Sapiens
DSHIQSCQD

SEQ ID NO: 12672 - protein, 9 aa, Homo Sapiens
GILLDVNTA

SEQ ID NO: 12673 - protein, 9 aa, Homo Sapiens
NSLLEEPRG

SEQ ID NO: 12674 - protein, 9 aa, Homo Sapiens
VPHGRKGKK

SEQ ID NO: 12675 - protein, 9 aa, Homo Sapiens
AFDVIEHYF

SEQ ID NO: 12676 - protein, 9 aa, Homo Sapiens
LTKLLLLCV

SEQ ID NO: 12677 - protein, 9 aa, Homo Sapiens
RLLGKQMGL

SEQ ID NO: 12678 - protein, 9 aa, Homo Sapiens
RNLHTVALY

SEQ ID NO: 12679 - protein, 9 aa, Homo Sapiens
NLTYCVFYT

SEQ ID NO: 12680 - protein, 9 aa, Homo Sapiens
PNYCTPELS

SEQ ID NO: 12681 - protein, 9 aa, Homo Sapiens
KIKGQLLET

SEQ ID NO: 12682 - protein, 9 aa, Homo Sapiens
GVDTNNRLH

SEQ ID NO: 12683 - protein, 9 aa, Homo Sapiens
EEVDVTPTL

SEQ ID NO: 12684 - protein, 9 aa, Homo Sapiens
LHEVLRFCS

SEQ ID NO: 12685 - protein, 9 aa, Homo Sapiens
YGYKERIST

SEQ ID NO: 12686 - protein, 9 aa, Homo Sapiens
SHFEFPNYC

SEQ ID NO: 12687 - protein, 9 aa, Homo Sapiens
QAPQELGAA

SEQ ID NO: 12688 - protein, 9 aa, Homo Sapiens
QDPVAGDIK

SEQ ID NO: 12689 - protein, 9 aa, Homo Sapiens
GGSENYNEL

SEQ ID NO: 12690 - protein, 9 aa, Homo Sapiens
SSIQPLPLP

SEQ ID NO: 12691 - protein, 9 aa, Homo Sapiens
ISLFTGDVN

SEQ ID NO: 12692 - protein, 9 aa, Homo Sapiens
ENGFWYLEQ

SEQ ID NO: 12693 - protein, 9 aa, Homo Sapiens
PRPRAATAP

SEQ ID NO: 12694 - protein, 9 aa, Homo Sapiens
PEFLFQHLS

SEQ ID NO: 12695 - protein, 9 aa, Homo Sapiens
EQLKRLHRA

SEQ ID NO: 12696 - protein, 9 aa, Homo Sapiens
AWAVMTPQK

SEQ ID NO: 12697 - protein, 9 aa, Homo Sapiens
EARNLAPLT

SEQ ID NO: 12698 - protein, 9 aa, Homo Sapiens
WQSDSSSAS

SEQ ID NO: 12699 - protein, 9 aa, Homo Sapiens
VTLGAVPAT

SEQ ID NO: 12700 - protein, 9 aa, Homo Sapiens
AEEDIDEIR

SEQ ID NO: 12701 - protein, 9 aa, Homo Sapiens
EVDVTPTLD

SEQ ID NO: 12702 - protein, 9 aa, Homo Sapiens
QHLKNKFGT

SEQ ID NO: 12703 - protein, 9 aa, Homo Sapiens
AAMPALRNI

SEQ ID NO: 12704 - protein, 9 aa, Homo Sapiens
PIQLITKNS

SEQ ID NO: 12705 - protein, 9 aa, Homo Sapiens
PTPGAQAPQ

SEQ ID NO: 12706 - protein, 9 aa, Homo Sapiens
QAGGSENYN

SEQ ID NO: 12707 - protein, 9 aa, Homo Sapiens
AKVEAKVAA

SEQ ID NO: 12708 - protein, 9 aa, Homo Sapiens
VCRELMSVF

SEQ ID NO: 12709 - protein, 9 aa, Homo Sapiens
WYLEQIRRE

SEQ ID NO: 12710 - protein, 9 aa, Homo Sapiens
YGLWYLSSH

SEQ ID NO: 12711 - protein, 9 aa, Homo Sapiens
NKFGTDYLL

SEQ ID NO: 12712 - protein, 9 aa, Homo Sapiens
SLFTGDVNY

SEQ ID NO: 12713 - protein, 9 aa, Homo Sapiens
FSNATKSAS

SEQ ID NO: 12714 - protein, 9 aa, Homo Sapiens
KILKKAEKD

SEQ ID NO: 12715 - protein, 9 aa, Homo Sapiens
LTYCVFYTK

SEQ ID NO: 12716 - protein, 9 aa, Homo Sapiens
LHESQILPF

SEQ ID NO: 12717 - protein, 9 aa, Homo Sapiens
EPRGEIRNL

SEQ ID NO: 12718 - protein, 9 aa, Homo Sapiens
KAKVEAKVA

SEQ ID NO: 12719 - protein, 9 aa, Homo Sapiens
LGSCLDLLE

SEQ ID NO: 12720 - protein, 9 aa, Homo Sapiens
LGAVPATQA

SEQ ID NO: 12721 - protein, 9 aa, Homo Sapiens
VTPTLDTMG

SEQ ID NO: 12722 - protein, 9 aa, Homo Sapiens
HTGEKPFEY

SEQ ID NO: 12723 - protein, 9 aa, Homo Sapiens
RPSVRAFNP

SEQ ID NO: 12724 - protein, 9 aa, Homo Sapiens
GLWYLSSHL

SEQ ID NO: 12725 - protein, 9 aa, Homo Sapiens
CSIVPLGIF

SEQ ID NO: 12726 - protein, 9 aa, Homo Sapiens
GEKPFEYNK

SEQ ID NO: 12727 - protein, 9 aa, Homo Sapiens
PATQAPPPP

SEQ ID NO: 12728 - protein, 9 aa, Homo Sapiens
EIYQKAFDV

SEQ ID NO: 12729 - protein, 9 aa, Homo Sapiens
ALMSKDRGA

SEQ ID NO: 12730 - protein, 9 aa, Homo Sapiens
GNLREVRLF

SEQ ID NO: 12731 - protein, 9 aa, Homo Sapiens
RAHYAQPPS

SEQ ID NO: 12732 - protein, 9 aa, Homo Sapiens
RREEREREK

SEQ ID NO: 12733 - protein, 9 aa, Homo Sapiens
STPSSQDPV

SEQ ID NO: 12734 - protein, 9 aa, Homo Sapiens
KFGTDYLLE

SEQ ID NO: 12735 - protein, 9 aa, Homo Sapiens
GGWPATRLQ

SEQ ID NO: 12736 - protein, 9 aa, Homo Sapiens
VECLRKLNA

SEQ ID NO: 12737 - protein, 9 aa, Homo Sapiens
LPVRVTSSI

SEQ ID NO: 12738 - protein, 9 aa, Homo Sapiens
LEILMEADV

SEQ ID NO: 12739 - protein, 9 aa, Homo Sapiens
QAKQEQLKR

SEQ ID NO: 12740 - protein, 9 aa, Homo Sapiens
RFCSIVPLG

SEQ ID NO: 12741 - protein, 9 aa, Homo Sapiens
SIPVPHGRK

SEQ ID NO: 12742 - protein, 9 aa, Homo Sapiens
EDLNGGILL

SEQ ID NO: 12743 - protein, 9 aa, Homo Sapiens
SAFHLGNLR

SEQ ID NO: 12744 - protein, 9 aa, Homo Sapiens
AATPALPEE

SEQ ID NO: 12745 - protein, 9 aa, Homo Sapiens
GHTAKKLGE

SEQ ID NO: 12746 - protein, 9 aa, Homo Sapiens
ANLCDEKAF

SEQ ID NO: 12747 - protein, 9 aa, Homo Sapiens
AKKQLAATP

SEQ ID NO: 12748 - protein, 9 aa, Homo Sapiens
IYANLCDEK

SEQ ID NO: 12749 - protein, 9 aa, Homo Sapiens
FDVIEHYFG

SEQ ID NO: 12750 - protein, 9 aa, Homo Sapiens
KAKKQLAAT

SEQ ID NO: 12751 - protein, 9 aa, Homo Sapiens
PRAATAPCS

SEQ ID NO: 12752 - protein, 9 aa, Homo Sapiens
GHGTSPVED

SEQ ID NO: 12753 - protein, 9 aa, Homo Sapiens
KLKRLEGGR

SEQ ID NO: 12754 - protein, 9 aa, Homo Sapiens
SVFFQISIK

SEQ ID NO: 12755 - protein, 9 aa, Homo Sapiens
LQDSVFFQI

SEQ ID NO: 12756 - protein, 9 aa, Homo Sapiens
LYLHVGMDI

SEQ ID NO: 12757 - protein, 9 aa, Homo Sapiens
ALRNINLRF

SEQ ID NO: 12758 - protein, 9 aa, Homo Sapiens
ETKEASHHE

SEQ ID NO: 12759 - protein, 9 aa, Homo Sapiens
YNQRRKRTN

SEQ ID NO: 12760 - protein, 9 aa, Homo Sapiens
FETKEASHH

SEQ ID NO: 12761 - protein, 9 aa, Homo Sapiens
GTDYLLEIK

SEQ ID NO: 12762 - protein, 9 aa, Homo Sapiens
AVVVCRIRA

SEQ ID NO: 12763 - protein, 9 aa, Homo Sapiens
RKRTNRIFY

SEQ ID NO: 12764 - protein, 9 aa, Homo Sapiens
QCEMIKARH

SEQ ID NO: 12765 - protein, 9 aa, Homo Sapiens
GETKEVTVR

SEQ ID NO: 12766 - protein, 9 aa, Homo Sapiens
APALMSKDR

SEQ ID NO: 12767 - protein, 9 aa, Homo Sapiens
RKHNGGSSN

SEQ ID NO: 12768 - protein, 9 aa, Homo Sapiens
PFEYNKCGK

SEQ ID NO: 12769 - protein, 9 aa, Homo Sapiens
ELTRICNDL

SEQ ID NO: 12770 - protein, 9 aa, Homo Sapiens
RLEGGRGSP

SEQ ID NO: 12771 - protein, 9 aa, Homo Sapiens
NVCTKCGVD

SEQ ID NO: 12772 - protein, 9 aa, Homo Sapiens
LAGLGAGLV

SEQ ID NO: 12773 - protein, 9 aa, Homo Sapiens
LCDEKAFVF

SEQ ID NO: 12774 - protein, 9 aa, Homo Sapiens
PRGEIRNLE

SEQ ID NO: 12775 - protein, 9 aa, Homo Sapiens
YAQPPSSVP

SEQ ID NO: 12776 - protein, 9 aa, Homo Sapiens
TDYLLEIKM

SEQ ID NO: 12777 - protein, 9 aa, Homo Sapiens
LKRLEGGRG

SEQ ID NO: 12778 - protein, 9 aa, Homo Sapiens
HFEFPNYCT

SEQ ID NO: 12779 - protein, 9 aa, Homo Sapiens
FFQISIKSL

SEQ ID NO: 12780 - protein, 9 aa, Homo Sapiens
EEDIDEIRK

SEQ ID NO: 12781 - protein, 9 aa, Homo Sapiens
YLSSHLVYI

SEQ ID NO: 12782 - protein, 9 aa, Homo Sapiens
DSSSASRAL

SEQ ID NO: 12783 - protein, 9 aa, Homo Sapiens
SSAQSAEAA

SEQ ID NO: 12784 - protein, 9 aa, Homo Sapiens
DELQELYEA

SEQ ID NO: 12785 - protein, 9 aa, Homo Sapiens
QPRPSVRAF

SEQ ID NO: 12786 - protein, 9 aa, Homo Sapiens
SPQPRPSVR

SEQ ID NO: 12787 - protein, 9 aa, Homo Sapiens
LRFCSIVPL

SEQ ID NO: 12788 - protein, 9 aa, Homo Sapiens
FFPKRRPSP

SEQ ID NO: 12789 - protein, 9 aa, Homo Sapiens
GMLDAFVPV

SEQ ID NO: 12790 - protein, 9 aa, Homo Sapiens
EREREKKGR

SEQ ID NO: 12791 - protein, 9 aa, Homo Sapiens
KLDKQCEMI

SEQ ID NO: 12792 - protein, 9 aa, Homo Sapiens
VKKAKKQLA

SEQ ID NO: 12793 - protein, 9 aa, Homo Sapiens
CGVDTNNRL

SEQ ID NO: 12794 - protein, 9 aa, Homo Sapiens
VEAKVAAGA

SEQ ID NO: 12795 - protein, 9 aa, Homo Sapiens
LCFGVDLPS

SEQ ID NO: 12796 - protein, 9 aa, Homo Sapiens
PRKAKVEAK

SEQ ID NO: 12797 - protein, 9 aa, Homo Sapiens
AHYAQPPSS

SEQ ID NO: 12798 - protein, 9 aa, Homo Sapiens
LLLCVSYQQ

SEQ ID NO: 12799 - protein, 9 aa, Homo Sapiens
NVCGICSKG

SEQ ID NO: 12800 - protein, 9 aa, Homo Sapiens
WPATRLQVW

SEQ ID NO: 12801 - protein, 9 aa, Homo Sapiens
DYAVVVCRI

SEQ ID NO: 12802 - protein, 9 aa, Homo Sapiens
VLSLWVALG

SEQ ID NO: 12803 - protein, 9 aa, Homo Sapiens
VLRFCSIVP

SEQ ID NO: 12804 - protein, 9 aa, Homo Sapiens
GVAWTDARS

SEQ ID NO: 12805 - protein, 9 aa, Homo Sapiens
YLAEARNLA

SEQ ID NO: 12806 - protein, 9 aa, Homo Sapiens
NGFWYLEQI

SEQ ID NO: 12807 - protein, 9 aa, Homo Sapiens
IVRSLPIQL

SEQ ID NO: 12808 - protein, 9 aa, Homo Sapiens
VDTNNRLHS

SEQ ID NO: 12809 - protein, 9 aa, Homo Sapiens
QKRSFKAVV

SEQ ID NO: 12810 - protein, 9 aa, Homo Sapiens
CIYIYKVLK

SEQ ID NO: 12811 - protein, 9 aa, Homo Sapiens
EKDGFLHET

SEQ ID NO: 12812 - protein, 9 aa, Homo Sapiens
ADGMTIKDS

SEQ ID NO: 12813 - protein, 9 aa, Homo Sapiens
LTCGVAWTD

SEQ ID NO: 12814 - protein, 9 aa, Homo Sapiens
TAEPELYLL

SEQ ID NO: 12815 - protein, 9 aa, Homo Sapiens
KMAQMARRL

SEQ ID NO: 12816 - protein, 9 aa, Homo Sapiens
ESQILPFPN

SEQ ID NO: 12817 - protein, 9 aa, Homo Sapiens
VNTGIANTL

SEQ ID NO: 12818 - protein, 9 aa, Homo Sapiens
ELIQLGITH

SEQ ID NO: 12819 - protein, 9 aa, Homo Sapiens
TQAPPPPPK

SEQ ID NO: 12820 - protein, 9 aa, Homo Sapiens
TAKVAEPPQ

SEQ ID NO: 12821 - protein, 9 aa, Homo Sapiens
KVEAKVAAG

SEQ ID NO: 12822 - protein, 9 aa, Homo Sapiens
KKAEKDGFL

SEQ ID NO: 12823 - protein, 9 aa, Homo Sapiens
VIEHYFGVE

SEQ ID NO: 12824 - protein, 9 aa, Homo Sapiens
KESYCIYIY

SEQ ID NO: 12825 - protein, 9 aa, Homo Sapiens
HIVRSLPIQ

SEQ ID NO: 12826 - protein, 9 aa, Homo Sapiens
FDYNQRRKR

SEQ ID NO: 12827 - protein, 9 aa, Homo Sapiens
KQKRSFKAV

SEQ ID NO: 12828 - protein, 9 aa, Homo Sapiens
FVPVQSSLL

SEQ ID NO: 12829 - protein, 9 aa, Homo Sapiens
IMTNGLCIW

SEQ ID NO: 12830 - protein, 9 aa, Homo Sapiens
ILERGGWPA

SEQ ID NO: 12831 - protein, 9 aa, Homo Sapiens
LLDFLLQLP

SEQ ID NO: 12832 - protein, 9 aa, Homo Sapiens
EHSERCESM

SEQ ID NO: 12833 - protein, 9 aa, Homo Sapiens
DSVITVGQG

SEQ ID NO: 12834 - protein, 9 aa, Homo Sapiens
SPNKEIIIL

SEQ ID NO: 12835 - protein, 9 aa, Homo Sapiens
RPWNDSLIR

SEQ ID NO: 12836 - protein, 9 aa, Homo Sapiens
PASATPLGP

SEQ ID NO: 12837 - protein, 9 aa, Homo Sapiens
RGPGPHSSL

SEQ ID NO: 12838 - protein, 9 aa, Homo Sapiens
IRLISLTDK

SEQ ID NO: 12839 - protein, 9 aa, Homo Sapiens
TTIIDSGPG

SEQ ID NO: 12840 - protein, 9 aa, Homo Sapiens
SFHQKSNLT

SEQ ID NO: 12841 - protein, 9 aa, Homo Sapiens
MNWDVQGYC

SEQ ID NO: 12842 - protein, 9 aa, Homo Sapiens
QPEEEELWE

SEQ ID NO: 12843 - protein, 9 aa, Homo Sapiens
SYMPRKPVK

SEQ ID NO: 12844 - protein, 9 aa, Homo Sapiens
EWAQNTIIP

SEQ ID NO: 12845 - protein, 9 aa, Homo Sapiens
KKRSAFPSR

SEQ ID NO: 12846 - protein, 9 aa, Homo Sapiens
EVLRPMVAR

SEQ ID NO: 12847 - protein, 9 aa, Homo Sapiens
KKKRSAFPS

SEQ ID NO: 12848 - protein, 9 aa, Homo Sapiens
DEHTTIIDS

SEQ ID NO: 12849 - protein, 9 aa, Homo Sapiens
KLLDFLLQL

SEQ ID NO: 12850 - protein, 9 aa, Homo Sapiens
SEHSERCES

SEQ ID NO: 12851 - protein, 9 aa, Homo Sapiens
CEEDNPVIL

SEQ ID NO: 12852 - protein, 9 aa, Homo Sapiens
TDKNALSGN

SEQ ID NO: 12853 - protein, 9 aa, Homo Sapiens
VSVSDEGYK

SEQ ID NO: 12854 - protein, 9 aa, Homo Sapiens
HSSLDQHVA

SEQ ID NO: 12855 - protein, 9 aa, Homo Sapiens
ALHSIGLKC

SEQ ID NO: 12856 - protein, 9 aa, Homo Sapiens
RPMVARYGL

SEQ ID NO: 12857 - protein, 9 aa, Homo Sapiens
LLTATHCRK

SEQ ID NO: 12858 - protein, 9 aa, Homo Sapiens
SPPNMDELM

SEQ ID NO: 12859 - protein, 9 aa, Homo Sapiens
KLSKMIENK

SEQ ID NO: 12860 - protein, 9 aa, Homo Sapiens
QALRRAAAY

SEQ ID NO: 12861 - protein, 9 aa, Homo Sapiens
DSHFPRYAV

SEQ ID NO: 12862 - protein, 9 aa, Homo Sapiens
LIRWCFFVD

SEQ ID NO: 12863 - protein, 9 aa, Homo Sapiens
DFVIIVFAY

SEQ ID NO: 12864 - protein, 9 aa, Homo Sapiens
KRSAFPSRS

SEQ ID NO: 12865 - protein, 9 aa, Homo Sapiens
VGQGEVVTV

SEQ ID NO: 12866 - protein, 9 aa, Homo Sapiens
PYSSASPHP

SEQ ID NO: 12867 - protein, 9 aa, Homo Sapiens
MDELMSRSQ

SEQ ID NO: 12868 - protein, 9 aa, Homo Sapiens
GTYSCSYMP

SEQ ID NO: 12869 - protein, 9 aa, Homo Sapiens
VSSLEALDS

SEQ ID NO: 12870 - protein, 9 aa, Homo Sapiens
MFNSSCMGG

SEQ ID NO: 12871 - protein, 9 aa, Homo Sapiens
TEARHIRRS

SEQ ID NO: 12872 - protein, 9 aa, Homo Sapiens
GLQRDWARA

SEQ ID NO: 12873 - protein, 9 aa, Homo Sapiens
MGPRRFLSP

SEQ ID NO: 12874 - protein, 9 aa, Homo Sapiens
SLLAQHKRI

SEQ ID NO: 12875 - protein, 9 aa, Homo Sapiens
SRESTNGST

SEQ ID NO: 12876 - protein, 9 aa, Homo Sapiens
PACYRRKED

SEQ ID NO: 12877 - protein, 9 aa, Homo Sapiens
HTTIIDSGP

SEQ ID NO: 12878 - protein, 9 aa, Homo Sapiens
KAKGCQSPP

SEQ ID NO: 12879 - protein, 9 aa, Homo Sapiens
EARHIRRSL

SEQ ID NO: 12880 - protein, 9 aa, Homo Sapiens
WLDFVIIVF

SEQ ID NO: 12881 - protein, 9 aa, Homo Sapiens
LETQYQYPQ

SEQ ID NO: 12882 - protein, 9 aa, Homo Sapiens
SLEALDSCF

SEQ ID NO: 12883 - protein, 9 aa, Homo Sapiens
DSGVCDSEE

SEQ ID NO: 12884 - protein, 9 aa, Homo Sapiens
WLLTATHCR

SEQ ID NO: 12885 - protein, 9 aa, Homo Sapiens
LWDTFEDDI

SEQ ID NO: 12886 - protein, 9 aa, Homo Sapiens
LKYRTKTQA

SEQ ID NO: 12887 - protein, 9 aa, Homo Sapiens
KKYRNQYCT

SEQ ID NO: 12888 - protein, 9 aa, Homo Sapiens
LTSVVSTRS

SEQ ID NO: 12889 - protein, 9 aa, Homo Sapiens
NMEWIPPES

SEQ ID NO: 12890 - protein, 9 aa, Homo Sapiens
ISFVLLLGA

SEQ ID NO: 12891 - protein, 9 aa, Homo Sapiens
VMFTNQSEH

SEQ ID NO: 12892 - protein, 9 aa, Homo Sapiens
QPTPQKVTN

SEQ ID NO: 12893 - protein, 9 aa, Homo Sapiens
SDQRGSRET

SEQ ID NO: 12894 - protein, 9 aa, Homo Sapiens
RSSKEPLIS

SEQ ID NO: 12895 - protein, 9 aa, Homo Sapiens
LDFVIIVFA

SEQ ID NO: 12896 - protein, 9 aa, Homo Sapiens
KGCQSPPKI

SEQ ID NO: 12897 - protein, 9 aa, Homo Sapiens
DNPVILSYF

SEQ ID NO: 12898 - protein, 9 aa, Homo Sapiens
LQRDWARAM

SEQ ID NO: 12899 - protein, 9 aa, Homo Sapiens
VCDSEESVF

SEQ ID NO: 12900 - protein, 9 aa, Homo Sapiens
SFVLLLGAA

SEQ ID NO: 12901 - protein, 9 aa, Homo Sapiens
AGPASATPL

SEQ ID NO: 12902 - protein, 9 aa, Homo Sapiens
RWCFFVDNH

SEQ ID NO: 12903 - protein, 9 aa, Homo Sapiens
FLKFSTEPN

SEQ ID NO: 12904 - protein, 9 aa, Homo Sapiens
VILSYFKRA

SEQ ID NO: 12905 - protein, 9 aa, Homo Sapiens
MPRKPVKHT

SEQ ID NO: 12906 - protein, 9 aa, Homo Sapiens
AKAKGCQSP

SEQ ID NO: 12907 - protein, 9 aa, Homo Sapiens
LLKKYRNQY

SEQ ID NO: 12908 - protein, 9 aa, Homo Sapiens
AFPSRSLSS

SEQ ID NO: 12909 - protein, 9 aa, Homo Sapiens
YSCSYMPRK

SEQ ID NO: 12910 - protein, 9 aa, Homo Sapiens
DFLLQLPHL

SEQ ID NO: 12911 - protein, 9 aa, Homo Sapiens
PESALRETV

SEQ ID NO: 12912 - protein, 9 aa, Homo Sapiens
AVGLQRDWA

SEQ ID NO: 12913 - protein, 9 aa, Homo Sapiens
VVQQFTHAG

SEQ ID NO: 12914 - protein, 9 aa, Homo Sapiens
PPESALRET

SEQ ID NO: 12915 - protein, 9 aa, Homo Sapiens
LSYFKRADP

SEQ ID NO: 12916 - protein, 9 aa, Homo Sapiens
CPYYCPNMY

SEQ ID NO: 12917 - protein, 9 aa, Homo Sapiens
ETDHRMAGQ

SEQ ID NO: 12918 - protein, 9 aa, Homo Sapiens
ALSTEARHI

SEQ ID NO: 12919 - protein, 9 aa, Homo Sapiens
ALRETVLGA

SEQ ID NO: 12920 - protein, 9 aa, Homo Sapiens
TVGQGEVVT

SEQ ID NO: 12921 - protein, 9 aa, Homo Sapiens
DTKADVLTE

SEQ ID NO: 12922 - protein, 9 aa, Homo Sapiens
ATPLGPRED

SEQ ID NO: 12923 - protein, 9 aa, Homo Sapiens
LVCVTPCDS

SEQ ID NO: 12924 - protein, 9 aa, Homo Sapiens
PGPHSSLDQ

SEQ ID NO: 12925 - protein, 9 aa, Homo Sapiens
PQPEEEELW

SEQ ID NO: 12926 - protein, 9 aa, Homo Sapiens
PDIRGRACF

SEQ ID NO: 12927 - protein, 9 aa, Homo Sapiens
WARAMELCL

SEQ ID NO: 12928 - protein, 9 aa, Homo Sapiens
KSFHQKSNL

SEQ ID NO: 12929 - protein, 9 aa, Homo Sapiens
GVCDSEESV

SEQ ID NO: 12930 - protein, 9 aa, Homo Sapiens
TQEDTTGPH

SEQ ID NO: 12931 - protein, 9 aa, Homo Sapiens
SAFPSRSLS

SEQ ID NO: 12932 - protein, 9 aa, Homo Sapiens
AVKFFLLKK

SEQ ID NO: 12933 - protein, 9 aa, Homo Sapiens
SSKEPLISG

SEQ ID NO: 12934 - protein, 9 aa, Homo Sapiens
LLVSVSDEG

SEQ ID NO: 12935 - protein, 9 aa, Homo Sapiens
VSDEGYKKL

SEQ ID NO: 12936 - protein, 9 aa, Homo Sapiens
ALLVSVSDE

SEQ ID NO: 12937 - protein, 9 aa, Homo Sapiens
VKEALSTEA

SEQ ID NO: 12938 - protein, 9 aa, Homo Sapiens
NGGLLFPFP

SEQ ID NO: 12939 - protein, 9 aa, Homo Sapiens
DISFVLLLG

SEQ ID NO: 12940 - protein, 9 aa, Homo Sapiens
HELTSNAIV

SEQ ID NO: 12941 - protein, 9 aa, Homo Sapiens
VRDVLDTVA

SEQ ID NO: 12942 - protein, 9 aa, Homo Sapiens
PNMDELMSR

SEQ ID NO: 12943 - protein, 9 aa, Homo Sapiens
RLLKKYRNQ

SEQ ID NO: 12944 - protein, 9 aa, Homo Sapiens
DTFEDDISE

SEQ ID NO: 12945 - protein, 9 aa, Homo Sapiens
ESPNKEIII

SEQ ID NO: 12946 - protein, 9 aa, Homo Sapiens
RLPALHSIG

SEQ ID NO: 12947 - protein, 9 aa, Homo Sapiens
ENKSPSVGL

SEQ ID NO: 12948 - protein, 9 aa, Homo Sapiens
RACFCALLN

SEQ ID NO: 12949 - protein, 9 aa, Homo Sapiens
EEELWEEEV

SEQ ID NO: 12950 - protein, 9 aa, Homo Sapiens
DQRGSRETD

SEQ ID NO: 12951 - protein, 9 aa, Homo Sapiens
PQKVTNCLH

SEQ ID NO: 12952 - protein, 9 aa, Homo Sapiens
LDISFVLLL

SEQ ID NO: 12953 - protein, 9 aa, Homo Sapiens
WIPPESALR

SEQ ID NO: 12954 - protein, 9 aa, Homo Sapiens
LLLRLPALH

SEQ ID NO: 12955 - protein, 9 aa, Homo Sapiens
IQFLKFSTE

SEQ ID NO: 12956 - protein, 9 aa, Homo Sapiens
QESSRHSAS

SEQ ID NO: 12957 - protein, 9 aa, Homo Sapiens
NKSPSVGLE

SEQ ID NO: 12958 - protein, 9 aa, Homo Sapiens
LSPEPKQPW

SEQ ID NO: 12959 - protein, 9 aa, Homo Sapiens
KEALSTEAR

SEQ ID NO: 12960 - protein, 9 aa, Homo Sapiens
RRFLSPEPK

SEQ ID NO: 12961 - protein, 9 aa, Homo Sapiens
ISLTDKNAL

SEQ ID NO: 12962 - protein, 9 aa, Homo Sapiens
AVLLCRARE

SEQ ID NO: 12963 - protein, 9 aa, Homo Sapiens
LTSNAIVFL

SEQ ID NO: 12964 - protein, 9 aa, Homo Sapiens
GLLFPFPDI

SEQ ID NO: 12965 - protein, 9 aa, Homo Sapiens
VGLQRDWAR

SEQ ID NO: 12966 - protein, 9 aa, Homo Sapiens
AFRLLKKYR

SEQ ID NO: 12967 - protein, 9 aa, Homo Sapiens
LLVLKYRGL

SEQ ID NO: 12968 - protein, 9 aa, Homo Sapiens
IPKVLVMAN

SEQ ID NO: 12969 - protein, 9 aa, Homo Sapiens
PWNDSLIRW

SEQ ID NO: 12970 - protein, 9 aa, Homo Sapiens
TTGPHQKTS

SEQ ID NO: 12971 - protein, 9 aa, Homo Sapiens
RLISLTDKN

SEQ ID NO: 12972 - protein, 9 aa, Homo Sapiens
SVSDEGYKK

SEQ ID NO: 12973 - protein, 9 aa, Homo Sapiens
CQSPPKIRN

SEQ ID NO: 12974 - protein, 9 aa, Homo Sapiens
NGTYSCSYM

SEQ ID NO: 12975 - protein, 9 aa, Homo Sapiens
TGPHQKTSL

SEQ ID NO: 12976 - protein, 9 aa, Homo Sapiens
SVITVGQGE

SEQ ID NO: 12977 - protein, 9 aa, Homo Sapiens
PCDSHFPRY

SEQ ID NO: 12978 - protein, 9 aa, Homo Sapiens
KFSTEPNHD

SEQ ID NO: 12979 - protein, 9 aa, Homo Sapiens
LVRDVLDTV

SEQ ID NO: 12980 - protein, 9 aa, Homo Sapiens
LQNMEWIPP

SEQ ID NO: 12981 - protein, 9 aa, Homo Sapiens
KKKLESPNK

SEQ ID NO: 12982 - protein, 9 aa, Homo Sapiens
ELTSNAIVF

SEQ ID NO: 12983 - protein, 9 aa, Homo Sapiens
SSLEALDSC

SEQ ID NO: 12984 - protein, 9 aa, Homo Sapiens
AGACFLLVL

SEQ ID NO: 12985 - protein, 9 aa, Homo Sapiens
IDSGPGACE

SEQ ID NO: 12986 - protein, 9 aa, Homo Sapiens
STGSDSGVC

SEQ ID NO: 12987 - protein, 9 aa, Homo Sapiens
RRKQQALRR

SEQ ID NO: 12988 - protein, 9 aa, Homo Sapiens
KFFLLKKFL

SEQ ID NO: 12989 - protein, 9 aa, Homo Sapiens
HESHAVLLC

SEQ ID NO: 12990 - protein, 9 aa, Homo Sapiens
FLQNMEWIP

SEQ ID NO: 12991 - protein, 9 aa, Homo Sapiens
RETDHRMAG

SEQ ID NO: 12992 - protein, 9 aa, Homo Sapiens
KSNLTVHQR

SEQ ID NO: 12993 - protein, 9 aa, Homo Sapiens
NPVILSYFK

SEQ ID NO: 12994 - protein, 9 aa, Homo Sapiens
RTAICPYYC

SEQ ID NO: 12995 - protein, 9 aa, Homo Sapiens
VKFFLLKKF

SEQ ID NO: 12996 - protein, 9 aa, Homo Sapiens
TFEDDISEI

SEQ ID NO: 12997 - protein, 9 aa, Homo Sapiens
YLKYRTKTQ

SEQ ID NO: 12998 - protein, 9 aa, Homo Sapiens
LFPFPDISR

SEQ ID NO: 12999 - protein, 9 aa, Homo Sapiens
ETPKKKRSA

SEQ ID NO: 13000 - protein, 9 aa, Homo Sapiens
QWLLTATHC

SEQ ID NO: 13001 - protein, 9 aa, Homo Sapiens
SRETDHRMA

SEQ ID NO: 13002 - protein, 9 aa, Homo Sapiens
FADYNREHG

SEQ ID NO: 13003 - protein, 9 aa, Homo Sapiens
PSDQRGSRE

SEQ ID NO: 13004 - protein, 9 aa, Homo Sapiens
CMLSLLAQH

SEQ ID NO: 13005 - protein, 9 aa, Homo Sapiens
CDSHFPRYA

SEQ ID NO: 13006 - protein, 9 aa, Homo Sapiens
LPHLQAMVA

SEQ ID NO: 13007 - protein, 9 aa, Homo Sapiens
MLSLLAQHK

SEQ ID NO: 13008 - protein, 9 aa, Homo Sapiens
SPPKIRNYN

SEQ ID NO: 13009 - protein, 9 aa, Homo Sapiens
NKEIIILHN

SEQ ID NO: 13010 - protein, 9 aa, Homo Sapiens
LALLVSVSD

SEQ ID NO: 13011 - protein, 9 aa, Homo Sapiens
NRPAERKTS

SEQ ID NO: 13012 - protein, 9 aa, Homo Sapiens
GGEEQRANR

SEQ ID NO: 13013 - protein, 9 aa, Homo Sapiens
AQNTIIPKV

SEQ ID NO: 13014 - protein, 9 aa, Homo Sapiens
PALHSIGLK

SEQ ID NO: 13015 - protein, 9 aa, Homo Sapiens
PLGPREDLG

SEQ ID NO: 13016 - protein, 9 aa, Homo Sapiens
CVTPCDSHF

SEQ ID NO: 13017 - protein, 9 aa, Homo Sapiens
SKMIENKSP

SEQ ID NO: 13018 - protein, 9 aa, Homo Sapiens
EQAQESSRH

SEQ ID NO: 13019 - protein, 9 aa, Homo Sapiens
LGPREDLGA

SEQ ID NO: 13020 - protein, 9 aa, Homo Sapiens
DSGPGACEE

SEQ ID NO: 13021 - protein, 9 aa, Homo Sapiens
NAFRLLKKY

SEQ ID NO: 13022 - protein, 9 aa, Homo Sapiens
PQWLLTATH

SEQ ID NO: 13023 - protein, 9 aa, Homo Sapiens
QIPGLWDTF

SEQ ID NO: 13024 - protein, 9 aa, Homo Sapiens
DVLDTVAFV

SEQ ID NO: 13025 - protein, 9 aa, Homo Sapiens
LWEEEVADE

SEQ ID NO: 13026 - protein, 9 aa, Homo Sapiens
YRTKTQASA

SEQ ID NO: 13027 - protein, 9 aa, Homo Sapiens
NMDELMSRS

SEQ ID NO: 13028 - protein, 9 aa, Homo Sapiens
KNALSGNEE

SEQ ID NO: 13029 - protein, 9 aa, Homo Sapiens
REVVQQFTH

SEQ ID NO: 13030 - protein, 9 aa, Homo Sapiens
GTGKVTVEY

SEQ ID NO: 13031 - protein, 9 aa, Homo Sapiens
HIQFLKFST

SEQ ID NO: 13032 - protein, 9 aa, Homo Sapiens
AKGCQSPPK

SEQ ID NO: 13033 - protein, 9 aa, Homo Sapiens
PPRSSKEPL

SEQ ID NO: 13034 - protein, 9 aa, Homo Sapiens
GWRTAICPY

SEQ ID NO: 13035 - protein, 9 aa, Homo Sapiens
NYMFNSSCM

SEQ ID NO: 13036 - protein, 9 aa, Homo Sapiens
LTRKIGGPL

SEQ ID NO: 13037 - protein, 9 aa, Homo Sapiens
FLLKKFLQN

SEQ ID NO: 13038 - protein, 9 aa, Homo Sapiens
SVVSTRSRS

SEQ ID NO: 13039 - protein, 9 aa, Homo Sapiens
SDEGYKKLA

SEQ ID NO: 13040 - protein, 9 aa, Homo Sapiens
QKSNLTVHQ

SEQ ID NO: 13041 - protein, 9 aa, Homo Sapiens
MVARYGLDL

SEQ ID NO: 13042 - protein, 9 aa, Homo Sapiens
IIPKVLVMA

SEQ ID NO: 13043 - protein, 9 aa, Homo Sapiens
VLLCRAREA

SEQ ID NO: 13044 - protein, 9 aa, Homo Sapiens
PQPLLIAFS

SEQ ID NO: 13045 - protein, 9 aa, Homo Sapiens
ALRRAAAYV

SEQ ID NO: 13046 - protein, 9 aa, Homo Sapiens
FEDDISEIS

SEQ ID NO: 13047 - protein, 9 aa, Homo Sapiens
YPQPLLIAF

SEQ ID NO: 13048 - protein, 9 aa, Homo Sapiens
LISLTDKNA

SEQ ID NO: 13049 - protein, 9 aa, Homo Sapiens
YNYMFNSSC

SEQ ID NO: 13050 - protein, 9 aa, Homo Sapiens
DVGTGKVTV

SEQ ID NO: 13051 - protein, 9 aa, Homo Sapiens
ESHAVLLCR

SEQ ID NO: 13052 - protein, 9 aa, Homo Sapiens
TYSCSYMPR

SEQ ID NO: 13053 - protein, 9 aa, Homo Sapiens
LSLLAQHKR

SEQ ID NO: 13054 - protein, 9 aa, Homo Sapiens
AQESSRHSA

SEQ ID NO: 13055 - protein, 9 aa, Homo Sapiens
MFTNQSEHS

SEQ ID NO: 13056 - protein, 9 aa, Homo Sapiens
EHTTIIDSG

SEQ ID NO: 13057 - protein, 9 aa, Homo Sapiens
QYQYPQPLL

SEQ ID NO: 13058 - protein, 9 aa, Homo Sapiens
GCQSPPKIR

SEQ ID NO: 13059 - protein, 9 aa, Homo Sapiens
KTQASATIL

SEQ ID NO: 13060 - protein, 9 aa, Homo Sapiens
AASPPNMDE

SEQ ID NO: 13061 - protein, 9 aa, Homo Sapiens
AGPDTKADV

SEQ ID NO: 13062 - protein, 9 aa, Homo Sapiens
FFLLKKFLQ

SEQ ID NO: 13063 - protein, 9 aa, Homo Sapiens
IIVFAYLTE

SEQ ID NO: 13064 - protein, 9 aa, Homo Sapiens
ALDSCFAVG

SEQ ID NO: 13065 - protein, 9 aa, Homo Sapiens
LTATHCRKK

SEQ ID NO: 13066 - protein, 9 aa, Homo Sapiens
EGQNGGLLF

SEQ ID NO: 13067 - protein, 9 aa, Homo Sapiens
SGPGACEES

SEQ ID NO: 13068 - protein, 9 aa, Homo Sapiens
QGSRESTNG

SEQ ID NO: 13069 - protein, 9 aa, Homo Sapiens
HYNYMFNSS

SEQ ID NO: 13070 - protein, 9 aa, Homo Sapiens
ANRPAERKT

SEQ ID NO: 13071 - protein, 9 aa, Homo Sapiens
QEDTTGPHQ

SEQ ID NO: 13072 - protein, 9 aa, Homo Sapiens
EELWEEEVA

SEQ ID NO: 13073 - protein, 9 aa, Homo Sapiens
ESALRETVL

SEQ ID NO: 13074 - protein, 9 aa, Homo Sapiens
FVIIVFAYL

SEQ ID NO: 13075 - protein, 9 aa, Homo Sapiens
VLDTVAFVE

SEQ ID NO: 13076 - protein, 9 aa, Homo Sapiens
MDRPPRSSK

SEQ ID NO: 13077 - protein, 9 aa, Homo Sapiens
FCMLSLLAQ

SEQ ID NO: 13078 - protein, 9 aa, Homo Sapiens
SKEPLISGW

SEQ ID NO: 13079 - protein, 9 aa, Homo Sapiens
GEGQNGGLL

SEQ ID NO: 13080 - protein, 9 aa, Homo Sapiens
HAGPDTKAD

SEQ ID NO: 13081 - protein, 9 aa, Homo Sapiens
RPPRSSKEP

SEQ ID NO: 13082 - protein, 9 aa, Homo Sapiens
YQYPQPLLI

SEQ ID NO: 13083 - protein, 9 aa, Homo Sapiens
YSSASPHPC

SEQ ID NO: 13084 - protein, 9 aa, Homo Sapiens
TSVVSTRSR

SEQ ID NO: 13085 - protein, 9 aa, Homo Sapiens
DTTGPHQKT

SEQ ID NO: 13086 - protein, 9 aa, Homo Sapiens
LSKMIENKS

SEQ ID NO: 13087 - protein, 9 aa, Homo Sapiens
FLLQLPHLQ

SEQ ID NO: 13088 - protein, 9 aa, Homo Sapiens
ASATPLGPR

SEQ ID NO: 13089 - protein, 9 aa, Homo Sapiens
KLESPNKEI

SEQ ID NO: 13090 - protein, 9 aa, Homo Sapiens
TAICPYYCP

SEQ ID NO: 13091 - protein, 9 aa, Homo Sapiens
RFLSPEPKQ

SEQ ID NO: 13092 - protein, 9 aa, Homo Sapiens
CFLLVLKYR

SEQ ID NO: 13093 - protein, 9 aa, Homo Sapiens
HQKSNLTVH

SEQ ID NO: 13094 - protein, 9 aa, Homo Sapiens
NTIIPKVLV

SEQ ID NO: 13095 - protein, 9 aa, Homo Sapiens
LHSIGLKCL

SEQ ID NO: 13096 - protein, 9 aa, Homo Sapiens
ERLTLTRKI

SEQ ID NO: 13097 - protein, 9 aa, Homo Sapiens
PGLWDTFED

SEQ ID NO: 13098 - protein, 9 aa, Homo Sapiens
RSAFPSRSL

SEQ ID NO: 13099 - protein, 9 aa, Homo Sapiens
KIGGPLLTA

SEQ ID NO: 13100 - protein, 9 aa, Homo Sapiens
EDTTGPHQK

SEQ ID NO: 13101 - protein, 9 aa, Homo Sapiens
TTQEDTTGP

SEQ ID NO: 13102 - protein, 9 aa, Homo Sapiens
HPQWLLTAT

SEQ ID NO: 13103 - protein, 9 aa, Homo Sapiens
SHFPRYAVM

SEQ ID NO: 13104 - protein, 9 aa, Homo Sapiens
QREVVQQFT

SEQ ID NO: 13105 - protein, 9 aa, Homo Sapiens
TIHYNYMFN

SEQ ID NO: 13106 - protein, 9 aa, Homo Sapiens
SVLAGACFL

SEQ ID NO: 13107 - protein, 9 aa, Homo Sapiens
DIRGRACFC

SEQ ID NO: 13108 - protein, 9 aa, Homo Sapiens
QAQESSRHS

SEQ ID NO: 13109 - protein, 9 aa, Homo Sapiens
SPEPKQPWS

SEQ ID NO: 13110 - protein, 9 aa, Homo Sapiens
GEEQRANRP

SEQ ID NO: 13111 - protein, 9 aa, Homo Sapiens
ACFLLVLKY

SEQ ID NO: 13112 - protein, 9 aa, Homo Sapiens
IVFLQQLLD

SEQ ID NO: 13113 - protein, 9 aa, Homo Sapiens
STEARHIRR

SEQ ID NO: 13114 - protein, 9 aa, Homo Sapiens
SRHEQAQES

SEQ ID NO: 13115 - protein, 9 aa, Homo Sapiens
IPPESALRE

SEQ ID NO: 13116 - protein, 9 aa, Homo Sapiens
LLDISFVLL

SEQ ID NO: 13117 - protein, 9 aa, Homo Sapiens
PVILSYFKR

SEQ ID NO: 13118 - protein, 9 aa, Homo Sapiens
LLCRAREAE

SEQ ID NO: 13119 - protein, 9 aa, Homo Sapiens
VTPCDSHFP

SEQ ID NO: 13120 - protein, 9 aa, Homo Sapiens
LKKYRNQYC

SEQ ID NO: 13121 - protein, 9 aa, Homo Sapiens
PWNWLDFVI

SEQ ID NO: 13122 - protein, 9 aa, Homo Sapiens
LDSCFAVGP

SEQ ID NO: 13123 - protein, 9 aa, Homo Sapiens
KADVLTECL

SEQ ID NO: 13124 - protein, 9 aa, Homo Sapiens
PEEEELWEE

SEQ ID NO: 13125 - protein, 9 aa, Homo Sapiens
SALRETVLG

SEQ ID NO: 13126 - protein, 9 aa, Homo Sapiens
TQYQYPQPL

SEQ ID NO: 13127 - protein, 9 aa, Homo Sapiens
GSRHEQAQE

SEQ ID NO: 13128 - protein, 9 aa, Homo Sapiens
HAVLLCRAR

SEQ ID NO: 13129 - protein, 9 aa, Homo Sapiens
KKFLQNMEW

SEQ ID NO: 13130 - protein, 9 aa, Homo Sapiens
NETPKKKRS

SEQ ID NO: 13131 - protein, 9 aa, Homo Sapiens
PRRFLSPEP

SEQ ID NO: 13132 - protein, 9 aa, Homo Sapiens
NQPTPQKVT

SEQ ID NO: 13133 - protein, 9 aa, Homo Sapiens
LKFSTEPNH

SEQ ID NO: 13134 - protein, 9 aa, Homo Sapiens
QFLKFSTEP

SEQ ID NO: 13135 - protein, 9 aa, Homo Sapiens
KGGEEQRAN

SEQ ID NO: 13136 - protein, 9 aa, Homo Sapiens
ATHCRKKVF

SEQ ID NO: 13137 - protein, 9 aa, Homo Sapiens
THESHAVLL

SEQ ID NO: 13138 - protein, 9 aa, Homo Sapiens
GSDSGVCDS

SEQ ID NO: 13139 - protein, 9 aa, Homo Sapiens
KLHAGPDTK

SEQ ID NO: 13140 - protein, 9 aa, Homo Sapiens
EWIPPESAL

SEQ ID NO: 13141 - protein, 9 aa, Homo Sapiens
APLTSVVST

SEQ ID NO: 13142 - protein, 9 aa, Homo Sapiens
WAQNTIIPK

SEQ ID NO: 13143 - protein, 9 aa, Homo Sapiens
LPAPYSSAS

SEQ ID NO: 13144 - protein, 9 aa, Homo Sapiens
GQGEVVTVR

SEQ ID NO: 13145 - protein, 9 aa, Homo Sapiens
GPHSSLDQH

SEQ ID NO: 13146 - protein, 9 aa, Homo Sapiens
ESSRHSASQ

SEQ ID NO: 13147 - protein, 9 aa, Homo Sapiens
MPRRKQQAL

SEQ ID NO: 13148 - protein, 9 aa, Homo Sapiens
FLLDISFVL

SEQ ID NO: 13149 - protein, 9 aa, Homo Sapiens
HSIGLKCLE

SEQ ID NO: 13150 - protein, 9 aa, Homo Sapiens
PMGPRRFLS

SEQ ID NO: 13151 - protein, 9 aa, Homo Sapiens
ETHESHAVL

SEQ ID NO: 13152 - protein, 9 aa, Homo Sapiens
NGSTNSNSS

SEQ ID NO: 13153 - protein, 9 aa, Homo Sapiens
MSGGFADYN

SEQ ID NO: 13154 - protein, 9 aa, Homo Sapiens
FRLLKKYRN

SEQ ID NO: 13155 - protein, 9 aa, Homo Sapiens
GPASATPLG

SEQ ID NO: 13156 - protein, 9 aa, Homo Sapiens
GKSFHQKSN

SEQ ID NO: 13157 - protein, 9 aa, Homo Sapiens
GRACFCALL

SEQ ID NO: 13158 - protein, 9 aa, Homo Sapiens
TPCDSHFPR

SEQ ID NO: 13159 - protein, 9 aa, Homo Sapiens
RTKTQASAT

SEQ ID NO: 13160 - protein, 9 aa, Homo Sapiens
VPLPAPYSS

SEQ ID NO: 13161 - protein, 9 aa, Homo Sapiens
PMVARYGLD

SEQ ID NO: 13162 - protein, 9 aa, Homo Sapiens
KFLQNMEWI

SEQ ID NO: 13163 - protein, 9 aa, Homo Sapiens
WEEEVADEE

SEQ ID NO: 13164 - protein, 9 aa, Homo Sapiens
TRKIGGPLL

SEQ ID NO: 13165 - protein, 9 aa, Homo Sapiens
LRLPALHSI

SEQ ID NO: 13166 - protein, 9 aa, Homo Sapiens
LTLTRKIGG

SEQ ID NO: 13167 - protein, 9 aa, Homo Sapiens
QRDWARAME

SEQ ID NO: 13168 - protein, 9 aa, Homo Sapiens
MPACYRRKE

SEQ ID NO: 13169 - protein, 9 aa, Homo Sapiens
FNSSCMGGM

SEQ ID NO: 13170 - protein, 9 aa, Homo Sapiens
TIIPKVLVM

SEQ ID NO: 13171 - protein, 9 aa, Homo Sapiens
LRRAAAYVS

SEQ ID NO: 13172 - protein, 9 aa, Homo Sapiens
QASATILGA

SEQ ID NO: 13173 - protein, 9 aa, Homo Sapiens
EVVQQFTHA

SEQ ID NO: 13174 - protein, 9 aa, Homo Sapiens
CGKSFHQKS

SEQ ID NO: 13175 - protein, 9 aa, Homo Sapiens
IIDSGPGAC

SEQ ID NO: 13176 - protein, 9 aa, Homo Sapiens
QILVRDVLD

SEQ ID NO: 13177 - protein, 9 aa, Homo Sapiens
EDNPVILSY

SEQ ID NO: 13178 - protein, 9 aa, Homo Sapiens
NDSLIRWCF

SEQ ID NO: 13179 - protein, 9 aa, Homo Sapiens
IPGLWDTFE

SEQ ID NO: 13180 - protein, 9 aa, Homo Sapiens
LLKKFLQNM

SEQ ID NO: 13181 - protein, 9 aa, Homo Sapiens
THCRKKVFR

SEQ ID NO: 13182 - protein, 9 aa, Homo Sapiens
VRKQREVVQ

SEQ ID NO: 13183 - protein, 9 aa, Homo Sapiens
CQYFLLDIS

SEQ ID NO: 13184 - protein, 9 aa, Homo Sapiens
STNGSTNSN

SEQ ID NO: 13185 - protein, 9 aa, Homo Sapiens
QRGSRETDH

SEQ ID NO: 13186 - protein, 9 aa, Homo Sapiens
LRETVLGAI

SEQ ID NO: 13187 - protein, 9 aa, Homo Sapiens
GPGPHSSLD

SEQ ID NO: 13188 - protein, 9 aa, Homo Sapiens
KMIENKSPS

SEQ ID NO: 13189 - protein, 9 aa, Homo Sapiens
YMPRKPVKH

SEQ ID NO: 13190 - protein, 9 aa, Homo Sapiens
ACYRRKEDS

SEQ ID NO: 13191 - protein, 9 aa, Homo Sapiens
FGAHIQFLK

SEQ ID NO: 13192 - protein, 9 aa, Homo Sapiens
TVKEALSTE

SEQ ID NO: 13193 - protein, 9 aa, Homo Sapiens
SHAVLLCRA

SEQ ID NO: 13194 - protein, 9 aa, Homo Sapiens
TGSDSGVCD

SEQ ID NO: 13195 - protein, 9 aa, Homo Sapiens
QLPHLQAMV

SEQ ID NO: 13196 - protein, 9 aa, Homo Sapiens
LPALHSIGL

SEQ ID NO: 13197 - protein, 9 aa, Homo Sapiens
LRGPGPHSS

SEQ ID NO: 13198 - protein, 9 aa, Homo Sapiens
ASPPNMDEL

SEQ ID NO: 13199 - protein, 9 aa, Homo Sapiens
TEVLRPMVA

SEQ ID NO: 13200 - protein, 9 aa, Homo Sapiens
TTIHYNYMF

SEQ ID NO: 13201 - protein, 9 aa, Homo Sapiens
KSPSVGLET

SEQ ID NO: 13202 - protein, 9 aa, Homo Sapiens
DSLIRWCFF

SEQ ID NO: 13203 - protein, 9 aa, Homo Sapiens
GFADYNREH

SEQ ID NO: 13204 - protein, 9 aa, Homo Sapiens
SLTDKNALS

SEQ ID NO: 13205 - protein, 9 aa, Homo Sapiens
SGGFADYNR

SEQ ID NO: 13206 - protein, 9 aa, Homo Sapiens
ILSYFKRAD

SEQ ID NO: 13207 - protein, 9 aa, Homo Sapiens
IRGRACFCA

SEQ ID NO: 13208 - protein, 9 aa, Homo Sapiens
QSPPKIRNY

SEQ ID NO: 13209 - protein, 9 aa, Homo Sapiens
QKVTNCLHI

SEQ ID NO: 13210 - protein, 9 aa, Homo Sapiens
YYCPNMYEE

SEQ ID NO: 13211 - protein, 9 aa, Homo Sapiens
WRTAICPYY

SEQ ID NO: 13212 - protein, 9 aa, Homo Sapiens
SCSYMPRKP

SEQ ID NO: 13213 - protein, 9 aa, Homo Sapiens
MEWIPPESA

SEQ ID NO: 13214 - protein, 9 aa, Homo Sapiens
YIAASPPNM

SEQ ID NO: 13215 - protein, 9 aa, Homo Sapiens
VLRPMVARY

SEQ ID NO: 13216 - protein, 9 aa, Homo Sapiens
NVNAFRLLK

SEQ ID NO: 13217 - protein, 9 aa, Homo Sapiens
PKKKRSAFP

SEQ ID NO: 13218 - protein, 9 aa, Homo Sapiens
GSRETDHRM

SEQ ID NO: 13219 - protein, 9 aa, Homo Sapiens
TEWAQNTII

SEQ ID NO: 13220 - protein, 9 aa, Homo Sapiens
RKIGGPLLT

SEQ ID NO: 13221 - protein, 9 aa, Homo Sapiens
NWLDFVIIV

SEQ ID NO: 13222 - protein, 9 aa, Homo Sapiens
GPDTKADVL

SEQ ID NO: 13223 - protein, 9 aa, Homo Sapiens
PTPQKVTNC

SEQ ID NO: 13224 - protein, 9 aa, Homo Sapiens
DWARAMELC

SEQ ID NO: 13225 - protein, 9 aa, Homo Sapiens
EEDNPVILS

SEQ ID NO: 13226 - protein, 9 aa, Homo Sapiens
RHEQAQESS

SEQ ID NO: 13227 - protein, 9 aa, Homo Sapiens
PDTKADVLT

SEQ ID NO: 13228 - protein, 9 aa, Homo Sapiens
QQALRRAAA

SEQ ID NO: 13229 - protein, 9 aa, Homo Sapiens
GGFADYNRE

SEQ ID NO: 13230 - protein, 9 aa, Homo Sapiens
GPRRFLSPE

SEQ ID NO: 13231 - protein, 9 aa, Homo Sapiens
LVSVSDEGY

SEQ ID NO: 13232 - protein, 9 aa, Homo Sapiens
GQNGGLLFP

SEQ ID NO: 13233 - protein, 9 aa, Homo Sapiens
SDSGVCDSE

SEQ ID NO: 13234 - protein, 9 aa, Homo Sapiens
SLIRWCFFV

SEQ ID NO: 13235 - protein, 9 aa, Homo Sapiens
VITVGQGEV

SEQ ID NO: 13236 - protein, 9 aa, Homo Sapiens
VCVTPCDSH

SEQ ID NO: 13237 - protein, 9 aa, Homo Sapiens
VNAFRLLKK

SEQ ID NO: 13238 - protein, 9 aa, Homo Sapiens
IMDRPPRSS

SEQ ID NO: 13239 - protein, 9 aa, Homo Sapiens
LLQLPHLQA

SEQ ID NO: 13240 - protein, 9 aa, Homo Sapiens
LSTEARHIR

SEQ ID NO: 13241 - protein, 9 aa, Homo Sapiens
FLLVLKYRG

SEQ ID NO: 13242 - protein, 9 aa, Homo Sapiens
GGLLFPFPD

SEQ ID NO: 13243 - protein, 9 aa, Homo Sapiens
MERLTLTRK

SEQ ID NO: 13244 - protein, 9 aa, Homo Sapiens
EKSFCMLSL

SEQ ID NO: 13245 - protein, 9 aa, Homo Sapiens
VQQFTHAGQ

SEQ ID NO: 13246 - protein, 9 aa, Homo Sapiens
EQRANRPAE

SEQ ID NO: 13247 - protein, 9 aa, Homo Sapiens
ESTNGSTNS

SEQ ID NO: 13248 - protein, 9 aa, Homo Sapiens
TSNAIVFLQ

SEQ ID NO: 13249 - protein, 9 aa, Homo Sapiens
QSEHSERCE

SEQ ID NO: 13250 - protein, 9 aa, Homo Sapiens
KEIIILHNP

SEQ ID NO: 13251 - protein, 9 aa, Homo Sapiens
PRRKQQALR

SEQ ID NO: 13252 - protein, 9 aa, Homo Sapiens
YFLLDISFV

SEQ ID NO: 13253 - protein, 9 aa, Homo Sapiens
RDWARAMEL

SEQ ID NO: 13254 - protein, 9 aa, Homo Sapiens
TATHCRKKV

SEQ ID NO: 13255 - protein, 9 aa, Homo Sapiens
IAASPPNMD

SEQ ID NO: 13256 - protein, 9 aa, Homo Sapiens
EALSTEARH

SEQ ID NO: 13257 - protein, 9 aa, Homo Sapiens
ETQYQYPQP

SEQ ID NO: 13258 - protein, 9 aa, Homo Sapiens
AIVFLQQLL

SEQ ID NO: 13259 - protein, 9 aa, Homo Sapiens
RLTLTRKIG

SEQ ID NO: 13260 - protein, 9 aa, Homo Sapiens
VGTGKVTVE

SEQ ID NO: 13261 - protein, 9 aa, Homo Sapiens
LQLPHLQAM

SEQ ID NO: 13262 - protein, 9 aa, Homo Sapiens
HEQAQESSR

SEQ ID NO: 13263 - protein, 9 aa, Homo Sapiens
AAVKFFLLK

SEQ ID NO: 13264 - protein, 9 aa, Homo Sapiens
TIIDSGPGA

SEQ ID NO: 13265 - protein, 9 aa, Homo Sapiens
PAKAKGCQS

SEQ ID NO: 13266 - protein, 9 aa, Homo Sapiens
RANRPAERK

SEQ ID NO: 13267 - protein, 9 aa, Homo Sapiens
ANQPTPQKV

SEQ ID NO: 13268 - protein, 9 aa, Homo Sapiens
KSFCMLSLL

SEQ ID NO: 13269 - protein, 9 aa, Homo Sapiens
DRPPRSSKE

SEQ ID NO: 13270 - protein, 9 aa, Homo Sapiens
PPNMDELMS

SEQ ID NO: 13271 - protein, 9 aa, Homo Sapiens
EEEELWEEE

SEQ ID NO: 13272 - protein, 9 aa, Homo Sapiens
GLWDTFEDD

SEQ ID NO: 13273 - protein, 9 aa, Homo Sapiens
PLPAPYSSA

SEQ ID NO: 13274 - protein, 9 aa, Homo Sapiens
QNTIIPKVL

SEQ ID NO: 13275 - protein, 9 aa, Homo Sapiens
RGRACFCAL

SEQ ID NO: 13276 - protein, 9 aa, Homo Sapiens
QYFLLDISF

SEQ ID NO: 13277 - protein, 9 aa, Homo Sapiens
RESTNGSTN

SEQ ID NO: 13278 - protein, 9 aa, Homo Sapiens
LLAQHKRIH

SEQ ID NO: 13279 - protein, 9 aa, Homo Sapiens
RKQREVVQQ

SEQ ID NO: 13280 - protein, 9 aa, Homo Sapiens
LDTVAFVEW

SEQ ID NO: 13281 - protein, 9 aa, Homo Sapiens
LESPNKEII

SEQ ID NO: 13282 - protein, 9 aa, Homo Sapiens
RALRGPGPH

SEQ ID NO: 13283 - protein, 9 aa, Homo Sapiens
SFCMLSLLA

SEQ ID NO: 13284 - protein, 9 aa, Homo Sapiens
VFLQQLLDF

SEQ ID NO: 13285 - protein, 9 aa, Homo Sapiens
ELWEEEVAD

SEQ ID NO: 13286 - protein, 9 aa, Homo Sapiens
QPLLIAFSA

SEQ ID NO: 13287 - protein, 9 aa, Homo Sapiens
WNWLDFVII

SEQ ID NO: 13288 - protein, 9 aa, Homo Sapiens
PHQKTSLWT

SEQ ID NO: 13289 - protein, 9 aa, Homo Sapiens
TKADVLTEC

SEQ ID NO: 13290 - protein, 9 aa, Homo Sapiens
RDVLDTVAF

SEQ ID NO: 13291 - protein, 9 aa, Homo Sapiens
VTEVLRPMV

SEQ ID NO: 13292 - protein, 9 aa, Homo Sapiens
QNGGLLFPF

SEQ ID NO: 13293 - protein, 9 aa, Homo Sapiens
FLSPEPKQP

SEQ ID NO: 13294 - protein, 9 aa, Homo Sapiens
AICPYYCPN

SEQ ID NO: 13295 - protein, 9 aa, Homo Sapiens
LHAGPDTKA

SEQ ID NO: 13296 - protein, 9 aa, Homo Sapiens
EALDSCFAV

SEQ ID NO: 13297 - protein, 9 aa, Homo Sapiens
LLRLPALHS

SEQ ID NO: 13298 - protein, 9 aa, Homo Sapiens
PRSSKEPLI

SEQ ID NO: 13299 - protein, 9 aa, Homo Sapiens
LLFPFPDIS

SEQ ID NO: 13300 - protein, 9 aa, Homo Sapiens
PAPYSSASP

SEQ ID NO: 13301 - protein, 9 aa, Homo Sapiens
DKNALSGNE

SEQ ID NO: 13302 - protein, 9 aa, Homo Sapiens
IENKSPSVG

SEQ ID NO: 13303 - protein, 9 aa, Homo Sapiens
PVTEVLRPM

SEQ ID NO: 13304 - protein, 9 aa, Homo Sapiens
CYRRKEDSS

SEQ ID NO: 13305 - protein, 9 aa, Homo Sapiens
NQSEHSERC

SEQ ID NO: 13306 - protein, 9 aa, Homo Sapiens
STANQPTPQ

SEQ ID NO: 13307 - protein, 9 aa, Homo Sapiens
VLAGACFLL

SEQ ID NO: 13308 - protein, 9 aa, Homo Sapiens
TPQKVTNCL

SEQ ID NO: 13309 - protein, 9 aa, Homo Sapiens
QGEVVTVRV

SEQ ID NO: 13310 - protein, 9 aa, Homo Sapiens
PPDIRGRAC

SEQ ID NO: 13311 - protein, 9 aa, Homo Sapiens
TNQSEHSER

SEQ ID NO: 13312 - protein, 9 aa, Homo Sapiens
TLTRKIGGP

SEQ ID NO: 13313 - protein, 9 aa, Homo Sapiens
ADSVITVGQ

SEQ ID NO: 13314 - protein, 9 aa, Homo Sapiens
LKKFLQNME

SEQ ID NO: 13315 - protein, 9 aa, Homo Sapiens
WDTFEDDIS

SEQ ID NO: 13316 - protein, 9 aa, Homo Sapiens
LRPMVARYG

SEQ ID NO: 13317 - protein, 9 aa, Homo Sapiens
TNGSTNSNS

SEQ ID NO: 13318 - protein, 9 aa, Homo Sapiens
PHSSLDQHV

SEQ ID NO: 13319 - protein, 9 aa, Homo Sapiens
TKTQASATI

SEQ ID NO: 13320 - protein, 9 aa, Homo Sapiens
CDSEESVFS

SEQ ID NO: 13321 - protein, 9 aa, Homo Sapiens
VIIVFAYLT

SEQ ID NO: 13322 - protein, 9 aa, Homo Sapiens
KKLESPNKE

SEQ ID NO: 13323 - protein, 9 aa, Homo Sapiens
PNKEIIILH

SEQ ID NO: 13324 - protein, 9 aa, Homo Sapiens
TANQPTPQK

SEQ ID NO: 13325 - protein, 9 aa, Homo Sapiens
NAIVFLQQL

SEQ ID NO: 13326 - protein, 9 aa, Homo Sapiens
SGVCDSEES

SEQ ID NO: 13327 - protein, 9 aa, Homo Sapiens
DEGYKKLAI

SEQ ID NO: 13328 - protein, 9 aa, Homo Sapiens
LTDKNALSG

SEQ ID NO: 13329 - protein, 9 aa, Homo Sapiens
ALRGPGPHS

SEQ ID NO: 13330 - protein, 9 aa, Homo Sapiens
GSRESTNGS

SEQ ID NO: 13331 - protein, 9 aa, Homo Sapiens
ICPYYCPNM

SEQ ID NO: 13332 - protein, 9 aa, Homo Sapiens
KYRTKTQAS

SEQ ID NO: 13333 - protein, 9 aa, Homo Sapiens
LEALDSCFA

SEQ ID NO: 13334 - protein, 9 aa, Homo Sapiens
YVRKQREVV

SEQ ID NO: 13335 - protein, 9 aa, Homo Sapiens
SNAIVFLQQ

SEQ ID NO: 13336 - protein, 9 aa, Homo Sapiens
LDFLLQLPH

SEQ ID NO: 13337 - protein, 9 aa, Homo Sapiens
WNDSLIRWC

SEQ ID NO: 13338 - protein, 9 aa, Homo Sapiens
CSYMPRKPV

SEQ ID NO: 13339 - protein, 9 aa, Homo Sapiens
YMFNSSCMG

SEQ ID NO: 13340 - protein, 9 aa, Homo Sapiens
KQQALRRAA

SEQ ID NO: 13341 - protein, 9 aa, Homo Sapiens
LAVGLQRDW

SEQ ID NO: 13342 - protein, 9 aa, Homo Sapiens
FTNQSEHSE

SEQ ID NO: 13343 - protein, 9 aa, Homo Sapiens
APYSSASPH

SEQ ID NO: 13344 - protein, 9 aa, Homo Sapiens
QRANRPAER

SEQ ID NO: 13345 - protein, 9 aa, Homo Sapiens
SATPLGPRE

SEQ ID NO: 13346 - protein, 9 aa, Homo Sapiens
LAGACFLLV

SEQ ID NO: 13347 - protein, 9 aa, Homo Sapiens
TQILVRDVL

SEQ ID NO: 13348 - protein, 9 aa, Homo Sapiens
QNMEWIPPE

SEQ ID NO: 13349 - protein, 9 aa, Homo Sapiens
SNLTVHQRT

SEQ ID NO: 13350 - protein, 9 aa, Homo Sapiens
PLTSVVSTR

SEQ ID NO: 13351 - protein, 9 aa, Homo Sapiens
ILVRDVLDT

SEQ ID NO: 13352 - protein, 9 aa, Homo Sapiens
IHYNYMFNS

SEQ ID NO: 13353 - protein, 9 aa, Homo Sapiens
TPLGPREDL

SEQ ID NO: 13354 - protein, 9 aa, Homo Sapiens
VVSSLEALD

SEQ ID NO: 13355 - protein, 9 aa, Homo Sapiens
HSERCESME

SEQ ID NO: 13356 - protein, 9 aa, Homo Sapiens
RKQQALRRA

SEQ ID NO: 13357 - protein, 9 aa, Homo Sapiens
GPHQKTSLW

SEQ ID NO: 13358 - protein, 9 aa, Homo Sapiens
FHQKSNLTV

SEQ ID NO: 13359 - protein, 9 aa, Homo Sapiens
QYPQPLLIA

SEQ ID NO: 13360 - protein, 9 aa, Homo Sapiens
RGSRETDHR

SEQ ID NO: 13361 - protein, 9 aa, Homo Sapiens
KQREVVQQF

SEQ ID NO: 13362 - protein, 9 aa, Homo Sapiens
SNETPKKKR

SEQ ID NO: 13363 - protein, 9 aa, Homo Sapiens
PYYCPNMYE

SEQ ID NO: 13364 - protein, 9 aa, Homo Sapiens
GAHIQFLKF

SEQ ID NO: 13365 - protein, 9 aa, Homo Sapiens
TVPLPAPYS

SEQ ID NO: 13366 - protein, 9 aa, Homo Sapiens
TQASATILG

SEQ ID NO: 13367 - protein, 9 aa, Homo Sapiens
MIENKSPSV

SEQ ID NO: 13368 - protein, 9 aa, Homo Sapiens
AHIQFLKFS

SEQ ID NO: 13369 - protein, 9 aa, Homo Sapiens
EEQRANRPA

SEQ ID NO: 13370 - protein, 9 aa, Homo Sapiens
IRWCFFVDN

SEQ ID NO: 13371 - protein, 9 aa, Homo Sapiens
GACFLLVLK

SEQ ID NO: 13372 - protein, 9 aa, Homo Sapiens
DSCFAVGPI

SEQ ID NO: 13373 - protein, 9 aa, Homo Sapiens
PTVPLPAPY

SEQ ID NO: 13374 - protein, 9 aa, Homo Sapiens
TPKKKRSAF

SEQ ID NO: 13375 - protein, 9 aa, Homo Sapiens
ITVGQGEVV

SEQ ID NO: 13376 - protein, 9 aa, Homo Sapiens
RQGSRESTN

SEQ ID NO: 13377 - protein, 9 aa, Homo Sapiens
DSPRHRLLM

SEQ ID NO: 13378 - protein, 9 aa, Homo Sapiens
QLAKLEKEP

SEQ ID NO: 13379 - protein, 9 aa, Homo Sapiens
TDGSATLSC

SEQ ID NO: 13380 - protein, 9 aa, Homo Sapiens
ACSKLCYKS

SEQ ID NO: 13381 - protein, 9 aa, Homo Sapiens
VFVKGHDKA

SEQ ID NO: 13382 - protein, 9 aa, Homo Sapiens
KKRLTIDHE

SEQ ID NO: 13383 - protein, 9 aa, Homo Sapiens
PESAGGLPP

SEQ ID NO: 13384 - protein, 9 aa, Homo Sapiens
LSRSRSRSL

SEQ ID NO: 13385 - protein, 9 aa, Homo Sapiens
KLTQFLMED

SEQ ID NO: 13386 - protein, 9 aa, Homo Sapiens
MVMDILQER

SEQ ID NO: 13387 - protein, 9 aa, Homo Sapiens
HQGARRPMP

SEQ ID NO: 13388 - protein, 9 aa, Homo Sapiens
HIEKEMLNL

SEQ ID NO: 13389 - protein, 9 aa, Homo Sapiens
SRWACKAVV

SEQ ID NO: 13390 - protein, 9 aa, Homo Sapiens
NVNTCHLPL

SEQ ID NO: 13391 - protein, 9 aa, Homo Sapiens
RSLFLVQHQ

SEQ ID NO: 13392 - protein, 9 aa, Homo Sapiens
PSRGMNIHN

SEQ ID NO: 13393 - protein, 9 aa, Homo Sapiens
TCQFINLML

SEQ ID NO: 13394 - protein, 9 aa, Homo Sapiens
KEKENERGR

SEQ ID NO: 13395 - protein, 9 aa, Homo Sapiens
AEVDPDTSW

SEQ ID NO: 13396 - protein, 9 aa, Homo Sapiens
RITRRCAAM

SEQ ID NO: 13397 - protein, 9 aa, Homo Sapiens
LPPQPAAAH

SEQ ID NO: 13398 - protein, 9 aa, Homo Sapiens
VHASTCRSS

SEQ ID NO: 13399 - protein, 9 aa, Homo Sapiens
KSTVLSRRR

SEQ ID NO: 13400 - protein, 9 aa, Homo Sapiens
FCIIPENMC

SEQ ID NO: 13401 - protein, 9 aa, Homo Sapiens
DDNKENEAF

SEQ ID NO: 13402 - protein, 9 aa, Homo Sapiens
PWLSSGELV

SEQ ID NO: 13403 - protein, 9 aa, Homo Sapiens
TVLSRRRMY

SEQ ID NO: 13404 - protein, 9 aa, Homo Sapiens
KPKYLSFTP

SEQ ID NO: 13405 - protein, 9 aa, Homo Sapiens
NLKRVAKDL

SEQ ID NO: 13406 - protein, 9 aa, Homo Sapiens
MLNLFQVTD

SEQ ID NO: 13407 - protein, 9 aa, Homo Sapiens
IQLELYQVK

SEQ ID NO: 13408 - protein, 9 aa, Homo Sapiens
MTLRDDQLA

SEQ ID NO: 13409 - protein, 9 aa, Homo Sapiens
SSLLLKYNV

SEQ ID NO: 13410 - protein, 9 aa, Homo Sapiens
LTQFLMEDR

SEQ ID NO: 13411 - protein, 9 aa, Homo Sapiens
SGQGNRYQQ

SEQ ID NO: 13412 - protein, 9 aa, Homo Sapiens
PRDQEAMHF

SEQ ID NO: 13413 - protein, 9 aa, Homo Sapiens
LCDGMFSRA

SEQ ID NO: 13414 - protein, 9 aa, Homo Sapiens
GRRRVPFAL

SEQ ID NO: 13415 - protein, 9 aa, Homo Sapiens
VQGLHLYCM

SEQ ID NO: 13416 - protein, 9 aa, Homo Sapiens
LGTGKTVSL

SEQ ID NO: 13417 - protein, 9 aa, Homo Sapiens
VSPAGAPYE

SEQ ID NO: 13418 - protein, 9 aa, Homo Sapiens
SGLDLDFET

SEQ ID NO: 13419 - protein, 9 aa, Homo Sapiens
SRGMNIHNL

SEQ ID NO: 13420 - protein, 9 aa, Homo Sapiens
DRRDRDREK

SEQ ID NO: 13421 - protein, 9 aa, Homo Sapiens
ARGVTQLPN

SEQ ID NO: 13422 - protein, 9 aa, Homo Sapiens
PTGFISHQK

SEQ ID NO: 13423 - protein, 9 aa, Homo Sapiens
VVPKFKLPY

SEQ ID NO: 13424 - protein, 9 aa, Homo Sapiens
DRDREKEKE

SEQ ID NO: 13425 - protein, 9 aa, Homo Sapiens
LTSYSSHQE

SEQ ID NO: 13426 - protein, 9 aa, Homo Sapiens
CWPTDKVEE

SEQ ID NO: 13427 - protein, 9 aa, Homo Sapiens
NGLQNYNLS

SEQ ID NO: 13428 - protein, 9 aa, Homo Sapiens
VGSACSKLC

SEQ ID NO: 13429 - protein, 9 aa, Homo Sapiens
CAAMAANKI

SEQ ID NO: 13430 - protein, 9 aa, Homo Sapiens
SRSLFLVQH

SEQ ID NO: 13431 - protein, 9 aa, Homo Sapiens
KKACKCLLL

SEQ ID NO: 13432 - protein, 9 aa, Homo Sapiens
CTLCDGMFS

SEQ ID NO: 13433 - protein, 9 aa, Homo Sapiens
KKPFSEYVN

SEQ ID NO: 13434 - protein, 9 aa, Homo Sapiens
ELVHASTCR

SEQ ID NO: 13435 - protein, 9 aa, Homo Sapiens
IYVDRMIKG

SEQ ID NO: 13436 - protein, 9 aa, Homo Sapiens
YHHPLTSYS

SEQ ID NO: 13437 - protein, 9 aa, Homo Sapiens
QLADTVALR

SEQ ID NO: 13438 - protein, 9 aa, Homo Sapiens
AGYSVRAKV

SEQ ID NO: 13439 - protein, 9 aa, Homo Sapiens
FLMEDRIQL

SEQ ID NO: 13440 - protein, 9 aa, Homo Sapiens
FSRSLFLVQ

SEQ ID NO: 13441 - protein, 9 aa, Homo Sapiens
NCGAKRCRQ

SEQ ID NO: 13442 - protein, 9 aa, Homo Sapiens
VPDCGNGEQ

SEQ ID NO: 13443 - protein, 9 aa, Homo Sapiens
ATGSPPCHS

SEQ ID NO: 13444 - protein, 9 aa, Homo Sapiens
QPAAAHQGR

SEQ ID NO: 13445 - protein, 9 aa, Homo Sapiens
WLSSGELVD

SEQ ID NO: 13446 - protein, 9 aa, Homo Sapiens
LFFFFFQGL

SEQ ID NO: 13447 - protein, 9 aa, Homo Sapiens
MLLGNKSDM

SEQ ID NO: 13448 - protein, 9 aa, Homo Sapiens
SYCCGSGRG

SEQ ID NO: 13449 - protein, 9 aa, Homo Sapiens
RLACIADEM

SEQ ID NO: 13450 - protein, 9 aa, Homo Sapiens
SPAGAPYET

SEQ ID NO: 13451 - protein, 9 aa, Homo Sapiens
QPVLAVARG

SEQ ID NO: 13452 - protein, 9 aa, Homo Sapiens
IIKYDGKHS

SEQ ID NO: 13453 - protein, 9 aa, Homo Sapiens
EHSATGSPP

SEQ ID NO: 13454 - protein, 9 aa, Homo Sapiens
GIGCCLVRG

SEQ ID NO: 13455 - protein, 9 aa, Homo Sapiens
VVVMVDCWP

SEQ ID NO: 13456 - protein, 9 aa, Homo Sapiens
VRPYDEVVL

SEQ ID NO: 13457 - protein, 9 aa, Homo Sapiens
RSLILKRKG

SEQ ID NO: 13458 - protein, 9 aa, Homo Sapiens
SYQFDPNLG

SEQ ID NO: 13459 - protein, 9 aa, Homo Sapiens
RQKQQLLEF

SEQ ID NO: 13460 - protein, 9 aa, Homo Sapiens
SPKYEDKKR

SEQ ID NO: 13461 - protein, 9 aa, Homo Sapiens
EKNRSLILK

SEQ ID NO: 13462 - protein, 9 aa, Homo Sapiens
VTGSVKSKR

SEQ ID NO: 13463 - protein, 9 aa, Homo Sapiens
FNTLLESNY

SEQ ID NO: 13464 - protein, 9 aa, Homo Sapiens
TGFISHQKK

SEQ ID NO: 13465 - protein, 9 aa, Homo Sapiens
GAKRCRQFL

SEQ ID NO: 13466 - protein, 9 aa, Homo Sapiens
VRDDVYDNI

SEQ ID NO: 13467 - protein, 9 aa, Homo Sapiens
PDTSWSSSL

SEQ ID NO: 13468 - protein, 9 aa, Homo Sapiens
SRFADGFPP

SEQ ID NO: 13469 - protein, 9 aa, Homo Sapiens
ACKAVVLLC

SEQ ID NO: 13470 - protein, 9 aa, Homo Sapiens
GAEVDPDTS

SEQ ID NO: 13471 - protein, 9 aa, Homo Sapiens
AGKEEYSAM

SEQ ID NO: 13472 - protein, 9 aa, Homo Sapiens
SVKSKRRNL

SEQ ID NO: 13473 - protein, 9 aa, Homo Sapiens
VVVVMVDCW

SEQ ID NO: 13474 - protein, 9 aa, Homo Sapiens
PVEMDDTET

SEQ ID NO: 13475 - protein, 9 aa, Homo Sapiens
PESGRRAKY

SEQ ID NO: 13476 - protein, 9 aa, Homo Sapiens
FIKERNLLF

SEQ ID NO: 13477 - protein, 9 aa, Homo Sapiens
VLVCRVNEE

SEQ ID NO: 13478 - protein, 9 aa, Homo Sapiens
RSTFIALTS

SEQ ID NO: 13479 - protein, 9 aa, Homo Sapiens
KERNLLFRT

SEQ ID NO: 13480 - protein, 9 aa, Homo Sapiens
TPAPASSSY

SEQ ID NO: 13481 - protein, 9 aa, Homo Sapiens
GSATLSCRG

SEQ ID NO: 13482 - protein, 9 aa, Homo Sapiens
PPQPAAAHQ

SEQ ID NO: 13483 - protein, 9 aa, Homo Sapiens
SDISDMLKI

SEQ ID NO: 13484 - protein, 9 aa, Homo Sapiens
TYMPHVFGE

SEQ ID NO: 13485 - protein, 9 aa, Homo Sapiens
SLLLKYNVK

SEQ ID NO: 13486 - protein, 9 aa, Homo Sapiens
HKLRQGFQR

SEQ ID NO: 13487 - protein, 9 aa, Homo Sapiens
WKPGSWTGE

SEQ ID NO: 13488 - protein, 9 aa, Homo Sapiens
TRRCAAMAA

SEQ ID NO: 13489 - protein, 9 aa, Homo Sapiens
RPYDEVVLP

SEQ ID NO: 13490 - protein, 9 aa, Homo Sapiens
WEKKPFSEY

SEQ ID NO: 13491 - protein, 9 aa, Homo Sapiens
WSPEQVCSF

SEQ ID NO: 13492 - protein, 9 aa, Homo Sapiens
LGRRRVPFA

SEQ ID NO: 13493 - protein, 9 aa, Homo Sapiens
HASTCRSSD

SEQ ID NO: 13494 - protein, 9 aa, Homo Sapiens
APASSSYCC

SEQ ID NO: 13495 - protein, 9 aa, Homo Sapiens
RRADDFVLK

SEQ ID NO: 13496 - protein, 8 aa, Homo Sapiens
KFLLDILL

SEQ ID NO: 13497 - protein, 9 aa, Homo Sapiens
YSYQFDPNL

SEQ ID NO: 13498 - protein, 9 aa, Homo Sapiens
KKAQLFEKN

SEQ ID NO: 13499 - protein, 9 aa, Homo Sapiens
HPLTSYSSH

SEQ ID NO: 13500 - protein, 9 aa, Homo Sapiens
KEEYSAMRD

SEQ ID NO: 13501 - protein, 9 aa, Homo Sapiens
EETIMDRQK

SEQ ID NO: 13502 - protein, 9 aa, Homo Sapiens
QWRLGAWKP

SEQ ID NO: 13503 - protein, 9 aa, Homo Sapiens
PRSQSMDSK

SEQ ID NO: 13504 - protein, 9 aa, Homo Sapiens
CGKAFSRSL

SEQ ID NO: 13505 - protein, 9 aa, Homo Sapiens
CSKLCYKSF

SEQ ID NO: 13506 - protein, 9 aa, Homo Sapiens
DSPKYEDKK

SEQ ID NO: 13507 - protein, 9 aa, Homo Sapiens
QASLWTEEI

SEQ ID NO: 13508 - protein, 9 aa, Homo Sapiens
GPCTCALAT

SEQ ID NO: 13509 - protein, 9 aa, Homo Sapiens
REKEKENER

SEQ ID NO: 13510 - protein, 9 aa, Homo Sapiens
LGAEVDPDT

SEQ ID NO: 13511 - protein, 9 aa, Homo Sapiens
LLESNYCTA

SEQ ID NO: 13512 - protein, 9 aa, Homo Sapiens
AGQLLPVEM

SEQ ID NO: 13513 - protein, 9 aa, Homo Sapiens
PLGTGKTVS

SEQ ID NO: 13514 - protein, 9 aa, Homo Sapiens
YMPHVFGEI

SEQ ID NO: 13515 - protein, 9 aa, Homo Sapiens
DVSRDMNRN

SEQ ID NO: 13516 - protein, 9 aa, Homo Sapiens
LERRSKSDK

SEQ ID NO: 13517 - protein, 9 aa, Homo Sapiens
SLILKRKGL

SEQ ID NO: 13518 - protein, 9 aa, Homo Sapiens
VSALVSGLD

SEQ ID NO: 13519 - protein, 9 aa, Homo Sapiens
EYKKRLTID

SEQ ID NO: 13520 - protein, 9 aa, Homo Sapiens
SMSPSRGMN

SEQ ID NO: 13521 - protein, 9 aa, Homo Sapiens
KACKCLLLK

SEQ ID NO: 13522 - protein, 9 aa, Homo Sapiens
RDREKEKEN

SEQ ID NO: 13523 - protein, 9 aa, Homo Sapiens
NELTSPNTP

SEQ ID NO: 13524 - protein, 9 aa, Homo Sapiens
RRDRDREKE

SEQ ID NO: 13525 - protein, 9 aa, Homo Sapiens
IQWSPSCNA

SEQ ID NO: 13526 - protein, 9 aa, Homo Sapiens
PENMCNIVT

SEQ ID NO: 13527 - protein, 9 aa, Homo Sapiens
DGFPPFNYS

SEQ ID NO: 13528 - protein, 9 aa, Homo Sapiens
GGGFKAIKH

SEQ ID NO: 13529 - protein, 9 aa, Homo Sapiens
RRQEKEADR

SEQ ID NO: 13530 - protein, 9 aa, Homo Sapiens
IPWLSSGEL

SEQ ID NO: 13531 - protein, 9 aa, Homo Sapiens
MLKILTESH

SEQ ID NO: 13532 - protein, 9 aa, Homo Sapiens
YEYKKRLTI

SEQ ID NO: 13533 - protein, 9 aa, Homo Sapiens
PPGPVGSAG

SEQ ID NO: 13534 - protein, 9 aa, Homo Sapiens
RAPLNLTTI

SEQ ID NO: 13535 - protein, 9 aa, Homo Sapiens
TGSVKSKRR

SEQ ID NO: 13536 - protein, 9 aa, Homo Sapiens
LPYIQPRTQ

SEQ ID NO: 13537 - protein, 9 aa, Homo Sapiens
VPNIYVDRM

SEQ ID NO: 13538 - protein, 9 aa, Homo Sapiens
QAKLTQFLM

SEQ ID NO: 13539 - protein, 9 aa, Homo Sapiens
LLFRTGPHL

SEQ ID NO: 13540 - protein, 9 aa, Homo Sapiens
AAAHQGRGG

SEQ ID NO: 13541 - protein, 9 aa, Homo Sapiens
NLTTILVST

SEQ ID NO: 13542 - protein, 9 aa, Homo Sapiens
AFSRSLFLV

SEQ ID NO: 13543 - protein, 9 aa, Homo Sapiens
EEETIMDRQ

SEQ ID NO: 13544 - protein, 9 aa, Homo Sapiens
IPELVHAST

SEQ ID NO: 13545 - protein, 9 aa, Homo Sapiens
TEEFITHSP

SEQ ID NO: 13546 - protein, 9 aa, Homo Sapiens
GFCIIPENM

SEQ ID NO: 13547 - protein, 9 aa, Homo Sapiens
DGGNEVVIS

SEQ ID NO: 13548 - protein, 9 aa, Homo Sapiens
SSATDSPKY

SEQ ID NO: 13549 - protein, 9 aa, Homo Sapiens
QEKEADRDR

SEQ ID NO: 13550 - protein, 9 aa, Homo Sapiens
PQWRLGAWK

SEQ ID NO: 13551 - protein, 9 aa, Homo Sapiens
ESPWRSSGQ

SEQ ID NO: 13552 - protein, 9 aa, Homo Sapiens
YKRLSVFVK

SEQ ID NO: 13553 - protein, 9 aa, Homo Sapiens
SQNQKSTVL

SEQ ID NO: 13554 - protein, 9 aa, Homo Sapiens
SSYCCGSGR

SEQ ID NO: 13555 - protein, 9 aa, Homo Sapiens
YCMQVEPRN

SEQ ID NO: 13556 - protein, 9 aa, Homo Sapiens
AFAGQLLPV

SEQ ID NO: 13557 - protein, 9 aa, Homo Sapiens
SSSSSLSRS

SEQ ID NO: 13558 - protein, 9 aa, Homo Sapiens
NLSANGYFH

SEQ ID NO: 13559 - protein, 9 aa, Homo Sapiens
TACTLCDGM

SEQ ID NO: 13560 - protein, 9 aa, Homo Sapiens
SNLVRPPSD

SEQ ID NO: 13561 - protein, 9 aa, Homo Sapiens
DDVYDNILT

SEQ ID NO: 13562 - protein, 9 aa, Homo Sapiens
MLVKDHGEP

SEQ ID NO: 13563 - protein, 9 aa, Homo Sapiens
RPAGSWKVT

SEQ ID NO: 13564 - protein, 9 aa, Homo Sapiens
VMDILQERD

SEQ ID NO: 13565 - protein, 9 aa, Homo Sapiens
LLMLVKDHG

SEQ ID NO: 13566 - protein, 9 aa, Homo Sapiens
QESPWRSSG

SEQ ID NO: 13567 - protein, 9 aa, Homo Sapiens
KILTESHTS

SEQ ID NO: 13568 - protein, 9 aa, Homo Sapiens
YKKRLTIDH

SEQ ID NO: 13569 - protein, 9 aa, Homo Sapiens
DRSLGRRRV

SEQ ID NO: 13570 - protein, 9 aa, Homo Sapiens
PVLAVARGV

SEQ ID NO: 13571 - protein, 9 aa, Homo Sapiens
GPVGSAGAR

SEQ ID NO: 13572 - protein, 9 aa, Homo Sapiens
TSRFADGFP

SEQ ID NO: 13573 - protein, 9 aa, Homo Sapiens
FQNVNTCHL

SEQ ID NO: 13574 - protein, 9 aa, Homo Sapiens
STSETPNEL

SEQ ID NO: 13575 - protein, 9 aa, Homo Sapiens
DRAVFAVLK

SEQ ID NO: 13576 - protein, 9 aa, Homo Sapiens
KLPYIQPRT

SEQ ID NO: 13577 - protein, 9 aa, Homo Sapiens
SPSMSPSRG

SEQ ID NO: 13578 - protein, 9 aa, Homo Sapiens
CGAKRCRQF

SEQ ID NO: 13579 - protein, 9 aa, Homo Sapiens
MIKGQKYEK

SEQ ID NO: 13580 - protein, 9 aa, Homo Sapiens
RLLMLVKDH

SEQ ID NO: 13581 - protein, 9 aa, Homo Sapiens
PWRSSGQRA

SEQ ID NO: 13582 - protein, 9 aa, Homo Sapiens
LPECPESAG

SEQ ID NO: 13583 - protein, 9 aa, Homo Sapiens
IDHEKSKLS

SEQ ID NO: 13584 - protein, 9 aa, Homo Sapiens
SRDMNRNFD

SEQ ID NO: 13585 - protein, 9 aa, Homo Sapiens
KHSVYGLEL

SEQ ID NO: 13586 - protein, 9 aa, Homo Sapiens
NRLERQLAD

SEQ ID NO: 13587 - protein, 9 aa, Homo Sapiens
NYNLSANGY

SEQ ID NO: 13588 - protein, 9 aa, Homo Sapiens
SNNGKTPMC

SEQ ID NO: 13589 - protein, 9 aa, Homo Sapiens
CMQVEPRNV

SEQ ID NO: 13590 - protein, 9 aa, Homo Sapiens
RSLGRRRVP

SEQ ID NO: 13591 - protein, 9 aa, Homo Sapiens
VPHRVALTL

SEQ ID NO: 13592 - protein, 9 aa, Homo Sapiens
TPMCHQCHK

SEQ ID NO: 13593 - protein, 9 aa, Homo Sapiens
APYETRWAF

SEQ ID NO: 13594 - protein, 9 aa, Homo Sapiens
AQPVLAVAR

SEQ ID NO: 13595 - protein, 9 aa, Homo Sapiens
ISDMLKILT

SEQ ID NO: 13596 - protein, 9 aa, Homo Sapiens
LAVARGVTQ

SEQ ID NO: 13597 - protein, 9 aa, Homo Sapiens
LEMPLGTGK

SEQ ID NO: 13598 - protein, 9 aa, Homo Sapiens
LNLFQVTDN

SEQ ID NO: 13599 - protein, 9 aa, Homo Sapiens
RLTCQFINL

SEQ ID NO: 13600 - protein, 9 aa, Homo Sapiens
GRLEEFFQN

SEQ ID NO: 13601 - protein, 9 aa, Homo Sapiens
FVVPKFKLP

SEQ ID NO: 13602 - protein, 9 aa, Homo Sapiens
DMLKILTES

SEQ ID NO: 13603 - protein, 9 aa, Homo Sapiens
KSDMSSERV

SEQ ID NO: 13604 - protein, 9 aa, Homo Sapiens
SSFVSAGIQ

SEQ ID NO: 13605 - protein, 9 aa, Homo Sapiens
LRPQEKPML

SEQ ID NO: 13606 - protein, 9 aa, Homo Sapiens
GSACSKLCY

SEQ ID NO: 13607 - protein, 9 aa, Homo Sapiens
GKTRRADDF

SEQ ID NO: 13608 - protein, 9 aa, Homo Sapiens
DCWPTDKVE

SEQ ID NO: 13609 - protein, 9 aa, Homo Sapiens
PAGSWKVTA

SEQ ID NO: 13610 - protein, 9 aa, Homo Sapiens
YLSESAVGP

SEQ ID NO: 13611 - protein, 9 aa, Homo Sapiens
NQKSTVLSR

SEQ ID NO: 13612 - protein, 9 aa, Homo Sapiens
LSSGELVDY

SEQ ID NO: 13613 - protein, 9 aa, Homo Sapiens
SSSSLSRSR

SEQ ID NO: 13614 - protein, 9 aa, Homo Sapiens
EKEKENERG

SEQ ID NO: 13615 - protein, 9 aa, Homo Sapiens
GIDVSRDMN

SEQ ID NO: 13616 - protein, 9 aa, Homo Sapiens
VIIELFPLQ

SEQ ID NO: 13617 - protein, 9 aa, Homo Sapiens
TLCDGMFSR

SEQ ID NO: 13618 - protein, 9 aa, Homo Sapiens
SYSSHQECH

SEQ ID NO: 13619 - protein, 9 aa, Homo Sapiens
NRIVDRAVF

SEQ ID NO: 13620 - protein, 9 aa, Homo Sapiens
ASSSYCCGS

SEQ ID NO: 13621 - protein, 9 aa, Homo Sapiens
VPKFKLPYI

SEQ ID NO: 13622 - protein, 9 aa, Homo Sapiens
VLEMPLGTG

SEQ ID NO: 13623 - protein, 9 aa, Homo Sapiens
CTCALATLK

SEQ ID NO: 13624 - protein, 9 aa, Homo Sapiens
YSSHQECHP

SEQ ID NO: 13625 - protein, 9 aa, Homo Sapiens
SALVSGLDL

SEQ ID NO: 13626 - protein, 9 aa, Homo Sapiens
QERDQGGFG

SEQ ID NO: 13627 - protein, 9 aa, Homo Sapiens
KSKRRNLLE

SEQ ID NO: 13628 - protein, 9 aa, Homo Sapiens
LELYQVKSE

SEQ ID NO: 13629 - protein, 9 aa, Homo Sapiens
KEVLKKAQL

SEQ ID NO: 13630 - protein, 9 aa, Homo Sapiens
LVAALACHQ

SEQ ID NO: 13631 - protein, 9 aa, Homo Sapiens
GHGVLEMPL

SEQ ID NO: 13632 - protein, 9 aa, Homo Sapiens
PQPAAAHQG

SEQ ID NO: 13633 - protein, 9 aa, Homo Sapiens
MDRQKQQLL

SEQ ID NO: 13634 - protein, 9 aa, Homo Sapiens
ASLWTEEIP

SEQ ID NO: 13635 - protein, 9 aa, Homo Sapiens
HLYCMQVEP

SEQ ID NO: 13636 - protein, 9 aa, Homo Sapiens
AKRCRQFLN

SEQ ID NO: 13637 - protein, 9 aa, Homo Sapiens
YFVLVPHRV

SEQ ID NO: 13638 - protein, 9 aa, Homo Sapiens
QLFEKNRSL

SEQ ID NO: 13639 - protein, 9 aa, Homo Sapiens
ILYKRLSVF

SEQ ID NO: 13640 - protein, 9 aa, Homo Sapiens
AAMAANKIK

SEQ ID NO: 13641 - protein, 9 aa, Homo Sapiens
GKAFSRSLF

SEQ ID NO: 13642 - protein, 9 aa, Homo Sapiens
ENMCNIVTA

SEQ ID NO: 13643 - protein, 9 aa, Homo Sapiens
QNVNTCHLP

SEQ ID NO: 13644 - protein, 9 aa, Homo Sapiens
PQEKPMLKF

SEQ ID NO: 13645 - protein, 9 aa, Homo Sapiens
PFRLTCQFI

SEQ ID NO: 13646 - protein, 9 aa, Homo Sapiens
MVGSACSKL

SEQ ID NO: 13647 - protein, 9 aa, Homo Sapiens
SQGLGMRPA

SEQ ID NO: 13648 - protein, 9 aa, Homo Sapiens
IIELFPLQI

SEQ ID NO: 13649 - protein, 9 aa, Homo Sapiens
DQEAMHFPK

SEQ ID NO: 13650 - protein, 9 aa, Homo Sapiens
FASSIVRPY

SEQ ID NO: 13651 - protein, 9 aa, Homo Sapiens
SSSLSRSRS

SEQ ID NO: 13652 - protein, 9 aa, Homo Sapiens
ECPESAGGL

SEQ ID NO: 13653 - protein, 9 aa, Homo Sapiens
MDNAGYSVR

SEQ ID NO: 13654 - protein, 9 aa, Homo Sapiens
DRLARRLYH

SEQ ID NO: 13655 - protein, 9 aa, Homo Sapiens
PYIQPRTQE

SEQ ID NO: 13656 - protein, 9 aa, Homo Sapiens
HKREQDHSL

SEQ ID NO: 13657 - protein, 9 aa, Homo Sapiens
KREQDHSLS

SEQ ID NO: 13658 - protein, 9 aa, Homo Sapiens
ETIMDRQKQ

SEQ ID NO: 13659 - protein, 9 aa, Homo Sapiens
RYYLRDLQL

SEQ ID NO: 13660 - protein, 9 aa, Homo Sapiens
VLVPHRVAL

SEQ ID NO: 13661 - protein, 9 aa, Homo Sapiens
ESLLDGGNE

SEQ ID NO: 13662 - protein, 9 aa, Homo Sapiens
EIPEIAHHP

SEQ ID NO: 13663 - protein, 9 aa, Homo Sapiens
LLAHRPRYY

SEQ ID NO: 13664 - protein, 9 aa, Homo Sapiens
ALRMHKLRQ

SEQ ID NO: 13665 - protein, 9 aa, Homo Sapiens
VMVDCWPTD

SEQ ID NO: 13666 - protein, 9 aa, Homo Sapiens
DSSLLLKYN

SEQ ID NO: 13667 - protein, 9 aa, Homo Sapiens
LRQGFQRLL

SEQ ID NO: 13668 - protein, 9 aa, Homo Sapiens
LNLTTILVS

SEQ ID NO: 13669 - protein, 9 aa, Homo Sapiens
TRRADDFVL

SEQ ID NO: 13670 - protein, 9 aa, Homo Sapiens
TPDENGKTR

SEQ ID NO: 13671 - protein, 9 aa, Homo Sapiens
MCHQCHKVI

SEQ ID NO: 13672 - protein, 9 aa, Homo Sapiens
RPRSQSMDS

SEQ ID NO: 13673 - protein, 9 aa, Homo Sapiens
RGLSAGYLS

SEQ ID NO: 13674 - protein, 9 aa, Homo Sapiens
LFLVQHQRI

SEQ ID NO: 13675 - protein, 9 aa, Homo Sapiens
GRRAKYSPC

SEQ ID NO: 13676 - protein, 9 aa, Homo Sapiens
PDENGKTRR

SEQ ID NO: 13677 - protein, 9 aa, Homo Sapiens
NVVVVMVDC

SEQ ID NO: 13678 - protein, 9 aa, Homo Sapiens
EYVNWGYEK

SEQ ID NO: 13679 - protein, 9 aa, Homo Sapiens
LTSRFADGF

SEQ ID NO: 13680 - protein, 9 aa, Homo Sapiens
ITRRCAAMA

SEQ ID NO: 13681 - protein, 9 aa, Homo Sapiens
LIDPDDNKE

SEQ ID NO: 13682 - protein, 9 aa, Homo Sapiens
WACKAVVLL

SEQ ID NO: 13683 - protein, 9 aa, Homo Sapiens
QDGTVQNLK

SEQ ID NO: 13684 - protein, 9 aa, Homo Sapiens
RSSGQRARP

SEQ ID NO: 13685 - protein, 9 aa, Homo Sapiens
CIADEMDVS

SEQ ID NO: 13686 - protein, 9 aa, Homo Sapiens
YETRWAFQV

SEQ ID NO: 13687 - protein, 9 aa, Homo Sapiens
ETRWAFQVL

SEQ ID NO: 13688 - protein, 9 aa, Homo Sapiens
GCCLVRGEY

SEQ ID NO: 13689 - protein, 9 aa, Homo Sapiens
LDGGNEVVI

SEQ ID NO: 13690 - protein, 9 aa, Homo Sapiens
SGQRARPAG

SEQ ID NO: 13691 - protein, 9 aa, Homo Sapiens
SSLSRSRSR

SEQ ID NO: 13692 - protein, 9 aa, Homo Sapiens
VDPDTSWSS

SEQ ID NO: 13693 - protein, 9 aa, Homo Sapiens
QFLMEDRIQ

SEQ ID NO: 13694 - protein, 9 aa, Homo Sapiens
CNAHREFLH

SEQ ID NO: 13695 - protein, 9 aa, Homo Sapiens
YNVKGSSSE

SEQ ID NO: 13696 - protein, 9 aa, Homo Sapiens
RDQEAMHFP

SEQ ID NO: 13697 - protein, 9 aa, Homo Sapiens
TSWSSSLAT

SEQ ID NO: 13698 - protein, 9 aa, Homo Sapiens
SQNRIVDRA

SEQ ID NO: 13699 - protein, 9 aa, Homo Sapiens
EQDHSLSSS

SEQ ID NO: 13700 - protein, 9 aa, Homo Sapiens
TIDHEKSKL

SEQ ID NO: 13701 - protein, 9 aa, Homo Sapiens
THSPDFEAA

SEQ ID NO: 13702 - protein, 9 aa, Homo Sapiens
ALFFFFFQG

SEQ ID NO: 13703 - protein, 9 aa, Homo Sapiens
AADRLARRL

SEQ ID NO: 13704 - protein, 9 aa, Homo Sapiens
RRCAAMAAN

SEQ ID NO: 13705 - protein, 9 aa, Homo Sapiens
NDFFLENNK

SEQ ID NO: 13706 - protein, 9 aa, Homo Sapiens
GCEYFVLVP

SEQ ID NO: 13707 - protein, 9 aa, Homo Sapiens
EFITHSPDF

SEQ ID NO: 13708 - protein, 9 aa, Homo Sapiens
IGCCLVRGE

SEQ ID NO: 13709 - protein, 9 aa, Homo Sapiens
GKEEYSAMR

SEQ ID NO: 13710 - protein, 9 aa, Homo Sapiens
IALTSSAVT

SEQ ID NO: 13711 - protein, 9 aa, Homo Sapiens
KGSSATDSP

SEQ ID NO: 13712 - protein, 9 aa, Homo Sapiens
TTACTLCDG

SEQ ID NO: 13713 - protein, 9 aa, Homo Sapiens
DNAGYSVRA

SEQ ID NO: 13714 - protein, 9 aa, Homo Sapiens
TCRSSDGVF

SEQ ID NO: 13715 - protein, 9 aa, Homo Sapiens
QLLPVEMDD

SEQ ID NO: 13716 - protein, 9 aa, Homo Sapiens
EFFQNVNTC

SEQ ID NO: 13717 - protein, 9 aa, Homo Sapiens
GPSQGLGMR

SEQ ID NO: 13718 - protein, 9 aa, Homo Sapiens
YILFYQLRE

SEQ ID NO: 13719 - protein, 9 aa, Homo Sapiens
TSRGLSGPS

SEQ ID NO: 13720 - protein, 9 aa, Homo Sapiens
LVCRVNEEI

SEQ ID NO: 13721 - protein, 9 aa, Homo Sapiens
MAANKIKLM

SEQ ID NO: 13722 - protein, 9 aa, Homo Sapiens
GSSATDSPK

SEQ ID NO: 13723 - protein, 9 aa, Homo Sapiens
LVHASTCRS

SEQ ID NO: 13724 - protein, 9 aa, Homo Sapiens
KTPMCHQCH

SEQ ID NO: 13725 - protein, 9 aa, Homo Sapiens
GLNGLQNYN

SEQ ID NO: 13726 - protein, 9 aa, Homo Sapiens
PECPESAGG

SEQ ID NO: 13727 - protein, 9 aa, Homo Sapiens
ERRSKSDKL

SEQ ID NO: 13728 - protein, 9 aa, Homo Sapiens
EKKACKCLL

SEQ ID NO: 13729 - protein, 9 aa, Homo Sapiens
DGKHSVYGL

SEQ ID NO: 13730 - protein, 9 aa, Homo Sapiens
YVNWGYEKR

SEQ ID NO: 13731 - protein, 9 aa, Homo Sapiens
GKTPMCHQC

SEQ ID NO: 13732 - protein, 9 aa, Homo Sapiens
PKYLSFTPP

SEQ ID NO: 13733 - protein, 9 aa, Homo Sapiens
QKQDGTVQN

SEQ ID NO: 13734 - protein, 9 aa, Homo Sapiens
NEVVISGFG

SEQ ID NO: 13735 - protein, 9 aa, Homo Sapiens
RSQSMDSKP

SEQ ID NO: 13736 - protein, 9 aa, Homo Sapiens
CLVRGEYGR

SEQ ID NO: 13737 - protein, 9 aa, Homo Sapiens
LDTAGKEEY

SEQ ID NO: 13738 - protein, 9 aa, Homo Sapiens
QNQKSTVLS

SEQ ID NO: 13739 - protein, 9 aa, Homo Sapiens
AKYSPCRGN

SEQ ID NO: 13740 - protein, 9 aa, Homo Sapiens
AKEVLKKAQ

SEQ ID NO: 13741 - protein, 9 aa, Homo Sapiens
ATHSTVRVL

SEQ ID NO: 13742 - protein, 9 aa, Homo Sapiens
PGGGFKAIK

SEQ ID NO: 13743 - protein, 9 aa, Homo Sapiens
SQSMDSKPW

SEQ ID NO: 13744 - protein, 9 aa, Homo Sapiens
MSPSRGMNI

SEQ ID NO: 13745 - protein, 9 aa, Homo Sapiens
DCGNGEQTT

SEQ ID NO: 13746 - protein, 9 aa, Homo Sapiens
NGKTPMCHQ

SEQ ID NO: 13747 - protein, 9 aa, Homo Sapiens
SIVRPYDEV

SEQ ID NO: 13748 - protein, 9 aa, Homo Sapiens
SAGGLPPPQ

SEQ ID NO: 13749 - protein, 9 aa, Homo Sapiens
EVDPDTSWS

SEQ ID NO: 13750 - protein, 9 aa, Homo Sapiens
IMLLGNKSD

SEQ ID NO: 13751 - protein, 9 aa, Homo Sapiens
FLERRSKSD

SEQ ID NO: 13752 - protein, 9 aa, Homo Sapiens
SDMLKILTE

SEQ ID NO: 13753 - protein, 9 aa, Homo Sapiens
LHIEKEMLN

SEQ ID NO: 13754 - protein, 9 aa, Homo Sapiens
DSEHSATGS

SEQ ID NO: 13755 - protein, 9 aa, Homo Sapiens
GEVGGPCTC

SEQ ID NO: 13756 - protein, 9 aa, Homo Sapiens
IWTYMPHVF

SEQ ID NO: 13757 - protein, 9 aa, Homo Sapiens
TLSCRGGLV

SEQ ID NO: 13758 - protein, 9 aa, Homo Sapiens
FVSALVSGL

SEQ ID NO: 13759 - protein, 9 aa, Homo Sapiens
DVTGSVKSK

SEQ ID NO: 13760 - protein, 9 aa, Homo Sapiens
YTNGSFGSS

SEQ ID NO: 13761 - protein, 9 aa, Homo Sapiens
ELMPFRLTC

SEQ ID NO: 13762 - protein, 9 aa, Homo Sapiens
SLSSSSSAS

SEQ ID NO: 13763 - protein, 9 aa, Homo Sapiens
FADGFPPFN

SEQ ID NO: 13764 - protein, 9 aa, Homo Sapiens
GQGNRYQQD

SEQ ID NO: 13765 - protein, 9 aa, Homo Sapiens
DFCRNKIVE

SEQ ID NO: 13766 - protein, 9 aa, Homo Sapiens
ASRWACKAV

SEQ ID NO: 13767 - protein, 9 aa, Homo Sapiens
FFIKERNLL

SEQ ID NO: 13768 - protein, 9 aa, Homo Sapiens
GMRPAGSWK

SEQ ID NO: 13769 - protein, 9 aa, Homo Sapiens
YVDRMIKGQ

SEQ ID NO: 13770 - protein, 9 aa, Homo Sapiens
IPEIAHHPT

SEQ ID NO: 13771 - protein, 9 aa, Homo Sapiens
RLSVFVKGH

SEQ ID NO: 13772 - protein, 9 aa, Homo Sapiens
ITHSPDFEA

SEQ ID NO: 13773 - protein, 9 aa, Homo Sapiens
LVSGLDLDF

SEQ ID NO: 13774 - protein, 9 aa, Homo Sapiens
ILRIQLELY

SEQ ID NO: 13775 - protein, 9 aa, Homo Sapiens
EVGPPGPVG

SEQ ID NO: 13776 - protein, 9 aa, Homo Sapiens
IGIGCCLVR

SEQ ID NO: 13777 - protein, 9 aa, Homo Sapiens
KDLGENLTD

SEQ ID NO: 13778 - protein, 9 aa, Homo Sapiens
EKLKCCWVN

SEQ ID NO: 13779 - protein, 9 aa, Homo Sapiens
DILDTAGKE

SEQ ID NO: 13780 - protein, 9 aa, Homo Sapiens
LWTEEIPEI

SEQ ID NO: 13781 - protein, 9 aa, Homo Sapiens
GYSVRAKVL

SEQ ID NO: 13782 - protein, 9 aa, Homo Sapiens
KEMLNLFQV

SEQ ID NO: 13783 - protein, 9 aa, Homo Sapiens
FVLVPHRVA

SEQ ID NO: 13784 - protein, 9 aa, Homo Sapiens
VPTSRGLSG

SEQ ID NO: 13785 - protein, 9 aa, Homo Sapiens
VSRDMNRNF

SEQ ID NO: 13786 - protein, 9 aa, Homo Sapiens
RMIKGQKYE

SEQ ID NO: 13787 - protein, 9 aa, Homo Sapiens
RSNLVRPPS

SEQ ID NO: 13788 - protein, 9 aa, Homo Sapiens
TLTTASKVF

SEQ ID NO: 13789 - protein, 9 aa, Homo Sapiens
ASTFQDFSH

SEQ ID NO: 13790 - protein, 9 aa, Homo Sapiens
YIIKYDGKH

SEQ ID NO: 13791 - protein, 9 aa, Homo Sapiens
QPESGRRAK

SEQ ID NO: 13792 - protein, 9 aa, Homo Sapiens
ADGFPPFNY

SEQ ID NO: 13793 - protein, 9 aa, Homo Sapiens
WRLGAWKPG

SEQ ID NO: 13794 - protein, 9 aa, Homo Sapiens
ADEMDVSLR

SEQ ID NO: 13795 - protein, 9 aa, Homo Sapiens
QDGSRNLIT

SEQ ID NO: 13796 - protein, 9 aa, Homo Sapiens
PFSEYVNWG

SEQ ID NO: 13797 - protein, 9 aa, Homo Sapiens
DRIGIGCCL

SEQ ID NO: 13798 - protein, 9 aa, Homo Sapiens
VLAVARGVT

SEQ ID NO: 13799 - protein, 9 aa, Homo Sapiens
KQDGTVQNL

SEQ ID NO: 13800 - protein, 9 aa, Homo Sapiens
FCRNKIVEN

SEQ ID NO: 13801 - protein, 9 aa, Homo Sapiens
QEGTTACTL

SEQ ID NO: 13802 - protein, 9 aa, Homo Sapiens
LGMRPAGSW

SEQ ID NO: 13803 - protein, 9 aa, Homo Sapiens
RWACKAVVL

SEQ ID NO: 13804 - protein, 9 aa, Homo Sapiens
DRPRSQSMD

SEQ ID NO: 13805 - protein, 9 aa, Homo Sapiens
SGPSQGLGM

SEQ ID NO: 13806 - protein, 9 aa, Homo Sapiens
DGTVQNLKE

SEQ ID NO: 13807 - protein, 9 aa, Homo Sapiens
PDDNKENEA

SEQ ID NO: 13808 - protein, 9 aa, Homo Sapiens
RDDQLAKLE

SEQ ID NO: 13809 - protein, 9 aa, Homo Sapiens
DYKTWSPEQ

SEQ ID NO: 13810 - protein, 9 aa, Homo Sapiens
NRSLILKRK

SEQ ID NO: 13811 - protein, 9 aa, Homo Sapiens
LRMHKLRQG

SEQ ID NO: 13812 - protein, 9 aa, Homo Sapiens
PLNLTTILV

SEQ ID NO: 13813 - protein, 9 aa, Homo Sapiens
RQGFQRLLG

SEQ ID NO: 13814 - protein, 9 aa, Homo Sapiens
CCLVRGEYG

SEQ ID NO: 13815 - protein, 9 aa, Homo Sapiens
VRAKVLITV

SEQ ID NO: 13816 - protein, 9 aa, Homo Sapiens
PLTSYSSHQ

SEQ ID NO: 13817 - protein, 9 aa, Homo Sapiens
KEEETIMDR

SEQ ID NO: 13818 - protein, 9 aa, Homo Sapiens
LLLKYNVKG

SEQ ID NO: 13819 - protein, 9 aa, Homo Sapiens
SKFASSIVR

SEQ ID NO: 13820 - protein, 9 aa, Homo Sapiens
FIALTSSAV

SEQ ID NO: 13821 - protein, 9 aa, Homo Sapiens
GLGMRPAGS

SEQ ID NO: 13822 - protein, 9 aa, Homo Sapiens
STVLSRRRM

SEQ ID NO: 13823 - protein, 9 aa, Homo Sapiens
WPGRRQEKE

SEQ ID NO: 13824 - protein, 9 aa, Homo Sapiens
CLLRPQEKP

SEQ ID NO: 13825 - protein, 9 aa, Homo Sapiens
INFKPLANL

SEQ ID NO: 13826 - protein, 9 aa, Homo Sapiens
VKPKYLSFT

SEQ ID NO: 13827 - protein, 9 aa, Homo Sapiens
ACTLCDGMF

SEQ ID NO: 13828 - protein, 9 aa, Homo Sapiens
KSDKLLIII

SEQ ID NO: 13829 - protein, 9 aa, Homo Sapiens
NKSDMSSER

SEQ ID NO: 13830 - protein, 9 aa, Homo Sapiens
TSETPNELT

SEQ ID NO: 13831 - protein, 9 aa, Homo Sapiens
LSVFVKGHD

SEQ ID NO: 13832 - protein, 9 aa, Homo Sapiens
ASSIVRPYD

SEQ ID NO: 13833 - protein, 9 aa, Homo Sapiens
MLPPQPAAA

SEQ ID NO: 13834 - protein, 9 aa, Homo Sapiens
YNDFFLENN

SEQ ID NO: 13835 - protein, 9 aa, Homo Sapiens
DPGHCWGFP

SEQ ID NO: 13836 - protein, 9 aa, Homo Sapiens
LGAWKPGSW

SEQ ID NO: 13837 - protein, 9 aa, Homo Sapiens
GSNNGKTPM

SEQ ID NO: 13838 - protein, 9 aa, Homo Sapiens
CKAVVLLCA

SEQ ID NO: 13839 - protein, 9 aa, Homo Sapiens
CWVNNYTDF

SEQ ID NO: 13840 - protein, 9 aa, Homo Sapiens
IFQLIDPDD

SEQ ID NO: 13841 - protein, 9 aa, Homo Sapiens
LYSYQFDPN

SEQ ID NO: 13842 - protein, 9 aa, Homo Sapiens
VPTLTTASK

SEQ ID NO: 13843 - protein, 9 aa, Homo Sapiens
SLSRSRSRS

SEQ ID NO: 13844 - protein, 9 aa, Homo Sapiens
EGTTACTLC

SEQ ID NO: 13845 - protein, 9 aa, Homo Sapiens
YDSNTVKPK

SEQ ID NO: 13846 - protein, 9 aa, Homo Sapiens
GFKAIKHGS

SEQ ID NO: 13847 - protein, 9 aa, Homo Sapiens
AGAPYETRW

SEQ ID NO: 13848 - protein, 9 aa, Homo Sapiens
SATDSPKYE

SEQ ID NO: 13849 - protein, 9 aa, Homo Sapiens
IDVSRDMNR

SEQ ID NO: 13850 - protein, 9 aa, Homo Sapiens
EIAHHPTGF

SEQ ID NO: 13851 - protein, 9 aa, Homo Sapiens
RAVFAVLKA

SEQ ID NO: 13852 - protein, 9 aa, Homo Sapiens
GSVKSKRRN

SEQ ID NO: 13853 - protein, 9 aa, Homo Sapiens
SKLCYKSFV

SEQ ID NO: 13854 - protein, 9 aa, Homo Sapiens
APGGGFKAI

SEQ ID NO: 13855 - protein, 9 aa, Homo Sapiens
SCNAHREFL

SEQ ID NO: 13856 - protein, 9 aa, Homo Sapiens
ALVSGLDLD

SEQ ID NO: 13857 - protein, 9 aa, Homo Sapiens
LLGIDVSRD

SEQ ID NO: 13858 - protein, 9 aa, Homo Sapiens
GQLLPVEMD

SEQ ID NO: 13859 - protein, 9 aa, Homo Sapiens
LYKRLSVFV

SEQ ID NO: 13860 - protein, 9 aa, Homo Sapiens
ALTSSAVTF

SEQ ID NO: 13861 - protein, 9 aa, Homo Sapiens
FSEYVNWGY

SEQ ID NO: 13862 - protein, 9 aa, Homo Sapiens
PDYKTWSPE

SEQ ID NO: 13863 - protein, 9 aa, Homo Sapiens
NNGKTPMCH

SEQ ID NO: 13864 - protein, 9 aa, Homo Sapiens
QWSPSCNAH

SEQ ID NO: 13865 - protein, 9 aa, Homo Sapiens
KYDGKHSVY

SEQ ID NO: 13866 - protein, 9 aa, Homo Sapiens
QNYNLSANG

SEQ ID NO: 13867 - protein, 9 aa, Homo Sapiens
SIQWSPSCN

SEQ ID NO: 13868 - protein, 9 aa, Homo Sapiens
ENGKTRRAD

SEQ ID NO: 13869 - protein, 9 aa, Homo Sapiens
QFLERRSKS

SEQ ID NO: 13870 - protein, 9 aa, Homo Sapiens
SGELVDYNV

SEQ ID NO: 13871 - protein, 9 aa, Homo Sapiens
RNKIVENKI

SEQ ID NO: 13872 - protein, 9 aa, Homo Sapiens
MHFPKVSTK

SEQ ID NO: 13873 - protein, 9 aa, Homo Sapiens
LGNKSDMSS

SEQ ID NO: 13874 - protein, 9 aa, Homo Sapiens
PDCGNGEQT

SEQ ID NO: 13875 - protein, 9 aa, Homo Sapiens
GGFKAIKHG

SEQ ID NO: 13876 - protein, 9 aa, Homo Sapiens
DLGENLTDE

SEQ ID NO: 13877 - protein, 9 aa, Homo Sapiens
SGRRAKYSP

SEQ ID NO: 13878 - protein, 9 aa, Homo Sapiens
FYLETGITG

SEQ ID NO: 13879 - protein, 9 aa, Homo Sapiens
VSGLDLDFE

SEQ ID NO: 13880 - protein, 9 aa, Homo Sapiens
LDILDTAGK

SEQ ID NO: 13881 - protein, 9 aa, Homo Sapiens
EVLKKAQLF

SEQ ID NO: 13882 - protein, 9 aa, Homo Sapiens
KTWSPEQVC

SEQ ID NO: 13883 - protein, 9 aa, Homo Sapiens
VLKKAQLFE

SEQ ID NO: 13884 - protein, 9 aa, Homo Sapiens
PSCNAHREF

SEQ ID NO: 13885 - protein, 9 aa, Homo Sapiens
IVRPYDEVV

SEQ ID NO: 13886 - protein, 9 aa, Homo Sapiens
DSDPGHCWG

SEQ ID NO: 13887 - protein, 9 aa, Homo Sapiens
MPHVFGEIS

SEQ ID NO: 13888 - protein, 9 aa, Homo Sapiens
QGNRYQQDG

SEQ ID NO: 13889 - protein, 9 aa, Homo Sapiens
PCTCALATL

SEQ ID NO: 13890 - protein, 9 aa, Homo Sapiens
VEKKACKCL

SEQ ID NO: 13891 - protein, 9 aa, Homo Sapiens
SVFVKGHDK

SEQ ID NO: 13892 - protein, 9 aa, Homo Sapiens
AMAANKIKL

SEQ ID NO: 13893 - protein, 9 aa, Homo Sapiens
FRLTCQFIN

SEQ ID NO: 13894 - protein, 9 aa, Homo Sapiens
LLRPQEKPM

SEQ ID NO: 13895 - protein, 9 aa, Homo Sapiens
FQLIDPDDN

SEQ ID NO: 13896 - protein, 9 aa, Homo Sapiens
TNGSFGSSF

SEQ ID NO: 13897 - protein, 9 aa, Homo Sapiens
LVPRLYSYQ

SEQ ID NO: 13898 - protein, 9 aa, Homo Sapiens
AQLFEKNRS

SEQ ID NO: 13899 - protein, 9 aa, Homo Sapiens
KNRSLILKR

SEQ ID NO: 13900 - protein, 9 aa, Homo Sapiens
QLIDPDDNK

SEQ ID NO: 13901 - protein, 9 aa, Homo Sapiens
AASRWACKA

SEQ ID NO: 13902 - protein, 9 aa, Homo Sapiens
ASKVFPEVV

SEQ ID NO: 13903 - protein, 9 aa, Homo Sapiens
RRAKYSPCR

SEQ ID NO: 13904 - protein, 9 aa, Homo Sapiens
RMHKLRQGF

SEQ ID NO: 13905 - protein, 9 aa, Homo Sapiens
QEKPMLKFS

SEQ ID NO: 13906 - protein, 9 aa, Homo Sapiens
NGSFGSSFV

SEQ ID NO: 13907 - protein, 9 aa, Homo Sapiens
TLRDDQLAK

SEQ ID NO: 13908 - protein, 9 aa, Homo Sapiens
PVIGILDIN

SEQ ID NO: 13909 - protein, 9 aa, Homo Sapiens
QDHSLSSSS

SEQ ID NO: 13910 - protein, 9 aa, Homo Sapiens
ACKCLLLKV

SEQ ID NO: 13911 - protein, 9 aa, Homo Sapiens
VEMDDTETG

SEQ ID NO: 13912 - protein, 9 aa, Homo Sapiens
VRVLVCRVN

SEQ ID NO: 13913 - protein, 9 aa, Homo Sapiens
LRDDQLAKL

SEQ ID NO: 13914 - protein, 9 aa, Homo Sapiens
PGHCWGFPD

SEQ ID NO: 13915 - protein, 9 aa, Homo Sapiens
HHPLTSYSS

SEQ ID NO: 13916 - protein, 9 aa, Homo Sapiens
RCAAMAANK

SEQ ID NO: 13917 - protein, 9 aa, Homo Sapiens
LTCQFINLM

SEQ ID NO: 13918 - protein, 9 aa, Homo Sapiens
ALACHQGAR

SEQ ID NO: 13919 - protein, 9 aa, Homo Sapiens
DRMIKGQKY

SEQ ID NO: 13920 - protein, 9 aa, Homo Sapiens
YPCAAGAST

SEQ ID NO: 13921 - protein, 9 aa, Homo Sapiens
LQASLWTEE

SEQ ID NO: 13922 - protein, 9 aa, Homo Sapiens
GFALFFFFF

SEQ ID NO: 13923 - protein, 9 aa, Homo Sapiens
STVRVLVCR

SEQ ID NO: 13924 - protein, 9 aa, Homo Sapiens
TLLESNYCT

SEQ ID NO: 13925 - protein, 9 aa, Homo Sapiens
PRYYLRDLQ

SEQ ID NO: 13926 - protein, 9 aa, Homo Sapiens
SDSSLLLKY

SEQ ID NO: 13927 - protein, 9 aa, Homo Sapiens
NGEQTTWFS

SEQ ID NO: 13928 - protein, 9 aa, Homo Sapiens
RLYSYQFDP

SEQ ID NO: 13929 - protein, 9 aa, Homo Sapiens
EEIPEIAHH

SEQ ID NO: 13930 - protein, 9 aa, Homo Sapiens
SKRRNLLED

SEQ ID NO: 13931 - protein, 9 aa, Homo Sapiens
LERQLADTV

SEQ ID NO: 13932 - protein, 9 aa, Homo Sapiens
LVPHRVALT

SEQ ID NO: 13933 - protein, 9 aa, Homo Sapiens
GLQNYNLSA

SEQ ID NO: 13934 - protein, 9 aa, Homo Sapiens
FEKNRSLIL

SEQ ID NO: 13935 - protein, 9 aa, Homo Sapiens
GNRYQQDGS

SEQ ID NO: 13936 - protein, 9 aa, Homo Sapiens
SNYCTAKGS

SEQ ID NO: 13937 - protein, 9 aa, Homo Sapiens
YYLRDLQLL

SEQ ID NO: 13938 - protein, 9 aa, Homo Sapiens
KLCYKSFVA

SEQ ID NO: 13939 - protein, 9 aa, Homo Sapiens
IEKEMLNLF

SEQ ID NO: 13940 - protein, 9 aa, Homo Sapiens
ADTVALRQE

SEQ ID NO: 13941 - protein, 9 aa, Homo Sapiens
HSLSSSSSA

SEQ ID NO: 13942 - protein, 9 aa, Homo Sapiens
REQDHSLSS

SEQ ID NO: 13943 - protein, 9 aa, Homo Sapiens
VVMVDCWPT

SEQ ID NO: 13944 - protein, 9 aa, Homo Sapiens
RAKYSPCRG

SEQ ID NO: 13945 - protein, 9 aa, Homo Sapiens
GTDGSATLS

SEQ ID NO: 13946 - protein, 9 aa, Homo Sapiens
KAQLFEKNR

SEQ ID NO: 13947 - protein, 9 aa, Homo Sapiens
PWMMAIGFS

SEQ ID NO: 13948 - protein, 9 aa, Homo Sapiens
GEVGPPGPV

SEQ ID NO: 13949 - protein, 9 aa, Homo Sapiens
TDSPKYEDK

SEQ ID NO: 13950 - protein, 9 aa, Homo Sapiens
RAPGGGFKA

SEQ ID NO: 13951 - protein, 9 aa, Homo Sapiens
FAGQLLPVE

SEQ ID NO: 13952 - protein, 9 aa, Homo Sapiens
PVGSAGARG

SEQ ID NO: 13953 - protein, 9 aa, Homo Sapiens
LTIDHEKSK

SEQ ID NO: 13954 - protein, 9 aa, Homo Sapiens
SFGSSFVSA

SEQ ID NO: 13955 - protein, 9 aa, Homo Sapiens
NMCNIVTAY

SEQ ID NO: 13956 - protein, 9 aa, Homo Sapiens
SATLSCRGG

SEQ ID NO: 13957 - protein, 9 aa, Homo Sapiens
KRLTIDHEK

SEQ ID NO: 13958 - protein, 9 aa, Homo Sapiens
DSNTVKPKY

SEQ ID NO: 13959 - protein, 9 aa, Homo Sapiens
ILDTAGKEE

SEQ ID NO: 13960 - protein, 9 aa, Homo Sapiens
LMEDRIQLW

SEQ ID NO: 13961 - protein, 9 aa, Homo Sapiens
RWPGRRQEK

SEQ ID NO: 13962 - protein, 9 aa, Homo Sapiens
LMPFRLTCQ

SEQ ID NO: 13963 - protein, 9 aa, Homo Sapiens
VMEKLKCCW

SEQ ID NO: 13964 - protein, 9 aa, Homo Sapiens
FPRDQEAMH

SEQ ID NO: 13965 - protein, 9 aa, Homo Sapiens
NRYQQDGSR

SEQ ID NO: 13966 - protein, 9 aa, Homo Sapiens
DMNRNFDDQ

SEQ ID NO: 13967 - protein, 9 aa, Homo Sapiens
AMDNAGYSV

SEQ ID NO: 13968 - protein, 9 aa, Homo Sapiens
KPFSEYVNW

SEQ ID NO: 13969 - protein, 9 aa, Homo Sapiens
SFPRDQEAM

SEQ ID NO: 13970 - protein, 9 aa, Homo Sapiens
GSFGSSFVS

SEQ ID NO: 13971 - protein, 9 aa, Homo Sapiens
ATEEFITHS

SEQ ID NO: 13972 - protein, 9 aa, Homo Sapiens
TVKPKYLSF

SEQ ID NO: 13973 - protein, 9 aa, Homo Sapiens
PTLTTASKV

SEQ ID NO: 13974 - protein, 9 aa, Homo Sapiens
QGFQRLLGL

SEQ ID NO: 13975 - protein, 9 aa, Homo Sapiens
MVDCWPTDK

SEQ ID NO: 13976 - protein, 9 aa, Homo Sapiens
AGASTFQDF

SEQ ID NO: 13977 - protein, 9 aa, Homo Sapiens
PTSRGLSGP

SEQ ID NO: 13978 - protein, 9 aa, Homo Sapiens
HYPCAAGAS

SEQ ID NO: 13979 - protein, 9 aa, Homo Sapiens
PSMSPSRGM

SEQ ID NO: 13980 - protein, 9 aa, Homo Sapiens
CQGVSEAAD

SEQ ID NO: 13981 - protein, 9 aa, Homo Sapiens
RIVDRAVFA

SEQ ID NO: 13982 - protein, 9 aa, Homo Sapiens
NAHREFLHR

SEQ ID NO: 13983 - protein, 9 aa, Homo Sapiens
EKEMLNLFQ

SEQ ID NO: 13984 - protein, 9 aa, Homo Sapiens
SSGQRARPA

SEQ ID NO: 13985 - protein, 9 aa, Homo Sapiens
PYETRWAFQ

SEQ ID NO: 13986 - protein, 9 aa, Homo Sapiens
VGPPGPVGS

SEQ ID NO: 13987 - protein, 9 aa, Homo Sapiens
SLGRRRVPF

SEQ ID NO: 13988 - protein, 9 aa, Homo Sapiens
VIGILDINF

SEQ ID NO: 13989 - protein, 9 aa, Homo Sapiens
SPSRGMNIH

SEQ ID NO: 13990 - protein, 9 aa, Homo Sapiens
ILQERDQGG

SEQ ID NO: 13991 - protein, 9 aa, Homo Sapiens
SSRGLSAGY

SEQ ID NO: 13992 - protein, 9 aa, Homo Sapiens
TQFLMEDRI

SEQ ID NO: 13993 - protein, 9 aa, Homo Sapiens
GLSAGYLSE

SEQ ID NO: 13994 - protein, 9 aa, Homo Sapiens
DENGKTRRA

SEQ ID NO: 13995 - protein, 9 aa, Homo Sapiens
VGSAGARGA

SEQ ID NO: 13996 - protein, 9 aa, Homo Sapiens
SICLLRPQE

SEQ ID NO: 13997 - protein, 9 aa, Homo Sapiens
EQTTWFSYL

SEQ ID NO: 13998 - protein, 9 aa, Homo Sapiens
SPRHRLLML

SEQ ID NO: 13999 - protein, 9 aa, Homo Sapiens
LHPDYKTWS

SEQ ID NO: 14000 - protein, 9 aa, Homo Sapiens
ILDINFKPL

SEQ ID NO: 14001 - protein, 9 aa, Homo Sapiens
ELTSPNTPE

SEQ ID NO: 14002 - protein, 9 aa, Homo Sapiens
SATGSPPCH

SEQ ID NO: 14003 - protein, 9 aa, Homo Sapiens
DPATEEFIT

SEQ ID NO: 14004 - protein, 9 aa, Homo Sapiens
DILQERDQG

SEQ ID NO: 14005 - protein, 9 aa, Homo Sapiens
RGMNIHNLA

SEQ ID NO: 14006 - protein, 9 aa, Homo Sapiens
KCCWVNNYT

SEQ ID NO: 14007 - protein, 9 aa, Homo Sapiens
LSAGYLSES

SEQ ID NO: 14008 - protein, 9 aa, Homo Sapiens
MPLGTGKTV

SEQ ID NO: 14009 - protein, 9 aa, Homo Sapiens
ILTESHTSK

SEQ ID NO: 14010 - protein, 9 aa, Homo Sapiens
AKDLGENLT

SEQ ID NO: 14011 - protein, 9 aa, Homo Sapiens
FVQGLHLYC

SEQ ID NO: 14012 - protein, 9 aa, Homo Sapiens
ETPNELTSP

SEQ ID NO: 14013 - protein, 9 aa, Homo Sapiens
AVEKKACKC

SEQ ID NO: 14014 - protein, 9 aa, Homo Sapiens
AALRAPLNL

SEQ ID NO: 14015 - protein, 9 aa, Homo Sapiens
QNRIVDRAV

SEQ ID NO: 14016 - protein, 9 aa, Homo Sapiens
EYFVLVPHR

SEQ ID NO: 14017 - protein, 9 aa, Homo Sapiens
LTTASKVFP

SEQ ID NO: 14018 - protein, 9 aa, Homo Sapiens
DPDTSWSSS

SEQ ID NO: 14019 - protein, 9 aa, Homo Sapiens
GLGTDGSAT

SEQ ID NO: 14020 - protein, 9 aa, Homo Sapiens
TASKVFPEV

SEQ ID NO: 14021 - protein, 9 aa, Homo Sapiens
SEAADRLAR

SEQ ID NO: 14022 - protein, 9 aa, Homo Sapiens
HSVYGLELH

SEQ ID NO: 14023 - protein, 9 aa, Homo Sapiens
SACSKLCYK

SEQ ID NO: 14024 - protein, 9 aa, Homo Sapiens
GKHSVYGLE

SEQ ID NO: 14025 - protein, 9 aa, Homo Sapiens
KAIKHGSPE

SEQ ID NO: 14026 - protein, 9 aa, Homo Sapiens
NGCEYFVLV

SEQ ID NO: 14027 - protein, 9 aa, Homo Sapiens
YNLSANGYF

SEQ ID NO: 14028 - protein, 9 aa, Homo Sapiens
KRRNLLEDD

SEQ ID NO: 14029 - protein, 9 aa, Homo Sapiens
LQNYNLSAN

SEQ ID NO: 14030 - protein, 9 aa, Homo Sapiens
ATLSCRGGL

SEQ ID NO: 14031 - protein, 9 aa, Homo Sapiens
RDDVYDNIL

SEQ ID NO: 14032 - protein, 9 aa, Homo Sapiens
SGYILFYQL

SEQ ID NO: 14033 - protein, 9 aa, Homo Sapiens
CGNGEQTTW

SEQ ID NO: 14034 - protein, 9 aa, Homo Sapiens
CRNKIVENK

SEQ ID NO: 14035 - protein, 9 aa, Homo Sapiens
ERQLADTVA

SEQ ID NO: 14036 - protein, 9 aa, Homo Sapiens
MEDRIQLWK

SEQ ID NO: 14037 - protein, 9 aa, Homo Sapiens
RALQASLWT

SEQ ID NO: 14038 - protein, 9 aa, Homo Sapiens
CEMVMDILQ

SEQ ID NO: 14039 - protein, 9 aa, Homo Sapiens
LYQVKSEVD

SEQ ID NO: 14040 - protein, 9 aa, Homo Sapiens
RVPFALSSD

SEQ ID NO: 14041 - protein, 9 aa, Homo Sapiens
FKLPYIQPR

SEQ ID NO: 14042 - protein, 9 aa, Homo Sapiens
LNGLQNYNL

SEQ ID NO: 14043 - protein, 9 aa, Homo Sapiens
MCNIVTAYM

SEQ ID NO: 14044 - protein, 9 aa, Homo Sapiens
WTEEIPEIA

SEQ ID NO: 14045 - protein, 9 aa, Homo Sapiens
LFEKNRSLI

SEQ ID NO: 14046 - protein, 9 aa, Homo Sapiens
LTSSAVTFP

SEQ ID NO: 14047 - protein, 9 aa, Homo Sapiens
RPQEKPMLK

SEQ ID NO: 14048 - protein, 9 aa, Homo Sapiens
GPPGPVGSA

SEQ ID NO: 14049 - protein, 9 aa, Homo Sapiens
TVQNLKETL

SEQ ID NO: 14050 - protein, 9 aa, Homo Sapiens
ATDSPKYED

SEQ ID NO: 14051 - protein, 9 aa, Homo Sapiens
FFQNVNTCH

SEQ ID NO: 14052 - protein, 9 aa, Homo Sapiens
WTYMPHVFG

SEQ ID NO: 14053 - protein, 9 aa, Homo Sapiens
KEADRDRGS

SEQ ID NO: 14054 - protein, 9 aa, Homo Sapiens
NLVRPPSDL

SEQ ID NO: 14055 - protein, 9 aa, Homo Sapiens
SPSCNAHRE

SEQ ID NO: 14056 - protein, 9 aa, Homo Sapiens
NIYVDRMIK

SEQ ID NO: 14057 - protein, 9 aa, Homo Sapiens
LPVEMDDTE

SEQ ID NO: 14058 - protein, 9 aa, Homo Sapiens
TGHGDSDPG

SEQ ID NO: 14059 - protein, 9 aa, Homo Sapiens
EAADRLARR

SEQ ID NO: 14060 - protein, 9 aa, Homo Sapiens
RQLADTVAL

SEQ ID NO: 14061 - protein, 9 aa, Homo Sapiens
HGDSDPGHC

SEQ ID NO: 14062 - protein, 9 aa, Homo Sapiens
ASTCRSSDG

SEQ ID NO: 14063 - protein, 9 aa, Homo Sapiens
IGILDINFK

SEQ ID NO: 14064 - protein, 9 aa, Homo Sapiens
PNELTSPNT

SEQ ID NO: 14065 - protein, 9 aa, Homo Sapiens
ICLLRPQEK

SEQ ID NO: 14066 - protein, 9 aa, Homo Sapiens
SDMSSERVI

SEQ ID NO: 14067 - protein, 9 aa, Homo Sapiens
FKAIKHGSP

SEQ ID NO: 14068 - protein, 9 aa, Homo Sapiens
PAGAPYETR

SEQ ID NO: 14069 - protein, 9 aa, Homo Sapiens
LTSPNTPEP

SEQ ID NO: 14070 - protein, 9 aa, Homo Sapiens
YCCGSGRGC

SEQ ID NO: 14071 - protein, 9 aa, Homo Sapiens
LQERDQGGF

SEQ ID NO: 14072 - protein, 9 aa, Homo Sapiens
SAGYLSESA

SEQ ID NO: 14073 - protein, 9 aa, Homo Sapiens
LETGITGTA

SEQ ID NO: 14074 - protein, 9 aa, Homo Sapiens
EMLNLFQVT

SEQ ID NO: 14075 - protein, 9 aa, Homo Sapiens
LAALRAPLN

SEQ ID NO: 14076 - protein, 9 aa, Homo Sapiens
RRRVPFALS

SEQ ID NO: 14077 - protein, 9 aa, Homo Sapiens
GNEVVISGF

SEQ ID NO: 14078 - protein, 9 aa, Homo Sapiens
PEIAHHPTG

SEQ ID NO: 14079 - protein, 9 aa, Homo Sapiens
MRPAGSWKV

SEQ ID NO: 14080 - protein, 9 aa, Homo Sapiens
LKKAQLFEK

SEQ ID NO: 14081 - protein, 9 aa, Homo Sapiens
STFIALTSS

SEQ ID NO: 14082 - protein, 9 aa, Homo Sapiens
AIKHGSPEF

SEQ ID NO: 14083 - protein, 9 aa, Homo Sapiens
KYSPCRGNT

SEQ ID NO: 14084 - protein, 9 aa, Homo Sapiens
RQEKEADRD

SEQ ID NO: 14085 - protein, 9 aa, Homo Sapiens
FYDSNTVKP

SEQ ID NO: 14086 - protein, 9 aa, Homo Sapiens
GTVQNLKET

SEQ ID NO: 14087 - protein, 9 aa, Homo Sapiens
VAALACHQG

SEQ ID NO: 14088 - protein, 9 aa, Homo Sapiens
LALRLACIA

SEQ ID NO: 14089 - protein, 9 aa, Homo Sapiens
SPWRSSGQR

SEQ ID NO: 14090 - protein, 9 aa, Homo Sapiens
TEEIPEIAH

SEQ ID NO: 14091 - protein, 9 aa, Homo Sapiens
QKSTVLSRR

SEQ ID NO: 14092 - protein, 9 aa, Homo Sapiens
QQDGSRNLI

SEQ ID NO: 14093 - protein, 9 aa, Homo Sapiens
PCAAGASTF

SEQ ID NO: 14094 - protein, 9 aa, Homo Sapiens
SRGLSAGYL

SEQ ID NO: 14095 - protein, 9 aa, Homo Sapiens
PQLVPRLYS

SEQ ID NO: 14096 - protein, 9 aa, Homo Sapiens
GYLSESAVG

SEQ ID NO: 14097 - protein, 9 aa, Homo Sapiens
IADEMDVSL

SEQ ID NO: 14098 - protein, 9 aa, Homo Sapiens
GILDINFKP

SEQ ID NO: 14099 - protein, 9 aa, Homo Sapiens
GDSDPGHCW

SEQ ID NO: 14100 - protein, 9 aa, Homo Sapiens
GLDLDFETF

SEQ ID NO: 14101 - protein, 9 aa, Homo Sapiens
LLDGGNEVV

SEQ ID NO: 14102 - protein, 9 aa, Homo Sapiens
HGVLEMPLG

SEQ ID NO: 14103 - protein, 9 aa, Homo Sapiens
SKSDKLLII

SEQ ID NO: 14104 - protein, 9 aa, Homo Sapiens
GRRQEKEAD

SEQ ID NO: 14105 - protein, 9 aa, Homo Sapiens
ESNYCTAKG

SEQ ID NO: 14106 - protein, 9 aa, Homo Sapiens
KFASSIVRP

SEQ ID NO: 14107 - protein, 9 aa, Homo Sapiens
AVARGVTQL

SEQ ID NO: 14108 - protein, 9 aa, Homo Sapiens
GAWKPGSWT

SEQ ID NO: 14109 - protein, 9 aa, Homo Sapiens
PRHRLLMLV

SEQ ID NO: 14110 - protein, 9 aa, Homo Sapiens
ITGTALHAS

SEQ ID NO: 14111 - protein, 9 aa, Homo Sapiens
HRPRYYLRD

SEQ ID NO: 14112 - protein, 9 aa, Homo Sapiens
TGSPPCHSP

SEQ ID NO: 14113 - protein, 9 aa, Homo Sapiens
RRVPFALSS

SEQ ID NO: 14114 - protein, 9 aa, Homo Sapiens
VQNLKETLK

SEQ ID NO: 14115 - protein, 9 aa, Homo Sapiens
ACHQGARRP

SEQ ID NO: 14116 - protein, 9 aa, Homo Sapiens
DTSWSSSLA

SEQ ID NO: 14117 - protein, 9 aa, Homo Sapiens
NYCTAKGSE

SEQ ID NO: 14118 - protein, 9 aa, Homo Sapiens
NPFYLETGI

SEQ ID NO: 14119 - protein, 9 aa, Homo Sapiens
IAHHPTGFI

SEQ ID NO: 14120 - protein, 9 aa, Homo Sapiens
IMDRQKQQL

SEQ ID NO: 14121 - protein, 9 aa, Homo Sapiens
IPENMCNIV

SEQ ID NO: 14122 - protein, 9 aa, Homo Sapiens
SETPNELTS

SEQ ID NO: 14123 - protein, 9 aa, Homo Sapiens
EEFFQNVNT

SEQ ID NO: 14124 - protein, 9 aa, Homo Sapiens
GLSGPSQGL

SEQ ID NO: 14125 - protein, 9 aa, Homo Sapiens
GAPYETRWA

SEQ ID NO: 14126 - protein, 9 aa, Homo Sapiens
VIMLLGNKS

SEQ ID NO: 14127 - protein, 9 aa, Homo Sapiens
PGPVGSAGA

SEQ ID NO: 14128 - protein, 9 aa, Homo Sapiens
DNILTNNLP

SEQ ID NO: 14129 - protein, 9 aa, Homo Sapiens
TGITGTALH

SEQ ID NO: 14130 - protein, 9 aa, Homo Sapiens
FPPFNYSLG

SEQ ID NO: 14131 - protein, 9 aa, Homo Sapiens
DHSLSSSSS

SEQ ID NO: 14132 - protein, 9 aa, Homo Sapiens
VKSKRRNLL

SEQ ID NO: 14133 - protein, 9 aa, Homo Sapiens
DPDDNKENE

SEQ ID NO: 14134 - protein, 9 aa, Homo Sapiens
LDINFKPLA

SEQ ID NO: 14135 - protein, 9 aa, Homo Sapiens
PAPASSSYC

SEQ ID NO: 14136 - protein, 9 aa, Homo Sapiens
SEYVNWGYE

SEQ ID NO: 14137 - protein, 9 aa, Homo Sapiens
AKLTQFLME

SEQ ID NO: 14138 - protein, 9 aa, Homo Sapiens
GITGTALHA

SEQ ID NO: 14139 - protein, 9 aa, Homo Sapiens
QGVSEAADR

SEQ ID NO: 14140 - protein, 9 aa, Homo Sapiens
TWSPEQVCS

SEQ ID NO: 14141 - protein, 9 aa, Homo Sapiens
KVFPEVVGD

SEQ ID NO: 14142 - protein, 9 aa, Homo Sapiens
PQDRPRSQS

SEQ ID NO: 14143 - protein, 9 aa, Homo Sapiens
RSKSDKLLI

SEQ ID NO: 14144 - protein, 9 aa, Homo Sapiens
PFYLETGIT

SEQ ID NO: 14145 - protein, 9 aa, Homo Sapiens
LYCMQVEPR

SEQ ID NO: 14146 - protein, 9 aa, Homo Sapiens
TIMDRQKQQ

SEQ ID NO: 14147 - protein, 9 aa, Homo Sapiens
ADRIGIGCC

SEQ ID NO: 14148 - protein, 9 aa, Homo Sapiens
TSYSSHQEC

SEQ ID NO: 14149 - protein, 9 aa, Homo Sapiens
TKVRDDVYD

SEQ ID NO: 14150 - protein, 9 aa, Homo Sapiens
TCALATLKL

SEQ ID NO: 14151 - protein, 9 aa, Homo Sapiens
EVVISGFGD

SEQ ID NO: 14152 - protein, 9 aa, Homo Sapiens
KRLSVFVKG

SEQ ID NO: 14153 - protein, 9 aa, Homo Sapiens
EMVMDILQE

SEQ ID NO: 14154 - protein, 9 aa, Homo Sapiens
TVRVLVCRV

SEQ ID NO: 14155 - protein, 9 aa, Homo Sapiens
VAKDLGENL

SEQ ID NO: 14156 - protein, 9 aa, Homo Sapiens
SNRLERQLA

SEQ ID NO: 14157 - protein, 9 aa, Homo Sapiens
LFPLQIYIH

SEQ ID NO: 14158 - protein, 9 aa, Homo Sapiens
GVSEAADRL

SEQ ID NO: 14159 - protein, 9 aa, Homo Sapiens
SDPGHCWGF

SEQ ID NO: 14160 - protein, 9 aa, Homo Sapiens
RHRLLMLVK

SEQ ID NO: 14161 - protein, 9 aa, Homo Sapiens
CIIPENMCN

SEQ ID NO: 14162 - protein, 9 aa, Homo Sapiens
DRQKQQLLE

SEQ ID NO: 14163 - protein, 9 aa, Homo Sapiens
CPESAGGLP

SEQ ID NO: 14164 - protein, 9 aa, Homo Sapiens
RIQLELYQV

SEQ ID NO: 14165 - protein, 9 aa, Homo Sapiens
EAMHFPKVS

SEQ ID NO: 14166 - protein, 9 aa, Homo Sapiens
ELYQVKSEV

SEQ ID NO: 14167 - protein, 9 aa, Homo Sapiens
CALATLKLL

SEQ ID NO: 14168 - protein, 9 aa, Homo Sapiens
SPEQVCSFL

SEQ ID NO: 14169 - protein, 9 aa, Homo Sapiens
SVRAKVLIT

SEQ ID NO: 14170 - protein, 9 aa, Homo Sapiens
FITHSPDFE

SEQ ID NO: 14171 - protein, 9 aa, Homo Sapiens
SMDSKPWYC

SEQ ID NO: 14172 - protein, 9 aa, Homo Sapiens
RYQQDGSRN

SEQ ID NO: 14173 - protein, 9 aa, Homo Sapiens
HHPTGFISH

SEQ ID NO: 14174 - protein, 9 aa, Homo Sapiens
GHCWGFPDR

SEQ ID NO: 14175 - protein, 9 aa, Homo Sapiens
AWKPGSWTG

SEQ ID NO: 14176 - protein, 9 aa, Homo Sapiens
TDSEHSATG

SEQ ID NO: 14177 - protein, 9 aa, Homo Sapiens
RLEEFFQNV

SEQ ID NO: 14178 - protein, 9 aa, Homo Sapiens
LLPVEMDDT

SEQ ID NO: 14179 - protein, 9 aa, Homo Sapiens
RLGAWKPGS

SEQ ID NO: 14180 - protein, 9 aa, Homo Sapiens
NEGKDFCRN

SEQ ID NO: 14181 - protein, 9 aa, Homo Sapiens
AHRPRYYLR

SEQ ID NO: 14182 - protein, 9 aa, Homo Sapiens
QGLGMRPAG

SEQ ID NO: 14183 - protein, 9 aa, Homo Sapiens
THSTVRVLV

SEQ ID NO: 14184 - protein, 9 aa, Homo Sapiens
KFKLPYIQP

SEQ ID NO: 14185 - protein, 9 aa, Homo Sapiens
GTTACTLCD

SEQ ID NO: 14186 - protein, 9 aa, Homo Sapiens
DDQLAKLEK

SEQ ID NO: 14187 - protein, 9 aa, Homo Sapiens
TMLPECPES

SEQ ID NO: 14188 - protein, 9 aa, Homo Sapiens
SLLDGGNEV

SEQ ID NO: 14189 - protein, 9 aa, Homo Sapiens
VPRLYSYQF

SEQ ID NO: 14190 - protein, 9 aa, Homo Sapiens
EKKPFSEYV

SEQ ID NO: 14191 - protein, 9 aa, Homo Sapiens
RGLSGPSQG

SEQ ID NO: 14192 - protein, 9 aa, Homo Sapiens
YQVKSEVDR

SEQ ID NO: 14193 - protein, 9 aa, Homo Sapiens
KRVAKDLGE

SEQ ID NO: 14194 - protein, 9 aa, Homo Sapiens
DVYDNILTN

SEQ ID NO: 14195 - protein, 9 aa, Homo Sapiens
DGSATLSCR

SEQ ID NO: 14196 - protein, 9 aa, Homo Sapiens
EEFITHSPD

SEQ ID NO: 14197 - protein, 9 aa, Homo Sapiens
LADTVALRQ

SEQ ID NO: 14198 - protein, 9 aa, Homo Sapiens
ERNLLFRTG

SEQ ID NO: 14199 - protein, 9 aa, Homo Sapiens
QGARRPMPG

SEQ ID NO: 14200 - protein, 9 aa, Homo Sapiens
ALQASLWTE

SEQ ID NO: 14201 - protein, 9 aa, Homo Sapiens
LRLACIADE

SEQ ID NO: 14202 - protein, 9 aa, Homo Sapiens
PMCHQCHKV

SEQ ID NO: 14203 - protein, 9 aa, Homo Sapiens
FFFIKERNL

SEQ ID NO: 14204 - protein, 9 aa, Homo Sapiens
LAKLEKEPK

SEQ ID NO: 14205 - protein, 9 aa, Homo Sapiens
LSGPSQGLG

SEQ ID NO: 14206 - protein, 9 aa, Homo Sapiens
RDMNRNFDD

SEQ ID NO: 14207 - protein, 9 aa, Homo Sapiens
RQESPWRSS

SEQ ID NO: 14208 - protein, 9 aa, Homo Sapiens
IDPDDNKEN

SEQ ID NO: 14209 - protein, 9 aa, Homo Sapiens
PAAAHQGRG

SEQ ID NO: 14210 - protein, 9 aa, Homo Sapiens
SLWTEEIPE

SEQ ID NO: 14211 - protein, 9 aa, Homo Sapiens
EVIIELFPL

SEQ ID NO: 14212 - protein, 9 aa, Homo Sapiens
DNKENEAFE

SEQ ID NO: 14213 - protein, 9 aa, Homo Sapiens
PKFKLPYIQ

SEQ ID NO: 14214 - protein, 9 aa, Homo Sapiens
VLLAHRPRY

SEQ ID NO: 14215 - protein, 9 aa, Homo Sapiens
QEAMHFPKV

SEQ ID NO: 14216 - protein, 9 aa, Homo Sapiens
CAAGASTFQ

SEQ ID NO: 14217 - protein, 9 aa, Homo Sapiens
HPDYKTWSP

SEQ ID NO: 14218 - protein, 9 aa, Homo Sapiens
IKYDGKHSV

SEQ ID NO: 14219 - protein, 9 aa, Homo Sapiens
LFNTLLESN

SEQ ID NO: 14220 - protein, 9 aa, Homo Sapiens
IIPENMCNI

SEQ ID NO: 14221 - protein, 9 aa, Homo Sapiens
LRAPLNLTT

SEQ ID NO: 14222 - protein, 9 aa, Homo Sapiens
DREKEKENE

SEQ ID NO: 14223 - protein, 9 aa, Homo Sapiens
APLNLTTIL

SEQ ID NO: 14224 - protein, 9 aa, Homo Sapiens
ETGITGTAL

SEQ ID NO: 14225 - protein, 9 aa, Homo Sapiens
KVRDDVYDN

SEQ ID NO: 14226 - protein, 9 aa, Homo Sapiens
SNTVKPKYL

SEQ ID NO: 14227 - protein, 9 aa, Homo Sapiens
LRSTFIALT

SEQ ID NO: 14228 - protein, 9 aa, Homo Sapiens
KTRRADDFV

SEQ ID NO: 14229 - protein, 9 aa, Homo Sapiens
SSGELVDYN

SEQ ID NO: 14230 - protein, 9 aa, Homo Sapiens
GASTFQDFS

SEQ ID NO: 14231 - protein, 9 aa, Homo Sapiens
LKRVAKDLG

SEQ ID NO: 14232 - protein, 9 aa, Homo Sapiens
GHGDSDPGH

SEQ ID NO: 14233 - protein, 9 aa, Homo Sapiens
HSTVRVLVC

SEQ ID NO: 14234 - protein, 9 aa, Homo Sapiens
VDRAVFAVL

SEQ ID NO: 14235 - protein, 9 aa, Homo Sapiens
FALFFFFFQ

SEQ ID NO: 14236 - protein, 9 aa, Homo Sapiens
RGVTQLPNH

SEQ ID NO: 14237 - protein, 9 aa, Homo Sapiens
KCLLLKVNQ

SEQ ID NO: 14238 - protein, 9 aa, Homo Sapiens
SSICLLRPQ

SEQ ID NO: 14239 - protein, 9 aa, Homo Sapiens
ELVDYNVDI

SEQ ID NO: 14240 - protein, 9 aa, Homo Sapiens
LESNYCTAK

SEQ ID NO: 14241 - protein, 9 aa, Homo Sapiens
GELVDYNVD

SEQ ID NO: 14242 - protein, 9 aa, Homo Sapiens
ESAGGLPPP

SEQ ID NO: 14243 - protein, 9 aa, Homo Sapiens
MAASRWACK

SEQ ID NO: 14244 - protein, 9 aa, Homo Sapiens
WSPSCNAHR

SEQ ID NO: 14245 - protein, 9 aa, Homo Sapiens
EGKDFCRNK

SEQ ID NO: 14246 - protein, 9 aa, Homo Sapiens
SLFLVQHQR

SEQ ID NO: 14247 - protein, 9 aa, Homo Sapiens
PSQGLGMRP

SEQ ID NO: 14248 - protein, 9 aa, Homo Sapiens
GLHLYCMQV

SEQ ID NO: 14249 - protein, 9 aa, Homo Sapiens
TTASKVFPE

SEQ ID NO: 14250 - protein, 9 aa, Homo Sapiens
DISDMLKIL

SEQ ID NO: 14251 - protein, 9 aa, Homo Sapiens
QGLHLYCMQ

SEQ ID NO: 14252 - protein, 9 aa, Homo Sapiens
GSSFVSAGI

SEQ ID NO: 14253 - protein, 9 aa, Homo Sapiens
PYHHPLTSY

SEQ ID NO: 14254 - protein, 9 aa, Homo Sapiens
GEQTTWFSY

SEQ ID NO: 14255 - protein, 9 aa, Homo Sapiens
QAVEKKACK

SEQ ID NO: 14256 - protein, 9 aa, Homo Sapiens
LAHRPRYYL

SEQ ID NO: 14257 - protein, 9 aa, Homo Sapiens
RDRDREKEK

SEQ ID NO: 14258 - protein, 9 aa, Homo Sapiens
AAGASTFQD

SEQ ID NO: 14259 - protein, 9 aa, Homo Sapiens
RLERQLADT

SEQ ID NO: 14260 - protein, 9 aa, Homo Sapiens
YKTWSPEQV

SEQ ID NO: 14261 - protein, 9 aa, Homo Sapiens
ALRLACIAD

SEQ ID NO: 14262 - protein, 9 aa, Homo Sapiens
RMTLRDDQL

SEQ ID NO: 14263 - protein, 9 aa, Homo Sapiens
TAGKEEYSA

SEQ ID NO: 14264 - protein, 9 aa, Homo Sapiens
KLKCCWVNN

SEQ ID NO: 14265 - protein, 9 aa, Homo Sapiens
LILKRKGLR

SEQ ID NO: 14266 - protein, 9 aa, Homo Sapiens
KYNVKGSSS

SEQ ID NO: 14267 - protein, 9 aa, Homo Sapiens
ALRAPLNLT

SEQ ID NO: 14268 - protein, 9 aa, Homo Sapiens
QDRPRSQSM

SEQ ID NO: 14269 - protein, 9 aa, Homo Sapiens
TSSAVTFPG

SEQ ID NO: 14270 - protein, 9 aa, Homo Sapiens
NGKTRRADD

SEQ ID NO: 14271 - protein, 9 aa, Homo Sapiens
ADRLARRLY

SEQ ID NO: 14272 - protein, 9 aa, Homo Sapiens
DTDSEHSAT

SEQ ID NO: 14273 - protein, 9 aa, Homo Sapiens
LSRRRMYSF

SEQ ID NO: 14274 - protein, 9 aa, Homo Sapiens
DTAGKEEYS

SEQ ID NO: 14275 - protein, 9 aa, Homo Sapiens
NAGYSVRAK

SEQ ID NO: 14276 - protein, 9 aa, Homo Sapiens
KAFSRSLFL

SEQ ID NO: 14277 - protein, 9 aa, Homo Sapiens
GFPPFNYSL

SEQ ID NO: 14278 - protein, 9 aa, Homo Sapiens
QTTWFSYLS

SEQ ID NO: 14279 - protein, 9 aa, Homo Sapiens
AYNDFFLEN

SEQ ID NO: 14280 - protein, 9 aa, Homo Sapiens
EVGGPCTCA

SEQ ID NO: 14281 - protein, 9 aa, Homo Sapiens
GGPCTCALA

SEQ ID NO: 14282 - protein, 9 aa, Homo Sapiens
GPQWRLGAW

SEQ ID NO: 14283 - protein, 9 aa, Homo Sapiens
MDILQERDQ

SEQ ID NO: 14284 - protein, 9 aa, Homo Sapiens
SEHSATGSP

SEQ ID NO: 14285 - protein, 9 aa, Homo Sapiens
PKYEDKKRR

SEQ ID NO: 14286 - protein, 9 aa, Homo Sapiens
RPRYYLRDL

SEQ ID NO: 14287 - protein, 9 aa, Homo Sapiens
SFVSAGIQT

SEQ ID NO: 14288 - protein, 9 aa, Homo Sapiens
WVNNYTDFS

SEQ ID NO: 14289 - protein, 9 aa, Homo Sapiens
LKYNVKGSS

SEQ ID NO: 14290 - protein, 9 aa, Homo Sapiens
CHQGARRPM

SEQ ID NO: 14291 - protein, 9 aa, Homo Sapiens
FPLQIYIHH

SEQ ID NO: 14292 - protein, 9 aa, Homo Sapiens
HSATGSPPC

SEQ ID NO: 14293 - protein, 9 aa, Homo Sapiens
VARGVTQLP

SEQ ID NO: 14294 - protein, 9 aa, Homo Sapiens
VLSRRRMYS

SEQ ID NO: 14295 - protein, 9 aa, Homo Sapiens
SQKQDGTVQ

SEQ ID NO: 14296 - protein, 9 aa, Homo Sapiens
MPFRLTCQF

SEQ ID NO: 14297 - protein, 9 aa, Homo Sapiens
GNGEQTTWF

SEQ ID NO: 14298 - protein, 9 aa, Homo Sapiens
PGRRQEKEA

SEQ ID NO: 14299 - protein, 9 aa, Homo Sapiens
RNLLFRTGP

SEQ ID NO: 14300 - protein, 9 aa, Homo Sapiens
KLRQGFQRL

SEQ ID NO: 14301 - protein, 9 aa, Homo Sapiens
AGYLSESAV

SEQ ID NO: 14302 - protein, 9 aa, Homo Sapiens
CKCLLLKVN

SEQ ID NO: 14303 - protein, 9 aa, Homo Sapiens
LHLYCMQVE

SEQ ID NO: 14304 - protein, 9 aa, Homo Sapiens
SSSYCCGSG

SEQ ID NO: 14305 - protein, 9 aa, Homo Sapiens
QSMDSKPWY

SEQ ID NO: 14306 - protein, 9 aa, Homo Sapiens
AMHFPKVST

SEQ ID NO: 14307 - protein, 9 aa, Homo Sapiens
CQFINLMLP

SEQ ID NO: 14308 - protein, 9 aa, Homo Sapiens
PATEEFITH

SEQ ID NO: 14309 - protein, 9 aa, Homo Sapiens
YSVRAKVLI

SEQ ID NO: 14310 - protein, 9 aa, Homo Sapiens
YDNILTNNL

SEQ ID NO: 14311 - protein, 9 aa, Homo Sapiens
DQLAKLEKE

SEQ ID NO: 14312 - protein, 9 aa, Homo Sapiens
MLPECPESA

SEQ ID NO: 14313 - protein, 9 aa, Homo Sapiens
AALACHQGA

SEQ ID NO: 14314 - protein, 9 aa, Homo Sapiens
LCYKSFVAY

SEQ ID NO: 14315 - protein, 9 aa, Homo Sapiens
DFVSALVSG

SEQ ID NO: 14316 - protein, 9 aa, Homo Sapiens
ALHIEKEML

SEQ ID NO: 14317 - protein, 9 aa, Homo Sapiens
STCRSSDGV

SEQ ID NO: 14318 - protein, 9 aa, Homo Sapiens
IVDRAVFAV

SEQ ID NO: 14319 - protein, 9 aa, Homo Sapiens
FVKGHDKAV

SEQ ID NO: 14320 - protein, 9 aa, Homo Sapiens
SSIVRPYDE

SEQ ID NO: 14321 - protein, 9 aa, Homo Sapiens
HPTGFISHQ

SEQ ID NO: 14322 - protein, 9 aa, Homo Sapiens
GGNEVVISG

SEQ ID NO: 14323 - protein, 9 aa, Homo Sapiens
VYDNILTNN

SEQ ID NO: 14324 - protein, 9 aa, Homo Sapiens
NLLFRTGPH

SEQ ID NO: 14325 - protein, 9 aa, Homo Sapiens
RIGIGCCLV

SEQ ID NO: 14326 - protein, 9 aa, Homo Sapiens
STFQDFSHI

SEQ ID NO: 14327 - protein, 9 aa, Homo Sapiens
GVLEMPLGT

SEQ ID NO: 14328 - protein, 9 aa, Homo Sapiens
LLGNKSDMS

SEQ ID NO: 14329 - protein, 9 aa, Homo Sapiens
WRSSGQRAR

SEQ ID NO: 14330 - protein, 9 aa, Homo Sapiens
MHKLRQGFQ

SEQ ID NO: 14331 - protein, 9 aa, Homo Sapiens
CCWVNNYTD

SEQ ID NO: 14332 - protein, 9 aa, Homo Sapiens
KEVIIELFP

SEQ ID NO: 14333 - protein, 9 aa, Homo Sapiens
ESGRRAKYS

SEQ ID NO: 14334 - protein, 9 aa, Homo Sapiens
TFIALTSSA

SEQ ID NO: 14335 - protein, 9 aa, Homo Sapiens
EMPLGTGKT

SEQ ID NO: 14336 - protein, 9 aa, Homo Sapiens
FGSSFVSAG

SEQ ID NO: 14337 - protein, 9 aa, Homo Sapiens
AHHPTGFIS

SEQ ID NO: 14338 - protein, 9 aa, Homo Sapiens
LVDYNVDIG

SEQ ID NO: 14339 - protein, 9 aa, Homo Sapiens
WMMAIGFSI

SEQ ID NO: 14340 - protein, 9 aa, Homo Sapiens
IELFPLQIY

SEQ ID NO: 14341 - protein, 9 aa, Homo Sapiens
YQQDGSRNL

SEQ ID NO: 14342 - protein, 9 aa, Homo Sapiens
LMLVKDHGE

SEQ ID NO: 14343 - protein, 9 aa, Homo Sapiens
INEGKDFCR

SEQ ID NO: 14344 - protein, 9 aa, Homo Sapiens
TPNELTSPN

SEQ ID NO: 14345 - protein, 9 aa, Homo Sapiens
NTLLESNYC

SEQ ID NO: 14346 - protein, 9 aa, Homo Sapiens
RVLVCRVNE

SEQ ID NO: 14347 - protein, 9 aa, Homo Sapiens
KNLKRVAKD

SEQ ID NO: 14348 - protein, 9 aa, Homo Sapiens
ELFPLQIYI

SEQ ID NO: 14349 - protein, 9 aa, Homo Sapiens
QLELYQVKS

SEQ ID NO: 14350 - protein, 9 aa, Homo Sapiens
SSSSSSLSR

SEQ ID NO: 14351 - protein, 9 aa, Homo Sapiens
SDKLLIIIQ

SEQ ID NO: 14352 - protein, 9 aa, Homo Sapiens
VDCWPTDKV

SEQ ID NO: 14353 - protein, 9 aa, Homo Sapiens
NPVIGILDI

SEQ ID NO: 14354 - protein, 9 aa, Homo Sapiens
IKERNLLFR

SEQ ID NO: 14355 - protein, 9 aa, Homo Sapiens
PASSSYCCG

SEQ ID NO: 14356 - protein, 9 aa, Homo Sapiens
CEYFVLVPH

SEQ ID NO: 14357 - protein, 9 aa, Homo Sapiens
SKVFPEVVG

SEQ ID NO: 14358 - protein, 9 aa, Homo Sapiens
PRLYSYQFD

SEQ ID NO: 14359 - protein, 9 aa, Homo Sapiens
LLKYNVKGS

SEQ ID NO: 14360 - protein, 9 aa, Homo Sapiens
SRGLSGPSQ

SEQ ID NO: 14361 - protein, 9 aa, Homo Sapiens
ASQNRIVDR

SEQ ID NO: 14362 - protein, 9 aa, Homo Sapiens
RVAKDLGEN

SEQ ID NO: 14363 - protein, 9 aa, Homo Sapiens
LKILTESHT

SEQ ID NO: 14364 - protein, 9 aa, Homo Sapiens
MEKLKCCWV

SEQ ID NO: 14365 - protein, 9 aa, Homo Sapiens
LACHQGARR

SEQ ID NO: 14366 - protein, 9 aa, Homo Sapiens
SSQKQDGTV

SEQ ID NO: 14367 - protein, 9 aa, Homo Sapiens
LGIDVSRDM

SEQ ID NO: 14368 - protein, 9 aa, Homo Sapiens
LEEFFQNVN

SEQ ID NO: 14369 - protein, 9 aa, Homo Sapiens
LGTDGSATL

SEQ ID NO: 14370 - protein, 9 aa, Homo Sapiens
RRSKSDKLL

SEQ ID NO: 14371 - protein, 9 aa, Homo Sapiens
LRIQLELYQ

SEQ ID NO: 14372 - protein, 9 aa, Homo Sapiens
YLETGITGT

SEQ ID NO: 14373 - protein, 9 aa, Homo Sapiens
EKEADRDRG

SEQ ID NO: 14374 - protein, 9 aa, Homo Sapiens
RFADGFPPF

SEQ ID NO: 14375 - protein, 9 aa, Homo Sapiens
DINFKPLAN

SEQ ID NO: 14376 - protein, 9 aa, Homo Sapiens
QLVPRLYSY

SEQ ID NO: 14377 - protein, 9 aa, Homo Sapiens
SSPSMSPSR

SEQ ID NO: 14378 - protein, 9 aa, Homo Sapiens
YDGKHSVYG

SEQ ID NO: 14379 - protein, 9 aa, Homo Sapiens
LKCCWVNNY

SEQ ID NO: 14380 - protein, 9 aa, Homo Sapiens
NTVKPKYLS

SEQ ID NO: 14381 - protein, 9 aa, Homo Sapiens
VDRMIKGQK

SEQ ID NO: 14382 - protein, 9 aa, Homo Sapiens
LACIADEMD

SEQ ID NO: 14383 - protein, 9 aa, Homo Sapiens
GYILFYQLR

SEQ ID NO: 14384 - protein, 9 aa, Homo Sapiens
LSSSSSASP

SEQ ID NO: 14385 - protein, 9 aa, Homo Sapiens
PNIYVDRMI

SEQ ID NO: 14386 - protein, 9 aa, Homo Sapiens
HRLLMLVKD

SEQ ID NO: 14387 - protein, 9 aa, Homo Sapiens
ACIADEMDV

SEQ ID NO: 14388 - protein, 9 aa, Homo Sapiens
PLQIYIHHP

SEQ ID NO: 14389 - protein, 9 aa, Homo Sapiens
VSEAADRLA

SEQ ID NO: 14390 - protein, 9 aa, Homo Sapiens
GNKSDMSSE

SEQ ID NO: 14391 - protein, 9 aa, Homo Sapiens
VPFALSSDS

SEQ ID NO: 14392 - protein, 9 aa, Homo Sapiens
KDFCRNKIV

SEQ ID NO: 14393 - protein, 9 aa, Homo Sapiens
RLTIDHEKS

SEQ ID NO: 14394 - protein, 9 aa, Homo Sapiens
VGGPCTCAL

SEQ ID NO: 14395 - protein, 9 aa, Homo Sapiens
GKDFCRNKI

SEQ ID NO: 14396 - protein, 9 aa, Homo Sapiens
PELVHASTC

SEQ ID NO: 14397 - protein, 9 aa, Homo Sapiens
LLKVVPSSA

SEQ ID NO: 14398 - protein, 9 aa, Homo Sapiens
EVIKEFLGE

SEQ ID NO: 14399 - protein, 9 aa, Homo Sapiens
PQDRYKALW

SEQ ID NO: 14400 - protein, 9 aa, Homo Sapiens
YTKENGTGG

SEQ ID NO: 14401 - protein, 9 aa, Homo Sapiens
TVIACLPHP

SEQ ID NO: 14402 - protein, 9 aa, Homo Sapiens
QGFLHWGGR

SEQ ID NO: 14403 - protein, 9 aa, Homo Sapiens
HSAQSPVPL

SEQ ID NO: 14404 - protein, 9 aa, Homo Sapiens
NRDLDLAKK

SEQ ID NO: 14405 - protein, 9 aa, Homo Sapiens
TAQRTLYRH

SEQ ID NO: 14406 - protein, 9 aa, Homo Sapiens
RWRRPLSFT

SEQ ID NO: 14407 - protein, 9 aa, Homo Sapiens
NPPQKKTDD

SEQ ID NO: 14408 - protein, 9 aa, Homo Sapiens
MAFRYHCRL

SEQ ID NO: 14409 - protein, 9 aa, Homo Sapiens
SESDPRTVF

SEQ ID NO: 14410 - protein, 9 aa, Homo Sapiens
LIKPVGNIS

SEQ ID NO: 14411 - protein, 9 aa, Homo Sapiens
ADRAWGLFT

SEQ ID NO: 14412 - protein, 9 aa, Homo Sapiens
KRLLKQEKS

SEQ ID NO: 14413 - protein, 9 aa, Homo Sapiens
VTFPKLEPR

SEQ ID NO: 14414 - protein, 9 aa, Homo Sapiens
VPFLDCLSC

SEQ ID NO: 14415 - protein, 9 aa, Homo Sapiens
LICEGTLER

SEQ ID NO: 14416 - protein, 9 aa, Homo Sapiens
SALRRREDE

SEQ ID NO: 14417 - protein, 9 aa, Homo Sapiens
HMWWGIIES

SEQ ID NO: 14418 - protein, 9 aa, Homo Sapiens
REMVSPPSP

SEQ ID NO: 14419 - protein, 9 aa, Homo Sapiens
TFRQYRMLG

SEQ ID NO: 14420 - protein, 9 aa, Homo Sapiens
TACPVQTPR

SEQ ID NO: 14421 - protein, 9 aa, Homo Sapiens
QQTKNIIRS

SEQ ID NO: 14422 - protein, 9 aa, Homo Sapiens
EPRHWELWC

SEQ ID NO: 14423 - protein, 9 aa, Homo Sapiens
MPGCDVCAL

SEQ ID NO: 14424 - protein, 9 aa, Homo Sapiens
TQISESDPR

SEQ ID NO: 14425 - protein, 9 aa, Homo Sapiens
SGDYVVMSA

SEQ ID NO: 14426 - protein, 9 aa, Homo Sapiens
AGKEITVTF

SEQ ID NO: 14427 - protein, 9 aa, Homo Sapiens
CRLEPEDGT

SEQ ID NO: 14428 - protein, 9 aa, Homo Sapiens
NYPDVKIME

SEQ ID NO: 14429 - protein, 9 aa, Homo Sapiens
SSCMGGMNQ

SEQ ID NO: 14430 - protein, 9 aa, Homo Sapiens
LKNIEEEDK

SEQ ID NO: 14431 - protein, 9 aa, Homo Sapiens
FTAFTTMDD

SEQ ID NO: 14432 - protein, 9 aa, Homo Sapiens
HFCPVHRPP

SEQ ID NO: 14433 - protein, 9 aa, Homo Sapiens
FPDFPFPND

SEQ ID NO: 14434 - protein, 9 aa, Homo Sapiens
GNPEIKVKG

SEQ ID NO: 14435 - protein, 9 aa, Homo Sapiens
RGRRRCARW

SEQ ID NO: 14436 - protein, 9 aa, Homo Sapiens
RWGIEDEET

SEQ ID NO: 14437 - protein, 9 aa, Homo Sapiens
EYRALGSRR

SEQ ID NO: 14438 - protein, 9 aa, Homo Sapiens
SSAWGWPCS

SEQ ID NO: 14439 - protein, 9 aa, Homo Sapiens
TQMYSPKKQ

SEQ ID NO: 14440 - protein, 9 aa, Homo Sapiens
IPKLLGPLQ

SEQ ID NO: 14441 - protein, 9 aa, Homo Sapiens
RRWWTLAGK

SEQ ID NO: 14442 - protein, 9 aa, Homo Sapiens
PELQKPWAG

SEQ ID NO: 14443 - protein, 9 aa, Homo Sapiens
AASETPTGL

SEQ ID NO: 14444 - protein, 9 aa, Homo Sapiens
GSATATLQK

SEQ ID NO: 14445 - protein, 9 aa, Homo Sapiens
RERGPWSPT

SEQ ID NO: 14446 - protein, 9 aa, Homo Sapiens
HPVKYFFFL

SEQ ID NO: 14447 - protein, 9 aa, Homo Sapiens
PLRATQNVF

SEQ ID NO: 14448 - protein, 9 aa, Homo Sapiens
PFLDCLSCP

SEQ ID NO: 14449 - protein, 9 aa, Homo Sapiens
FRYHCRLIE

SEQ ID NO: 14450 - protein, 9 aa, Homo Sapiens
PPQKKTDDK

SEQ ID NO: 14451 - protein, 9 aa, Homo Sapiens
LQLLFFVIF

SEQ ID NO: 14452 - protein, 9 aa, Homo Sapiens
RPLSYSDTD

SEQ ID NO: 14453 - protein, 9 aa, Homo Sapiens
AFTTMDDWL

SEQ ID NO: 14454 - protein, 9 aa, Homo Sapiens
KHQRIVITP

SEQ ID NO: 14455 - protein, 9 aa, Homo Sapiens
VIKMLSKAV

SEQ ID NO: 14456 - protein, 9 aa, Homo Sapiens
VIKEFLGEE

SEQ ID NO: 14457 - protein, 9 aa, Homo Sapiens
EVGPLGVLV

SEQ ID NO: 14458 - protein, 9 aa, Homo Sapiens
QERWRRAFA

SEQ ID NO: 14459 - protein, 9 aa, Homo Sapiens
DMARTLNWG

SEQ ID NO: 14460 - protein, 9 aa, Homo Sapiens
SSSAWGWPC

SEQ ID NO: 14461 - protein, 9 aa, Homo Sapiens
RLRPLSYSD

SEQ ID NO: 14462 - protein, 9 aa, Homo Sapiens
ECTQKNVKV

SEQ ID NO: 14463 - protein, 9 aa, Homo Sapiens
ELQRMTSGT

SEQ ID NO: 14464 - protein, 9 aa, Homo Sapiens
PKNKSQSPD

SEQ ID NO: 14465 - protein, 9 aa, Homo Sapiens
GWASLSLLS

SEQ ID NO: 14466 - protein, 9 aa, Homo Sapiens
IHFPSFLRT

SEQ ID NO: 14467 - protein, 9 aa, Homo Sapiens
SCLELSLEG

SEQ ID NO: 14468 - protein, 9 aa, Homo Sapiens
RFIGLKCLE

SEQ ID NO: 14469 - protein, 9 aa, Homo Sapiens
TPRTEVMKS

SEQ ID NO: 14470 - protein, 9 aa, Homo Sapiens
YSDNNSPAG

SEQ ID NO: 14471 - protein, 9 aa, Homo Sapiens
TSKLGYSYN

SEQ ID NO: 14472 - protein, 9 aa, Homo Sapiens
RGGRGRRRC

SEQ ID NO: 14473 - protein, 9 aa, Homo Sapiens
VLQKSEEVR

SEQ ID NO: 14474 - protein, 9 aa, Homo Sapiens
LASSSAWGW

SEQ ID NO: 14475 - protein, 9 aa, Homo Sapiens
FLYEVFAQS

SEQ ID NO: 14476 - protein, 9 aa, Homo Sapiens
AWTGHVNPA

SEQ ID NO: 14477 - protein, 9 aa, Homo Sapiens
RAFATSPGA

SEQ ID NO: 14478 - protein, 9 aa, Homo Sapiens
TRGLVRPVS

SEQ ID NO: 14479 - protein, 9 aa, Homo Sapiens
KSFSRVSLV

SEQ ID NO: 14480 - protein, 9 aa, Homo Sapiens
ERLLIENCN

SEQ ID NO: 14481 - protein, 9 aa, Homo Sapiens
CMGGMNQRP

SEQ ID NO: 14482 - protein, 9 aa, Homo Sapiens
CCTRGLVRP

SEQ ID NO: 14483 - protein, 9 aa, Homo Sapiens
SKLGYSYNR

SEQ ID NO: 14484 - protein, 9 aa, Homo Sapiens
PHVEKSDVE

SEQ ID NO: 14485 - protein, 9 aa, Homo Sapiens
GAGDLYKRG

SEQ ID NO: 14486 - protein, 9 aa, Homo Sapiens
RQYRMLGKG

SEQ ID NO: 14487 - protein, 9 aa, Homo Sapiens
VIHMSWCPC

SEQ ID NO: 14488 - protein, 9 aa, Homo Sapiens
AACRSVAAL

SEQ ID NO: 14489 - protein, 9 aa, Homo Sapiens
LEPEISPLE

SEQ ID NO: 14490 - protein, 9 aa, Homo Sapiens
GSQTPCTTG

SEQ ID NO: 14491 - protein, 9 aa, Homo Sapiens
PTEHDKSHS

SEQ ID NO: 14492 - protein, 9 aa, Homo Sapiens
STQSEGKMP

SEQ ID NO: 14493 - protein, 9 aa, Homo Sapiens
SLPQTSLIK

SEQ ID NO: 14494 - protein, 9 aa, Homo Sapiens
AEEPIHATP

SEQ ID NO: 14495 - protein, 9 aa, Homo Sapiens
SDADMQRIL

SEQ ID NO: 14496 - protein, 9 aa, Homo Sapiens
AEHFFAGLE

SEQ ID NO: 14497 - protein, 9 aa, Homo Sapiens
MKRALCCVL

SEQ ID NO: 14498 - protein, 9 aa, Homo Sapiens
ELQKPWAGR

SEQ ID NO: 14499 - protein, 9 aa, Homo Sapiens
GKIPKLLGP

SEQ ID NO: 14500 - protein, 9 aa, Homo Sapiens
DLTPDHPVV

SEQ ID NO: 14501 - protein, 9 aa, Homo Sapiens
GNDMARTLN

SEQ ID NO: 14502 - protein, 9 aa, Homo Sapiens
MSAYFDLSR

SEQ ID NO: 14503 - protein, 9 aa, Homo Sapiens
TERMPPLIA

SEQ ID NO: 14504 - protein, 9 aa, Homo Sapiens
GNAWFVYKD

SEQ ID NO: 14505 - protein, 9 aa, Homo Sapiens
QTKNIIRSK

SEQ ID NO: 14506 - protein, 9 aa, Homo Sapiens
WAGRRRGGR

SEQ ID NO: 14507 - protein, 9 aa, Homo Sapiens
ESLTSGATE

SEQ ID NO: 14508 - protein, 9 aa, Homo Sapiens
GRSPRIPEP

SEQ ID NO: 14509 - protein, 9 aa, Homo Sapiens
RCERLTFNN

SEQ ID NO: 14510 - protein, 9 aa, Homo Sapiens
GPDADAQLR

SEQ ID NO: 14511 - protein, 9 aa, Homo Sapiens
PTHSAQSPV

SEQ ID NO: 14512 - protein, 9 aa, Homo Sapiens
IKVKGIDPV

SEQ ID NO: 14513 - protein, 9 aa, Homo Sapiens
QTCRTGCPR

SEQ ID NO: 14514 - protein, 9 aa, Homo Sapiens
IFCYKGAER

SEQ ID NO: 14515 - protein, 9 aa, Homo Sapiens
ESAPEAAAA

SEQ ID NO: 14516 - protein, 9 aa, Homo Sapiens
SSDTSALPY

SEQ ID NO: 14517 - protein, 9 aa, Homo Sapiens
PPALGPLKG

SEQ ID NO: 14518 - protein, 9 aa, Homo Sapiens
LERLLIENC

SEQ ID NO: 14519 - protein, 9 aa, Homo Sapiens
PPGKVPQKE

SEQ ID NO: 14520 - protein, 9 aa, Homo Sapiens
TEVMKSLPQ

SEQ ID NO: 14521 - protein, 9 aa, Homo Sapiens
FEHLTNLSY

SEQ ID NO: 14522 - protein, 9 aa, Homo Sapiens
EEQTHPPSP

SEQ ID NO: 14523 - protein, 9 aa, Homo Sapiens
GNIVTEHKN

SEQ ID NO: 14524 - protein, 9 aa, Homo Sapiens
QKWLNRHSW

SEQ ID NO: 14525 - protein, 9 aa, Homo Sapiens
VVINTSKEM

SEQ ID NO: 14526 - protein, 9 aa, Homo Sapiens
AVSDADMQR

SEQ ID NO: 14527 - protein, 9 aa, Homo Sapiens
DPHGDNGRL

SEQ ID NO: 14528 - protein, 9 aa, Homo Sapiens
TMDDWLSAI

SEQ ID NO: 14529 - protein, 9 aa, Homo Sapiens
ELQKKTESL

SEQ ID NO: 14530 - protein, 9 aa, Homo Sapiens
LEVGSESCE

SEQ ID NO: 14531 - protein, 9 aa, Homo Sapiens
AVVVIHMSW

SEQ ID NO: 14532 - protein, 9 aa, Homo Sapiens
LPHPVKYFF

SEQ ID NO: 14533 - protein, 9 aa, Homo Sapiens
EILSDKIHF

SEQ ID NO: 14534 - protein, 9 aa, Homo Sapiens
DCLSCPGRN

SEQ ID NO: 14535 - protein, 9 aa, Homo Sapiens
FDNLPDPQE

SEQ ID NO: 14536 - protein, 9 aa, Homo Sapiens
CGCCKICAN

SEQ ID NO: 14537 - protein, 9 aa, Homo Sapiens
IYIHRLAPG

SEQ ID NO: 14538 - protein, 9 aa, Homo Sapiens
HLALAPSTA

SEQ ID NO: 14539 - protein, 9 aa, Homo Sapiens
TTMDDWLSA

SEQ ID NO: 14540 - protein, 9 aa, Homo Sapiens
EKSDVEMEA

SEQ ID NO: 14541 - protein, 9 aa, Homo Sapiens
RCYGYTGAF

SEQ ID NO: 14542 - protein, 9 aa, Homo Sapiens
EFYLNDETL

SEQ ID NO: 14543 - protein, 9 aa, Homo Sapiens
GIPANPTHL

SEQ ID NO: 14544 - protein, 9 aa, Homo Sapiens
SPPGIYIHR

SEQ ID NO: 14545 - protein, 9 aa, Homo Sapiens
SSFSPGGLE

SEQ ID NO: 14546 - protein, 9 aa, Homo Sapiens
PDADAQLRR

SEQ ID NO: 14547 - protein, 9 aa, Homo Sapiens
DPQKLKPGE

SEQ ID NO: 14548 - protein, 9 aa, Homo Sapiens
PQLPTCDAP

SEQ ID NO: 14549 - protein, 9 aa, Homo Sapiens
ADNSTPVTT

SEQ ID NO: 14550 - protein, 9 aa, Homo Sapiens
RELQNAPDP

SEQ ID NO: 14551 - protein, 9 aa, Homo Sapiens
SDNNSPAGN

SEQ ID NO: 14552 - protein, 9 aa, Homo Sapiens
VTVRWKRVL

SEQ ID NO: 14553 - protein, 9 aa, Homo Sapiens
KRYPHVKIE

SEQ ID NO: 14554 - protein, 9 aa, Homo Sapiens
GEEWPSPKN

SEQ ID NO: 14555 - protein, 9 aa, Homo Sapiens
YHCRLIEHS

SEQ ID NO: 14556 - protein, 9 aa, Homo Sapiens
KALWLIFFM

SEQ ID NO: 14557 - protein, 9 aa, Homo Sapiens
VAVLTGLGL

SEQ ID NO: 14558 - protein, 9 aa, Homo Sapiens
GSESCEDQY

SEQ ID NO: 14559 - protein, 9 aa, Homo Sapiens
NPTHLAHNL

SEQ ID NO: 14560 - protein, 9 aa, Homo Sapiens
SPAGNIVTE

SEQ ID NO: 14561 - protein, 9 aa, Homo Sapiens
SIAGSATAT

SEQ ID NO: 14562 - protein, 9 aa, Homo Sapiens
LSINKLTSE

SEQ ID NO: 14563 - protein, 9 aa, Homo Sapiens
VPNSNERCY

SEQ ID NO: 14564 - protein, 9 aa, Homo Sapiens
LGELQLLFF

SEQ ID NO: 14565 - protein, 9 aa, Homo Sapiens
RLLKQEKSL

SEQ ID NO: 14566 - protein, 9 aa, Homo Sapiens
KEESPVVSC

SEQ ID NO: 14567 - protein, 9 aa, Homo Sapiens
LHFPHENLR

SEQ ID NO: 14568 - protein, 9 aa, Homo Sapiens
NQRGQPLTK

SEQ ID NO: 14569 - protein, 9 aa, Homo Sapiens
DKIHFPSFL

SEQ ID NO: 14570 - protein, 9 aa, Homo Sapiens
KVLQLPAAL

SEQ ID NO: 14571 - protein, 9 aa, Homo Sapiens
SMEVLKVGT

SEQ ID NO: 14572 - protein, 9 aa, Homo Sapiens
PGKVPQKEN

SEQ ID NO: 14573 - protein, 9 aa, Homo Sapiens
SAEPRHWEL

SEQ ID NO: 14574 - protein, 9 aa, Homo Sapiens
LDPSGHVAG

SEQ ID NO: 14575 - protein, 9 aa, Homo Sapiens
DSYVENEEY

SEQ ID NO: 14576 - protein, 9 aa, Homo Sapiens
ARAAKLDPS

SEQ ID NO: 14577 - protein, 9 aa, Homo Sapiens
SAQSPVPLR

SEQ ID NO: 14578 - protein, 9 aa, Homo Sapiens
KKTDDKAFS

SEQ ID NO: 14579 - protein, 9 aa, Homo Sapiens
RMLGKGGFG

SEQ ID NO: 14580 - protein, 9 aa, Homo Sapiens
TGSQTTFLA

SEQ ID NO: 14581 - protein, 9 aa, Homo Sapiens
FIWLHDSYV

SEQ ID NO: 14582 - protein, 9 aa, Homo Sapiens
ASGSSLQAG

SEQ ID NO: 14583 - protein, 9 aa, Homo Sapiens
IVITPTEVA

SEQ ID NO: 14584 - protein, 9 aa, Homo Sapiens
WRPRGRRRC

SEQ ID NO: 14585 - protein, 9 aa, Homo Sapiens
SCRLEPEDG

SEQ ID NO: 14586 - protein, 9 aa, Homo Sapiens
LSYLYLANN

SEQ ID NO: 14587 - protein, 9 aa, Homo Sapiens
LRRREDETR

SEQ ID NO: 14588 - protein, 9 aa, Homo Sapiens
YVVMSAYFD

SEQ ID NO: 14589 - protein, 9 aa, Homo Sapiens
EQTHPPSPA

SEQ ID NO: 14590 - protein, 9 aa, Homo Sapiens
GRRRGGRGR

SEQ ID NO: 14591 - protein, 9 aa, Homo Sapiens
LGRSPRIPE

SEQ ID NO: 14592 - protein, 9 aa, Homo Sapiens
PQPWTRPGW

SEQ ID NO: 14593 - protein, 9 aa, Homo Sapiens
SKDETTHDD

SEQ ID NO: 14594 - protein, 9 aa, Homo Sapiens
FAGLEVIVL

SEQ ID NO: 14595 - protein, 9 aa, Homo Sapiens
TSALPYDSV

SEQ ID NO: 14596 - protein, 9 aa, Homo Sapiens
GGRPQGCPD

SEQ ID NO: 14597 - protein, 9 aa, Homo Sapiens
GDYVVMSAY

SEQ ID NO: 14598 - protein, 9 aa, Homo Sapiens
GPWSPTHSA

SEQ ID NO: 14599 - protein, 9 aa, Homo Sapiens
IEEFYLNDE

SEQ ID NO: 14600 - protein, 9 aa, Homo Sapiens
FTPLPLPPV

SEQ ID NO: 14601 - protein, 9 aa, Homo Sapiens
FHWILLSAD

SEQ ID NO: 14602 - protein, 9 aa, Homo Sapiens
ELYLNLYLV

SEQ ID NO: 14603 - protein, 9 aa, Homo Sapiens
WWLQVPGEL

SEQ ID NO: 14604 - protein, 9 aa, Homo Sapiens
SGNVNGKRR

SEQ ID NO: 14605 - protein, 9 aa, Homo Sapiens
SEDHLQEEE

SEQ ID NO: 14606 - protein, 9 aa, Homo Sapiens
PTCDAPLEG

SEQ ID NO: 14607 - protein, 9 aa, Homo Sapiens
KRYHMWWGI

SEQ ID NO: 14608 - protein, 9 aa, Homo Sapiens
AQLERLLIE

SEQ ID NO: 14609 - protein, 9 aa, Homo Sapiens
YEGCKVGRC

SEQ ID NO: 14610 - protein, 9 aa, Homo Sapiens
NGKRRNHTK

SEQ ID NO: 14611 - protein, 9 aa, Homo Sapiens
PPWHGLMAA

SEQ ID NO: 14612 - protein, 9 aa, Homo Sapiens
VLDWCSSNE

SEQ ID NO: 14613 - protein, 9 aa, Homo Sapiens
LKVGTVLAI

SEQ ID NO: 14614 - protein, 9 aa, Homo Sapiens
RPFLLSLAA

SEQ ID NO: 14615 - protein, 9 aa, Homo Sapiens
PVRKDNNAA

SEQ ID NO: 14616 - protein, 9 aa, Homo Sapiens
QTHPPSPAG

SEQ ID NO: 14617 - protein, 9 aa, Homo Sapiens
EVESAPEAA

SEQ ID NO: 14618 - protein, 9 aa, Homo Sapiens
RMILSLPLI

SEQ ID NO: 14619 - protein, 9 aa, Homo Sapiens
LAKITAKLN

SEQ ID NO: 14620 - protein, 9 aa, Homo Sapiens
LQTLDQSTT

SEQ ID NO: 14621 - protein, 9 aa, Homo Sapiens
LENGIPANP

SEQ ID NO: 14622 - protein, 9 aa, Homo Sapiens
RLPALRFIG

SEQ ID NO: 14623 - protein, 9 aa, Homo Sapiens
LPTCDAPLE

SEQ ID NO: 14624 - protein, 9 aa, Homo Sapiens
LYLVKEAID

SEQ ID NO: 14625 - protein, 9 aa, Homo Sapiens
EPSMRPFLL

SEQ ID NO: 14626 - protein, 9 aa, Homo Sapiens
VSLQKWLNR

SEQ ID NO: 14627 - protein, 9 aa, Homo Sapiens
SSEDHLQEE

SEQ ID NO: 14628 - protein, 9 aa, Homo Sapiens
FPNDFPNFM

SEQ ID NO: 14629 - protein, 9 aa, Homo Sapiens
FDEAELRHQ

SEQ ID NO: 14630 - protein, 9 aa, Homo Sapiens
IWLHDSYVE

SEQ ID NO: 14631 - protein, 9 aa, Homo Sapiens
SGSMEVLKV

SEQ ID NO: 14632 - protein, 9 aa, Homo Sapiens
SFSRVSLVI

SEQ ID NO: 14633 - protein, 9 aa, Homo Sapiens
QGMLMAYPA

SEQ ID NO: 14634 - protein, 9 aa, Homo Sapiens
CANQPGEIC

SEQ ID NO: 14635 - protein, 9 aa, Homo Sapiens
PLTACPVQT

SEQ ID NO: 14636 - protein, 9 aa, Homo Sapiens
DPSGHVAGG

SEQ ID NO: 14637 - protein, 9 aa, Homo Sapiens
FLMGGDLPA

SEQ ID NO: 14638 - protein, 9 aa, Homo Sapiens
TPSLASLDV

SEQ ID NO: 14639 - protein, 9 aa, Homo Sapiens
HTERMPPLI

SEQ ID NO: 14640 - protein, 9 aa, Homo Sapiens
PFPTPSLAS

SEQ ID NO: 14641 - protein, 9 aa, Homo Sapiens
EFLGEEVFK

SEQ ID NO: 14642 - protein, 9 aa, Homo Sapiens
ALAPSTALL

SEQ ID NO: 14643 - protein, 9 aa, Homo Sapiens
TFLAEGELP

SEQ ID NO: 14644 - protein, 9 aa, Homo Sapiens
RQADEEITG

SEQ ID NO: 14645 - protein, 9 aa, Homo Sapiens
TPRLPPGGR

SEQ ID NO: 14646 - protein, 9 aa, Homo Sapiens
TPGTSLTSH

SEQ ID NO: 14647 - protein, 9 aa, Homo Sapiens
LGPLKGGDV

SEQ ID NO: 14648 - protein, 9 aa, Homo Sapiens
YLNLYLVKE

SEQ ID NO: 14649 - protein, 9 aa, Homo Sapiens
LIICSRACS

SEQ ID NO: 14650 - protein, 9 aa, Homo Sapiens
PGIYIHRLA

SEQ ID NO: 14651 - protein, 9 aa, Homo Sapiens
EKRYHMWWG

SEQ ID NO: 14652 - protein, 9 aa, Homo Sapiens
GCCKICANQ

SEQ ID NO: 14653 - protein, 9 aa, Homo Sapiens
SCLFLLKEL

SEQ ID NO: 14654 - protein, 9 aa, Homo Sapiens
PSMRPFLLS

SEQ ID NO: 14655 - protein, 9 aa, Homo Sapiens
DTAQRTLYR

SEQ ID NO: 14656 - protein, 9 aa, Homo Sapiens
LRLPALRFI

SEQ ID NO: 14657 - protein, 9 aa, Homo Sapiens
DFLEKRYHM

SEQ ID NO: 14658 - protein, 9 aa, Homo Sapiens
KVGRCTYGH

SEQ ID NO: 14659 - protein, 9 aa, Homo Sapiens
SYSDTDVIL

SEQ ID NO: 14660 - protein, 9 aa, Homo Sapiens
LYEVFAQSK

SEQ ID NO: 14661 - protein, 9 aa, Homo Sapiens
HCSTGYKPP

SEQ ID NO: 14662 - protein, 9 aa, Homo Sapiens
SSMDTQMYS

SEQ ID NO: 14663 - protein, 9 aa, Homo Sapiens
HDFHWILLS

SEQ ID NO: 14664 - protein, 9 aa, Homo Sapiens
AAHLALAPS

SEQ ID NO: 14665 - protein, 9 aa, Homo Sapiens
RRNHTKRIQ

SEQ ID NO: 14666 - protein, 9 aa, Homo Sapiens
GPSRWGIED

SEQ ID NO: 14667 - protein, 9 aa, Homo Sapiens
SRNKCHCST

SEQ ID NO: 14668 - protein, 9 aa, Homo Sapiens
REKVTFPKL

SEQ ID NO: 14669 - protein, 9 aa, Homo Sapiens
YLNDETLEY

SEQ ID NO: 14670 - protein, 9 aa, Homo Sapiens
GIEDEETSS

SEQ ID NO: 14671 - protein, 9 aa, Homo Sapiens
LHDSYVENE

SEQ ID NO: 14672 - protein, 9 aa, Homo Sapiens
FAQSKDETT

SEQ ID NO: 14673 - protein, 9 aa, Homo Sapiens
FKVTDSRDG

SEQ ID NO: 14674 - protein, 9 aa, Homo Sapiens
VMKSLPQTS

SEQ ID NO: 14675 - protein, 9 aa, Homo Sapiens
LSLEGERLC

SEQ ID NO: 14676 - protein, 9 aa, Homo Sapiens
VIQHLRIHT

SEQ ID NO: 14677 - protein, 9 aa, Homo Sapiens
AQRTLYRHV

SEQ ID NO: 14678 - protein, 9 aa, Homo Sapiens
GLIICSRAC

SEQ ID NO: 14679 - protein, 9 aa, Homo Sapiens
WELWCAVSK

SEQ ID NO: 14680 - protein, 9 aa, Homo Sapiens
GGPTEHDKS

SEQ ID NO: 14681 - protein, 9 aa, Homo Sapiens
DCSFLDYIL

SEQ ID NO: 14682 - protein, 9 aa, Homo Sapiens
GQLTYMLVP

SEQ ID NO: 14683 - protein, 9 aa, Homo Sapiens
EHFFAGLEV

SEQ ID NO: 14684 - protein, 9 aa, Homo Sapiens
GVGAAHLAL

SEQ ID NO: 14685 - protein, 9 aa, Homo Sapiens
VAACRSVAA

SEQ ID NO: 14686 - protein, 9 aa, Homo Sapiens
STTKLNNVI

SEQ ID NO: 14687 - protein, 9 aa, Homo Sapiens
YRILYGVEQ

SEQ ID NO: 14688 - protein, 9 aa, Homo Sapiens
LEHILGSLL

SEQ ID NO: 14689 - protein, 9 aa, Homo Sapiens
PFAYPGAGD

SEQ ID NO: 14690 - protein, 9 aa, Homo Sapiens
AEPRHWELW

SEQ ID NO: 14691 - protein, 9 aa, Homo Sapiens
LPLPPVPFL

SEQ ID NO: 14692 - protein, 9 aa, Homo Sapiens
ARQADEEIT

SEQ ID NO: 14693 - protein, 9 aa, Homo Sapiens
PLRIHFCPV

SEQ ID NO: 14694 - protein, 9 aa, Homo Sapiens
DYVVMSAYF

SEQ ID NO: 14695 - protein, 9 aa, Homo Sapiens
RTLYRHVML

SEQ ID NO: 14696 - protein, 9 aa, Homo Sapiens
SRKWCRCRG

SEQ ID NO: 14697 - protein, 9 aa, Homo Sapiens
RRRKRLLKQ

SEQ ID NO: 14698 - protein, 9 aa, Homo Sapiens
KLGYSYNRD

SEQ ID NO: 14699 - protein, 9 aa, Homo Sapiens
GSSLQAGDE

SEQ ID NO: 14700 - protein, 9 aa, Homo Sapiens
EEFYLNDET

SEQ ID NO: 14701 - protein, 9 aa, Homo Sapiens
HGNLACVCY

SEQ ID NO: 14702 - protein, 9 aa, Homo Sapiens
TTDDPQKLK

SEQ ID NO: 14703 - protein, 9 aa, Homo Sapiens
SKVSEEQTH

SEQ ID NO: 14704 - protein, 9 aa, Homo Sapiens
NGGSCRQTG

SEQ ID NO: 14705 - protein, 9 aa, Homo Sapiens
GKAFARSLL

SEQ ID NO: 14706 - protein, 9 aa, Homo Sapiens
CRLIEHSRI

SEQ ID NO: 14707 - protein, 9 aa, Homo Sapiens
MWWGIIESF

SEQ ID NO: 14708 - protein, 9 aa, Homo Sapiens
DTQMYSPKK

SEQ ID NO: 14709 - protein, 9 aa, Homo Sapiens
HYRTGKRLN

SEQ ID NO: 14710 - protein, 9 aa, Homo Sapiens
RRAVLTCFS

SEQ ID NO: 14711 - protein, 9 aa, Homo Sapiens
GNISRSMLW

SEQ ID NO: 14712 - protein, 9 aa, Homo Sapiens
EVMKSLPQT

SEQ ID NO: 14713 - protein, 9 aa, Homo Sapiens
DMQRILELE

SEQ ID NO: 14714 - protein, 9 aa, Homo Sapiens
AVCELDQSG

SEQ ID NO: 14715 - protein, 9 aa, Homo Sapiens
SRDGQSRTI

SEQ ID NO: 14716 - protein, 9 aa, Homo Sapiens
RRRGGRGRR

SEQ ID NO: 14717 - protein, 9 aa, Homo Sapiens
YMLVPDWQF

SEQ ID NO: 14718 - protein, 9 aa, Homo Sapiens
NLSYLYLAN

SEQ ID NO: 14719 - protein, 9 aa, Homo Sapiens
YLVSLQKWL

SEQ ID NO: 14720 - protein, 9 aa, Homo Sapiens
LEKRYHMWW

SEQ ID NO: 14721 - protein, 9 aa, Homo Sapiens
RLAPGSVAK

SEQ ID NO: 14722 - protein, 9 aa, Homo Sapiens
LRIHFCPVH

SEQ ID NO: 14723 - protein, 9 aa, Homo Sapiens
HLTNLSYLY

SEQ ID NO: 14724 - protein, 9 aa, Homo Sapiens
YANSYSFWM

SEQ ID NO: 14725 - protein, 9 aa, Homo Sapiens
AYFDLSRRM

SEQ ID NO: 14726 - protein, 9 aa, Homo Sapiens
SLGRNLICE

SEQ ID NO: 14727 - protein, 9 aa, Homo Sapiens
FSRVSLVIQ

SEQ ID NO: 14728 - protein, 9 aa, Homo Sapiens
RNKCHCSTG

SEQ ID NO: 14729 - protein, 9 aa, Homo Sapiens
MDTQMYSPK

SEQ ID NO: 14730 - protein, 9 aa, Homo Sapiens
PQKLKPGEI

SEQ ID NO: 14731 - protein, 9 aa, Homo Sapiens
VEDLTPDHP

SEQ ID NO: 14732 - protein, 9 aa, Homo Sapiens
PQTSLIKPV

SEQ ID NO: 14733 - protein, 9 aa, Homo Sapiens
VLVIFGVGA

SEQ ID NO: 14734 - protein, 9 aa, Homo Sapiens
ELEHRVECT

SEQ ID NO: 14735 - protein, 9 aa, Homo Sapiens
ESPVVSCRL

SEQ ID NO: 14736 - protein, 9 aa, Homo Sapiens
LLIENCNLT

SEQ ID NO: 14737 - protein, 9 aa, Homo Sapiens
TALLLLLLL

SEQ ID NO: 14738 - protein, 9 aa, Homo Sapiens
HGEVGPLGV

SEQ ID NO: 14739 - protein, 9 aa, Homo Sapiens
CRSVAALLP

SEQ ID NO: 14740 - protein, 9 aa, Homo Sapiens
PLGVLVIFG

SEQ ID NO: 14741 - protein, 9 aa, Homo Sapiens
TATTSGIRS

SEQ ID NO: 14742 - protein, 9 aa, Homo Sapiens
VKIMELQRM

SEQ ID NO: 14743 - protein, 9 aa, Homo Sapiens
PVNHLRCER

SEQ ID NO: 14744 - protein, 9 aa, Homo Sapiens
QCASAPCCN

SEQ ID NO: 14745 - protein, 9 aa, Homo Sapiens
QLERLLIEN

SEQ ID NO: 14746 - protein, 9 aa, Homo Sapiens
GPYEGYEST

SEQ ID NO: 14747 - protein, 9 aa, Homo Sapiens
RNAWWLQVP

SEQ ID NO: 14748 - protein, 9 aa, Homo Sapiens
RRAFATSPG

SEQ ID NO: 14749 - protein, 9 aa, Homo Sapiens
SPRIPEPVH

SEQ ID NO: 14750 - protein, 9 aa, Homo Sapiens
ATSPGAVVV

SEQ ID NO: 14751 - protein, 9 aa, Homo Sapiens
PRREMVSPP

SEQ ID NO: 14752 - protein, 9 aa, Homo Sapiens
TLAGKEITV

SEQ ID NO: 14753 - protein, 9 aa, Homo Sapiens
CWLYIQLQC

SEQ ID NO: 14754 - protein, 9 aa, Homo Sapiens
SDPRTVFIA

SEQ ID NO: 14755 - protein, 9 aa, Homo Sapiens
SPTHSAQSP

SEQ ID NO: 14756 - protein, 9 aa, Homo Sapiens
ILGSLLTEQ

SEQ ID NO: 14757 - protein, 9 aa, Homo Sapiens
ICANQPGEI

SEQ ID NO: 14758 - protein, 9 aa, Homo Sapiens
KINRDCSFL

SEQ ID NO: 14759 - protein, 9 aa, Homo Sapiens
NPAFCNFPS

SEQ ID NO: 14760 - protein, 9 aa, Homo Sapiens
HFFAGLEVI

SEQ ID NO: 14761 - protein, 9 aa, Homo Sapiens
IAVEDLTPD

SEQ ID NO: 14762 - protein, 9 aa, Homo Sapiens
SCKINRDCS

SEQ ID NO: 14763 - protein, 9 aa, Homo Sapiens
VPQKENLWL

SEQ ID NO: 14764 - protein, 9 aa, Homo Sapiens
ATYTKENGT

SEQ ID NO: 14765 - protein, 9 aa, Homo Sapiens
LPALRFIGL

SEQ ID NO: 14766 - protein, 9 aa, Homo Sapiens
LTSRSHEPY

SEQ ID NO: 14767 - protein, 9 aa, Homo Sapiens
KKTESLTSG

SEQ ID NO: 14768 - protein, 9 aa, Homo Sapiens
SPQPWTRPG

SEQ ID NO: 14769 - protein, 9 aa, Homo Sapiens
LLIFIYDEI

SEQ ID NO: 14770 - protein, 9 aa, Homo Sapiens
VGTVLAILG

SEQ ID NO: 14771 - protein, 9 aa, Homo Sapiens
EFDNLPDPQ

SEQ ID NO: 14772 - protein, 9 aa, Homo Sapiens
GRNLICEGT

SEQ ID NO: 14773 - protein, 9 aa, Homo Sapiens
AQGFLHWGG

SEQ ID NO: 14774 - protein, 9 aa, Homo Sapiens
SYNRDLDLA

SEQ ID NO: 14775 - protein, 9 aa, Homo Sapiens
DAASYRILY

SEQ ID NO: 14776 - protein, 9 aa, Homo Sapiens
GKNSLSKNV

SEQ ID NO: 14777 - protein, 9 aa, Homo Sapiens
GVNPEPLRA

SEQ ID NO: 14778 - protein, 9 aa, Homo Sapiens
ARSLLLIQH

SEQ ID NO: 14779 - protein, 9 aa, Homo Sapiens
IYDEIRKLI

SEQ ID NO: 14780 - protein, 9 aa, Homo Sapiens
ASRAALERW

SEQ ID NO: 14781 - protein, 9 aa, Homo Sapiens
SKSLGRNLI

SEQ ID NO: 14782 - protein, 9 aa, Homo Sapiens
SYRILYGVE

SEQ ID NO: 14783 - protein, 9 aa, Homo Sapiens
ALGSRRGMA

SEQ ID NO: 14784 - protein, 9 aa, Homo Sapiens
MNQRPILTI

SEQ ID NO: 14785 - protein, 9 aa, Homo Sapiens
GRCTYGHVY

SEQ ID NO: 14786 - protein, 9 aa, Homo Sapiens
AAWSPQPWT

SEQ ID NO: 14787 - protein, 9 aa, Homo Sapiens
EKVTFPKLE

SEQ ID NO: 14788 - protein, 9 aa, Homo Sapiens
KIMELQRMT

SEQ ID NO: 14789 - protein, 9 aa, Homo Sapiens
SLGELQLLF

SEQ ID NO: 14790 - protein, 9 aa, Homo Sapiens
LQVPGELGT

SEQ ID NO: 14791 - protein, 9 aa, Homo Sapiens
WVNNNIING

SEQ ID NO: 14792 - protein, 9 aa, Homo Sapiens
MGGDLPALD

SEQ ID NO: 14793 - protein, 9 aa, Homo Sapiens
RVQVFTKRP

SEQ ID NO: 14794 - protein, 9 aa, Homo Sapiens
DIQAWEMKP

SEQ ID NO: 14795 - protein, 9 aa, Homo Sapiens
IICSRACSL

SEQ ID NO: 14796 - protein, 9 aa, Homo Sapiens
QVQLLRVVL

SEQ ID NO: 14797 - protein, 9 aa, Homo Sapiens
NYKTLQVLV

SEQ ID NO: 14798 - protein, 9 aa, Homo Sapiens
HLQEEEQIE

SEQ ID NO: 14799 - protein, 9 aa, Homo Sapiens
AELYLNLYL

SEQ ID NO: 14800 - protein, 9 aa, Homo Sapiens
PDKARAETS

SEQ ID NO: 14801 - protein, 9 aa, Homo Sapiens
NLREWKLFQ

SEQ ID NO: 14802 - protein, 9 aa, Homo Sapiens
CRGIEEHRL

SEQ ID NO: 14803 - protein, 9 aa, Homo Sapiens
AFATSPGAV

SEQ ID NO: 14804 - protein, 9 aa, Homo Sapiens
CPVHRPPWH

SEQ ID NO: 14805 - protein, 9 aa, Homo Sapiens
MEVLKVGTV

SEQ ID NO: 14806 - protein, 9 aa, Homo Sapiens
REYRALGSR

SEQ ID NO: 14807 - protein, 9 aa, Homo Sapiens
TGYKPPNCQ

SEQ ID NO: 14808 - protein, 9 aa, Homo Sapiens
SATLGRSPR

SEQ ID NO: 14809 - protein, 9 aa, Homo Sapiens
QADEEITGY

SEQ ID NO: 14810 - protein, 9 aa, Homo Sapiens
RKRLLKQEK

SEQ ID NO: 14811 - protein, 9 aa, Homo Sapiens
HRPPWHGLM

SEQ ID NO: 14812 - protein, 9 aa, Homo Sapiens
AQSKDETTH

SEQ ID NO: 14813 - protein, 9 aa, Homo Sapiens
YPGAGDLYK

SEQ ID NO: 14814 - protein, 9 aa, Homo Sapiens
TPLTACPVQ

SEQ ID NO: 14815 - protein, 9 aa, Homo Sapiens
LQVLVADLV

SEQ ID NO: 14816 - protein, 9 aa, Homo Sapiens
CQTCRTGCP

SEQ ID NO: 14817 - protein, 9 aa, Homo Sapiens
SPPEAASET

SEQ ID NO: 14818 - protein, 9 aa, Homo Sapiens
GHVNPAFCN

SEQ ID NO: 14819 - protein, 9 aa, Homo Sapiens
PRRGLIICS

SEQ ID NO: 14820 - protein, 9 aa, Homo Sapiens
GEASGSSLQ

SEQ ID NO: 14821 - protein, 9 aa, Homo Sapiens
STALLLLLL

SEQ ID NO: 14822 - protein, 9 aa, Homo Sapiens
AGNIVTEHK

SEQ ID NO: 14823 - protein, 9 aa, Homo Sapiens
LVIQHLRIH

SEQ ID NO: 14824 - protein, 9 aa, Homo Sapiens
RDCSFLDYI

SEQ ID NO: 14825 - protein, 9 aa, Homo Sapiens
PGCDVCALL

SEQ ID NO: 14826 - protein, 9 aa, Homo Sapiens
LLDTAQRTL

SEQ ID NO: 14827 - protein, 9 aa, Homo Sapiens
ARWRRPLSF

SEQ ID NO: 14828 - protein, 9 aa, Homo Sapiens
LSDKIHFPS

SEQ ID NO: 14829 - protein, 9 aa, Homo Sapiens
LKPHTERMP

SEQ ID NO: 14830 - protein, 9 aa, Homo Sapiens
PGGRRWGCW

SEQ ID NO: 14831 - protein, 9 aa, Homo Sapiens
FSPGGLEPE

SEQ ID NO: 14832 - protein, 9 aa, Homo Sapiens
GIRSTLTPT

SEQ ID NO: 14833 - protein, 9 aa, Homo Sapiens
LLLLLIAAS

SEQ ID NO: 14834 - protein, 9 aa, Homo Sapiens
VIFGVGAAH

SEQ ID NO: 14835 - protein, 9 aa, Homo Sapiens
VMSAYFDLS

SEQ ID NO: 14836 - protein, 9 aa, Homo Sapiens
EEDKLIEEQ

SEQ ID NO: 14837 - protein, 9 aa, Homo Sapiens
QWAGLLLVV

SEQ ID NO: 14838 - protein, 9 aa, Homo Sapiens
DDPQKLKPG

SEQ ID NO: 14839 - protein, 9 aa, Homo Sapiens
CLPHPVKYF

SEQ ID NO: 14840 - protein, 9 aa, Homo Sapiens
STIPPHVEK

SEQ ID NO: 14841 - protein, 9 aa, Homo Sapiens
REQKCRKID

SEQ ID NO: 14842 - protein, 9 aa, Homo Sapiens
QKSEEVRVQ

SEQ ID NO: 14843 - protein, 9 aa, Homo Sapiens
KCKRYPHVK

SEQ ID NO: 14844 - protein, 9 aa, Homo Sapiens
ATPRGWASL

SEQ ID NO: 14845 - protein, 9 aa, Homo Sapiens
RHWELWCAV

SEQ ID NO: 14846 - protein, 9 aa, Homo Sapiens
NKCHCSTGY

SEQ ID NO: 14847 - protein, 9 aa, Homo Sapiens
LVAQSPVPV

SEQ ID NO: 14848 - protein, 9 aa, Homo Sapiens
ASLSLLSLT

SEQ ID NO: 14849 - protein, 9 aa, Homo Sapiens
LTNLSYLYL

SEQ ID NO: 14850 - protein, 9 aa, Homo Sapiens
LHKVLQLPA

SEQ ID NO: 14851 - protein, 9 aa, Homo Sapiens
SLQKWLNRH

SEQ ID NO: 14852 - protein, 9 aa, Homo Sapiens
IPPGLKPHT

SEQ ID NO: 14853 - protein, 9 aa, Homo Sapiens
SALPYDSVK

SEQ ID NO: 14854 - protein, 9 aa, Homo Sapiens
FLLKELLAL

SEQ ID NO: 14855 - protein, 9 aa, Homo Sapiens
CESAEPRHW

SEQ ID NO: 14856 - protein, 9 aa, Homo Sapiens
PRVLEFDNL

SEQ ID NO: 14857 - protein, 9 aa, Homo Sapiens
FTTMDDWLS

SEQ ID NO: 14858 - protein, 9 aa, Homo Sapiens
INKLTSERK

SEQ ID NO: 14859 - protein, 9 aa, Homo Sapiens
KWCRCRGIE

SEQ ID NO: 14860 - protein, 9 aa, Homo Sapiens
VTTPPRYPQ

SEQ ID NO: 14861 - protein, 9 aa, Homo Sapiens
RCCTRGLVR

SEQ ID NO: 14862 - protein, 9 aa, Homo Sapiens
IGEEWPSPK

SEQ ID NO: 14863 - protein, 9 aa, Homo Sapiens
ERGPWSPTH

SEQ ID NO: 14864 - protein, 9 aa, Homo Sapiens
RWGCWPSLA

SEQ ID NO: 14865 - protein, 9 aa, Homo Sapiens
GKEITVTFN

SEQ ID NO: 14866 - protein, 9 aa, Homo Sapiens
LSCPGRNAW

SEQ ID NO: 14867 - protein, 9 aa, Homo Sapiens
VSCRLEPED

SEQ ID NO: 14868 - protein, 9 aa, Homo Sapiens
EMLHDFHWI

SEQ ID NO: 14869 - protein, 9 aa, Homo Sapiens
VVLVAQSPV

SEQ ID NO: 14870 - protein, 9 aa, Homo Sapiens
SLASLDVYV

SEQ ID NO: 14871 - protein, 9 aa, Homo Sapiens
TATLQKELS

SEQ ID NO: 14872 - protein, 9 aa, Homo Sapiens
EHLTNLSYL

SEQ ID NO: 14873 - protein, 9 aa, Homo Sapiens
NSYSFWMAT

SEQ ID NO: 14874 - protein, 9 aa, Homo Sapiens
FCPVHRPPW

SEQ ID NO: 14875 - protein, 9 aa, Homo Sapiens
TGLGLIHGE

SEQ ID NO: 14876 - protein, 9 aa, Homo Sapiens
YKESLALRG

SEQ ID NO: 14877 - protein, 9 aa, Homo Sapiens
LLLIAASTQ

SEQ ID NO: 14878 - protein, 9 aa, Homo Sapiens
IEMLHDFHW

SEQ ID NO: 14879 - protein, 9 aa, Homo Sapiens
TASSSPHTA

SEQ ID NO: 14880 - protein, 9 aa, Homo Sapiens
QRIVITPTE

SEQ ID NO: 14881 - protein, 9 aa, Homo Sapiens
FLGEEVFKI

SEQ ID NO: 14882 - protein, 9 aa, Homo Sapiens
DNTDIQAWE

SEQ ID NO: 14883 - protein, 9 aa, Homo Sapiens
KENGTGGAG

SEQ ID NO: 14884 - protein, 9 aa, Homo Sapiens
RHQQMADPD

SEQ ID NO: 14885 - protein, 9 aa, Homo Sapiens
NNIINGSQV

SEQ ID NO: 14886 - protein, 9 aa, Homo Sapiens
VTDSRDGQS

SEQ ID NO: 14887 - protein, 9 aa, Homo Sapiens
TGKIPKLLG

SEQ ID NO: 14888 - protein, 9 aa, Homo Sapiens
PVEVIKEFL

SEQ ID NO: 14889 - protein, 9 aa, Homo Sapiens
LPLGTGNDM

SEQ ID NO: 14890 - protein, 9 aa, Homo Sapiens
ESTANPTVS

SEQ ID NO: 14891 - protein, 9 aa, Homo Sapiens
GQVIWVNNN

SEQ ID NO: 14892 - protein, 9 aa, Homo Sapiens
RLLIENCNL

SEQ ID NO: 14893 - protein, 9 aa, Homo Sapiens
AWWLQVPGE

SEQ ID NO: 14894 - protein, 9 aa, Homo Sapiens
DNNAALLHS

SEQ ID NO: 14895 - protein, 9 aa, Homo Sapiens
MILSLPLIN

SEQ ID NO: 14896 - protein, 9 aa, Homo Sapiens
SRPVTVAST

SEQ ID NO: 14897 - protein, 9 aa, Homo Sapiens
SRVSLVIQH

SEQ ID NO: 14898 - protein, 9 aa, Homo Sapiens
SPVPVAVLT

SEQ ID NO: 14899 - protein, 9 aa, Homo Sapiens
PDFTAFTTM

SEQ ID NO: 14900 - protein, 9 aa, Homo Sapiens
DNLPDPQEG

SEQ ID NO: 14901 - protein, 9 aa, Homo Sapiens
HRRHSRRCS

SEQ ID NO: 14902 - protein, 9 aa, Homo Sapiens
WFVYKDTSL

SEQ ID NO: 14903 - protein, 9 aa, Homo Sapiens
NVNGKRRNH

SEQ ID NO: 14904 - protein, 9 aa, Homo Sapiens
KCHCSTGYK

SEQ ID NO: 14905 - protein, 9 aa, Homo Sapiens
DEEITGYVA

SEQ ID NO: 14906 - protein, 9 aa, Homo Sapiens
PGGLEPEIS

SEQ ID NO: 14907 - protein, 9 aa, Homo Sapiens
FFAGLEVIV

SEQ ID NO: 14908 - protein, 9 aa, Homo Sapiens
STLTGKIPK

SEQ ID NO: 14909 - protein, 9 aa, Homo Sapiens
RKDAASYRI

SEQ ID NO: 14910 - protein, 9 aa, Homo Sapiens
LVRPVSASF

SEQ ID NO: 14911 - protein, 9 aa, Homo Sapiens
CNGGVCREG

SEQ ID NO: 14912 - protein, 9 aa, Homo Sapiens
PPDISRLRL

SEQ ID NO: 14913 - protein, 9 aa, Homo Sapiens
KVSEEQTHP

SEQ ID NO: 14914 - protein, 9 aa, Homo Sapiens
PSLASLDVY

SEQ ID NO: 14915 - protein, 9 aa, Homo Sapiens
RHEVESAPE

SEQ ID NO: 14916 - protein, 9 aa, Homo Sapiens
VSLVIQHLR

SEQ ID NO: 14917 - protein, 9 aa, Homo Sapiens
VPVAVLTGL

SEQ ID NO: 14918 - protein, 9 aa, Homo Sapiens
EFIWLHDSY

SEQ ID NO: 14919 - protein, 9 aa, Homo Sapiens
PEPEREQKC

SEQ ID NO: 14920 - protein, 9 aa, Homo Sapiens
HVNPAFCNF

SEQ ID NO: 14921 - protein, 9 aa, Homo Sapiens
VGSESCEDQ

SEQ ID NO: 14922 - protein, 9 aa, Homo Sapiens
VASTQSEGK

SEQ ID NO: 14923 - protein, 9 aa, Homo Sapiens
SLLLIQHQR

SEQ ID NO: 14924 - protein, 9 aa, Homo Sapiens
RRWGCWPSL

SEQ ID NO: 14925 - protein, 9 aa, Homo Sapiens
CQIKIFCYK

SEQ ID NO: 14926 - protein, 9 aa, Homo Sapiens
PSLASSSAW

SEQ ID NO: 14927 - protein, 9 aa, Homo Sapiens
WSPTHSAQS

SEQ ID NO: 14928 - protein, 9 aa, Homo Sapiens
ASTQSEGKM

SEQ ID NO: 14929 - protein, 9 aa, Homo Sapiens
LPQTSLIKP

SEQ ID NO: 14930 - protein, 9 aa, Homo Sapiens
YSTVCSAVL

SEQ ID NO: 14931 - protein, 9 aa, Homo Sapiens
RLIEHSRIH

SEQ ID NO: 14932 - protein, 9 aa, Homo Sapiens
VFLMGGDLP

SEQ ID NO: 14933 - protein, 9 aa, Homo Sapiens
QTLDQSTTK

SEQ ID NO: 14934 - protein, 9 aa, Homo Sapiens
VVSCRLEPE

SEQ ID NO: 14935 - protein, 9 aa, Homo Sapiens
LDSKAVPRA

SEQ ID NO: 14936 - protein, 9 aa, Homo Sapiens
NGGVNPEPL

SEQ ID NO: 14937 - protein, 9 aa, Homo Sapiens
CWPSLASSS

SEQ ID NO: 14938 - protein, 9 aa, Homo Sapiens
QSKLACMSN

SEQ ID NO: 14939 - protein, 9 aa, Homo Sapiens
HRLAPGSVA

SEQ ID NO: 14940 - protein, 9 aa, Homo Sapiens
THPPSPAGA

SEQ ID NO: 14941 - protein, 9 aa, Homo Sapiens
AAELYLNLY

SEQ ID NO: 14942 - protein, 9 aa, Homo Sapiens
MELQRMTSG

SEQ ID NO: 14943 - protein, 9 aa, Homo Sapiens
WTRPGWRPR

SEQ ID NO: 14944 - protein, 9 aa, Homo Sapiens
TDSRDGQSR

SEQ ID NO: 14945 - protein, 9 aa, Homo Sapiens
RPPWHGLMA

SEQ ID NO: 14946 - protein, 9 aa, Homo Sapiens
LKQILNVAV

SEQ ID NO: 14947 - protein, 9 aa, Homo Sapiens
HGGGFVALT

SEQ ID NO: 14948 - protein, 9 aa, Homo Sapiens
RRPLSFTPL

SEQ ID NO: 14949 - protein, 9 aa, Homo Sapiens
TTKLNNVIY

SEQ ID NO: 14950 - protein, 9 aa, Homo Sapiens
CPGRNAWWL

SEQ ID NO: 14951 - protein, 9 aa, Homo Sapiens
ISLDPHGDN

SEQ ID NO: 14952 - protein, 9 aa, Homo Sapiens
NAWFVYKDT

SEQ ID NO: 14953 - protein, 9 aa, Homo Sapiens
FYLNDETLE

SEQ ID NO: 14954 - protein, 9 aa, Homo Sapiens
ITAKLNYAE

SEQ ID NO: 14955 - protein, 9 aa, Homo Sapiens
GKVPQKENL

SEQ ID NO: 14956 - protein, 9 aa, Homo Sapiens
LHYLVSLQK

SEQ ID NO: 14957 - protein, 9 aa, Homo Sapiens
ALWLIFFML

SEQ ID NO: 14958 - protein, 9 aa, Homo Sapiens
CRKIDTHPS

SEQ ID NO: 14959 - protein, 9 aa, Homo Sapiens
QSGNPEIKV

SEQ ID NO: 14960 - protein, 9 aa, Homo Sapiens
ATVRKGYST

SEQ ID NO: 14961 - protein, 9 aa, Homo Sapiens
TRASRAALE

SEQ ID NO: 14962 - protein, 9 aa, Homo Sapiens
FIYDEIRKL

SEQ ID NO: 14963 - protein, 9 aa, Homo Sapiens
TVIEEFYLN

SEQ ID NO: 14964 - protein, 9 aa, Homo Sapiens
VVIHMSWCP

SEQ ID NO: 14965 - protein, 9 aa, Homo Sapiens
EWPSPKNKS

SEQ ID NO: 14966 - protein, 9 aa, Homo Sapiens
DFPFPNDFP

SEQ ID NO: 14967 - protein, 9 aa, Homo Sapiens
YSALRRRED

SEQ ID NO: 14968 - protein, 9 aa, Homo Sapiens
GDSKKGNSS

SEQ ID NO: 14969 - protein, 9 aa, Homo Sapiens
IHGEVGPLG

SEQ ID NO: 14970 - protein, 9 aa, Homo Sapiens
PPREYRALG

SEQ ID NO: 14971 - protein, 9 aa, Homo Sapiens
SLQAGDEKE

SEQ ID NO: 14972 - protein, 9 aa, Homo Sapiens
CKVGRCTYG

SEQ ID NO: 14973 - protein, 9 aa, Homo Sapiens
QIQQTKNII

SEQ ID NO: 14974 - protein, 9 aa, Homo Sapiens
ELQNAPDPS

SEQ ID NO: 14975 - protein, 9 aa, Homo Sapiens
GCPDKARAE

SEQ ID NO: 14976 - protein, 9 aa, Homo Sapiens
CEDQYDDLY

SEQ ID NO: 14977 - protein, 9 aa, Homo Sapiens
MTPTASSSP

SEQ ID NO: 14978 - protein, 9 aa, Homo Sapiens
GDNGRLNIL

SEQ ID NO: 14979 - protein, 9 aa, Homo Sapiens
QGSSEDHLQ

SEQ ID NO: 14980 - protein, 9 aa, Homo Sapiens
GLLDTAQRT

SEQ ID NO: 14981 - protein, 9 aa, Homo Sapiens
GCKVGRCTY

SEQ ID NO: 14982 - protein, 9 aa, Homo Sapiens
PVPFLDCLS

SEQ ID NO: 14983 - protein, 9 aa, Homo Sapiens
MEASCLELS

SEQ ID NO: 14984 - protein, 9 aa, Homo Sapiens
VLTCFSAGC

SEQ ID NO: 14985 - protein, 9 aa, Homo Sapiens
MAYPAKVED

SEQ ID NO: 14986 - protein, 9 aa, Homo Sapiens
RTPGTSLTS

SEQ ID NO: 14987 - protein, 9 aa, Homo Sapiens
YSPKKQERV

SEQ ID NO: 14988 - protein, 9 aa, Homo Sapiens
LGWQMPPAL

SEQ ID NO: 14989 - protein, 9 aa, Homo Sapiens
VSPPSPLSG

SEQ ID NO: 14990 - protein, 9 aa, Homo Sapiens
LSCLFLLKE

SEQ ID NO: 14991 - protein, 9 aa, Homo Sapiens
VRPVSASFL

SEQ ID NO: 14992 - protein, 9 aa, Homo Sapiens
FVYKDTSLH

SEQ ID NO: 14993 - protein, 9 aa, Homo Sapiens
TSLTSHDSR

SEQ ID NO: 14994 - protein, 9 aa, Homo Sapiens
NSPEMCQTC

SEQ ID NO: 14995 - protein, 9 aa, Homo Sapiens
CERLTFNNP

SEQ ID NO: 14996 - protein, 9 aa, Homo Sapiens
HVEKSDVEM

SEQ ID NO: 14997 - protein, 9 aa, Homo Sapiens
GWPCSPTRA

SEQ ID NO: 14998 - protein, 9 aa, Homo Sapiens
YLPPVYNQR

SEQ ID NO: 14999 - protein, 9 aa, Homo Sapiens
NAPDPSLRA

SEQ ID NO: 15000 - protein, 9 aa, Homo Sapiens
KLDSKAVPR

SEQ ID NO: 15001 - protein, 9 aa, Homo Sapiens
KSHRRHSRR

SEQ ID NO: 15002 - protein, 9 aa, Homo Sapiens
KSLGRNLIC

SEQ ID NO: 15003 - protein, 9 aa, Homo Sapiens
IKEFLGEEV

SEQ ID NO: 15004 - protein, 9 aa, Homo Sapiens
PPASIPPDI

SEQ ID NO: 15005 - protein, 9 aa, Homo Sapiens
SKLACMSND

SEQ ID NO: 15006 - protein, 9 aa, Homo Sapiens
TQQKSVTVV

SEQ ID NO: 15007 - protein, 9 aa, Homo Sapiens
TDKQTVTTP

SEQ ID NO: 15008 - protein, 9 aa, Homo Sapiens
EICWLYIQL

SEQ ID NO: 15009 - protein, 9 aa, Homo Sapiens
SKKGNSSPS

SEQ ID NO: 15010 - protein, 9 aa, Homo Sapiens
SLRAAWSPQ

SEQ ID NO: 15011 - protein, 9 aa, Homo Sapiens
MTSGTPRTE

SEQ ID NO: 15012 - protein, 9 aa, Homo Sapiens
CASAPCCNG

SEQ ID NO: 15013 - protein, 9 aa, Homo Sapiens
LAVCELDQS

SEQ ID NO: 15014 - protein, 9 aa, Homo Sapiens
AWGWPCSPT

SEQ ID NO: 15015 - protein, 9 aa, Homo Sapiens
PAQGFLHWG

SEQ ID NO: 15016 - protein, 9 aa, Homo Sapiens
PCSPTRASR

SEQ ID NO: 15017 - protein, 9 aa, Homo Sapiens
LDQSTTKLN

SEQ ID NO: 15018 - protein, 9 aa, Homo Sapiens
LKCKRYPHV

SEQ ID NO: 15019 - protein, 9 aa, Homo Sapiens
KQCASAPCC

SEQ ID NO: 15020 - protein, 9 aa, Homo Sapiens
EPIHATPRG

SEQ ID NO: 15021 - protein, 9 aa, Homo Sapiens
LRGTHEKDT

SEQ ID NO: 15022 - protein, 9 aa, Homo Sapiens
RSLLLIQHQ

SEQ ID NO: 15023 - protein, 9 aa, Homo Sapiens
HYLVSLQKW

SEQ ID NO: 15024 - protein, 9 aa, Homo Sapiens
WPCSPTRAS

SEQ ID NO: 15025 - protein, 9 aa, Homo Sapiens
PNYPDVKIM

SEQ ID NO: 15026 - protein, 9 aa, Homo Sapiens
LVIFGVGAA

SEQ ID NO: 15027 - protein, 9 aa, Homo Sapiens
VAQSPVPVA

SEQ ID NO: 15028 - protein, 9 aa, Homo Sapiens
LTACPVQTP

SEQ ID NO: 15029 - protein, 9 aa, Homo Sapiens
KIFCYKGAE

SEQ ID NO: 15030 - protein, 9 aa, Homo Sapiens
EITGYVATR

SEQ ID NO: 15031 - protein, 9 aa, Homo Sapiens
NVIKMLSKA

SEQ ID NO: 15032 - protein, 9 aa, Homo Sapiens
QRMTSGTPR

SEQ ID NO: 15033 - protein, 9 aa, Homo Sapiens
NDTVIEEFY

SEQ ID NO: 15034 - protein, 9 aa, Homo Sapiens
ESLALRGTH

SEQ ID NO: 15035 - protein, 9 aa, Homo Sapiens
EEETTDDPQ

SEQ ID NO: 15036 - protein, 9 aa, Homo Sapiens
SATATLQKE

SEQ ID NO: 15037 - protein, 9 aa, Homo Sapiens
PHTERMPPL

SEQ ID NO: 15038 - protein, 9 aa, Homo Sapiens
CTQKNVKVI

SEQ ID NO: 15039 - protein, 9 aa, Homo Sapiens
GGRRWGCWP

SEQ ID NO: 15040 - protein, 9 aa, Homo Sapiens
QLTYMLVPD

SEQ ID NO: 15041 - protein, 9 aa, Homo Sapiens
SGSSLQAGD

SEQ ID NO: 15042 - protein, 9 aa, Homo Sapiens
RYPHVKIEG

SEQ ID NO: 15043 - protein, 9 aa, Homo Sapiens
FREKVTFPK

SEQ ID NO: 15044 - protein, 9 aa, Homo Sapiens
THSAQSPVP

SEQ ID NO: 15045 - protein, 9 aa, Homo Sapiens
AGDLYKRGS

SEQ ID NO: 15046 - protein, 9 aa, Homo Sapiens
REFKVTDSR

SEQ ID NO: 15047 - protein, 9 aa, Homo Sapiens
WASLSLLSL

SEQ ID NO: 15048 - protein, 9 aa, Homo Sapiens
QPHRRMILS

SEQ ID NO: 15049 - protein, 9 aa, Homo Sapiens
SILSTTPAD

SEQ ID NO: 15050 - protein, 9 aa, Homo Sapiens
LKELLALGS

SEQ ID NO: 15051 - protein, 9 aa, Homo Sapiens
SLTPRLPPG

SEQ ID NO: 15052 - protein, 9 aa, Homo Sapiens
VIIDNTDIQ

SEQ ID NO: 15053 - protein, 9 aa, Homo Sapiens
YSDTDVILM

SEQ ID NO: 15054 - protein, 9 aa, Homo Sapiens
LLQTLDQST

SEQ ID NO: 15055 - protein, 9 aa, Homo Sapiens
FLPRRGLII

SEQ ID NO: 15056 - protein, 9 aa, Homo Sapiens
KRALCCVLL

SEQ ID NO: 15057 - protein, 9 aa, Homo Sapiens
RLLPGTQQK

SEQ ID NO: 15058 - protein, 9 aa, Homo Sapiens
GLTHTCETL

SEQ ID NO: 15059 - protein, 9 aa, Homo Sapiens
VEVIKEFLG

SEQ ID NO: 15060 - protein, 9 aa, Homo Sapiens
ASSSPHTAG

SEQ ID NO: 15061 - protein, 9 aa, Homo Sapiens
MGGMNQRPI

SEQ ID NO: 15062 - protein, 9 aa, Homo Sapiens
IRSTLTPTV

SEQ ID NO: 15063 - protein, 9 aa, Homo Sapiens
GRNAWWLQV

SEQ ID NO: 15064 - protein, 9 aa, Homo Sapiens
LGVLVIFGV

SEQ ID NO: 15065 - protein, 9 aa, Homo Sapiens
QMPPALGPL

SEQ ID NO: 15066 - protein, 9 aa, Homo Sapiens
QRTLYRHVM

SEQ ID NO: 15067 - protein, 9 aa, Homo Sapiens
SVAQLERLL

SEQ ID NO: 15068 - protein, 9 aa, Homo Sapiens
VPVEVIKEF

SEQ ID NO: 15069 - protein, 9 aa, Homo Sapiens
DTSALPYDS

SEQ ID NO: 15070 - protein, 9 aa, Homo Sapiens
RRKRLLKQE

SEQ ID NO: 15071 - protein, 9 aa, Homo Sapiens
RCARWRRPL

SEQ ID NO: 15072 - protein, 9 aa, Homo Sapiens
TSPGAVVVI

SEQ ID NO: 15073 - protein, 9 aa, Homo Sapiens
YSFWMATVD

SEQ ID NO: 15074 - protein, 9 aa, Homo Sapiens
IACLPHPVK

SEQ ID NO: 15075 - protein, 9 aa, Homo Sapiens
EESPVVSCR

SEQ ID NO: 15076 - protein, 9 aa, Homo Sapiens
ASAPCCNGG

SEQ ID NO: 15077 - protein, 9 aa, Homo Sapiens
SRPRREMVS

SEQ ID NO: 15078 - protein, 9 aa, Homo Sapiens
CYEQGLIDL

SEQ ID NO: 15079 - protein, 9 aa, Homo Sapiens
VGRCTYGHV

SEQ ID NO: 15080 - protein, 9 aa, Homo Sapiens
FATSPGAVV

SEQ ID NO: 15081 - protein, 9 aa, Homo Sapiens
LSKNVIKML

SEQ ID NO: 15082 - protein, 9 aa, Homo Sapiens
KAFARSLLL

SEQ ID NO: 15083 - protein, 9 aa, Homo Sapiens
PFPNDFPNF

SEQ ID NO: 15084 - protein, 9 aa, Homo Sapiens
FLHWGGRKS

SEQ ID NO: 15085 - protein, 9 aa, Homo Sapiens
SCPGRNAWW

SEQ ID NO: 15086 - protein, 9 aa, Homo Sapiens
EFKVTDSRD

SEQ ID NO: 15087 - protein, 9 aa, Homo Sapiens
VTPLPWCPR

SEQ ID NO: 15088 - protein, 9 aa, Homo Sapiens
LQSKLACMS

SEQ ID NO: 15089 - protein, 9 aa, Homo Sapiens
SHRRHSRRC

SEQ ID NO: 15090 - protein, 9 aa, Homo Sapiens
FGPSRWGIE

SEQ ID NO: 15091 - protein, 9 aa, Homo Sapiens
KPAQGFLHW

SEQ ID NO: 15092 - protein, 9 aa, Homo Sapiens
VVVGVLLKV

SEQ ID NO: 15093 - protein, 9 aa, Homo Sapiens
LTSERKVSL

SEQ ID NO: 15094 - protein, 9 aa, Homo Sapiens
VGPYEGYES

SEQ ID NO: 15095 - protein, 9 aa, Homo Sapiens
LACMSNDFK

SEQ ID NO: 15096 - protein, 9 aa, Homo Sapiens
HENLREWKL

SEQ ID NO: 15097 - protein, 9 aa, Homo Sapiens
RCRGIEEHR

SEQ ID NO: 15098 - protein, 9 aa, Homo Sapiens
HRVECTQKN

SEQ ID NO: 15099 - protein, 9 aa, Homo Sapiens
IYQSVVINT

SEQ ID NO: 15100 - protein, 9 aa, Homo Sapiens
WKRVLDWCS

SEQ ID NO: 15101 - protein, 9 aa, Homo Sapiens
TKENGTGGA

SEQ ID NO: 15102 - protein, 9 aa, Homo Sapiens
YSYNRDLDL

SEQ ID NO: 15103 - protein, 9 aa, Homo Sapiens
LTGLGLIHG

SEQ ID NO: 15104 - protein, 9 aa, Homo Sapiens
SETPTGLRF

SEQ ID NO: 15105 - protein, 9 aa, Homo Sapiens
HRRMILSLP

SEQ ID NO: 15106 - protein, 9 aa, Homo Sapiens
GGMNQRPIL

SEQ ID NO: 15107 - protein, 9 aa, Homo Sapiens
ANQPGEICN

SEQ ID NO: 15108 - protein, 9 aa, Homo Sapiens
KVTFPKLEP

SEQ ID NO: 15109 - protein, 9 aa, Homo Sapiens
NYSALRRRE

SEQ ID NO: 15110 - protein, 9 aa, Homo Sapiens
NNSPAGNIV

SEQ ID NO: 15111 - protein, 9 aa, Homo Sapiens
GLEPEISPL

SEQ ID NO: 15112 - protein, 9 aa, Homo Sapiens
LRHQQMADP

SEQ ID NO: 15113 - protein, 9 aa, Homo Sapiens
VLEFDNLPD

SEQ ID NO: 15114 - protein, 9 aa, Homo Sapiens
NQRPILTII

SEQ ID NO: 15115 - protein, 9 aa, Homo Sapiens
GGRGRRRCA

SEQ ID NO: 15116 - protein, 9 aa, Homo Sapiens
GELQLLFFV

SEQ ID NO: 15117 - protein, 9 aa, Homo Sapiens
KGNSSPSRD

SEQ ID NO: 15118 - protein, 9 aa, Homo Sapiens
PEICWLYIQ

SEQ ID NO: 15119 - protein, 9 aa, Homo Sapiens
ALLPRRRRC

SEQ ID NO: 15120 - protein, 9 aa, Homo Sapiens
KVPQKENLW

SEQ ID NO: 15121 - protein, 9 aa, Homo Sapiens
FAEHFFAGL

SEQ ID NO: 15122 - protein, 9 aa, Homo Sapiens
RASRAALER

SEQ ID NO: 15123 - protein, 9 aa, Homo Sapiens
LAEGELPEC

SEQ ID NO: 15124 - protein, 9 aa, Homo Sapiens
QVLGLTHTC

SEQ ID NO: 15125 - protein, 9 aa, Homo Sapiens
PSTALLLLL

SEQ ID NO: 15126 - protein, 9 aa, Homo Sapiens
GAAHLALAP

SEQ ID NO: 15127 - protein, 9 aa, Homo Sapiens
VECTQKNVK

SEQ ID NO: 15128 - protein, 9 aa, Homo Sapiens
ALHKVLQLP

SEQ ID NO: 15129 - protein, 9 aa, Homo Sapiens
PRHWELWCA

SEQ ID NO: 15130 - protein, 9 aa, Homo Sapiens
LGSRRGMAY

SEQ ID NO: 15131 - protein, 9 aa, Homo Sapiens
VRVQVFTKR

SEQ ID NO: 15132 - protein, 9 aa, Homo Sapiens
DKNSPEMCQ

SEQ ID NO: 15133 - protein, 9 aa, Homo Sapiens
KEITVTFNQ

SEQ ID NO: 15134 - protein, 9 aa, Homo Sapiens
GCDVCALLH

SEQ ID NO: 15135 - protein, 9 aa, Homo Sapiens
DECEPVEAI

SEQ ID NO: 15136 - protein, 9 aa, Homo Sapiens
EGQKSHRRH

SEQ ID NO: 15137 - protein, 9 aa, Homo Sapiens
HFPHENLRE

SEQ ID NO: 15138 - protein, 9 aa, Homo Sapiens
PNPNQCCQD

SEQ ID NO: 15139 - protein, 9 aa, Homo Sapiens
KVTDSRDGQ

SEQ ID NO: 15140 - protein, 9 aa, Homo Sapiens
QTPCTTGYV

SEQ ID NO: 15141 - protein, 9 aa, Homo Sapiens
AADRAWGLF

SEQ ID NO: 15142 - protein, 9 aa, Homo Sapiens
IIDNTDIQA

SEQ ID NO: 15143 - protein, 9 aa, Homo Sapiens
KRVLDWCSS

SEQ ID NO: 15144 - protein, 9 aa, Homo Sapiens
DSRDGQSRT

SEQ ID NO: 15145 - protein, 9 aa, Homo Sapiens
CKRYPHVKI

SEQ ID NO: 15146 - protein, 9 aa, Homo Sapiens
HPEICWLYI

SEQ ID NO: 15147 - protein, 9 aa, Homo Sapiens
PEEGQKSHR

SEQ ID NO: 15148 - protein, 9 aa, Homo Sapiens
VYKDTSLHS

SEQ ID NO: 15149 - protein, 9 aa, Homo Sapiens
QLPTCDAPL

SEQ ID NO: 15150 - protein, 9 aa, Homo Sapiens
PKLEPRDVA

SEQ ID NO: 15151 - protein, 9 aa, Homo Sapiens
GLGLIHGEV

SEQ ID NO: 15152 - protein, 9 aa, Homo Sapiens
CQDECAGGC

SEQ ID NO: 15153 - protein, 9 aa, Homo Sapiens
PYDSVKYTL

SEQ ID NO: 15154 - protein, 9 aa, Homo Sapiens
ACRSVAALL

SEQ ID NO: 15155 - protein, 9 aa, Homo Sapiens
AALLPRRRR

SEQ ID NO: 15156 - protein, 9 aa, Homo Sapiens
EPEISPLEV

SEQ ID NO: 15157 - protein, 9 aa, Homo Sapiens
PQGCPDKAR

SEQ ID NO: 15158 - protein, 9 aa, Homo Sapiens
KCRKIDTHP

SEQ ID NO: 15159 - protein, 9 aa, Homo Sapiens
RPLSFTPLP

SEQ ID NO: 15160 - protein, 9 aa, Homo Sapiens
IQTFFWSFY

SEQ ID NO: 15161 - protein, 9 aa, Homo Sapiens
EDLTPDHPV

SEQ ID NO: 15162 - protein, 9 aa, Homo Sapiens
GGGPTEHDK

SEQ ID NO: 15163 - protein, 9 aa, Homo Sapiens
EISPELQKP

SEQ ID NO: 15164 - protein, 9 aa, Homo Sapiens
GLIHGEVGP

SEQ ID NO: 15165 - protein, 9 aa, Homo Sapiens
CVPNSNERC

SEQ ID NO: 15166 - protein, 9 aa, Homo Sapiens
PYEGYESTA

SEQ ID NO: 15167 - protein, 9 aa, Homo Sapiens
PLGAGPDAD

SEQ ID NO: 15168 - protein, 9 aa, Homo Sapiens
VNNNIINGS

SEQ ID NO: 15169 - protein, 9 aa, Homo Sapiens
WRRPLSFTP

SEQ ID NO: 15170 - protein, 9 aa, Homo Sapiens
SPEEGQKSH

SEQ ID NO: 15171 - protein, 9 aa, Homo Sapiens
SFWMATVDV

SEQ ID NO: 15172 - protein, 9 aa, Homo Sapiens
CARWRRPLS

SEQ ID NO: 15173 - protein, 9 aa, Homo Sapiens
APDPSLRAA

SEQ ID NO: 15174 - protein, 9 aa, Homo Sapiens
SKAVPRATC

SEQ ID NO: 15175 - protein, 9 aa, Homo Sapiens
YKTLQVLVA

SEQ ID NO: 15176 - protein, 9 aa, Homo Sapiens
ACLPHPVKY

SEQ ID NO: 15177 - protein, 9 aa, Homo Sapiens
LLENGIPAN

SEQ ID NO: 15178 - protein, 9 aa, Homo Sapiens
DNGRLNILP

SEQ ID NO: 15179 - protein, 9 aa, Homo Sapiens
VEKSDVEME

SEQ ID NO: 15180 - protein, 9 aa, Homo Sapiens
HSEPSMRPF

SEQ ID NO: 15181 - protein, 9 aa, Homo Sapiens
VALTSRSHE

SEQ ID NO: 15182 - protein, 9 aa, Homo Sapiens
QSPVPLRIH

SEQ ID NO: 15183 - protein, 9 aa, Homo Sapiens
HYARWDRHD

SEQ ID NO: 15184 - protein, 9 aa, Homo Sapiens
EPVEAIAKF

SEQ ID NO: 15185 - protein, 9 aa, Homo Sapiens
RALGSRRGM

SEQ ID NO: 15186 - protein, 9 aa, Homo Sapiens
NYLPPVYNQ

SEQ ID NO: 15187 - protein, 9 aa, Homo Sapiens
LASLDVYVA

SEQ ID NO: 15188 - protein, 9 aa, Homo Sapiens
TKARAAKLD

SEQ ID NO: 15189 - protein, 9 aa, Homo Sapiens
SRWGIEDEE

SEQ ID NO: 15190 - protein, 9 aa, Homo Sapiens
KTDDKAFSL

SEQ ID NO: 15191 - protein, 9 aa, Homo Sapiens
FPHENLREW

SEQ ID NO: 15192 - protein, 9 aa, Homo Sapiens
LENGKVFLM

SEQ ID NO: 15193 - protein, 9 aa, Homo Sapiens
SLHFPHENL

SEQ ID NO: 15194 - protein, 9 aa, Homo Sapiens
LQKWLNRHS

SEQ ID NO: 15195 - protein, 9 aa, Homo Sapiens
LVSLQKWLN

SEQ ID NO: 15196 - protein, 9 aa, Homo Sapiens
RRMILSLPL

SEQ ID NO: 15197 - protein, 9 aa, Homo Sapiens
EVFAQSKDE

SEQ ID NO: 15198 - protein, 9 aa, Homo Sapiens
ERLTFNNPT

SEQ ID NO: 15199 - protein, 9 aa, Homo Sapiens
LNLYLVKEA

SEQ ID NO: 15200 - protein, 9 aa, Homo Sapiens
PLPPVPFLD

SEQ ID NO: 15201 - protein, 9 aa, Homo Sapiens
TSLIKPVGN

SEQ ID NO: 15202 - protein, 9 aa, Homo Sapiens
TDDKAFSLK

SEQ ID NO: 15203 - protein, 9 aa, Homo Sapiens
QTSLIKPVG

SEQ ID NO: 15204 - protein, 9 aa, Homo Sapiens
NERCYGYTG

SEQ ID NO: 15205 - protein, 9 aa, Homo Sapiens
AEGELPECA

SEQ ID NO: 15206 - protein, 9 aa, Homo Sapiens
SLASSSAWG

SEQ ID NO: 15207 - protein, 9 aa, Homo Sapiens
AFRYHCRLI

SEQ ID NO: 15208 - protein, 9 aa, Homo Sapiens
PVYNQRGQP

SEQ ID NO: 15209 - protein, 9 aa, Homo Sapiens
DSGNVNGKR

SEQ ID NO: 15210 - protein, 9 aa, Homo Sapiens
RSCKINRDC

SEQ ID NO: 15211 - protein, 9 aa, Homo Sapiens
PWTRPGWRP

SEQ ID NO: 15212 - protein, 9 aa, Homo Sapiens
GTGDSKKGN

SEQ ID NO: 15213 - protein, 9 aa, Homo Sapiens
SKLDSKAVP

SEQ ID NO: 15214 - protein, 9 aa, Homo Sapiens
AQSPVPVAV

SEQ ID NO: 15215 - protein, 9 aa, Homo Sapiens
SVAALLPRR

SEQ ID NO: 15216 - protein, 9 aa, Homo Sapiens
IKIFCYKGA

SEQ ID NO: 15217 - protein, 9 aa, Homo Sapiens
GKVFLMGGD

SEQ ID NO: 15218 - protein, 9 aa, Homo Sapiens
IEDEETSSG

SEQ ID NO: 15219 - protein, 9 aa, Homo Sapiens
QSTTKLNNV

SEQ ID NO: 15220 - protein, 9 aa, Homo Sapiens
ETPTGLRFS

SEQ ID NO: 15221 - protein, 9 aa, Homo Sapiens
PVPLRIHFC

SEQ ID NO: 15222 - protein, 9 aa, Homo Sapiens
LLLLLLIAA

SEQ ID NO: 15223 - protein, 9 aa, Homo Sapiens
PVAVLTGLG

SEQ ID NO: 15224 - protein, 9 aa, Homo Sapiens
VIWVNNNII

SEQ ID NO: 15225 - protein, 9 aa, Homo Sapiens
KSEEVRVQV

SEQ ID NO: 15226 - protein, 9 aa, Homo Sapiens
SIDSLKQIL

SEQ ID NO: 15227 - protein, 9 aa, Homo Sapiens
PPVPFLDCL

SEQ ID NO: 15228 - protein, 9 aa, Homo Sapiens
SYSFWMATV

SEQ ID NO: 15229 - protein, 9 aa, Homo Sapiens
APCCNGGVC

SEQ ID NO: 15230 - protein, 9 aa, Homo Sapiens
GRGRRRCAR

SEQ ID NO: 15231 - protein, 9 aa, Homo Sapiens
PVIIDNTDI

SEQ ID NO: 15232 - protein, 9 aa, Homo Sapiens
SAPCCNGGV

SEQ ID NO: 15233 - protein, 9 aa, Homo Sapiens
VIEEFYLND

SEQ ID NO: 15234 - protein, 9 aa, Homo Sapiens
AKLKGHYRT

SEQ ID NO: 15235 - protein, 9 aa, Homo Sapiens
VINTSKEMS

SEQ ID NO: 15236 - protein, 9 aa, Homo Sapiens
PRLVAVCPI

SEQ ID NO: 15237 - protein, 9 aa, Homo Sapiens
PHENLREWK

SEQ ID NO: 15238 - protein, 9 aa, Homo Sapiens
LSFTPLPLP

SEQ ID NO: 15239 - protein, 9 aa, Homo Sapiens
TSGIRSTLT

SEQ ID NO: 15240 - protein, 9 aa, Homo Sapiens
VCYEQGLID

SEQ ID NO: 15241 - protein, 9 aa, Homo Sapiens
MDDWLSAIK

SEQ ID NO: 15242 - protein, 9 aa, Homo Sapiens
TDIQAWEMK

SEQ ID NO: 15243 - protein, 9 aa, Homo Sapiens
RAAWSPQPW

SEQ ID NO: 15244 - protein, 9 aa, Homo Sapiens
DSLKQILNV

SEQ ID NO: 15245 - protein, 9 aa, Homo Sapiens
LSTTPADNS

SEQ ID NO: 15246 - protein, 9 aa, Homo Sapiens
FCYKGAERK

SEQ ID NO: 15247 - protein, 9 aa, Homo Sapiens
QISESDPRT

SEQ ID NO: 15248 - protein, 9 aa, Homo Sapiens
KLDPSGHVA

SEQ ID NO: 15249 - protein, 9 aa, Homo Sapiens
PPHVEKSDV

SEQ ID NO: 15250 - protein, 9 aa, Homo Sapiens
KWLNRHSWQ

SEQ ID NO: 15251 - protein, 9 aa, Homo Sapiens
DADMQRILE

SEQ ID NO: 15252 - protein, 9 aa, Homo Sapiens
EQKCRKIDT

SEQ ID NO: 15253 - protein, 9 aa, Homo Sapiens
ARWDRHDSV

SEQ ID NO: 15254 - protein, 9 aa, Homo Sapiens
ASTIPPHVE

SEQ ID NO: 15255 - protein, 9 aa, Homo Sapiens
RPRREMVSP

SEQ ID NO: 15256 - protein, 9 aa, Homo Sapiens
NPEIKVKGI

SEQ ID NO: 15257 - protein, 9 aa, Homo Sapiens
KQTVTTPPR

SEQ ID NO: 15258 - protein, 9 aa, Homo Sapiens
GNSSPSRDR

SEQ ID NO: 15259 - protein, 9 aa, Homo Sapiens
FFWSFYLGW

SEQ ID NO: 15260 - protein, 9 aa, Homo Sapiens
QELLAKITA

SEQ ID NO: 15261 - protein, 9 aa, Homo Sapiens
MAADRAWGL

SEQ ID NO: 15262 - protein, 9 aa, Homo Sapiens
FKHQRIVIT

SEQ ID NO: 15263 - protein, 9 aa, Homo Sapiens
EGYESTANP

SEQ ID NO: 15264 - protein, 9 aa, Homo Sapiens
CDAPLEGFA

SEQ ID NO: 15265 - protein, 9 aa, Homo Sapiens
TSDDECEPV

SEQ ID NO: 15266 - protein, 9 aa, Homo Sapiens
TVRKGYSTV

SEQ ID NO: 15267 - protein, 9 aa, Homo Sapiens
SLKQILNVA

SEQ ID NO: 15268 - protein, 9 aa, Homo Sapiens
KNVIKMLSK

SEQ ID NO: 15269 - protein, 9 aa, Homo Sapiens
HGLMAADRA

SEQ ID NO: 15270 - protein, 9 aa, Homo Sapiens
SVEALHKVL

SEQ ID NO: 15271 - protein, 9 aa, Homo Sapiens
GFLHWGGRK

SEQ ID NO: 15272 - protein, 9 aa, Homo Sapiens
GGSCRQTGD

SEQ ID NO: 15273 - protein, 9 aa, Homo Sapiens
NTFRQYRML

SEQ ID NO: 15274 - protein, 9 aa, Homo Sapiens
GAWTGHVNP

SEQ ID NO: 15275 - protein, 9 aa, Homo Sapiens
CYKGAERKM

SEQ ID NO: 15276 - protein, 9 aa, Homo Sapiens
GTQQKSVTV

SEQ ID NO: 15277 - protein, 9 aa, Homo Sapiens
MATVDVSDM

SEQ ID NO: 15278 - protein, 9 aa, Homo Sapiens
PGAGDLYKR

SEQ ID NO: 15279 - protein, 9 aa, Homo Sapiens
GMNQRPILT

SEQ ID NO: 15280 - protein, 9 aa, Homo Sapiens
SMRPFLLSL

SEQ ID NO: 15281 - protein, 9 aa, Homo Sapiens
ECEPVEAIA

SEQ ID NO: 15282 - protein, 9 aa, Homo Sapiens
GYSTVCSAV

SEQ ID NO: 15283 - protein, 9 aa, Homo Sapiens
ELLALGSLE

SEQ ID NO: 15284 - protein, 9 aa, Homo Sapiens
LQAGDEKEW

SEQ ID NO: 15285 - protein, 9 aa, Homo Sapiens
QKENLWLQC

SEQ ID NO: 15286 - protein, 9 aa, Homo Sapiens
ACVCYEQGL

SEQ ID NO: 15287 - protein, 9 aa, Homo Sapiens
SCRQTGDFT

SEQ ID NO: 15288 - protein, 9 aa, Homo Sapiens
QKPWAGRRR

SEQ ID NO: 15289 - protein, 9 aa, Homo Sapiens
VLLKVVPSS

SEQ ID NO: 15290 - protein, 9 aa, Homo Sapiens
PSRLPGPSE

SEQ ID NO: 15291 - protein, 9 aa, Homo Sapiens
MLGKGGFGE

SEQ ID NO: 15292 - protein, 9 aa, Homo Sapiens
LGTGNDMAR

SEQ ID NO: 15293 - protein, 9 aa, Homo Sapiens
WGIEDEETS

SEQ ID NO: 15294 - protein, 9 aa, Homo Sapiens
IQQTKNIIR

SEQ ID NO: 15295 - protein, 9 aa, Homo Sapiens
ITGYVATRW

SEQ ID NO: 15296 - protein, 9 aa, Homo Sapiens
TGNDMARTL

SEQ ID NO: 15297 - protein, 9 aa, Homo Sapiens
LSSDTSALP

SEQ ID NO: 15298 - protein, 9 aa, Homo Sapiens
SLVIQHLRI

SEQ ID NO: 15299 - protein, 9 aa, Homo Sapiens
TPTGLRFSP

SEQ ID NO: 15300 - protein, 9 aa, Homo Sapiens
VAALLPRRR

SEQ ID NO: 15301 - protein, 9 aa, Homo Sapiens
HDKSHSNSS

SEQ ID NO: 15302 - protein, 9 aa, Homo Sapiens
RWRRAFATS

SEQ ID NO: 15303 - protein, 9 aa, Homo Sapiens
RAAKLDPSG

SEQ ID NO: 15304 - protein, 9 aa, Homo Sapiens
RFQIQQTKN

SEQ ID NO: 15305 - protein, 9 aa, Homo Sapiens
EEPIHATPR

SEQ ID NO: 15306 - protein, 9 aa, Homo Sapiens
VFQGMLMAY

SEQ ID NO: 15307 - protein, 9 aa, Homo Sapiens
VAQLERLLI

SEQ ID NO: 15308 - protein, 9 aa, Homo Sapiens
EAASETPTG

SEQ ID NO: 15309 - protein, 9 aa, Homo Sapiens
NAWWLQVPG

SEQ ID NO: 15310 - protein, 9 aa, Homo Sapiens
KNTFRQYRM

SEQ ID NO: 15311 - protein, 9 aa, Homo Sapiens
KITAKLNYA

SEQ ID NO: 15312 - protein, 9 aa, Homo Sapiens
NNNIINGSQ

SEQ ID NO: 15313 - protein, 9 aa, Homo Sapiens
AAKLKGHYR

SEQ ID NO: 15314 - protein, 9 aa, Homo Sapiens
SCEDQYDDL

SEQ ID NO: 15315 - protein, 9 aa, Homo Sapiens
NSRKWCRCR

SEQ ID NO: 15316 - protein, 9 aa, Homo Sapiens
PGAVVVIHM

SEQ ID NO: 15317 - protein, 9 aa, Homo Sapiens
QTVTTPPRY

SEQ ID NO: 15318 - protein, 9 aa, Homo Sapiens
ELLAKITAK

SEQ ID NO: 15319 - protein, 9 aa, Homo Sapiens
DFHWILLSA

SEQ ID NO: 15320 - protein, 9 aa, Homo Sapiens
LFFVIFLLL

SEQ ID NO: 15321 - protein, 9 aa, Homo Sapiens
NPNQCCQDE

SEQ ID NO: 15322 - protein, 9 aa, Homo Sapiens
PPGIYIHRL

SEQ ID NO: 15323 - protein, 9 aa, Homo Sapiens
PTASSSPHT

SEQ ID NO: 15324 - protein, 9 aa, Homo Sapiens
LYLNLYLVK

SEQ ID NO: 15325 - protein, 9 aa, Homo Sapiens
LQRMTSGTP

SEQ ID NO: 15326 - protein, 9 aa, Homo Sapiens
IMELQRMTS

SEQ ID NO: 15327 - protein, 9 aa, Homo Sapiens
PGRNAWWLQ

SEQ ID NO: 15328 - protein, 9 aa, Homo Sapiens
RSKSLGRNL

SEQ ID NO: 15329 - protein, 9 aa, Homo Sapiens
QGCPDKARA

SEQ ID NO: 15330 - protein, 9 aa, Homo Sapiens
SEPSMRPFL

SEQ ID NO: 15331 - protein, 9 aa, Homo Sapiens
IFGVGAAHL

SEQ ID NO: 15332 - protein, 9 aa, Homo Sapiens
GQGSSEDHL

SEQ ID NO: 15333 - protein, 9 aa, Homo Sapiens
VGPLGVLVI

SEQ ID NO: 15334 - protein, 9 aa, Homo Sapiens
SAYFDLSRR

SEQ ID NO: 15335 - protein, 9 aa, Homo Sapiens
SQTTFLAEG

SEQ ID NO: 15336 - protein, 9 aa, Homo Sapiens
NKLTSERKV

SEQ ID NO: 15337 - protein, 9 aa, Homo Sapiens
PHPVKYFFF

SEQ ID NO: 15338 - protein, 9 aa, Homo Sapiens
PHTAGVMTP

SEQ ID NO: 15339 - protein, 9 aa, Homo Sapiens
AKITAKLNY

SEQ ID NO: 15340 - protein, 9 aa, Homo Sapiens
LWLIFFMLG

SEQ ID NO: 15341 - protein, 9 aa, Homo Sapiens
PREYRALGS

SEQ ID NO: 15342 - protein, 9 aa, Homo Sapiens
FRQYRMLGK

SEQ ID NO: 15343 - protein, 9 aa, Homo Sapiens
NIEEEDKLI

SEQ ID NO: 15344 - protein, 9 aa, Homo Sapiens
FGKLSINKL

SEQ ID NO: 15345 - protein, 9 aa, Homo Sapiens
VVMSAYFDL

SEQ ID NO: 15346 - protein, 9 aa, Homo Sapiens
KLLGPLQTP

SEQ ID NO: 15347 - protein, 9 aa, Homo Sapiens
AGSATATLQ

SEQ ID NO: 15348 - protein, 9 aa, Homo Sapiens
ADMQRILEL

SEQ ID NO: 15349 - protein, 9 aa, Homo Sapiens
RPFPTPSLA

SEQ ID NO: 15350 - protein, 9 aa, Homo Sapiens
ALPYDSVKY

SEQ ID NO: 15351 - protein, 9 aa, Homo Sapiens
GKRRNHTKR

SEQ ID NO: 15352 - protein, 9 aa, Homo Sapiens
LERWQERWR

SEQ ID NO: 15353 - protein, 9 aa, Homo Sapiens
VRKDNNAAL

SEQ ID NO: 15354 - protein, 9 aa, Homo Sapiens
LKGHYRTGK

SEQ ID NO: 15355 - protein, 9 aa, Homo Sapiens
LALRGTHEK

SEQ ID NO: 15356 - protein, 9 aa, Homo Sapiens
SPCVNGGSC

SEQ ID NO: 15357 - protein, 9 aa, Homo Sapiens
EIHPEICWL

SEQ ID NO: 15358 - protein, 9 aa, Homo Sapiens
LMGGDLPAL

SEQ ID NO: 15359 - protein, 9 aa, Homo Sapiens
PRTEVMKSL

SEQ ID NO: 15360 - protein, 9 aa, Homo Sapiens
ERWQERWRR

SEQ ID NO: 15361 - protein, 9 aa, Homo Sapiens
PEREQKCRK

SEQ ID NO: 15362 - protein, 9 aa, Homo Sapiens
PWHGLMAAD

SEQ ID NO: 15363 - protein, 9 aa, Homo Sapiens
CDVCALLHR

SEQ ID NO: 15364 - protein, 9 aa, Homo Sapiens
RRRCARWRR

SEQ ID NO: 15365 - protein, 9 aa, Homo Sapiens
KTESLTSGA

SEQ ID NO: 15366 - protein, 9 aa, Homo Sapiens
KVGTVLAIL

SEQ ID NO: 15367 - protein, 9 aa, Homo Sapiens
LLFFVIFLL

SEQ ID NO: 15368 - protein, 9 aa, Homo Sapiens
CCNGGVCRE

SEQ ID NO: 15369 - protein, 9 aa, Homo Sapiens
YPAKVEDQV

SEQ ID NO: 15370 - protein, 9 aa, Homo Sapiens
PANPTHLAH

SEQ ID NO: 15371 - protein, 9 aa, Homo Sapiens
PWSPTHSAQ

SEQ ID NO: 15372 - protein, 9 aa, Homo Sapiens
EAELRHQQM

SEQ ID NO: 15373 - protein, 9 aa, Homo Sapiens
WNYSALRRR

SEQ ID NO: 15374 - protein, 9 aa, Homo Sapiens
HGDNGRLNI

SEQ ID NO: 15375 - protein, 9 aa, Homo Sapiens
FAYPGAGDL

SEQ ID NO: 15376 - protein, 9 aa, Homo Sapiens
GTLADRERG

SEQ ID NO: 15377 - protein, 9 aa, Homo Sapiens
ADRERGPWS

SEQ ID NO: 15378 - protein, 9 aa, Homo Sapiens
PGELGTLAD

SEQ ID NO: 15379 - protein, 9 aa, Homo Sapiens
PKLLGPLQT

SEQ ID NO: 15380 - protein, 9 aa, Homo Sapiens
VEAIAKFDY

SEQ ID NO: 15381 - protein, 9 aa, Homo Sapiens
FHGGGFVAL

SEQ ID NO: 15382 - protein, 9 aa, Homo Sapiens
QVIWVNNNI

SEQ ID NO: 15383 - protein, 9 aa, Homo Sapiens
RLPGPSETP

SEQ ID NO: 15384 - protein, 9 aa, Homo Sapiens
FWSFYLGWV

SEQ ID NO: 15385 - protein, 9 aa, Homo Sapiens
PAGNIVTEH

SEQ ID NO: 15386 - protein, 9 aa, Homo Sapiens
LEHRVECTQ

SEQ ID NO: 15387 - protein, 9 aa, Homo Sapiens
LPGPSETPI

SEQ ID NO: 15388 - protein, 9 aa, Homo Sapiens
NSPAGNIVT

SEQ ID NO: 15389 - protein, 9 aa, Homo Sapiens
LRPLSYSDT

SEQ ID NO: 15390 - protein, 9 aa, Homo Sapiens
CCKICANQP

SEQ ID NO: 15391 - protein, 9 aa, Homo Sapiens
DKQTVTTPP

SEQ ID NO: 15392 - protein, 9 aa, Homo Sapiens
LGSVEALHK

SEQ ID NO: 15393 - protein, 9 aa, Homo Sapiens
SFSPGGLEP

SEQ ID NO: 15394 - protein, 9 aa, Homo Sapiens
APRVLEFDN

SEQ ID NO: 15395 - protein, 9 aa, Homo Sapiens
PCVNGGSCR

SEQ ID NO: 15396 - protein, 9 aa, Homo Sapiens
EEGQKSHRR

SEQ ID NO: 15397 - protein, 9 aa, Homo Sapiens
TRPGWRPRG

SEQ ID NO: 15398 - protein, 9 aa, Homo Sapiens
RVVLVAQSP

SEQ ID NO: 15399 - protein, 9 aa, Homo Sapiens
LPGTQQKSV

SEQ ID NO: 15400 - protein, 9 aa, Homo Sapiens
LDQSGLGPL

SEQ ID NO: 15401 - protein, 9 aa, Homo Sapiens
SRFQIQQTK

SEQ ID NO: 15402 - protein, 9 aa, Homo Sapiens
IHFCPVHRP

SEQ ID NO: 15403 - protein, 9 aa, Homo Sapiens
SPVIIDNTD

SEQ ID NO: 15404 - protein, 9 aa, Homo Sapiens
ITPTEVARN

SEQ ID NO: 15405 - protein, 9 aa, Homo Sapiens
EGCKVGRCT

SEQ ID NO: 15406 - protein, 9 aa, Homo Sapiens
ETTDDPQKL

SEQ ID NO: 15407 - protein, 9 aa, Homo Sapiens
GSQTTFLAE

SEQ ID NO: 15408 - protein, 9 aa, Homo Sapiens
SGSNYKTLQ

SEQ ID NO: 15409 - protein, 9 aa, Homo Sapiens
KNSLSKNVI

SEQ ID NO: 15410 - protein, 9 aa, Homo Sapiens
YKALWLIFF

SEQ ID NO: 15411 - protein, 9 aa, Homo Sapiens
RAVLTCFSA

SEQ ID NO: 15412 - protein, 9 aa, Homo Sapiens
LACVCYEQG

SEQ ID NO: 15413 - protein, 9 aa, Homo Sapiens
AASYRILYG

SEQ ID NO: 15414 - protein, 9 aa, Homo Sapiens
YNRDLDLAK

SEQ ID NO: 15415 - protein, 9 aa, Homo Sapiens
RNYLPPVYN

SEQ ID NO: 15416 - protein, 9 aa, Homo Sapiens
HLRCERLTF

SEQ ID NO: 15417 - protein, 9 aa, Homo Sapiens
NIINGSQVW

SEQ ID NO: 15418 - protein, 9 aa, Homo Sapiens
LLKELLALG

SEQ ID NO: 15419 - protein, 9 aa, Homo Sapiens
FGSQTPCTT

SEQ ID NO: 15420 - protein, 9 aa, Homo Sapiens
EHRVECTQK

SEQ ID NO: 15421 - protein, 9 aa, Homo Sapiens
LLLLIAAST

SEQ ID NO: 15422 - protein, 9 aa, Homo Sapiens
DLYKRGSVR

SEQ ID NO: 15423 - protein, 9 aa, Homo Sapiens
VHGNLACVC

SEQ ID NO: 15424 - protein, 9 aa, Homo Sapiens
WCRCRGIEE

SEQ ID NO: 15425 - protein, 9 aa, Homo Sapiens
LTSHDSRSQ

SEQ ID NO: 15426 - protein, 9 aa, Homo Sapiens
PSPCVNGGS

SEQ ID NO: 15427 - protein, 9 aa, Homo Sapiens
EALHKVLQL

SEQ ID NO: 15428 - protein, 9 aa, Homo Sapiens
PPGGRRWGC

SEQ ID NO: 15429 - protein, 9 aa, Homo Sapiens
NAATVRKGY

SEQ ID NO: 15430 - protein, 9 aa, Homo Sapiens
ICWLYIQLQ

SEQ ID NO: 15431 - protein, 9 aa, Homo Sapiens
PCCNGGVCR

SEQ ID NO: 15432 - protein, 9 aa, Homo Sapiens
RILYGVEQK

SEQ ID NO: 15433 - protein, 9 aa, Homo Sapiens
KVVPSSAAT

SEQ ID NO: 15434 - protein, 9 aa, Homo Sapiens
WPSPKNKSQ

SEQ ID NO: 15435 - protein, 9 aa, Homo Sapiens
FIGLKCLEH

SEQ ID NO: 15436 - protein, 9 aa, Homo Sapiens
CVNGGSCRQ

SEQ ID NO: 15437 - protein, 9 aa, Homo Sapiens
GGVNPEPLR

SEQ ID NO: 15438 - protein, 9 aa, Homo Sapiens
DSKAVPRAT

SEQ ID NO: 15439 - protein, 9 aa, Homo Sapiens
IDNTDIQAW

SEQ ID NO: 15440 - protein, 9 aa, Homo Sapiens
PDFPFPNDF

SEQ ID NO: 15441 - protein, 9 aa, Homo Sapiens
AVLTGLGLI

SEQ ID NO: 15442 - protein, 9 aa, Homo Sapiens
LDPHGDNGR

SEQ ID NO: 15443 - protein, 9 aa, Homo Sapiens
SIYQSVVIN

SEQ ID NO: 15444 - protein, 9 aa, Homo Sapiens
VVGVLLKVV

SEQ ID NO: 15445 - protein, 9 aa, Homo Sapiens
ILSTTPADN

SEQ ID NO: 15446 - protein, 9 aa, Homo Sapiens
GHYRTGKRL

SEQ ID NO: 15447 - protein, 9 aa, Homo Sapiens
ACMSNDFKS

SEQ ID NO: 15448 - protein, 9 aa, Homo Sapiens
QYRMLGKGG

SEQ ID NO: 15449 - protein, 9 aa, Homo Sapiens
IWVNNNIIN

SEQ ID NO: 15450 - protein, 9 aa, Homo Sapiens
ACPVQTPRL

SEQ ID NO: 15451 - protein, 9 aa, Homo Sapiens
ASETPTGLR

SEQ ID NO: 15452 - protein, 9 aa, Homo Sapiens
QPVRKDNNA

SEQ ID NO: 15453 - protein, 9 aa, Homo Sapiens
EFGSQTPCT

SEQ ID NO: 15454 - protein, 9 aa, Homo Sapiens
DRAWGLFTP

SEQ ID NO: 15455 - protein, 9 aa, Homo Sapiens
DHLQEEEQI

SEQ ID NO: 15456 - protein, 9 aa, Homo Sapiens
RIVITPTEV

SEQ ID NO: 15457 - protein, 9 aa, Homo Sapiens
NGKVFLMGG

SEQ ID NO: 15458 - protein, 9 aa, Homo Sapiens
AQSPVPLRI

SEQ ID NO: 15459 - protein, 9 aa, Homo Sapiens
ASYRILYGV

SEQ ID NO: 15460 - protein, 9 aa, Homo Sapiens
YIHRLAPGS

SEQ ID NO: 15461 - protein, 9 aa, Homo Sapiens
FPKLEPRDV

SEQ ID NO: 15462 - protein, 9 aa, Homo Sapiens
KNSPEMCQT

SEQ ID NO: 15463 - protein, 9 aa, Homo Sapiens
VSIDSLKQI

SEQ ID NO: 15464 - protein, 9 aa, Homo Sapiens
NISRSMLWW

SEQ ID NO: 15465 - protein, 9 aa, Homo Sapiens
WLYIQLQCC

SEQ ID NO: 15466 - protein, 9 aa, Homo Sapiens
VCELDQSGL

SEQ ID NO: 15467 - protein, 9 aa, Homo Sapiens
AFARSLLLI

SEQ ID NO: 15468 - protein, 9 aa, Homo Sapiens
GRRHEVESA

SEQ ID NO: 15469 - protein, 9 aa, Homo Sapiens
ELQLLFFVI

SEQ ID NO: 15470 - protein, 9 aa, Homo Sapiens
SSHVRRAVL

SEQ ID NO: 15471 - protein, 9 aa, Homo Sapiens
QILNVAVKE

SEQ ID NO: 15472 - protein, 9 aa, Homo Sapiens
LLPGTQQKS

SEQ ID NO: 15473 - protein, 9 aa, Homo Sapiens
IEEEDKLIE

SEQ ID NO: 15474 - protein, 9 aa, Homo Sapiens
PPQLPTCDA

SEQ ID NO: 15475 - protein, 9 aa, Homo Sapiens
YEVFAQSKD

SEQ ID NO: 15476 - protein, 9 aa, Homo Sapiens
AKLDPSGHV

SEQ ID NO: 15477 - protein, 9 aa, Homo Sapiens
QIKIFCYKG

SEQ ID NO: 15478 - protein, 9 aa, Homo Sapiens
NSLSKNVIK

SEQ ID NO: 15479 - protein, 9 aa, Homo Sapiens
PPPGKVPQK

SEQ ID NO: 15480 - protein, 9 aa, Homo Sapiens
PGLKPHTER

SEQ ID NO: 15481 - protein, 9 aa, Homo Sapiens
PSQPHRRMI

SEQ ID NO: 15482 - protein, 9 aa, Homo Sapiens
HFPSFLRTV

SEQ ID NO: 15483 - protein, 9 aa, Homo Sapiens
TLQVLVADL

SEQ ID NO: 15484 - protein, 9 aa, Homo Sapiens
VPGELGTLA

SEQ ID NO: 15485 - protein, 9 aa, Homo Sapiens
DFTAFTTMD

SEQ ID NO: 15486 - protein, 9 aa, Homo Sapiens
LPRRGLIIC

SEQ ID NO: 15487 - protein, 9 aa, Homo Sapiens
RGPWSPTHS

SEQ ID NO: 15488 - protein, 9 aa, Homo Sapiens
SGLGPLVAA

SEQ ID NO: 15489 - protein, 9 aa, Homo Sapiens
DQSGLGPLV

SEQ ID NO: 15490 - protein, 9 aa, Homo Sapiens
KARAAKLDP

SEQ ID NO: 15491 - protein, 9 aa, Homo Sapiens
EEITGYVAT

SEQ ID NO: 15492 - protein, 9 aa, Homo Sapiens
QLLRVVLVA

SEQ ID NO: 15493 - protein, 9 aa, Homo Sapiens
LHDFHWILL

SEQ ID NO: 15494 - protein, 9 aa, Homo Sapiens
CTRGLVRPV

SEQ ID NO: 15495 - protein, 9 aa, Homo Sapiens
HDSYVENEE

SEQ ID NO: 15496 - protein, 9 aa, Homo Sapiens
YLVKEAIDA

SEQ ID NO: 15497 - protein, 9 aa, Homo Sapiens
LADRERGPW

SEQ ID NO: 15498 - protein, 9 aa, Homo Sapiens
QDRYKALWL

SEQ ID NO: 15499 - protein, 9 aa, Homo Sapiens
ILNVAVKEK

SEQ ID NO: 15500 - protein, 9 aa, Homo Sapiens
TFPKLEPRD

SEQ ID NO: 15501 - protein, 9 aa, Homo Sapiens
VLTGLGLIH

SEQ ID NO: 15502 - protein, 9 aa, Homo Sapiens
VESAPEAAA

SEQ ID NO: 15503 - protein, 9 aa, Homo Sapiens
NQPGEICNE

SEQ ID NO: 15504 - protein, 9 aa, Homo Sapiens
SRAALERWQ

SEQ ID NO: 15505 - protein, 9 aa, Homo Sapiens
GGLEPEISP

SEQ ID NO: 15506 - protein, 9 aa, Homo Sapiens
DTSLHSPSN

SEQ ID NO: 15507 - protein, 9 aa, Homo Sapiens
NLACVCYEQ

SEQ ID NO: 15508 - protein, 9 aa, Homo Sapiens
EVGSESCED

SEQ ID NO: 15509 - protein, 9 aa, Homo Sapiens
WTGHVNPAF

SEQ ID NO: 15510 - protein, 9 aa, Homo Sapiens
LIENCNLTQ

SEQ ID NO: 15511 - protein, 9 aa, Homo Sapiens
DNNSPAGNI

SEQ ID NO: 15512 - protein, 9 aa, Homo Sapiens
LTCFSAGCC

SEQ ID NO: 15513 - protein, 9 aa, Homo Sapiens
VVVIHMSWC

SEQ ID NO: 15514 - protein, 9 aa, Homo Sapiens
LPPVYNQRG

SEQ ID NO: 15515 - protein, 9 aa, Homo Sapiens
EIKVKGIDP

SEQ ID NO: 15516 - protein, 9 aa, Homo Sapiens
LPYDSVKYT

SEQ ID NO: 15517 - protein, 9 aa, Homo Sapiens
PLPLPPVPF

SEQ ID NO: 15518 - protein, 9 aa, Homo Sapiens
FARSLLLIQ

SEQ ID NO: 15519 - protein, 9 aa, Homo Sapiens
PNDFPNFMH

SEQ ID NO: 15520 - protein, 9 aa, Homo Sapiens
GGGFVALTS

SEQ ID NO: 15521 - protein, 9 aa, Homo Sapiens
PSLRAAWSP

SEQ ID NO: 15522 - protein, 9 aa, Homo Sapiens
TQWAGLLLV

SEQ ID NO: 15523 - protein, 9 aa, Homo Sapiens
LVPDWQFDI

SEQ ID NO: 15524 - protein, 9 aa, Homo Sapiens
DPRTVFIAL

SEQ ID NO: 15525 - protein, 9 aa, Homo Sapiens
IYKESLALR

SEQ ID NO: 15526 - protein, 9 aa, Homo Sapiens
DRLRPLSYS

SEQ ID NO: 15527 - protein, 9 aa, Homo Sapiens
CLFLLKELL

SEQ ID NO: 15528 - protein, 9 aa, Homo Sapiens
RVECTQKNV

SEQ ID NO: 15529 - protein, 9 aa, Homo Sapiens
THTCETLKL

SEQ ID NO: 15530 - protein, 9 aa, Homo Sapiens
ASIAGSATA

SEQ ID NO: 15531 - protein, 9 aa, Homo Sapiens
PSETPILPQ

SEQ ID NO: 15532 - protein, 9 aa, Homo Sapiens
FQIQQTKNI

SEQ ID NO: 15533 - protein, 9 aa, Homo Sapiens
LDGGGPTEH

SEQ ID NO: 15534 - protein, 9 aa, Homo Sapiens
QVLVADLVS

SEQ ID NO: 15535 - protein, 9 aa, Homo Sapiens
SKAVSDADM

SEQ ID NO: 15536 - protein, 9 aa, Homo Sapiens
PVTVASTQS

SEQ ID NO: 15537 - protein, 9 aa, Homo Sapiens
HPQIQTFFW

SEQ ID NO: 15538 - protein, 9 aa, Homo Sapiens
SHDSRSQRA

SEQ ID NO: 15539 - protein, 9 aa, Homo Sapiens
TVSLEHILG

SEQ ID NO: 15540 - protein, 9 aa, Homo Sapiens
LQNAPDPSL

SEQ ID NO: 15541 - protein, 9 aa, Homo Sapiens
TESLTSGAT

SEQ ID NO: 15542 - protein, 9 aa, Homo Sapiens
LGTLADRER

SEQ ID NO: 15543 - protein, 9 aa, Homo Sapiens
GFVALTSRS

SEQ ID NO: 15544 - protein, 9 aa, Homo Sapiens
GPNPNQCCQ

SEQ ID NO: 15545 - protein, 9 aa, Homo Sapiens
GAGPDADAQ

SEQ ID NO: 15546 - protein, 9 aa, Homo Sapiens
DPSLRAAWS

SEQ ID NO: 15547 - protein, 9 aa, Homo Sapiens
NPEPLRATQ

SEQ ID NO: 15548 - protein, 9 aa, Homo Sapiens
PDPSLRAAW

SEQ ID NO: 15549 - protein, 9 aa, Homo Sapiens
GWRPRGRRR

SEQ ID NO: 15550 - protein, 9 aa, Homo Sapiens
GPLGVLVIF

SEQ ID NO: 15551 - protein, 9 aa, Homo Sapiens
RWKRVLDWC

SEQ ID NO: 15552 - protein, 9 aa, Homo Sapiens
HTCETLKLQ

SEQ ID NO: 15553 - protein, 9 aa, Homo Sapiens
RHDSVESGC

SEQ ID NO: 15554 - protein, 9 aa, Homo Sapiens
RRHEVESAP

SEQ ID NO: 15555 - protein, 9 aa, Homo Sapiens
TPRGWASLS

SEQ ID NO: 15556 - protein, 9 aa, Homo Sapiens
QPQDRYKAL

SEQ ID NO: 15557 - protein, 9 aa, Homo Sapiens
GSMEVLKVG

SEQ ID NO: 15558 - protein, 9 aa, Homo Sapiens
IPPHVEKSD

SEQ ID NO: 15559 - protein, 9 aa, Homo Sapiens
LSYSDTDVI

SEQ ID NO: 15560 - protein, 9 aa, Homo Sapiens
TPADNSTPV

SEQ ID NO: 15561 - protein, 9 aa, Homo Sapiens
MYSPKKQER

SEQ ID NO: 15562 - protein, 9 aa, Homo Sapiens
LQELLAKIT

SEQ ID NO: 15563 - protein, 9 aa, Homo Sapiens
DAQLRRLQL

SEQ ID NO: 15564 - protein, 9 aa, Homo Sapiens
EEEDKLIEE

SEQ ID NO: 15565 - protein, 9 aa, Homo Sapiens
ALRGTHEKD

SEQ ID NO: 15566 - protein, 9 aa, Homo Sapiens
GQKSHRRHS

SEQ ID NO: 15567 - protein, 9 aa, Homo Sapiens
ESAEPRHWE

SEQ ID NO: 15568 - protein, 9 aa, Homo Sapiens
LIAASTQWA

SEQ ID NO: 15569 - protein, 9 aa, Homo Sapiens
SLEHILGSL

SEQ ID NO: 15570 - protein, 9 aa, Homo Sapiens
TPCTTGYVF

SEQ ID NO: 15571 - protein, 9 aa, Homo Sapiens
RRGLIICSR

SEQ ID NO: 15572 - protein, 9 aa, Homo Sapiens
MLVPDWQFD

SEQ ID NO: 15573 - protein, 9 aa, Homo Sapiens
GVWNYSALR

SEQ ID NO: 15574 - protein, 9 aa, Homo Sapiens
IPANPTHLA

SEQ ID NO: 15575 - protein, 9 aa, Homo Sapiens
RWDRHDSVE

SEQ ID NO: 15576 - protein, 9 aa, Homo Sapiens
QNAPDPSLR

SEQ ID NO: 15577 - protein, 9 aa, Homo Sapiens
FQGMLMAYP

SEQ ID NO: 15578 - protein, 9 aa, Homo Sapiens
NDFPNFMHN

SEQ ID NO: 15579 - protein, 9 aa, Homo Sapiens
ELRHQQMAD

SEQ ID NO: 15580 - protein, 9 aa, Homo Sapiens
PSQRTPLTA

SEQ ID NO: 15581 - protein, 9 aa, Homo Sapiens
AYPAKVEDQ

SEQ ID NO: 15582 - protein, 9 aa, Homo Sapiens
FVVVGVLLK

SEQ ID NO: 15583 - protein, 9 aa, Homo Sapiens
YKHLKCKRY

SEQ ID NO: 15584 - protein, 9 aa, Homo Sapiens
KGHYRTGKR

SEQ ID NO: 15585 - protein, 9 aa, Homo Sapiens
HCRLIEHSR

SEQ ID NO: 15586 - protein, 9 aa, Homo Sapiens
RKDNNAALL

SEQ ID NO: 15587 - protein, 9 aa, Homo Sapiens
DGGGPTEHD

SEQ ID NO: 15588 - protein, 9 aa, Homo Sapiens
LPWCPRLVA

SEQ ID NO: 15589 - protein, 9 aa, Homo Sapiens
AQSGNPEIK

SEQ ID NO: 15590 - protein, 9 aa, Homo Sapiens
GCRLLPGTQ

SEQ ID NO: 15591 - protein, 9 aa, Homo Sapiens
RGLVRPVSA

SEQ ID NO: 15592 - protein, 9 aa, Homo Sapiens
AFEHLTNLS

SEQ ID NO: 15593 - protein, 9 aa, Homo Sapiens
FLAEGELPE

SEQ ID NO: 15594 - protein, 9 aa, Homo Sapiens
KLSINKLTS

SEQ ID NO: 15595 - protein, 9 aa, Homo Sapiens
LTPDHPVVL

SEQ ID NO: 15596 - protein, 9 aa, Homo Sapiens
CSPTRASRA

SEQ ID NO: 15597 - protein, 9 aa, Homo Sapiens
SAPEAAAAE

SEQ ID NO: 15598 - protein, 9 aa, Homo Sapiens
HPPSPAGAG

SEQ ID NO: 15599 - protein, 9 aa, Homo Sapiens
CMSNDFKSV

SEQ ID NO: 15600 - protein, 9 aa, Homo Sapiens
SGNPEIKVK

SEQ ID NO: 15601 - protein, 9 aa, Homo Sapiens
SNYKTLQVL

SEQ ID NO: 15602 - protein, 9 aa, Homo Sapiens
YRALGSRRG

SEQ ID NO: 15603 - protein, 9 aa, Homo Sapiens
TLYRHVMLE

SEQ ID NO: 15604 - protein, 9 aa, Homo Sapiens
WGGRKSVSV

SEQ ID NO: 15605 - protein, 9 aa, Homo Sapiens
TYMLVPDWQ

SEQ ID NO: 15606 - protein, 9 aa, Homo Sapiens
RVLDWCSSN

SEQ ID NO: 15607 - protein, 9 aa, Homo Sapiens
SPGGLEPEI

SEQ ID NO: 15608 - protein, 9 aa, Homo Sapiens
SLEGERLCK

SEQ ID NO: 15609 - protein, 9 aa, Homo Sapiens
CKICANQPG

SEQ ID NO: 15610 - protein, 9 aa, Homo Sapiens
LLSKLDSKA

SEQ ID NO: 15611 - protein, 9 aa, Homo Sapiens
TTPADNSTP

SEQ ID NO: 15612 - protein, 9 aa, Homo Sapiens
LLIAASTQW

SEQ ID NO: 15613 - protein, 9 aa, Homo Sapiens
PIHATPRGW

SEQ ID NO: 15614 - protein, 9 aa, Homo Sapiens
NLKNIEEED

SEQ ID NO: 15615 - protein, 9 aa, Homo Sapiens
PLGTGNDMA

SEQ ID NO: 15616 - protein, 9 aa, Homo Sapiens
CGKAFARSL

SEQ ID NO: 15617 - protein, 9 aa, Homo Sapiens
EEWPSPKNK

SEQ ID NO: 15618 - protein, 9 aa, Homo Sapiens
SQTPCTTGY

SEQ ID NO: 15619 - protein, 9 aa, Homo Sapiens
PVVSCRLEP

SEQ ID NO: 15620 - protein, 9 aa, Homo Sapiens
AVEDLTPDH

SEQ ID NO: 15621 - protein, 9 aa, Homo Sapiens
RLVAVCPIP

SEQ ID NO: 15622 - protein, 9 aa, Homo Sapiens
YARWDRHDS

SEQ ID NO: 15623 - protein, 9 aa, Homo Sapiens
RWQERWRRA

SEQ ID NO: 15624 - protein, 9 aa, Homo Sapiens
TAFTTMDDW

SEQ ID NO: 15625 - protein, 9 aa, Homo Sapiens
PSRWGIEDE

SEQ ID NO: 15626 - protein, 9 aa, Homo Sapiens
WQMPPALGP

SEQ ID NO: 15627 - protein, 9 aa, Homo Sapiens
TTSGIRSTL

SEQ ID NO: 15628 - protein, 9 aa, Homo Sapiens
PRLPPGGRR

SEQ ID NO: 15629 - protein, 9 aa, Homo Sapiens
VLGLTHTCE

SEQ ID NO: 15630 - protein, 9 aa, Homo Sapiens
GAVVVIHMS

SEQ ID NO: 15631 - protein, 9 aa, Homo Sapiens
ALGPLKGGD

SEQ ID NO: 15632 - protein, 9 aa, Homo Sapiens
RLPPGGRRW

SEQ ID NO: 15633 - protein, 9 aa, Homo Sapiens
GMLMAYPAK

SEQ ID NO: 15634 - protein, 9 aa, Homo Sapiens
YKDTSLHSP

SEQ ID NO: 15635 - protein, 9 aa, Homo Sapiens
CRCRGIEEH

SEQ ID NO: 15636 - protein, 9 aa, Homo Sapiens
PGQGSSEDH

SEQ ID NO: 15637 - protein, 9 aa, Homo Sapiens
PTRASRAAL

SEQ ID NO: 15638 - protein, 9 aa, Homo Sapiens
VGAAHLALA

SEQ ID NO: 15639 - protein, 9 aa, Homo Sapiens
VRKGYSTVC

SEQ ID NO: 15640 - protein, 9 aa, Homo Sapiens
GGFVALTSR

SEQ ID NO: 15641 - protein, 9 aa, Homo Sapiens
RPVTVASTQ

SEQ ID NO: 15642 - protein, 9 aa, Homo Sapiens
SESCEDQYD

SEQ ID NO: 15643 - protein, 9 aa, Homo Sapiens
QIQTFFWSF

SEQ ID NO: 15644 - protein, 9 aa, Homo Sapiens
LEFDNLPDP

SEQ ID NO: 15645 - protein, 9 aa, Homo Sapiens
NSNERCYGY

SEQ ID NO: 15646 - protein, 9 aa, Homo Sapiens
ILSDKIHFP

SEQ ID NO: 15647 - protein, 9 aa, Homo Sapiens
EMVSPPSPL

SEQ ID NO: 15648 - protein, 9 aa, Homo Sapiens
VNHLRCERL

SEQ ID NO: 15649 - protein, 9 aa, Homo Sapiens
PQKKTDDKA

SEQ ID NO: 15650 - protein, 9 aa, Homo Sapiens
PALRFIGLK

SEQ ID NO: 15651 - protein, 9 aa, Homo Sapiens
RSPRIPEPV

SEQ ID NO: 15652 - protein, 9 aa, Homo Sapiens
DTVIEEFYL

SEQ ID NO: 15653 - protein, 9 aa, Homo Sapiens
MPPPGKVPQ

SEQ ID NO: 15654 - protein, 9 aa, Homo Sapiens
VQLLRVVLV

SEQ ID NO: 15655 - protein, 9 aa, Homo Sapiens
WSPQPWTRP

SEQ ID NO: 15656 - protein, 9 aa, Homo Sapiens
ALCCVLLLC

SEQ ID NO: 15657 - protein, 9 aa, Homo Sapiens
TKNIIRSKT

SEQ ID NO: 15658 - protein, 9 aa, Homo Sapiens
ISPELQKPW

SEQ ID NO: 15659 - protein, 9 aa, Homo Sapiens
RRGGRGRRR

SEQ ID NO: 15660 - protein, 9 aa, Homo Sapiens
ICSRACSLG

SEQ ID NO: 15661 - protein, 9 aa, Homo Sapiens
DADAQLRRL

SEQ ID NO: 15662 - protein, 9 aa, Homo Sapiens
NHLRCERLT

SEQ ID NO: 15663 - protein, 9 aa, Homo Sapiens
FGVGAAHLA

SEQ ID NO: 15664 - protein, 9 aa, Homo Sapiens
NGIPANPTH

SEQ ID NO: 15665 - protein, 9 aa, Homo Sapiens
GTPRTEVMK

SEQ ID NO: 15666 - protein, 9 aa, Homo Sapiens
KKGNSSPSR

SEQ ID NO: 15667 - protein, 9 aa, Homo Sapiens
NPNYPDVKI

SEQ ID NO: 15668 - protein, 9 aa, Homo Sapiens
GRPFPTPSL

SEQ ID NO: 15669 - protein, 9 aa, Homo Sapiens
PDISRLRLE

SEQ ID NO: 15670 - protein, 9 aa, Homo Sapiens
VNPAFCNFP

SEQ ID NO: 15671 - protein, 9 aa, Homo Sapiens
VIACLPHPV

SEQ ID NO: 15672 - protein, 9 aa, Homo Sapiens
KPHTERMPP

SEQ ID NO: 15673 - protein, 9 aa, Homo Sapiens
IKPVGNISR

SEQ ID NO: 15674 - protein, 9 aa, Homo Sapiens
RKWCRCRGI

SEQ ID NO: 15675 - protein, 9 aa, Homo Sapiens
VGVLLKVVP

SEQ ID NO: 15676 - protein, 9 aa, Homo Sapiens
ISILSTTPA

SEQ ID NO: 15677 - protein, 9 aa, Homo Sapiens
SMDTQMYSP

SEQ ID NO: 15678 - protein, 9 aa, Homo Sapiens
KSLPQTSLI

SEQ ID NO: 15679 - protein, 9 aa, Homo Sapiens
KQILNVAVK

SEQ ID NO: 15680 - protein, 9 aa, Homo Sapiens
VPDWQFDIT

SEQ ID NO: 15681 - protein, 9 aa, Homo Sapiens
GNLACVCYE

SEQ ID NO: 15682 - protein, 9 aa, Homo Sapiens
LRVVLVAQS

SEQ ID NO: 15683 - protein, 9 aa, Homo Sapiens
RTPLTACPV

SEQ ID NO: 15684 - protein, 9 aa, Homo Sapiens
PCTTGYVFH

SEQ ID NO: 15685 - protein, 9 aa, Homo Sapiens
KLKGHYRTG

SEQ ID NO: 15686 - protein, 9 aa, Homo Sapiens
SPKNKSQSP

SEQ ID NO: 15687 - protein, 9 aa, Homo Sapiens
YKGAERKMR

SEQ ID NO: 15688 - protein, 9 aa, Homo Sapiens
IPPDISRLR

SEQ ID NO: 15689 - protein, 9 aa, Homo Sapiens
NQCCQDECA

SEQ ID NO: 15690 - protein, 9 aa, Homo Sapiens
VITPTEVAR

SEQ ID NO: 15691 - protein, 9 aa, Homo Sapiens
DRHDSVESG

SEQ ID NO: 15692 - protein, 9 aa, Homo Sapiens
TQVLGLTHT

SEQ ID NO: 15693 - protein, 9 aa, Homo Sapiens
LFLLKELLA

SEQ ID NO: 15694 - protein, 9 aa, Homo Sapiens
QKKTDDKAF

SEQ ID NO: 15695 - protein, 9 aa, Homo Sapiens
QAAKLKGHY

SEQ ID NO: 15696 - protein, 9 aa, Homo Sapiens
LPPGGRRWG

SEQ ID NO: 15697 - protein, 9 aa, Homo Sapiens
ESCEDQYDD

SEQ ID NO: 15698 - protein, 9 aa, Homo Sapiens
QTQVLGLTH

SEQ ID NO: 15699 - protein, 9 aa, Homo Sapiens
HATPRGWAS

SEQ ID NO: 15700 - protein, 9 aa, Homo Sapiens
SVVINTSKE

SEQ ID NO: 15701 - protein, 9 aa, Homo Sapiens
VLKVGTVLA

SEQ ID NO: 15702 - protein, 9 aa, Homo Sapiens
NAALLHSNK

SEQ ID NO: 15703 - protein, 9 aa, Homo Sapiens
LGLTHTCET

SEQ ID NO: 15704 - protein, 9 aa, Homo Sapiens
LMAYPAKVE

SEQ ID NO: 15705 - protein, 9 aa, Homo Sapiens
LTYMLVPDW

SEQ ID NO: 15706 - protein, 9 aa, Homo Sapiens
VLVAQSPVP

SEQ ID NO: 15707 - protein, 9 aa, Homo Sapiens
DAPLEGFAL

SEQ ID NO: 15708 - protein, 9 aa, Homo Sapiens
MLMAYPAKV

SEQ ID NO: 15709 - protein, 9 aa, Homo Sapiens
QKLKPGEID

SEQ ID NO: 15710 - protein, 9 aa, Homo Sapiens
TLTGKIPKL

SEQ ID NO: 15711 - protein, 9 aa, Homo Sapiens
LLRVVLVAQ

SEQ ID NO: 15712 - protein, 9 aa, Homo Sapiens
ENGKVFLMG

SEQ ID NO: 15713 - protein, 9 aa, Homo Sapiens
TCDAPLEGF

SEQ ID NO: 15714 - protein, 9 aa, Homo Sapiens
AWFVYKDTS

SEQ ID NO: 15715 - protein, 9 aa, Homo Sapiens
QSKDETTHD

SEQ ID NO: 15716 - protein, 9 aa, Homo Sapiens
QSVVINTSK

SEQ ID NO: 15717 - protein, 9 aa, Homo Sapiens
MQRILELEK

SEQ ID NO: 15718 - protein, 9 aa, Homo Sapiens
KAQSGNPEI

SEQ ID NO: 15719 - protein, 9 aa, Homo Sapiens
RPGWRPRGR

SEQ ID NO: 15720 - protein, 9 aa, Homo Sapiens
SLIEMLHDF

SEQ ID NO: 15721 - protein, 9 aa, Homo Sapiens
ANPTHLAHN

SEQ ID NO: 15722 - protein, 9 aa, Homo Sapiens
FFDEAELRH

SEQ ID NO: 15723 - protein, 9 aa, Homo Sapiens
PADNSTPVT

SEQ ID NO: 15724 - protein, 9 aa, Homo Sapiens
ESDPRTVFI

SEQ ID NO: 15725 - protein, 9 aa, Homo Sapiens
PRTVFIALT

SEQ ID NO: 15726 - protein, 9 aa, Homo Sapiens
TLADRERGP

SEQ ID NO: 15727 - protein, 9 aa, Homo Sapiens
FPFPNDFPN

SEQ ID NO: 15728 - protein, 9 aa, Homo Sapiens
SPTRASRAA

SEQ ID NO: 15729 - protein, 9 aa, Homo Sapiens
QKSHRRHSR

SEQ ID NO: 15730 - protein, 9 aa, Homo Sapiens
LIEMLHDFH

SEQ ID NO: 15731 - protein, 9 aa, Homo Sapiens
WCPRLVAVC

SEQ ID NO: 15732 - protein, 9 aa, Homo Sapiens
RYKALWLIF

SEQ ID NO: 15733 - protein, 9 aa, Homo Sapiens
HSRPRREMV

SEQ ID NO: 15734 - protein, 9 aa, Homo Sapiens
DPPQLPTCD

SEQ ID NO: 15735 - protein, 9 aa, Homo Sapiens
PHGDNGRLN

SEQ ID NO: 15736 - protein, 9 aa, Homo Sapiens
PWAGRRRGG

SEQ ID NO: 15737 - protein, 9 aa, Homo Sapiens
LLLLLLLIA

SEQ ID NO: 15738 - protein, 9 aa, Homo Sapiens
SPVPLRIHF

SEQ ID NO: 15739 - protein, 9 aa, Homo Sapiens
VSEEQTHPP

SEQ ID NO: 15740 - protein, 9 aa, Homo Sapiens
LDTAQRTLY

SEQ ID NO: 15741 - protein, 9 aa, Homo Sapiens
ISESDPRTV

SEQ ID NO: 15742 - protein, 9 aa, Homo Sapiens
QFFDEAELR

SEQ ID NO: 15743 - protein, 9 aa, Homo Sapiens
PVEAIAKFD

SEQ ID NO: 15744 - protein, 9 aa, Homo Sapiens
VRRAVLTCF

SEQ ID NO: 15745 - protein, 9 aa, Homo Sapiens
GPSETPILP

SEQ ID NO: 15746 - protein, 9 aa, Homo Sapiens
RKGYSTVCS

SEQ ID NO: 15747 - protein, 9 aa, Homo Sapiens
SGTPRTEVM

SEQ ID NO: 15748 - protein, 9 aa, Homo Sapiens
VEALHKVLQ

SEQ ID NO: 15749 - protein, 9 aa, Homo Sapiens
SEEVRVQVF

SEQ ID NO: 15750 - protein, 9 aa, Homo Sapiens
ALTSRSHEP

SEQ ID NO: 15751 - protein, 9 aa, Homo Sapiens
EETTDDPQK

SEQ ID NO: 15752 - protein, 9 aa, Homo Sapiens
SNTDKQTVT

SEQ ID NO: 15753 - protein, 9 aa, Homo Sapiens
ILYGVEQKG

SEQ ID NO: 15754 - protein, 9 aa, Homo Sapiens
GEIHPEICW

SEQ ID NO: 15755 - protein, 9 aa, Homo Sapiens
ANSYSFWMA

SEQ ID NO: 15756 - protein, 9 aa, Homo Sapiens
TVRWKRVLD

SEQ ID NO: 15757 - protein, 9 aa, Homo Sapiens
EPLRATQNV

SEQ ID NO: 15758 - protein, 9 aa, Homo Sapiens
KDTSLHSPS

SEQ ID NO: 15759 - protein, 9 aa, Homo Sapiens
YESTANPTV

SEQ ID NO: 15760 - protein, 9 aa, Homo Sapiens
DDECEPVEA

SEQ ID NO: 15761 - protein, 9 aa, Homo Sapiens
KLACMSNDF

SEQ ID NO: 15762 - protein, 9 aa, Homo Sapiens
LRCERLTFN

SEQ ID NO: 15763 - protein, 9 aa, Homo Sapiens
QLLFFVIFL

SEQ ID NO: 15764 - protein, 9 aa, Homo Sapiens
AWGLFTPAP

SEQ ID NO: 15765 - protein, 9 aa, Homo Sapiens
AASTQWAGL

SEQ ID NO: 15766 - protein, 9 aa, Homo Sapiens
ATTSGIRST

SEQ ID NO: 15767 - protein, 9 aa, Homo Sapiens
GLEVIVLTA

SEQ ID NO: 15768 - protein, 9 aa, Homo Sapiens
KESLALRGT

SEQ ID NO: 15769 - protein, 9 aa, Homo Sapiens
AYPGAGDLY

SEQ ID NO: 15770 - protein, 9 aa, Homo Sapiens
YHMWWGIIE

SEQ ID NO: 15771 - protein, 9 aa, Homo Sapiens
KRRNHTKRI

SEQ ID NO: 15772 - protein, 9 aa, Homo Sapiens
QKCRKIDTH

SEQ ID NO: 15773 - protein, 9 aa, Homo Sapiens
DQSTTKLNN

SEQ ID NO: 15774 - protein, 9 aa, Homo Sapiens
TLDQSTTKL

SEQ ID NO: 15775 - protein, 9 aa, Homo Sapiens
ASIPPDISR

SEQ ID NO: 15776 - protein, 9 aa, Homo Sapiens
NLYLVKEAI

SEQ ID NO: 15777 - protein, 9 aa, Homo Sapiens
PLEVGSESC

SEQ ID NO: 15778 - protein, 9 aa, Homo Sapiens
LAGKEITVT

SEQ ID NO: 15779 - protein, 9 aa, Homo Sapiens
LTGKIPKLL

SEQ ID NO: 15780 - protein, 9 aa, Homo Sapiens
PEMCQTCRT

SEQ ID NO: 15781 - protein, 9 aa, Homo Sapiens
ASATLGRSP

SEQ ID NO: 15782 - protein, 9 aa, Homo Sapiens
GTGNDMART

SEQ ID NO: 15783 - protein, 9 aa, Homo Sapiens
CSLHFPHEN

SEQ ID NO: 15784 - protein, 9 aa, Homo Sapiens
GLMAADRAW

SEQ ID NO: 15785 - protein, 9 aa, Homo Sapiens
PALGPLKGG

SEQ ID NO: 15786 - protein, 9 aa, Homo Sapiens
LGQLTYMLV

SEQ ID NO: 15787 - protein, 9 aa, Homo Sapiens
VSDADMQRI

SEQ ID NO: 15788 - protein, 9 aa, Homo Sapiens
YNQRGQPLT

SEQ ID NO: 15789 - protein, 9 aa, Homo Sapiens
LPPVPFLDC

SEQ ID NO: 15790 - protein, 9 aa, Homo Sapiens
IVNPPQKKT

SEQ ID NO: 15791 - protein, 9 aa, Homo Sapiens
GTSLTSHDS

SEQ ID NO: 15792 - protein, 9 aa, Homo Sapiens
KIHFPSFLR

SEQ ID NO: 15793 - protein, 9 aa, Homo Sapiens
LALAPSTAL

SEQ ID NO: 15794 - protein, 9 aa, Homo Sapiens
RALCCVLLL

SEQ ID NO: 15795 - protein, 9 aa, Homo Sapiens
PFLLSLAAL

SEQ ID NO: 15796 - protein, 9 aa, Homo Sapiens
MDAMKRALC

SEQ ID NO: 15797 - protein, 9 aa, Homo Sapiens
KTLQVLVAD

SEQ ID NO: 15798 - protein, 9 aa, Homo Sapiens
SEEQTHPPS

SEQ ID NO: 15799 - protein, 9 aa, Homo Sapiens
AGPDADAQL

SEQ ID NO: 15800 - protein, 9 aa, Homo Sapiens
ELSLEGERL

SEQ ID NO: 15801 - protein, 9 aa, Homo Sapiens
MVSPPSPLS

SEQ ID NO: 15802 - protein, 9 aa, Homo Sapiens
FPTPSLASL

SEQ ID NO: 15803 - protein, 9 aa, Homo Sapiens
PEPLRATQN

SEQ ID NO: 15804 - protein, 9 aa, Homo Sapiens
CCQDECAGG

SEQ ID NO: 15805 - protein, 9 aa, Homo Sapiens
GEVGPLGVL

SEQ ID NO: 15806 - protein, 9 aa, Homo Sapiens
SSSPHTAGV

SEQ ID NO: 15807 - protein, 9 aa, Homo Sapiens
RAWGLFTPA

SEQ ID NO: 15808 - protein, 9 aa, Homo Sapiens
HWGGRKSVS

SEQ ID NO: 15809 - protein, 9 aa, Homo Sapiens
VGNISRSML

SEQ ID NO: 15810 - protein, 9 aa, Homo Sapiens
ANPNYPDVK

SEQ ID NO: 15811 - protein, 9 aa, Homo Sapiens
GSNTDKQTV

SEQ ID NO: 15812 - protein, 9 aa, Homo Sapiens
RVLEFDNLP

SEQ ID NO: 15813 - protein, 9 aa, Homo Sapiens
CFPDFPFPN

SEQ ID NO: 15814 - protein, 9 aa, Homo Sapiens
TNLSYLYLA

SEQ ID NO: 15815 - protein, 9 aa, Homo Sapiens
MGCRLLPGT

SEQ ID NO: 15816 - protein, 9 aa, Homo Sapiens
ELGTLADRE

SEQ ID NO: 15817 - protein, 9 aa, Homo Sapiens
ALERWQERW

SEQ ID NO: 15818 - protein, 9 aa, Homo Sapiens
STLTPTVLA

SEQ ID NO: 15819 - protein, 9 aa, Homo Sapiens
VYNQRGQPL

SEQ ID NO: 15820 - protein, 9 aa, Homo Sapiens
PRGWASLSL

SEQ ID NO: 15821 - protein, 9 aa, Homo Sapiens
GRPQGCPDK

SEQ ID NO: 15822 - protein, 9 aa, Homo Sapiens
RLLSKLDSK

SEQ ID NO: 15823 - protein, 9 aa, Homo Sapiens
EHILGSLLT

SEQ ID NO: 15824 - protein, 9 aa, Homo Sapiens
MKSLPQTSL

SEQ ID NO: 15825 - protein, 9 aa, Homo Sapiens
KIPKLLGPL

SEQ ID NO: 15826 - protein, 9 aa, Homo Sapiens
KNIEEEDKL

SEQ ID NO: 15827 - protein, 9 aa, Homo Sapiens
TFGPSRWGI

SEQ ID NO: 15828 - protein, 9 aa, Homo Sapiens
WDRHDSVES

SEQ ID NO: 15829 - protein, 9 aa, Homo Sapiens
LSKLDSKAV

SEQ ID NO: 15830 - protein, 9 aa, Homo Sapiens
RYHCRLIEH

SEQ ID NO: 15831 - protein, 9 aa, Homo Sapiens
CLSCPGRNA

SEQ ID NO: 15832 - protein, 9 aa, Homo Sapiens
GSNYKTLQV

SEQ ID NO: 15833 - protein, 9 aa, Homo Sapiens
MPPALGPLK

SEQ ID NO: 15834 - protein, 9 aa, Homo Sapiens
RGTHEKDTE

SEQ ID NO: 15835 - protein, 9 aa, Homo Sapiens
YEGYESTAN

SEQ ID NO: 15836 - protein, 9 aa, Homo Sapiens
WLQVPGELG

SEQ ID NO: 15837 - protein, 9 aa, Homo Sapiens
HVRRAVLTC

SEQ ID NO: 15838 - protein, 9 aa, Homo Sapiens
KGYSTVCSA

SEQ ID NO: 15839 - protein, 9 aa, Homo Sapiens
QSPVPVAVL

SEQ ID NO: 15840 - protein, 9 aa, Homo Sapiens
PGTSLTSHD

SEQ ID NO: 15841 - protein, 9 aa, Homo Sapiens
LEVIVLTAM

SEQ ID NO: 15842 - protein, 9 aa, Homo Sapiens
PWCPRLVAV

SEQ ID NO: 15843 - protein, 9 aa, Homo Sapiens
PNQCCQDEC

SEQ ID NO: 15844 - protein, 9 aa, Homo Sapiens
LARQADEEI

SEQ ID NO: 15845 - protein, 9 aa, Homo Sapiens
GNVNGKRRN

SEQ ID NO: 15846 - protein, 9 aa, Homo Sapiens
QDECAGGCS

SEQ ID NO: 15847 - protein, 9 aa, Homo Sapiens
VFREKVTFP

SEQ ID NO: 15848 - protein, 9 aa, Homo Sapiens
RLTFNNPTT

SEQ ID NO: 15849 - protein, 9 aa, Homo Sapiens
EHDKSHSNS

SEQ ID NO: 15850 - protein, 9 aa, Homo Sapiens
DKARAETSQ

SEQ ID NO: 15851 - protein, 9 aa, Homo Sapiens
QRTPLTACP

SEQ ID NO: 15852 - protein, 9 aa, Homo Sapiens
EPEREQKCR

SEQ ID NO: 15853 - protein, 9 aa, Homo Sapiens
VFAQSKDET

SEQ ID NO: 15854 - protein, 9 aa, Homo Sapiens
YPDVKIMEL

SEQ ID NO: 15855 - protein, 9 aa, Homo Sapiens
KGEASGSSL

SEQ ID NO: 15856 - protein, 9 aa, Homo Sapiens
KNIIRSKTP

SEQ ID NO: 15857 - protein, 9 aa, Homo Sapiens
PQIQTFFWS

SEQ ID NO: 15858 - protein, 9 aa, Homo Sapiens
NGRLNILPY

SEQ ID NO: 15859 - protein, 9 aa, Homo Sapiens
RREMVSPPS

SEQ ID NO: 15860 - protein, 9 aa, Homo Sapiens
TYTKENGTG

SEQ ID NO: 15861 - protein, 9 aa, Homo Sapiens
CYGYTGAFR

SEQ ID NO: 15862 - protein, 9 aa, Homo Sapiens
YRMLGKGGF

SEQ ID NO: 15863 - protein, 9 aa, Homo Sapiens
APSTALLLL

SEQ ID NO: 15864 - protein, 9 aa, Homo Sapiens
AALERWQER

SEQ ID NO: 15865 - protein, 9 aa, Homo Sapiens
VQIAVEDLT

SEQ ID NO: 15866 - protein, 9 aa, Homo Sapiens
SDDECEPVE

SEQ ID NO: 15867 - protein, 9 aa, Homo Sapiens
ATLGRSPRI

SEQ ID NO: 15868 - protein, 9 aa, Homo Sapiens
INTSKEMSC

SEQ ID NO: 15869 - protein, 9 aa, Homo Sapiens
EMAFRYHCR

SEQ ID NO: 15870 - protein, 9 aa, Homo Sapiens
HLKCKRYPH

SEQ ID NO: 15871 - protein, 9 aa, Homo Sapiens
SCMGGMNQR

SEQ ID NO: 15872 - protein, 9 aa, Homo Sapiens
TQAAKLKGH

SEQ ID NO: 15873 - protein, 9 aa, Homo Sapiens
GWQMPPALG

SEQ ID NO: 15874 - protein, 9 aa, Homo Sapiens
AATVRKGYS

SEQ ID NO: 15875 - protein, 9 aa, Homo Sapiens
RPQGCPDKA

SEQ ID NO: 15876 - protein, 9 aa, Homo Sapiens
EVLKVGTVL

SEQ ID NO: 15877 - protein, 9 aa, Homo Sapiens
FLDCLSCPG

SEQ ID NO: 15878 - protein, 9 aa, Homo Sapiens
LGRNLICEG

SEQ ID NO: 15879 - protein, 9 aa, Homo Sapiens
GIYIHRLAP

SEQ ID NO: 15880 - protein, 9 aa, Homo Sapiens
RCTYGHVYK

SEQ ID NO: 15881 - protein, 9 aa, Homo Sapiens
ATATLQKEL

SEQ ID NO: 15882 - protein, 9 aa, Homo Sapiens
KPWAGRRRG

SEQ ID NO: 15883 - protein, 9 aa, Homo Sapiens
SPVVSCRLE

SEQ ID NO: 15884 - protein, 9 aa, Homo Sapiens
LELSLEGER

SEQ ID NO: 15885 - protein, 9 aa, Homo Sapiens
GLKPHTERM

SEQ ID NO: 15886 - protein, 9 aa, Homo Sapiens
KGTGDSKKG

SEQ ID NO: 15887 - protein, 9 aa, Homo Sapiens
LLKQEKSLA

SEQ ID NO: 15888 - protein, 9 aa, Homo Sapiens
VHRPPWHGL

SEQ ID NO: 15889 - protein, 9 aa, Homo Sapiens
IRCCTRGLV

SEQ ID NO: 15890 - protein, 9 aa, Homo Sapiens
FLEKRYHMW

SEQ ID NO: 15891 - protein, 9 aa, Homo Sapiens
VNGKRRNHT

SEQ ID NO: 15892 - protein, 9 aa, Homo Sapiens
PTPSLASLD

SEQ ID NO: 15893 - protein, 9 aa, Homo Sapiens
AHLALAPST

SEQ ID NO: 15894 - protein, 9 aa, Homo Sapiens
WLHDSYVEN

SEQ ID NO: 15895 - protein, 9 aa, Homo Sapiens
RSVAALLPR

SEQ ID NO: 15896 - protein, 9 aa, Homo Sapiens
ALRRREDET

SEQ ID NO: 15897 - protein, 9 aa, Homo Sapiens
IAGSATATL

SEQ ID NO: 15898 - protein, 9 aa, Homo Sapiens
TIPPHVEKS

SEQ ID NO: 15899 - protein, 9 aa, Homo Sapiens
WPSLASSSA

SEQ ID NO: 15900 - protein, 9 aa, Homo Sapiens
PNSNERCYG

SEQ ID NO: 15901 - protein, 9 aa, Homo Sapiens
HEVESAPEA

SEQ ID NO: 15902 - protein, 9 aa, Homo Sapiens
TTFLAEGEL

SEQ ID NO: 15903 - protein, 9 aa, Homo Sapiens
AGRRRGGRG

SEQ ID NO: 15904 - protein, 9 aa, Homo Sapiens
SDTSALPYD

SEQ ID NO: 15905 - protein, 9 aa, Homo Sapiens
PVGNISRSM

SEQ ID NO: 15906 - protein, 9 aa, Homo Sapiens
LDCLSCPGR

SEQ ID NO: 15907 - protein, 9 aa, Homo Sapiens
ASCLELSLE

SEQ ID NO: 15908 - protein, 9 aa, Homo Sapiens
TEHDKSHSN

SEQ ID NO: 15909 - protein, 9 aa, Homo Sapiens
CTTGYVFHG

SEQ ID NO: 15910 - protein, 9 aa, Homo Sapiens
WRRAFATSP

SEQ ID NO: 15911 - protein, 9 aa, Homo Sapiens
SLDPHGDNG

SEQ ID NO: 15912 - protein, 9 aa, Homo Sapiens
GELGTLADR

SEQ ID NO: 15913 - protein, 9 aa, Homo Sapiens
PEIKVKGID

SEQ ID NO: 15914 - protein, 9 aa, Homo Sapiens
GDLYKRGSV

SEQ ID NO: 15915 - protein, 9 aa, Homo Sapiens
GYSYNRDLD

SEQ ID NO: 15916 - protein, 9 aa, Homo Sapiens
MCQTCRTGC

SEQ ID NO: 15917 - protein, 9 aa, Homo Sapiens
VRWKRVLDW

SEQ ID NO: 15918 - protein, 9 aa, Homo Sapiens
HILGSLLTE

SEQ ID NO: 15919 - protein, 9 aa, Homo Sapiens
QTTFLAEGE

SEQ ID NO: 15920 - protein, 9 aa, Homo Sapiens
LLRLPALRF

SEQ ID NO: 15921 - protein, 9 aa, Homo Sapiens
GSVEALHKV

SEQ ID NO: 15922 - protein, 9 aa, Homo Sapiens
SFKHQRIVI

SEQ ID NO: 15923 - protein, 9 aa, Homo Sapiens
TPTASSSPH

SEQ ID NO: 15924 - protein, 9 aa, Homo Sapiens
PEAASETPT

SEQ ID NO: 15925 - protein, 9 aa, Homo Sapiens
EVTVRWKRV

SEQ ID NO: 15926 - protein, 9 aa, Homo Sapiens
MKELQKKTE

SEQ ID NO: 15927 - protein, 9 aa, Homo Sapiens
ALRFIGLKC

SEQ ID NO: 15928 - protein, 9 aa, Homo Sapiens
VWNYSALRR

SEQ ID NO: 15929 - protein, 9 aa, Homo Sapiens
EDHLQEEEQ

SEQ ID NO: 15930 - protein, 9 aa, Homo Sapiens
ELDQSGLGP

SEQ ID NO: 15931 - protein, 9 aa, Homo Sapiens
IFIYDEIRK

SEQ ID NO: 15932 - protein, 9 aa, Homo Sapiens
TPDHPVVLE

SEQ ID NO: 15933 - protein, 9 aa, Homo Sapiens
WQERWRRAF

SEQ ID NO: 15934 - protein, 9 aa, Homo Sapiens
CPDKARAET

SEQ ID NO: 15935 - protein, 9 aa, Homo Sapiens
HWELWCAVS

SEQ ID NO: 15936 - protein, 9 aa, Homo Sapiens
GVLLKVVPS

SEQ ID NO: 15937 - protein, 9 aa, Homo Sapiens
RGWASLSLL

SEQ ID NO: 15938 - protein, 9 aa, Homo Sapiens
SLTSHDSRS

SEQ ID NO: 15939 - protein, 9 aa, Homo Sapiens
KAVPRATCC

SEQ ID NO: 15940 - protein, 9 aa, Homo Sapiens
GVLVIFGVG

SEQ ID NO: 15941 - protein, 9 aa, Homo Sapiens
TGDSKKGNS

SEQ ID NO: 15942 - protein, 9 aa, Homo Sapiens
ERCYGYTGA

SEQ ID NO: 15943 - protein, 9 aa, Homo Sapiens
LIFIYDEIR

SEQ ID NO: 15944 - protein, 9 aa, Homo Sapiens
NLICEGTLE

SEQ ID NO: 15945 - protein, 9 aa, Homo Sapiens
SPHTAGVMT

SEQ ID NO: 15946 - protein, 9 aa, Homo Sapiens
IRKLILRRY

SEQ ID NO: 15947 - protein, 9 aa, Homo Sapiens
SPELQKPWA

SEQ ID NO: 15948 - protein, 9 aa, Homo Sapiens
IHATPRGWA

SEQ ID NO: 15949 - protein, 9 aa, Homo Sapiens
AWSPQPWTR

SEQ ID NO: 15950 - protein, 9 aa, Homo Sapiens
NTDIQAWEM

SEQ ID NO: 15951 - protein, 9 aa, Homo Sapiens
RMTSGTPRT

SEQ ID NO: 15952 - protein, 9 aa, Homo Sapiens
PGTQQKSVT

SEQ ID NO: 15953 - protein, 9 aa, Homo Sapiens
TQSEGKMPD

SEQ ID NO: 15954 - protein, 9 aa, Homo Sapiens
RRREDETRT

SEQ ID NO: 15955 - protein, 9 aa, Homo Sapiens
GRRRCARWR

SEQ ID NO: 15956 - protein, 9 aa, Homo Sapiens
MLHDFHWIL

SEQ ID NO: 15957 - protein, 9 aa, Homo Sapiens
GCWPSLASS

SEQ ID NO: 15958 - protein, 9 aa, Homo Sapiens
TFFWSFYLG

SEQ ID NO: 15959 - protein, 9 aa, Homo Sapiens
WMATVDVSD

SEQ ID NO: 15960 - protein, 9 aa, Homo Sapiens
PVHRPPWHG

SEQ ID NO: 15961 - protein, 9 aa, Homo Sapiens
VNGGSCRQT

SEQ ID NO: 15962 - protein, 9 aa, Homo Sapiens
DKLIEEQNE

SEQ ID NO: 15963 - protein, 9 aa, Homo Sapiens
RSTLTPTVL

SEQ ID NO: 15964 - protein, 9 aa, Homo Sapiens
AAKLDPSGH

SEQ ID NO: 15965 - protein, 9 aa, Homo Sapiens
PGPSETPIL

SEQ ID NO: 15966 - protein, 9 aa, Homo Sapiens
VSLQSKLAC

SEQ ID NO: 15967 - protein, 9 aa, Homo Sapiens
PPGLKPHTE

SEQ ID NO: 15968 - protein, 9 aa, Homo Sapiens
SRLPGPSET

SEQ ID NO: 15969 - protein, 9 aa, Homo Sapiens
YQSVVINTS

SEQ ID NO: 15970 - protein, 9 aa, Homo Sapiens
NRDCSFLDY

SEQ ID NO: 15971 - protein, 9 aa, Homo Sapiens
KNKSQSPDL

SEQ ID NO: 15972 - protein, 9 aa, Homo Sapiens
WTLAGKEIT

SEQ ID NO: 15973 - protein, 9 aa, Homo Sapiens
EASCLELSL

SEQ ID NO: 15974 - protein, 9 aa, Homo Sapiens
TSHDSRSQR

SEQ ID NO: 15975 - protein, 9 aa, Homo Sapiens
INRDCSFLD

SEQ ID NO: 15976 - protein, 9 aa, Homo Sapiens
PLSFTPLPL

SEQ ID NO: 15977 - protein, 9 aa, Homo Sapiens
RTEVMKSLP

SEQ ID NO: 15978 - protein, 9 aa, Homo Sapiens
LAPSTALLL

SEQ ID NO: 15979 - protein, 9 aa, Homo Sapiens
PSPKNKSQS

SEQ ID NO: 15980 - protein, 9 aa, Homo Sapiens
KDAASYRIL

SEQ ID NO: 15981 - protein, 9 aa, Homo Sapiens
PPEAASETP

SEQ ID NO: 15982 - protein, 9 aa, Homo Sapiens
LHWGGRKSV

SEQ ID NO: 15983 - protein, 9 aa, Homo Sapiens
TPLPWCPRL

SEQ ID NO: 15984 - protein, 9 aa, Homo Sapiens
PTVIACLPH

SEQ ID NO: 15985 - protein, 9 aa, Homo Sapiens
EASGSSLQA

SEQ ID NO: 15986 - protein, 9 aa, Homo Sapiens
LRATQNVFT

SEQ ID NO: 15987 - protein, 9 aa, Homo Sapiens
STGYKPPNC

SEQ ID NO: 15988 - protein, 9 aa, Homo Sapiens
LQKPWAGRR

SEQ ID NO: 15989 - protein, 9 aa, Homo Sapiens
ILSLPLINR

SEQ ID NO: 15990 - protein, 9 aa, Homo Sapiens
AMKRALCCV

SEQ ID NO: 15991 - protein, 9 aa, Homo Sapiens
KPVGNISRS

SEQ ID NO: 15992 - protein, 9 aa, Homo Sapiens
QVPGELGTL

SEQ ID NO: 15993 - protein, 9 aa, Homo Sapiens
EVRVQVFTK

SEQ ID NO: 15994 - protein, 9 aa, Homo Sapiens
ADEEITGYV

SEQ ID NO: 15995 - protein, 9 aa, Homo Sapiens
ADAQLRRLQ

SEQ ID NO: 15996 - protein, 9 aa, Homo Sapiens
PQKENLWLQ

SEQ ID NO: 15997 - protein, 9 aa, Homo Sapiens
STQWAGLLL

SEQ ID NO: 15998 - protein, 9 aa, Homo Sapiens
KDNNAALLH

SEQ ID NO: 15999 - protein, 9 aa, Homo Sapiens
KVFLMGGDL

SEQ ID NO: 16000 - protein, 9 aa, Homo Sapiens
VNPEPLRAT

SEQ ID NO: 16001 - protein, 9 aa, Homo Sapiens
SSLQAGDEK

SEQ ID NO: 16002 - protein, 9 aa, Homo Sapiens
SKNVIKMLS

SEQ ID NO: 16003 - protein, 9 aa, Homo Sapiens
CTYGHVYKA

SEQ ID NO: 16004 - protein, 9 aa, Homo Sapiens
LTHTCETLK

SEQ ID NO: 16005 - protein, 9 aa, Homo Sapiens
DLQELLAKI

SEQ ID NO: 16006 - protein, 9 aa, Homo Sapiens
SFTPLPLPP

SEQ ID NO: 16007 - protein, 9 aa, Homo Sapiens
PLSYSDTDV

SEQ ID NO: 16008 - protein, 9 aa, Homo Sapiens
RAALERWQE

SEQ ID NO: 16009 - protein, 9 aa, Homo Sapiens
DAMKRALCC

SEQ ID NO: 16010 - protein, 9 aa, Homo Sapiens
PDVKIMELQ

SEQ ID NO: 16011 - protein, 9 aa, Homo Sapiens
AGLEVIVLT

SEQ ID NO: 16012 - protein, 9 aa, Homo Sapiens
KELQKKTES

SEQ ID NO: 16013 - protein, 9 aa, Homo Sapiens
VCQIKIFCY

SEQ ID NO: 16014 - protein, 9 aa, Homo Sapiens
KQEKSLAGW

SEQ ID NO: 16015 - protein, 9 aa, Homo Sapiens
DISRLRLER

SEQ ID NO: 16016 - protein, 9 aa, Homo Sapiens
WGLFTPAPT

SEQ ID NO: 16017 - protein, 9 aa, Homo Sapiens
LLAKITAKL

SEQ ID NO: 16018 - protein, 9 aa, Homo Sapiens
SAWGWPCSP

SEQ ID NO: 16019 - protein, 9 aa, Homo Sapiens
RYHMWWGII

SEQ ID NO: 16020 - protein, 9 aa, Homo Sapiens
QSGLGPLVA

SEQ ID NO: 16021 - protein, 9 aa, Homo Sapiens
GYESTANPT

SEQ ID NO: 16022 - protein, 9 aa, Homo Sapiens
GLVRPVSAS

SEQ ID NO: 16023 - protein, 9 aa, Homo Sapiens
KHLKCKRYP

SEQ ID NO: 16024 - protein, 9 aa, Homo Sapiens
QIAVEDLTP

SEQ ID NO: 16025 - protein, 9 aa, Homo Sapiens
LKVVPSSAA

SEQ ID NO: 16026 - protein, 9 aa, Homo Sapiens
TVASTQSEG

SEQ ID NO: 16027 - protein, 9 aa, Homo Sapiens
RIHFCPVHR

SEQ ID NO: 16028 - protein, 9 aa, Homo Sapiens
NTDKQTVTT

SEQ ID NO: 16029 - protein, 9 aa, Homo Sapiens
PHRRMILSL

SEQ ID NO: 16030 - protein, 9 aa, Homo Sapiens
EMCQTCRTG

SEQ ID NO: 16031 - protein, 9 aa, Homo Sapiens
ASSMDTQMY

SEQ ID NO: 16032 - protein, 9 aa, Homo Sapiens
TGHVNPAFC

SEQ ID NO: 16033 - protein, 9 aa, Homo Sapiens
KLTSERKVS

SEQ ID NO: 16034 - protein, 9 aa, Homo Sapiens
SDTDVILMC

SEQ ID NO: 16035 - protein, 9 aa, Homo Sapiens
VPLRIHFCP

SEQ ID NO: 16036 - protein, 9 aa, Homo Sapiens
YPHVKIEGK

SEQ ID NO: 16037 - protein, 9 aa, Homo Sapiens
RVSLVIQHL

SEQ ID NO: 16038 - protein, 9 aa, Homo Sapiens
WGCWPSLAS

SEQ ID NO: 16039 - protein, 9 aa, Homo Sapiens
GSCRQTGDF

SEQ ID NO: 16040 - protein, 9 aa, Homo Sapiens
SYLYLANNK

SEQ ID NO: 16041 - protein, 9 aa, Homo Sapiens
LQKKTESLT

SEQ ID NO: 16042 - protein, 9 aa, Homo Sapiens
ASTQWAGLL

SEQ ID NO: 16043 - protein, 9 aa, Homo Sapiens
WGWPCSPTR

SEQ ID NO: 16044 - protein, 9 aa, Homo Sapiens
LEFGSQTPC

SEQ ID NO: 16045 - protein, 9 aa, Homo Sapiens
SLIKPVGNI

SEQ ID NO: 16046 - protein, 9 aa, Homo Sapiens
HKVLQLPAA

SEQ ID NO: 16047 - protein, 9 aa, Homo Sapiens
RRCARWRRP

SEQ ID NO: 16048 - protein, 9 aa, Homo Sapiens
QRPILTIIT

SEQ ID NO: 16049 - protein, 9 aa, Homo Sapiens
LREFKVTDS

SEQ ID NO: 16050 - protein, 9 aa, Homo Sapiens
CSTGYKPPN

SEQ ID NO: 16051 - protein, 9 aa, Homo Sapiens
RWWTLAGKE

SEQ ID NO: 16052 - protein, 9 aa, Homo Sapiens
GRRWGCWPS

SEQ ID NO: 16053 - protein, 9 aa, Homo Sapiens
RGLIICSRA

SEQ ID NO: 16054 - protein, 9 aa, Homo Sapiens
GKLSINKLT

SEQ ID NO: 16055 - protein, 9 aa, Homo Sapiens
CEPVEAIAK

SEQ ID NO: 16056 - protein, 9 aa, Homo Sapiens
LMAADRAWG

SEQ ID NO: 16057 - protein, 9 aa, Homo Sapiens
QKKTESLTS

SEQ ID NO: 16058 - protein, 9 aa, Homo Sapiens
SSPHTAGVM

SEQ ID NO: 16059 - protein, 9 aa, Homo Sapiens
CHCSTGYKP

SEQ ID NO: 16060 - protein, 9 aa, Homo Sapiens
ERWRRAFAT

SEQ ID NO: 16061 - protein, 9 aa, Homo Sapiens
SLALRGTHE

SEQ ID NO: 16062 - protein, 9 aa, Homo Sapiens
LTPRLPPGG

SEQ ID NO: 16063 - protein, 9 aa, Homo Sapiens
MRPFLLSLA

SEQ ID NO: 16064 - protein, 9 aa, Homo Sapiens
VSLEHILGS

SEQ ID NO: 16065 - protein, 9 aa, Homo Sapiens
IDSLKQILN

SEQ ID NO: 16066 - protein, 9 aa, Homo Sapiens
LSLTPRLPP

SEQ ID NO: 16067 - protein, 9 aa, Homo Sapiens
KELLALGSL

SEQ ID NO: 16068 - protein, 9 aa, Homo Sapiens
SYVENEEYA

SEQ ID NO: 16069 - protein, 9 aa, Homo Sapiens
TVTTPPRYP

SEQ ID NO: 16070 - protein, 9 aa, Homo Sapiens
IAASTQWAG

SEQ ID NO: 16071 - protein, 9 aa, Homo Sapiens
PVPVAVLTG

SEQ ID NO: 16072 - protein, 9 aa, Homo Sapiens
PASIPPDIS

SEQ ID NO: 16073 - protein, 9 aa, Homo Sapiens
TDDPQKLKP

SEQ ID NO: 16074 - protein, 9 aa, Homo Sapiens
CLELSLEGE

SEQ ID NO: 16075 - protein, 9 aa, Homo Sapiens
DVKIMELQR

SEQ ID NO: 16076 - protein, 9 aa, Homo Sapiens
PPVYNQRGQ

SEQ ID NO: 16077 - protein, 9 aa, Homo Sapiens
IHPEICWLY

SEQ ID NO: 16078 - protein, 9 aa, Homo Sapiens
NNAALLHSN

SEQ ID NO: 16079 - protein, 9 aa, Homo Sapiens
SLSKNVIKM

SEQ ID NO: 16080 - protein, 9 aa, Homo Sapiens
VTVASTQSE

SEQ ID NO: 16081 - protein, 9 aa, Homo Sapiens
QMYSPKKQE

SEQ ID NO: 16082 - protein, 9 aa, Homo Sapiens
HDSVESGCQ

SEQ ID NO: 16083 - protein, 9 aa, Homo Sapiens
GSSEDHLQE

SEQ ID NO: 16084 - protein, 9 aa, Homo Sapiens
SQPHRRMIL

SEQ ID NO: 16085 - protein, 9 aa, Homo Sapiens
SPEMCQTCR

SEQ ID NO: 16086 - protein, 9 aa, Homo Sapiens
MARTLNWGG

SEQ ID NO: 16087 - protein, 9 aa, Homo Sapiens
SPGAVVVIH

SEQ ID NO: 16088 - protein, 9 aa, Homo Sapiens
LIHGEVGPL

SEQ ID NO: 16089 - protein, 9 aa, Homo Sapiens
NDMARTLNW

SEQ ID NO: 16090 - protein, 9 aa, Homo Sapiens
VNPPQKKTD

SEQ ID NO: 16091 - protein, 9 aa, Homo Sapiens
NLPDPQEGP

SEQ ID NO: 16092 - protein, 9 aa, Homo Sapiens
QPWTRPGWR

SEQ ID NO: 16093 - protein, 9 aa, Homo Sapiens
YPPREYRAL

SEQ ID NO: 16094 - protein, 9 aa, Homo Sapiens
ENLREWKLF

SEQ ID NO: 16095 - protein, 9 aa, Homo Sapiens
SIPPDISRL

SEQ ID NO: 16096 - protein, 9 aa, Homo Sapiens
CVCYEQGLI

SEQ ID NO: 16097 - protein, 9 aa, Homo Sapiens
RNLICEGTL

SEQ ID NO: 16098 - protein, 9 aa, Homo Sapiens
SDKIHFPSF

SEQ ID NO: 16099 - protein, 9 aa, Homo Sapiens
CPRLVAVCP

SEQ ID NO: 16100 - protein, 9 aa, Homo Sapiens
EDKLIEEQN

SEQ ID NO: 16101 - protein, 9 aa, Homo Sapiens
TPLPLPPVP

SEQ ID NO: 16102 - protein, 9 aa, Homo Sapiens
FVALTSRSH

SEQ ID NO: 16103 - protein, 9 aa, Homo Sapiens
SLLSLTPRL

SEQ ID NO: 16104 - protein, 9 aa, Homo Sapiens
CSFLDYILG

SEQ ID NO: 16105 - protein, 9 aa, Homo Sapiens
TSGTPRTEV

SEQ ID NO: 16106 - protein, 9 aa, Homo Sapiens
IHRLAPGSV

SEQ ID NO: 16107 - protein, 9 aa, Homo Sapiens
GHSEPSMRP

SEQ ID NO: 16108 - protein, 9 aa, Homo Sapiens
AELRHQQMA

SEQ ID NO: 16109 - protein, 9 aa, Homo Sapiens
CKINRDCSF

SEQ ID NO: 16110 - protein, 9 aa, Homo Sapiens
EREQKCRKI

SEQ ID NO: 16111 - protein, 9 aa, Homo Sapiens
SINKLTSER

SEQ ID NO: 16112 - protein, 9 aa, Homo Sapiens
KICANQPGE

SEQ ID NO: 16113 - protein, 9 aa, Homo Sapiens
LRAAWSPQP

SEQ ID NO: 16114 - protein, 9 aa, Homo Sapiens
LSLLSLTPR

SEQ ID NO: 16115 - protein, 9 aa, Homo Sapiens
SELEHRVEC

SEQ ID NO: 16116 - protein, 9 aa, Homo Sapiens
LKQEKSLAG

SEQ ID NO: 16117 - protein, 9 aa, Homo Sapiens
LGLIHGEVG

SEQ ID NO: 16118 - protein, 9 aa, Homo Sapiens
KTQISESDP

SEQ ID NO: 16119 - protein, 9 aa, Homo Sapiens
STTPADNST

SEQ ID NO: 16120 - protein, 9 aa, Homo Sapiens
QCCQDECAG

SEQ ID NO: 16121 - protein, 9 aa, Homo Sapiens
SLQSKLACM

SEQ ID NO: 16122 - protein, 9 aa, Homo Sapiens
PHYARWDRH

SEQ ID NO: 16123 - protein, 9 aa, Homo Sapiens
QTFFWSFYL

SEQ ID NO: 16124 - protein, 9 aa, Homo Sapiens
LRRRKRLLK

SEQ ID NO: 16125 - protein, 9 aa, Homo Sapiens
ENGIPANPT

SEQ ID NO: 16126 - protein, 9 aa, Homo Sapiens
PASATLGRS

SEQ ID NO: 16127 - protein, 9 aa, Homo Sapiens
RGRRHEVES

SEQ ID NO: 16128 - protein, 9 aa, Homo Sapiens
SNERCYGYT

SEQ ID NO: 16129 - protein, 9 aa, Homo Sapiens
AEILSDKIH

SEQ ID NO: 16130 - protein, 9 aa, Homo Sapiens
LGAGPDADA

SEQ ID NO: 16131 - protein, 9 aa, Homo Sapiens
LRFIGLKCL

SEQ ID NO: 16132 - protein, 9 aa, Homo Sapiens
PGWRPRGRR

SEQ ID NO: 16133 - protein, 9 aa, Homo Sapiens
LQKSEEVRV

SEQ ID NO: 16134 - protein, 9 aa, Homo Sapiens
LGYSYNRDL

SEQ ID NO: 16135 - protein, 9 aa, Homo Sapiens
ASSSAWGWP

SEQ ID NO: 16136 - protein, 9 aa, Homo Sapiens
WWTLAGKEI

SEQ ID NO: 16137 - protein, 9 aa, Homo Sapiens
SGIRSTLTP

SEQ ID NO: 16138 - protein, 9 aa, Homo Sapiens
DRYKALWLI

SEQ ID NO: 16139 - protein, 9 aa, Homo Sapiens
GPTEHDKSH

SEQ ID NO: 16140 - protein, 9 aa, Homo Sapiens
CRLLPGTQQ

SEQ ID NO: 16141 - protein, 9 aa, Homo Sapiens
DRERGPWSP

SEQ ID NO: 16142 - protein, 9 aa, Homo Sapiens
GSLLTEQSL

SEQ ID NO: 16143 - protein, 9 aa, Homo Sapiens
AVLTCFSAG

SEQ ID NO: 16144 - protein, 9 aa, Homo Sapiens
WHGLMAADR

SEQ ID NO: 16145 - protein, 9 aa, Homo Sapiens
FWMATVDVS

SEQ ID NO: 16146 - protein, 9 aa, Homo Sapiens
SQRTPLTAC

SEQ ID NO: 16147 - protein, 9 aa, Homo Sapiens
LGSLLTEQS

SEQ ID NO: 16148 - protein, 9 aa, Homo Sapiens
EEVRVQVFT

SEQ ID NO: 16149 - protein, 9 aa, Homo Sapiens
YVGPYEGYE

SEQ ID NO: 16150 - protein, 9 aa, Homo Sapiens
DEAELRHQQ

SEQ ID NO: 16151 - protein, 9 aa, Homo Sapiens
HQRIVITPT

SEQ ID NO: 16152 - protein, 9 aa, Homo Sapiens
ASIYQSVVI

SEQ ID NO: 16153 - protein, 9 aa, Homo Sapiens
DSKKGNSSP

SEQ ID NO: 16154 - protein, 9 aa, Homo Sapiens
LLSLTPRLP

SEQ ID NO: 16155 - protein, 9 aa, Homo Sapiens
KEFLGEEVF

SEQ ID NO: 16156 - protein, 9 aa, Homo Sapiens
KAVSDADMQ

SEQ ID NO: 16157 - protein, 9 aa, Homo Sapiens
ISRLRLERT

SEQ ID NO: 16158 - protein, 9 aa, Homo Sapiens
RNSRKWCRC

SEQ ID NO: 16159 - protein, 9 aa, Homo Sapiens
CELDQSGLG

SEQ ID NO: 16160 - protein, 9 aa, Homo Sapiens
SHVRRAVLT

SEQ ID NO: 16161 - protein, 9 aa, Homo Sapiens
TLGRSPRIP

SEQ ID NO: 16162 - protein, 9 aa, Homo Sapiens
EASIAGSAT

SEQ ID NO: 16163 - protein, 9 aa, Homo Sapiens
PLPWCPRLV

SEQ ID NO: 16164 - protein, 9 aa, Homo Sapiens
SGAWTGHVN

SEQ ID NO: 16165 - protein, 9 aa, Homo Sapiens
FFVIFLLLY

SEQ ID NO: 16166 - protein, 9 aa, Homo Sapiens
CAKVMNAYE

SEQ ID NO: 16167 - protein, 9 aa, Homo Sapiens
QLLFQNNEI

SEQ ID NO: 16168 - protein, 9 aa, Homo Sapiens
PAPSFSYEV

SEQ ID NO: 16169 - protein, 9 aa, Homo Sapiens
DLGRAAAAA

SEQ ID NO: 16170 - protein, 9 aa, Homo Sapiens
PQMPTRMEK

SEQ ID NO: 16171 - protein, 9 aa, Homo Sapiens
MPDKPVSDK

SEQ ID NO: 16172 - protein, 9 aa, Homo Sapiens
ETRIENRIV

SEQ ID NO: 16173 - protein, 9 aa, Homo Sapiens
AANPLFLQP

SEQ ID NO: 16174 - protein, 9 aa, Homo Sapiens
SDSSSASAF

SEQ ID NO: 16175 - protein, 9 aa, Homo Sapiens
MNYSCEPNC

SEQ ID NO: 16176 - protein, 9 aa, Homo Sapiens
ETDKTQLLS

SEQ ID NO: 16177 - protein, 9 aa, Homo Sapiens
YGLPWRSGK

SEQ ID NO: 16178 - protein, 9 aa, Homo Sapiens
SEGHHTKDF

SEQ ID NO: 16179 - protein, 9 aa, Homo Sapiens
HRQWFFKEF

SEQ ID NO: 16180 - protein, 9 aa, Homo Sapiens
ELSTCGPTK

SEQ ID NO: 16181 - protein, 9 aa, Homo Sapiens
SPQGGHIAI

SEQ ID NO: 16182 - protein, 9 aa, Homo Sapiens
SGMDTAFSV

SEQ ID NO: 16183 - protein, 9 aa, Homo Sapiens
QSSELKGTP

SEQ ID NO: 16184 - protein, 9 aa, Homo Sapiens
KRHGKPIKV

SEQ ID NO: 16185 - protein, 9 aa, Homo Sapiens
PSLLLNPTE

SEQ ID NO: 16186 - protein, 9 aa, Homo Sapiens
WSTVEGAAP

SEQ ID NO: 16187 - protein, 9 aa, Homo Sapiens
SYCSHLRQH

SEQ ID NO: 16188 - protein, 9 aa, Homo Sapiens
SGFHPSNIE

SEQ ID NO: 16189 - protein, 9 aa, Homo Sapiens
PGTRVRAMT

SEQ ID NO: 16190 - protein, 9 aa, Homo Sapiens
SVPELDRDK

SEQ ID NO: 16191 - protein, 9 aa, Homo Sapiens
FPSLANGTA

SEQ ID NO: 16192 - protein, 9 aa, Homo Sapiens
LRRLGPPGP

SEQ ID NO: 16193 - protein, 9 aa, Homo Sapiens
DTNSDSVQS

SEQ ID NO: 16194 - protein, 9 aa, Homo Sapiens
NLWLPRELK

SEQ ID NO: 16195 - protein, 9 aa, Homo Sapiens
KENSMLREK

SEQ ID NO: 16196 - protein, 9 aa, Homo Sapiens
MEDYHQFYE

SEQ ID NO: 16197 - protein, 9 aa, Homo Sapiens
GFQKPSAIQ

SEQ ID NO: 16198 - protein, 9 aa, Homo Sapiens
PLPEPAASS

SEQ ID NO: 16199 - protein, 9 aa, Homo Sapiens
SYIPKDNRL

SEQ ID NO: 16200 - protein, 9 aa, Homo Sapiens
QTRHEQEQR

SEQ ID NO: 16201 - protein, 9 aa, Homo Sapiens
TVLKSQYEG

SEQ ID NO: 16202 - protein, 9 aa, Homo Sapiens
CCYLKLLSL

SEQ ID NO: 16203 - protein, 9 aa, Homo Sapiens
TSCSKPPLL

SEQ ID NO: 16204 - protein, 9 aa, Homo Sapiens
EKARKMKRK

SEQ ID NO: 16205 - protein, 9 aa, Homo Sapiens
MNSVNLKNI

SEQ ID NO: 16206 - protein, 9 aa, Homo Sapiens
QGKRLATSP

SEQ ID NO: 16207 - protein, 9 aa, Homo Sapiens
SKPGRGDKS

SEQ ID NO: 16208 - protein, 9 aa, Homo Sapiens
MQKIQDCSQ

SEQ ID NO: 16209 - protein, 9 aa, Homo Sapiens
FPVSPALVP

SEQ ID NO: 16210 - protein, 9 aa, Homo Sapiens
LQREPVRGQ

SEQ ID NO: 16211 - protein, 9 aa, Homo Sapiens
QEEDDAGVE

SEQ ID NO: 16212 - protein, 9 aa, Homo Sapiens
HNDSPELST

SEQ ID NO: 16213 - protein, 9 aa, Homo Sapiens
DWRGPHGTF

SEQ ID NO: 16214 - protein, 9 aa, Homo Sapiens
RPTRIPQLL

SEQ ID NO: 16215 - protein, 9 aa, Homo Sapiens
YEPGAHPAI

SEQ ID NO: 16216 - protein, 9 aa, Homo Sapiens
GDWMVKQAS

SEQ ID NO: 16217 - protein, 9 aa, Homo Sapiens
SKEFFMENS

SEQ ID NO: 16218 - protein, 9 aa, Homo Sapiens
AVPLPNWLI

SEQ ID NO: 16219 - protein, 9 aa, Homo Sapiens
TMYLLSYIP

SEQ ID NO: 16220 - protein, 9 aa, Homo Sapiens
YTTSQGLAA

SEQ ID NO: 16221 - protein, 9 aa, Homo Sapiens
KKEVKQEKK

SEQ ID NO: 16222 - protein, 9 aa, Homo Sapiens
CSKPPLLGF

SEQ ID NO: 16223 - protein, 9 aa, Homo Sapiens
LQLFQEDLG

SEQ ID NO: 16224 - protein, 9 aa, Homo Sapiens
AHNGNNDQS

SEQ ID NO: 16225 - protein, 9 aa, Homo Sapiens
HSDQREDVA

SEQ ID NO: 16226 - protein, 9 aa, Homo Sapiens
LETDKTQLL

SEQ ID NO: 16227 - protein, 9 aa, Homo Sapiens
PWKDLHPDH

SEQ ID NO: 16228 - protein, 9 aa, Homo Sapiens
KYLSHQQMQ

SEQ ID NO: 16229 - protein, 9 aa, Homo Sapiens
TLIPPNGEK

SEQ ID NO: 16230 - protein, 9 aa, Homo Sapiens
NVSVQTVSK

SEQ ID NO: 16231 - protein, 9 aa, Homo Sapiens
RWWNHIDEN

SEQ ID NO: 16232 - protein, 9 aa, Homo Sapiens
ISTELAISF

SEQ ID NO: 16233 - protein, 9 aa, Homo Sapiens
SISRNCTED

SEQ ID NO: 16234 - protein, 9 aa, Homo Sapiens
CSDHPMIDI

SEQ ID NO: 16235 - protein, 9 aa, Homo Sapiens
NPSFIRQLE

SEQ ID NO: 16236 - protein, 9 aa, Homo Sapiens
NNLLSVPPA

SEQ ID NO: 16237 - protein, 9 aa, Homo Sapiens
IPQLLPRSQ

SEQ ID NO: 16238 - protein, 9 aa, Homo Sapiens
LENDPGSNQ

SEQ ID NO: 16239 - protein, 9 aa, Homo Sapiens
CGKIGLIEE

SEQ ID NO: 16240 - protein, 9 aa, Homo Sapiens
RLPALPGDR

SEQ ID NO: 16241 - protein, 9 aa, Homo Sapiens
RGENTGTSG

SEQ ID NO: 16242 - protein, 9 aa, Homo Sapiens
VLSVFRAIT

SEQ ID NO: 16243 - protein, 9 aa, Homo Sapiens
SSKDSETEL

SEQ ID NO: 16244 - protein, 9 aa, Homo Sapiens
AYTLRLELD

SEQ ID NO: 16245 - protein, 9 aa, Homo Sapiens
RQWFFKEFP

SEQ ID NO: 16246 - protein, 9 aa, Homo Sapiens
NLLAHWPAK

SEQ ID NO: 16247 - protein, 9 aa, Homo Sapiens
KLELAFRRQ

SEQ ID NO: 16248 - protein, 9 aa, Homo Sapiens
DWQSVITNQ

SEQ ID NO: 16249 - protein, 9 aa, Homo Sapiens
NREQKLREE

SEQ ID NO: 16250 - protein, 9 aa, Homo Sapiens
FSRSVPELD

SEQ ID NO: 16251 - protein, 9 aa, Homo Sapiens
GLPWRSGKL

SEQ ID NO: 16252 - protein, 9 aa, Homo Sapiens
GGGKALAVP

SEQ ID NO: 16253 - protein, 9 aa, Homo Sapiens
GNKRSDPEQ

SEQ ID NO: 16254 - protein, 9 aa, Homo Sapiens
KPQQPTPRK

SEQ ID NO: 16255 - protein, 9 aa, Homo Sapiens
SNRKYSVGV

SEQ ID NO: 16256 - protein, 9 aa, Homo Sapiens
LSLDYFKKQ

SEQ ID NO: 16257 - protein, 9 aa, Homo Sapiens
QREEVRGTS

SEQ ID NO: 16258 - protein, 9 aa, Homo Sapiens
PVSDSSSAS

SEQ ID NO: 16259 - protein, 9 aa, Homo Sapiens
PTEIPTPHS

SEQ ID NO: 16260 - protein, 9 aa, Homo Sapiens
SNIEVDLLK

SEQ ID NO: 16261 - protein, 9 aa, Homo Sapiens
RALQTRHEQ

SEQ ID NO: 16262 - protein, 9 aa, Homo Sapiens
KQEAQVVIY

SEQ ID NO: 16263 - protein, 9 aa, Homo Sapiens
RALYEVGAG

SEQ ID NO: 16264 - protein, 9 aa, Homo Sapiens
KFYSSELHG

SEQ ID NO: 16265 - protein, 9 aa, Homo Sapiens
VPGCCYLKL

SEQ ID NO: 16266 - protein, 9 aa, Homo Sapiens
LKFVTSCSK

SEQ ID NO: 16267 - protein, 9 aa, Homo Sapiens
ALVAPATAH

SEQ ID NO: 16268 - protein, 9 aa, Homo Sapiens
GPMGQRLKG

SEQ ID NO: 16269 - protein, 9 aa, Homo Sapiens
FDSDWNSHQ

SEQ ID NO: 16270 - protein, 9 aa, Homo Sapiens
KGQLALSFR

SEQ ID NO: 16271 - protein, 9 aa, Homo Sapiens
KAGLYGLPW

SEQ ID NO: 16272 - protein, 9 aa, Homo Sapiens
EGHHTKDFT

SEQ ID NO: 16273 - protein, 9 aa, Homo Sapiens
PEQMLYTFR

SEQ ID NO: 16274 - protein, 9 aa, Homo Sapiens
FEKLPEYVF

SEQ ID NO: 16275 - protein, 9 aa, Homo Sapiens
FPLGPATHE

SEQ ID NO: 16276 - protein, 9 aa, Homo Sapiens
HQQMQELSN

SEQ ID NO: 16277 - protein, 9 aa, Homo Sapiens
QLLRRLGPP

SEQ ID NO: 16278 - protein, 9 aa, Homo Sapiens
PLQVLSVFR

SEQ ID NO: 16279 - protein, 9 aa, Homo Sapiens
GNCSRFMNY

SEQ ID NO: 16280 - protein, 9 aa, Homo Sapiens
KLSLDYFKK

SEQ ID NO: 16281 - protein, 9 aa, Homo Sapiens
WFFKEFPRL

SEQ ID NO: 16282 - protein, 9 aa, Homo Sapiens
KACLNFTYE

SEQ ID NO: 16283 - protein, 9 aa, Homo Sapiens
AFRRQSSSP

SEQ ID NO: 16284 - protein, 9 aa, Homo Sapiens
KAMSVSDSI

SEQ ID NO: 16285 - protein, 9 aa, Homo Sapiens
EDGLRMFMT

SEQ ID NO: 16286 - protein, 9 aa, Homo Sapiens
LDYFKKQKA

SEQ ID NO: 16287 - protein, 9 aa, Homo Sapiens
GTWSSKATS

SEQ ID NO: 16288 - protein, 9 aa, Homo Sapiens
QVYQERIQW

SEQ ID NO: 16289 - protein, 9 aa, Homo Sapiens
RVDDRRSVY

SEQ ID NO: 16290 - protein, 9 aa, Homo Sapiens
FWSTVEGAA

SEQ ID NO: 16291 - protein, 9 aa, Homo Sapiens
LPAPKQLRF

SEQ ID NO: 16292 - protein, 9 aa, Homo Sapiens
ERALQTRHE

SEQ ID NO: 16293 - protein, 9 aa, Homo Sapiens
PSGAQLPCW

SEQ ID NO: 16294 - protein, 9 aa, Homo Sapiens
KATLHTKCK

SEQ ID NO: 16295 - protein, 9 aa, Homo Sapiens
CTSDYKDNF

SEQ ID NO: 16296 - protein, 9 aa, Homo Sapiens
MPEPLAPKS

SEQ ID NO: 16297 - protein, 9 aa, Homo Sapiens
AGGRGENTG

SEQ ID NO: 16298 - protein, 9 aa, Homo Sapiens
PLGPATHEG

SEQ ID NO: 16299 - protein, 9 aa, Homo Sapiens
NLNSLLAGT

SEQ ID NO: 16300 - protein, 9 aa, Homo Sapiens
VTEDSPLIL

SEQ ID NO: 16301 - protein, 9 aa, Homo Sapiens
LPGDREAAL

SEQ ID NO: 16302 - protein, 9 aa, Homo Sapiens
QGPDVLSPA

SEQ ID NO: 16303 - protein, 9 aa, Homo Sapiens
DNACLIVRY

SEQ ID NO: 16304 - protein, 9 aa, Homo Sapiens
LPASHPLFG

SEQ ID NO: 16305 - protein, 9 aa, Homo Sapiens
KERSHKLQQ

SEQ ID NO: 16306 - protein, 9 aa, Homo Sapiens
FQRQKYLSH

SEQ ID NO: 16307 - protein, 9 aa, Homo Sapiens
PECAAGFFK

SEQ ID NO: 16308 - protein, 9 aa, Homo Sapiens
SAADIKQQN

SEQ ID NO: 16309 - protein, 9 aa, Homo Sapiens
LGSLLFAHR

SEQ ID NO: 16310 - protein, 9 aa, Homo Sapiens
AYSDLAGSF

SEQ ID NO: 16311 - protein, 9 aa, Homo Sapiens
LDVRITVLK

SEQ ID NO: 16312 - protein, 9 aa, Homo Sapiens
PDAVPDALD

SEQ ID NO: 16313 - protein, 9 aa, Homo Sapiens
QLNKDFEGP

SEQ ID NO: 16314 - protein, 9 aa, Homo Sapiens
IAHNGNNDQ

SEQ ID NO: 16315 - protein, 9 aa, Homo Sapiens
SVRSKPPMS

SEQ ID NO: 16316 - protein, 9 aa, Homo Sapiens
VGKDHHGRM

SEQ ID NO: 16317 - protein, 9 aa, Homo Sapiens
YDSKINGRG

SEQ ID NO: 16318 - protein, 9 aa, Homo Sapiens
GSLLFAHRI

SEQ ID NO: 16319 - protein, 9 aa, Homo Sapiens
CDRQMKDYG

SEQ ID NO: 16320 - protein, 9 aa, Homo Sapiens
AGAWLPGAA

SEQ ID NO: 16321 - protein, 9 aa, Homo Sapiens
LVGNKRSDP

SEQ ID NO: 16322 - protein, 9 aa, Homo Sapiens
VLLRAGAWL

SEQ ID NO: 16323 - protein, 9 aa, Homo Sapiens
KNRSKEFFM

SEQ ID NO: 16324 - protein, 9 aa, Homo Sapiens
MDQAVGDLK

SEQ ID NO: 16325 - protein, 9 aa, Homo Sapiens
KLPSLLLNP

SEQ ID NO: 16326 - protein, 9 aa, Homo Sapiens
VKLLYRVLV

SEQ ID NO: 16327 - protein, 9 aa, Homo Sapiens
LCDKVNEEM

SEQ ID NO: 16328 - protein, 9 aa, Homo Sapiens
SVCDGAVGY

SEQ ID NO: 16329 - protein, 9 aa, Homo Sapiens
TVSSTCSSD

SEQ ID NO: 16330 - protein, 9 aa, Homo Sapiens
DTTPKKPED

SEQ ID NO: 16331 - protein, 9 aa, Homo Sapiens
ILDITKREQ

SEQ ID NO: 16332 - protein, 9 aa, Homo Sapiens
PKLKATADD

SEQ ID NO: 16333 - protein, 9 aa, Homo Sapiens
PGDREAALN

SEQ ID NO: 16334 - protein, 9 aa, Homo Sapiens
GFQFVAPSG

SEQ ID NO: 16335 - protein, 9 aa, Homo Sapiens
LAFRRQSSS

SEQ ID NO: 16336 - protein, 9 aa, Homo Sapiens
RASQLHQRD

SEQ ID NO: 16337 - protein, 9 aa, Homo Sapiens
GAQGPDVLS

SEQ ID NO: 16338 - protein, 9 aa, Homo Sapiens
FVTSCSKPP

SEQ ID NO: 16339 - protein, 9 aa, Homo Sapiens
VDYDNACLI

SEQ ID NO: 16340 - protein, 9 aa, Homo Sapiens
LSYCGGGKA

SEQ ID NO: 16341 - protein, 9 aa, Homo Sapiens
MDTAFSVAL

SEQ ID NO: 16342 - protein, 9 aa, Homo Sapiens
LCGKAFSYC

SEQ ID NO: 16343 - protein, 9 aa, Homo Sapiens
FSVALDLVE

SEQ ID NO: 16344 - protein, 9 aa, Homo Sapiens
MPTRMEKEE

SEQ ID NO: 16345 - protein, 9 aa, Homo Sapiens
ATCTLANGK

SEQ ID NO: 16346 - protein, 9 aa, Homo Sapiens
FIRQLEEYQ

SEQ ID NO: 16347 - protein, 9 aa, Homo Sapiens
HTVPVMWLK

SEQ ID NO: 16348 - protein, 9 aa, Homo Sapiens
YEDRRSFAL

SEQ ID NO: 16349 - protein, 9 aa, Homo Sapiens
RCRKQKVEM

SEQ ID NO: 16350 - protein, 9 aa, Homo Sapiens
FWCFQCEQL

SEQ ID NO: 16351 - protein, 9 aa, Homo Sapiens
LGPRGDPGL

SEQ ID NO: 16352 - protein, 9 aa, Homo Sapiens
SGAQLPCWG

SEQ ID NO: 16353 - protein, 9 aa, Homo Sapiens
AARAGFQFV

SEQ ID NO: 16354 - protein, 9 aa, Homo Sapiens
TRVRAMTIY

SEQ ID NO: 16355 - protein, 9 aa, Homo Sapiens
LRNLLAHWP

SEQ ID NO: 16356 - protein, 9 aa, Homo Sapiens
QHLESIDNE

SEQ ID NO: 16357 - protein, 9 aa, Homo Sapiens
DDVVVTEDS

SEQ ID NO: 16358 - protein, 9 aa, Homo Sapiens
RGQGGRTPH

SEQ ID NO: 16359 - protein, 9 aa, Homo Sapiens
HCDRQMKDY

SEQ ID NO: 16360 - protein, 9 aa, Homo Sapiens
SRAPLLPLQ

SEQ ID NO: 16361 - protein, 9 aa, Homo Sapiens
SQVIEQLPK

SEQ ID NO: 16362 - protein, 9 aa, Homo Sapiens
ISRNCTEDR

SEQ ID NO: 16363 - protein, 9 aa, Homo Sapiens
MMVVAWGTG

SEQ ID NO: 16364 - protein, 9 aa, Homo Sapiens
PSNIEVDLL

SEQ ID NO: 16365 - protein, 9 aa, Homo Sapiens
GVQVSSPNE

SEQ ID NO: 16366 - protein, 9 aa, Homo Sapiens
LLSFQRYLT

SEQ ID NO: 16367 - protein, 9 aa, Homo Sapiens
FMTRDLDLS

SEQ ID NO: 16368 - protein, 9 aa, Homo Sapiens
GFGGVQVSS

SEQ ID NO: 16369 - protein, 9 aa, Homo Sapiens
ALQTRHEQE

SEQ ID NO: 16370 - protein, 9 aa, Homo Sapiens
DWMVKQASL

SEQ ID NO: 16371 - protein, 9 aa, Homo Sapiens
AHWPAKHQA

SEQ ID NO: 16372 - protein, 9 aa, Homo Sapiens
DITKREQLE

SEQ ID NO: 16373 - protein, 9 aa, Homo Sapiens
KRLKMEGHK

SEQ ID NO: 16374 - protein, 9 aa, Homo Sapiens
KPNRTSSVL

SEQ ID NO: 16375 - protein, 9 aa, Homo Sapiens
PATHEGTYR

SEQ ID NO: 16376 - protein, 9 aa, Homo Sapiens
TDKTQLLSS

SEQ ID NO: 16377 - protein, 9 aa, Homo Sapiens
YEEYEHIRR

SEQ ID NO: 16378 - protein, 9 aa, Homo Sapiens
SLFSSVRSK

SEQ ID NO: 16379 - protein, 9 aa, Homo Sapiens
FKTVGLFAG

SEQ ID NO: 16380 - protein, 9 aa, Homo Sapiens
PDWRGPHGT

SEQ ID NO: 16381 - protein, 9 aa, Homo Sapiens
PRAMFVLSK

SEQ ID NO: 16382 - protein, 9 aa, Homo Sapiens
SDNPFVYEP

SEQ ID NO: 16383 - protein, 9 aa, Homo Sapiens
LAPKSYPES

SEQ ID NO: 16384 - protein, 9 aa, Homo Sapiens
RQGRALGSR

SEQ ID NO: 16385 - protein, 9 aa, Homo Sapiens
NKDFEGPPL

SEQ ID NO: 16386 - protein, 9 aa, Homo Sapiens
TSSRFFRGT

SEQ ID NO: 16387 - protein, 9 aa, Homo Sapiens
LELAFRRQS

SEQ ID NO: 16388 - protein, 9 aa, Homo Sapiens
YHQFYEDVK

SEQ ID NO: 16389 - protein, 9 aa, Homo Sapiens
WRGPHGTFF

SEQ ID NO: 16390 - protein, 9 aa, Homo Sapiens
WFLHFWSTV

SEQ ID NO: 16391 - protein, 9 aa, Homo Sapiens
NACLIVRYL

SEQ ID NO: 16392 - protein, 9 aa, Homo Sapiens
SERARQGAK

SEQ ID NO: 16393 - protein, 9 aa, Homo Sapiens
LDITKREQL

SEQ ID NO: 16394 - protein, 9 aa, Homo Sapiens
SSSRESRGQ

SEQ ID NO: 16395 - protein, 9 aa, Homo Sapiens
LFAHRIITD

SEQ ID NO: 16396 - protein, 9 aa, Homo Sapiens
NQEEDDAGV

SEQ ID NO: 16397 - protein, 9 aa, Homo Sapiens
HTKCKEKAK

SEQ ID NO: 16398 - protein, 9 aa, Homo Sapiens
EPLAPKSYP

SEQ ID NO: 16399 - protein, 9 aa, Homo Sapiens
HPSNIEVDL

SEQ ID NO: 16400 - protein, 9 aa, Homo Sapiens
TRMEKEEES

SEQ ID NO: 16401 - protein, 9 aa, Homo Sapiens
QLPKPNRTS

SEQ ID NO: 16402 - protein, 9 aa, Homo Sapiens
KGRALYEVG

SEQ ID NO: 16403 - protein, 9 aa, Homo Sapiens
QREPVRGQC

SEQ ID NO: 16404 - protein, 9 aa, Homo Sapiens
FRAKVCGKI

SEQ ID NO: 16405 - protein, 9 aa, Homo Sapiens
YLYTVVKDQ

SEQ ID NO: 16406 - protein, 9 aa, Homo Sapiens
QHRQWFFKE

SEQ ID NO: 16407 - protein, 9 aa, Homo Sapiens
RARQGAKER

SEQ ID NO: 16408 - protein, 9 aa, Homo Sapiens
DDDWQSVIT

SEQ ID NO: 16409 - protein, 9 aa, Homo Sapiens
GPLPASHPL

SEQ ID NO: 16410 - protein, 9 aa, Homo Sapiens
PVSPALVPG

SEQ ID NO: 16411 - protein, 9 aa, Homo Sapiens
VLCDKVNEE

SEQ ID NO: 16412 - protein, 9 aa, Homo Sapiens
HLLPEKNAE

SEQ ID NO: 16413 - protein, 9 aa, Homo Sapiens
IPAALVRAL

SEQ ID NO: 16414 - protein, 9 aa, Homo Sapiens
QFNVPVSLE

SEQ ID NO: 16415 - protein, 9 aa, Homo Sapiens
PGLRIPPRR

SEQ ID NO: 16416 - protein, 9 aa, Homo Sapiens
DLKQGDDYD

SEQ ID NO: 16417 - protein, 9 aa, Homo Sapiens
REREKEKAR

SEQ ID NO: 16418 - protein, 9 aa, Homo Sapiens
ISFESTEPS

SEQ ID NO: 16419 - protein, 9 aa, Homo Sapiens
LLSYIPKDN

SEQ ID NO: 16420 - protein, 9 aa, Homo Sapiens
WKDLHPDHM

SEQ ID NO: 16421 - protein, 9 aa, Homo Sapiens
GGTSVRPCS

SEQ ID NO: 16422 - protein, 9 aa, Homo Sapiens
TLHTKCKEK

SEQ ID NO: 16423 - protein, 9 aa, Homo Sapiens
YGFQKPSAI

SEQ ID NO: 16424 - protein, 9 aa, Homo Sapiens
DKEKGKTLL

SEQ ID NO: 16425 - protein, 9 aa, Homo Sapiens
LNSLLAGTE

SEQ ID NO: 16426 - protein, 9 aa, Homo Sapiens
DQAVGDLKQ

SEQ ID NO: 16427 - protein, 9 aa, Homo Sapiens
LDCSDHPMI

SEQ ID NO: 16428 - protein, 9 aa, Homo Sapiens
SGNLSMPDK

SEQ ID NO: 16429 - protein, 9 aa, Homo Sapiens
WGPLQREPV

SEQ ID NO: 16430 - protein, 9 aa, Homo Sapiens
EKGKTLLSP

SEQ ID NO: 16431 - protein, 9 aa, Homo Sapiens
PHSDQREDV

SEQ ID NO: 16432 - protein, 9 aa, Homo Sapiens
KGFGAQGPD

SEQ ID NO: 16433 - protein, 9 aa, Homo Sapiens
SHAVPLPNW

SEQ ID NO: 16434 - protein, 9 aa, Homo Sapiens
DRTMYLLSY

SEQ ID NO: 16435 - protein, 9 aa, Homo Sapiens
ENTGTSGGQ

SEQ ID NO: 16436 - protein, 9 aa, Homo Sapiens
TLNTMFWVY

SEQ ID NO: 16437 - protein, 9 aa, Homo Sapiens
VREGEEERR

SEQ ID NO: 16438 - protein, 9 aa, Homo Sapiens
QIGVFSGLY

SEQ ID NO: 16439 - protein, 9 aa, Homo Sapiens
HLYPYTTSQ

SEQ ID NO: 16440 - protein, 9 aa, Homo Sapiens
EGDPESLVF

SEQ ID NO: 16441 - protein, 9 aa, Homo Sapiens
LNFTYEYIF

SEQ ID NO: 16442 - protein, 9 aa, Homo Sapiens
QEAQVVIYE

SEQ ID NO: 16443 - protein, 9 aa, Homo Sapiens
LLQEGDHES

SEQ ID NO: 16444 - protein, 9 aa, Homo Sapiens
STLVGNKRS

SEQ ID NO: 16445 - protein, 9 aa, Homo Sapiens
LVFLSTCFG

SEQ ID NO: 16446 - protein, 9 aa, Homo Sapiens
ELAISFEST

SEQ ID NO: 16447 - protein, 9 aa, Homo Sapiens
MRQQGLPPP

SEQ ID NO: 16448 - protein, 9 aa, Homo Sapiens
LLPSGAQLP

SEQ ID NO: 16449 - protein, 9 aa, Homo Sapiens
VLVATCTLA

SEQ ID NO: 16450 - protein, 9 aa, Homo Sapiens
GDREAALND

SEQ ID NO: 16451 - protein, 9 aa, Homo Sapiens
VCNVKLLYR

SEQ ID NO: 16452 - protein, 9 aa, Homo Sapiens
ELRKPDDDK

SEQ ID NO: 16453 - protein, 9 aa, Homo Sapiens
SAFENVKPK

SEQ ID NO: 16454 - protein, 9 aa, Homo Sapiens
IITNNPHLQ

SEQ ID NO: 16455 - protein, 9 aa, Homo Sapiens
GHNIINTGE

SEQ ID NO: 16456 - protein, 9 aa, Homo Sapiens
DAVLYCGAT

SEQ ID NO: 16457 - protein, 9 aa, Homo Sapiens
FAQGKRLAT

SEQ ID NO: 16458 - protein, 9 aa, Homo Sapiens
NGEFTALVY

SEQ ID NO: 16459 - protein, 9 aa, Homo Sapiens
EGHKAMERL

SEQ ID NO: 16460 - protein, 9 aa, Homo Sapiens
WRSGKLKDL

SEQ ID NO: 16461 - protein, 9 aa, Homo Sapiens
PVSISRNCT

SEQ ID NO: 16462 - protein, 9 aa, Homo Sapiens
NLLSVPPAA

SEQ ID NO: 16463 - protein, 9 aa, Homo Sapiens
IYGEKFENE

SEQ ID NO: 16464 - protein, 9 aa, Homo Sapiens
KREQLENAL

SEQ ID NO: 16465 - protein, 9 aa, Homo Sapiens
MLREQIAML

SEQ ID NO: 16466 - protein, 9 aa, Homo Sapiens
ESKLSDTIQ

SEQ ID NO: 16467 - protein, 9 aa, Homo Sapiens
INKLLSHAV

SEQ ID NO: 16468 - protein, 9 aa, Homo Sapiens
CQTEVCPPL

SEQ ID NO: 16469 - protein, 9 aa, Homo Sapiens
VYNFRAKVC

SEQ ID NO: 16470 - protein, 9 aa, Homo Sapiens
IGFLYGNMY

SEQ ID NO: 16471 - protein, 9 aa, Homo Sapiens
GVGDTGMQD

SEQ ID NO: 16472 - protein, 9 aa, Homo Sapiens
THPIDKAMS

SEQ ID NO: 16473 - protein, 9 aa, Homo Sapiens
SELKGTPEV

SEQ ID NO: 16474 - protein, 9 aa, Homo Sapiens
GVLQEFDLI

SEQ ID NO: 16475 - protein, 9 aa, Homo Sapiens
LYYQDLLQL

SEQ ID NO: 16476 - protein, 9 aa, Homo Sapiens
NPMAQEGCK

SEQ ID NO: 16477 - protein, 9 aa, Homo Sapiens
RRLSFSCSP

SEQ ID NO: 16478 - protein, 9 aa, Homo Sapiens
PPNGEKKAC

SEQ ID NO: 16479 - protein, 9 aa, Homo Sapiens
VLQSSELKG

SEQ ID NO: 16480 - protein, 9 aa, Homo Sapiens
YAYHKSEII

SEQ ID NO: 16481 - protein, 9 aa, Homo Sapiens
RGGRDLGRA

SEQ ID NO: 16482 - protein, 9 aa, Homo Sapiens
LAALSEFVE

SEQ ID NO: 16483 - protein, 9 aa, Homo Sapiens
LRKPDDDKP

SEQ ID NO: 16484 - protein, 9 aa, Homo Sapiens
LVAPATAHE

SEQ ID NO: 16485 - protein, 9 aa, Homo Sapiens
GDTTPKKPE

SEQ ID NO: 16486 - protein, 9 aa, Homo Sapiens
GDHESSAVV

SEQ ID NO: 16487 - protein, 9 aa, Homo Sapiens
FLSTCFGGF

SEQ ID NO: 16488 - protein, 9 aa, Homo Sapiens
VIFDSDWNS

SEQ ID NO: 16489 - protein, 9 aa, Homo Sapiens
HREYRSGQS

SEQ ID NO: 16490 - protein, 9 aa, Homo Sapiens
NRKYSVGVK

SEQ ID NO: 16491 - protein, 9 aa, Homo Sapiens
GAFAAPAAG

SEQ ID NO: 16492 - protein, 9 aa, Homo Sapiens
QVIEQLPKP

SEQ ID NO: 16493 - protein, 9 aa, Homo Sapiens
GPDAVPDAL

SEQ ID NO: 16494 - protein, 9 aa, Homo Sapiens
VVCPLHNQE

SEQ ID NO: 16495 - protein, 9 aa, Homo Sapiens
LSSEINWAP

SEQ ID NO: 16496 - protein, 9 aa, Homo Sapiens
TTLIPPNGE

SEQ ID NO: 16497 - protein, 9 aa, Homo Sapiens
IYKRKKIIT

SEQ ID NO: 16498 - protein, 9 aa, Homo Sapiens
AFSVALDLV

SEQ ID NO: 16499 - protein, 9 aa, Homo Sapiens
DTCGPGCMK

SEQ ID NO: 16500 - protein, 9 aa, Homo Sapiens
KVCGKIGLI

SEQ ID NO: 16501 - protein, 9 aa, Homo Sapiens
PLYQSMNYK

SEQ ID NO: 16502 - protein, 9 aa, Homo Sapiens
VNSAIRYLK

SEQ ID NO: 16503 - protein, 9 aa, Homo Sapiens
LKLALHMEI

SEQ ID NO: 16504 - protein, 9 aa, Homo Sapiens
LAHWPAKHQ

SEQ ID NO: 16505 - protein, 9 aa, Homo Sapiens
VQSLKEIIC

SEQ ID NO: 16506 - protein, 9 aa, Homo Sapiens
LANGTAQDG

SEQ ID NO: 16507 - protein, 9 aa, Homo Sapiens
THKGEPTTF

SEQ ID NO: 16508 - protein, 9 aa, Homo Sapiens
ANDTRRLSF

SEQ ID NO: 16509 - protein, 9 aa, Homo Sapiens
SSKATSVKP

SEQ ID NO: 16510 - protein, 9 aa, Homo Sapiens
RYLKGQLAL

SEQ ID NO: 16511 - protein, 9 aa, Homo Sapiens
PAPHPPDFQ

SEQ ID NO: 16512 - protein, 9 aa, Homo Sapiens
PVLQSSELK

SEQ ID NO: 16513 - protein, 9 aa, Homo Sapiens
AVGVSEGHH

SEQ ID NO: 16514 - protein, 9 aa, Homo Sapiens
RKATLHTKC

SEQ ID NO: 16515 - protein, 9 aa, Homo Sapiens
VGDWMVKQA

SEQ ID NO: 16516 - protein, 9 aa, Homo Sapiens
GERPRVHFR

SEQ ID NO: 16517 - protein, 9 aa, Homo Sapiens
LYQSMNYKP

SEQ ID NO: 16518 - protein, 9 aa, Homo Sapiens
HVERALQTR

SEQ ID NO: 16519 - protein, 9 aa, Homo Sapiens
SHLLSNSQR

SEQ ID NO: 16520 - protein, 9 aa, Homo Sapiens
SASAFENVK

SEQ ID NO: 16521 - protein, 9 aa, Homo Sapiens
NAGGRGENT

SEQ ID NO: 16522 - protein, 9 aa, Homo Sapiens
LAFLFLMQK

SEQ ID NO: 16523 - protein, 9 aa, Homo Sapiens
NEIAHNGNN

SEQ ID NO: 16524 - protein, 9 aa, Homo Sapiens
SGSSSSSSL

SEQ ID NO: 16525 - protein, 9 aa, Homo Sapiens
SIDNEEDEE

SEQ ID NO: 16526 - protein, 9 aa, Homo Sapiens
VSSPNENVA

SEQ ID NO: 16527 - protein, 9 aa, Homo Sapiens
SRDSAYTLR

SEQ ID NO: 16528 - protein, 9 aa, Homo Sapiens
HYNIAELQS

SEQ ID NO: 16529 - protein, 9 aa, Homo Sapiens
QGAKERSHK

SEQ ID NO: 16530 - protein, 9 aa, Homo Sapiens
KAMERLKML

SEQ ID NO: 16531 - protein, 9 aa, Homo Sapiens
RRSGAGPES

SEQ ID NO: 16532 - protein, 9 aa, Homo Sapiens
TQNQSSKDS

SEQ ID NO: 16533 - protein, 9 aa, Homo Sapiens
DLSVPGCCY

SEQ ID NO: 16534 - protein, 9 aa, Homo Sapiens
YAYGFQKPS

SEQ ID NO: 16535 - protein, 9 aa, Homo Sapiens
YEDVKDAQE

SEQ ID NO: 16536 - protein, 9 aa, Homo Sapiens
SLQLFQEDL

SEQ ID NO: 16537 - protein, 9 aa, Homo Sapiens
HSQDVLCDK

SEQ ID NO: 16538 - protein, 9 aa, Homo Sapiens
QGRALGSRP

SEQ ID NO: 16539 - protein, 9 aa, Homo Sapiens
KMMQVIQEY

SEQ ID NO: 16540 - protein, 9 aa, Homo Sapiens
FLMQKIQDC

SEQ ID NO: 16541 - protein, 9 aa, Homo Sapiens
KARCSSEDD

SEQ ID NO: 16542 - protein, 9 aa, Homo Sapiens
LKSKLETEQ

SEQ ID NO: 16543 - protein, 9 aa, Homo Sapiens
DTYVCTSDY

SEQ ID NO: 16544 - protein, 9 aa, Homo Sapiens
GAASRTTSK

SEQ ID NO: 16545 - protein, 9 aa, Homo Sapiens
KGHNIINTG

SEQ ID NO: 16546 - protein, 9 aa, Homo Sapiens
PELSTCGPT

SEQ ID NO: 16547 - protein, 9 aa, Homo Sapiens
CAAGFFKTV

SEQ ID NO: 16548 - protein, 9 aa, Homo Sapiens
IYEEYEHIR

SEQ ID NO: 16549 - protein, 9 aa, Homo Sapiens
VQTVSKNLN

SEQ ID NO: 16550 - protein, 9 aa, Homo Sapiens
GTAQDGDTH

SEQ ID NO: 16551 - protein, 9 aa, Homo Sapiens
STDVGSCTV

SEQ ID NO: 16552 - protein, 9 aa, Homo Sapiens
LPEPSRHMS

SEQ ID NO: 16553 - protein, 9 aa, Homo Sapiens
NSMLREKMH

SEQ ID NO: 16554 - protein, 9 aa, Homo Sapiens
KGKTLLSPL

SEQ ID NO: 16555 - protein, 9 aa, Homo Sapiens
TPSHLLSNS

SEQ ID NO: 16556 - protein, 9 aa, Homo Sapiens
DTRRLSFSC

SEQ ID NO: 16557 - protein, 9 aa, Homo Sapiens
PLAALSEFV

SEQ ID NO: 16558 - protein, 9 aa, Homo Sapiens
MFLFKWIEE

SEQ ID NO: 16559 - protein, 9 aa, Homo Sapiens
AGTEATLSH

SEQ ID NO: 16560 - protein, 9 aa, Homo Sapiens
DYHCAKVMN

SEQ ID NO: 16561 - protein, 9 aa, Homo Sapiens
PGSNQDTDI

SEQ ID NO: 16562 - protein, 9 aa, Homo Sapiens
IGLRGERPR

SEQ ID NO: 16563 - protein, 9 aa, Homo Sapiens
SHLKGHNII

SEQ ID NO: 16564 - protein, 9 aa, Homo Sapiens
IFTKKEVKQ

SEQ ID NO: 16565 - protein, 9 aa, Homo Sapiens
TRRLSFSCS

SEQ ID NO: 16566 - protein, 9 aa, Homo Sapiens
LRLPALPGD

SEQ ID NO: 16567 - protein, 9 aa, Homo Sapiens
EKLSLDYFK

SEQ ID NO: 16568 - protein, 9 aa, Homo Sapiens
PGPSLFLSA

SEQ ID NO: 16569 - protein, 9 aa, Homo Sapiens
VGSCTVVCP

SEQ ID NO: 16570 - protein, 9 aa, Homo Sapiens
VKQASLDFF

SEQ ID NO: 16571 - protein, 9 aa, Homo Sapiens
DSDWNSHQD

SEQ ID NO: 16572 - protein, 9 aa, Homo Sapiens
TSVHYNIAE

SEQ ID NO: 16573 - protein, 9 aa, Homo Sapiens
SNPMAQEGC

SEQ ID NO: 16574 - protein, 9 aa, Homo Sapiens
PVAPAVAIF

SEQ ID NO: 16575 - protein, 9 aa, Homo Sapiens
KPEQMLYTF

SEQ ID NO: 16576 - protein, 9 aa, Homo Sapiens
VVAIFCSVQ

SEQ ID NO: 16577 - protein, 9 aa, Homo Sapiens
LTSSRFFRG

SEQ ID NO: 16578 - protein, 9 aa, Homo Sapiens
QNYSFNDLS

SEQ ID NO: 16579 - protein, 9 aa, Homo Sapiens
RSVYYVDHN

SEQ ID NO: 16580 - protein, 9 aa, Homo Sapiens
VVDILWSNP

SEQ ID NO: 16581 - protein, 9 aa, Homo Sapiens
QKRAEQFNV

SEQ ID NO: 16582 - protein, 9 aa, Homo Sapiens
QNSTLVGNK

SEQ ID NO: 16583 - protein, 9 aa, Homo Sapiens
VLEKRASQL

SEQ ID NO: 16584 - protein, 9 aa, Homo Sapiens
ENHKKFYSS

SEQ ID NO: 16585 - protein, 9 aa, Homo Sapiens
LRGGRDLGR

SEQ ID NO: 16586 - protein, 9 aa, Homo Sapiens
RRSVYYVDH

SEQ ID NO: 16587 - protein, 9 aa, Homo Sapiens
MSEPMRQQG

SEQ ID NO: 16588 - protein, 9 aa, Homo Sapiens
KRAEQFNVP

SEQ ID NO: 16589 - protein, 9 aa, Homo Sapiens
FMFLFKWIE

SEQ ID NO: 16590 - protein, 9 aa, Homo Sapiens
LPKPNRTSS

SEQ ID NO: 16591 - protein, 9 aa, Homo Sapiens
ANPLFLQPE

SEQ ID NO: 16592 - protein, 9 aa, Homo Sapiens
LNPTEETVR

SEQ ID NO: 16593 - protein, 9 aa, Homo Sapiens
PPRRSGAGP

SEQ ID NO: 16594 - protein, 9 aa, Homo Sapiens
SGRSNKLAR

SEQ ID NO: 16595 - protein, 9 aa, Homo Sapiens
LFQEDLGSP

SEQ ID NO: 16596 - protein, 9 aa, Homo Sapiens
RLKMEGHKA

SEQ ID NO: 16597 - protein, 9 aa, Homo Sapiens
VTVKRHGKP

SEQ ID NO: 16598 - protein, 9 aa, Homo Sapiens
DNEEDEEAK

SEQ ID NO: 16599 - protein, 9 aa, Homo Sapiens
KGVLQEFDL

SEQ ID NO: 16600 - protein, 9 aa, Homo Sapiens
RSLFSSVRS

SEQ ID NO: 16601 - protein, 9 aa, Homo Sapiens
THEGTYRCF

SEQ ID NO: 16602 - protein, 9 aa, Homo Sapiens
PAVAIFATQ

SEQ ID NO: 16603 - protein, 9 aa, Homo Sapiens
EATLSHAKT

SEQ ID NO: 16604 - protein, 9 aa, Homo Sapiens
QVLEKRASQ

SEQ ID NO: 16605 - protein, 9 aa, Homo Sapiens
YNIQKESTV

SEQ ID NO: 16606 - protein, 9 aa, Homo Sapiens
RVRAMTIYK

SEQ ID NO: 16607 - protein, 9 aa, Homo Sapiens
GSGRSNKLA

SEQ ID NO: 16608 - protein, 9 aa, Homo Sapiens
APATAHEPV

SEQ ID NO: 16609 - protein, 9 aa, Homo Sapiens
CILETDKTQ

SEQ ID NO: 16610 - protein, 9 aa, Homo Sapiens
ELECVREGE

SEQ ID NO: 16611 - protein, 9 aa, Homo Sapiens
DSPELSTCG

SEQ ID NO: 16612 - protein, 9 aa, Homo Sapiens
TPTEIPTPH

SEQ ID NO: 16613 - protein, 9 aa, Homo Sapiens
YEVGAGTGQ

SEQ ID NO: 16614 - protein, 9 aa, Homo Sapiens
FSSVRSKPP

SEQ ID NO: 16615 - protein, 9 aa, Homo Sapiens
GPGLRIPPR

SEQ ID NO: 16616 - protein, 9 aa, Homo Sapiens
HPDHMLMEA

SEQ ID NO: 16617 - protein, 9 aa, Homo Sapiens
SQLHQRDVL

SEQ ID NO: 16618 - protein, 9 aa, Homo Sapiens
FFMENSSRQ

SEQ ID NO: 16619 - protein, 9 aa, Homo Sapiens
RAGFQFVAP

SEQ ID NO: 16620 - protein, 9 aa, Homo Sapiens
LLSPTHLPW

SEQ ID NO: 16621 - protein, 9 aa, Homo Sapiens
LYGNMYCSI

SEQ ID NO: 16622 - protein, 9 aa, Homo Sapiens
CEQLNKDFE

SEQ ID NO: 16623 - protein, 9 aa, Homo Sapiens
VFENKNSDE

SEQ ID NO: 16624 - protein, 9 aa, Homo Sapiens
EKLPSPLAA

SEQ ID NO: 16625 - protein, 9 aa, Homo Sapiens
NFRAKVCGK

SEQ ID NO: 16626 - protein, 9 aa, Homo Sapiens
QWFFKEFPR

SEQ ID NO: 16627 - protein, 9 aa, Homo Sapiens
PAPKQLRFD

SEQ ID NO: 16628 - protein, 9 aa, Homo Sapiens
VLQEFDLIR

SEQ ID NO: 16629 - protein, 9 aa, Homo Sapiens
DSLAYSDLA

SEQ ID NO: 16630 - protein, 9 aa, Homo Sapiens
KVKGVLQEF

SEQ ID NO: 16631 - protein, 9 aa, Homo Sapiens
KVLVATCTL

SEQ ID NO: 16632 - protein, 9 aa, Homo Sapiens
FFKEFPRLK

SEQ ID NO: 16633 - protein, 9 aa, Homo Sapiens
SRFMNYSCE

SEQ ID NO: 16634 - protein, 9 aa, Homo Sapiens
INPEDYKKP

SEQ ID NO: 16635 - protein, 9 aa, Homo Sapiens
KRCNDMINL

SEQ ID NO: 16636 - protein, 9 aa, Homo Sapiens
NRYFTLDQV

SEQ ID NO: 16637 - protein, 9 aa, Homo Sapiens
SFQRYLTSS

SEQ ID NO: 16638 - protein, 9 aa, Homo Sapiens
DCVKACLNF

SEQ ID NO: 16639 - protein, 9 aa, Homo Sapiens
GFLYGNMYC

SEQ ID NO: 16640 - protein, 9 aa, Homo Sapiens
VATCTLANG

SEQ ID NO: 16641 - protein, 9 aa, Homo Sapiens
CGPMGQRLK

SEQ ID NO: 16642 - protein, 9 aa, Homo Sapiens
LQVVVSEEE

SEQ ID NO: 16643 - protein, 9 aa, Homo Sapiens
NGTAQDGDT

SEQ ID NO: 16644 - protein, 9 aa, Homo Sapiens
GSFAYAFAA

SEQ ID NO: 16645 - protein, 9 aa, Homo Sapiens
KARKMKRKE

SEQ ID NO: 16646 - protein, 9 aa, Homo Sapiens
KMHRRFENA

SEQ ID NO: 16647 - protein, 9 aa, Homo Sapiens
WDTVSTLQA

SEQ ID NO: 16648 - protein, 9 aa, Homo Sapiens
GDTGMQDAK

SEQ ID NO: 16649 - protein, 9 aa, Homo Sapiens
QLHQRDVLL

SEQ ID NO: 16650 - protein, 9 aa, Homo Sapiens
IPPNGEKKA

SEQ ID NO: 16651 - protein, 9 aa, Homo Sapiens
SKLSDTIQV

SEQ ID NO: 16652 - protein, 9 aa, Homo Sapiens
GHIAIAMRL

SEQ ID NO: 16653 - protein, 9 aa, Homo Sapiens
KTKQIMSPV

SEQ ID NO: 16654 - protein, 9 aa, Homo Sapiens
LYGYLPEPS

SEQ ID NO: 16655 - protein, 9 aa, Homo Sapiens
GKARCSSED

SEQ ID NO: 16656 - protein, 9 aa, Homo Sapiens
CKLLYIRLA

SEQ ID NO: 16657 - protein, 9 aa, Homo Sapiens
LPWDTVSTL

SEQ ID NO: 16658 - protein, 9 aa, Homo Sapiens
NLSMPDKPV

SEQ ID NO: 16659 - protein, 9 aa, Homo Sapiens
FKTKQIMSP

SEQ ID NO: 16660 - protein, 9 aa, Homo Sapiens
EMPEPLAPK

SEQ ID NO: 16661 - protein, 9 aa, Homo Sapiens
FALYFAVVN

SEQ ID NO: 16662 - protein, 9 aa, Homo Sapiens
SGFRSLGYE

SEQ ID NO: 16663 - protein, 9 aa, Homo Sapiens
SFSYEVGSE

SEQ ID NO: 16664 - protein, 9 aa, Homo Sapiens
DRQMKDYGP

SEQ ID NO: 16665 - protein, 9 aa, Homo Sapiens
ELAFRRQSS

SEQ ID NO: 16666 - protein, 9 aa, Homo Sapiens
PSHLLSNSQ

SEQ ID NO: 16667 - protein, 9 aa, Homo Sapiens
KQPREWSAS

SEQ ID NO: 16668 - protein, 9 aa, Homo Sapiens
TNSDSVQSL

SEQ ID NO: 16669 - protein, 9 aa, Homo Sapiens
CRNVTSNDK

SEQ ID NO: 16670 - protein, 9 aa, Homo Sapiens
ATVSSTCSS

SEQ ID NO: 16671 - protein, 9 aa, Homo Sapiens
FRAITHPSW

SEQ ID NO: 16672 - protein, 9 aa, Homo Sapiens
LAISFESTE

SEQ ID NO: 16673 - protein, 9 aa, Homo Sapiens
IQIGVFSGL

SEQ ID NO: 16674 - protein, 9 aa, Homo Sapiens
NSVNLKNIL

SEQ ID NO: 16675 - protein, 9 aa, Homo Sapiens
FTKKEVKQE

SEQ ID NO: 16676 - protein, 9 aa, Homo Sapiens
NDPGSNQDT

SEQ ID NO: 16677 - protein, 9 aa, Homo Sapiens
LSASASSAS

SEQ ID NO: 16678 - protein, 9 aa, Homo Sapiens
EEEEEDNQE

SEQ ID NO: 16679 - protein, 9 aa, Homo Sapiens
PAALVRALL

SEQ ID NO: 16680 - protein, 9 aa, Homo Sapiens
LKNILQWES

SEQ ID NO: 16681 - protein, 9 aa, Homo Sapiens
NLKNILQWE

SEQ ID NO: 16682 - protein, 9 aa, Homo Sapiens
CGGGKALAV

SEQ ID NO: 16683 - protein, 9 aa, Homo Sapiens
QDVLCDKVN

SEQ ID NO: 16684 - protein, 9 aa, Homo Sapiens
KEFFMENSS

SEQ ID NO: 16685 - protein, 9 aa, Homo Sapiens
IYLNDSVCD

SEQ ID NO: 16686 - protein, 9 aa, Homo Sapiens
PTVKWMKDS

SEQ ID NO: 16687 - protein, 9 aa, Homo Sapiens
KTGLLSVAK

SEQ ID NO: 16688 - protein, 9 aa, Homo Sapiens
VLIGFLYGN

SEQ ID NO: 16689 - protein, 9 aa, Homo Sapiens
NQGDEGDAR

SEQ ID NO: 16690 - protein, 9 aa, Homo Sapiens
EGSGRSNKL

SEQ ID NO: 16691 - protein, 9 aa, Homo Sapiens
LVSAYTLNT

SEQ ID NO: 16692 - protein, 9 aa, Homo Sapiens
KLREEIRKG

SEQ ID NO: 16693 - protein, 9 aa, Homo Sapiens
YLSHQQMQE

SEQ ID NO: 16694 - protein, 9 aa, Homo Sapiens
CTLANGKPP

SEQ ID NO: 16695 - protein, 9 aa, Homo Sapiens
SQVRCRKQK

SEQ ID NO: 16696 - protein, 9 aa, Homo Sapiens
EQIAMLRLE

SEQ ID NO: 16697 - protein, 9 aa, Homo Sapiens
CLYEANDTR

SEQ ID NO: 16698 - protein, 9 aa, Homo Sapiens
SAAPTLTRV

SEQ ID NO: 16699 - protein, 9 aa, Homo Sapiens
LGRAAAAAA

SEQ ID NO: 16700 - protein, 9 aa, Homo Sapiens
PPFSRMNRE

SEQ ID NO: 16701 - protein, 9 aa, Homo Sapiens
SFGRDSDKG

SEQ ID NO: 16702 - protein, 9 aa, Homo Sapiens
RMQKRAEQF

SEQ ID NO: 16703 - protein, 9 aa, Homo Sapiens
AAGAKKGKA

SEQ ID NO: 16704 - protein, 9 aa, Homo Sapiens
GSLGPRGDP

SEQ ID NO: 16705 - protein, 9 aa, Homo Sapiens
EKTPSHLLS

SEQ ID NO: 16706 - protein, 9 aa, Homo Sapiens
LPGPLPASH

SEQ ID NO: 16707 - protein, 9 aa, Homo Sapiens
GPLQREPVR

SEQ ID NO: 16708 - protein, 9 aa, Homo Sapiens
EYEHIRREN

SEQ ID NO: 16709 - protein, 9 aa, Homo Sapiens
MAARAGFQF

SEQ ID NO: 16710 - protein, 9 aa, Homo Sapiens
RSIGLRGER

SEQ ID NO: 16711 - protein, 9 aa, Homo Sapiens
NFNKCFLNV

SEQ ID NO: 16712 - protein, 9 aa, Homo Sapiens
TAFSVALDL

SEQ ID NO: 16713 - protein, 9 aa, Homo Sapiens
YKPMQMYVL

SEQ ID NO: 16714 - protein, 9 aa, Homo Sapiens
QSHLKGHNI

SEQ ID NO: 16715 - protein, 9 aa, Homo Sapiens
GNLSMPDKP

SEQ ID NO: 16716 - protein, 9 aa, Homo Sapiens
DTAFSVALD

SEQ ID NO: 16717 - protein, 9 aa, Homo Sapiens
DKGKLEKTS

SEQ ID NO: 16718 - protein, 9 aa, Homo Sapiens
AVLYCGATL

SEQ ID NO: 16719 - protein, 9 aa, Homo Sapiens
VQPTLLYMD

SEQ ID NO: 16720 - protein, 9 aa, Homo Sapiens
CLDCPKLKA

SEQ ID NO: 16721 - protein, 9 aa, Homo Sapiens
GDPSPTVKW

SEQ ID NO: 16722 - protein, 9 aa, Homo Sapiens
PDKVGDWMV

SEQ ID NO: 16723 - protein, 9 aa, Homo Sapiens
LECVREGEE

SEQ ID NO: 16724 - protein, 9 aa, Homo Sapiens
VIRERRCTL

SEQ ID NO: 16725 - protein, 9 aa, Homo Sapiens
KKPQTQGRR

SEQ ID NO: 16726 - protein, 9 aa, Homo Sapiens
CINPEDYKK

SEQ ID NO: 16727 - protein, 9 aa, Homo Sapiens
AMFVLSKGH

SEQ ID NO: 16728 - protein, 9 aa, Homo Sapiens
EEKQWGPLQ

SEQ ID NO: 16729 - protein, 9 aa, Homo Sapiens
WNSHQDLQA

SEQ ID NO: 16730 - protein, 9 aa, Homo Sapiens
IQEYIEDYN

SEQ ID NO: 16731 - protein, 9 aa, Homo Sapiens
VGNKRSDPE

SEQ ID NO: 16732 - protein, 9 aa, Homo Sapiens
FPVSISRNC

SEQ ID NO: 16733 - protein, 9 aa, Homo Sapiens
EAMEHPYLY

SEQ ID NO: 16734 - protein, 9 aa, Homo Sapiens
LFTTASVYD

SEQ ID NO: 16735 - protein, 9 aa, Homo Sapiens
KRKKIITNN

SEQ ID NO: 16736 - protein, 9 aa, Homo Sapiens
MINLGRLQG

SEQ ID NO: 16737 - protein, 9 aa, Homo Sapiens
LQTRHEQEQ

SEQ ID NO: 16738 - protein, 9 aa, Homo Sapiens
KNLNDSGIQ

SEQ ID NO: 16739 - protein, 9 aa, Homo Sapiens
NRSKEFFME

SEQ ID NO: 16740 - protein, 9 aa, Homo Sapiens
IPPRRSGAG

SEQ ID NO: 16741 - protein, 9 aa, Homo Sapiens
REQLENALG

SEQ ID NO: 16742 - protein, 9 aa, Homo Sapiens
LHFWSTVEG

SEQ ID NO: 16743 - protein, 9 aa, Homo Sapiens
VKLELAFRR

SEQ ID NO: 16744 - protein, 9 aa, Homo Sapiens
QTQGRRPIC

SEQ ID NO: 16745 - protein, 9 aa, Homo Sapiens
GTSVRPCSR

SEQ ID NO: 16746 - protein, 9 aa, Homo Sapiens
ASPQGGHIA

SEQ ID NO: 16747 - protein, 9 aa, Homo Sapiens
PTPHSDQRE

SEQ ID NO: 16748 - protein, 9 aa, Homo Sapiens
YLTSSRFFR

SEQ ID NO: 16749 - protein, 9 aa, Homo Sapiens
FQFVAPSGG

SEQ ID NO: 16750 - protein, 9 aa, Homo Sapiens
HPYLYTVVK

SEQ ID NO: 16751 - protein, 9 aa, Homo Sapiens
FNFVSWIAL

SEQ ID NO: 16752 - protein, 9 aa, Homo Sapiens
TSNDKVLFN

SEQ ID NO: 16753 - protein, 9 aa, Homo Sapiens
SEPMRQQGL

SEQ ID NO: 16754 - protein, 9 aa, Homo Sapiens
SLGYEGCGF

SEQ ID NO: 16755 - protein, 9 aa, Homo Sapiens
LYPYTTSQG

SEQ ID NO: 16756 - protein, 9 aa, Homo Sapiens
FQEDLGSPA

SEQ ID NO: 16757 - protein, 9 aa, Homo Sapiens
SPELSTCGP

SEQ ID NO: 16758 - protein, 9 aa, Homo Sapiens
CVKACLNFT

SEQ ID NO: 16759 - protein, 9 aa, Homo Sapiens
GLYGLPWRS

SEQ ID NO: 16760 - protein, 9 aa, Homo Sapiens
EDYHQFYED

SEQ ID NO: 16761 - protein, 9 aa, Homo Sapiens
ENSMLREKM

SEQ ID NO: 16762 - protein, 9 aa, Homo Sapiens
WSKKQKMNT

SEQ ID NO: 16763 - protein, 9 aa, Homo Sapiens
PLAPKSYPE

SEQ ID NO: 16764 - protein, 9 aa, Homo Sapiens
TEDSPLILS

SEQ ID NO: 16765 - protein, 9 aa, Homo Sapiens
SRSLFSSVR

SEQ ID NO: 16766 - protein, 9 aa, Homo Sapiens
FVKDAVLYC

SEQ ID NO: 16767 - protein, 9 aa, Homo Sapiens
DFSRSVPEL

SEQ ID NO: 16768 - protein, 9 aa, Homo Sapiens
QEKTPSHLL

SEQ ID NO: 16769 - protein, 9 aa, Homo Sapiens
FLQPEGKPT

SEQ ID NO: 16770 - protein, 9 aa, Homo Sapiens
ALPGDREAA

SEQ ID NO: 16771 - protein, 9 aa, Homo Sapiens
ECLDCPKLK

SEQ ID NO: 16772 - protein, 9 aa, Homo Sapiens
VIQEYIEDY

SEQ ID NO: 16773 - protein, 9 aa, Homo Sapiens
SGQRAAEPR

SEQ ID NO: 16774 - protein, 9 aa, Homo Sapiens
SPRAMFVLS

SEQ ID NO: 16775 - protein, 9 aa, Homo Sapiens
GFRSLGYEG

SEQ ID NO: 16776 - protein, 9 aa, Homo Sapiens
GHVERALQT

SEQ ID NO: 16777 - protein, 9 aa, Homo Sapiens
TVDDATDAW

SEQ ID NO: 16778 - protein, 9 aa, Homo Sapiens
IHTEQKPYK

SEQ ID NO: 16779 - protein, 9 aa, Homo Sapiens
LPAPSFSYE

SEQ ID NO: 16780 - protein, 9 aa, Homo Sapiens
VVVSEEEEE

SEQ ID NO: 16781 - protein, 9 aa, Homo Sapiens
KELECVREG

SEQ ID NO: 16782 - protein, 9 aa, Homo Sapiens
QMPTRMEKE

SEQ ID NO: 16783 - protein, 9 aa, Homo Sapiens
DVVVTEDSP

SEQ ID NO: 16784 - protein, 9 aa, Homo Sapiens
QTVSKNLND

SEQ ID NO: 16785 - protein, 9 aa, Homo Sapiens
AGDTYVCTS

SEQ ID NO: 16786 - protein, 9 aa, Homo Sapiens
EKLPEYVFE

SEQ ID NO: 16787 - protein, 9 aa, Homo Sapiens
SNDKVLFNV

SEQ ID NO: 16788 - protein, 9 aa, Homo Sapiens
INLGRLQGF

SEQ ID NO: 16789 - protein, 9 aa, Homo Sapiens
PEPSRHMST

SEQ ID NO: 16790 - protein, 9 aa, Homo Sapiens
YQAGDTYVC

SEQ ID NO: 16791 - protein, 9 aa, Homo Sapiens
GGAFAAPAA

SEQ ID NO: 16792 - protein, 9 aa, Homo Sapiens
VVVTEDSPL

SEQ ID NO: 16793 - protein, 9 aa, Homo Sapiens
AVKSLKSKL

SEQ ID NO: 16794 - protein, 9 aa, Homo Sapiens
ALYEVGAGT

SEQ ID NO: 16795 - protein, 9 aa, Homo Sapiens
SPTHLPWDT

SEQ ID NO: 16796 - protein, 9 aa, Homo Sapiens
HPPDFQMMI

SEQ ID NO: 16797 - protein, 9 aa, Homo Sapiens
PQNEIAHNG

SEQ ID NO: 16798 - protein, 9 aa, Homo Sapiens
ALLQPPLKG

SEQ ID NO: 16799 - protein, 9 aa, Homo Sapiens
PSGQRAAEP

SEQ ID NO: 16800 - protein, 9 aa, Homo Sapiens
SDTIQVYQE

SEQ ID NO: 16801 - protein, 9 aa, Homo Sapiens
AISFESTEP

SEQ ID NO: 16802 - protein, 9 aa, Homo Sapiens
NSTLVGNKR

SEQ ID NO: 16803 - protein, 9 aa, Homo Sapiens
LYHTVPVMW

SEQ ID NO: 16804 - protein, 9 aa, Homo Sapiens
HSGRVLCQT

SEQ ID NO: 16805 - protein, 9 aa, Homo Sapiens
KLPSPLAAL

SEQ ID NO: 16806 - protein, 9 aa, Homo Sapiens
RIPPRRSGA

SEQ ID NO: 16807 - protein, 9 aa, Homo Sapiens
AILVCYFCE

SEQ ID NO: 16808 - protein, 9 aa, Homo Sapiens
QPGPTRWQQ

SEQ ID NO: 16809 - protein, 9 aa, Homo Sapiens
TPHSDQRED

SEQ ID NO: 16810 - protein, 9 aa, Homo Sapiens
LPPPLRPSG

SEQ ID NO: 16811 - protein, 9 aa, Homo Sapiens
PSVQPTLLY

SEQ ID NO: 16812 - protein, 9 aa, Homo Sapiens
LPEPAASSQ

SEQ ID NO: 16813 - protein, 9 aa, Homo Sapiens
KRASQLHQR

SEQ ID NO: 16814 - protein, 9 aa, Homo Sapiens
SMEKVDRLA

SEQ ID NO: 16815 - protein, 9 aa, Homo Sapiens
CSSDKAGMG

SEQ ID NO: 16816 - protein, 9 aa, Homo Sapiens
DGLRMFMTR

SEQ ID NO: 16817 - protein, 9 aa, Homo Sapiens
LAGTEATLS

SEQ ID NO: 16818 - protein, 9 aa, Homo Sapiens
PTLLYMDME

SEQ ID NO: 16819 - protein, 9 aa, Homo Sapiens
NYSCEPNCE

SEQ ID NO: 16820 - protein, 9 aa, Homo Sapiens
LHKVKGVLQ

SEQ ID NO: 16821 - protein, 9 aa, Homo Sapiens
QMKMKWESL

SEQ ID NO: 16822 - protein, 9 aa, Homo Sapiens
PQTQGRRPI

SEQ ID NO: 16823 - protein, 9 aa, Homo Sapiens
LSHAVPLPN

SEQ ID NO: 16824 - protein, 9 aa, Homo Sapiens
VCDGAVGYS

SEQ ID NO: 16825 - protein, 9 aa, Homo Sapiens
EGDAREGEN

SEQ ID NO: 16826 - protein, 9 aa, Homo Sapiens
SSVRSKPPM

SEQ ID NO: 16827 - protein, 9 aa, Homo Sapiens
ERRVDDRRS

SEQ ID NO: 16828 - protein, 9 aa, Homo Sapiens
GKDHHGRMM

SEQ ID NO: 16829 - protein, 9 aa, Homo Sapiens
SKNLNDSGI

SEQ ID NO: 16830 - protein, 9 aa, Homo Sapiens
KPIKVSYDE

SEQ ID NO: 16831 - protein, 9 aa, Homo Sapiens
PMRQQGLPP

SEQ ID NO: 16832 - protein, 9 aa, Homo Sapiens
YCSHLRQHE

SEQ ID NO: 16833 - protein, 9 aa, Homo Sapiens
DEGDAREGE

SEQ ID NO: 16834 - protein, 9 aa, Homo Sapiens
LEIYKRKKI

SEQ ID NO: 16835 - protein, 9 aa, Homo Sapiens
FLDCSDHPM

SEQ ID NO: 16836 - protein, 9 aa, Homo Sapiens
NCTEDRFTL

SEQ ID NO: 16837 - protein, 9 aa, Homo Sapiens
RSNKLARGQ

SEQ ID NO: 16838 - protein, 9 aa, Homo Sapiens
PALVPGILD

SEQ ID NO: 16839 - protein, 9 aa, Homo Sapiens
QQREEVRGT

SEQ ID NO: 16840 - protein, 9 aa, Homo Sapiens
PQKPQQPTP

SEQ ID NO: 16841 - protein, 9 aa, Homo Sapiens
EGCGFPSLG

SEQ ID NO: 16842 - protein, 9 aa, Homo Sapiens
LSYIPKDNR

SEQ ID NO: 16843 - protein, 9 aa, Homo Sapiens
GKPIKVSYD

SEQ ID NO: 16844 - protein, 9 aa, Homo Sapiens
MKMKWESLH

SEQ ID NO: 16845 - protein, 9 aa, Homo Sapiens
KVDRLARKP

SEQ ID NO: 16846 - protein, 9 aa, Homo Sapiens
YGVFPVAPA

SEQ ID NO: 16847 - protein, 9 aa, Homo Sapiens
IDKAMSVSD

SEQ ID NO: 16848 - protein, 9 aa, Homo Sapiens
HTEQKPYKY

SEQ ID NO: 16849 - protein, 9 aa, Homo Sapiens
DMINLGRLQ

SEQ ID NO: 16850 - protein, 9 aa, Homo Sapiens
CGPGCMKTC

SEQ ID NO: 16851 - protein, 9 aa, Homo Sapiens
DQQHRQWFF

SEQ ID NO: 16852 - protein, 9 aa, Homo Sapiens
DHGFPGSLG

SEQ ID NO: 16853 - protein, 9 aa, Homo Sapiens
STELAISFE

SEQ ID NO: 16854 - protein, 9 aa, Homo Sapiens
SSPNENVAI

SEQ ID NO: 16855 - protein, 9 aa, Homo Sapiens
NYSFNDLSS

SEQ ID NO: 16856 - protein, 9 aa, Homo Sapiens
PIKVSYDEW

SEQ ID NO: 16857 - protein, 9 aa, Homo Sapiens
AFPVSPALV

SEQ ID NO: 16858 - protein, 9 aa, Homo Sapiens
YHKKIHTEQ

SEQ ID NO: 16859 - protein, 9 aa, Homo Sapiens
KPQTQGRRP

SEQ ID NO: 16860 - protein, 9 aa, Homo Sapiens
LVRALLQPP

SEQ ID NO: 16861 - protein, 9 aa, Homo Sapiens
TLRCHLLPE

SEQ ID NO: 16862 - protein, 9 aa, Homo Sapiens
SFNDLSSEI

SEQ ID NO: 16863 - protein, 9 aa, Homo Sapiens
PVYGFMFLF

SEQ ID NO: 16864 - protein, 9 aa, Homo Sapiens
NDSPELSTC

SEQ ID NO: 16865 - protein, 9 aa, Homo Sapiens
ILVCYFCEY

SEQ ID NO: 16866 - protein, 9 aa, Homo Sapiens
ILYHTVPVM

SEQ ID NO: 16867 - protein, 9 aa, Homo Sapiens
VCTSDYKDN

SEQ ID NO: 16868 - protein, 9 aa, Homo Sapiens
KTTKFLDCS

SEQ ID NO: 16869 - protein, 9 aa, Homo Sapiens
GHNDSPELS

SEQ ID NO: 16870 - protein, 9 aa, Homo Sapiens
LSVPPAAFQ

SEQ ID NO: 16871 - protein, 9 aa, Homo Sapiens
PGTWSSKAT

SEQ ID NO: 16872 - protein, 9 aa, Homo Sapiens
SKLETEQET

SEQ ID NO: 16873 - protein, 9 aa, Homo Sapiens
PTDCGPMGQ

SEQ ID NO: 16874 - protein, 9 aa, Homo Sapiens
VDILWSNPM

SEQ ID NO: 16875 - protein, 9 aa, Homo Sapiens
TVHLVLRLR

SEQ ID NO: 16876 - protein, 9 aa, Homo Sapiens
ESTVHLVLR

SEQ ID NO: 16877 - protein, 9 aa, Homo Sapiens
LLSVPPAAF

SEQ ID NO: 16878 - protein, 9 aa, Homo Sapiens
LWAILVCYF

SEQ ID NO: 16879 - protein, 9 aa, Homo Sapiens
PGPTRWQQR

SEQ ID NO: 16880 - protein, 9 aa, Homo Sapiens
GRAEAPAAG

SEQ ID NO: 16881 - protein, 9 aa, Homo Sapiens
GGHLYPYTT

SEQ ID NO: 16882 - protein, 9 aa, Homo Sapiens
QGGHIAIAM

SEQ ID NO: 16883 - protein, 9 aa, Homo Sapiens
GSQSLALSA

SEQ ID NO: 16884 - protein, 9 aa, Homo Sapiens
SMLREKMHR

SEQ ID NO: 16885 - protein, 9 aa, Homo Sapiens
FCEQLNKDF

SEQ ID NO: 16886 - protein, 9 aa, Homo Sapiens
LKGQLALSF

SEQ ID NO: 16887 - protein, 9 aa, Homo Sapiens
HIAIAMRLR

SEQ ID NO: 16888 - protein, 9 aa, Homo Sapiens
VPDALDYKS

SEQ ID NO: 16889 - protein, 9 aa, Homo Sapiens
QAVGDLKQA

SEQ ID NO: 16890 - protein, 9 aa, Homo Sapiens
TKREQLENA

SEQ ID NO: 16891 - protein, 9 aa, Homo Sapiens
ALFTTASVY

SEQ ID NO: 16892 - protein, 9 aa, Homo Sapiens
VAQAVGVSE

SEQ ID NO: 16893 - protein, 9 aa, Homo Sapiens
PYTTSQGLA

SEQ ID NO: 16894 - protein, 9 aa, Homo Sapiens
SQSLALSAA

SEQ ID NO: 16895 - protein, 9 aa, Homo Sapiens
EYRSGQSSG

SEQ ID NO: 16896 - protein, 9 aa, Homo Sapiens
MIQIGVFSG

SEQ ID NO: 16897 - protein, 9 aa, Homo Sapiens
VRMNSVNLK

SEQ ID NO: 16898 - protein, 9 aa, Homo Sapiens
PRKSMCKLL

SEQ ID NO: 16899 - protein, 9 aa, Homo Sapiens
ESKMMQVIQ

SEQ ID NO: 16900 - protein, 9 aa, Homo Sapiens
ADKVHCDRQ

SEQ ID NO: 16901 - protein, 9 aa, Homo Sapiens
SDKGKLEKT

SEQ ID NO: 16902 - protein, 9 aa, Homo Sapiens
WNHIDENGK

SEQ ID NO: 16903 - protein, 9 aa, Homo Sapiens
EEEEDNQEE

SEQ ID NO: 16904 - protein, 9 aa, Homo Sapiens
VGVSEGHHT

SEQ ID NO: 16905 - protein, 9 aa, Homo Sapiens
LESIDNEED

SEQ ID NO: 16906 - protein, 9 aa, Homo Sapiens
NEIFTKKEV

SEQ ID NO: 16907 - protein, 9 aa, Homo Sapiens
FAYAFAALV

SEQ ID NO: 16908 - protein, 9 aa, Homo Sapiens
TFEGSGRSN

SEQ ID NO: 16909 - protein, 9 aa, Homo Sapiens
LLAHWPAKH

SEQ ID NO: 16910 - protein, 9 aa, Homo Sapiens
TTSKPGRGD

SEQ ID NO: 16911 - protein, 9 aa, Homo Sapiens
SPDEEGRAE

SEQ ID NO: 16912 - protein, 9 aa, Homo Sapiens
GSSSSSSLS

SEQ ID NO: 16913 - protein, 9 aa, Homo Sapiens
GCCYLKLLS

SEQ ID NO: 16914 - protein, 9 aa, Homo Sapiens
KDLHPDHML

SEQ ID NO: 16915 - protein, 9 aa, Homo Sapiens
FLFLMQKIQ

SEQ ID NO: 16916 - protein, 9 aa, Homo Sapiens
AASRTTSKP

SEQ ID NO: 16917 - protein, 9 aa, Homo Sapiens
MGGHLYPYT

SEQ ID NO: 16918 - protein, 9 aa, Homo Sapiens
GENTGTSGG

SEQ ID NO: 16919 - protein, 9 aa, Homo Sapiens
QKPSAIQQR

SEQ ID NO: 16920 - protein, 9 aa, Homo Sapiens
RDSDKGKLE

SEQ ID NO: 16921 - protein, 9 aa, Homo Sapiens
AFLFLMQKI

SEQ ID NO: 16922 - protein, 9 aa, Homo Sapiens
ETGSQVRCR

SEQ ID NO: 16923 - protein, 9 aa, Homo Sapiens
RMFMTRDLD

SEQ ID NO: 16924 - protein, 9 aa, Homo Sapiens
AEEEEEDNQ

SEQ ID NO: 16925 - protein, 9 aa, Homo Sapiens
DREAALNDS

SEQ ID NO: 16926 - protein, 9 aa, Homo Sapiens
EQKPYKYEE

SEQ ID NO: 16927 - protein, 9 aa, Homo Sapiens
LPEKNAEDM

SEQ ID NO: 16928 - protein, 9 aa, Homo Sapiens
LALHMEIAT

SEQ ID NO: 16929 - protein, 9 aa, Homo Sapiens
ALRNLLAHW

SEQ ID NO: 16930 - protein, 9 aa, Homo Sapiens
GDELRKPDD

SEQ ID NO: 16931 - protein, 9 aa, Homo Sapiens
TWSSKATSV

SEQ ID NO: 16932 - protein, 9 aa, Homo Sapiens
FFKTVGLFA

SEQ ID NO: 16933 - protein, 9 aa, Homo Sapiens
ASRTTSKPG

SEQ ID NO: 16934 - protein, 9 aa, Homo Sapiens
ESADFWCFQ

SEQ ID NO: 16935 - protein, 9 aa, Homo Sapiens
LRAGAWLPG

SEQ ID NO: 16936 - protein, 9 aa, Homo Sapiens
GATECINPE

SEQ ID NO: 16937 - protein, 9 aa, Homo Sapiens
LNTMFWVYL

SEQ ID NO: 16938 - protein, 9 aa, Homo Sapiens
RGPHGTFFG

SEQ ID NO: 16939 - protein, 9 aa, Homo Sapiens
YKRKKIITN

SEQ ID NO: 16940 - protein, 9 aa, Homo Sapiens
GLSGAQIPN

SEQ ID NO: 16941 - protein, 9 aa, Homo Sapiens
QQGLPPPLR

SEQ ID NO: 16942 - protein, 9 aa, Homo Sapiens
FPGSLGPRG

SEQ ID NO: 16943 - protein, 9 aa, Homo Sapiens
QLQCNEMYI

SEQ ID NO: 16944 - protein, 9 aa, Homo Sapiens
QCGKTFNQS

SEQ ID NO: 16945 - protein, 9 aa, Homo Sapiens
ERARQGAKE

SEQ ID NO: 16946 - protein, 9 aa, Homo Sapiens
MSVSDSIIT

SEQ ID NO: 16947 - protein, 9 aa, Homo Sapiens
WAILVCYFC

SEQ ID NO: 16948 - protein, 9 aa, Homo Sapiens
DSAYTLRLE

SEQ ID NO: 16949 - protein, 9 aa, Homo Sapiens
MAGALRQGR

SEQ ID NO: 16950 - protein, 9 aa, Homo Sapiens
KYSVGVKKN

SEQ ID NO: 16951 - protein, 9 aa, Homo Sapiens
ALRQGRALG

SEQ ID NO: 16952 - protein, 9 aa, Homo Sapiens
LFLSASHCR

SEQ ID NO: 16953 - protein, 9 aa, Homo Sapiens
FMENSSRQR

SEQ ID NO: 16954 - protein, 9 aa, Homo Sapiens
PRLLPSGAQ

SEQ ID NO: 16955 - protein, 9 aa, Homo Sapiens
TLLYMDMEG

SEQ ID NO: 16956 - protein, 9 aa, Homo Sapiens
DLEKELECV

SEQ ID NO: 16957 - protein, 9 aa, Homo Sapiens
SHPAFAQGK

SEQ ID NO: 16958 - protein, 9 aa, Homo Sapiens
GFFKTVGLF

SEQ ID NO: 16959 - protein, 9 aa, Homo Sapiens
QSVITNQLN

SEQ ID NO: 16960 - protein, 9 aa, Homo Sapiens
ATTSRDSAY

SEQ ID NO: 16961 - protein, 9 aa, Homo Sapiens
YGFMFLFKW

SEQ ID NO: 16962 - protein, 9 aa, Homo Sapiens
DQEQLLRRL

SEQ ID NO: 16963 - protein, 9 aa, Homo Sapiens
LGGPGGAFA

SEQ ID NO: 16964 - protein, 9 aa, Homo Sapiens
TTKFLDCSD

SEQ ID NO: 16965 - protein, 9 aa, Homo Sapiens
PKSYPESVC

SEQ ID NO: 16966 - protein, 9 aa, Homo Sapiens
LWLDGNNLL

SEQ ID NO: 16967 - protein, 9 aa, Homo Sapiens
CSVQMAMSR

SEQ ID NO: 16968 - protein, 9 aa, Homo Sapiens
GLRQNEDVW

SEQ ID NO: 16969 - protein, 9 aa, Homo Sapiens
TVCNVKLLY

SEQ ID NO: 16970 - protein, 9 aa, Homo Sapiens
LQDVFVGVS

SEQ ID NO: 16971 - protein, 9 aa, Homo Sapiens
VRHSQDVLC

SEQ ID NO: 16972 - protein, 9 aa, Homo Sapiens
GQGGRTPHK

SEQ ID NO: 16973 - protein, 9 aa, Homo Sapiens
PAFPVSPAL

SEQ ID NO: 16974 - protein, 9 aa, Homo Sapiens
KDAVLYCGA

SEQ ID NO: 16975 - protein, 9 aa, Homo Sapiens
KQNSTLVGN

SEQ ID NO: 16976 - protein, 9 aa, Homo Sapiens
DPLKNLWLP

SEQ ID NO: 16977 - protein, 9 aa, Homo Sapiens
RSKEFFMEN

SEQ ID NO: 16978 - protein, 9 aa, Homo Sapiens
GDDDWQSVI

SEQ ID NO: 16979 - protein, 9 aa, Homo Sapiens
YVFENKNSD

SEQ ID NO: 16980 - protein, 9 aa, Homo Sapiens
DQMKMKWES

SEQ ID NO: 16981 - protein, 9 aa, Homo Sapiens
AAESGGTSV

SEQ ID NO: 16982 - protein, 9 aa, Homo Sapiens
MARPRKARE

SEQ ID NO: 16983 - protein, 9 aa, Homo Sapiens
LVCYFCEYW

SEQ ID NO: 16984 - protein, 9 aa, Homo Sapiens
KNFNKCFLN

SEQ ID NO: 16985 - protein, 9 aa, Homo Sapiens
NKLARGQAA

SEQ ID NO: 16986 - protein, 9 aa, Homo Sapiens
QKPYKYEEC

SEQ ID NO: 16987 - protein, 9 aa, Homo Sapiens
RHSQDVLCD

SEQ ID NO: 16988 - protein, 9 aa, Homo Sapiens
MSLKLALHM

SEQ ID NO: 16989 - protein, 9 aa, Homo Sapiens
TDVGSCTVV

SEQ ID NO: 16990 - protein, 9 aa, Homo Sapiens
EKMHRRFEN

SEQ ID NO: 16991 - protein, 9 aa, Homo Sapiens
RKPDDDKPT

SEQ ID NO: 16992 - protein, 9 aa, Homo Sapiens
SLSCLGGSQ

SEQ ID NO: 16993 - protein, 9 aa, Homo Sapiens
KALAVPFEP

SEQ ID NO: 16994 - protein, 9 aa, Homo Sapiens
PLDKEKGKT

SEQ ID NO: 16995 - protein, 9 aa, Homo Sapiens
KVHCDRQMK

SEQ ID NO: 16996 - protein, 9 aa, Homo Sapiens
GHREYRSGQ

SEQ ID NO: 16997 - protein, 9 aa, Homo Sapiens
ITKREQLEN

SEQ ID NO: 16998 - protein, 9 aa, Homo Sapiens
VSVQTVSKN

SEQ ID NO: 16999 - protein, 9 aa, Homo Sapiens
GVSEGHHTK

SEQ ID NO: 17000 - protein, 9 aa, Homo Sapiens
AGTELISDT

SEQ ID NO: 17001 - protein, 9 aa, Homo Sapiens
LKNLWLPRE

SEQ ID NO: 17002 - protein, 9 aa, Homo Sapiens
GQRAAEPRL

SEQ ID NO: 17003 - protein, 9 aa, Homo Sapiens
QLFQEDLGS

SEQ ID NO: 17004 - protein, 9 aa, Homo Sapiens
TTATVSSTC

SEQ ID NO: 17005 - protein, 9 aa, Homo Sapiens
KSFGRDSDK

SEQ ID NO: 17006 - protein, 9 aa, Homo Sapiens
KKPEDPSAL

SEQ ID NO: 17007 - protein, 9 aa, Homo Sapiens
QGIYEEYEH

SEQ ID NO: 17008 - protein, 9 aa, Homo Sapiens
SKATSVKPL

SEQ ID NO: 17009 - protein, 9 aa, Homo Sapiens
RVLRGGRDL

SEQ ID NO: 17010 - protein, 9 aa, Homo Sapiens
ESIDNEEDE

SEQ ID NO: 17011 - protein, 9 aa, Homo Sapiens
SVQPTLLYM

SEQ ID NO: 17012 - protein, 9 aa, Homo Sapiens
NPLFLQPEG

SEQ ID NO: 17013 - protein, 9 aa, Homo Sapiens
NSMLREQIA

SEQ ID NO: 17014 - protein, 9 aa, Homo Sapiens
AFAAPAAGS

SEQ ID NO: 17015 - protein, 9 aa, Homo Sapiens
GYLPEPSRH

SEQ ID NO: 17016 - protein, 9 aa, Homo Sapiens
EDDVVVTED

SEQ ID NO: 17017 - protein, 9 aa, Homo Sapiens
AGSFAYAFA

SEQ ID NO: 17018 - protein, 9 aa, Homo Sapiens
YEHIRRENP

SEQ ID NO: 17019 - protein, 9 aa, Homo Sapiens
QKESTVHLV

SEQ ID NO: 17020 - protein, 9 aa, Homo Sapiens
LHPDHMLME

SEQ ID NO: 17021 - protein, 9 aa, Homo Sapiens
ANGTAQDGD

SEQ ID NO: 17022 - protein, 9 aa, Homo Sapiens
GGKALAVPF

SEQ ID NO: 17023 - protein, 9 aa, Homo Sapiens
LKMEGHKAM

SEQ ID NO: 17024 - protein, 9 aa, Homo Sapiens
LSVFRAITH

SEQ ID NO: 17025 - protein, 9 aa, Homo Sapiens
RVLCQTEVC

SEQ ID NO: 17026 - protein, 9 aa, Homo Sapiens
GAQIPNGEF

SEQ ID NO: 17027 - protein, 9 aa, Homo Sapiens
YRVLVAEVN

SEQ ID NO: 17028 - protein, 9 aa, Homo Sapiens
LYTVVKDQA

SEQ ID NO: 17029 - protein, 9 aa, Homo Sapiens
QIPNGEFTA

SEQ ID NO: 17030 - protein, 9 aa, Homo Sapiens
PESLVFLST

SEQ ID NO: 17031 - protein, 9 aa, Homo Sapiens
VSAYTLNTM

SEQ ID NO: 17032 - protein, 9 aa, Homo Sapiens
RKAREPLLV

SEQ ID NO: 17033 - protein, 9 aa, Homo Sapiens
NSDSVQSLK

SEQ ID NO: 17034 - protein, 9 aa, Homo Sapiens
LWSNPMAQE

SEQ ID NO: 17035 - protein, 9 aa, Homo Sapiens
MFMTRDLDL

SEQ ID NO: 17036 - protein, 9 aa, Homo Sapiens
PDKPVSDKL

SEQ ID NO: 17037 - protein, 9 aa, Homo Sapiens
GSYAYHKSE

SEQ ID NO: 17038 - protein, 9 aa, Homo Sapiens
EVTTLIPPN

SEQ ID NO: 17039 - protein, 9 aa, Homo Sapiens
KLLYRVLVA

SEQ ID NO: 17040 - protein, 9 aa, Homo Sapiens
TLQVVVSEE

SEQ ID NO: 17041 - protein, 9 aa, Homo Sapiens
PKPNRTSSV

SEQ ID NO: 17042 - protein, 9 aa, Homo Sapiens
KTLQVVVSE

SEQ ID NO: 17043 - protein, 9 aa, Homo Sapiens
PLWAILVCY

SEQ ID NO: 17044 - protein, 9 aa, Homo Sapiens
CFQCEQLLC

SEQ ID NO: 17045 - protein, 9 aa, Homo Sapiens
SHPLFGRLV

SEQ ID NO: 17046 - protein, 9 aa, Homo Sapiens
RTTSKPGRG

SEQ ID NO: 17047 - protein, 9 aa, Homo Sapiens
YCGGGKALA

SEQ ID NO: 17048 - protein, 9 aa, Homo Sapiens
AYHKSEIIY

SEQ ID NO: 17049 - protein, 9 aa, Homo Sapiens
RFMNYSCEP

SEQ ID NO: 17050 - protein, 9 aa, Homo Sapiens
DHMLMEAFF

SEQ ID NO: 17051 - protein, 9 aa, Homo Sapiens
YNIAELQSS

SEQ ID NO: 17052 - protein, 9 aa, Homo Sapiens
RHGKPIKVS

SEQ ID NO: 17053 - protein, 9 aa, Homo Sapiens
LGGSQSLAL

SEQ ID NO: 17054 - protein, 9 aa, Homo Sapiens
PEDYKKPIQ

SEQ ID NO: 17055 - protein, 9 aa, Homo Sapiens
EGVKLELAF

SEQ ID NO: 17056 - protein, 9 aa, Homo Sapiens
RQNEDVWLW

SEQ ID NO: 17057 - protein, 9 aa, Homo Sapiens
GCMKTCDNW

SEQ ID NO: 17058 - protein, 9 aa, Homo Sapiens
RWQQREEVR

SEQ ID NO: 17059 - protein, 9 aa, Homo Sapiens
AVQATKNFN

SEQ ID NO: 17060 - protein, 9 aa, Homo Sapiens
TIKKPQTQG

SEQ ID NO: 17061 - protein, 9 aa, Homo Sapiens
NEDGLRMFM

SEQ ID NO: 17062 - protein, 9 aa, Homo Sapiens
VRALLQPPL

SEQ ID NO: 17063 - protein, 9 aa, Homo Sapiens
AVGDPSPTV

SEQ ID NO: 17064 - protein, 9 aa, Homo Sapiens
DSDKGKLEK

SEQ ID NO: 17065 - protein, 9 aa, Homo Sapiens
DLSSEINWA

SEQ ID NO: 17066 - protein, 9 aa, Homo Sapiens
QIAMLRLEL

SEQ ID NO: 17067 - protein, 9 aa, Homo Sapiens
QEFDLIRTE

SEQ ID NO: 17068 - protein, 9 aa, Homo Sapiens
GGSQSLALS

SEQ ID NO: 17069 - protein, 9 aa, Homo Sapiens
TVSKNLNDS

SEQ ID NO: 17070 - protein, 9 aa, Homo Sapiens
IDQISMEKV

SEQ ID NO: 17071 - protein, 9 aa, Homo Sapiens
NENFILKHT

SEQ ID NO: 17072 - protein, 9 aa, Homo Sapiens
STCSSDKAG

SEQ ID NO: 17073 - protein, 9 aa, Homo Sapiens
ATLSHAKTL

SEQ ID NO: 17074 - protein, 9 aa, Homo Sapiens
LSPTHLPWD

SEQ ID NO: 17075 - protein, 9 aa, Homo Sapiens
AAGFFKTVG

SEQ ID NO: 17076 - protein, 9 aa, Homo Sapiens
ADIKQQNGM

SEQ ID NO: 17077 - protein, 9 aa, Homo Sapiens
LCQTEVCPP

SEQ ID NO: 17078 - protein, 9 aa, Homo Sapiens
DVGSCTVVC

SEQ ID NO: 17079 - protein, 9 aa, Homo Sapiens
IQVYQERIQ

SEQ ID NO: 17080 - protein, 9 aa, Homo Sapiens
PALKQPREW

SEQ ID NO: 17081 - protein, 9 aa, Homo Sapiens
FENENFILK

SEQ ID NO: 17082 - protein, 9 aa, Homo Sapiens
REQKLREEI

SEQ ID NO: 17083 - protein, 9 aa, Homo Sapiens
RMEKEEESE

SEQ ID NO: 17084 - protein, 9 aa, Homo Sapiens
DVLCDKVNE

SEQ ID NO: 17085 - protein, 9 aa, Homo Sapiens
RAGAWLPGA

SEQ ID NO: 17086 - protein, 9 aa, Homo Sapiens
LRQNEDVWL

SEQ ID NO: 17087 - protein, 9 aa, Homo Sapiens
VLSKGHTFL

SEQ ID NO: 17088 - protein, 9 aa, Homo Sapiens
RVLLRAGAW

SEQ ID NO: 17089 - protein, 9 aa, Homo Sapiens
QDVFVGVSA

SEQ ID NO: 17090 - protein, 9 aa, Homo Sapiens
LLLNPTEET

SEQ ID NO: 17091 - protein, 9 aa, Homo Sapiens
NSGMDTAFS

SEQ ID NO: 17092 - protein, 9 aa, Homo Sapiens
PLRPSGQRA

SEQ ID NO: 17093 - protein, 9 aa, Homo Sapiens
SCSKPPLLG

SEQ ID NO: 17094 - protein, 9 aa, Homo Sapiens
GGRGENTGT

SEQ ID NO: 17095 - protein, 9 aa, Homo Sapiens
WQSVITNQL

SEQ ID NO: 17096 - protein, 9 aa, Homo Sapiens
PKQLRFDQH

SEQ ID NO: 17097 - protein, 9 aa, Homo Sapiens
KNLWLPREL

SEQ ID NO: 17098 - protein, 9 aa, Homo Sapiens
QRYLTSSRF

SEQ ID NO: 17099 - protein, 9 aa, Homo Sapiens
FKKQKAEWQ

SEQ ID NO: 17100 - protein, 9 aa, Homo Sapiens
LGYEGCGFP

SEQ ID NO: 17101 - protein, 9 aa, Homo Sapiens
YYQDLLQLQ

SEQ ID NO: 17102 - protein, 9 aa, Homo Sapiens
HENSMLREQ

SEQ ID NO: 17103 - protein, 9 aa, Homo Sapiens
RAMFVLSKG

SEQ ID NO: 17104 - protein, 9 aa, Homo Sapiens
LYRVLVAEV

SEQ ID NO: 17105 - protein, 9 aa, Homo Sapiens
HLCGKAFSY

SEQ ID NO: 17106 - protein, 9 aa, Homo Sapiens
VHCDRQMKD

SEQ ID NO: 17107 - protein, 9 aa, Homo Sapiens
LEKELECVR

SEQ ID NO: 17108 - protein, 9 aa, Homo Sapiens
TKQIMSPVS

SEQ ID NO: 17109 - protein, 9 aa, Homo Sapiens
PSPTVKWMK

SEQ ID NO: 17110 - protein, 9 aa, Homo Sapiens
VMNAYEEQS

SEQ ID NO: 17111 - protein, 9 aa, Homo Sapiens
SKMMQVIQE

SEQ ID NO: 17112 - protein, 9 aa, Homo Sapiens
SRESRGQGG

SEQ ID NO: 17113 - protein, 9 aa, Homo Sapiens
LPGPRLLPS

SEQ ID NO: 17114 - protein, 9 aa, Homo Sapiens
PDHMLMEAF

SEQ ID NO: 17115 - protein, 9 aa, Homo Sapiens
SVPGCCYLK

SEQ ID NO: 17116 - protein, 9 aa, Homo Sapiens
ISPRAMFVL

SEQ ID NO: 17117 - protein, 9 aa, Homo Sapiens
KQGDDYDSK

SEQ ID NO: 17118 - protein, 9 aa, Homo Sapiens
SPQNEIAHN

SEQ ID NO: 17119 - protein, 9 aa, Homo Sapiens
CGATLDEAE

SEQ ID NO: 17120 - protein, 9 aa, Homo Sapiens
VCYFCEYWL

SEQ ID NO: 17121 - protein, 9 aa, Homo Sapiens
ERFQLYYQD

SEQ ID NO: 17122 - protein, 9 aa, Homo Sapiens
EQLPKPNRT

SEQ ID NO: 17123 - protein, 9 aa, Homo Sapiens
QEWFLHFWS

SEQ ID NO: 17124 - protein, 9 aa, Homo Sapiens
EQLNKDFEG

SEQ ID NO: 17125 - protein, 9 aa, Homo Sapiens
RFQLYYQDL

SEQ ID NO: 17126 - protein, 9 aa, Homo Sapiens
RDSAYTLRL

SEQ ID NO: 17127 - protein, 9 aa, Homo Sapiens
HKAMERLKM

SEQ ID NO: 17128 - protein, 9 aa, Homo Sapiens
TKCKEKAKP

SEQ ID NO: 17129 - protein, 9 aa, Homo Sapiens
TTLRCHLLP

SEQ ID NO: 17130 - protein, 9 aa, Homo Sapiens
SLVFLSTCF

SEQ ID NO: 17131 - protein, 9 aa, Homo Sapiens
PRRKATLHT

SEQ ID NO: 17132 - protein, 9 aa, Homo Sapiens
HKGEPTTFQ

SEQ ID NO: 17133 - protein, 9 aa, Homo Sapiens
MFVLSKGHT

SEQ ID NO: 17134 - protein, 9 aa, Homo Sapiens
VLGSLLFAH

SEQ ID NO: 17135 - protein, 9 aa, Homo Sapiens
VHLVLRLRG

SEQ ID NO: 17136 - protein, 9 aa, Homo Sapiens
YPFKTKQIM

SEQ ID NO: 17137 - protein, 9 aa, Homo Sapiens
SGGTSVRPC

SEQ ID NO: 17138 - protein, 9 aa, Homo Sapiens
DRRSFALYF

SEQ ID NO: 17139 - protein, 9 aa, Homo Sapiens
SAKGFGAQG

SEQ ID NO: 17140 - protein, 9 aa, Homo Sapiens
ATLHTKCKE

SEQ ID NO: 17141 - protein, 9 aa, Homo Sapiens
ARAGFQFVA

SEQ ID NO: 17142 - protein, 9 aa, Homo Sapiens
EFFMENSSR

SEQ ID NO: 17143 - protein, 9 aa, Homo Sapiens
SSTTHKGEP

SEQ ID NO: 17144 - protein, 9 aa, Homo Sapiens
PSANRYFTL

SEQ ID NO: 17145 - protein, 9 aa, Homo Sapiens
VCGKIGLIE

SEQ ID NO: 17146 - protein, 9 aa, Homo Sapiens
ISMEKVDRL

SEQ ID NO: 17147 - protein, 9 aa, Homo Sapiens
RAVPQMPTR

SEQ ID NO: 17148 - protein, 9 aa, Homo Sapiens
GFGAQGPDV

SEQ ID NO: 17149 - protein, 9 aa, Homo Sapiens
GLRIPPRRS

SEQ ID NO: 17150 - protein, 9 aa, Homo Sapiens
TGLLSVAKG

SEQ ID NO: 17151 - protein, 9 aa, Homo Sapiens
NSLLAGTEL

SEQ ID NO: 17152 - protein, 9 aa, Homo Sapiens
HMEIATYRK

SEQ ID NO: 17153 - protein, 9 aa, Homo Sapiens
EWSASRRSS

SEQ ID NO: 17154 - protein, 9 aa, Homo Sapiens
TEATLSHAK

SEQ ID NO: 17155 - protein, 9 aa, Homo Sapiens
TPECAAGFF

SEQ ID NO: 17156 - protein, 9 aa, Homo Sapiens
QQPTPRKSP

SEQ ID NO: 17157 - protein, 9 aa, Homo Sapiens
LVATCTLAN

SEQ ID NO: 17158 - protein, 9 aa, Homo Sapiens
QNQSSKDSE

SEQ ID NO: 17159 - protein, 9 aa, Homo Sapiens
SPALVPGIL

SEQ ID NO: 17160 - protein, 9 aa, Homo Sapiens
SSAEDQMKM

SEQ ID NO: 17161 - protein, 9 aa, Homo Sapiens
SVRPCSRPH

SEQ ID NO: 17162 - protein, 9 aa, Homo Sapiens
KESTVHLVL

SEQ ID NO: 17163 - protein, 9 aa, Homo Sapiens
LNIDQLQCN

SEQ ID NO: 17164 - protein, 9 aa, Homo Sapiens
QEYIEDYNQ

SEQ ID NO: 17165 - protein, 9 aa, Homo Sapiens
STTHKGEPT

SEQ ID NO: 17166 - protein, 9 aa, Homo Sapiens
AYTLNTMFW

SEQ ID NO: 17167 - protein, 9 aa, Homo Sapiens
RVQAANPLF

SEQ ID NO: 17168 - protein, 9 aa, Homo Sapiens
RAAESGGTS

SEQ ID NO: 17169 - protein, 9 aa, Homo Sapiens
KPLYQSMNY

SEQ ID NO: 17170 - protein, 9 aa, Homo Sapiens
PTRWQQREE

SEQ ID NO: 17171 - protein, 9 aa, Homo Sapiens
SRSVPELDR

SEQ ID NO: 17172 - protein, 9 aa, Homo Sapiens
QAANPLFLQ

SEQ ID NO: 17173 - protein, 9 aa, Homo Sapiens
QVIQEYIED

SEQ ID NO: 17174 - protein, 9 aa, Homo Sapiens
DYHQFYEDV

SEQ ID NO: 17175 - protein, 9 aa, Homo Sapiens
LRLYGYLPE

SEQ ID NO: 17176 - protein, 9 aa, Homo Sapiens
SLGPRGDPG

SEQ ID NO: 17177 - protein, 9 aa, Homo Sapiens
PGSLGPRGD

SEQ ID NO: 17178 - protein, 9 aa, Homo Sapiens
VGDPSPTVK

SEQ ID NO: 17179 - protein, 9 aa, Homo Sapiens
IEQLPKPNR

SEQ ID NO: 17180 - protein, 9 aa, Homo Sapiens
KKQKAEWQT

SEQ ID NO: 17181 - protein, 9 aa, Homo Sapiens
SCLGGSQSL

SEQ ID NO: 17182 - protein, 9 aa, Homo Sapiens
SVITNQLNK

SEQ ID NO: 17183 - protein, 9 aa, Homo Sapiens
MEGHKAMER

SEQ ID NO: 17184 - protein, 9 aa, Homo Sapiens
LRPSGQRAA

SEQ ID NO: 17185 - protein, 9 aa, Homo Sapiens
DQLLQEGDH

SEQ ID NO: 17186 - protein, 9 aa, Homo Sapiens
ERPRVHFRT

SEQ ID NO: 17187 - protein, 9 aa, Homo Sapiens
LKGTPEVSC

SEQ ID NO: 17188 - protein, 9 aa, Homo Sapiens
AGFQFVAPS

SEQ ID NO: 17189 - protein, 9 aa, Homo Sapiens
SSSTTHKGE

SEQ ID NO: 17190 - protein, 9 aa, Homo Sapiens
LDRTMYLLS

SEQ ID NO: 17191 - protein, 9 aa, Homo Sapiens
YDNACLIVR

SEQ ID NO: 17192 - protein, 9 aa, Homo Sapiens
KFGSYAYHK

SEQ ID NO: 17193 - protein, 9 aa, Homo Sapiens
PQLLPRSQR

SEQ ID NO: 17194 - protein, 9 aa, Homo Sapiens
APHPPDFQM

SEQ ID NO: 17195 - protein, 9 aa, Homo Sapiens
YMEDYHQFY

SEQ ID NO: 17196 - protein, 9 aa, Homo Sapiens
LRGERPRVH

SEQ ID NO: 17197 - protein, 9 aa, Homo Sapiens
SNKLARGQA

SEQ ID NO: 17198 - protein, 9 aa, Homo Sapiens
SSEGLRQNE

SEQ ID NO: 17199 - protein, 9 aa, Homo Sapiens
GFHPSNIEV

SEQ ID NO: 17200 - protein, 9 aa, Homo Sapiens
RKNRSKEFF

SEQ ID NO: 17201 - protein, 9 aa, Homo Sapiens
PSPLAALSE

SEQ ID NO: 17202 - protein, 9 aa, Homo Sapiens
ALKQPREWS

SEQ ID NO: 17203 - protein, 9 aa, Homo Sapiens
TELISDTCL

SEQ ID NO: 17204 - protein, 9 aa, Homo Sapiens
GCLYEANDT

SEQ ID NO: 17205 - protein, 9 aa, Homo Sapiens
VFRAITHPS

SEQ ID NO: 17206 - protein, 9 aa, Homo Sapiens
GPHGTFFGM

SEQ ID NO: 17207 - protein, 9 aa, Homo Sapiens
AVPDALDYK

SEQ ID NO: 17208 - protein, 9 aa, Homo Sapiens
FVLSKGHTF

SEQ ID NO: 17209 - protein, 9 aa, Homo Sapiens
DTVDYDNAC

SEQ ID NO: 17210 - protein, 9 aa, Homo Sapiens
KKIITNNPH

SEQ ID NO: 17211 - protein, 9 aa, Homo Sapiens
FVYEPGAHP

SEQ ID NO: 17212 - protein, 9 aa, Homo Sapiens
VYEPGAHPA

SEQ ID NO: 17213 - protein, 9 aa, Homo Sapiens
TQPPFSRMN

SEQ ID NO: 17214 - protein, 9 aa, Homo Sapiens
LGPPGPEAW

SEQ ID NO: 17215 - protein, 9 aa, Homo Sapiens
KQWGPLQRE

SEQ ID NO: 17216 - protein, 9 aa, Homo Sapiens
SFESTEPSD

SEQ ID NO: 17217 - protein, 9 aa, Homo Sapiens
AESGGTSVR

SEQ ID NO: 17218 - protein, 9 aa, Homo Sapiens
EDRRSFALY

SEQ ID NO: 17219 - protein, 9 aa, Homo Sapiens
HKVKGVLQE

SEQ ID NO: 17220 - protein, 9 aa, Homo Sapiens
DMERFQLYY

SEQ ID NO: 17221 - protein, 9 aa, Homo Sapiens
SGRVLCQTE

SEQ ID NO: 17222 - protein, 9 aa, Homo Sapiens
YSCEPNCET

SEQ ID NO: 17223 - protein, 9 aa, Homo Sapiens
DSVCDGAVG

SEQ ID NO: 17224 - protein, 9 aa, Homo Sapiens
NKRSDPEQN

SEQ ID NO: 17225 - protein, 9 aa, Homo Sapiens
QVVIYETNC

SEQ ID NO: 17226 - protein, 9 aa, Homo Sapiens
GDPESLVFL

SEQ ID NO: 17227 - protein, 9 aa, Homo Sapiens
VVDPLKNLW

SEQ ID NO: 17228 - protein, 9 aa, Homo Sapiens
KKFMIQIGV

SEQ ID NO: 17229 - protein, 9 aa, Homo Sapiens
SQLLFQNNE

SEQ ID NO: 17230 - protein, 9 aa, Homo Sapiens
EIYKRKKII

SEQ ID NO: 17231 - protein, 9 aa, Homo Sapiens
MQVIQEYIE

SEQ ID NO: 17232 - protein, 9 aa, Homo Sapiens
FCSVQMAMS

SEQ ID NO: 17233 - protein, 9 aa, Homo Sapiens
DCKQEAQVV

SEQ ID NO: 17234 - protein, 9 aa, Homo Sapiens
YGYLPEPSR

SEQ ID NO: 17235 - protein, 9 aa, Homo Sapiens
LMQKIQDCS

SEQ ID NO: 17236 - protein, 9 aa, Homo Sapiens
LMSLKLALH

SEQ ID NO: 17237 - protein, 9 aa, Homo Sapiens
GPTRWQQRE

SEQ ID NO: 17238 - protein, 9 aa, Homo Sapiens
RDLGRAAAA

SEQ ID NO: 17239 - protein, 9 aa, Homo Sapiens
LPALPGDRE

SEQ ID NO: 17240 - protein, 9 aa, Homo Sapiens
HHDLNIDQL

SEQ ID NO: 17241 - protein, 9 aa, Homo Sapiens
DTGMQDAKA

SEQ ID NO: 17242 - protein, 9 aa, Homo Sapiens
RMNSVNLKN

SEQ ID NO: 17243 - protein, 9 aa, Homo Sapiens
CKQEAQVVI

SEQ ID NO: 17244 - protein, 9 aa, Homo Sapiens
LGPLPEPAA

SEQ ID NO: 17245 - protein, 9 aa, Homo Sapiens
SLKEPQKPQ

SEQ ID NO: 17246 - protein, 9 aa, Homo Sapiens
PPPLRPSGQ

SEQ ID NO: 17247 - protein, 9 aa, Homo Sapiens
PGCMKTCDN

SEQ ID NO: 17248 - protein, 9 aa, Homo Sapiens
VDDATDAWG

SEQ ID NO: 17249 - protein, 9 aa, Homo Sapiens
TCSSDKAGM

SEQ ID NO: 17250 - protein, 9 aa, Homo Sapiens
MNAYEEQSK

SEQ ID NO: 17251 - protein, 9 aa, Homo Sapiens
TLSHAKTLL

SEQ ID NO: 17252 - protein, 9 aa, Homo Sapiens
TAQDGDTHP

SEQ ID NO: 17253 - protein, 9 aa, Homo Sapiens
VAPAVAIFA

SEQ ID NO: 17254 - protein, 9 aa, Homo Sapiens
KSMCKLLYI

SEQ ID NO: 17255 - protein, 9 aa, Homo Sapiens
QAGDTYVCT

SEQ ID NO: 17256 - protein, 9 aa, Homo Sapiens
QISMEKVDR

SEQ ID NO: 17257 - protein, 9 aa, Homo Sapiens
GRDLGRAAA

SEQ ID NO: 17258 - protein, 9 aa, Homo Sapiens
KSYPESVCE

SEQ ID NO: 17259 - protein, 9 aa, Homo Sapiens
VDMERFQLY

SEQ ID NO: 17260 - protein, 9 aa, Homo Sapiens
RLGPLPEPA

SEQ ID NO: 17261 - protein, 9 aa, Homo Sapiens
SLLLNPTEE

SEQ ID NO: 17262 - protein, 9 aa, Homo Sapiens
VAKGKESRH

SEQ ID NO: 17263 - protein, 9 aa, Homo Sapiens
DKVHCDRQM

SEQ ID NO: 17264 - protein, 9 aa, Homo Sapiens
LRCHLLPEK

SEQ ID NO: 17265 - protein, 9 aa, Homo Sapiens
QGLPPPLRP

SEQ ID NO: 17266 - protein, 9 aa, Homo Sapiens
WSSKATSVK

SEQ ID NO: 17267 - protein, 9 aa, Homo Sapiens
LSMPDKPVS

SEQ ID NO: 17268 - protein, 9 aa, Homo Sapiens
SLAYSDLAG

SEQ ID NO: 17269 - protein, 9 aa, Homo Sapiens
YLPEPSRHM

SEQ ID NO: 17270 - protein, 9 aa, Homo Sapiens
NFTYEYIFN

SEQ ID NO: 17271 - protein, 9 aa, Homo Sapiens
SLDYFKKQK

SEQ ID NO: 17272 - protein, 9 aa, Homo Sapiens
CTVVCPLHN

SEQ ID NO: 17273 - protein, 9 aa, Homo Sapiens
REAMEHPYL

SEQ ID NO: 17274 - protein, 9 aa, Homo Sapiens
SGHNDSPEL

SEQ ID NO: 17275 - protein, 9 aa, Homo Sapiens
SRTTSKPGR

SEQ ID NO: 17276 - protein, 9 aa, Homo Sapiens
WPAKHQAAA

SEQ ID NO: 17277 - protein, 9 aa, Homo Sapiens
FQRYLTSSR

SEQ ID NO: 17278 - protein, 9 aa, Homo Sapiens
LFSSVRSKP

SEQ ID NO: 17279 - protein, 9 aa, Homo Sapiens
KLPEYVFEN

SEQ ID NO: 17280 - protein, 9 aa, Homo Sapiens
LVPDWRGPH

SEQ ID NO: 17281 - protein, 9 aa, Homo Sapiens
AVIRERRCT

SEQ ID NO: 17282 - protein, 9 aa, Homo Sapiens
PTHLPWDTV

SEQ ID NO: 17283 - protein, 9 aa, Homo Sapiens
EDSPLILSA

SEQ ID NO: 17284 - protein, 9 aa, Homo Sapiens
NIQKESTVH

SEQ ID NO: 17285 - protein, 9 aa, Homo Sapiens
NVTSNDKVL

SEQ ID NO: 17286 - protein, 9 aa, Homo Sapiens
SKPPLLGFA

SEQ ID NO: 17287 - protein, 9 aa, Homo Sapiens
FQCEQLLCA

SEQ ID NO: 17288 - protein, 9 aa, Homo Sapiens
VRSKPPMSL

SEQ ID NO: 17289 - protein, 9 aa, Homo Sapiens
KDFEGPPLA

SEQ ID NO: 17290 - protein, 9 aa, Homo Sapiens
QVRCRKQKV

SEQ ID NO: 17291 - protein, 9 aa, Homo Sapiens
SNAGGRGEN

SEQ ID NO: 17292 - protein, 9 aa, Homo Sapiens
CNDMINLGR

SEQ ID NO: 17293 - protein, 9 aa, Homo Sapiens
TRVLMKVDG

SEQ ID NO: 17294 - protein, 9 aa, Homo Sapiens
GPVYGFMFL

SEQ ID NO: 17295 - protein, 9 aa, Homo Sapiens
AGLYGLPWR

SEQ ID NO: 17296 - protein, 9 aa, Homo Sapiens
QKYLSHQQM

SEQ ID NO: 17297 - protein, 9 aa, Homo Sapiens
DYDSKINGR

SEQ ID NO: 17298 - protein, 9 aa, Homo Sapiens
LETQNQSSK

SEQ ID NO: 17299 - protein, 9 aa, Homo Sapiens
HNTIKKPQT

SEQ ID NO: 17300 - protein, 9 aa, Homo Sapiens
EGDTTPKKP

SEQ ID NO: 17301 - protein, 9 aa, Homo Sapiens
LLQPPLKGV

SEQ ID NO: 17302 - protein, 9 aa, Homo Sapiens
DVRITVLKS

SEQ ID NO: 17303 - protein, 9 aa, Homo Sapiens
WCFQCEQLL

SEQ ID NO: 17304 - protein, 9 aa, Homo Sapiens
IKQQNGMES

SEQ ID NO: 17305 - protein, 9 aa, Homo Sapiens
PKRCNDMIN

SEQ ID NO: 17306 - protein, 9 aa, Homo Sapiens
SVHYNIAEL

SEQ ID NO: 17307 - protein, 9 aa, Homo Sapiens
APKSYPESV

SEQ ID NO: 17308 - protein, 9 aa, Homo Sapiens
AGALRQGRA

SEQ ID NO: 17309 - protein, 9 aa, Homo Sapiens
LFLQPEGKP

SEQ ID NO: 17310 - protein, 9 aa, Homo Sapiens
AVPQMPTRM

SEQ ID NO: 17311 - protein, 9 aa, Homo Sapiens
HLKGHNIIN

SEQ ID NO: 17312 - protein, 9 aa, Homo Sapiens
IRERRCTLP

SEQ ID NO: 17313 - protein, 9 aa, Homo Sapiens
LSNSQRTPI

SEQ ID NO: 17314 - protein, 9 aa, Homo Sapiens
HAVPLPNWL

SEQ ID NO: 17315 - protein, 9 aa, Homo Sapiens
QGPVYGFMF

SEQ ID NO: 17316 - protein, 9 aa, Homo Sapiens
GTEATLSHA

SEQ ID NO: 17317 - protein, 9 aa, Homo Sapiens
EKVDRLARK

SEQ ID NO: 17318 - protein, 9 aa, Homo Sapiens
SREKLPSPL

SEQ ID NO: 17319 - protein, 9 aa, Homo Sapiens
GPRKSMCKL

SEQ ID NO: 17320 - protein, 9 aa, Homo Sapiens
KLSDTIQVY

SEQ ID NO: 17321 - protein, 9 aa, Homo Sapiens
WSNPMAQEG

SEQ ID NO: 17322 - protein, 9 aa, Homo Sapiens
LYEDRRSFA

SEQ ID NO: 17323 - protein, 9 aa, Homo Sapiens
FMIQIGVFS

SEQ ID NO: 17324 - protein, 9 aa, Homo Sapiens
EWFLHFWST

SEQ ID NO: 17325 - protein, 9 aa, Homo Sapiens
FLHFWSTVE

SEQ ID NO: 17326 - protein, 9 aa, Homo Sapiens
ENENFILKH

SEQ ID NO: 17327 - protein, 9 aa, Homo Sapiens
DKVGDWMVK

SEQ ID NO: 17328 - protein, 9 aa, Homo Sapiens
REKMHRRFE

SEQ ID NO: 17329 - protein, 9 aa, Homo Sapiens
TTHKGEPTT

SEQ ID NO: 17330 - protein, 9 aa, Homo Sapiens
GGRDLGRAA

SEQ ID NO: 17331 - protein, 9 aa, Homo Sapiens
AMTIYKQSQ

SEQ ID NO: 17332 - protein, 9 aa, Homo Sapiens
MASPQGGHI

SEQ ID NO: 17333 - protein, 9 aa, Homo Sapiens
HPKILYHTV

SEQ ID NO: 17334 - protein, 9 aa, Homo Sapiens
WENPDIMSQ

SEQ ID NO: 17335 - protein, 9 aa, Homo Sapiens
EQLLRRLGP

SEQ ID NO: 17336 - protein, 9 aa, Homo Sapiens
TGSQVRCRK

SEQ ID NO: 17337 - protein, 9 aa, Homo Sapiens
LIGFLYGNM

SEQ ID NO: 17338 - protein, 9 aa, Homo Sapiens
RLGPPGPEA

SEQ ID NO: 17339 - protein, 9 aa, Homo Sapiens
AIFCSVQMA

SEQ ID NO: 17340 - protein, 9 aa, Homo Sapiens
EDNQEEDDA

SEQ ID NO: 17341 - protein, 9 aa, Homo Sapiens
LLSVAKGKE

SEQ ID NO: 17342 - protein, 9 aa, Homo Sapiens
GPSLFLSAS

SEQ ID NO: 17343 - protein, 9 aa, Homo Sapiens
PNGEFTALV

SEQ ID NO: 17344 - protein, 9 aa, Homo Sapiens
QFYEDVKDA

SEQ ID NO: 17345 - protein, 9 aa, Homo Sapiens
FPVAPAVAI

SEQ ID NO: 17346 - protein, 9 aa, Homo Sapiens
HLLSNSQRT

SEQ ID NO: 17347 - protein, 9 aa, Homo Sapiens
RSFALYFAV

SEQ ID NO: 17348 - protein, 9 aa, Homo Sapiens
GRDSDKGKL

SEQ ID NO: 17349 - protein, 9 aa, Homo Sapiens
KQNYSFNDL

SEQ ID NO: 17350 - protein, 9 aa, Homo Sapiens
ESAAPTLTR

SEQ ID NO: 17351 - protein, 9 aa, Homo Sapiens
QSMNYKPMQ

SEQ ID NO: 17352 - protein, 9 aa, Homo Sapiens
PGPLPASHP

SEQ ID NO: 17353 - protein, 9 aa, Homo Sapiens
SLPAPSFSY

SEQ ID NO: 17354 - protein, 9 aa, Homo Sapiens
RDLKQGDDY

SEQ ID NO: 17355 - protein, 9 aa, Homo Sapiens
DVDLSVPGC

SEQ ID NO: 17356 - protein, 9 aa, Homo Sapiens
ENRIVITGD

SEQ ID NO: 17357 - protein, 9 aa, Homo Sapiens
VKGVLQEFD

SEQ ID NO: 17358 - protein, 9 aa, Homo Sapiens
KTPSHLLSN

SEQ ID NO: 17359 - protein, 9 aa, Homo Sapiens
DNQEEDDAG

SEQ ID NO: 17360 - protein, 9 aa, Homo Sapiens
QNGMESASE

SEQ ID NO: 17361 - protein, 9 aa, Homo Sapiens
QLLQEGDHE

SEQ ID NO: 17362 - protein, 9 aa, Homo Sapiens
PTRIPQLLP

SEQ ID NO: 17363 - protein, 9 aa, Homo Sapiens
RKSMCKLLY

SEQ ID NO: 17364 - protein, 9 aa, Homo Sapiens
GNNLLSVPP

SEQ ID NO: 17365 - protein, 9 aa, Homo Sapiens
HGALVAPAT

SEQ ID NO: 17366 - protein, 9 aa, Homo Sapiens
PGSPDEEGR

SEQ ID NO: 17367 - protein, 9 aa, Homo Sapiens
CYFCEYWLF

SEQ ID NO: 17368 - protein, 9 aa, Homo Sapiens
SWIALFTTA

SEQ ID NO: 17369 - protein, 9 aa, Homo Sapiens
SSTCSSDKA

SEQ ID NO: 17370 - protein, 9 aa, Homo Sapiens
RPSGQRAAE

SEQ ID NO: 17371 - protein, 9 aa, Homo Sapiens
HHGRMMVVA

SEQ ID NO: 17372 - protein, 9 aa, Homo Sapiens
CHLLPEKNA

SEQ ID NO: 17373 - protein, 9 aa, Homo Sapiens
QDAKAIRGS

SEQ ID NO: 17374 - protein, 9 aa, Homo Sapiens
ALVRALLQP

SEQ ID NO: 17375 - protein, 9 aa, Homo Sapiens
EKFENENFI

SEQ ID NO: 17376 - protein, 9 aa, Homo Sapiens
PSGHNDSPE

SEQ ID NO: 17377 - protein, 9 aa, Homo Sapiens
FSYEVGSEL

SEQ ID NO: 17378 - protein, 9 aa, Homo Sapiens
QWGPLQREP

SEQ ID NO: 17379 - protein, 9 aa, Homo Sapiens
QEGDHESSA

SEQ ID NO: 17380 - protein, 9 aa, Homo Sapiens
EIAHNGNND

SEQ ID NO: 17381 - protein, 9 aa, Homo Sapiens
LPSGAQLPC

SEQ ID NO: 17382 - protein, 9 aa, Homo Sapiens
PQHLESIDN

SEQ ID NO: 17383 - protein, 9 aa, Homo Sapiens
TGHVERALQ

SEQ ID NO: 17384 - protein, 9 aa, Homo Sapiens
YLNDSVCDG

SEQ ID NO: 17385 - protein, 9 aa, Homo Sapiens
GEKFENENF

SEQ ID NO: 17386 - protein, 9 aa, Homo Sapiens
RQGAKERSH

SEQ ID NO: 17387 - protein, 9 aa, Homo Sapiens
CTEDRFTLR

SEQ ID NO: 17388 - protein, 9 aa, Homo Sapiens
VPQMPTRME

SEQ ID NO: 17389 - protein, 9 aa, Homo Sapiens
VPELDRDKS

SEQ ID NO: 17390 - protein, 9 aa, Homo Sapiens
IYAYGFQKP

SEQ ID NO: 17391 - protein, 9 aa, Homo Sapiens
KIITNNPHL

SEQ ID NO: 17392 - protein, 9 aa, Homo Sapiens
PSAHGALVA

SEQ ID NO: 17393 - protein, 9 aa, Homo Sapiens
KQQNGMESA

SEQ ID NO: 17394 - protein, 9 aa, Homo Sapiens
KGKARCSSE

SEQ ID NO: 17395 - protein, 9 aa, Homo Sapiens
KSSAEDQMK

SEQ ID NO: 17396 - protein, 9 aa, Homo Sapiens
TVKWMKDSN

SEQ ID NO: 17397 - protein, 9 aa, Homo Sapiens
TMFWVYLAT

SEQ ID NO: 17398 - protein, 9 aa, Homo Sapiens
TLVGNKRSD

SEQ ID NO: 17399 - protein, 9 aa, Homo Sapiens
TGMQDAKAI

SEQ ID NO: 17400 - protein, 9 aa, Homo Sapiens
DFWCFQCEQ

SEQ ID NO: 17401 - protein, 9 aa, Homo Sapiens
LSHPAFAQG

SEQ ID NO: 17402 - protein, 9 aa, Homo Sapiens
EANDTRRLS

SEQ ID NO: 17403 - protein, 9 aa, Homo Sapiens
APKQLRFDQ

SEQ ID NO: 17404 - protein, 9 aa, Homo Sapiens
YGEKFENEN

SEQ ID NO: 17405 - protein, 9 aa, Homo Sapiens
TRWQQREEV

SEQ ID NO: 17406 - protein, 9 aa, Homo Sapiens
KNMKTQPPF

SEQ ID NO: 17407 - protein, 9 aa, Homo Sapiens
WLPGAALGR

SEQ ID NO: 17408 - protein, 9 aa, Homo Sapiens
AKERSHKLQ

SEQ ID NO: 17409 - protein, 9 aa, Homo Sapiens
TEIPTPHSD

SEQ ID NO: 17410 - protein, 9 aa, Homo Sapiens
SSSASAFEN

SEQ ID NO: 17411 - protein, 9 aa, Homo Sapiens
DWNSHQDLQ

SEQ ID NO: 17412 - protein, 9 aa, Homo Sapiens
RSKPPMSLE

SEQ ID NO: 17413 - protein, 9 aa, Homo Sapiens
EIFTKKEVK

SEQ ID NO: 17414 - protein, 9 aa, Homo Sapiens
YHCAKVMNA

SEQ ID NO: 17415 - protein, 9 aa, Homo Sapiens
LPSPLAALS

SEQ ID NO: 17416 - protein, 9 aa, Homo Sapiens
PSGNLSMPD

SEQ ID NO: 17417 - protein, 9 aa, Homo Sapiens
QMLYTFRYD

SEQ ID NO: 17418 - protein, 9 aa, Homo Sapiens
SYEVGSELA

SEQ ID NO: 17419 - protein, 9 aa, Homo Sapiens
YPYTTSQGL

SEQ ID NO: 17420 - protein, 9 aa, Homo Sapiens
NMQSTVDDA

SEQ ID NO: 17421 - protein, 9 aa, Homo Sapiens
YTFRYDDGT

SEQ ID NO: 17422 - protein, 9 aa, Homo Sapiens
TDCGPMGQR

SEQ ID NO: 17423 - protein, 9 aa, Homo Sapiens
ATKNFNKCF

SEQ ID NO: 17424 - protein, 9 aa, Homo Sapiens
PFKTKQIMS

SEQ ID NO: 17425 - protein, 9 aa, Homo Sapiens
LYGLPWRSG

SEQ ID NO: 17426 - protein, 9 aa, Homo Sapiens
ASQLHQRDV

SEQ ID NO: 17427 - protein, 9 aa, Homo Sapiens
PSFIRQLEE

SEQ ID NO: 17428 - protein, 9 aa, Homo Sapiens
SKGRALYEV

SEQ ID NO: 17429 - protein, 9 aa, Homo Sapiens
AKVMNAYEE

SEQ ID NO: 17430 - protein, 9 aa, Homo Sapiens
ENGKSHWVF

SEQ ID NO: 17431 - protein, 9 aa, Homo Sapiens
QPREWSASR

SEQ ID NO: 17432 - protein, 9 aa, Homo Sapiens
ENPDIMSQL

SEQ ID NO: 17433 - protein, 9 aa, Homo Sapiens
LSHQQMQEL

SEQ ID NO: 17434 - protein, 9 aa, Homo Sapiens
EEGRAEAPA

SEQ ID NO: 17435 - protein, 9 aa, Homo Sapiens
KMKWESLHQ

SEQ ID NO: 17436 - protein, 9 aa, Homo Sapiens
NGEKKACVR

SEQ ID NO: 17437 - protein, 9 aa, Homo Sapiens
PAFAQGKRL

SEQ ID NO: 17438 - protein, 9 aa, Homo Sapiens
MSQLLFQNN

SEQ ID NO: 17439 - protein, 9 aa, Homo Sapiens
KQIMSPVSK

SEQ ID NO: 17440 - protein, 9 aa, Homo Sapiens
VRITVLKSQ

SEQ ID NO: 17441 - protein, 9 aa, Homo Sapiens
KEPQKPQQP

SEQ ID NO: 17442 - protein, 9 aa, Homo Sapiens
GDDYDSKIN

SEQ ID NO: 17443 - protein, 9 aa, Homo Sapiens
NTIKKPQTQ

SEQ ID NO: 17444 - protein, 9 aa, Homo Sapiens
EREKEKARK

SEQ ID NO: 17445 - protein, 9 aa, Homo Sapiens
KQLRFDQHS

SEQ ID NO: 17446 - protein, 9 aa, Homo Sapiens
KTLLSPLVM

SEQ ID NO: 17447 - protein, 9 aa, Homo Sapiens
WSASRRSSA

SEQ ID NO: 17448 - protein, 9 aa, Homo Sapiens
ADFWCFQCE

SEQ ID NO: 17449 - protein, 9 aa, Homo Sapiens
AGGGGDELR

SEQ ID NO: 17450 - protein, 9 aa, Homo Sapiens
DIMSQLLFQ

SEQ ID NO: 17451 - protein, 9 aa, Homo Sapiens
DAVIRERRC

SEQ ID NO: 17452 - protein, 9 aa, Homo Sapiens
ASAFENVKP

SEQ ID NO: 17453 - protein, 9 aa, Homo Sapiens
MEHPYLYTV

SEQ ID NO: 17454 - protein, 9 aa, Homo Sapiens
NPDIMSQLL

SEQ ID NO: 17455 - protein, 9 aa, Homo Sapiens
LHTKCKEKA

SEQ ID NO: 17456 - protein, 9 aa, Homo Sapiens
SSASAFENV

SEQ ID NO: 17457 - protein, 9 aa, Homo Sapiens
GAAGAKKGK

SEQ ID NO: 17458 - protein, 9 aa, Homo Sapiens
GVKLELAFR

SEQ ID NO: 17459 - protein, 9 aa, Homo Sapiens
KEKARKMKR

SEQ ID NO: 17460 - protein, 9 aa, Homo Sapiens
GAWLPGAAL

SEQ ID NO: 17461 - protein, 9 aa, Homo Sapiens
ERMQKRAEQ

SEQ ID NO: 17462 - protein, 9 aa, Homo Sapiens
RAPLLPLQD

SEQ ID NO: 17463 - protein, 9 aa, Homo Sapiens
HNMQSTVDD

SEQ ID NO: 17464 - protein, 9 aa, Homo Sapiens
FSRMNREEL

SEQ ID NO: 17465 - protein, 9 aa, Homo Sapiens
PASHPLFGR

SEQ ID NO: 17466 - protein, 9 aa, Homo Sapiens
GFCEQLNKD

SEQ ID NO: 17467 - protein, 9 aa, Homo Sapiens
LQSSELKGT

SEQ ID NO: 17468 - protein, 9 aa, Homo Sapiens
NGFCEQLNK

SEQ ID NO: 17469 - protein, 9 aa, Homo Sapiens
PDALDYKSF

SEQ ID NO: 17470 - protein, 9 aa, Homo Sapiens
LYEANDTRR

SEQ ID NO: 17471 - protein, 9 aa, Homo Sapiens
TSRDSAYTL

SEQ ID NO: 17472 - protein, 9 aa, Homo Sapiens
TCGPGCMKT

SEQ ID NO: 17473 - protein, 9 aa, Homo Sapiens
PLPASHPLF

SEQ ID NO: 17474 - protein, 9 aa, Homo Sapiens
SVNLKNILQ

SEQ ID NO: 17475 - protein, 9 aa, Homo Sapiens
YVSGFHPSN

SEQ ID NO: 17476 - protein, 9 aa, Homo Sapiens
MGQRLKGAR

SEQ ID NO: 17477 - protein, 9 aa, Homo Sapiens
GRSNKLARG

SEQ ID NO: 17478 - protein, 9 aa, Homo Sapiens
SMCKLLYIR

SEQ ID NO: 17479 - protein, 9 aa, Homo Sapiens
QVVDILWSN

SEQ ID NO: 17480 - protein, 9 aa, Homo Sapiens
LRMFMTRDL

SEQ ID NO: 17481 - protein, 9 aa, Homo Sapiens
LLPEKNAED

SEQ ID NO: 17482 - protein, 9 aa, Homo Sapiens
SSRESRGQG

SEQ ID NO: 17483 - protein, 9 aa, Homo Sapiens
PNPSFIRQL

SEQ ID NO: 17484 - protein, 9 aa, Homo Sapiens
MLYTFRYDD

SEQ ID NO: 17485 - protein, 9 aa, Homo Sapiens
NAAAGSFAY

SEQ ID NO: 17486 - protein, 9 aa, Homo Sapiens
SFAYAFAAL

SEQ ID NO: 17487 - protein, 9 aa, Homo Sapiens
GGDELRKPD

SEQ ID NO: 17488 - protein, 9 aa, Homo Sapiens
QGPDAVPDA

SEQ ID NO: 17489 - protein, 9 aa, Homo Sapiens
EWSKKQKMN

SEQ ID NO: 17490 - protein, 9 aa, Homo Sapiens
AFEDFSRSV

SEQ ID NO: 17491 - protein, 9 aa, Homo Sapiens
HWPAKHQAA

SEQ ID NO: 17492 - protein, 9 aa, Homo Sapiens
LSKGHTFLA

SEQ ID NO: 17493 - protein, 9 aa, Homo Sapiens
REQIAMLRL

SEQ ID NO: 17494 - protein, 9 aa, Homo Sapiens
KILYHTVPV

SEQ ID NO: 17495 - protein, 9 aa, Homo Sapiens
YHKSEIIYT

SEQ ID NO: 17496 - protein, 9 aa, Homo Sapiens
GGGGDELRK

SEQ ID NO: 17497 - protein, 9 aa, Homo Sapiens
RESRGQGGR

SEQ ID NO: 17498 - protein, 9 aa, Homo Sapiens
IMSQLLFQN

SEQ ID NO: 17499 - protein, 9 aa, Homo Sapiens
TKNFNKCFL

SEQ ID NO: 17500 - protein, 9 aa, Homo Sapiens
VLKSQYEGR

SEQ ID NO: 17501 - protein, 9 aa, Homo Sapiens
QVSSPNENV

SEQ ID NO: 17502 - protein, 9 aa, Homo Sapiens
HEGTYRCFG

SEQ ID NO: 17503 - protein, 9 aa, Homo Sapiens
QVVVSEEEE

SEQ ID NO: 17504 - protein, 9 aa, Homo Sapiens
ALHMEIATY

SEQ ID NO: 17505 - protein, 9 aa, Homo Sapiens
GVFPVAPAV

SEQ ID NO: 17506 - protein, 9 aa, Homo Sapiens
NDLSSEINW

SEQ ID NO: 17507 - protein, 9 aa, Homo Sapiens
ENDPGSNQD

SEQ ID NO: 17508 - protein, 9 aa, Homo Sapiens
SGLGHREYR

SEQ ID NO: 17509 - protein, 9 aa, Homo Sapiens
LFEKLPEYV

SEQ ID NO: 17510 - protein, 9 aa, Homo Sapiens
PEYVFENKN

SEQ ID NO: 17511 - protein, 9 aa, Homo Sapiens
VSPALVPGI

SEQ ID NO: 17512 - protein, 9 aa, Homo Sapiens
HQFYEDVKD

SEQ ID NO: 17513 - protein, 9 aa, Homo Sapiens
GLLSVAKGK

SEQ ID NO: 17514 - protein, 9 aa, Homo Sapiens
QSLALSAAA

SEQ ID NO: 17515 - protein, 9 aa, Homo Sapiens
YDTCGPGCM

SEQ ID NO: 17516 - protein, 9 aa, Homo Sapiens
DPESLVFLS

SEQ ID NO: 17517 - protein, 9 aa, Homo Sapiens
KGKESRHAA

SEQ ID NO: 17518 - protein, 9 aa, Homo Sapiens
IPNGEFTAL

SEQ ID NO: 17519 - protein, 9 aa, Homo Sapiens
QSTVDDATD

SEQ ID NO: 17520 - protein, 9 aa, Homo Sapiens
SRGQGGRTP

SEQ ID NO: 17521 - protein, 9 aa, Homo Sapiens
YLLSYIPKD

SEQ ID NO: 17522 - protein, 9 aa, Homo Sapiens
TPKKPEDPS

SEQ ID NO: 17523 - protein, 9 aa, Homo Sapiens
IIYLNDSVC

SEQ ID NO: 17524 - protein, 9 aa, Homo Sapiens
ILSHPAFAQ

SEQ ID NO: 17525 - protein, 9 aa, Homo Sapiens
GHKAMERLK

SEQ ID NO: 17526 - protein, 9 aa, Homo Sapiens
NSAIRYLKG

SEQ ID NO: 17527 - protein, 9 aa, Homo Sapiens
EDYHCAKVM

SEQ ID NO: 17528 - protein, 9 aa, Homo Sapiens
LQEFDLIRT

SEQ ID NO: 17529 - protein, 9 aa, Homo Sapiens
VKACLNFTY

SEQ ID NO: 17530 - protein, 9 aa, Homo Sapiens
PREWSASRR

SEQ ID NO: 17531 - protein, 9 aa, Homo Sapiens
IENRIVITG

SEQ ID NO: 17532 - protein, 9 aa, Homo Sapiens
QPTLLYMDM

SEQ ID NO: 17533 - protein, 9 aa, Homo Sapiens
VFPVAPAVA

SEQ ID NO: 17534 - protein, 9 aa, Homo Sapiens
ASLQLFQED

SEQ ID NO: 17535 - protein, 9 aa, Homo Sapiens
TATVSSTCS

SEQ ID NO: 17536 - protein, 9 aa, Homo Sapiens
GPGCMKTCD

SEQ ID NO: 17537 - protein, 9 aa, Homo Sapiens
VSGFHPSNI

SEQ ID NO: 17538 - protein, 9 aa, Homo Sapiens
PKKPEDPSA

SEQ ID NO: 17539 - protein, 9 aa, Homo Sapiens
AKKGKARCS

SEQ ID NO: 17540 - protein, 9 aa, Homo Sapiens
RGERPRVHF

SEQ ID NO: 17541 - protein, 9 aa, Homo Sapiens
GDHGFPGSL

SEQ ID NO: 17542 - protein, 9 aa, Homo Sapiens
DYFKKQKAE

SEQ ID NO: 17543 - protein, 9 aa, Homo Sapiens
CVREGEEER

SEQ ID NO: 17544 - protein, 9 aa, Homo Sapiens
NDTRRLSFS

SEQ ID NO: 17545 - protein, 9 aa, Homo Sapiens
SMLREQIAM

SEQ ID NO: 17546 - protein, 9 aa, Homo Sapiens
LSVPGCCYL

SEQ ID NO: 17547 - protein, 9 aa, Homo Sapiens
NATSNRKYS

SEQ ID NO: 17548 - protein, 9 aa, Homo Sapiens
ASHPLFGRL

SEQ ID NO: 17549 - protein, 9 aa, Homo Sapiens
DCSDHPMID

SEQ ID NO: 17550 - protein, 9 aa, Homo Sapiens
STVDDATDA

SEQ ID NO: 17551 - protein, 9 aa, Homo Sapiens
FAHRIITDS

SEQ ID NO: 17552 - protein, 9 aa, Homo Sapiens
SRNCTEDRF

SEQ ID NO: 17553 - protein, 9 aa, Homo Sapiens
HGFPGSLGP

SEQ ID NO: 17554 - protein, 9 aa, Homo Sapiens
IDNEEDEEA

SEQ ID NO: 17555 - protein, 9 aa, Homo Sapiens
TFRYDDGTF

SEQ ID NO: 17556 - protein, 9 aa, Homo Sapiens
AKVCGKIGL

SEQ ID NO: 17557 - protein, 9 aa, Homo Sapiens
MRFNEIFTK

SEQ ID NO: 17558 - protein, 9 aa, Homo Sapiens
KFENENFIL

SEQ ID NO: 17559 - protein, 9 aa, Homo Sapiens
EEDNQEEDD

SEQ ID NO: 17560 - protein, 9 aa, Homo Sapiens
FVAPSGGAG

SEQ ID NO: 17561 - protein, 9 aa, Homo Sapiens
ISETRIENR

SEQ ID NO: 17562 - protein, 9 aa, Homo Sapiens
IDQLQCNEM

SEQ ID NO: 17563 - protein, 9 aa, Homo Sapiens
GGGDELRKP

SEQ ID NO: 17564 - protein, 9 aa, Homo Sapiens
VDLSVPGCC

SEQ ID NO: 17565 - protein, 9 aa, Homo Sapiens
EKLKKFMIQ

SEQ ID NO: 17566 - protein, 9 aa, Homo Sapiens
IEDDVVVTE

SEQ ID NO: 17567 - protein, 9 aa, Homo Sapiens
SGAQIPNGE

SEQ ID NO: 17568 - protein, 9 aa, Homo Sapiens
AGVGDTGMQ

SEQ ID NO: 17569 - protein, 9 aa, Homo Sapiens
PRRSGAGPE

SEQ ID NO: 17570 - protein, 9 aa, Homo Sapiens
KKTLQVVVS

SEQ ID NO: 17571 - protein, 9 aa, Homo Sapiens
DNPFVYEPG

SEQ ID NO: 17572 - protein, 9 aa, Homo Sapiens
GLPPPLRPS

SEQ ID NO: 17573 - protein, 9 aa, Homo Sapiens
NPTEETVRR

SEQ ID NO: 17574 - protein, 9 aa, Homo Sapiens
NIAELQSSS

SEQ ID NO: 17575 - protein, 9 aa, Homo Sapiens
KGKLEKTSK

SEQ ID NO: 17576 - protein, 9 aa, Homo Sapiens
NPGPRKSMC

SEQ ID NO: 17577 - protein, 9 aa, Homo Sapiens
LLYRVLVAE

SEQ ID NO: 17578 - protein, 9 aa, Homo Sapiens
KEKGKTLLS

SEQ ID NO: 17579 - protein, 9 aa, Homo Sapiens
KGEPTTFQS

SEQ ID NO: 17580 - protein, 9 aa, Homo Sapiens
TCTLANGKP

SEQ ID NO: 17581 - protein, 9 aa, Homo Sapiens
CDGAVGYSM

SEQ ID NO: 17582 - protein, 9 aa, Homo Sapiens
EYVFENKNS

SEQ ID NO: 17583 - protein, 9 aa, Homo Sapiens
VTSCSKPPL

SEQ ID NO: 17584 - protein, 9 aa, Homo Sapiens
CSRFMNYSC

SEQ ID NO: 17585 - protein, 9 aa, Homo Sapiens
GLGHREYRS

SEQ ID NO: 17586 - protein, 9 aa, Homo Sapiens
KKTTKFLDC

SEQ ID NO: 17587 - protein, 9 aa, Homo Sapiens
AGFFKTVGL

SEQ ID NO: 17588 - protein, 9 aa, Homo Sapiens
LKEPQKPQQ

SEQ ID NO: 17589 - protein, 9 aa, Homo Sapiens
SEEEEEDGT

SEQ ID NO: 17590 - protein, 9 aa, Homo Sapiens
MTIYKQSQH

SEQ ID NO: 17591 - protein, 9 aa, Homo Sapiens
LAGSFLKEV

SEQ ID NO: 17592 - protein, 9 aa, Homo Sapiens
AQGKRLATS

SEQ ID NO: 17593 - protein, 9 aa, Homo Sapiens
TVVCPLHNQ

SEQ ID NO: 17594 - protein, 9 aa, Homo Sapiens
DSPQNEIAH

SEQ ID NO: 17595 - protein, 9 aa, Homo Sapiens
KVLFNVTVT

SEQ ID NO: 17596 - protein, 9 aa, Homo Sapiens
EKELECVRE

SEQ ID NO: 17597 - protein, 9 aa, Homo Sapiens
GFMFLFKWI

SEQ ID NO: 17598 - protein, 9 aa, Homo Sapiens
YTLRLELDG

SEQ ID NO: 17599 - protein, 9 aa, Homo Sapiens
GRMMVVAWG

SEQ ID NO: 17600 - protein, 9 aa, Homo Sapiens
TSNRKYSVG

SEQ ID NO: 17601 - protein, 9 aa, Homo Sapiens
FGAQGPDVL

SEQ ID NO: 17602 - protein, 9 aa, Homo Sapiens
IFCSVQMAM

SEQ ID NO: 17603 - protein, 9 aa, Homo Sapiens
APAVAIFAT

SEQ ID NO: 17604 - protein, 9 aa, Homo Sapiens
RSLGYEGCG

SEQ ID NO: 17605 - protein, 9 aa, Homo Sapiens
LGPATHEGT

SEQ ID NO: 17606 - protein, 9 aa, Homo Sapiens
LFLMQKIQD

SEQ ID NO: 17607 - protein, 9 aa, Homo Sapiens
NDKVLFNVT

SEQ ID NO: 17608 - protein, 9 aa, Homo Sapiens
NDSLAYSDL

SEQ ID NO: 17609 - protein, 9 aa, Homo Sapiens
YNFRAKVCG

SEQ ID NO: 17610 - protein, 9 aa, Homo Sapiens
EYPFKTKQI

SEQ ID NO: 17611 - protein, 9 aa, Homo Sapiens
SPSSSTTHK

SEQ ID NO: 17612 - protein, 9 aa, Homo Sapiens
SAYTLNTMF

SEQ ID NO: 17613 - protein, 9 aa, Homo Sapiens
RAMTIYKQS

SEQ ID NO: 17614 - protein, 9 aa, Homo Sapiens
FGRDSDKGK

SEQ ID NO: 17615 - protein, 9 aa, Homo Sapiens
SVAKGKESR

SEQ ID NO: 17616 - protein, 9 aa, Homo Sapiens
RFNEIFTKK

SEQ ID NO: 17617 - protein, 9 aa, Homo Sapiens
GAKKGKARC

SEQ ID NO: 17618 - protein, 9 aa, Homo Sapiens
LKKFMIQIG

SEQ ID NO: 17619 - protein, 9 aa, Homo Sapiens
NDMINLGRL

SEQ ID NO: 17620 - protein, 9 aa, Homo Sapiens
YSKGRALYE

SEQ ID NO: 17621 - protein, 9 aa, Homo Sapiens
EDVWLWQLE

SEQ ID NO: 17622 - protein, 9 aa, Homo Sapiens
FNEIFTKKE

SEQ ID NO: 17623 - protein, 9 aa, Homo Sapiens
RVLGSLLFA

SEQ ID NO: 17624 - protein, 9 aa, Homo Sapiens
VERALQTRH

SEQ ID NO: 17625 - protein, 9 aa, Homo Sapiens
GGPGGAFAA

SEQ ID NO: 17626 - protein, 9 aa, Homo Sapiens
TYVCTSDYK

SEQ ID NO: 17627 - protein, 9 aa, Homo Sapiens
ITVLKSQYE

SEQ ID NO: 17628 - protein, 9 aa, Homo Sapiens
LAECLDCPK

SEQ ID NO: 17629 - protein, 9 aa, Homo Sapiens
FLYGNMYCS

SEQ ID NO: 17630 - protein, 9 aa, Homo Sapiens
LLSNSQRTP

SEQ ID NO: 17631 - protein, 9 aa, Homo Sapiens
SDTVDYDNA

SEQ ID NO: 17632 - protein, 9 aa, Homo Sapiens
DPSPTVKWM

SEQ ID NO: 17633 - protein, 9 aa, Homo Sapiens
VKSLKSKLE

SEQ ID NO: 17634 - protein, 9 aa, Homo Sapiens
GYEGCGFPS

SEQ ID NO: 17635 - protein, 9 aa, Homo Sapiens
LKQPREWSA

SEQ ID NO: 17636 - protein, 9 aa, Homo Sapiens
SAYTLRLEL

SEQ ID NO: 17637 - protein, 9 aa, Homo Sapiens
RIENRIVIT

SEQ ID NO: 17638 - protein, 9 aa, Homo Sapiens
KPNPSFIRQ

SEQ ID NO: 17639 - protein, 9 aa, Homo Sapiens
PLKNLWLPR

SEQ ID NO: 17640 - protein, 9 aa, Homo Sapiens
RAKVCGKIG

SEQ ID NO: 17641 - protein, 9 aa, Homo Sapiens
EPQKPQQPT

SEQ ID NO: 17642 - protein, 9 aa, Homo Sapiens
PTRMEKEEE

SEQ ID NO: 17643 - protein, 9 aa, Homo Sapiens
VKRHGKPIK

SEQ ID NO: 17644 - protein, 9 aa, Homo Sapiens
EREREKEKA

SEQ ID NO: 17645 - protein, 9 aa, Homo Sapiens
IAHNMQSTV

SEQ ID NO: 17646 - protein, 9 aa, Homo Sapiens
SLKSKLETE

SEQ ID NO: 17647 - protein, 9 aa, Homo Sapiens
IPTPHSDQR

SEQ ID NO: 17648 - protein, 9 aa, Homo Sapiens
WLDGNNLLS

SEQ ID NO: 17649 - protein, 9 aa, Homo Sapiens
SDWNSHQDL

SEQ ID NO: 17650 - protein, 9 aa, Homo Sapiens
FYEDVKDAQ

SEQ ID NO: 17651 - protein, 9 aa, Homo Sapiens
SLLFAHRII

SEQ ID NO: 17652 - protein, 9 aa, Homo Sapiens
AECLDCPKL

SEQ ID NO: 17653 - protein, 9 aa, Homo Sapiens
DAVPDALDY

SEQ ID NO: 17654 - protein, 9 aa, Homo Sapiens
PGCCYLKLL

SEQ ID NO: 17655 - protein, 9 aa, Homo Sapiens
RRLGPPGPE

SEQ ID NO: 17656 - protein, 9 aa, Homo Sapiens
ENSMLREQI

SEQ ID NO: 17657 - protein, 9 aa, Homo Sapiens
LAYSDLAGS

SEQ ID NO: 17658 - protein, 9 aa, Homo Sapiens
YMDMEGQNQ

SEQ ID NO: 17659 - protein, 9 aa, Homo Sapiens
NHKKFYSSE

SEQ ID NO: 17660 - protein, 9 aa, Homo Sapiens
TECINPEDY

SEQ ID NO: 17661 - protein, 9 aa, Homo Sapiens
VLYCGATLD

SEQ ID NO: 17662 - protein, 9 aa, Homo Sapiens
YFKKQKAEW

SEQ ID NO: 17663 - protein, 9 aa, Homo Sapiens
LASLQLFQE

SEQ ID NO: 17664 - protein, 9 aa, Homo Sapiens
EAQVVIYET

SEQ ID NO: 17665 - protein, 9 aa, Homo Sapiens
GALVAPATA

SEQ ID NO: 17666 - protein, 9 aa, Homo Sapiens
HESSAVVKL

SEQ ID NO: 17667 - protein, 9 aa, Homo Sapiens
IFDSDWNSH

SEQ ID NO: 17668 - protein, 9 aa, Homo Sapiens
YSFNDLSSE

SEQ ID NO: 17669 - protein, 9 aa, Homo Sapiens
SSELKGTPE

SEQ ID NO: 17670 - protein, 9 aa, Homo Sapiens
RNLLAHWPA

SEQ ID NO: 17671 - protein, 9 aa, Homo Sapiens
KFMIQIGVF

SEQ ID NO: 17672 - protein, 9 aa, Homo Sapiens
SAIRYLKGQ

SEQ ID NO: 17673 - protein, 9 aa, Homo Sapiens
GKALAVPFE

SEQ ID NO: 17674 - protein, 9 aa, Homo Sapiens
ESRGQGGRT

SEQ ID NO: 17675 - protein, 9 aa, Homo Sapiens
ATECINPED

SEQ ID NO: 17676 - protein, 9 aa, Homo Sapiens
TELAISFES

SEQ ID NO: 17677 - protein, 9 aa, Homo Sapiens
VVILDITKR

SEQ ID NO: 17678 - protein, 9 aa, Homo Sapiens
DTIQVYQER

SEQ ID NO: 17679 - protein, 9 aa, Homo Sapiens
LYEVGAGTG

SEQ ID NO: 17680 - protein, 9 aa, Homo Sapiens
PNGEKKACV

SEQ ID NO: 17681 - protein, 9 aa, Homo Sapiens
MLPGPSLFL

SEQ ID NO: 17682 - protein, 9 aa, Homo Sapiens
GLRGERPRV

SEQ ID NO: 17683 - protein, 9 aa, Homo Sapiens
AQGPDVLSP

SEQ ID NO: 17684 - protein, 9 aa, Homo Sapiens
IRPGTWSSK

SEQ ID NO: 17685 - protein, 9 aa, Homo Sapiens
GKTLLSPLV

SEQ ID NO: 17686 - protein, 9 aa, Homo Sapiens
FTLDQVFKP

SEQ ID NO: 17687 - protein, 9 aa, Homo Sapiens
RAEQFNVPV

SEQ ID NO: 17688 - protein, 9 aa, Homo Sapiens
THLPWDTVS

SEQ ID NO: 17689 - protein, 9 aa, Homo Sapiens
NEDVWLWQL

SEQ ID NO: 17690 - protein, 9 aa, Homo Sapiens
HRLGPLPEP

SEQ ID NO: 17691 - protein, 9 aa, Homo Sapiens
SSSLSASAS

SEQ ID NO: 17692 - protein, 9 aa, Homo Sapiens
KDSETELLS

SEQ ID NO: 17693 - protein, 9 aa, Homo Sapiens
YEVGSELAS

SEQ ID NO: 17694 - protein, 9 aa, Homo Sapiens
QNEIAHNGN

SEQ ID NO: 17695 - protein, 9 aa, Homo Sapiens
RKKIITNNP

SEQ ID NO: 17696 - protein, 9 aa, Homo Sapiens
LYCGATLDE

SEQ ID NO: 17697 - protein, 9 aa, Homo Sapiens
EDFSRSVPE

SEQ ID NO: 17698 - protein, 9 aa, Homo Sapiens
LNREQKLRE

SEQ ID NO: 17699 - protein, 9 aa, Homo Sapiens
CLASLQLFQ

SEQ ID NO: 17700 - protein, 9 aa, Homo Sapiens
CHSGRVLCQ

SEQ ID NO: 17701 - protein, 9 aa, Homo Sapiens
KTQPPFSRM

SEQ ID NO: 17702 - protein, 9 aa, Homo Sapiens
CMKTCDNWN

SEQ ID NO: 17703 - protein, 9 aa, Homo Sapiens
SVQTVSKNL

SEQ ID NO: 17704 - protein, 9 aa, Homo Sapiens
KATSVKPLR

SEQ ID NO: 17705 - protein, 9 aa, Homo Sapiens
EDYKKPIQE

SEQ ID NO: 17706 - protein, 9 aa, Homo Sapiens
LSDTIQVYQ

SEQ ID NO: 17707 - protein, 9 aa, Homo Sapiens
AWLPGAALG

SEQ ID NO: 17708 - protein, 9 aa, Homo Sapiens
AQIPNGEFT

SEQ ID NO: 17709 - protein, 9 aa, Homo Sapiens
KPGRGDKSP

SEQ ID NO: 17710 - protein, 9 aa, Homo Sapiens
QLRFDQHSA

SEQ ID NO: 17711 - protein, 9 aa, Homo Sapiens
MQDAKAIRG

SEQ ID NO: 17712 - protein, 9 aa, Homo Sapiens
RRKATLHTK

SEQ ID NO: 17713 - protein, 9 aa, Homo Sapiens
VDPLKNLWL

SEQ ID NO: 17714 - protein, 9 aa, Homo Sapiens
VAIFCSVQM

SEQ ID NO: 17715 - protein, 9 aa, Homo Sapiens
LLRAGAWLP

SEQ ID NO: 17716 - protein, 9 aa, Homo Sapiens
LRIPPRRSG

SEQ ID NO: 17717 - protein, 9 aa, Homo Sapiens
PLFLQPEGK

SEQ ID NO: 17718 - protein, 9 aa, Homo Sapiens
NVLIGFLYG

SEQ ID NO: 17719 - protein, 9 aa, Homo Sapiens
NTTLRCHLL

SEQ ID NO: 17720 - protein, 9 aa, Homo Sapiens
IRQLEEYQG

SEQ ID NO: 17721 - protein, 9 aa, Homo Sapiens
GPGGAFAAP

SEQ ID NO: 17722 - protein, 9 aa, Homo Sapiens
NQDTDIPKG

SEQ ID NO: 17723 - protein, 9 aa, Homo Sapiens
LPSLLLNPT

SEQ ID NO: 17724 - protein, 9 aa, Homo Sapiens
SSSSSSLSA

SEQ ID NO: 17725 - protein, 9 aa, Homo Sapiens
ATSNRKYSV

SEQ ID NO: 17726 - protein, 9 aa, Homo Sapiens
RTMYLLSYI

SEQ ID NO: 17727 - protein, 9 aa, Homo Sapiens
SDSVQSLKE

SEQ ID NO: 17728 - protein, 9 aa, Homo Sapiens
PQGGHIAIA

SEQ ID NO: 17729 - protein, 9 aa, Homo Sapiens
FVSWIALFT

SEQ ID NO: 17730 - protein, 9 aa, Homo Sapiens
QKLREEIRK

SEQ ID NO: 17731 - protein, 9 aa, Homo Sapiens
SMPDKPVSD

SEQ ID NO: 17732 - protein, 9 aa, Homo Sapiens
AMSVSDSII

SEQ ID NO: 17733 - protein, 9 aa, Homo Sapiens
SLANGTAQD

SEQ ID NO: 17734 - protein, 9 aa, Homo Sapiens
RERRCTLPT

SEQ ID NO: 17735 - protein, 9 aa, Homo Sapiens
TSKPGRGDK

SEQ ID NO: 17736 - protein, 9 aa, Homo Sapiens
FHPSNIEVD

SEQ ID NO: 17737 - protein, 9 aa, Homo Sapiens
KLKATADDF

SEQ ID NO: 17738 - protein, 9 aa, Homo Sapiens
LSHAKTLLA

SEQ ID NO: 17739 - protein, 9 aa, Homo Sapiens
RKYSVGVKK

SEQ ID NO: 17740 - protein, 9 aa, Homo Sapiens
GSQVRCRKQ

SEQ ID NO: 17741 - protein, 9 aa, Homo Sapiens
VDDRRSVYY

SEQ ID NO: 17742 - protein, 9 aa, Homo Sapiens
HLPWDTVST

SEQ ID NO: 17743 - protein, 9 aa, Homo Sapiens
DKPVSDKLS

SEQ ID NO: 17744 - protein, 9 aa, Homo Sapiens
PSDNPFVYE

SEQ ID NO: 17745 - protein, 9 aa, Homo Sapiens
NKLLSHAVP

SEQ ID NO: 17746 - protein, 9 aa, Homo Sapiens
NPEDYKKPI

SEQ ID NO: 17747 - protein, 9 aa, Homo Sapiens
SPTVKWMKD

SEQ ID NO: 17748 - protein, 9 aa, Homo Sapiens
GFPGSLGPR

SEQ ID NO: 17749 - protein, 9 aa, Homo Sapiens
RCHLLPEKN

SEQ ID NO: 17750 - protein, 9 aa, Homo Sapiens
GHLYPYTTS

SEQ ID NO: 17751 - protein, 9 aa, Homo Sapiens
NIINTGEKS

SEQ ID NO: 17752 - protein, 9 aa, Homo Sapiens
APTLTRVLM

SEQ ID NO: 17753 - protein, 9 aa, Homo Sapiens
HNGNNDQSI

SEQ ID NO: 17754 - protein, 9 aa, Homo Sapiens
VAPATAHEP

SEQ ID NO: 17755 - protein, 9 aa, Homo Sapiens
SIGLRGERP

SEQ ID NO: 17756 - protein, 9 aa, Homo Sapiens
RRVDDRRSV

SEQ ID NO: 17757 - protein, 9 aa, Homo Sapiens
RLYGYLPEP

SEQ ID NO: 17758 - protein, 9 aa, Homo Sapiens
FTYEYIFNN

SEQ ID NO: 17759 - protein, 9 aa, Homo Sapiens
SSGLGHREY

SEQ ID NO: 17760 - protein, 9 aa, Homo Sapiens
LREKMHRRF

SEQ ID NO: 17761 - protein, 9 aa, Homo Sapiens
QPPFSRMNR

SEQ ID NO: 17762 - protein, 9 aa, Homo Sapiens
FKPEQMLYT

SEQ ID NO: 17763 - protein, 9 aa, Homo Sapiens
LANGKPPSV

SEQ ID NO: 17764 - protein, 9 aa, Homo Sapiens
HFPSLANGT

SEQ ID NO: 17765 - protein, 9 aa, Homo Sapiens
KPPLLGFAY

SEQ ID NO: 17766 - protein, 9 aa, Homo Sapiens
DELDVRITV

SEQ ID NO: 17767 - protein, 9 aa, Homo Sapiens
YCGATLDEA

SEQ ID NO: 17768 - protein, 9 aa, Homo Sapiens
QMKDYGPAK

SEQ ID NO: 17769 - protein, 9 aa, Homo Sapiens
ETQNQSSKD

SEQ ID NO: 17770 - protein, 9 aa, Homo Sapiens
EGLRQNEDV

SEQ ID NO: 17771 - protein, 9 aa, Homo Sapiens
KQCGKTFNQ

SEQ ID NO: 17772 - protein, 9 aa, Homo Sapiens
LYMDMEGQN

SEQ ID NO: 17773 - protein, 9 aa, Homo Sapiens
LGHREYRSG

SEQ ID NO: 17774 - protein, 9 aa, Homo Sapiens
GTRVRAMTI

SEQ ID NO: 17775 - protein, 9 aa, Homo Sapiens
DGNNLLSVP

SEQ ID NO: 17776 - protein, 9 aa, Homo Sapiens
SANRYFTLD

SEQ ID NO: 17777 - protein, 9 aa, Homo Sapiens
ACLNFTYEY

SEQ ID NO: 17778 - protein, 9 aa, Homo Sapiens
HPAFAQGKR

SEQ ID NO: 17779 - protein, 9 aa, Homo Sapiens
AELQSSSRA

SEQ ID NO: 17780 - protein, 9 aa, Homo Sapiens
GMQDAKAIR

SEQ ID NO: 17781 - protein, 9 aa, Homo Sapiens
MCKLLYIRL

SEQ ID NO: 17782 - protein, 9 aa, Homo Sapiens
VTKPNPSFI

SEQ ID NO: 17783 - protein, 9 aa, Homo Sapiens
PFSRMNREE

SEQ ID NO: 17784 - protein, 9 aa, Homo Sapiens
ECAAGFFKT

SEQ ID NO: 17785 - protein, 9 aa, Homo Sapiens
SKDSETELL

SEQ ID NO: 17786 - protein, 9 aa, Homo Sapiens
NHIDENGKS

SEQ ID NO: 17787 - protein, 9 aa, Homo Sapiens
PDEEGRAEA

SEQ ID NO: 17788 - protein, 9 aa, Homo Sapiens
GGHIAIAMR

SEQ ID NO: 17789 - protein, 9 aa, Homo Sapiens
DLNIDQLQC

SEQ ID NO: 17790 - protein, 9 aa, Homo Sapiens
WWNHIDENG

SEQ ID NO: 17791 - protein, 9 aa, Homo Sapiens
DALDYKSFS

SEQ ID NO: 17792 - protein, 9 aa, Homo Sapiens
EQKLREEIR

SEQ ID NO: 17793 - protein, 9 aa, Homo Sapiens
IAELQSSSR

SEQ ID NO: 17794 - protein, 9 aa, Homo Sapiens
YCDTNSDSV

SEQ ID NO: 17795 - protein, 9 aa, Homo Sapiens
NPFVYEPGA

SEQ ID NO: 17796 - protein, 9 aa, Homo Sapiens
LLAGTELIS

SEQ ID NO: 17797 - protein, 9 aa, Homo Sapiens
GPRLLPSGA

SEQ ID NO: 17798 - protein, 9 aa, Homo Sapiens
YRSGQSSGY

SEQ ID NO: 17799 - protein, 9 aa, Homo Sapiens
FLSASHCRA

SEQ ID NO: 17800 - protein, 9 aa, Homo Sapiens
VGDTGMQDA

SEQ ID NO: 17801 - protein, 9 aa, Homo Sapiens
HGRMMVVAW

SEQ ID NO: 17802 - protein, 9 aa, Homo Sapiens
VVTEDSPLI

SEQ ID NO: 17803 - protein, 9 aa, Homo Sapiens
DSVQSLKEI

SEQ ID NO: 17804 - protein, 9 aa, Homo Sapiens
AQVVIYETN

SEQ ID NO: 17805 - protein, 9 aa, Homo Sapiens
ASAADIKQQ

SEQ ID NO: 17806 - protein, 9 aa, Homo Sapiens
CNVLIGFLY

SEQ ID NO: 17807 - protein, 9 aa, Homo Sapiens
LPWRSGKLK

SEQ ID NO: 17808 - protein, 9 aa, Homo Sapiens
CDTNSDSVQ

SEQ ID NO: 17809 - protein, 9 aa, Homo Sapiens
IRVLGSLLF

SEQ ID NO: 17810 - protein, 9 aa, Homo Sapiens
SCTVVCPLH

SEQ ID NO: 17811 - protein, 9 aa, Homo Sapiens
QKIQDCSQW

SEQ ID NO: 17812 - protein, 9 aa, Homo Sapiens
KSKLETEQE

SEQ ID NO: 17813 - protein, 9 aa, Homo Sapiens
GGVQVSSPN

SEQ ID NO: 17814 - protein, 9 aa, Homo Sapiens
DCPKLKATA

SEQ ID NO: 17815 - protein, 9 aa, Homo Sapiens
RMMVVAWGT

SEQ ID NO: 17816 - protein, 9 aa, Homo Sapiens
QKPQQPTPR

SEQ ID NO: 17817 - protein, 9 aa, Homo Sapiens
NSHQDLQAQ

SEQ ID NO: 17818 - protein, 9 aa, Homo Sapiens
LSGAQIPNG

SEQ ID NO: 17819 - protein, 9 aa, Homo Sapiens
MMQVIQEYI

SEQ ID NO: 17820 - protein, 9 aa, Homo Sapiens
TQGRRPICI

SEQ ID NO: 17821 - protein, 9 aa, Homo Sapiens
KIHTEQKPY

SEQ ID NO: 17822 - protein, 9 aa, Homo Sapiens
FEGSGRSNK

SEQ ID NO: 17823 - protein, 9 aa, Homo Sapiens
SEGLRQNED

SEQ ID NO: 17824 - protein, 9 aa, Homo Sapiens
SHPKILYHT

SEQ ID NO: 17825 - protein, 9 aa, Homo Sapiens
SLLAGTELI

SEQ ID NO: 17826 - protein, 9 aa, Homo Sapiens
KKGKARCSS

SEQ ID NO: 17827 - protein, 9 aa, Homo Sapiens
HCAKVMNAY

SEQ ID NO: 17828 - protein, 9 aa, Homo Sapiens
VPSDNPFVY

SEQ ID NO: 17829 - protein, 9 aa, Homo Sapiens
AAGSFAYAF

SEQ ID NO: 17830 - protein, 9 aa, Homo Sapiens
SVFRAITHP

SEQ ID NO: 17831 - protein, 9 aa, Homo Sapiens
PQQPTPRKS

SEQ ID NO: 17832 - protein, 9 aa, Homo Sapiens
NIDQLQCNE

SEQ ID NO: 17833 - protein, 9 aa, Homo Sapiens
PYLYTVVKD

SEQ ID NO: 17834 - protein, 9 aa, Homo Sapiens
AFSYCSHLR

SEQ ID NO: 17835 - protein, 9 aa, Homo Sapiens
GISETRIEN

SEQ ID NO: 17836 - protein, 9 aa, Homo Sapiens
QGGRTPHKE

SEQ ID NO: 17837 - protein, 9 aa, Homo Sapiens
VHYNIAELQ

SEQ ID NO: 17838 - protein, 9 aa, Homo Sapiens
DDWQSVITN

SEQ ID NO: 17839 - protein, 9 aa, Homo Sapiens
RYLTSSRFF

SEQ ID NO: 17840 - protein, 9 aa, Homo Sapiens
MQKRAEQFN

SEQ ID NO: 17841 - protein, 9 aa, Homo Sapiens
RQQGLPPPL

SEQ ID NO: 17842 - protein, 9 aa, Homo Sapiens
SQDVLCDKV

SEQ ID NO: 17843 - protein, 9 aa, Homo Sapiens
SGDDDWQSV

SEQ ID NO: 17844 - protein, 9 aa, Homo Sapiens
AFAQGKRLA

SEQ ID NO: 17845 - protein, 9 aa, Homo Sapiens
TKFLDCSDH

SEQ ID NO: 17846 - protein, 9 aa, Homo Sapiens
LKGHNIINT

SEQ ID NO: 17847 - protein, 9 aa, Homo Sapiens
PGGAFAAPA

SEQ ID NO: 17848 - protein, 9 aa, Homo Sapiens
DKTQLLSSP

SEQ ID NO: 17849 - protein, 9 aa, Homo Sapiens
QLYYQDLLQ

SEQ ID NO: 17850 - protein, 9 aa, Homo Sapiens
ERPTRIPQL

SEQ ID NO: 17851 - protein, 9 aa, Homo Sapiens
RIPQLLPRS

SEQ ID NO: 17852 - protein, 9 aa, Homo Sapiens
WLPRELKPN

SEQ ID NO: 17853 - protein, 9 aa, Homo Sapiens
RDDCKQEAQ

SEQ ID NO: 17854 - protein, 9 aa, Homo Sapiens
SMNYKPMQM

SEQ ID NO: 17855 - protein, 9 aa, Homo Sapiens
NTMFWVYLA

SEQ ID NO: 17856 - protein, 9 aa, Homo Sapiens
VQVSSPNEN

SEQ ID NO: 17857 - protein, 9 aa, Homo Sapiens
KLKKFMIQI

SEQ ID NO: 17858 - protein, 9 aa, Homo Sapiens
AAAGSFAYA

SEQ ID NO: 17859 - protein, 9 aa, Homo Sapiens
CLGGSQSLA

SEQ ID NO: 17860 - protein, 9 aa, Homo Sapiens
YQSMNYKPM

SEQ ID NO: 17861 - protein, 9 aa, Homo Sapiens
LVPGILDLG

SEQ ID NO: 17862 - protein, 9 aa, Homo Sapiens
CPKLKATAD

SEQ ID NO: 17863 - protein, 9 aa, Homo Sapiens
DKAMSVSDS

SEQ ID NO: 17864 - protein, 9 aa, Homo Sapiens
NQSSKDSET

SEQ ID NO: 17865 - protein, 9 aa, Homo Sapiens
GRGENTGTS

SEQ ID NO: 17866 - protein, 9 aa, Homo Sapiens
DILWSNPMA

SEQ ID NO: 17867 - protein, 9 aa, Homo Sapiens
REKEKARKM

SEQ ID NO: 17868 - protein, 9 aa, Homo Sapiens
KLETEQETT

SEQ ID NO: 17869 - protein, 9 aa, Homo Sapiens
APLLPLQDV

SEQ ID NO: 17870 - protein, 9 aa, Homo Sapiens
NYKPMQMYV

SEQ ID NO: 17871 - protein, 9 aa, Homo Sapiens
KLEVVAIFC

SEQ ID NO: 17872 - protein, 9 aa, Homo Sapiens
VYGFMFLFK

SEQ ID NO: 17873 - protein, 9 aa, Homo Sapiens
VSEEEEEDG

SEQ ID NO: 17874 - protein, 9 aa, Homo Sapiens
QAVGVSEGH

SEQ ID NO: 17875 - protein, 9 aa, Homo Sapiens
PRKAREPLL

SEQ ID NO: 17876 - protein, 9 aa, Homo Sapiens
VRCRKQKVE

SEQ ID NO: 17877 - protein, 9 aa, Homo Sapiens
DIKQQNGME

SEQ ID NO: 17878 - protein, 9 aa, Homo Sapiens
ESGGTSVRP

SEQ ID NO: 17879 - protein, 9 aa, Homo Sapiens
VLRGGRDLG

SEQ ID NO: 17880 - protein, 9 aa, Homo Sapiens
KAVGDPSPT

SEQ ID NO: 17881 - protein, 9 aa, Homo Sapiens
VSSTCSSDK

SEQ ID NO: 17882 - protein, 9 aa, Homo Sapiens
ANRYFTLDQ

SEQ ID NO: 17883 - protein, 9 aa, Homo Sapiens
LEKRASQLH

SEQ ID NO: 17884 - protein, 9 aa, Homo Sapiens
EGTYRCFGS

SEQ ID NO: 17885 - protein, 9 aa, Homo Sapiens
LQCNEMYIN

SEQ ID NO: 17886 - protein, 9 aa, Homo Sapiens
PWDTVSTLQ

SEQ ID NO: 17887 - protein, 9 aa, Homo Sapiens
VFLSTCFGG

SEQ ID NO: 17888 - protein, 9 aa, Homo Sapiens
PWRSGKLKD

SEQ ID NO: 17889 - protein, 9 aa, Homo Sapiens
AHGALVAPA

SEQ ID NO: 17890 - protein, 9 aa, Homo Sapiens
WLLNREQKL

SEQ ID NO: 17891 - protein, 9 aa, Homo Sapiens
VSDSSSASA

SEQ ID NO: 17892 - protein, 9 aa, Homo Sapiens
QRLKGARRL

SEQ ID NO: 17893 - protein, 9 aa, Homo Sapiens
LQVLSVFRA

SEQ ID NO: 17894 - protein, 9 aa, Homo Sapiens
CRKQKVEME

SEQ ID NO: 17895 - protein, 9 aa, Homo Sapiens
KGTPEVSCR

SEQ ID NO: 17896 - protein, 9 aa, Homo Sapiens
GIYAYGFQK

SEQ ID NO: 17897 - protein, 9 aa, Homo Sapiens
DYDNACLIV

SEQ ID NO: 17898 - protein, 9 aa, Homo Sapiens
EEYEHIRRE

SEQ ID NO: 17899 - protein, 9 aa, Homo Sapiens
FKEFPRLKR

SEQ ID NO: 17900 - protein, 9 aa, Homo Sapiens
GDEGDAREG

SEQ ID NO: 17901 - protein, 9 aa, Homo Sapiens
KAFSYCSHL

SEQ ID NO: 17902 - protein, 9 aa, Homo Sapiens
QLLPRSQRQ

SEQ ID NO: 17903 - protein, 9 aa, Homo Sapiens
YEANDTRRL

SEQ ID NO: 17904 - protein, 9 aa, Homo Sapiens
PSFSYEVGS

SEQ ID NO: 17905 - protein, 9 aa, Homo Sapiens
LLAFLFLMQ

SEQ ID NO: 17906 - protein, 9 aa, Homo Sapiens
LLRRLGPPG

SEQ ID NO: 17907 - protein, 9 aa, Homo Sapiens
QLLSSPFSI

SEQ ID NO: 17908 - protein, 9 aa, Homo Sapiens
YEGCGFPSL

SEQ ID NO: 17909 - protein, 9 aa, Homo Sapiens
LDGNNLLSV

SEQ ID NO: 17910 - protein, 9 aa, Homo Sapiens
SQSHLKGHN

SEQ ID NO: 17911 - protein, 9 aa, Homo Sapiens
YHTVPVMWL

SEQ ID NO: 17912 - protein, 9 aa, Homo Sapiens
VSEGHHTKD

SEQ ID NO: 17913 - protein, 9 aa, Homo Sapiens
LKQGDDYDS

SEQ ID NO: 17914 - protein, 9 aa, Homo Sapiens
YLKGQLALS

SEQ ID NO: 17915 - protein, 9 aa, Homo Sapiens
DLHPDHMLM

SEQ ID NO: 17916 - protein, 9 aa, Homo Sapiens
HKKIHTEQK

SEQ ID NO: 17917 - protein, 9 aa, Homo Sapiens
EQMLYTFRY

SEQ ID NO: 17918 - protein, 9 aa, Homo Sapiens
PDEGDTTPK

SEQ ID NO: 17919 - protein, 9 aa, Homo Sapiens
QCEQLLCAK

SEQ ID NO: 17920 - protein, 9 aa, Homo Sapiens
DHESSAVVK

SEQ ID NO: 17921 - protein, 9 aa, Homo Sapiens
DQLQCNEMY

SEQ ID NO: 17922 - protein, 9 aa, Homo Sapiens
SIYGEKFEN

SEQ ID NO: 17923 - protein, 9 aa, Homo Sapiens
LLPLQDVFV

SEQ ID NO: 17924 - protein, 9 aa, Homo Sapiens
QEQLLRRLG

SEQ ID NO: 17925 - protein, 9 aa, Homo Sapiens
QIMSPVSKT

SEQ ID NO: 17926 - protein, 9 aa, Homo Sapiens
FNKCFLNVC

SEQ ID NO: 17927 - protein, 9 aa, Homo Sapiens
KLLSHAVPL

SEQ ID NO: 17928 - protein, 9 aa, Homo Sapiens
YSDLAGSFL

SEQ ID NO: 17929 - protein, 9 aa, Homo Sapiens
NGKSHWVFE

SEQ ID NO: 17930 - protein, 9 aa, Homo Sapiens
YETGSQVRC

SEQ ID NO: 17931 - protein, 9 aa, Homo Sapiens
VSISRNCTE

SEQ ID NO: 17932 - protein, 9 aa, Homo Sapiens
GAKERSHKL

SEQ ID NO: 17933 - protein, 9 aa, Homo Sapiens
AWLLNREQK

SEQ ID NO: 17934 - protein, 9 aa, Homo Sapiens
FEDFSRSVP

SEQ ID NO: 17935 - protein, 9 aa, Homo Sapiens
KFVTSCSKP

SEQ ID NO: 17936 - protein, 9 aa, Homo Sapiens
LTRVLMKVD

SEQ ID NO: 17937 - protein, 9 aa, Homo Sapiens
TRIPQLLPR

SEQ ID NO: 17938 - protein, 9 aa, Homo Sapiens
DDYDSKING

SEQ ID NO: 17939 - protein, 9 aa, Homo Sapiens
TEQKPYKYE

SEQ ID NO: 17940 - protein, 9 aa, Homo Sapiens
LSCLGGSQS

SEQ ID NO: 17941 - protein, 9 aa, Homo Sapiens
AHNMQSTVD

SEQ ID NO: 17942 - protein, 9 aa, Homo Sapiens
PSLFLSASH

SEQ ID NO: 17943 - protein, 9 aa, Homo Sapiens
GTELISDTC

SEQ ID NO: 17944 - protein, 9 aa, Homo Sapiens
ARQGAKERS

SEQ ID NO: 17945 - protein, 9 aa, Homo Sapiens
LPLWAILVC

SEQ ID NO: 17946 - protein, 9 aa, Homo Sapiens
SFIRQLEEY

SEQ ID NO: 17947 - protein, 9 aa, Homo Sapiens
IKKPQTQGR

SEQ ID NO: 17948 - protein, 9 aa, Homo Sapiens
DENGKSHWV

SEQ ID NO: 17949 - protein, 9 aa, Homo Sapiens
QAVQATKNF

SEQ ID NO: 17950 - protein, 9 aa, Homo Sapiens
AKGFGAQGP

SEQ ID NO: 17951 - protein, 9 aa, Homo Sapiens
SLKLALHME

SEQ ID NO: 17952 - protein, 9 aa, Homo Sapiens
FQEWFLHFW

SEQ ID NO: 17953 - protein, 9 aa, Homo Sapiens
DRRSVYYVD

SEQ ID NO: 17954 - protein, 9 aa, Homo Sapiens
EIPTPHSDQ

SEQ ID NO: 17955 - protein, 9 aa, Homo Sapiens
SSSSSLSAS

SEQ ID NO: 17956 - protein, 9 aa, Homo Sapiens
VTSNDKVLF

SEQ ID NO: 17957 - protein, 9 aa, Homo Sapiens
SSELHGPKT

SEQ ID NO: 17958 - protein, 9 aa, Homo Sapiens
STVHLVLRL

SEQ ID NO: 17959 - protein, 9 aa, Homo Sapiens
YTLNTMFWV

SEQ ID NO: 17960 - protein, 9 aa, Homo Sapiens
SSLSASASS

SEQ ID NO: 17961 - protein, 9 aa, Homo Sapiens
GMDTAFSVA

SEQ ID NO: 17962 - protein, 9 aa, Homo Sapiens
NIEVDLLKN

SEQ ID NO: 17963 - protein, 9 aa, Homo Sapiens
TLANGKPPS

SEQ ID NO: 17964 - protein, 9 aa, Homo Sapiens
VNLKNILQW

SEQ ID NO: 17965 - protein, 9 aa, Homo Sapiens
TKKEVKQEK

SEQ ID NO: 17966 - protein, 9 aa, Homo Sapiens
NEEDEEAKA

SEQ ID NO: 17967 - protein, 9 aa, Homo Sapiens
PPLDKEKGK

SEQ ID NO: 17968 - protein, 9 aa, Homo Sapiens
PSLANGTAQ

SEQ ID NO: 17969 - protein, 9 aa, Homo Sapiens
FNDLSSEIN

SEQ ID NO: 17970 - protein, 9 aa, Homo Sapiens
RSAKGFGAQ

SEQ ID NO: 17971 - protein, 9 aa, Homo Sapiens
LNDSVCDGA

SEQ ID NO: 17972 - protein, 9 aa, Homo Sapiens
VPDWRGPHG

SEQ ID NO: 17973 - protein, 9 aa, Homo Sapiens
AKGKESRHA

SEQ ID NO: 17974 - protein, 9 aa, Homo Sapiens
SVQSLKEII

SEQ ID NO: 17975 - protein, 9 aa, Homo Sapiens
PGPRKSMCK

SEQ ID NO: 17976 - protein, 9 aa, Homo Sapiens
KVGDWMVKQ

SEQ ID NO: 17977 - protein, 9 aa, Homo Sapiens
MKTQPPFSR

SEQ ID NO: 17978 - protein, 9 aa, Homo Sapiens
GPATHEGTY

SEQ ID NO: 17979 - protein, 9 aa, Homo Sapiens
LLYMDMEGQ

SEQ ID NO: 17980 - protein, 9 aa, Homo Sapiens
HKKFYSSEL

SEQ ID NO: 17981 - protein, 9 aa, Homo Sapiens
LIPPNGEKK

SEQ ID NO: 17982 - protein, 9 aa, Homo Sapiens
RYFTLDQVF

SEQ ID NO: 17983 - protein, 9 aa, Homo Sapiens
EGRAEAPAA

SEQ ID NO: 17984 - protein, 9 aa, Homo Sapiens
DEGDTTPKK

SEQ ID NO: 17985 - protein, 9 aa, Homo Sapiens
MERFQLYYQ

SEQ ID NO: 17986 - protein, 9 aa, Homo Sapiens
GRVLCQTEV

SEQ ID NO: 17987 - protein, 9 aa, Homo Sapiens
KSLKSKLET

SEQ ID NO: 17988 - protein, 9 aa, Homo Sapiens
CNVKLLYRV

SEQ ID NO: 17989 - protein, 9 aa, Homo Sapiens
IALFTTASV

SEQ ID NO: 17990 - protein, 9 aa, Homo Sapiens
REYRSGQSS

SEQ ID NO: 17991 - protein, 9 aa, Homo Sapiens
FNEDGLRMF

SEQ ID NO: 17992 - protein, 9 aa, Homo Sapiens
PHPPDFQMM

SEQ ID NO: 17993 - protein, 9 aa, Homo Sapiens
PLLPLQDVF

SEQ ID NO: 17994 - protein, 9 aa, Homo Sapiens
DELRKPDDD

SEQ ID NO: 17995 - protein, 9 aa, Homo Sapiens
MQSTVDDAT

SEQ ID NO: 17996 - protein, 9 aa, Homo Sapiens
VILDITKRE

SEQ ID NO: 17997 - protein, 9 aa, Homo Sapiens
LLPGPLPAS

SEQ ID NO: 17998 - protein, 9 aa, Homo Sapiens
SNQDTDIPK

SEQ ID NO: 17999 - protein, 9 aa, Homo Sapiens
KVMNAYEEQ

SEQ ID NO: 18000 - protein, 9 aa, Homo Sapiens
SSSSLSASA

SEQ ID NO: 18001 - protein, 9 aa, Homo Sapiens
AIRYLKGQL

SEQ ID NO: 18002 - protein, 9 aa, Homo Sapiens
DEEGRAEAP

SEQ ID NO: 18003 - protein, 9 aa, Homo Sapiens
HPSANRYFT

SEQ ID NO: 18004 - protein, 9 aa, Homo Sapiens
SYCGGGKAL

SEQ ID NO: 18005 - protein, 9 aa, Homo Sapiens
KAREPLLVA

SEQ ID NO: 18006 - protein, 9 aa, Homo Sapiens
AMEHPYLYT

SEQ ID NO: 18007 - protein, 9 aa, Homo Sapiens
IQKESTVHL

SEQ ID NO: 18008 - protein, 9 aa, Homo Sapiens
IHPSANRYF

SEQ ID NO: 18009 - protein, 9 aa, Homo Sapiens
RNVTSNDKV

SEQ ID NO: 18010 - protein, 9 aa, Homo Sapiens
ILWSNPMAQ

SEQ ID NO: 18011 - protein, 9 aa, Homo Sapiens
DSSSASAFE

SEQ ID NO: 18012 - protein, 9 aa, Homo Sapiens
QGDEGDARE

SEQ ID NO: 18013 - protein, 9 aa, Homo Sapiens
KTQLLSSPF

SEQ ID NO: 18014 - protein, 9 aa, Homo Sapiens
VINKLLSHA

SEQ ID NO: 18015 - protein, 9 aa, Homo Sapiens
SAEDQMKMK

SEQ ID NO: 18016 - protein, 9 aa, Homo Sapiens
LPEYVFENK

SEQ ID NO: 18017 - protein, 9 aa, Homo Sapiens
GERPTRIPQ

SEQ ID NO: 18018 - protein, 9 aa, Homo Sapiens
DKVLFNVTV

SEQ ID NO: 18019 - protein, 9 aa, Homo Sapiens
FMNYSCEPN

SEQ ID NO: 18020 - protein, 9 aa, Homo Sapiens
SFALYFAVV

SEQ ID NO: 18021 - protein, 9 aa, Homo Sapiens
AEQFNVPVS

SEQ ID NO: 18022 - protein, 9 aa, Homo Sapiens
CLNFTYEYI

SEQ ID NO: 18023 - protein, 9 aa, Homo Sapiens
PTLTRVLMK

SEQ ID NO: 18024 - protein, 9 aa, Homo Sapiens
AQAVGVSEG

SEQ ID NO: 18025 - protein, 9 aa, Homo Sapiens
SHAKTLLAA

SEQ ID NO: 18026 - protein, 9 aa, Homo Sapiens
GSCTVVCPL

SEQ ID NO: 18027 - protein, 9 aa, Homo Sapiens
ALVPGILDL

SEQ ID NO: 18028 - protein, 9 aa, Homo Sapiens
WQQREEVRG

SEQ ID NO: 18029 - protein, 9 aa, Homo Sapiens
VKDAVLYCG

SEQ ID NO: 18030 - protein, 9 aa, Homo Sapiens
AYGFQKPSA

SEQ ID NO: 18031 - protein, 9 aa, Homo Sapiens
TIQVYQERI

SEQ ID NO: 18032 - protein, 9 aa, Homo Sapiens
TKPNPSFIR

SEQ ID NO: 18033 - protein, 9 aa, Homo Sapiens
HPIDKAMSV

SEQ ID NO: 18034 - protein, 9 aa, Homo Sapiens
WMVKQASLD

SEQ ID NO: 18035 - protein, 9 aa, Homo Sapiens
LCNVLIGFL

SEQ ID NO: 18036 - protein, 9 aa, Homo Sapiens
RRSFALYFA

SEQ ID NO: 18037 - protein, 9 aa, Homo Sapiens
PHGTFFGMF

SEQ ID NO: 18038 - protein, 9 aa, Homo Sapiens
QTEVCPPLL

SEQ ID NO: 18039 - protein, 9 aa, Homo Sapiens
CQGPVYGFM

SEQ ID NO: 18040 - protein, 9 aa, Homo Sapiens
AYAFAALVL

SEQ ID NO: 18041 - protein, 9 aa, Homo Sapiens
PALPGDREA

SEQ ID NO: 18042 - protein, 9 aa, Homo Sapiens
ATHEGTYRC

SEQ ID NO: 18043 - protein, 9 aa, Homo Sapiens
RCNDMINLG

SEQ ID NO: 18044 - protein, 9 aa, Homo Sapiens
AVAIFATQF

SEQ ID NO: 18045 - protein, 9 aa, Homo Sapiens
YAFAALVLC

SEQ ID NO: 18046 - protein, 9 aa, Homo Sapiens
YQGPDAVPD

SEQ ID NO: 18047 - protein, 9 aa, Homo Sapiens
EVGAGTGQI

SEQ ID NO: 18048 - protein, 9 aa, Homo Sapiens
QQHRQWFFK

SEQ ID NO: 18049 - protein, 9 aa, Homo Sapiens
DPGSNQDTD

SEQ ID NO: 18050 - protein, 9 aa, Homo Sapiens
VVSEEEEED

SEQ ID NO: 18051 - protein, 9 aa, Homo Sapiens
QNEDVWLWQ

SEQ ID NO: 18052 - protein, 9 aa, Homo Sapiens
REWSASRRS

SEQ ID NO: 18053 - protein, 9 aa, Homo Sapiens
SVYYVDHNT

SEQ ID NO: 18054 - protein, 9 aa, Homo Sapiens
HLESIDNEE

SEQ ID NO: 18055 - protein, 9 aa, Homo Sapiens
SSNAGGRGE

SEQ ID NO: 18056 - protein, 9 aa, Homo Sapiens
EPSRHMSTM

SEQ ID NO: 18057 - protein, 9 aa, Homo Sapiens
KIDQISMEK

SEQ ID NO: 18058 - protein, 9 aa, Homo Sapiens
IDENGKSHW

SEQ ID NO: 18059 - protein, 9 aa, Homo Sapiens
RPGTWSSKA

SEQ ID NO: 18060 - protein, 9 aa, Homo Sapiens
GRALYEVGA

SEQ ID NO: 18061 - protein, 9 aa, Homo Sapiens
AADIKQQNG

SEQ ID NO: 18062 - protein, 9 aa, Homo Sapiens
QQNGMESAS

SEQ ID NO: 18063 - protein, 9 aa, Homo Sapiens
VRAMTIYKQ

SEQ ID NO: 18064 - protein, 9 aa, Homo Sapiens
EKQWGPLQR

SEQ ID NO: 18065 - protein, 9 aa, Homo Sapiens
LYTFRYDDG

SEQ ID NO: 18066 - protein, 9 aa, Homo Sapiens
QVLSVFRAI

SEQ ID NO: 18067 - protein, 9 aa, Homo Sapiens
LPLQDVFVG

SEQ ID NO: 18068 - protein, 9 aa, Homo Sapiens
LSVAKGKES

SEQ ID NO: 18069 - protein, 9 aa, Homo Sapiens
TTSRDSAYT

SEQ ID NO: 18070 - protein, 9 aa, Homo Sapiens
NNATSNRKY

SEQ ID NO: 18071 - protein, 9 aa, Homo Sapiens
NDSVCDGAV

SEQ ID NO: 18072 - protein, 9 aa, Homo Sapiens
EKEKARKMK

SEQ ID NO: 18073 - protein, 9 aa, Homo Sapiens
QGDDYDSKI

SEQ ID NO: 18074 - protein, 9 aa, Homo Sapiens
LLGGPGGAF

SEQ ID NO: 18075 - protein, 9 aa, Homo Sapiens
LWLPRELKP

SEQ ID NO: 18076 - protein, 9 aa, Homo Sapiens
GSNQDTDIP

SEQ ID NO: 18077 - protein, 9 aa, Homo Sapiens
TRIENRIVI

SEQ ID NO: 18078 - protein, 9 aa, Homo Sapiens
MLREKMHRR

SEQ ID NO: 18079 - protein, 9 aa, Homo Sapiens
GLRMFMTRD

SEQ ID NO: 18080 - protein, 9 aa, Homo Sapiens
GDTYVCTSD

SEQ ID NO: 18081 - protein, 9 aa, Homo Sapiens
FRSLGYEGC

SEQ ID NO: 18082 - protein, 9 aa, Homo Sapiens
ELKGTPEVS

SEQ ID NO: 18083 - protein, 9 aa, Homo Sapiens
KKIHTEQKP

SEQ ID NO: 18084 - protein, 9 aa, Homo Sapiens
TVDYDNACL

SEQ ID NO: 18085 - protein, 9 aa, Homo Sapiens
RHRLGPLPE

SEQ ID NO: 18086 - protein, 9 aa, Homo Sapiens
EPMRQQGLP

SEQ ID NO: 18087 - protein, 9 aa, Homo Sapiens
MNYKPMQMY

SEQ ID NO: 18088 - protein, 9 aa, Homo Sapiens
YFTLDQVFK

SEQ ID NO: 18089 - protein, 9 aa, Homo Sapiens
QRQKYLSHQ

SEQ ID NO: 18090 - protein, 9 aa, Homo Sapiens
LRFDQHSAN

SEQ ID NO: 18091 - protein, 9 aa, Homo Sapiens
INSGMDTAF

SEQ ID NO: 18092 - protein, 9 aa, Homo Sapiens
QATKNFNKC

SEQ ID NO: 18093 - protein, 9 aa, Homo Sapiens
NSDTVDYDN

SEQ ID NO: 18094 - protein, 9 aa, Homo Sapiens
LRQGRALGS

SEQ ID NO: 18095 - protein, 9 aa, Homo Sapiens
LQEGDHESS

SEQ ID NO: 18096 - protein, 9 aa, Homo Sapiens
HKSEIIYTW

SEQ ID NO: 18097 - protein, 9 aa, Homo Sapiens
LAGTELISD

SEQ ID NO: 18098 - protein, 9 aa, Homo Sapiens
KLALHMEIA

SEQ ID NO: 18099 - protein, 9 aa, Homo Sapiens
FQKPSAIQQ

SEQ ID NO: 18100 - protein, 9 aa, Homo Sapiens
HGKPIKVSY

SEQ ID NO: 18101 - protein, 9 aa, Homo Sapiens
YSVGVKKNS

SEQ ID NO: 18102 - protein, 9 aa, Homo Sapiens
SPLAALSEF

SEQ ID NO: 18103 - protein, 9 aa, Homo Sapiens
HMLMEAFFK

SEQ ID NO: 18104 - protein, 9 aa, Homo Sapiens
TQLLSSPFS

SEQ ID NO: 18105 - protein, 9 aa, Homo Sapiens
DDRRSVYYV

SEQ ID NO: 18106 - protein, 9 aa, Homo Sapiens
LNKDFEGPP

SEQ ID NO: 18107 - protein, 9 aa, Homo Sapiens
VSWIALFTT

SEQ ID NO: 18108 - protein, 9 aa, Homo Sapiens
RITVLKSQY

SEQ ID NO: 18109 - protein, 9 aa, Homo Sapiens
YSSELHGPK

SEQ ID NO: 18110 - protein, 9 aa, Homo Sapiens
RQKYLSHQQ

SEQ ID NO: 18111 - protein, 9 aa, Homo Sapiens
FAAPAAGSK

SEQ ID NO: 18112 - protein, 9 aa, Homo Sapiens
VLCQTEVCP

SEQ ID NO: 18113 - protein, 9 aa, Homo Sapiens
PIDKAMSVS

SEQ ID NO: 18114 - protein, 9 aa, Homo Sapiens
TLTRVLMKV

SEQ ID NO: 18115 - protein, 9 aa, Homo Sapiens
PDIMSQLLF

SEQ ID NO: 18116 - protein, 9 aa, Homo Sapiens
PLQREPVRG

SEQ ID NO: 18117 - protein, 9 aa, Homo Sapiens
LETEQETTT

SEQ ID NO: 18118 - protein, 9 aa, Homo Sapiens
TIYKQSQHM

SEQ ID NO: 18119 - protein, 9 aa, Homo Sapiens
VPKRCNDMI

SEQ ID NO: 18120 - protein, 9 aa, Homo Sapiens
RKLPSLLLN

SEQ ID NO: 18121 - protein, 9 aa, Homo Sapiens
EVVAIFCSV

SEQ ID NO: 18122 - protein, 9 aa, Homo Sapiens
WIALFTTAS

SEQ ID NO: 18123 - protein, 9 aa, Homo Sapiens
LLNPTEETV

SEQ ID NO: 18124 - protein, 9 aa, Homo Sapiens
LLFAHRIIT

SEQ ID NO: 18125 - protein, 9 aa, Homo Sapiens
PFVYEPGAH

SEQ ID NO: 18126 - protein, 9 aa, Homo Sapiens
LLSHAVPLP

SEQ ID NO: 18127 - protein, 9 aa, Homo Sapiens
KFLDCSDHP

SEQ ID NO: 18128 - protein, 9 aa, Homo Sapiens
LDCPKLKAT

SEQ ID NO: 18129 - protein, 9 aa, Homo Sapiens
LHMEIATYR

SEQ ID NO: 18130 - protein, 9 aa, Homo Sapiens
EQFNVPVSL

SEQ ID NO: 18131 - protein, 9 aa, Homo Sapiens
EKRASQLHQ

SEQ ID NO: 18132 - protein, 9 aa, Homo Sapiens
AEDQMKMKW

SEQ ID NO: 18133 - protein, 9 aa, Homo Sapiens
KKFYSSELH

SEQ ID NO: 18134 - protein, 9 aa, Homo Sapiens
VQAANPLFL

SEQ ID NO: 18135 - protein, 9 aa, Homo Sapiens
VTTLIPPNG

SEQ ID NO: 18136 - protein, 9 aa, Homo Sapiens
LLNREQKLR

SEQ ID NO: 18137 - protein, 9 aa, Homo Sapiens
GRHRLGPLP

SEQ ID NO: 18138 - protein, 9 aa, Homo Sapiens
QEDLGSPAS

SEQ ID NO: 18139 - protein, 9 aa, Homo Sapiens
AGAKKGKAR

SEQ ID NO: 18140 - protein, 9 aa, Homo Sapiens
FRRQSSSPE

SEQ ID NO: 18141 - protein, 9 aa, Homo Sapiens
MKTCDNWNE

SEQ ID NO: 18142 - protein, 9 aa, Homo Sapiens
RLYEDRRSF

SEQ ID NO: 18143 - protein, 9 aa, Homo Sapiens
SPNENVAIY

SEQ ID NO: 18144 - protein, 9 aa, Homo Sapiens
SHQQMQELS

SEQ ID NO: 18145 - protein, 9 aa, Homo Sapiens
QDTDIPKGY

SEQ ID NO: 18146 - protein, 9 aa, Homo Sapiens
ESLVFLSTC

SEQ ID NO: 18147 - protein, 9 aa, Homo Sapiens
ELDVRITVL

SEQ ID NO: 18148 - protein, 9 aa, Homo Sapiens
RPRKAREPL

SEQ ID NO: 18149 - protein, 9 aa, Homo Sapiens
DLAGSFLKE

SEQ ID NO: 18150 - protein, 9 aa, Homo Sapiens
NVKLLYRVL

SEQ ID NO: 18151 - protein, 9 aa, Homo Sapiens
NMKTQPPFS

SEQ ID NO: 18152 - protein, 9 aa, Homo Sapiens
DCGPMGQRL

SEQ ID NO: 18153 - protein, 9 aa, Homo Sapiens
ESHPKILYH

SEQ ID NO: 18154 - protein, 9 aa, Homo Sapiens
LEVVAIFCS

SEQ ID NO: 18155 - protein, 9 aa, Homo Sapiens
GSPDEEGRA

SEQ ID NO: 18156 - protein, 9 aa, Homo Sapiens
MVKQASLDF

SEQ ID NO: 18157 - protein, 9 aa, Homo Sapiens
NVRMNSVNL

SEQ ID NO: 18158 - protein, 9 aa, Homo Sapiens
VITNQLNKS

SEQ ID NO: 18159 - protein, 9 aa, Homo Sapiens
FGSYAYHKS

SEQ ID NO: 18160 - protein, 9 aa, Homo Sapiens
AAPTLTRVL

SEQ ID NO: 18161 - protein, 9 aa, Homo Sapiens
RAEAPAAGI

SEQ ID NO: 18162 - protein, 9 aa, Homo Sapiens
KMEGHKAME

SEQ ID NO: 18163 - protein, 9 aa, Homo Sapiens
ECINPEDYK

SEQ ID NO: 18164 - protein, 9 aa, Homo Sapiens
SVSDSIITP

SEQ ID NO: 18165 - protein, 9 aa, Homo Sapiens
LMGGHLYPY

SEQ ID NO: 18166 - protein, 9 aa, Homo Sapiens
PMGQRLKGA

SEQ ID NO: 18167 - protein, 9 aa, Homo Sapiens
LDKEKGKTL

SEQ ID NO: 18168 - protein, 9 aa, Homo Sapiens
ECVREGEEE

SEQ ID NO: 18169 - protein, 9 aa, Homo Sapiens
RFDQHSANI

SEQ ID NO: 18170 - protein, 9 aa, Homo Sapiens
NFVSWIALF

SEQ ID NO: 18171 - protein, 9 aa, Homo Sapiens
GALRQGRAL

SEQ ID NO: 18172 - protein, 9 aa, Homo Sapiens
NCSRFMNYS

SEQ ID NO: 18173 - protein, 9 aa, Homo Sapiens
RLLPSGAQL

SEQ ID NO: 18174 - protein, 9 aa, Homo Sapiens
GPLPEPAAS

SEQ ID NO: 18175 - protein, 9 aa, Homo Sapiens
SETRIENRI

SEQ ID NO: 18176 - protein, 9 aa, Homo Sapiens
FQLYYQDLL

SEQ ID NO: 18177 - protein, 9 aa, Homo Sapiens
DDCKQEAQV

SEQ ID NO: 18178 - protein, 9 aa, Homo Sapiens
EDQMKMKWE

SEQ ID NO: 18179 - protein, 9 aa, Homo Sapiens
HIRRENPVG

SEQ ID NO: 18180 - protein, 9 aa, Homo Sapiens
YVCTSDYKD

SEQ ID NO: 18181 - protein, 9 aa, Homo Sapiens
EGDHESSAV

SEQ ID NO: 18182 - protein, 9 aa, Homo Sapiens
RNCTEDRFT

SEQ ID NO: 18183 - protein, 9 aa, Homo Sapiens
GQRLKGARR

SEQ ID NO: 18184 - protein, 9 aa, Homo Sapiens
IMSPVSKTQ

SEQ ID NO: 18185 - protein, 9 aa, Homo Sapiens
MYLLSYIPK

SEQ ID NO: 18186 - protein, 9 aa, Homo Sapiens
PPLRPSGQR

SEQ ID NO: 18187 - protein, 9 aa, Homo Sapiens
EHPYLYTVV

SEQ ID NO: 18188 - protein, 9 aa, Homo Sapiens
SLFLSASHC

SEQ ID NO: 18189 - protein, 9 aa, Homo Sapiens
FYSSELHGP

SEQ ID NO: 18190 - protein, 9 aa, Homo Sapiens
REKLPSPLA

SEQ ID NO: 18191 - protein, 9 aa, Homo Sapiens
FESTEPSDN

SEQ ID NO: 18192 - protein, 9 aa, Homo Sapiens
EPLQVLSVF

SEQ ID NO: 18193 - protein, 9 aa, Homo Sapiens
LREQIAMLR

SEQ ID NO: 18194 - protein, 9 aa, Homo Sapiens
QSSKDSETE

SEQ ID NO: 18195 - protein, 9 aa, Homo Sapiens
LPGPSLFLS

SEQ ID NO: 18196 - protein, 9 aa, Homo Sapiens
VSKNLNDSG

SEQ ID NO: 18197 - protein, 9 aa, Homo Sapiens
ARPRKAREP

SEQ ID NO: 18198 - protein, 9 aa, Homo Sapiens
PGPRLLPSG

SEQ ID NO: 18199 - protein, 9 aa, Homo Sapiens
SLSASASSA

SEQ ID NO: 18200 - protein, 9 aa, Homo Sapiens
TVKRHGKPI

SEQ ID NO: 18201 - protein, 9 aa, Homo Sapiens
CDKVNEEMY

SEQ ID NO: 18202 - protein, 9 aa, Homo Sapiens
SHQDLQAQD

SEQ ID NO: 18203 - protein, 9 aa, Homo Sapiens
SADFWCFQC

SEQ ID NO: 18204 - protein, 9 aa, Homo Sapiens
HNIINTGEK

SEQ ID NO: 18205 - protein, 9 aa, Homo Sapiens
FGGVQVSSP

SEQ ID NO: 18206 - protein, 9 aa, Homo Sapiens
HFWSTVEGA

SEQ ID NO: 18207 - protein, 9 aa, Homo Sapiens
SYAYHKSEI

SEQ ID NO: 18208 - protein, 9 aa, Homo Sapiens
HDLNIDQLQ

SEQ ID NO: 18209 - protein, 9 aa, Homo Sapiens
PLQDVFVGV

SEQ ID NO: 18210 - protein, 9 aa, Homo Sapiens
RGIYAYGFQ

SEQ ID NO: 18211 - protein, 9 aa, Homo Sapiens
LSFQRYLTS

SEQ ID NO: 18212 - protein, 9 aa, Homo Sapiens
FSYCSHLRQ

SEQ ID NO: 18213 - protein, 9 aa, Homo Sapiens
KDHHGRMMV

SEQ ID NO: 18214 - protein, 9 aa, Homo Sapiens
RQMKDYGPA

SEQ ID NO: 18215 - protein, 9 aa, Homo Sapiens
AALVRALLQ

SEQ ID NO: 18216 - protein, 9 aa, Homo Sapiens
DTSVHYNIA

SEQ ID NO: 18217 - protein, 9 aa, Homo Sapiens
NRIVITGDA

SEQ ID NO: 18218 - protein, 9 aa, Homo Sapiens
RPRVHFRTL

SEQ ID NO: 18219 - protein, 9 aa, Homo Sapiens
PSSSTTHKG

SEQ ID NO: 18220 - protein, 9 aa, Homo Sapiens
GKAFSYCSH

SEQ ID NO: 18221 - protein, 9 aa, Homo Sapiens
EHIRRENPV

SEQ ID NO: 18222 - protein, 9 aa, Homo Sapiens
ILETDKTQL

SEQ ID NO: 18223 - protein, 9 aa, Homo Sapiens
TTPKKPEDP

SEQ ID NO: 18224 - protein, 9 aa, Homo Sapiens
VQATKNFNK

SEQ ID NO: 18225 - protein, 9 aa, Homo Sapiens
VIEQLPKPN

SEQ ID NO: 18226 - protein, 9 aa, Homo Sapiens
SAHGALVAP

SEQ ID NO: 18227 - protein, 9 aa, Homo Sapiens
SDLAGSFLK

SEQ ID NO: 18228 - protein, 9 aa, Homo Sapiens
HIDENGKSH

SEQ ID NO: 18229 - protein, 9 aa, Homo Sapiens
HGTFFGMFS

SEQ ID NO: 18230 - protein, 9 aa, Homo Sapiens
TSVRPCSRP

SEQ ID NO: 18231 - protein, 9 aa, Homo Sapiens
FENHKKFYS

SEQ ID NO: 18232 - protein, 9 aa, Homo Sapiens
DQISMEKVD

SEQ ID NO: 18233 - protein, 9 aa, Homo Sapiens
SGRHRLGPL

SEQ ID NO: 18234 - protein, 9 aa, Homo Sapiens
QESAAPTLT

SEQ ID NO: 18235 - protein, 9 aa, Homo Sapiens
DHHGRMMVV

SEQ ID NO: 18236 - protein, 9 aa, Homo Sapiens
GIYEEYEHI

SEQ ID NO: 18237 - protein, 9 aa, Homo Sapiens
RSVPELDRD

SEQ ID NO: 18238 - protein, 9 aa, Homo Sapiens
PEPLAPKSY

SEQ ID NO: 18239 - protein, 9 aa, Homo Sapiens
EEEDNQEED

SEQ ID NO: 18240 - protein, 9 aa, Homo Sapiens
APSFSYEVG

SEQ ID NO: 18241 - protein, 9 aa, Homo Sapiens
LKFGSYAYH

SEQ ID NO: 18242 - protein, 9 aa, Homo Sapiens
QFVAPSGGA

SEQ ID NO: 18243 - protein, 9 aa, Homo Sapiens
RALLQPPLK

SEQ ID NO: 18244 - protein, 9 aa, Homo Sapiens
MEKVDRLAR

SEQ ID NO: 18245 - protein, 9 aa, Homo Sapiens
PKILYHTVP

SEQ ID NO: 18246 - protein, 9 aa, Homo Sapiens
RLSYCGGGK

SEQ ID NO: 18247 - protein, 9 aa, Homo Sapiens
IRYLKGQLA

SEQ ID NO: 18248 - protein, 9 aa, Homo Sapiens
LVLKGWESH

SEQ ID NO: 18249 - protein, 9 aa, Homo Sapiens
VSKNRCHLE

SEQ ID NO: 18250 - protein, 9 aa, Homo Sapiens
MNGEPLAAK

SEQ ID NO: 18251 - protein, 9 aa, Homo Sapiens
ILGASKAHM

SEQ ID NO: 18252 - protein, 9 aa, Homo Sapiens
RHIIFHSGN

SEQ ID NO: 18253 - protein, 9 aa, Homo Sapiens
LQDFNEAQC

SEQ ID NO: 18254 - protein, 9 aa, Homo Sapiens
LELVATVAM

SEQ ID NO: 18255 - protein, 9 aa, Homo Sapiens
ENVRNGIRT

SEQ ID NO: 18256 - protein, 9 aa, Homo Sapiens
PKPHEKALT

SEQ ID NO: 18257 - protein, 9 aa, Homo Sapiens
MKRNQVASP

SEQ ID NO: 18258 - protein, 9 aa, Homo Sapiens
DHNKSSEVS

SEQ ID NO: 18259 - protein, 9 aa, Homo Sapiens
EDLQWWPHK

SEQ ID NO: 18260 - protein, 9 aa, Homo Sapiens
KIIRGNQLQ

SEQ ID NO: 18261 - protein, 9 aa, Homo Sapiens
EVKNAKLEE

SEQ ID NO: 18262 - protein, 9 aa, Homo Sapiens
CKIVIRHAH

SEQ ID NO: 18263 - protein, 9 aa, Homo Sapiens
FMLDGSYSV

SEQ ID NO: 18264 - protein, 9 aa, Homo Sapiens
LEEEQSSSS

SEQ ID NO: 18265 - protein, 9 aa, Homo Sapiens
VSLPELEDR

SEQ ID NO: 18266 - protein, 9 aa, Homo Sapiens
VCQLEQGEL

SEQ ID NO: 18267 - protein, 9 aa, Homo Sapiens
APSVENVRN

SEQ ID NO: 18268 - protein, 9 aa, Homo Sapiens
TSTKGSSSP

SEQ ID NO: 18269 - protein, 9 aa, Homo Sapiens
TPAQQYSLL

SEQ ID NO: 18270 - protein, 9 aa, Homo Sapiens
KEGDEQKRG

SEQ ID NO: 18271 - protein, 9 aa, Homo Sapiens
IVWQQVFDD

SEQ ID NO: 18272 - protein, 9 aa, Homo Sapiens
CTLWRKDVS

SEQ ID NO: 18273 - protein, 9 aa, Homo Sapiens
SNDKRICVV

SEQ ID NO: 18274 - protein, 9 aa, Homo Sapiens
YSNPHRMSH

SEQ ID NO: 18275 - protein, 9 aa, Homo Sapiens
LWDFQGYIK

SEQ ID NO: 18276 - protein, 9 aa, Homo Sapiens
HELNEQKRK

SEQ ID NO: 18277 - protein, 9 aa, Homo Sapiens
LGLLFQLVL

SEQ ID NO: 18278 - protein, 9 aa, Homo Sapiens
SNFGVQAGD

SEQ ID NO: 18279 - protein, 9 aa, Homo Sapiens
RLYLGTVLG

SEQ ID NO: 18280 - protein, 9 aa, Homo Sapiens
CVHHVSTEP

SEQ ID NO: 18281 - protein, 9 aa, Homo Sapiens
ARRPRGQDG

SEQ ID NO: 18282 - protein, 9 aa, Homo Sapiens
RSDCENEED

SEQ ID NO: 18283 - protein, 9 aa, Homo Sapiens
VETYHRTRP

SEQ ID NO: 18284 - protein, 9 aa, Homo Sapiens
PRGQDGKPV

SEQ ID NO: 18285 - protein, 9 aa, Homo Sapiens
EDITKTFEV

SEQ ID NO: 18286 - protein, 9 aa, Homo Sapiens
KGTHLPAEV

SEQ ID NO: 18287 - protein, 9 aa, Homo Sapiens
PLAGLPKPK

SEQ ID NO: 18288 - protein, 9 aa, Homo Sapiens
GGAAVPGIS

SEQ ID NO: 18289 - protein, 9 aa, Homo Sapiens
SHKANGQHD

SEQ ID NO: 18290 - protein, 9 aa, Homo Sapiens
YLFIMVAIM

SEQ ID NO: 18291 - protein, 9 aa, Homo Sapiens
INHPVYTPP

SEQ ID NO: 18292 - protein, 9 aa, Homo Sapiens
LRIRSAQGR

SEQ ID NO: 18293 - protein, 9 aa, Homo Sapiens
LNPIKGGGG

SEQ ID NO: 18294 - protein, 9 aa, Homo Sapiens
NRKEKTAAE

SEQ ID NO: 18295 - protein, 9 aa, Homo Sapiens
CTLSYQKSG

SEQ ID NO: 18296 - protein, 9 aa, Homo Sapiens
GDKGRVQAE

SEQ ID NO: 18297 - protein, 9 aa, Homo Sapiens
KSRLVSQPV

SEQ ID NO: 18298 - protein, 9 aa, Homo Sapiens
GCTLSYQKS

SEQ ID NO: 18299 - protein, 9 aa, Homo Sapiens
ITNYHLYLR

SEQ ID NO: 18300 - protein, 9 aa, Homo Sapiens
RSILNSAMQ

SEQ ID NO: 18301 - protein, 9 aa, Homo Sapiens
CCLTLCDFS

SEQ ID NO: 18302 - protein, 9 aa, Homo Sapiens
KMEEWSASE

SEQ ID NO: 18303 - protein, 9 aa, Homo Sapiens
AKSVLDKMM

SEQ ID NO: 18304 - protein, 9 aa, Homo Sapiens
PLLHCFVIL

SEQ ID NO: 18305 - protein, 9 aa, Homo Sapiens
DSGIQECFS

SEQ ID NO: 18306 - protein, 9 aa, Homo Sapiens
RFDGALRVL

SEQ ID NO: 18307 - protein, 9 aa, Homo Sapiens
ASKAHMAAT

SEQ ID NO: 18308 - protein, 9 aa, Homo Sapiens
HTKLSYRPW

SEQ ID NO: 18309 - protein, 9 aa, Homo Sapiens
KIYKIYLTL

SEQ ID NO: 18310 - protein, 9 aa, Homo Sapiens
SAAWRIYVT

SEQ ID NO: 18311 - protein, 9 aa, Homo Sapiens
KPPHRVRLP

SEQ ID NO: 18312 - protein, 9 aa, Homo Sapiens
FDLVTRQVF

SEQ ID NO: 18313 - protein, 9 aa, Homo Sapiens
ILSMFLAIR

SEQ ID NO: 18314 - protein, 9 aa, Homo Sapiens
DLVFMLDGS

SEQ ID NO: 18315 - protein, 9 aa, Homo Sapiens
DRPQEIAMW

SEQ ID NO: 18316 - protein, 9 aa, Homo Sapiens
VRGNEPRSD

SEQ ID NO: 18317 - protein, 9 aa, Homo Sapiens
ENGDINWII

SEQ ID NO: 18318 - protein, 9 aa, Homo Sapiens
RPRQLVEEL

SEQ ID NO: 18319 - protein, 9 aa, Homo Sapiens
KPPTVTMPQ

SEQ ID NO: 18320 - protein, 9 aa, Homo Sapiens
DITKTFEVN

SEQ ID NO: 18321 - protein, 9 aa, Homo Sapiens
SVSKNRCHL

SEQ ID NO: 18322 - protein, 9 aa, Homo Sapiens
NNVTCVFDP

SEQ ID NO: 18323 - protein, 9 aa, Homo Sapiens
FQSFPNLAA

SEQ ID NO: 18324 - protein, 9 aa, Homo Sapiens
QELLKQVRL

SEQ ID NO: 18325 - protein, 9 aa, Homo Sapiens
GGRENSFRY

SEQ ID NO: 18326 - protein, 9 aa, Homo Sapiens
PIIKIDIRL

SEQ ID NO: 18327 - protein, 9 aa, Homo Sapiens
KDPRIVVTH

SEQ ID NO: 18328 - protein, 9 aa, Homo Sapiens
PWQCPKEPE

SEQ ID NO: 18329 - protein, 9 aa, Homo Sapiens
TCLDGTRSR

SEQ ID NO: 18330 - protein, 9 aa, Homo Sapiens
RKSSVFKAI

SEQ ID NO: 18331 - protein, 9 aa, Homo Sapiens
ETRGAPKPH

SEQ ID NO: 18332 - protein, 9 aa, Homo Sapiens
MAWQVSLPE

SEQ ID NO: 18333 - protein, 9 aa, Homo Sapiens
VNTMRLCSA

SEQ ID NO: 18334 - protein, 9 aa, Homo Sapiens
SLGNMGKAK

SEQ ID NO: 18335 - protein, 9 aa, Homo Sapiens
VRTLVFALV

SEQ ID NO: 18336 - protein, 9 aa, Homo Sapiens
LIMNTMEKT

SEQ ID NO: 18337 - protein, 9 aa, Homo Sapiens
EEVSLQKIV

SEQ ID NO: 18338 - protein, 9 aa, Homo Sapiens
SYTGEEVPE

SEQ ID NO: 18339 - protein, 9 aa, Homo Sapiens
QQMLKVELK

SEQ ID NO: 18340 - protein, 9 aa, Homo Sapiens
LAAKKEQPG

SEQ ID NO: 18341 - protein, 9 aa, Homo Sapiens
IELSRNQAL

SEQ ID NO: 18342 - protein, 9 aa, Homo Sapiens
VKLFNTYIR

SEQ ID NO: 18343 - protein, 9 aa, Homo Sapiens
GEKPFICKQ

SEQ ID NO: 18344 - protein, 9 aa, Homo Sapiens
AAERRAPEK

SEQ ID NO: 18345 - protein, 9 aa, Homo Sapiens
KEEDMETES

SEQ ID NO: 18346 - protein, 9 aa, Homo Sapiens
ILHRRSLEA

SEQ ID NO: 18347 - protein, 9 aa, Homo Sapiens
LELLQERPF

SEQ ID NO: 18348 - protein, 9 aa, Homo Sapiens
CYDCVDCKA

SEQ ID NO: 18349 - protein, 9 aa, Homo Sapiens
SLQKIVKMS

SEQ ID NO: 18350 - protein, 9 aa, Homo Sapiens
ADLNPIKGG

SEQ ID NO: 18351 - protein, 9 aa, Homo Sapiens
DLGSLGNMG

SEQ ID NO: 18352 - protein, 9 aa, Homo Sapiens
GWQQMLKVE

SEQ ID NO: 18353 - protein, 9 aa, Homo Sapiens
VHHVSTEPS

SEQ ID NO: 18354 - protein, 9 aa, Homo Sapiens
QALSKEEDM

SEQ ID NO: 18355 - protein, 9 aa, Homo Sapiens
KSAQQELKH

SEQ ID NO: 18356 - protein, 9 aa, Homo Sapiens
FSVKILQIE

SEQ ID NO: 18357 - protein, 9 aa, Homo Sapiens
KNQLFLFYG

SEQ ID NO: 18358 - protein, 9 aa, Homo Sapiens
QPAHVRVCI

SEQ ID NO: 18359 - protein, 9 aa, Homo Sapiens
GPGADHPQH

SEQ ID NO: 18360 - protein, 9 aa, Homo Sapiens
MHAVKDHGL

SEQ ID NO: 18361 - protein, 9 aa, Homo Sapiens
MPQIKALMT

SEQ ID NO: 18362 - protein, 9 aa, Homo Sapiens
QLKSRGVKL

SEQ ID NO: 18363 - protein, 9 aa, Homo Sapiens
IVVTHCLVP

SEQ ID NO: 18364 - protein, 9 aa, Homo Sapiens
PFIGMYSAP

SEQ ID NO: 18365 - protein, 9 aa, Homo Sapiens
KEKRKMKRN

SEQ ID NO: 18366 - protein, 9 aa, Homo Sapiens
YVHRDLCAA

SEQ ID NO: 18367 - protein, 9 aa, Homo Sapiens
DRLINFTDK

SEQ ID NO: 18368 - protein, 9 aa, Homo Sapiens
LPELPGPPG

SEQ ID NO: 18369 - protein, 9 aa, Homo Sapiens
APAPGTGGY

SEQ ID NO: 18370 - protein, 9 aa, Homo Sapiens
YRGADINYA

SEQ ID NO: 18371 - protein, 9 aa, Homo Sapiens
KLLEAVEPE

SEQ ID NO: 18372 - protein, 9 aa, Homo Sapiens
LLLVICHHG

SEQ ID NO: 18373 - protein, 9 aa, Homo Sapiens
LYCAASCNN

SEQ ID NO: 18374 - protein, 9 aa, Homo Sapiens
GHQASLPDT

SEQ ID NO: 18375 - protein, 9 aa, Homo Sapiens
LVSYLFIMV

SEQ ID NO: 18376 - protein, 9 aa, Homo Sapiens
THLRRHCGE

SEQ ID NO: 18377 - protein, 9 aa, Homo Sapiens
NGEPLAAKK

SEQ ID NO: 18378 - protein, 9 aa, Homo Sapiens
RRDILHRRS

SEQ ID NO: 18379 - protein, 9 aa, Homo Sapiens
QVLCVFEEF

SEQ ID NO: 18380 - protein, 9 aa, Homo Sapiens
MDENLMHMS

SEQ ID NO: 18381 - protein, 9 aa, Homo Sapiens
DGIPMCKRN

SEQ ID NO: 18382 - protein, 9 aa, Homo Sapiens
YDCVDCKAG

SEQ ID NO: 18383 - protein, 9 aa, Homo Sapiens
GTGGYSVCG

SEQ ID NO: 18384 - protein, 9 aa, Homo Sapiens
LQSSEEVSL

SEQ ID NO: 18385 - protein, 9 aa, Homo Sapiens
THKITVFYI

SEQ ID NO: 18386 - protein, 9 aa, Homo Sapiens
CGACTLWRK

SEQ ID NO: 18387 - protein, 9 aa, Homo Sapiens
GSGSFGISV

SEQ ID NO: 18388 - protein, 9 aa, Homo Sapiens
DEVLKLLYR

SEQ ID NO: 18389 - protein, 9 aa, Homo Sapiens
LDVLERCPH

SEQ ID NO: 18390 - protein, 9 aa, Homo Sapiens
DFSVLWDFQ

SEQ ID NO: 18391 - protein, 9 aa, Homo Sapiens
QWDGLGPLP

SEQ ID NO: 18392 - protein, 9 aa, Homo Sapiens
STNVASLWQ

SEQ ID NO: 18393 - protein, 9 aa, Homo Sapiens
QALAALLRD

SEQ ID NO: 18394 - protein, 9 aa, Homo Sapiens
TPEGTIIGA

SEQ ID NO: 18395 - protein, 9 aa, Homo Sapiens
AEEEYEAHY

SEQ ID NO: 18396 - protein, 9 aa, Homo Sapiens
MVKALHTEP

SEQ ID NO: 18397 - protein, 9 aa, Homo Sapiens
PAEVNSGGL

SEQ ID NO: 18398 - protein, 9 aa, Homo Sapiens
ASLIEKLMK

SEQ ID NO: 18399 - protein, 9 aa, Homo Sapiens
MDSDDEIPM

SEQ ID NO: 18400 - protein, 9 aa, Homo Sapiens
MQELLKQVR

SEQ ID NO: 18401 - protein, 9 aa, Homo Sapiens
IQSAKETEK

SEQ ID NO: 18402 - protein, 9 aa, Homo Sapiens
DKQEESSWG

SEQ ID NO: 18403 - protein, 9 aa, Homo Sapiens
TCGLGKATR

SEQ ID NO: 18404 - protein, 9 aa, Homo Sapiens
PKPIIKIDI

SEQ ID NO: 18405 - protein, 9 aa, Homo Sapiens
ACRVTETLS

SEQ ID NO: 18406 - protein, 9 aa, Homo Sapiens
LDRADAWLF

SEQ ID NO: 18407 - protein, 9 aa, Homo Sapiens
GRVLGVLNR

SEQ ID NO: 18408 - protein, 9 aa, Homo Sapiens
DENLMHMSY

SEQ ID NO: 18409 - protein, 9 aa, Homo Sapiens
YYINHPVYT

SEQ ID NO: 18410 - protein, 9 aa, Homo Sapiens
LIALIALDC

SEQ ID NO: 18411 - protein, 9 aa, Homo Sapiens
VRVCIPLSI

SEQ ID NO: 18412 - protein, 9 aa, Homo Sapiens
LSLSPAPTP

SEQ ID NO: 18413 - protein, 9 aa, Homo Sapiens
NREQKLHAL

SEQ ID NO: 18414 - protein, 9 aa, Homo Sapiens
INVGNLLIV

SEQ ID NO: 18415 - protein, 9 aa, Homo Sapiens
HDISFSVAD

SEQ ID NO: 18416 - protein, 9 aa, Homo Sapiens
MARCTSINV

SEQ ID NO: 18417 - protein, 9 aa, Homo Sapiens
IEKLMKEKR

SEQ ID NO: 18418 - protein, 9 aa, Homo Sapiens
TNYSIYLNH

SEQ ID NO: 18419 - protein, 9 aa, Homo Sapiens
PGSTQFFFR

SEQ ID NO: 18420 - protein, 9 aa, Homo Sapiens
DSWGSDAQQ

SEQ ID NO: 18421 - protein, 9 aa, Homo Sapiens
KSDGIPMCK

SEQ ID NO: 18422 - protein, 9 aa, Homo Sapiens
ATKIKRELH

SEQ ID NO: 18423 - protein, 9 aa, Homo Sapiens
IMVAIMGIP

SEQ ID NO: 18424 - protein, 9 aa, Homo Sapiens
KDSVSVATR

SEQ ID NO: 18425 - protein, 9 aa, Homo Sapiens
SCSLGCLGA

SEQ ID NO: 18426 - protein, 9 aa, Homo Sapiens
HIWLFICHK

SEQ ID NO: 18427 - protein, 9 aa, Homo Sapiens
DVNENPPIF

SEQ ID NO: 18428 - protein, 9 aa, Homo Sapiens
LFLKIMAMI

SEQ ID NO: 18429 - protein, 9 aa, Homo Sapiens
SKNRCHLEG

SEQ ID NO: 18430 - protein, 9 aa, Homo Sapiens
YLAEYSAEY

SEQ ID NO: 18431 - protein, 9 aa, Homo Sapiens
SVATPGSST

SEQ ID NO: 18432 - protein, 9 aa, Homo Sapiens
MKIIHISDV

SEQ ID NO: 18433 - protein, 9 aa, Homo Sapiens
FAYELVVTA

SEQ ID NO: 18434 - protein, 9 aa, Homo Sapiens
EQLTFSLSR

SEQ ID NO: 18435 - protein, 9 aa, Homo Sapiens
ACADSLPRK

SEQ ID NO: 18436 - protein, 9 aa, Homo Sapiens
REQHAQQWV

SEQ ID NO: 18437 - protein, 9 aa, Homo Sapiens
TAPAALEAQ

SEQ ID NO: 18438 - protein, 9 aa, Homo Sapiens
LMHMSYEAG

SEQ ID NO: 18439 - protein, 9 aa, Homo Sapiens
QEASNKKKV

SEQ ID NO: 18440 - protein, 9 aa, Homo Sapiens
AGQMLHGTG

SEQ ID NO: 18441 - protein, 9 aa, Homo Sapiens
HAPPATKIK

SEQ ID NO: 18442 - protein, 9 aa, Homo Sapiens
EILGASKAH

SEQ ID NO: 18443 - protein, 9 aa, Homo Sapiens
VGQSNFLIF

SEQ ID NO: 18444 - protein, 9 aa, Homo Sapiens
GGPASTLAQ

SEQ ID NO: 18445 - protein, 9 aa, Homo Sapiens
GEQGLPELP

SEQ ID NO: 18446 - protein, 9 aa, Homo Sapiens
SYRPWDSNE

SEQ ID NO: 18447 - protein, 9 aa, Homo Sapiens
QEFAMTFAT

SEQ ID NO: 18448 - protein, 9 aa, Homo Sapiens
KAENGDINW

SEQ ID NO: 18449 - protein, 9 aa, Homo Sapiens
CSTTCGLGK

SEQ ID NO: 18450 - protein, 9 aa, Homo Sapiens
STKRPFKCQ

SEQ ID NO: 18451 - protein, 9 aa, Homo Sapiens
ACLCGSVLL

SEQ ID NO: 18452 - protein, 9 aa, Homo Sapiens
DAQTELEVL

SEQ ID NO: 18453 - protein, 9 aa, Homo Sapiens
FGMKIIHIS

SEQ ID NO: 18454 - protein, 9 aa, Homo Sapiens
TALSLSPAP

SEQ ID NO: 18455 - protein, 9 aa, Homo Sapiens
QCVHHVSTE

SEQ ID NO: 18456 - protein, 9 aa, Homo Sapiens
GVDGVIGMM

SEQ ID NO: 18457 - protein, 9 aa, Homo Sapiens
CMISDLFIN

SEQ ID NO: 18458 - protein, 9 aa, Homo Sapiens
VLDLGGGGL

SEQ ID NO: 18459 - protein, 9 aa, Homo Sapiens
EKLMKEKRK

SEQ ID NO: 18460 - protein, 9 aa, Homo Sapiens
GNCLEDLLC

SEQ ID NO: 18461 - protein, 9 aa, Homo Sapiens
EERKSSVFK

SEQ ID NO: 18462 - protein, 9 aa, Homo Sapiens
SIVWQQVFD

SEQ ID NO: 18463 - protein, 9 aa, Homo Sapiens
ENLDKNLVP

SEQ ID NO: 18464 - protein, 9 aa, Homo Sapiens
IFGYRGTDC

SEQ ID NO: 18465 - protein, 9 aa, Homo Sapiens
QNYGLIHGD

SEQ ID NO: 18466 - protein, 9 aa, Homo Sapiens
AMDYKTTVC

SEQ ID NO: 18467 - protein, 9 aa, Homo Sapiens
KRVLALSVQ

SEQ ID NO: 18468 - protein, 9 aa, Homo Sapiens
YICGESAAW

SEQ ID NO: 18469 - protein, 9 aa, Homo Sapiens
CHSVIHIQA

SEQ ID NO: 18470 - protein, 9 aa, Homo Sapiens
GFYACSVVV

SEQ ID NO: 18471 - protein, 9 aa, Homo Sapiens
DTLPSWLNV

SEQ ID NO: 18472 - protein, 9 aa, Homo Sapiens
RLINFTDKS

SEQ ID NO: 18473 - protein, 9 aa, Homo Sapiens
NVTCVFDPV

SEQ ID NO: 18474 - protein, 9 aa, Homo Sapiens
RYASGHKNT

SEQ ID NO: 18475 - protein, 9 aa, Homo Sapiens
ECGAKGSWQ

SEQ ID NO: 18476 - protein, 9 aa, Homo Sapiens
LDVQKSGKV

SEQ ID NO: 18477 - protein, 9 aa, Homo Sapiens
NLDKNLVPV

SEQ ID NO: 18478 - protein, 9 aa, Homo Sapiens
NYHLYLRSL

SEQ ID NO: 18479 - protein, 9 aa, Homo Sapiens
YEQNSLIWV

SEQ ID NO: 18480 - protein, 9 aa, Homo Sapiens
YLDKIIRGN

SEQ ID NO: 18481 - protein, 9 aa, Homo Sapiens
MEPGPIAPS

SEQ ID NO: 18482 - protein, 9 aa, Homo Sapiens
SVTDVRVAE

SEQ ID NO: 18483 - protein, 9 aa, Homo Sapiens
SEIRNLNPV

SEQ ID NO: 18484 - protein, 9 aa, Homo Sapiens
CFEASECKE

SEQ ID NO: 18485 - protein, 9 aa, Homo Sapiens
NNYQVKCIN

SEQ ID NO: 18486 - protein, 9 aa, Homo Sapiens
ISDLFINNY

SEQ ID NO: 18487 - protein, 9 aa, Homo Sapiens
LALSVQTDY

SEQ ID NO: 18488 - protein, 9 aa, Homo Sapiens
SAASERLAT

SEQ ID NO: 18489 - protein, 9 aa, Homo Sapiens
EYPLTIQNI

SEQ ID NO: 18490 - protein, 9 aa, Homo Sapiens
STTLSDVVD

SEQ ID NO: 18491 - protein, 9 aa, Homo Sapiens
GEEVPEITR

SEQ ID NO: 18492 - protein, 9 aa, Homo Sapiens
IDAAFFREH

SEQ ID NO: 18493 - protein, 9 aa, Homo Sapiens
RGQDGKPVR

SEQ ID NO: 18494 - protein, 9 aa, Homo Sapiens
GCIPMQDFA

SEQ ID NO: 18495 - protein, 9 aa, Homo Sapiens
QICKIVIRH

SEQ ID NO: 18496 - protein, 9 aa, Homo Sapiens
SSMCGHVVL

SEQ ID NO: 18497 - protein, 9 aa, Homo Sapiens
KLWCMYISP

SEQ ID NO: 18498 - protein, 9 aa, Homo Sapiens
HAPSITLPP

SEQ ID NO: 18499 - protein, 9 aa, Homo Sapiens
VHVACADSL

SEQ ID NO: 18500 - protein, 9 aa, Homo Sapiens
PLRTFKDTM

SEQ ID NO: 18501 - protein, 9 aa, Homo Sapiens
TTCGLGKAT

SEQ ID NO: 18502 - protein, 9 aa, Homo Sapiens
GYSVCGETH

SEQ ID NO: 18503 - protein, 9 aa, Homo Sapiens
DHPRAEVRC

SEQ ID NO: 18504 - protein, 9 aa, Homo Sapiens
GVGKSTVST

SEQ ID NO: 18505 - protein, 9 aa, Homo Sapiens
LDQTDSWND

SEQ ID NO: 18506 - protein, 9 aa, Homo Sapiens
SESKVKEHT

SEQ ID NO: 18507 - protein, 9 aa, Homo Sapiens
MHKDIQLAR

SEQ ID NO: 18508 - protein, 9 aa, Homo Sapiens
FVLGPFDDL

SEQ ID NO: 18509 - protein, 9 aa, Homo Sapiens
SVFAYELVV

SEQ ID NO: 18510 - protein, 9 aa, Homo Sapiens
EKGERDNAK

SEQ ID NO: 18511 - protein, 9 aa, Homo Sapiens
GLIKLKELH

SEQ ID NO: 18512 - protein, 9 aa, Homo Sapiens
WTEKQKSVG

SEQ ID NO: 18513 - protein, 9 aa, Homo Sapiens
KKRIPPPFQ

SEQ ID NO: 18514 - protein, 9 aa, Homo Sapiens
EEPQPQKII

SEQ ID NO: 18515 - protein, 9 aa, Homo Sapiens
RPFIGMYSA

SEQ ID NO: 18516 - protein, 9 aa, Homo Sapiens
ECFSRSREY

SEQ ID NO: 18517 - protein, 9 aa, Homo Sapiens
QPTDSEKEI

SEQ ID NO: 18518 - protein, 9 aa, Homo Sapiens
SLLCSRLCQ

SEQ ID NO: 18519 - protein, 9 aa, Homo Sapiens
NLKAGRFHC

SEQ ID NO: 18520 - protein, 9 aa, Homo Sapiens
GAGYILQDF

SEQ ID NO: 18521 - protein, 9 aa, Homo Sapiens
PATKIKREL

SEQ ID NO: 18522 - protein, 9 aa, Homo Sapiens
PLGPGAPAP

SEQ ID NO: 18523 - protein, 9 aa, Homo Sapiens
THKLCLLKW

SEQ ID NO: 18524 - protein, 9 aa, Homo Sapiens
ASSHRYASG

SEQ ID NO: 18525 - protein, 9 aa, Homo Sapiens
YHKCLQLLK

SEQ ID NO: 18526 - protein, 9 aa, Homo Sapiens
ILVGNVTGA

SEQ ID NO: 18527 - protein, 9 aa, Homo Sapiens
ELNEQKRKS

SEQ ID NO: 18528 - protein, 9 aa, Homo Sapiens
LVFALVNST

SEQ ID NO: 18529 - protein, 9 aa, Homo Sapiens
AQGMDIEEV

SEQ ID NO: 18530 - protein, 9 aa, Homo Sapiens
ESDNTWISY

SEQ ID NO: 18531 - protein, 9 aa, Homo Sapiens
ASLGFHGGH

SEQ ID NO: 18532 - protein, 9 aa, Homo Sapiens
ETSVYFCAS

SEQ ID NO: 18533 - protein, 9 aa, Homo Sapiens
IALIALDCC

SEQ ID NO: 18534 - protein, 9 aa, Homo Sapiens
GSNFGVQAG

SEQ ID NO: 18535 - protein, 9 aa, Homo Sapiens
DAQQSTSGQ

SEQ ID NO: 18536 - protein, 9 aa, Homo Sapiens
GQVKEQRLA

SEQ ID NO: 18537 - protein, 9 aa, Homo Sapiens
RRRRSRFVV

SEQ ID NO: 18538 - protein, 9 aa, Homo Sapiens
VDCKAGSYR

SEQ ID NO: 18539 - protein, 9 aa, Homo Sapiens
LNPAVHFPQ

SEQ ID NO: 18540 - protein, 9 aa, Homo Sapiens
ATPPIATHA

SEQ ID NO: 18541 - protein, 9 aa, Homo Sapiens
FICHKWLSV

SEQ ID NO: 18542 - protein, 9 aa, Homo Sapiens
NDKRICVVN

SEQ ID NO: 18543 - protein, 9 aa, Homo Sapiens
LVATVAMEP

SEQ ID NO: 18544 - protein, 9 aa, Homo Sapiens
IKDGCGLQG

SEQ ID NO: 18545 - protein, 9 aa, Homo Sapiens
VASLWQELA

SEQ ID NO: 18546 - protein, 9 aa, Homo Sapiens
ADQEEQAGP

SEQ ID NO: 18547 - protein, 9 aa, Homo Sapiens
DSPDSSPPR

SEQ ID NO: 18548 - protein, 9 aa, Homo Sapiens
ESWTQPPPH

SEQ ID NO: 18549 - protein, 9 aa, Homo Sapiens
AKSDEHLYK

SEQ ID NO: 18550 - protein, 9 aa, Homo Sapiens
GSNVDQGPK

SEQ ID NO: 18551 - protein, 9 aa, Homo Sapiens
ITSTSLLCS

SEQ ID NO: 18552 - protein, 9 aa, Homo Sapiens
LKPFNQRLI

SEQ ID NO: 18553 - protein, 9 aa, Homo Sapiens
NKGSIVWQQ

SEQ ID NO: 18554 - protein, 9 aa, Homo Sapiens
CSDELGCNK

SEQ ID NO: 18555 - protein, 9 aa, Homo Sapiens
LQGILQLGL

SEQ ID NO: 18556 - protein, 9 aa, Homo Sapiens
QIKALMTGS

SEQ ID NO: 18557 - protein, 9 aa, Homo Sapiens
SAPEKITLF

SEQ ID NO: 18558 - protein, 9 aa, Homo Sapiens
IYGGRVHNE

SEQ ID NO: 18559 - protein, 9 aa, Homo Sapiens
TRLPVTNIS

SEQ ID NO: 18560 - protein, 9 aa, Homo Sapiens
NVRNGIRTG

SEQ ID NO: 18561 - protein, 9 aa, Homo Sapiens
KLFNTYIRK

SEQ ID NO: 18562 - protein, 9 aa, Homo Sapiens
QHIFSAKSS

SEQ ID NO: 18563 - protein, 9 aa, Homo Sapiens
FQVLGAHRD

SEQ ID NO: 18564 - protein, 9 aa, Homo Sapiens
LVNDVNENP

SEQ ID NO: 18565 - protein, 9 aa, Homo Sapiens
LRHIIFHSG

SEQ ID NO: 18566 - protein, 9 aa, Homo Sapiens
APGACYHKC

SEQ ID NO: 18567 - protein, 9 aa, Homo Sapiens
HPRAEVRCR

SEQ ID NO: 18568 - protein, 9 aa, Homo Sapiens
RAAPGACYH

SEQ ID NO: 18569 - protein, 9 aa, Homo Sapiens
LLQERPFLA

SEQ ID NO: 18570 - protein, 9 aa, Homo Sapiens
HPQHLRDRT

SEQ ID NO: 18571 - protein, 9 aa, Homo Sapiens
RNLRHIIFH

SEQ ID NO: 18572 - protein, 9 aa, Homo Sapiens
KRGPQSLDK

SEQ ID NO: 18573 - protein, 9 aa, Homo Sapiens
VSTEPSCPG

SEQ ID NO: 18574 - protein, 9 aa, Homo Sapiens
DEQKRGAEE

SEQ ID NO: 18575 - protein, 9 aa, Homo Sapiens
PPRPAQGYS

SEQ ID NO: 18576 - protein, 9 aa, Homo Sapiens
LGPGAPAPL

SEQ ID NO: 18577 - protein, 9 aa, Homo Sapiens
QGKHRAVST

SEQ ID NO: 18578 - protein, 9 aa, Homo Sapiens
PMRKKERNP

SEQ ID NO: 18579 - protein, 9 aa, Homo Sapiens
VGYIEIVTI

SEQ ID NO: 18580 - protein, 9 aa, Homo Sapiens
LPFLFKVLL

SEQ ID NO: 18581 - protein, 9 aa, Homo Sapiens
KKRVVQVLF

SEQ ID NO: 18582 - protein, 9 aa, Homo Sapiens
GCPLLHCFV

SEQ ID NO: 18583 - protein, 9 aa, Homo Sapiens
IPRGKIYKI

SEQ ID NO: 18584 - protein, 9 aa, Homo Sapiens
KSVQRGLLA

SEQ ID NO: 18585 - protein, 9 aa, Homo Sapiens
FTALDVQKS

SEQ ID NO: 18586 - protein, 9 aa, Homo Sapiens
KIVKMSIIW

SEQ ID NO: 18587 - protein, 9 aa, Homo Sapiens
PESKDALDV

SEQ ID NO: 18588 - protein, 9 aa, Homo Sapiens
VCIPLSILE

SEQ ID NO: 18589 - protein, 9 aa, Homo Sapiens
VKEWLSEFK

SEQ ID NO: 18590 - protein, 9 aa, Homo Sapiens
DDCGDCSDE

SEQ ID NO: 18591 - protein, 9 aa, Homo Sapiens
GLGLLNNIL

SEQ ID NO: 18592 - protein, 9 aa, Homo Sapiens
TVAMEPGPI

SEQ ID NO: 18593 - protein, 9 aa, Homo Sapiens
DVAQKWCSN

SEQ ID NO: 18594 - protein, 9 aa, Homo Sapiens
AGYILQDFN

SEQ ID NO: 18595 - protein, 9 aa, Homo Sapiens
KLFHTLNED

SEQ ID NO: 18596 - protein, 9 aa, Homo Sapiens
IPMQDFALT

SEQ ID NO: 18597 - protein, 9 aa, Homo Sapiens
VLKLLYRGA

SEQ ID NO: 18598 - protein, 9 aa, Homo Sapiens
GWTPLYCAA

SEQ ID NO: 18599 - protein, 9 aa, Homo Sapiens
NNREQKLHA

SEQ ID NO: 18600 - protein, 9 aa, Homo Sapiens
STKGSSSPT

SEQ ID NO: 18601 - protein, 9 aa, Homo Sapiens
GNEPRSDRS

SEQ ID NO: 18602 - protein, 9 aa, Homo Sapiens
YTGEEVPEI

SEQ ID NO: 18603 - protein, 9 aa, Homo Sapiens
AFFQSSGIC

SEQ ID NO: 18604 - protein, 9 aa, Homo Sapiens
PQLMSLVGY

SEQ ID NO: 18605 - protein, 9 aa, Homo Sapiens
KILIAIALI

SEQ ID NO: 18606 - protein, 9 aa, Homo Sapiens
FNMLKRLRS

SEQ ID NO: 18607 - protein, 9 aa, Homo Sapiens
CLKPFNQRL

SEQ ID NO: 18608 - protein, 9 aa, Homo Sapiens
GQDGKPVRK

SEQ ID NO: 18609 - protein, 9 aa, Homo Sapiens
VPLNIDICA

SEQ ID NO: 18610 - protein, 9 aa, Homo Sapiens
LDNLGVPWP

SEQ ID NO: 18611 - protein, 9 aa, Homo Sapiens
ICHKWLSVD

SEQ ID NO: 18612 - protein, 9 aa, Homo Sapiens
SAQGRKKAF

SEQ ID NO: 18613 - protein, 9 aa, Homo Sapiens
FGMGHNVAT

SEQ ID NO: 18614 - protein, 9 aa, Homo Sapiens
ASECKESSP

SEQ ID NO: 18615 - protein, 9 aa, Homo Sapiens
MQRQAEKEE

SEQ ID NO: 18616 - protein, 9 aa, Homo Sapiens
EATLGLLFQ

SEQ ID NO: 18617 - protein, 9 aa, Homo Sapiens
AIKAQTVLH

SEQ ID NO: 18618 - protein, 9 aa, Homo Sapiens
WDGLGPLPD

SEQ ID NO: 18619 - protein, 9 aa, Homo Sapiens
DKPPHRVRL

SEQ ID NO: 18620 - protein, 9 aa, Homo Sapiens
CVFEEFVQG

SEQ ID NO: 18621 - protein, 9 aa, Homo Sapiens
HPKPIIKID

SEQ ID NO: 18622 - protein, 9 aa, Homo Sapiens
PYQPKDFDS

SEQ ID NO: 18623 - protein, 9 aa, Homo Sapiens
RALQPSDLD

SEQ ID NO: 18624 - protein, 9 aa, Homo Sapiens
AKLEEEQSS

SEQ ID NO: 18625 - protein, 9 aa, Homo Sapiens
YQPKDFDSE

SEQ ID NO: 18626 - protein, 9 aa, Homo Sapiens
DSWNDRPQE

SEQ ID NO: 18627 - protein, 9 aa, Homo Sapiens
QPKDFDSER

SEQ ID NO: 18628 - protein, 9 aa, Homo Sapiens
LCSAKAPND

SEQ ID NO: 18629 - protein, 9 aa, Homo Sapiens
HNEFDQRLL

SEQ ID NO: 18630 - protein, 9 aa, Homo Sapiens
FTKRHKFED

SEQ ID NO: 18631 - protein, 9 aa, Homo Sapiens
DKRICVVNF

SEQ ID NO: 18632 - protein, 9 aa, Homo Sapiens
PQKIIYEEA

SEQ ID NO: 18633 - protein, 9 aa, Homo Sapiens
TNYHLYLRS

SEQ ID NO: 18634 - protein, 9 aa, Homo Sapiens
KGSSSPTTA

SEQ ID NO: 18635 - protein, 9 aa, Homo Sapiens
HGHQASLPD

SEQ ID NO: 18636 - protein, 9 aa, Homo Sapiens
VWQQVFDDK

SEQ ID NO: 18637 - protein, 9 aa, Homo Sapiens
NYPSSRAMY

SEQ ID NO: 18638 - protein, 9 aa, Homo Sapiens
GAKGSWQVG

SEQ ID NO: 18639 - protein, 9 aa, Homo Sapiens
LPELEDRLQ

SEQ ID NO: 18640 - protein, 9 aa, Homo Sapiens
VLGPFDDLK

SEQ ID NO: 18641 - protein, 9 aa, Homo Sapiens
SLRPASASL

SEQ ID NO: 18642 - protein, 9 aa, Homo Sapiens
EKITLFEAH

SEQ ID NO: 18643 - protein, 9 aa, Homo Sapiens
HKWLSVDTT

SEQ ID NO: 18644 - protein, 9 aa, Homo Sapiens
KASSHRYAS

SEQ ID NO: 18645 - protein, 9 aa, Homo Sapiens
SLIEKLMKE

SEQ ID NO: 18646 - protein, 9 aa, Homo Sapiens
EVHKVGLLG

SEQ ID NO: 18647 - protein, 9 aa, Homo Sapiens
IDHIVGNQT

SEQ ID NO: 18648 - protein, 9 aa, Homo Sapiens
CLLLTGGCP

SEQ ID NO: 18649 - protein, 9 aa, Homo Sapiens
SPPRPAQGY

SEQ ID NO: 18650 - protein, 9 aa, Homo Sapiens
EFYIPYQPK

SEQ ID NO: 18651 - protein, 9 aa, Homo Sapiens
RQKMELAKQ

SEQ ID NO: 18652 - protein, 9 aa, Homo Sapiens
VLCVFEEFV

SEQ ID NO: 18653 - protein, 9 aa, Homo Sapiens
RRMQNLDNL

SEQ ID NO: 18654 - protein, 9 aa, Homo Sapiens
RGAPKPHEK

SEQ ID NO: 18655 - protein, 9 aa, Homo Sapiens
VNTLRVKSR

SEQ ID NO: 18656 - protein, 9 aa, Homo Sapiens
STQFFFRTP

SEQ ID NO: 18657 - protein, 9 aa, Homo Sapiens
WLCSKPFRV

SEQ ID NO: 18658 - protein, 9 aa, Homo Sapiens
SVTCLDGTR

SEQ ID NO: 18659 - protein, 9 aa, Homo Sapiens
PSVENVRNG

SEQ ID NO: 18660 - protein, 9 aa, Homo Sapiens
NVPAFVAAV

SEQ ID NO: 18661 - protein, 9 aa, Homo Sapiens
LDAMNPDCG

SEQ ID NO: 18662 - protein, 9 aa, Homo Sapiens
MESLSAPEK

SEQ ID NO: 18663 - protein, 9 aa, Homo Sapiens
VYTPPTYGA

SEQ ID NO: 18664 - protein, 9 aa, Homo Sapiens
FLKIMAMIT

SEQ ID NO: 18665 - protein, 9 aa, Homo Sapiens
GFAGLIKLK

SEQ ID NO: 18666 - protein, 9 aa, Homo Sapiens
LKEHLPGQT

SEQ ID NO: 18667 - protein, 9 aa, Homo Sapiens
GGAPCQNLK

SEQ ID NO: 18668 - protein, 9 aa, Homo Sapiens
HQERHLAKE

SEQ ID NO: 18669 - protein, 9 aa, Homo Sapiens
LQWWPHKDG

SEQ ID NO: 18670 - protein, 9 aa, Homo Sapiens
EINTDHNKS

SEQ ID NO: 18671 - protein, 9 aa, Homo Sapiens
NTLRVKSRE

SEQ ID NO: 18672 - protein, 9 aa, Homo Sapiens
TYIEELIKN

SEQ ID NO: 18673 - protein, 9 aa, Homo Sapiens
LPSWLNVPA

SEQ ID NO: 18674 - protein, 9 aa, Homo Sapiens
KDGCGLQGA

SEQ ID NO: 18675 - protein, 9 aa, Homo Sapiens
SVFKAIDSS

SEQ ID NO: 18676 - protein, 9 aa, Homo Sapiens
NAQCCDCRK

SEQ ID NO: 18677 - protein, 9 aa, Homo Sapiens
HISDVFRNT

SEQ ID NO: 18678 - protein, 9 aa, Homo Sapiens
RAGAGYILQ

SEQ ID NO: 18679 - protein, 9 aa, Homo Sapiens
RNCCLTLCD

SEQ ID NO: 18680 - protein, 9 aa, Homo Sapiens
DNPLEATVH

SEQ ID NO: 18681 - protein, 9 aa, Homo Sapiens
DLAPNSSSP

SEQ ID NO: 18682 - protein, 9 aa, Homo Sapiens
YSVCGETHR

SEQ ID NO: 18683 - protein, 9 aa, Homo Sapiens
GGPVLCRDK

SEQ ID NO: 18684 - protein, 9 aa, Homo Sapiens
VRASLIEKL

SEQ ID NO: 18685 - protein, 9 aa, Homo Sapiens
ENLMHMSYE

SEQ ID NO: 18686 - protein, 9 aa, Homo Sapiens
VHTRQARSL

SEQ ID NO: 18687 - protein, 9 aa, Homo Sapiens
CQLEQGELP

SEQ ID NO: 18688 - protein, 9 aa, Homo Sapiens
GLRLLDLCY

SEQ ID NO: 18689 - protein, 9 aa, Homo Sapiens
RLILINDKE

SEQ ID NO: 18690 - protein, 9 aa, Homo Sapiens
MKGTHLPAE

SEQ ID NO: 18691 - protein, 9 aa, Homo Sapiens
RALRGRKPA

SEQ ID NO: 18692 - protein, 9 aa, Homo Sapiens
PKPKRGPQS

SEQ ID NO: 18693 - protein, 9 aa, Homo Sapiens
EDMETESDA

SEQ ID NO: 18694 - protein, 9 aa, Homo Sapiens
CRDKMEEWS

SEQ ID NO: 18695 - protein, 9 aa, Homo Sapiens
KNTSWGAVF

SEQ ID NO: 18696 - protein, 9 aa, Homo Sapiens
TVTPSAFLE

SEQ ID NO: 18697 - protein, 9 aa, Homo Sapiens
YILQDFNEA

SEQ ID NO: 18698 - protein, 9 aa, Homo Sapiens
SARSGLCGL

SEQ ID NO: 18699 - protein, 9 aa, Homo Sapiens
STEVTLNTV

SEQ ID NO: 18700 - protein, 9 aa, Homo Sapiens
DRFDGALRV

SEQ ID NO: 18701 - protein, 9 aa, Homo Sapiens
RERYEDSHQ

SEQ ID NO: 18702 - protein, 9 aa, Homo Sapiens
GEVLSILLD

SEQ ID NO: 18703 - protein, 9 aa, Homo Sapiens
CLMSVVCIK

SEQ ID NO: 18704 - protein, 9 aa, Homo Sapiens
QQDLESHMR

SEQ ID NO: 18705 - protein, 9 aa, Homo Sapiens
PDCGIPLSH

SEQ ID NO: 18706 - protein, 9 aa, Homo Sapiens
LPGSTQFFF

SEQ ID NO: 18707 - protein, 9 aa, Homo Sapiens
SKKHIQPDY

SEQ ID NO: 18708 - protein, 9 aa, Homo Sapiens
RVLALSVQT

SEQ ID NO: 18709 - protein, 9 aa, Homo Sapiens
PRPAQGYSS

SEQ ID NO: 18710 - protein, 9 aa, Homo Sapiens
NVLCVRASL

SEQ ID NO: 18711 - protein, 9 aa, Homo Sapiens
KLQEFANAI

SEQ ID NO: 18712 - protein, 9 aa, Homo Sapiens
NTDHNKSSE

SEQ ID NO: 18713 - protein, 9 aa, Homo Sapiens
LVLHAPPAT

SEQ ID NO: 18714 - protein, 9 aa, Homo Sapiens
SLQNDYLRK

SEQ ID NO: 18715 - protein, 9 aa, Homo Sapiens
YLGTVLGNL

SEQ ID NO: 18716 - protein, 9 aa, Homo Sapiens
LCHSVIHIQ

SEQ ID NO: 18717 - protein, 9 aa, Homo Sapiens
VQAECLKPF

SEQ ID NO: 18718 - protein, 9 aa, Homo Sapiens
SAIKAQTVL

SEQ ID NO: 18719 - protein, 9 aa, Homo Sapiens
EGVFDHMKV

SEQ ID NO: 18720 - protein, 9 aa, Homo Sapiens
VDQGPKGDR

SEQ ID NO: 18721 - protein, 9 aa, Homo Sapiens
PPEHQDSVE

SEQ ID NO: 18722 - protein, 9 aa, Homo Sapiens
VLRIRSAQG

SEQ ID NO: 18723 - protein, 9 aa, Homo Sapiens
HQSMSQNYG

SEQ ID NO: 18724 - protein, 9 aa, Homo Sapiens
QGILQLGLE

SEQ ID NO: 18725 - protein, 9 aa, Homo Sapiens
GKSTVSTEL

SEQ ID NO: 18726 - protein, 9 aa, Homo Sapiens
CTSETEQDI

SEQ ID NO: 18727 - protein, 9 aa, Homo Sapiens
KWTPEVKHL

SEQ ID NO: 18728 - protein, 9 aa, Homo Sapiens
PRYGYAPNQ

SEQ ID NO: 18729 - protein, 9 aa, Homo Sapiens
TTKQGDPHE

SEQ ID NO: 18730 - protein, 9 aa, Homo Sapiens
ALVKLFNTY

SEQ ID NO: 18731 - protein, 9 aa, Homo Sapiens
FYFVGYIEI

SEQ ID NO: 18732 - protein, 9 aa, Homo Sapiens
SRSNGTVTP

SEQ ID NO: 18733 - protein, 9 aa, Homo Sapiens
PPPFTALSL

SEQ ID NO: 18734 - protein, 9 aa, Homo Sapiens
IAFTKRHKF

SEQ ID NO: 18735 - protein, 9 aa, Homo Sapiens
IWRIVSLEP

SEQ ID NO: 18736 - protein, 9 aa, Homo Sapiens
LGVLNRKRH

SEQ ID NO: 18737 - protein, 9 aa, Homo Sapiens
KQRQKMELA

SEQ ID NO: 18738 - protein, 9 aa, Homo Sapiens
GVPVLSGDA

SEQ ID NO: 18739 - protein, 9 aa, Homo Sapiens
AGNCKPTSS

SEQ ID NO: 18740 - protein, 9 aa, Homo Sapiens
IIFHSGNNP

SEQ ID NO: 18741 - protein, 9 aa, Homo Sapiens
KVTELDEVP

SEQ ID NO: 18742 - protein, 9 aa, Homo Sapiens
PHKDGTKFI

SEQ ID NO: 18743 - protein, 9 aa, Homo Sapiens
FHDRLINFT

SEQ ID NO: 18744 - protein, 9 aa, Homo Sapiens
KANGQHDIS

SEQ ID NO: 18745 - protein, 9 aa, Homo Sapiens
HMARCTSIN

SEQ ID NO: 18746 - protein, 9 aa, Homo Sapiens
IKAQTVLHE

SEQ ID NO: 18747 - protein, 9 aa, Homo Sapiens
PDTQVLLDS

SEQ ID NO: 18748 - protein, 9 aa, Homo Sapiens
DQWDGLGPL

SEQ ID NO: 18749 - protein, 9 aa, Homo Sapiens
PLPTSPGSL

SEQ ID NO: 18750 - protein, 9 aa, Homo Sapiens
QKSGKVSKS

SEQ ID NO: 18751 - protein, 9 aa, Homo Sapiens
LVSMLLIAC

SEQ ID NO: 18752 - protein, 9 aa, Homo Sapiens
EKMTSSDVE

SEQ ID NO: 18753 - protein, 9 aa, Homo Sapiens
RSADAVYQE

SEQ ID NO: 18754 - protein, 9 aa, Homo Sapiens
QFFFRTPTY

SEQ ID NO: 18755 - protein, 9 aa, Homo Sapiens
HKLCLLKWI

SEQ ID NO: 18756 - protein, 9 aa, Homo Sapiens
MLSQAIGPL

SEQ ID NO: 18757 - protein, 9 aa, Homo Sapiens
APSEAPDIW

SEQ ID NO: 18758 - protein, 9 aa, Homo Sapiens
GAAPDAPAE

SEQ ID NO: 18759 - protein, 9 aa, Homo Sapiens
PVKYEQNSL

SEQ ID NO: 18760 - protein, 9 aa, Homo Sapiens
IKSCRPNNV

SEQ ID NO: 18761 - protein, 9 aa, Homo Sapiens
FISPYSNPH

SEQ ID NO: 18762 - protein, 9 aa, Homo Sapiens
RDRFDGALR

SEQ ID NO: 18763 - protein, 9 aa, Homo Sapiens
NQLFLFYGK

SEQ ID NO: 18764 - protein, 9 aa, Homo Sapiens
MLSHLTHHK

SEQ ID NO: 18765 - protein, 9 aa, Homo Sapiens
FEVLTDGAK

SEQ ID NO: 18766 - protein, 9 aa, Homo Sapiens
TPPIATHAP

SEQ ID NO: 18767 - protein, 9 aa, Homo Sapiens
LSYQKSGKH

SEQ ID NO: 18768 - protein, 9 aa, Homo Sapiens
LVPTGVPVL

SEQ ID NO: 18769 - protein, 9 aa, Homo Sapiens
MTQLPKAEK

SEQ ID NO: 18770 - protein, 9 aa, Homo Sapiens
AYFIQPLSA

SEQ ID NO: 18771 - protein, 9 aa, Homo Sapiens
APSKDTQRT

SEQ ID NO: 18772 - protein, 9 aa, Homo Sapiens
GEEGRGGRG

SEQ ID NO: 18773 - protein, 9 aa, Homo Sapiens
ALIALDCCV

SEQ ID NO: 18774 - protein, 9 aa, Homo Sapiens
ALDRESVFA

SEQ ID NO: 18775 - protein, 9 aa, Homo Sapiens
PATTSTKGS

SEQ ID NO: 18776 - protein, 9 aa, Homo Sapiens
SDEHLYKTV

SEQ ID NO: 18777 - protein, 9 aa, Homo Sapiens
EQRLAGNGL

SEQ ID NO: 18778 - protein, 9 aa, Homo Sapiens
RYMQELLKQ

SEQ ID NO: 18779 - protein, 9 aa, Homo Sapiens
NGCTLSYQK

SEQ ID NO: 18780 - protein, 9 aa, Homo Sapiens
IFNMLKRLR

SEQ ID NO: 18781 - protein, 9 aa, Homo Sapiens
SEEDEAEDS

SEQ ID NO: 18782 - protein, 9 aa, Homo Sapiens
GCDRQMIFN

SEQ ID NO: 18783 - protein, 9 aa, Homo Sapiens
QGENLDKNL

SEQ ID NO: 18784 - protein, 9 aa, Homo Sapiens
ASTLAQTAA

SEQ ID NO: 18785 - protein, 9 aa, Homo Sapiens
QKSVGQKRN

SEQ ID NO: 18786 - protein, 9 aa, Homo Sapiens
TMYLTQVMQ

SEQ ID NO: 18787 - protein, 9 aa, Homo Sapiens
TVFYIAEGQ

SEQ ID NO: 18788 - protein, 9 aa, Homo Sapiens
TLMWRGPED

SEQ ID NO: 18789 - protein, 9 aa, Homo Sapiens
KGEPGSNVD

SEQ ID NO: 18790 - protein, 9 aa, Homo Sapiens
EELLYELKL

SEQ ID NO: 18791 - protein, 9 aa, Homo Sapiens
RLAGNGLEA

SEQ ID NO: 18792 - protein, 9 aa, Homo Sapiens
NQSSASQKE

SEQ ID NO: 18793 - protein, 9 aa, Homo Sapiens
SVQRGLLAE

SEQ ID NO: 18794 - protein, 9 aa, Homo Sapiens
RKLFHTLNE

SEQ ID NO: 18795 - protein, 9 aa, Homo Sapiens
QFQKACRVT

SEQ ID NO: 18796 - protein, 9 aa, Homo Sapiens
PDLGSLGNM

SEQ ID NO: 18797 - protein, 9 aa, Homo Sapiens
ELSRNQALA

SEQ ID NO: 18798 - protein, 9 aa, Homo Sapiens
STGNLLCFH

SEQ ID NO: 18799 - protein, 9 aa, Homo Sapiens
ENAPLCHSV

SEQ ID NO: 18800 - protein, 9 aa, Homo Sapiens
FQGYIKYSA

SEQ ID NO: 18801 - protein, 9 aa, Homo Sapiens
HRNRKMAAW

SEQ ID NO: 18802 - protein, 9 aa, Homo Sapiens
PGTGGYSVC

SEQ ID NO: 18803 - protein, 9 aa, Homo Sapiens
ETYHRTRPL

SEQ ID NO: 18804 - protein, 9 aa, Homo Sapiens
KVTGGNLVS

SEQ ID NO: 18805 - protein, 9 aa, Homo Sapiens
THPKPIIKI

SEQ ID NO: 18806 - protein, 9 aa, Homo Sapiens
HQRWLWIVP

SEQ ID NO: 18807 - protein, 9 aa, Homo Sapiens
EISRLSASE

SEQ ID NO: 18808 - protein, 9 aa, Homo Sapiens
KMKRNQVAS

SEQ ID NO: 18809 - protein, 9 aa, Homo Sapiens
LKDSEQLTF

SEQ ID NO: 18810 - protein, 9 aa, Homo Sapiens
EEGGRENSF

SEQ ID NO: 18811 - protein, 9 aa, Homo Sapiens
LSKVTELDE

SEQ ID NO: 18812 - protein, 9 aa, Homo Sapiens
EEARRPRGQ

SEQ ID NO: 18813 - protein, 9 aa, Homo Sapiens
KIMPVKYEQ

SEQ ID NO: 18814 - protein, 9 aa, Homo Sapiens
FFCRDCGQG

SEQ ID NO: 18815 - protein, 9 aa, Homo Sapiens
RVVQVLFQN

SEQ ID NO: 18816 - protein, 9 aa, Homo Sapiens
DCGDCSDEL

SEQ ID NO: 18817 - protein, 9 aa, Homo Sapiens
TGGYSVCGE

SEQ ID NO: 18818 - protein, 9 aa, Homo Sapiens
LHRNRKMAA

SEQ ID NO: 18819 - protein, 9 aa, Homo Sapiens
GSTQFFFRT

SEQ ID NO: 18820 - protein, 9 aa, Homo Sapiens
SSDVEAGSD

SEQ ID NO: 18821 - protein, 9 aa, Homo Sapiens
EKELPPLDP

SEQ ID NO: 18822 - protein, 9 aa, Homo Sapiens
WQCPKEPEP

SEQ ID NO: 18823 - protein, 9 aa, Homo Sapiens
PFNQRLIVL

SEQ ID NO: 18824 - protein, 9 aa, Homo Sapiens
RDILHRRSL

SEQ ID NO: 18825 - protein, 9 aa, Homo Sapiens
MDYKTTVCE

SEQ ID NO: 18826 - protein, 9 aa, Homo Sapiens
GAKLKKCFN

SEQ ID NO: 18827 - protein, 9 aa, Homo Sapiens
ESKDALDVS

SEQ ID NO: 18828 - protein, 9 aa, Homo Sapiens
YAIFGMGHN

SEQ ID NO: 18829 - protein, 9 aa, Homo Sapiens
TDLVFMLDG

SEQ ID NO: 18830 - protein, 9 aa, Homo Sapiens
WKLIMNTME

SEQ ID NO: 18831 - protein, 9 aa, Homo Sapiens
GMCADGAND

SEQ ID NO: 18832 - protein, 9 aa, Homo Sapiens
QSSASQKEL

SEQ ID NO: 18833 - protein, 9 aa, Homo Sapiens
NLVLHAPPA

SEQ ID NO: 18834 - protein, 9 aa, Homo Sapiens
QLEDNIKRL

SEQ ID NO: 18835 - protein, 9 aa, Homo Sapiens
VTPSAFLEP

SEQ ID NO: 18836 - protein, 9 aa, Homo Sapiens
INFTDKSLF

SEQ ID NO: 18837 - protein, 9 aa, Homo Sapiens
LLGDKGRVQ

SEQ ID NO: 18838 - protein, 9 aa, Homo Sapiens
HRMSHYTII

SEQ ID NO: 18839 - protein, 9 aa, Homo Sapiens
EHSPRGILV

SEQ ID NO: 18840 - protein, 9 aa, Homo Sapiens
WDFQGYIKY

SEQ ID NO: 18841 - protein, 9 aa, Homo Sapiens
VHNEFDQRL

SEQ ID NO: 18842 - protein, 9 aa, Homo Sapiens
GTHLPAEVW

SEQ ID NO: 18843 - protein, 9 aa, Homo Sapiens
TLCPLGTEL

SEQ ID NO: 18844 - protein, 9 aa, Homo Sapiens
FEISIGKKD

SEQ ID NO: 18845 - protein, 9 aa, Homo Sapiens
GSSVTCLDG

SEQ ID NO: 18846 - protein, 9 aa, Homo Sapiens
AKRVTIMHK

SEQ ID NO: 18847 - protein, 9 aa, Homo Sapiens
VPEHSPRGI

SEQ ID NO: 18848 - protein, 9 aa, Homo Sapiens
DHIVGNQTD

SEQ ID NO: 18849 - protein, 9 aa, Homo Sapiens
TKDPRIVVT

SEQ ID NO: 18850 - protein, 9 aa, Homo Sapiens
NMLKRLRSV

SEQ ID NO: 18851 - protein, 9 aa, Homo Sapiens
DSDDEIPMR

SEQ ID NO: 18852 - protein, 9 aa, Homo Sapiens
NPDAQTELE

SEQ ID NO: 18853 - protein, 9 aa, Homo Sapiens
MHNSTYGLC

SEQ ID NO: 18854 - protein, 9 aa, Homo Sapiens
SYFFKDTLD

SEQ ID NO: 18855 - protein, 9 aa, Homo Sapiens
TNLAQQGHN

SEQ ID NO: 18856 - protein, 9 aa, Homo Sapiens
TTKDPRIVV

SEQ ID NO: 18857 - protein, 9 aa, Homo Sapiens
DDEIPMRKK

SEQ ID NO: 18858 - protein, 9 aa, Homo Sapiens
LDLAPNSSS

SEQ ID NO: 18859 - protein, 9 aa, Homo Sapiens
RQARSLSVE

SEQ ID NO: 18860 - protein, 9 aa, Homo Sapiens
NIDICALFK

SEQ ID NO: 18861 - protein, 9 aa, Homo Sapiens
RAEKEGDEQ

SEQ ID NO: 18862 - protein, 9 aa, Homo Sapiens
VIQEFAMTF

SEQ ID NO: 18863 - protein, 9 aa, Homo Sapiens
LDCCVCVLH

SEQ ID NO: 18864 - protein, 9 aa, Homo Sapiens
LRGWQQMLK

SEQ ID NO: 18865 - protein, 9 aa, Homo Sapiens
ETNYSIYLN

SEQ ID NO: 18866 - protein, 9 aa, Homo Sapiens
GPLGPGAPA

SEQ ID NO: 18867 - protein, 9 aa, Homo Sapiens
GLPKPKRGP

SEQ ID NO: 18868 - protein, 9 aa, Homo Sapiens
DNHSYFFKD

SEQ ID NO: 18869 - protein, 9 aa, Homo Sapiens
APGTGGYSV

SEQ ID NO: 18870 - protein, 9 aa, Homo Sapiens
SRNQALAAL

SEQ ID NO: 18871 - protein, 9 aa, Homo Sapiens
WLFRKAHET

SEQ ID NO: 18872 - protein, 9 aa, Homo Sapiens
IMAMITELR

SEQ ID NO: 18873 - protein, 9 aa, Homo Sapiens
GSVEVKAKK

SEQ ID NO: 18874 - protein, 9 aa, Homo Sapiens
PGTNNSRVL

SEQ ID NO: 18875 - protein, 9 aa, Homo Sapiens
RNQVASPQI

SEQ ID NO: 18876 - protein, 9 aa, Homo Sapiens
TSILSVTSR

SEQ ID NO: 18877 - protein, 9 aa, Homo Sapiens
LWQELAAVI

SEQ ID NO: 18878 - protein, 9 aa, Homo Sapiens
LNRKRHELA

SEQ ID NO: 18879 - protein, 9 aa, Homo Sapiens
PAKLNRQDV

SEQ ID NO: 18880 - protein, 9 aa, Homo Sapiens
ESVFAYELV

SEQ ID NO: 18881 - protein, 9 aa, Homo Sapiens
DLLASHSEE

SEQ ID NO: 18882 - protein, 9 aa, Homo Sapiens
SLLAKYAAA

SEQ ID NO: 18883 - protein, 9 aa, Homo Sapiens
DAAHELNEQ

SEQ ID NO: 18884 - protein, 9 aa, Homo Sapiens
TYRKFSTEV

SEQ ID NO: 18885 - protein, 9 aa, Homo Sapiens
VLKGWESHM

SEQ ID NO: 18886 - protein, 9 aa, Homo Sapiens
VPTGVPVLS

SEQ ID NO: 18887 - protein, 9 aa, Homo Sapiens
GPPGVDGVI

SEQ ID NO: 18888 - protein, 9 aa, Homo Sapiens
RFVHTRQAR

SEQ ID NO: 18889 - protein, 9 aa, Homo Sapiens
TQGKHRAVS

SEQ ID NO: 18890 - protein, 9 aa, Homo Sapiens
RHLAKEQLQ

SEQ ID NO: 18891 - protein, 9 aa, Homo Sapiens
FLDLVVKLE

SEQ ID NO: 18892 - protein, 9 aa, Homo Sapiens
DHPQHLRDR

SEQ ID NO: 18893 - protein, 9 aa, Homo Sapiens
PQPQKIIYE

SEQ ID NO: 18894 - protein, 9 aa, Homo Sapiens
LSGSRQGSA

SEQ ID NO: 18895 - protein, 9 aa, Homo Sapiens
GVLNRKRHE

SEQ ID NO: 18896 - protein, 9 aa, Homo Sapiens
DLCAANILV

SEQ ID NO: 18897 - protein, 9 aa, Homo Sapiens
SLSPSEYVQ

SEQ ID NO: 18898 - protein, 9 aa, Homo Sapiens
GAGNCKPTS

SEQ ID NO: 18899 - protein, 9 aa, Homo Sapiens
ENRALQPSD

SEQ ID NO: 18900 - protein, 9 aa, Homo Sapiens
ADIIGFTRL

SEQ ID NO: 18901 - protein, 9 aa, Homo Sapiens
KVRTLVFAL

SEQ ID NO: 18902 - protein, 9 aa, Homo Sapiens
QSRPFIGMY

SEQ ID NO: 18903 - protein, 9 aa, Homo Sapiens
LAQQGHNSP

SEQ ID NO: 18904 - protein, 9 aa, Homo Sapiens
CIKSCRPNN

SEQ ID NO: 18905 - protein, 9 aa, Homo Sapiens
RTSADRFRM

SEQ ID NO: 18906 - protein, 9 aa, Homo Sapiens
AESHRPPEH

SEQ ID NO: 18907 - protein, 9 aa, Homo Sapiens
LEVLSPQAH

SEQ ID NO: 18908 - protein, 9 aa, Homo Sapiens
SAHGYSWKL

SEQ ID NO: 18909 - protein, 9 aa, Homo Sapiens
ESKEEELTA

SEQ ID NO: 18910 - protein, 9 aa, Homo Sapiens
KACRVTETL

SEQ ID NO: 18911 - protein, 9 aa, Homo Sapiens
LSAASERLA

SEQ ID NO: 18912 - protein, 9 aa, Homo Sapiens
LHRRSLEAK

SEQ ID NO: 18913 - protein, 9 aa, Homo Sapiens
EVKAKKRIP

SEQ ID NO: 18914 - protein, 9 aa, Homo Sapiens
GAVPLLCQL

SEQ ID NO: 18915 - protein, 9 aa, Homo Sapiens
TLSDVVDRV

SEQ ID NO: 18916 - protein, 9 aa, Homo Sapiens
GSVRYTHKL

SEQ ID NO: 18917 - protein, 9 aa, Homo Sapiens
MRKKERNPM

SEQ ID NO: 18918 - protein, 9 aa, Homo Sapiens
VRYTHKLCL

SEQ ID NO: 18919 - protein, 9 aa, Homo Sapiens
HRQRAEIYA

SEQ ID NO: 18920 - protein, 9 aa, Homo Sapiens
QGYIKYSAL

SEQ ID NO: 18921 - protein, 9 aa, Homo Sapiens
DSSPPRRPQ

SEQ ID NO: 18922 - protein, 9 aa, Homo Sapiens
NYGLIHGDL

SEQ ID NO: 18923 - protein, 9 aa, Homo Sapiens
IGMYSAPRE

SEQ ID NO: 18924 - protein, 9 aa, Homo Sapiens
NQTDQEMVS

SEQ ID NO: 18925 - protein, 9 aa, Homo Sapiens
FRMKRRMQN

SEQ ID NO: 18926 - protein, 9 aa, Homo Sapiens
DIWRIVSLE

SEQ ID NO: 18927 - protein, 9 aa, Homo Sapiens
PPGVDGVIG

SEQ ID NO: 18928 - protein, 9 aa, Homo Sapiens
NCKPTSSEG

SEQ ID NO: 18929 - protein, 9 aa, Homo Sapiens
LCVFEEFVQ

SEQ ID NO: 18930 - protein, 9 aa, Homo Sapiens
EGRGGRGTA

SEQ ID NO: 18931 - protein, 9 aa, Homo Sapiens
GNCKPTSSE

SEQ ID NO: 18932 - protein, 9 aa, Homo Sapiens
CALLGVVTD

SEQ ID NO: 18933 - protein, 9 aa, Homo Sapiens
VTMPQIKAL

SEQ ID NO: 18934 - protein, 9 aa, Homo Sapiens
LASHSEEDE

SEQ ID NO: 18935 - protein, 9 aa, Homo Sapiens
CRDCGQGFT

SEQ ID NO: 18936 - protein, 9 aa, Homo Sapiens
AAPAPGRPR

SEQ ID NO: 18937 - protein, 9 aa, Homo Sapiens
MSTLMWRGP

SEQ ID NO: 18938 - protein, 9 aa, Homo Sapiens
THAPSITLP

SEQ ID NO: 18939 - protein, 9 aa, Homo Sapiens
DSEQLTFSL

SEQ ID NO: 18940 - protein, 9 aa, Homo Sapiens
GTLRNAPSK

SEQ ID NO: 18941 - protein, 9 aa, Homo Sapiens
TVPRSMHNS

SEQ ID NO: 18942 - protein, 9 aa, Homo Sapiens
QKRGAEEEE

SEQ ID NO: 18943 - protein, 9 aa, Homo Sapiens
QQLADVAQK

SEQ ID NO: 18944 - protein, 9 aa, Homo Sapiens
NTSWGAVFP

SEQ ID NO: 18945 - protein, 9 aa, Homo Sapiens
GNGHEHRSD

SEQ ID NO: 18946 - protein, 9 aa, Homo Sapiens
AENGDINWI

SEQ ID NO: 18947 - protein, 9 aa, Homo Sapiens
IPYQPKDFD

SEQ ID NO: 18948 - protein, 9 aa, Homo Sapiens
KAKKRIPPP

SEQ ID NO: 18949 - protein, 9 aa, Homo Sapiens
VDGVIGMMG

SEQ ID NO: 18950 - protein, 9 aa, Homo Sapiens
DSLRPASAS

SEQ ID NO: 18951 - protein, 9 aa, Homo Sapiens
GGCPLLHCF

SEQ ID NO: 18952 - protein, 9 aa, Homo Sapiens
ESEHLSELA

SEQ ID NO: 18953 - protein, 9 aa, Homo Sapiens
TLAQTAAGG

SEQ ID NO: 18954 - protein, 9 aa, Homo Sapiens
GGLTYITIS

SEQ ID NO: 18955 - protein, 9 aa, Homo Sapiens
DTQVLLDSA

SEQ ID NO: 18956 - protein, 9 aa, Homo Sapiens
YQKSGKHSL

SEQ ID NO: 18957 - protein, 9 aa, Homo Sapiens
EGDEQKRGA

SEQ ID NO: 18958 - protein, 9 aa, Homo Sapiens
RFFCRDCGQ

SEQ ID NO: 18959 - protein, 9 aa, Homo Sapiens
AAIDEKPKE

SEQ ID NO: 18960 - protein, 9 aa, Homo Sapiens
EKMYLDKII

SEQ ID NO: 18961 - protein, 9 aa, Homo Sapiens
KRLEQEIQT

SEQ ID NO: 18962 - protein, 9 aa, Homo Sapiens
VLHAPPATK

SEQ ID NO: 18963 - protein, 9 aa, Homo Sapiens
QNSIHSLTL

SEQ ID NO: 18964 - protein, 9 aa, Homo Sapiens
IANGGASLS

SEQ ID NO: 18965 - protein, 9 aa, Homo Sapiens
CAVGVQWPR

SEQ ID NO: 18966 - protein, 9 aa, Homo Sapiens
GGGAAVPGI

SEQ ID NO: 18967 - protein, 9 aa, Homo Sapiens
PDSSPPRRP

SEQ ID NO: 18968 - protein, 9 aa, Homo Sapiens
DRQMIFNML

SEQ ID NO: 18969 - protein, 9 aa, Homo Sapiens
GACYHKCLQ

SEQ ID NO: 18970 - protein, 9 aa, Homo Sapiens
DLKEHLPGQ

SEQ ID NO: 18971 - protein, 9 aa, Homo Sapiens
SVENVRNGI

SEQ ID NO: 18972 - protein, 9 aa, Homo Sapiens
AESKEEELT

SEQ ID NO: 18973 - protein, 9 aa, Homo Sapiens
NGQHDISFS

SEQ ID NO: 18974 - protein, 9 aa, Homo Sapiens
EHQGENLDK

SEQ ID NO: 18975 - protein, 9 aa, Homo Sapiens
NFEACREME

SEQ ID NO: 18976 - protein, 9 aa, Homo Sapiens
YTLPRLKTY

SEQ ID NO: 18977 - protein, 9 aa, Homo Sapiens
GLLFQLVLK

SEQ ID NO: 18978 - protein, 9 aa, Homo Sapiens
GDLEDLKEH

SEQ ID NO: 18979 - protein, 9 aa, Homo Sapiens
ESSQRGFYA

SEQ ID NO: 18980 - protein, 9 aa, Homo Sapiens
NAGMNVDIH

SEQ ID NO: 18981 - protein, 9 aa, Homo Sapiens
EKEGDEQKR

SEQ ID NO: 18982 - protein, 9 aa, Homo Sapiens
SAAPAPGRP

SEQ ID NO: 18983 - protein, 9 aa, Homo Sapiens
CSLGCLGAL

SEQ ID NO: 18984 - protein, 9 aa, Homo Sapiens
PDVDFSEDN

SEQ ID NO: 18985 - protein, 9 aa, Homo Sapiens
RARHDSPDS

SEQ ID NO: 18986 - protein, 9 aa, Homo Sapiens
LVGYVLRFL

SEQ ID NO: 18987 - protein, 9 aa, Homo Sapiens
GKSPSPLPT

SEQ ID NO: 18988 - protein, 9 aa, Homo Sapiens
QVKEQRLAG

SEQ ID NO: 18989 - protein, 9 aa, Homo Sapiens
APAPGRPRQ

SEQ ID NO: 18990 - protein, 9 aa, Homo Sapiens
VVFEYPLTI

SEQ ID NO: 18991 - protein, 9 aa, Homo Sapiens
RKFSTEVTL

SEQ ID NO: 18992 - protein, 9 aa, Homo Sapiens
TLFEAHMAR

SEQ ID NO: 18993 - protein, 9 aa, Homo Sapiens
VLWDFQGYI

SEQ ID NO: 18994 - protein, 9 aa, Homo Sapiens
SIGKKDEVI

SEQ ID NO: 18995 - protein, 9 aa, Homo Sapiens
QPEGPHTSR

SEQ ID NO: 18996 - protein, 9 aa, Homo Sapiens
NKKKVEDAL

SEQ ID NO: 18997 - protein, 9 aa, Homo Sapiens
QTVLHEQKT

SEQ ID NO: 18998 - protein, 9 aa, Homo Sapiens
TTAPAALEA

SEQ ID NO: 18999 - protein, 9 aa, Homo Sapiens
YSTNVASLW

SEQ ID NO: 19000 - protein, 9 aa, Homo Sapiens
VRCRACGAL

SEQ ID NO: 19001 - protein, 9 aa, Homo Sapiens
KGGVGKSTV

SEQ ID NO: 19002 - protein, 9 aa, Homo Sapiens
SVLDKMMVE

SEQ ID NO: 19003 - protein, 9 aa, Homo Sapiens
TDETRIFQV

SEQ ID NO: 19004 - protein, 9 aa, Homo Sapiens
QIEKQRQKM

SEQ ID NO: 19005 - protein, 9 aa, Homo Sapiens
LSELAEEEY

SEQ ID NO: 19006 - protein, 9 aa, Homo Sapiens
EISIGKKDE

SEQ ID NO: 19007 - protein, 9 aa, Homo Sapiens
VTIMHKDIQ

SEQ ID NO: 19008 - protein, 9 aa, Homo Sapiens
ALRVLYGNR

SEQ ID NO: 19009 - protein, 9 aa, Homo Sapiens
ERSNDKRIC

SEQ ID NO: 19010 - protein, 9 aa, Homo Sapiens
SHSLSPSEY

SEQ ID NO: 19011 - protein, 9 aa, Homo Sapiens
SAHVQWMVV

SEQ ID NO: 19012 - protein, 9 aa, Homo Sapiens
LLIVFDDDS

SEQ ID NO: 19013 - protein, 9 aa, Homo Sapiens
FESTGESEW

SEQ ID NO: 19014 - protein, 9 aa, Homo Sapiens
YHLYLRSLE

SEQ ID NO: 19015 - protein, 9 aa, Homo Sapiens
GRENSFRYW

SEQ ID NO: 19016 - protein, 9 aa, Homo Sapiens
VGYVLRFLP

SEQ ID NO: 19017 - protein, 9 aa, Homo Sapiens
NGDINWIIP

SEQ ID NO: 19018 - protein, 9 aa, Homo Sapiens
QHVYIGSAC

SEQ ID NO: 19019 - protein, 9 aa, Homo Sapiens
YRKKSPAWK

SEQ ID NO: 19020 - protein, 9 aa, Homo Sapiens
PVPLSKVTE

SEQ ID NO: 19021 - protein, 9 aa, Homo Sapiens
WWPHKDGTK

SEQ ID NO: 19022 - protein, 9 aa, Homo Sapiens
ADVAQKWCS

SEQ ID NO: 19023 - protein, 9 aa, Homo Sapiens
GTVLGNLLI

SEQ ID NO: 19024 - protein, 9 aa, Homo Sapiens
NPGLGLLNN

SEQ ID NO: 19025 - protein, 9 aa, Homo Sapiens
LPKPKRGPQ

SEQ ID NO: 19026 - protein, 9 aa, Homo Sapiens
SHRFNGNST

SEQ ID NO: 19027 - protein, 9 aa, Homo Sapiens
LALVKLFNT

SEQ ID NO: 19028 - protein, 9 aa, Homo Sapiens
ATTSTKGSS

SEQ ID NO: 19029 - protein, 9 aa, Homo Sapiens
NQKASSHRY

SEQ ID NO: 19030 - protein, 9 aa, Homo Sapiens
VLENAPLCH

SEQ ID NO: 19031 - protein, 9 aa, Homo Sapiens
DSACTSETE

SEQ ID NO: 19032 - protein, 9 aa, Homo Sapiens
HIVGNQTDQ

SEQ ID NO: 19033 - protein, 9 aa, Homo Sapiens
PLSKVTELD

SEQ ID NO: 19034 - protein, 9 aa, Homo Sapiens
TRFGMKIIH

SEQ ID NO: 19035 - protein, 9 aa, Homo Sapiens
KRYMQELLK

SEQ ID NO: 19036 - protein, 9 aa, Homo Sapiens
KPFRVICIY

SEQ ID NO: 19037 - protein, 9 aa, Homo Sapiens
LVSQPVGQS

SEQ ID NO: 19038 - protein, 9 aa, Homo Sapiens
AHMARCTSI

SEQ ID NO: 19039 - protein, 9 aa, Homo Sapiens
YEDTPEGTI

SEQ ID NO: 19040 - protein, 9 aa, Homo Sapiens
ECKESSPMP

SEQ ID NO: 19041 - protein, 9 aa, Homo Sapiens
LSADMLSQA

SEQ ID NO: 19042 - protein, 9 aa, Homo Sapiens
STLMWRGPE

SEQ ID NO: 19043 - protein, 9 aa, Homo Sapiens
RKPAPEWAS

SEQ ID NO: 19044 - protein, 9 aa, Homo Sapiens
YSLLAKYAA

SEQ ID NO: 19045 - protein, 9 aa, Homo Sapiens
SPCGACTLW

SEQ ID NO: 19046 - protein, 9 aa, Homo Sapiens
RPNNVTCVF

SEQ ID NO: 19047 - protein, 9 aa, Homo Sapiens
ICVVNFEAC

SEQ ID NO: 19048 - protein, 9 aa, Homo Sapiens
FQGMVFDLV

SEQ ID NO: 19049 - protein, 9 aa, Homo Sapiens
EKTAAEKSR

SEQ ID NO: 19050 - protein, 9 aa, Homo Sapiens
HRTRPLRSL

SEQ ID NO: 19051 - protein, 9 aa, Homo Sapiens
LSILLDLAP

SEQ ID NO: 19052 - protein, 9 aa, Homo Sapiens
SCKRPKNQL

SEQ ID NO: 19053 - protein, 9 aa, Homo Sapiens
TRIFQVLGA

SEQ ID NO: 19054 - protein, 9 aa, Homo Sapiens
HPVYTPPTY

SEQ ID NO: 19055 - protein, 9 aa, Homo Sapiens
KGRVQAECL

SEQ ID NO: 19056 - protein, 9 aa, Homo Sapiens
NCCLTLCDF

SEQ ID NO: 19057 - protein, 9 aa, Homo Sapiens
SPAAAAIDE

SEQ ID NO: 19058 - protein, 9 aa, Homo Sapiens
GKIYKIYLT

SEQ ID NO: 19059 - protein, 9 aa, Homo Sapiens
TDQEMVSAS

SEQ ID NO: 19060 - protein, 9 aa, Homo Sapiens
GLLGDKGRV

SEQ ID NO: 19061 - protein, 9 aa, Homo Sapiens
KRVTIMHKD

SEQ ID NO: 19062 - protein, 9 aa, Homo Sapiens
EISRKLFHT

SEQ ID NO: 19063 - protein, 9 aa, Homo Sapiens
ERKSSVFKA

SEQ ID NO: 19064 - protein, 9 aa, Homo Sapiens
KYEQNSLIW

SEQ ID NO: 19065 - protein, 9 aa, Homo Sapiens
ATESNKVPL

SEQ ID NO: 19066 - protein, 9 aa, Homo Sapiens
VKNAKLEEE

SEQ ID NO: 19067 - protein, 9 aa, Homo Sapiens
KITSTSLLC

SEQ ID NO: 19068 - protein, 9 aa, Homo Sapiens
SDLFINNYQ

SEQ ID NO: 19069 - protein, 9 aa, Homo Sapiens
TEVTLNTVG

SEQ ID NO: 19070 - protein, 9 aa, Homo Sapiens
AAPDAPAEP

SEQ ID NO: 19071 - protein, 9 aa, Homo Sapiens
MHVNAGQML

SEQ ID NO: 19072 - protein, 9 aa, Homo Sapiens
LRLLDLCYN

SEQ ID NO: 19073 - protein, 9 aa, Homo Sapiens
LSLEKKDLR

SEQ ID NO: 19074 - protein, 9 aa, Homo Sapiens
AQTVLHEQK

SEQ ID NO: 19075 - protein, 9 aa, Homo Sapiens
NICLTADSL

SEQ ID NO: 19076 - protein, 9 aa, Homo Sapiens
QDFNEAQCN

SEQ ID NO: 19077 - protein, 9 aa, Homo Sapiens
QEFPALQET

SEQ ID NO: 19078 - protein, 9 aa, Homo Sapiens
CGQGFTLKP

SEQ ID NO: 19079 - protein, 9 aa, Homo Sapiens
ICKQCGKAY

SEQ ID NO: 19080 - protein, 9 aa, Homo Sapiens
AMHVNAGQM

SEQ ID NO: 19081 - protein, 9 aa, Homo Sapiens
PGLGLLNNI

SEQ ID NO: 19082 - protein, 9 aa, Homo Sapiens
GQHDISFSV

SEQ ID NO: 19083 - protein, 9 aa, Homo Sapiens
VSQPVGQSN

SEQ ID NO: 19084 - protein, 9 aa, Homo Sapiens
EKRKMKRNQ

SEQ ID NO: 19085 - protein, 9 aa, Homo Sapiens
CIPMQDFAL

SEQ ID NO: 19086 - protein, 9 aa, Homo Sapiens
PTDLVFMLD

SEQ ID NO: 19087 - protein, 9 aa, Homo Sapiens
ASNKKKVED

SEQ ID NO: 19088 - protein, 9 aa, Homo Sapiens
FCMLSHLTH

SEQ ID NO: 19089 - protein, 9 aa, Homo Sapiens
LKALNAHRS

SEQ ID NO: 19090 - protein, 9 aa, Homo Sapiens
PRGILVGNV

SEQ ID NO: 19091 - protein, 9 aa, Homo Sapiens
ALQFQKACR

SEQ ID NO: 19092 - protein, 9 aa, Homo Sapiens
QRLIVLDLG

SEQ ID NO: 19093 - protein, 9 aa, Homo Sapiens
SSPDCAVGV

SEQ ID NO: 19094 - protein, 9 aa, Homo Sapiens
SLPCFEASE

SEQ ID NO: 19095 - protein, 9 aa, Homo Sapiens
IRELWRKKQ

SEQ ID NO: 19096 - protein, 9 aa, Homo Sapiens
QIMQRTSAD

SEQ ID NO: 19097 - protein, 9 aa, Homo Sapiens
YAFTALDVQ

SEQ ID NO: 19098 - protein, 9 aa, Homo Sapiens
RTLVFALVN

SEQ ID NO: 19099 - protein, 9 aa, Homo Sapiens
LQNDYLRKM

SEQ ID NO: 19100 - protein, 9 aa, Homo Sapiens
EEQAGPSCD

SEQ ID NO: 19101 - protein, 9 aa, Homo Sapiens
PAEPDAGAA

SEQ ID NO: 19102 - protein, 9 aa, Homo Sapiens
VIRHAHQIA

SEQ ID NO: 19103 - protein, 9 aa, Homo Sapiens
RDNAKLQEF

SEQ ID NO: 19104 - protein, 9 aa, Homo Sapiens
GYSSMCGHV

SEQ ID NO: 19105 - protein, 9 aa, Homo Sapiens
LAEYSAEYS

SEQ ID NO: 19106 - protein, 9 aa, Homo Sapiens
HILHTAEKP

SEQ ID NO: 19107 - protein, 9 aa, Homo Sapiens
PAPGTGGYS

SEQ ID NO: 19108 - protein, 9 aa, Homo Sapiens
DLLVNDVNE

SEQ ID NO: 19109 - protein, 9 aa, Homo Sapiens
YFQSFPNLA

SEQ ID NO: 19110 - protein, 9 aa, Homo Sapiens
FYACSVVVD

SEQ ID NO: 19111 - protein, 9 aa, Homo Sapiens
HQDSVEGLS

SEQ ID NO: 19112 - protein, 9 aa, Homo Sapiens
LTHSESKVK

SEQ ID NO: 19113 - protein, 9 aa, Homo Sapiens
PEIDCLCTQ

SEQ ID NO: 19114 - protein, 9 aa, Homo Sapiens
SGALHRNRK

SEQ ID NO: 19115 - protein, 9 aa, Homo Sapiens
ACQRLKGMK

SEQ ID NO: 19116 - protein, 9 aa, Homo Sapiens
SDGWTPLYC

SEQ ID NO: 19117 - protein, 9 aa, Homo Sapiens
LGDKGRVQA

SEQ ID NO: 19118 - protein, 9 aa, Homo Sapiens
GTSVSKNRC

SEQ ID NO: 19119 - protein, 9 aa, Homo Sapiens
VAQKWCSNT

SEQ ID NO: 19120 - protein, 9 aa, Homo Sapiens
KNRCHLEGG

SEQ ID NO: 19121 - protein, 9 aa, Homo Sapiens
RELWRKKQS

SEQ ID NO: 19122 - protein, 9 aa, Homo Sapiens
KSEECNRSW

SEQ ID NO: 19123 - protein, 9 aa, Homo Sapiens
QVSLPELED

SEQ ID NO: 19124 - protein, 9 aa, Homo Sapiens
KDLTVLIAM

SEQ ID NO: 19125 - protein, 9 aa, Homo Sapiens
DSEKEIYNQ

SEQ ID NO: 19126 - protein, 9 aa, Homo Sapiens
GNECGAKGS

SEQ ID NO: 19127 - protein, 9 aa, Homo Sapiens
EPLERLVSA

SEQ ID NO: 19128 - protein, 9 aa, Homo Sapiens
WPDKSEECN

SEQ ID NO: 19129 - protein, 9 aa, Homo Sapiens
GDASLGFHG

SEQ ID NO: 19130 - protein, 9 aa, Homo Sapiens
DKNLVPVAA

SEQ ID NO: 19131 - protein, 9 aa, Homo Sapiens
LVKLFNTYI

SEQ ID NO: 19132 - protein, 9 aa, Homo Sapiens
RSIDAAFFR

SEQ ID NO: 19133 - protein, 9 aa, Homo Sapiens
EVLLNMTKN

SEQ ID NO: 19134 - protein, 9 aa, Homo Sapiens
WESHMVEGQ

SEQ ID NO: 19135 - protein, 9 aa, Homo Sapiens
DAMNPDCGI

SEQ ID NO: 19136 - protein, 9 aa, Homo Sapiens
SRSHSIFSV

SEQ ID NO: 19137 - protein, 9 aa, Homo Sapiens
LLFFYFVGY

SEQ ID NO: 19138 - protein, 9 aa, Homo Sapiens
IHTFLDVSL

SEQ ID NO: 19139 - protein, 9 aa, Homo Sapiens
LLASHSEED

SEQ ID NO: 19140 - protein, 9 aa, Homo Sapiens
IQEFAMTFA

SEQ ID NO: 19141 - protein, 9 aa, Homo Sapiens
IHSTKRPFK

SEQ ID NO: 19142 - protein, 9 aa, Homo Sapiens
EPEYLAEYS

SEQ ID NO: 19143 - protein, 9 aa, Homo Sapiens
LTEFFLLAS

SEQ ID NO: 19144 - protein, 9 aa, Homo Sapiens
MITELRSIN

SEQ ID NO: 19145 - protein, 9 aa, Homo Sapiens
NLDNLGVPW

SEQ ID NO: 19146 - protein, 9 aa, Homo Sapiens
TVLHEQKTL

SEQ ID NO: 19147 - protein, 9 aa, Homo Sapiens
GLCGLGSCL

SEQ ID NO: 19148 - protein, 9 aa, Homo Sapiens
KKEQPGGAH

SEQ ID NO: 19149 - protein, 9 aa, Homo Sapiens
ITTKDPRIV

SEQ ID NO: 19150 - protein, 9 aa, Homo Sapiens
LLVICHHGT

SEQ ID NO: 19151 - protein, 9 aa, Homo Sapiens
SQPVGQSNF

SEQ ID NO: 19152 - protein, 9 aa, Homo Sapiens
NSTGNLLCF

SEQ ID NO: 19153 - protein, 9 aa, Homo Sapiens
ITSTQGKHR

SEQ ID NO: 19154 - protein, 9 aa, Homo Sapiens
IILPAQGMD

SEQ ID NO: 19155 - protein, 9 aa, Homo Sapiens
KAVHVACAD

SEQ ID NO: 19156 - protein, 9 aa, Homo Sapiens
FTTAAYLRM

SEQ ID NO: 19157 - protein, 9 aa, Homo Sapiens
KKILIAIAL

SEQ ID NO: 19158 - protein, 9 aa, Homo Sapiens
AQQSTSGQP

SEQ ID NO: 19159 - protein, 9 aa, Homo Sapiens
VPLLCQLDT

SEQ ID NO: 19160 - protein, 9 aa, Homo Sapiens
QRTSADRFR

SEQ ID NO: 19161 - protein, 9 aa, Homo Sapiens
GGRVHNEFD

SEQ ID NO: 19162 - protein, 9 aa, Homo Sapiens
KIIHISDVF

SEQ ID NO: 19163 - protein, 9 aa, Homo Sapiens
LEDNIKRLE

SEQ ID NO: 19164 - protein, 9 aa, Homo Sapiens
QIQLKSRGV

SEQ ID NO: 19165 - protein, 9 aa, Homo Sapiens
DTMYLTQVM

SEQ ID NO: 19166 - protein, 9 aa, Homo Sapiens
GGVGKSTVS

SEQ ID NO: 19167 - protein, 9 aa, Homo Sapiens
QITTYDLLL

SEQ ID NO: 19168 - protein, 9 aa, Homo Sapiens
SLEKKDLRD

SEQ ID NO: 19169 - protein, 9 aa, Homo Sapiens
EVLSPQAHL

SEQ ID NO: 19170 - protein, 9 aa, Homo Sapiens
CVDCKAGSY

SEQ ID NO: 19171 - protein, 9 aa, Homo Sapiens
NAPLCHSVI

SEQ ID NO: 19172 - protein, 9 aa, Homo Sapiens
FIQPLSAAS

SEQ ID NO: 19173 - protein, 9 aa, Homo Sapiens
LATPPIATH

SEQ ID NO: 19174 - protein, 9 aa, Homo Sapiens
RGILVGNVT

SEQ ID NO: 19175 - protein, 9 aa, Homo Sapiens
WPHKDGTKF

SEQ ID NO: 19176 - protein, 9 aa, Homo Sapiens
FDGALRVLY

SEQ ID NO: 19177 - protein, 9 aa, Homo Sapiens
HLRRHCGEK

SEQ ID NO: 19178 - protein, 9 aa, Homo Sapiens
LGCIPMQDF

SEQ ID NO: 19179 - protein, 9 aa, Homo Sapiens
DFQGYIKYS

SEQ ID NO: 19180 - protein, 9 aa, Homo Sapiens
GKATRVSNQ

SEQ ID NO: 19181 - protein, 9 aa, Homo Sapiens
LLHFFLLAA

SEQ ID NO: 19182 - protein, 9 aa, Homo Sapiens
KEEDKQEES

SEQ ID NO: 19183 - protein, 9 aa, Homo Sapiens
IKRLEQEIQ

SEQ ID NO: 19184 - protein, 9 aa, Homo Sapiens
REMESLSAP

SEQ ID NO: 19185 - protein, 9 aa, Homo Sapiens
SQPYFQSFP

SEQ ID NO: 19186 - protein, 9 aa, Homo Sapiens
DEVDADLNP

SEQ ID NO: 19187 - protein, 9 aa, Homo Sapiens
LINDKEELL

SEQ ID NO: 19188 - protein, 9 aa, Homo Sapiens
RVYITNYHL

SEQ ID NO: 19189 - protein, 9 aa, Homo Sapiens
MTSSDVEAG

SEQ ID NO: 19190 - protein, 9 aa, Homo Sapiens
TTYDLLLVI

SEQ ID NO: 19191 - protein, 9 aa, Homo Sapiens
LGLTEFFLL

SEQ ID NO: 19192 - protein, 9 aa, Homo Sapiens
SGGLTYITI

SEQ ID NO: 19193 - protein, 9 aa, Homo Sapiens
VTSATESNK

SEQ ID NO: 19194 - protein, 9 aa, Homo Sapiens
AKETEKSLH

SEQ ID NO: 19195 - protein, 9 aa, Homo Sapiens
TALEQMQRQ

SEQ ID NO: 19196 - protein, 9 aa, Homo Sapiens
SATESNKVP

SEQ ID NO: 19197 - protein, 9 aa, Homo Sapiens
EVSLQKIVK

SEQ ID NO: 19198 - protein, 9 aa, Homo Sapiens
PGACYHKCL

SEQ ID NO: 19199 - protein, 9 aa, Homo Sapiens
CSHAKGSRS

SEQ ID NO: 19200 - protein, 9 aa, Homo Sapiens
PHEAAYDAC

SEQ ID NO: 19201 - protein, 9 aa, Homo Sapiens
HRDLCAANI

SEQ ID NO: 19202 - protein, 9 aa, Homo Sapiens
PSEYVQGKS

SEQ ID NO: 19203 - protein, 9 aa, Homo Sapiens
KELWKLIMN

SEQ ID NO: 19204 - protein, 9 aa, Homo Sapiens
SLRSCSLGC

SEQ ID NO: 19205 - protein, 9 aa, Homo Sapiens
QKELALLQD

SEQ ID NO: 19206 - protein, 9 aa, Homo Sapiens
EKKDLRDRE

SEQ ID NO: 19207 - protein, 9 aa, Homo Sapiens
LRPASASLW

SEQ ID NO: 19208 - protein, 9 aa, Homo Sapiens
ASEIRNLNP

SEQ ID NO: 19209 - protein, 9 aa, Homo Sapiens
GALRVLYGN

SEQ ID NO: 19210 - protein, 9 aa, Homo Sapiens
PAALEAQTT

SEQ ID NO: 19211 - protein, 9 aa, Homo Sapiens
NQRLIVLDL

SEQ ID NO: 19212 - protein, 9 aa, Homo Sapiens
SQNPGKPRV

SEQ ID NO: 19213 - protein, 9 aa, Homo Sapiens
REVSFESTG

SEQ ID NO: 19214 - protein, 9 aa, Homo Sapiens
LRSCSLGCL

SEQ ID NO: 19215 - protein, 9 aa, Homo Sapiens
SLSPAPTPG

SEQ ID NO: 19216 - protein, 9 aa, Homo Sapiens
GLWPDKSEE

SEQ ID NO: 19217 - protein, 9 aa, Homo Sapiens
AEKDLTVLI

SEQ ID NO: 19218 - protein, 9 aa, Homo Sapiens
VNFEACREM

SEQ ID NO: 19219 - protein, 9 aa, Homo Sapiens
AAMHVNAGQ

SEQ ID NO: 19220 - protein, 9 aa, Homo Sapiens
SWLCSKPFR

SEQ ID NO: 19221 - protein, 9 aa, Homo Sapiens
QSIYGGRVH

SEQ ID NO: 19222 - protein, 9 aa, Homo Sapiens
AAAIDEKPK

SEQ ID NO: 19223 - protein, 9 aa, Homo Sapiens
YIRELWRKK

SEQ ID NO: 19224 - protein, 9 aa, Homo Sapiens
CKRNVMILT

SEQ ID NO: 19225 - protein, 9 aa, Homo Sapiens
LEQMQRQAE

SEQ ID NO: 19226 - protein, 9 aa, Homo Sapiens
VLCRDKMEE

SEQ ID NO: 19227 - protein, 9 aa, Homo Sapiens
HVNAGQMLH

SEQ ID NO: 19228 - protein, 9 aa, Homo Sapiens
MNPDCGIPL

SEQ ID NO: 19229 - protein, 9 aa, Homo Sapiens
LSKEEDMET

SEQ ID NO: 19230 - protein, 9 aa, Homo Sapiens
LFINNYQVK

SEQ ID NO: 19231 - protein, 9 aa, Homo Sapiens
QKIVKMSII

SEQ ID NO: 19232 - protein, 9 aa, Homo Sapiens
CIPLSILEP

SEQ ID NO: 19233 - protein, 9 aa, Homo Sapiens
SIYGGRVHN

SEQ ID NO: 19234 - protein, 9 aa, Homo Sapiens
SSVTCLDGT

SEQ ID NO: 19235 - protein, 9 aa, Homo Sapiens
ATRPPDQPE

SEQ ID NO: 19236 - protein, 9 aa, Homo Sapiens
LAGNGLEAW

SEQ ID NO: 19237 - protein, 9 aa, Homo Sapiens
LFNTYIRKY

SEQ ID NO: 19238 - protein, 9 aa, Homo Sapiens
YIQICKIVI

SEQ ID NO: 19239 - protein, 9 aa, Homo Sapiens
QTDSWNDRP

SEQ ID NO: 19240 - protein, 9 aa, Homo Sapiens
WTPLYCAAS

SEQ ID NO: 19241 - protein, 9 aa, Homo Sapiens
CRACGALRN

SEQ ID NO: 19242 - protein, 9 aa, Homo Sapiens
LQSAFEETG

SEQ ID NO: 19243 - protein, 9 aa, Homo Sapiens
RNRKMAAWP

SEQ ID NO: 19244 - protein, 9 aa, Homo Sapiens
LLVNDVNEN

SEQ ID NO: 19245 - protein, 9 aa, Homo Sapiens
REEPQPQKI

SEQ ID NO: 19246 - protein, 9 aa, Homo Sapiens
HNDQLYVSE

SEQ ID NO: 19247 - protein, 9 aa, Homo Sapiens
LKGWESHMV

SEQ ID NO: 19248 - protein, 9 aa, Homo Sapiens
VVNFEACRE

SEQ ID NO: 19249 - protein, 9 aa, Homo Sapiens
TFYQEQQAQ

SEQ ID NO: 19250 - protein, 9 aa, Homo Sapiens
EHLYKTVPA

SEQ ID NO: 19251 - protein, 9 aa, Homo Sapiens
FNTSAAQPQ

SEQ ID NO: 19252 - protein, 9 aa, Homo Sapiens
CPLGTELAP

SEQ ID NO: 19253 - protein, 9 aa, Homo Sapiens
KHRQRAEIY

SEQ ID NO: 19254 - protein, 9 aa, Homo Sapiens
KTTVCENAQ

SEQ ID NO: 19255 - protein, 9 aa, Homo Sapiens
KFQGMVFDL

SEQ ID NO: 19256 - protein, 9 aa, Homo Sapiens
HNKSSEVSQ

SEQ ID NO: 19257 - protein, 9 aa, Homo Sapiens
APGRPRQLV

SEQ ID NO: 19258 - protein, 9 aa, Homo Sapiens
IFSVKILQI

SEQ ID NO: 19259 - protein, 9 aa, Homo Sapiens
MEVYEDTPE

SEQ ID NO: 19260 - protein, 9 aa, Homo Sapiens
RPLRSLRKD

SEQ ID NO: 19261 - protein, 9 aa, Homo Sapiens
ELFDPDIQV

SEQ ID NO: 19262 - protein, 9 aa, Homo Sapiens
ELWKLIMNT

SEQ ID NO: 19263 - protein, 9 aa, Homo Sapiens
GPFDDLKHR

SEQ ID NO: 19264 - protein, 9 aa, Homo Sapiens
QSSEEVSLQ

SEQ ID NO: 19265 - protein, 9 aa, Homo Sapiens
PSEAPDIWR

SEQ ID NO: 19266 - protein, 9 aa, Homo Sapiens
KNKEGVFDH

SEQ ID NO: 19267 - protein, 9 aa, Homo Sapiens
LLAEVAGLQ

SEQ ID NO: 19268 - protein, 9 aa, Homo Sapiens
KDTMYLTQV

SEQ ID NO: 19269 - protein, 9 aa, Homo Sapiens
NSVPTNLAQ

SEQ ID NO: 19270 - protein, 9 aa, Homo Sapiens
GEDSACTSE

SEQ ID NO: 19271 - protein, 9 aa, Homo Sapiens
FAGLIKLKE

SEQ ID NO: 19272 - protein, 9 aa, Homo Sapiens
LYADIIGFT

SEQ ID NO: 19273 - protein, 9 aa, Homo Sapiens
KRICVVNFE

SEQ ID NO: 19274 - protein, 9 aa, Homo Sapiens
GEPGSNVDQ

SEQ ID NO: 19275 - protein, 9 aa, Homo Sapiens
LVFMLDGSY

SEQ ID NO: 19276 - protein, 9 aa, Homo Sapiens
LNIDICALF

SEQ ID NO: 19277 - protein, 9 aa, Homo Sapiens
LSQQDLESH

SEQ ID NO: 19278 - protein, 9 aa, Homo Sapiens
LTVLGAFLN

SEQ ID NO: 19279 - protein, 9 aa, Homo Sapiens
PSARRYEFR

SEQ ID NO: 19280 - protein, 9 aa, Homo Sapiens
VKAKKRIPP

SEQ ID NO: 19281 - protein, 9 aa, Homo Sapiens
VWTEKQKSV

SEQ ID NO: 19282 - protein, 9 aa, Homo Sapiens
KEEELTAGS

SEQ ID NO: 19283 - protein, 9 aa, Homo Sapiens
ASAVPSETS

SEQ ID NO: 19284 - protein, 9 aa, Homo Sapiens
SVLWDFQGY

SEQ ID NO: 19285 - protein, 9 aa, Homo Sapiens
VVTHCLVPK

SEQ ID NO: 19286 - protein, 9 aa, Homo Sapiens
WDSNELVPL

SEQ ID NO: 19287 - protein, 9 aa, Homo Sapiens
LPDTESGYT

SEQ ID NO: 19288 - protein, 9 aa, Homo Sapiens
RGFYACSVV

SEQ ID NO: 19289 - protein, 9 aa, Homo Sapiens
LSPAPTPGS

SEQ ID NO: 19290 - protein, 9 aa, Homo Sapiens
EQHAQQWVE

SEQ ID NO: 19291 - protein, 9 aa, Homo Sapiens
AYYINHPVY

SEQ ID NO: 19292 - protein, 9 aa, Homo Sapiens
CKQCGKAYG

SEQ ID NO: 19293 - protein, 9 aa, Homo Sapiens
TTSTKGSSS

SEQ ID NO: 19294 - protein, 9 aa, Homo Sapiens
NDKEELLKE

SEQ ID NO: 19295 - protein, 9 aa, Homo Sapiens
SNKVPLHAS

SEQ ID NO: 19296 - protein, 9 aa, Homo Sapiens
LMKTVMAVL

SEQ ID NO: 19297 - protein, 9 aa, Homo Sapiens
MGAYKYIRE

SEQ ID NO: 19298 - protein, 9 aa, Homo Sapiens
VVKEWLSEF

SEQ ID NO: 19299 - protein, 9 aa, Homo Sapiens
CSLTHSESK

SEQ ID NO: 19300 - protein, 9 aa, Homo Sapiens
TEPSCPGRG

SEQ ID NO: 19301 - protein, 9 aa, Homo Sapiens
ASLPDTQVL

SEQ ID NO: 19302 - protein, 9 aa, Homo Sapiens
SVEVKAKKR

SEQ ID NO: 19303 - protein, 9 aa, Homo Sapiens
EQAGPSCDK

SEQ ID NO: 19304 - protein, 9 aa, Homo Sapiens
NVDQGPKGD

SEQ ID NO: 19305 - protein, 9 aa, Homo Sapiens
RLPVTNISS

SEQ ID NO: 19306 - protein, 9 aa, Homo Sapiens
DGAKLKKCF

SEQ ID NO: 19307 - protein, 9 aa, Homo Sapiens
SPADVIQEF

SEQ ID NO: 19308 - protein, 9 aa, Homo Sapiens
CRKPAPEWA

SEQ ID NO: 19309 - protein, 9 aa, Homo Sapiens
RYEDSHQEE

SEQ ID NO: 19310 - protein, 9 aa, Homo Sapiens
RIRSAQGRK

SEQ ID NO: 19311 - protein, 9 aa, Homo Sapiens
APLCHSVIH

SEQ ID NO: 19312 - protein, 9 aa, Homo Sapiens
SQNYGLIHG

SEQ ID NO: 19313 - protein, 9 aa, Homo Sapiens
NAKLQEFAN

SEQ ID NO: 19314 - protein, 9 aa, Homo Sapiens
SRPFIGMYS

SEQ ID NO: 19315 - protein, 9 aa, Homo Sapiens
HKITVFYIA

SEQ ID NO: 19316 - protein, 9 aa, Homo Sapiens
DADDCGDCS

SEQ ID NO: 19317 - protein, 9 aa, Homo Sapiens
QLTFSLSRH

SEQ ID NO: 19318 - protein, 9 aa, Homo Sapiens
IYLSSPDCA

SEQ ID NO: 19319 - protein, 9 aa, Homo Sapiens
FPALQETNY

SEQ ID NO: 19320 - protein, 9 aa, Homo Sapiens
MSYRKKSPA

SEQ ID NO: 19321 - protein, 9 aa, Homo Sapiens
MHMSYEAGI

SEQ ID NO: 19322 - protein, 9 aa, Homo Sapiens
QTELEVLLN

SEQ ID NO: 19323 - protein, 9 aa, Homo Sapiens
APEKELPPL

SEQ ID NO: 19324 - protein, 9 aa, Homo Sapiens
DKEELLKEM

SEQ ID NO: 19325 - protein, 9 aa, Homo Sapiens
EEEGGRENS

SEQ ID NO: 19326 - protein, 9 aa, Homo Sapiens
SYRKKSPAW

SEQ ID NO: 19327 - protein, 9 aa, Homo Sapiens
AIDNYDSSG

SEQ ID NO: 19328 - protein, 9 aa, Homo Sapiens
GKNARSILN

SEQ ID NO: 19329 - protein, 9 aa, Homo Sapiens
DPDIQVLKD

SEQ ID NO: 19330 - protein, 9 aa, Homo Sapiens
DTECSHAKG

SEQ ID NO: 19331 - protein, 9 aa, Homo Sapiens
AMNPDCGIP

SEQ ID NO: 19332 - protein, 9 aa, Homo Sapiens
SECKESSPM

SEQ ID NO: 19333 - protein, 9 aa, Homo Sapiens
ALQETNYSI

SEQ ID NO: 19334 - protein, 9 aa, Homo Sapiens
GERSNDKRI

SEQ ID NO: 19335 - protein, 9 aa, Homo Sapiens
RFGMKIIHI

SEQ ID NO: 19336 - protein, 9 aa, Homo Sapiens
IGKKDEVIS

SEQ ID NO: 19337 - protein, 9 aa, Homo Sapiens
LRRHCGEKP

SEQ ID NO: 19338 - protein, 9 aa, Homo Sapiens
TLLKLCKNA

SEQ ID NO: 19339 - protein, 9 aa, Homo Sapiens
QELKHRQRA

SEQ ID NO: 19340 - protein, 9 aa, Homo Sapiens
VSFESTGES

SEQ ID NO: 19341 - protein, 9 aa, Homo Sapiens
LPTSPGSLR

SEQ ID NO: 19342 - protein, 9 aa, Homo Sapiens
PLGTELAPR

SEQ ID NO: 19343 - protein, 9 aa, Homo Sapiens
AEKEGDEQK

SEQ ID NO: 19344 - protein, 9 aa, Homo Sapiens
VSYLFIMVA

SEQ ID NO: 19345 - protein, 9 aa, Homo Sapiens
VLHEQKTLP

SEQ ID NO: 19346 - protein, 9 aa, Homo Sapiens
SWPLCVMYA

SEQ ID NO: 19347 - protein, 9 aa, Homo Sapiens
LFICHKWLS

SEQ ID NO: 19348 - protein, 9 aa, Homo Sapiens
ENSFYTLPR

SEQ ID NO: 19349 - protein, 9 aa, Homo Sapiens
AAWRIYVTL

SEQ ID NO: 19350 - protein, 9 aa, Homo Sapiens
RDCGQGFTL

SEQ ID NO: 19351 - protein, 9 aa, Homo Sapiens
EEVPEITRT

SEQ ID NO: 19352 - protein, 9 aa, Homo Sapiens
VQRGLLAEV

SEQ ID NO: 19353 - protein, 9 aa, Homo Sapiens
SKEEELTAG

SEQ ID NO: 19354 - protein, 9 aa, Homo Sapiens
GSFGISVAT

SEQ ID NO: 19355 - protein, 9 aa, Homo Sapiens
YFFKDTLDL

SEQ ID NO: 19356 - protein, 9 aa, Homo Sapiens
RWLWIVPSG

SEQ ID NO: 19357 - protein, 9 aa, Homo Sapiens
GILGPPGVD

SEQ ID NO: 19358 - protein, 9 aa, Homo Sapiens
QLQHIFSAK

SEQ ID NO: 19359 - protein, 9 aa, Homo Sapiens
EEELLYELK

SEQ ID NO: 19360 - protein, 9 aa, Homo Sapiens
MVAIMGIPA

SEQ ID NO: 19361 - protein, 9 aa, Homo Sapiens
DFENAQPTD

SEQ ID NO: 19362 - protein, 9 aa, Homo Sapiens
REQVLCVFE

SEQ ID NO: 19363 - protein, 9 aa, Homo Sapiens
EQFCRLDEY

SEQ ID NO: 19364 - protein, 9 aa, Homo Sapiens
WEKQLQHIF

SEQ ID NO: 19365 - protein, 9 aa, Homo Sapiens
KNPLRVQPH

SEQ ID NO: 19366 - protein, 9 aa, Homo Sapiens
VPRSMHNST

SEQ ID NO: 19367 - protein, 9 aa, Homo Sapiens
ASTENSFYT

SEQ ID NO: 19368 - protein, 9 aa, Homo Sapiens
EIRNLNPVF

SEQ ID NO: 19369 - protein, 9 aa, Homo Sapiens
FLRKKILIA

SEQ ID NO: 19370 - protein, 9 aa, Homo Sapiens
EPRSDRSPS

SEQ ID NO: 19371 - protein, 9 aa, Homo Sapiens
TQFFFRTPT

SEQ ID NO: 19372 - protein, 9 aa, Homo Sapiens
VSLQKIVKM

SEQ ID NO: 19373 - protein, 9 aa, Homo Sapiens
DPLELLQER

SEQ ID NO: 19374 - protein, 9 aa, Homo Sapiens
YITNYHLYL

SEQ ID NO: 19375 - protein, 9 aa, Homo Sapiens
SADRFRMKR

SEQ ID NO: 19376 - protein, 9 aa, Homo Sapiens
IPMCKRNVM

SEQ ID NO: 19377 - protein, 9 aa, Homo Sapiens
FSAKSSRFL

SEQ ID NO: 19378 - protein, 9 aa, Homo Sapiens
FGVQAGDIQ

SEQ ID NO: 19379 - protein, 9 aa, Homo Sapiens
TFKDTMYLT

SEQ ID NO: 19380 - protein, 9 aa, Homo Sapiens
CGLGSCLPG

SEQ ID NO: 19381 - protein, 9 aa, Homo Sapiens
YIEELIKNY

SEQ ID NO: 19382 - protein, 9 aa, Homo Sapiens
QTDYTFPLA

SEQ ID NO: 19383 - protein, 9 aa, Homo Sapiens
LPDTQVLLD

SEQ ID NO: 19384 - protein, 9 aa, Homo Sapiens
IFQVLGAHR

SEQ ID NO: 19385 - protein, 9 aa, Homo Sapiens
RITILGSNF

SEQ ID NO: 19386 - protein, 9 aa, Homo Sapiens
FFKDTLDLT

SEQ ID NO: 19387 - protein, 9 aa, Homo Sapiens
LLGLTVLGA

SEQ ID NO: 19388 - protein, 9 aa, Homo Sapiens
PCQNLKAGR

SEQ ID NO: 19389 - protein, 9 aa, Homo Sapiens
DFACQRLKG

SEQ ID NO: 19390 - protein, 9 aa, Homo Sapiens
AEQFCRLDE

SEQ ID NO: 19391 - protein, 9 aa, Homo Sapiens
QHLRDRTCR

SEQ ID NO: 19392 - protein, 9 aa, Homo Sapiens
SGSSVTCLD

SEQ ID NO: 19393 - protein, 9 aa, Homo Sapiens
LIEKLMKEK

SEQ ID NO: 19394 - protein, 9 aa, Homo Sapiens
QRGDLEDLK

SEQ ID NO: 19395 - protein, 9 aa, Homo Sapiens
PLYCAASCN

SEQ ID NO: 19396 - protein, 9 aa, Homo Sapiens
RFVVRRRSF

SEQ ID NO: 19397 - protein, 9 aa, Homo Sapiens
AEEEGGREN

SEQ ID NO: 19398 - protein, 9 aa, Homo Sapiens
EPDAGAAPE

SEQ ID NO: 19399 - protein, 9 aa, Homo Sapiens
HDGQFAVIQ

SEQ ID NO: 19400 - protein, 9 aa, Homo Sapiens
DAAFFREHL

SEQ ID NO: 19401 - protein, 9 aa, Homo Sapiens
GIPMCKRNV

SEQ ID NO: 19402 - protein, 9 aa, Homo Sapiens
NPLRVQPHL

SEQ ID NO: 19403 - protein, 9 aa, Homo Sapiens
RPEIDCLCT

SEQ ID NO: 19404 - protein, 9 aa, Homo Sapiens
LQERPFLAW

SEQ ID NO: 19405 - protein, 9 aa, Homo Sapiens
QMLHGTGGL

SEQ ID NO: 19406 - protein, 9 aa, Homo Sapiens
VTSRDSECD

SEQ ID NO: 19407 - protein, 9 aa, Homo Sapiens
IIGFTRLAS

SEQ ID NO: 19408 - protein, 9 aa, Homo Sapiens
GPGAPAPLL

SEQ ID NO: 19409 - protein, 9 aa, Homo Sapiens
QTTKQGDPH

SEQ ID NO: 19410 - protein, 9 aa, Homo Sapiens
LMKEKRKMK

SEQ ID NO: 19411 - protein, 9 aa, Homo Sapiens
SAAQPQYFK

SEQ ID NO: 19412 - protein, 9 aa, Homo Sapiens
DACLCGSVL

SEQ ID NO: 19413 - protein, 9 aa, Homo Sapiens
SNKKKVEDA

SEQ ID NO: 19414 - protein, 9 aa, Homo Sapiens
PIKGGGGCL

SEQ ID NO: 19415 - protein, 9 aa, Homo Sapiens
CGHVVLALG

SEQ ID NO: 19416 - protein, 9 aa, Homo Sapiens
HQASLPDTQ

SEQ ID NO: 19417 - protein, 9 aa, Homo Sapiens
QVASPQIMQ

SEQ ID NO: 19418 - protein, 9 aa, Homo Sapiens
RSHSIFSVK

SEQ ID NO: 19419 - protein, 9 aa, Homo Sapiens
VKALHTEPQ

SEQ ID NO: 19420 - protein, 9 aa, Homo Sapiens
GSQNPGKPR

SEQ ID NO: 19421 - protein, 9 aa, Homo Sapiens
SLSEALYPV

SEQ ID NO: 19422 - protein, 9 aa, Homo Sapiens
FIMVAIMGI

SEQ ID NO: 19423 - protein, 9 aa, Homo Sapiens
QLGCIPMQD

SEQ ID NO: 19424 - protein, 9 aa, Homo Sapiens
LFDPDIQVL

SEQ ID NO: 19425 - protein, 9 aa, Homo Sapiens
LRNAPSKDT

SEQ ID NO: 19426 - protein, 9 aa, Homo Sapiens
GMYSAPREL

SEQ ID NO: 19427 - protein, 9 aa, Homo Sapiens
SKEEDMETE

SEQ ID NO: 19428 - protein, 9 aa, Homo Sapiens
DVDFSEDNP

SEQ ID NO: 19429 - protein, 9 aa, Homo Sapiens
IKLKELHLE

SEQ ID NO: 19430 - protein, 9 aa, Homo Sapiens
GLCNYPSSR

SEQ ID NO: 19431 - protein, 9 aa, Homo Sapiens
ILDAMNPDC

SEQ ID NO: 19432 - protein, 9 aa, Homo Sapiens
ETHKITVFY

SEQ ID NO: 19433 - protein, 9 aa, Homo Sapiens
CMLSHLTHH

SEQ ID NO: 19434 - protein, 9 aa, Homo Sapiens
AVKVQTTKQ

SEQ ID NO: 19435 - protein, 9 aa, Homo Sapiens
QVFDDKAKL

SEQ ID NO: 19436 - protein, 9 aa, Homo Sapiens
SMSQNYGLI

SEQ ID NO: 19437 - protein, 9 aa, Homo Sapiens
TKDEDITKT

SEQ ID NO: 19438 - protein, 9 aa, Homo Sapiens
TECSHAKGS

SEQ ID NO: 19439 - protein, 9 aa, Homo Sapiens
SESWTQPPP

SEQ ID NO: 19440 - protein, 9 aa, Homo Sapiens
SITVPRSMH

SEQ ID NO: 19441 - protein, 9 aa, Homo Sapiens
RNGIRTGFL

SEQ ID NO: 19442 - protein, 9 aa, Homo Sapiens
VPTNLAQQG

SEQ ID NO: 19443 - protein, 9 aa, Homo Sapiens
LVFGAGNCK

SEQ ID NO: 19444 - protein, 9 aa, Homo Sapiens
TNISSASTG

SEQ ID NO: 19445 - protein, 9 aa, Homo Sapiens
QLPKAEKEK

SEQ ID NO: 19446 - protein, 9 aa, Homo Sapiens
AQGRKKAFS

SEQ ID NO: 19447 - protein, 9 aa, Homo Sapiens
VLKELWKLI

SEQ ID NO: 19448 - protein, 9 aa, Homo Sapiens
EQVLCVFEE

SEQ ID NO: 19449 - protein, 9 aa, Homo Sapiens
LCNYPSSRA

SEQ ID NO: 19450 - protein, 9 aa, Homo Sapiens
YCVGMCADG

SEQ ID NO: 19451 - protein, 9 aa, Homo Sapiens
FDHMKVALD

SEQ ID NO: 19452 - protein, 9 aa, Homo Sapiens
RDLCAANIL

SEQ ID NO: 19453 - protein, 9 aa, Homo Sapiens
YDLLLVICH

SEQ ID NO: 19454 - protein, 9 aa, Homo Sapiens
GRKPALPSA

SEQ ID NO: 19455 - protein, 9 aa, Homo Sapiens
FQSSGICPV

SEQ ID NO: 19456 - protein, 9 aa, Homo Sapiens
MYSAPRELT

SEQ ID NO: 19457 - protein, 9 aa, Homo Sapiens
PALQETNYS

SEQ ID NO: 19458 - protein, 9 aa, Homo Sapiens
LPAQGMDIE

SEQ ID NO: 19459 - protein, 9 aa, Homo Sapiens
DALDVSSEA

SEQ ID NO: 19460 - protein, 9 aa, Homo Sapiens
MGHNVATGT

SEQ ID NO: 19461 - protein, 9 aa, Homo Sapiens
AWLRPEIDC

SEQ ID NO: 19462 - protein, 9 aa, Homo Sapiens
LEKKDLRDR

SEQ ID NO: 19463 - protein, 9 aa, Homo Sapiens
EPLAAKKEQ

SEQ ID NO: 19464 - protein, 9 aa, Homo Sapiens
NKSSEVSQS

SEQ ID NO: 19465 - protein, 9 aa, Homo Sapiens
FTSEKGVVK

SEQ ID NO: 19466 - protein, 9 aa, Homo Sapiens
RHCGEKPYI

SEQ ID NO: 19467 - protein, 9 aa, Homo Sapiens
KPHEKALTS

SEQ ID NO: 19468 - protein, 9 aa, Homo Sapiens
AHRSADAVY

SEQ ID NO: 19469 - protein, 9 aa, Homo Sapiens
AKLKKCFNK

SEQ ID NO: 19470 - protein, 9 aa, Homo Sapiens
EVDADLNPI

SEQ ID NO: 19471 - protein, 9 aa, Homo Sapiens
AFTALDVQK

SEQ ID NO: 19472 - protein, 9 aa, Homo Sapiens
SVATRDQDG

SEQ ID NO: 19473 - protein, 9 aa, Homo Sapiens
RSRFVVRRR

SEQ ID NO: 19474 - protein, 9 aa, Homo Sapiens
AAKKEQPGG

SEQ ID NO: 19475 - protein, 9 aa, Homo Sapiens
MYLDKIIRG

SEQ ID NO: 19476 - protein, 9 aa, Homo Sapiens
DLVVKLEKL

SEQ ID NO: 19477 - protein, 9 aa, Homo Sapiens
INWIIPDRF

SEQ ID NO: 19478 - protein, 9 aa, Homo Sapiens
ERDNAKLQE

SEQ ID NO: 19479 - protein, 9 aa, Homo Sapiens
FEACREMES

SEQ ID NO: 19480 - protein, 9 aa, Homo Sapiens
LHAPPATKI

SEQ ID NO: 19481 - protein, 9 aa, Homo Sapiens
LCDFSIPEE

SEQ ID NO: 19482 - protein, 9 aa, Homo Sapiens
EQKRKSARR

SEQ ID NO: 19483 - protein, 9 aa, Homo Sapiens
QYCVGMCAD

SEQ ID NO: 19484 - protein, 9 aa, Homo Sapiens
NSESWTQPP

SEQ ID NO: 19485 - protein, 9 aa, Homo Sapiens
TPGGGGGAA

SEQ ID NO: 19486 - protein, 9 aa, Homo Sapiens
PEKELPPLD

SEQ ID NO: 19487 - protein, 9 aa, Homo Sapiens
TGEEVPEIT

SEQ ID NO: 19488 - protein, 9 aa, Homo Sapiens
AAYDACLCG

SEQ ID NO: 19489 - protein, 9 aa, Homo Sapiens
RTRPLRSLR

SEQ ID NO: 19490 - protein, 9 aa, Homo Sapiens
QIAVRMLAH

SEQ ID NO: 19491 - protein, 9 aa, Homo Sapiens
MIFNMLKRL

SEQ ID NO: 19492 - protein, 9 aa, Homo Sapiens
SRNLRHIIF

SEQ ID NO: 19493 - protein, 9 aa, Homo Sapiens
TVTMPQIKA

SEQ ID NO: 19494 - protein, 9 aa, Homo Sapiens
IKIDIRLER

SEQ ID NO: 19495 - protein, 9 aa, Homo Sapiens
PVLCRDKME

SEQ ID NO: 19496 - protein, 9 aa, Homo Sapiens
NLAQQGHNS

SEQ ID NO: 19497 - protein, 9 aa, Homo Sapiens
DNTWISYSE

SEQ ID NO: 19498 - protein, 9 aa, Homo Sapiens
QFAVIQLVG

SEQ ID NO: 19499 - protein, 9 aa, Homo Sapiens
AEVNSGGLT

SEQ ID NO: 19500 - protein, 9 aa, Homo Sapiens
CLEDLLCIL

SEQ ID NO: 19501 - protein, 9 aa, Homo Sapiens
ELEVLLNMT

SEQ ID NO: 19502 - protein, 9 aa, Homo Sapiens
DVQKSGKVS

SEQ ID NO: 19503 - protein, 9 aa, Homo Sapiens
PGVDGVIGM

SEQ ID NO: 19504 - protein, 9 aa, Homo Sapiens
YHRTRPLRS

SEQ ID NO: 19505 - protein, 9 aa, Homo Sapiens
SAPAEVNSG

SEQ ID NO: 19506 - protein, 9 aa, Homo Sapiens
KVQTTKQGD

SEQ ID NO: 19507 - protein, 9 aa, Homo Sapiens
KGEQGLPEL

SEQ ID NO: 19508 - protein, 9 aa, Homo Sapiens
PTVTMPQIK

SEQ ID NO: 19509 - protein, 9 aa, Homo Sapiens
DYYAGKNAR

SEQ ID NO: 19510 - protein, 9 aa, Homo Sapiens
CLDGTRSRS

SEQ ID NO: 19511 - protein, 9 aa, Homo Sapiens
LVCQLEQGE

SEQ ID NO: 19512 - protein, 9 aa, Homo Sapiens
DSHQEEAQY

SEQ ID NO: 19513 - protein, 9 aa, Homo Sapiens
HFFLLAAFT

SEQ ID NO: 19514 - protein, 9 aa, Homo Sapiens
PPFTALSLS

SEQ ID NO: 19515 - protein, 9 aa, Homo Sapiens
KDEDITKTF

SEQ ID NO: 19516 - protein, 9 aa, Homo Sapiens
APLLFLNKQ

SEQ ID NO: 19517 - protein, 9 aa, Homo Sapiens
GSLGNMGKA

SEQ ID NO: 19518 - protein, 9 aa, Homo Sapiens
NMSYRKKSP

SEQ ID NO: 19519 - protein, 9 aa, Homo Sapiens
ALRGRKPAL

SEQ ID NO: 19520 - protein, 9 aa, Homo Sapiens
GLLLYNSAA

SEQ ID NO: 19521 - protein, 9 aa, Homo Sapiens
ALAKSDEHL

SEQ ID NO: 19522 - protein, 9 aa, Homo Sapiens
YDPSIGMYG

SEQ ID NO: 19523 - protein, 9 aa, Homo Sapiens
RKKILIAIA

SEQ ID NO: 19524 - protein, 9 aa, Homo Sapiens
LVEAHKINN

SEQ ID NO: 19525 - protein, 9 aa, Homo Sapiens
FGISVATPG

SEQ ID NO: 19526 - protein, 9 aa, Homo Sapiens
GWESHMVEG

SEQ ID NO: 19527 - protein, 9 aa, Homo Sapiens
ILYADIIGF

SEQ ID NO: 19528 - protein, 9 aa, Homo Sapiens
YVQGKSPVN

SEQ ID NO: 19529 - protein, 9 aa, Homo Sapiens
LLSSRNMSY

SEQ ID NO: 19530 - protein, 9 aa, Homo Sapiens
SHQEEAQYG

SEQ ID NO: 19531 - protein, 9 aa, Homo Sapiens
PDQPEGPHT

SEQ ID NO: 19532 - protein, 9 aa, Homo Sapiens
LFIMVAIMG

SEQ ID NO: 19533 - protein, 9 aa, Homo Sapiens
SDAQQSTSG

SEQ ID NO: 19534 - protein, 9 aa, Homo Sapiens
PDTESGYTE

SEQ ID NO: 19535 - protein, 9 aa, Homo Sapiens
ETKNPLRVQ

SEQ ID NO: 19536 - protein, 9 aa, Homo Sapiens
MREEPQPQK

SEQ ID NO: 19537 - protein, 9 aa, Homo Sapiens
RAEVRCRAC

SEQ ID NO: 19538 - protein, 9 aa, Homo Sapiens
RFRMKRRMQ

SEQ ID NO: 19539 - protein, 9 aa, Homo Sapiens
HKCLQLLKA

SEQ ID NO: 19540 - protein, 9 aa, Homo Sapiens
DLEDLKEHL

SEQ ID NO: 19541 - protein, 9 aa, Homo Sapiens
FLRLYLGTV

SEQ ID NO: 19542 - protein, 9 aa, Homo Sapiens
KNLENRALQ

SEQ ID NO: 19543 - protein, 9 aa, Homo Sapiens
LDVSSEATL

SEQ ID NO: 19544 - protein, 9 aa, Homo Sapiens
HSWLSWPLC

SEQ ID NO: 19545 - protein, 9 aa, Homo Sapiens
DINWIIPDR

SEQ ID NO: 19546 - protein, 9 aa, Homo Sapiens
GSDAQQSTS

SEQ ID NO: 19547 - protein, 9 aa, Homo Sapiens
IGFTRLASD

SEQ ID NO: 19548 - protein, 9 aa, Homo Sapiens
QCCDCRKPA

SEQ ID NO: 19549 - protein, 9 aa, Homo Sapiens
SRKLLEAVE

SEQ ID NO: 19550 - protein, 9 aa, Homo Sapiens
VFALVNSTV

SEQ ID NO: 19551 - protein, 9 aa, Homo Sapiens
QPAGTFYQE

SEQ ID NO: 19552 - protein, 9 aa, Homo Sapiens
TRSREQVLC

SEQ ID NO: 19553 - protein, 9 aa, Homo Sapiens
PEYLAEYSA

SEQ ID NO: 19554 - protein, 9 aa, Homo Sapiens
EDLKEHLPG

SEQ ID NO: 19555 - protein, 9 aa, Homo Sapiens
PTGVPVLSG

SEQ ID NO: 19556 - protein, 9 aa, Homo Sapiens
AYLRMHAVK

SEQ ID NO: 19557 - protein, 9 aa, Homo Sapiens
QNLDNLGVP

SEQ ID NO: 19558 - protein, 9 aa, Homo Sapiens
VHVLQNSIH

SEQ ID NO: 19559 - protein, 9 aa, Homo Sapiens
AQTTAPAAL

SEQ ID NO: 19560 - protein, 9 aa, Homo Sapiens
MRLCSAKAP

SEQ ID NO: 19561 - protein, 9 aa, Homo Sapiens
LLLYNSAAA

SEQ ID NO: 19562 - protein, 9 aa, Homo Sapiens
TLVFALVNS

SEQ ID NO: 19563 - protein, 9 aa, Homo Sapiens
GKGEQGLPE

SEQ ID NO: 19564 - protein, 9 aa, Homo Sapiens
NEPRSDRSP

SEQ ID NO: 19565 - protein, 9 aa, Homo Sapiens
GQGFTLKPN

SEQ ID NO: 19566 - protein, 9 aa, Homo Sapiens
EVSFESTGE

SEQ ID NO: 19567 - protein, 9 aa, Homo Sapiens
TSINVLCVR

SEQ ID NO: 19568 - protein, 9 aa, Homo Sapiens
NSAHGYSWK

SEQ ID NO: 19569 - protein, 9 aa, Homo Sapiens
ESHRPPEHQ

SEQ ID NO: 19570 - protein, 9 aa, Homo Sapiens
YIPYQPKDF

SEQ ID NO: 19571 - protein, 9 aa, Homo Sapiens
EGTIIGAVT

SEQ ID NO: 19572 - protein, 9 aa, Homo Sapiens
VFHDRLINF

SEQ ID NO: 19573 - protein, 9 aa, Homo Sapiens
FSEDNPLEA

SEQ ID NO: 19574 - protein, 9 aa, Homo Sapiens
TFLDVSLSE

SEQ ID NO: 19575 - protein, 9 aa, Homo Sapiens
LRPEIDCLC

SEQ ID NO: 19576 - protein, 9 aa, Homo Sapiens
MSLVGYVLR

SEQ ID NO: 19577 - protein, 9 aa, Homo Sapiens
QGLPELPGP

SEQ ID NO: 19578 - protein, 9 aa, Homo Sapiens
QECFSRSRE

SEQ ID NO: 19579 - protein, 9 aa, Homo Sapiens
AEELLDRLT

SEQ ID NO: 19580 - protein, 9 aa, Homo Sapiens
CVRASLIEK

SEQ ID NO: 19581 - protein, 9 aa, Homo Sapiens
DCKAGSYRQ

SEQ ID NO: 19582 - protein, 9 aa, Homo Sapiens
CAANILVGE

SEQ ID NO: 19583 - protein, 9 aa, Homo Sapiens
PKNQLFLFY

SEQ ID NO: 19584 - protein, 9 aa, Homo Sapiens
ESHDKEEDK

SEQ ID NO: 19585 - protein, 9 aa, Homo Sapiens
MKTVMAVLG

SEQ ID NO: 19586 - protein, 9 aa, Homo Sapiens
TTPVLVCQL

SEQ ID NO: 19587 - protein, 9 aa, Homo Sapiens
YVSEAPINY

SEQ ID NO: 19588 - protein, 9 aa, Homo Sapiens
KAGRFHCQC

SEQ ID NO: 19589 - protein, 9 aa, Homo Sapiens
IMQRTSADR

SEQ ID NO: 19590 - protein, 9 aa, Homo Sapiens
KSSVFKAID

SEQ ID NO: 19591 - protein, 9 aa, Homo Sapiens
YPLTIQNIN

SEQ ID NO: 19592 - protein, 9 aa, Homo Sapiens
YAGKNARSI

SEQ ID NO: 19593 - protein, 9 aa, Homo Sapiens
KLCKNAGMN

SEQ ID NO: 19594 - protein, 9 aa, Homo Sapiens
GSQPYFQSF

SEQ ID NO: 19595 - protein, 9 aa, Homo Sapiens
EHLSELAEE

SEQ ID NO: 19596 - protein, 9 aa, Homo Sapiens
GTYTVAVAK

SEQ ID NO: 19597 - protein, 9 aa, Homo Sapiens
LNNILLTYC

SEQ ID NO: 19598 - protein, 9 aa, Homo Sapiens
YVISYTGEE

SEQ ID NO: 19599 - protein, 9 aa, Homo Sapiens
SSARSGLCG

SEQ ID NO: 19600 - protein, 9 aa, Homo Sapiens
TGVPVLSGD

SEQ ID NO: 19601 - protein, 9 aa, Homo Sapiens
VDRVSDTPS

SEQ ID NO: 19602 - protein, 9 aa, Homo Sapiens
LRREQHAQQ

SEQ ID NO: 19603 - protein, 9 aa, Homo Sapiens
MSAHVQWMV

SEQ ID NO: 19604 - protein, 9 aa, Homo Sapiens
NGTVTPSAF

SEQ ID NO: 19605 - protein, 9 aa, Homo Sapiens
NAHRSADAV

SEQ ID NO: 19606 - protein, 9 aa, Homo Sapiens
GAPKPHEKA

SEQ ID NO: 19607 - protein, 9 aa, Homo Sapiens
AQCCDCRKP

SEQ ID NO: 19608 - protein, 9 aa, Homo Sapiens
LVETPLSIQ

SEQ ID NO: 19609 - protein, 9 aa, Homo Sapiens
ACLDWQSLG

SEQ ID NO: 19610 - protein, 9 aa, Homo Sapiens
GICPVLEFS

SEQ ID NO: 19611 - protein, 9 aa, Homo Sapiens
EDILSMFLA

SEQ ID NO: 19612 - protein, 9 aa, Homo Sapiens
TTAAYLRMH

SEQ ID NO: 19613 - protein, 9 aa, Homo Sapiens
LPVTNISSA

SEQ ID NO: 19614 - protein, 9 aa, Homo Sapiens
LNSVPTNLA

SEQ ID NO: 19615 - protein, 9 aa, Homo Sapiens
ILSVTSRDS

SEQ ID NO: 19616 - protein, 9 aa, Homo Sapiens
APDIWRIVS

SEQ ID NO: 19617 - protein, 9 aa, Homo Sapiens
GGYYLDLSG

SEQ ID NO: 19618 - protein, 9 aa, Homo Sapiens
LFQNTRARE

SEQ ID NO: 19619 - protein, 9 aa, Homo Sapiens
ELQHQERHL

SEQ ID NO: 19620 - protein, 9 aa, Homo Sapiens
LSRSIDAAF

SEQ ID NO: 19621 - protein, 9 aa, Homo Sapiens
ILLGLTVLG

SEQ ID NO: 19622 - protein, 9 aa, Homo Sapiens
QGMVFDLVT

SEQ ID NO: 19623 - protein, 9 aa, Homo Sapiens
FSEPEYLAE

SEQ ID NO: 19624 - protein, 9 aa, Homo Sapiens
TYHRTRPLR

SEQ ID NO: 19625 - protein, 9 aa, Homo Sapiens
AGETRGAPK

SEQ ID NO: 19626 - protein, 9 aa, Homo Sapiens
RVHNEFDQR

SEQ ID NO: 19627 - protein, 9 aa, Homo Sapiens
LLIFLRKKI

SEQ ID NO: 19628 - protein, 9 aa, Homo Sapiens
LYLGTVLGN

SEQ ID NO: 19629 - protein, 9 aa, Homo Sapiens
IAIDNYDSS

SEQ ID NO: 19630 - protein, 9 aa, Homo Sapiens
GVVKEWLSE

SEQ ID NO: 19631 - protein, 9 aa, Homo Sapiens
PVTNISSAS

SEQ ID NO: 19632 - protein, 9 aa, Homo Sapiens
CRPNNVTCV

SEQ ID NO: 19633 - protein, 9 aa, Homo Sapiens
FLLAAFTWM

SEQ ID NO: 19634 - protein, 9 aa, Homo Sapiens
KVLLVETPL

SEQ ID NO: 19635 - protein, 9 aa, Homo Sapiens
LWKLIMNTM

SEQ ID NO: 19636 - protein, 9 aa, Homo Sapiens
LGSLGNMGK

SEQ ID NO: 19637 - protein, 9 aa, Homo Sapiens
EKQRQKMEL

SEQ ID NO: 19638 - protein, 9 aa, Homo Sapiens
KITSTQGKH

SEQ ID NO: 19639 - protein, 9 aa, Homo Sapiens
DYLRKMNKY

SEQ ID NO: 19640 - protein, 9 aa, Homo Sapiens
IMHKDIQLA

SEQ ID NO: 19641 - protein, 9 aa, Homo Sapiens
QVNTLRVKS

SEQ ID NO: 19642 - protein, 9 aa, Homo Sapiens
MVEGQVKEQ

SEQ ID NO: 19643 - protein, 9 aa, Homo Sapiens
LIALDCCVC

SEQ ID NO: 19644 - protein, 9 aa, Homo Sapiens
DGQFAVIQL

SEQ ID NO: 19645 - protein, 9 aa, Homo Sapiens
GMKIIHISD

SEQ ID NO: 19646 - protein, 9 aa, Homo Sapiens
EQKRGAEEE

SEQ ID NO: 19647 - protein, 9 aa, Homo Sapiens
ADRFRMKRR

SEQ ID NO: 19648 - protein, 9 aa, Homo Sapiens
FQNMSWIRG

SEQ ID NO: 19649 - protein, 9 aa, Homo Sapiens
PLTLCPLGT

SEQ ID NO: 19650 - protein, 9 aa, Homo Sapiens
HVRVCIPLS

SEQ ID NO: 19651 - protein, 9 aa, Homo Sapiens
FSVLWDFQG

SEQ ID NO: 19652 - protein, 9 aa, Homo Sapiens
PSEIAIDNY

SEQ ID NO: 19653 - protein, 9 aa, Homo Sapiens
RYTHKLCLL

SEQ ID NO: 19654 - protein, 9 aa, Homo Sapiens
MQDFALTQD

SEQ ID NO: 19655 - protein, 9 aa, Homo Sapiens
PPGLQPEPR

SEQ ID NO: 19656 - protein, 9 aa, Homo Sapiens
LQFQKACRV

SEQ ID NO: 19657 - protein, 9 aa, Homo Sapiens
QMQRQAEKE

SEQ ID NO: 19658 - protein, 9 aa, Homo Sapiens
LSPSEYVQG

SEQ ID NO: 19659 - protein, 9 aa, Homo Sapiens
SILYADIIG

SEQ ID NO: 19660 - protein, 9 aa, Homo Sapiens
HSYFFKDTL

SEQ ID NO: 19661 - protein, 9 aa, Homo Sapiens
LLAKYAAAT

SEQ ID NO: 19662 - protein, 9 aa, Homo Sapiens
KAEKDLTVL

SEQ ID NO: 19663 - protein, 9 aa, Homo Sapiens
IQICKIVIR

SEQ ID NO: 19664 - protein, 9 aa, Homo Sapiens
VTGGNLVSM

SEQ ID NO: 19665 - protein, 9 aa, Homo Sapiens
EVNSGGLTY

SEQ ID NO: 19666 - protein, 9 aa, Homo Sapiens
RSGKSPSPL

SEQ ID NO: 19667 - protein, 9 aa, Homo Sapiens
PVLSGDATF

SEQ ID NO: 19668 - protein, 9 aa, Homo Sapiens
QSSGICPVL

SEQ ID NO: 19669 - protein, 9 aa, Homo Sapiens
TDEVLSLEK

SEQ ID NO: 19670 - protein, 9 aa, Homo Sapiens
FVHTRQARS

SEQ ID NO: 19671 - protein, 9 aa, Homo Sapiens
LGFQNMSWI

SEQ ID NO: 19672 - protein, 9 aa, Homo Sapiens
ILSETKNPL

SEQ ID NO: 19673 - protein, 9 aa, Homo Sapiens
ALHRNRKMA

SEQ ID NO: 19674 - protein, 9 aa, Homo Sapiens
IVFEDFACQ

SEQ ID NO: 19675 - protein, 9 aa, Homo Sapiens
LDLGGGGLC

SEQ ID NO: 19676 - protein, 9 aa, Homo Sapiens
GESKTIASE

SEQ ID NO: 19677 - protein, 9 aa, Homo Sapiens
SPSEYVQGK

SEQ ID NO: 19678 - protein, 9 aa, Homo Sapiens
GADHPQHLR

SEQ ID NO: 19679 - protein, 9 aa, Homo Sapiens
QVKKQIQLK

SEQ ID NO: 19680 - protein, 9 aa, Homo Sapiens
IWFIQLTGQ

SEQ ID NO: 19681 - protein, 9 aa, Homo Sapiens
AKGKTFGTF

SEQ ID NO: 19682 - protein, 9 aa, Homo Sapiens
RRSLEAKDI

SEQ ID NO: 19683 - protein, 9 aa, Homo Sapiens
MCKRNVMIL

SEQ ID NO: 19684 - protein, 9 aa, Homo Sapiens
ILHTAEKPY

SEQ ID NO: 19685 - protein, 9 aa, Homo Sapiens
AGLIKLKEL

SEQ ID NO: 19686 - protein, 9 aa, Homo Sapiens
WGAVFPSKR

SEQ ID NO: 19687 - protein, 9 aa, Homo Sapiens
IVPSGLAPA

SEQ ID NO: 19688 - protein, 9 aa, Homo Sapiens
GYYLDLSGS

SEQ ID NO: 19689 - protein, 9 aa, Homo Sapiens
QEFYIPYQP

SEQ ID NO: 19690 - protein, 9 aa, Homo Sapiens
TDTSLQNDY

SEQ ID NO: 19691 - protein, 9 aa, Homo Sapiens
LTHHKRIQT

SEQ ID NO: 19692 - protein, 9 aa, Homo Sapiens
QFSFNTSAA

SEQ ID NO: 19693 - protein, 9 aa, Homo Sapiens
LVICHHGTA

SEQ ID NO: 19694 - protein, 9 aa, Homo Sapiens
LEVLLNMTK

SEQ ID NO: 19695 - protein, 9 aa, Homo Sapiens
SGTSVSKNR

SEQ ID NO: 19696 - protein, 9 aa, Homo Sapiens
ELLDRLTSH

SEQ ID NO: 19697 - protein, 9 aa, Homo Sapiens
GSPAAAAID

SEQ ID NO: 19698 - protein, 9 aa, Homo Sapiens
HIFSAKSSR

SEQ ID NO: 19699 - protein, 9 aa, Homo Sapiens
DLVTRQVFD

SEQ ID NO: 19700 - protein, 9 aa, Homo Sapiens
IKEILGASK

SEQ ID NO: 19701 - protein, 9 aa, Homo Sapiens
DGALRVLYG

SEQ ID NO: 19702 - protein, 9 aa, Homo Sapiens
QERHLAKEQ

SEQ ID NO: 19703 - protein, 9 aa, Homo Sapiens
LYELKLNRK

SEQ ID NO: 19704 - protein, 9 aa, Homo Sapiens
PQVVKECRA

SEQ ID NO: 19705 - protein, 9 aa, Homo Sapiens
EACREMESL

SEQ ID NO: 19706 - protein, 9 aa, Homo Sapiens
LLLTGGCPL

SEQ ID NO: 19707 - protein, 9 aa, Homo Sapiens
QGRKKAFST

SEQ ID NO: 19708 - protein, 9 aa, Homo Sapiens
KRKMKRNQV

SEQ ID NO: 19709 - protein, 9 aa, Homo Sapiens
KLIMNTMEK

SEQ ID NO: 19710 - protein, 9 aa, Homo Sapiens
GGGGLCLMS

SEQ ID NO: 19711 - protein, 9 aa, Homo Sapiens
VKYEQNSLI

SEQ ID NO: 19712 - protein, 9 aa, Homo Sapiens
NSGGLTYIT

SEQ ID NO: 19713 - protein, 9 aa, Homo Sapiens
ILEKMYLDK

SEQ ID NO: 19714 - protein, 9 aa, Homo Sapiens
SIFSVKILQ

SEQ ID NO: 19715 - protein, 9 aa, Homo Sapiens
GLTEFFLLA

SEQ ID NO: 19716 - protein, 9 aa, Homo Sapiens
GGGGGAAVP

SEQ ID NO: 19717 - protein, 9 aa, Homo Sapiens
KITVFYIAE

SEQ ID NO: 19718 - protein, 9 aa, Homo Sapiens
QRWLWIVPS

SEQ ID NO: 19719 - protein, 9 aa, Homo Sapiens
FRTPTYNLK

SEQ ID NO: 19720 - protein, 9 aa, Homo Sapiens
SINVLCVRA

SEQ ID NO: 19721 - protein, 9 aa, Homo Sapiens
RFNGNSTGN

SEQ ID NO: 19722 - protein, 9 aa, Homo Sapiens
KDTLDLTYE

SEQ ID NO: 19723 - protein, 9 aa, Homo Sapiens
KRNQVASPQ

SEQ ID NO: 19724 - protein, 9 aa, Homo Sapiens
ARHDSPDSS

SEQ ID NO: 19725 - protein, 9 aa, Homo Sapiens
IVRESDNTW

SEQ ID NO: 19726 - protein, 9 aa, Homo Sapiens
IVIRHAHQI

SEQ ID NO: 19727 - protein, 9 aa, Homo Sapiens
EAAYDACLC

SEQ ID NO: 19728 - protein, 9 aa, Homo Sapiens
DPDLGSLGN

SEQ ID NO: 19729 - protein, 9 aa, Homo Sapiens
HMKVALDKV

SEQ ID NO: 19730 - protein, 9 aa, Homo Sapiens
APCQNLKAG

SEQ ID NO: 19731 - protein, 9 aa, Homo Sapiens
PEKITLFEA

SEQ ID NO: 19732 - protein, 9 aa, Homo Sapiens
IRESSQRGF

SEQ ID NO: 19733 - protein, 9 aa, Homo Sapiens
PVGQSNFLI

SEQ ID NO: 19734 - protein, 9 aa, Homo Sapiens
EKAENGDIN

SEQ ID NO: 19735 - protein, 9 aa, Homo Sapiens
FNGNECGAK

SEQ ID NO: 19736 - protein, 9 aa, Homo Sapiens
GGGLCLMSV

SEQ ID NO: 19737 - protein, 9 aa, Homo Sapiens
LIFGYRGTD

SEQ ID NO: 19738 - protein, 9 aa, Homo Sapiens
VCIKDGCGL

SEQ ID NO: 19739 - protein, 9 aa, Homo Sapiens
AFTKRHKFE

SEQ ID NO: 19740 - protein, 9 aa, Homo Sapiens
EIKDSVSVA

SEQ ID NO: 19741 - protein, 9 aa, Homo Sapiens
SSEEVSLQK

SEQ ID NO: 19742 - protein, 9 aa, Homo Sapiens
CGDCSDELG

SEQ ID NO: 19743 - protein, 9 aa, Homo Sapiens
TWISYSENI

SEQ ID NO: 19744 - protein, 9 aa, Homo Sapiens
TGGNLVSML

SEQ ID NO: 19745 - protein, 9 aa, Homo Sapiens
SEPEYLAEY

SEQ ID NO: 19746 - protein, 9 aa, Homo Sapiens
QAGAVPLLC

SEQ ID NO: 19747 - protein, 9 aa, Homo Sapiens
VLQSSEEVS

SEQ ID NO: 19748 - protein, 9 aa, Homo Sapiens
SFYTLPRLK

SEQ ID NO: 19749 - protein, 9 aa, Homo Sapiens
VEIKDSVSV

SEQ ID NO: 19750 - protein, 9 aa, Homo Sapiens
VSSEATLGL

SEQ ID NO: 19751 - protein, 9 aa, Homo Sapiens
AALLHFFLL

SEQ ID NO: 19752 - protein, 9 aa, Homo Sapiens
KHLCPNVPI

SEQ ID NO: 19753 - protein, 9 aa, Homo Sapiens
EIVRESDNT

SEQ ID NO: 19754 - protein, 9 aa, Homo Sapiens
KLMKTVMAV

SEQ ID NO: 19755 - protein, 9 aa, Homo Sapiens
VFGAGNCKP

SEQ ID NO: 19756 - protein, 9 aa, Homo Sapiens
EVRCRACGA

SEQ ID NO: 19757 - protein, 9 aa, Homo Sapiens
SFNTSAAQP

SEQ ID NO: 19758 - protein, 9 aa, Homo Sapiens
GGNCLEDLL

SEQ ID NO: 19759 - protein, 9 aa, Homo Sapiens
SADMLSQAI

SEQ ID NO: 19760 - protein, 9 aa, Homo Sapiens
KEWLSEFKT

SEQ ID NO: 19761 - protein, 9 aa, Homo Sapiens
GLLAEVAGL

SEQ ID NO: 19762 - protein, 9 aa, Homo Sapiens
KQLQHIFSA

SEQ ID NO: 19763 - protein, 9 aa, Homo Sapiens
GRVHNEFDQ

SEQ ID NO: 19764 - protein, 9 aa, Homo Sapiens
RMQNLDNLG

SEQ ID NO: 19765 - protein, 9 aa, Homo Sapiens
DIVFEDFAC

SEQ ID NO: 19766 - protein, 9 aa, Homo Sapiens
YTLDVLERC

SEQ ID NO: 19767 - protein, 9 aa, Homo Sapiens
SGYTEQLFQ

SEQ ID NO: 19768 - protein, 9 aa, Homo Sapiens
VDITLLGFQ

SEQ ID NO: 19769 - protein, 9 aa, Homo Sapiens
WKNTSWGAV

SEQ ID NO: 19770 - protein, 9 aa, Homo Sapiens
MAYYINHPV

SEQ ID NO: 19771 - protein, 9 aa, Homo Sapiens
VEDALSLIH

SEQ ID NO: 19772 - protein, 9 aa, Homo Sapiens
LSSRNMSYR

SEQ ID NO: 19773 - protein, 9 aa, Homo Sapiens
VEAHKINNR

SEQ ID NO: 19774 - protein, 9 aa, Homo Sapiens
NPIKGGGGC

SEQ ID NO: 19775 - protein, 9 aa, Homo Sapiens
LKITSTSLL

SEQ ID NO: 19776 - protein, 9 aa, Homo Sapiens
QHAQQWVEV

SEQ ID NO: 19777 - protein, 9 aa, Homo Sapiens
GEDLQWWPH

SEQ ID NO: 19778 - protein, 9 aa, Homo Sapiens
RMHAVKDHG

SEQ ID NO: 19779 - protein, 9 aa, Homo Sapiens
ILQDFNEAQ

SEQ ID NO: 19780 - protein, 9 aa, Homo Sapiens
LQYCVGMCA

SEQ ID NO: 19781 - protein, 9 aa, Homo Sapiens
VFMLDGSYS

SEQ ID NO: 19782 - protein, 9 aa, Homo Sapiens
LDRESVFAY

SEQ ID NO: 19783 - protein, 9 aa, Homo Sapiens
PDIQVLKDL

SEQ ID NO: 19784 - protein, 9 aa, Homo Sapiens
VQVLFQNTR

SEQ ID NO: 19785 - protein, 9 aa, Homo Sapiens
PTNLAQQGH

SEQ ID NO: 19786 - protein, 9 aa, Homo Sapiens
LSSPDCAVG

SEQ ID NO: 19787 - protein, 9 aa, Homo Sapiens
RAPEKELPP

SEQ ID NO: 19788 - protein, 9 aa, Homo Sapiens
TEKQKSVGQ

SEQ ID NO: 19789 - protein, 9 aa, Homo Sapiens
RCPHRPILQ

SEQ ID NO: 19790 - protein, 9 aa, Homo Sapiens
GTFYQEQQA

SEQ ID NO: 19791 - protein, 9 aa, Homo Sapiens
MYLTQVMQA

SEQ ID NO: 19792 - protein, 9 aa, Homo Sapiens
NIKRLEQEI

SEQ ID NO: 19793 - protein, 9 aa, Homo Sapiens
SQQDLESHM

SEQ ID NO: 19794 - protein, 9 aa, Homo Sapiens
YEKAENGDI

SEQ ID NO: 19795 - protein, 9 aa, Homo Sapiens
SWGAVFPSK

SEQ ID NO: 19796 - protein, 9 aa, Homo Sapiens
GGGYYLDLS

SEQ ID NO: 19797 - protein, 9 aa, Homo Sapiens
VNDVNENPP

SEQ ID NO: 19798 - protein, 9 aa, Homo Sapiens
QKIIYEEAL

SEQ ID NO: 19799 - protein, 9 aa, Homo Sapiens
QGMDIEEVE

SEQ ID NO: 19800 - protein, 9 aa, Homo Sapiens
LENRALQPS

SEQ ID NO: 19801 - protein, 9 aa, Homo Sapiens
QFCRLDEYN

SEQ ID NO: 19802 - protein, 9 aa, Homo Sapiens
AWLFRKAHE

SEQ ID NO: 19803 - protein, 9 aa, Homo Sapiens
DSAIKAQTV

SEQ ID NO: 19804 - protein, 9 aa, Homo Sapiens
PMQDFALTQ

SEQ ID NO: 19805 - protein, 9 aa, Homo Sapiens
TASGSSVTC

SEQ ID NO: 19806 - protein, 9 aa, Homo Sapiens
FSVRGNEPR

SEQ ID NO: 19807 - protein, 9 aa, Homo Sapiens
SGLSADMLS

SEQ ID NO: 19808 - protein, 9 aa, Homo Sapiens
AQQYSLLAK

SEQ ID NO: 19809 - protein, 9 aa, Homo Sapiens
HKDGTKFIC

SEQ ID NO: 19810 - protein, 9 aa, Homo Sapiens
KELPPLDPE

SEQ ID NO: 19811 - protein, 9 aa, Homo Sapiens
VATVAMEPG

SEQ ID NO: 19812 - protein, 9 aa, Homo Sapiens
DIQVLKDLF

SEQ ID NO: 19813 - protein, 9 aa, Homo Sapiens
TSLLCSRLC

SEQ ID NO: 19814 - protein, 9 aa, Homo Sapiens
IPMRKKERN

SEQ ID NO: 19815 - protein, 9 aa, Homo Sapiens
FFIFLGLTE

SEQ ID NO: 19816 - protein, 9 aa, Homo Sapiens
TSETEQDIR

SEQ ID NO: 19817 - protein, 9 aa, Homo Sapiens
PWDSNELVP

SEQ ID NO: 19818 - protein, 9 aa, Homo Sapiens
VYEDTPEGT

SEQ ID NO: 19819 - protein, 9 aa, Homo Sapiens
QGYSSPGIQ

SEQ ID NO: 19820 - protein, 9 aa, Homo Sapiens
YEDSHQEEA

SEQ ID NO: 19821 - protein, 9 aa, Homo Sapiens
LLDRLTSHS

SEQ ID NO: 19822 - protein, 9 aa, Homo Sapiens
PCFEASECK

SEQ ID NO: 19823 - protein, 9 aa, Homo Sapiens
QTHLRRHCG

SEQ ID NO: 19824 - protein, 9 aa, Homo Sapiens
VLNRKRHEL

SEQ ID NO: 19825 - protein, 9 aa, Homo Sapiens
SLPELEDRL

SEQ ID NO: 19826 - protein, 9 aa, Homo Sapiens
LIAFTKRHK

SEQ ID NO: 19827 - protein, 9 aa, Homo Sapiens
DCSDELGCN

SEQ ID NO: 19828 - protein, 9 aa, Homo Sapiens
HKDIQLARR

SEQ ID NO: 19829 - protein, 9 aa, Homo Sapiens
ICPVLEFSK

SEQ ID NO: 19830 - protein, 9 aa, Homo Sapiens
PPDQPEGPH

SEQ ID NO: 19831 - protein, 9 aa, Homo Sapiens
RESHDKEED

SEQ ID NO: 19832 - protein, 9 aa, Homo Sapiens
SIIWFIQLT

SEQ ID NO: 19833 - protein, 9 aa, Homo Sapiens
QETNYSIYL

SEQ ID NO: 19834 - protein, 9 aa, Homo Sapiens
HLYLRSLET

SEQ ID NO: 19835 - protein, 9 aa, Homo Sapiens
VVKSVQRGL

SEQ ID NO: 19836 - protein, 9 aa, Homo Sapiens
SCRPNNVTC

SEQ ID NO: 19837 - protein, 9 aa, Homo Sapiens
RVCIPLSIL

SEQ ID NO: 19838 - protein, 9 aa, Homo Sapiens
KDSEQLTFS

SEQ ID NO: 19839 - protein, 9 aa, Homo Sapiens
AESQVNTLR

SEQ ID NO: 19840 - protein, 9 aa, Homo Sapiens
QGQLPDTES

SEQ ID NO: 19841 - protein, 9 aa, Homo Sapiens
SVSVATRDQ

SEQ ID NO: 19842 - protein, 9 aa, Homo Sapiens
YADIIGFTR

SEQ ID NO: 19843 - protein, 9 aa, Homo Sapiens
ESHMRELIY

SEQ ID NO: 19844 - protein, 9 aa, Homo Sapiens
NSRVLFNLL

SEQ ID NO: 19845 - protein, 9 aa, Homo Sapiens
KQIQLKSRG

SEQ ID NO: 19846 - protein, 9 aa, Homo Sapiens
LGTVLGNLL

SEQ ID NO: 19847 - protein, 9 aa, Homo Sapiens
LSDVVDRVS

SEQ ID NO: 19848 - protein, 9 aa, Homo Sapiens
PSCPRLSRK

SEQ ID NO: 19849 - protein, 9 aa, Homo Sapiens
QASLPDTQV

SEQ ID NO: 19850 - protein, 9 aa, Homo Sapiens
PGADHPQHL

SEQ ID NO: 19851 - protein, 9 aa, Homo Sapiens
KDEDKPPHR

SEQ ID NO: 19852 - protein, 9 aa, Homo Sapiens
FIFLGLTEF

SEQ ID NO: 19853 - protein, 9 aa, Homo Sapiens
NAQPTDSEK

SEQ ID NO: 19854 - protein, 9 aa, Homo Sapiens
EVLDQDGTY

SEQ ID NO: 19855 - protein, 9 aa, Homo Sapiens
FKDTLDLTY

SEQ ID NO: 19856 - protein, 9 aa, Homo Sapiens
EYVQGKSPV

SEQ ID NO: 19857 - protein, 9 aa, Homo Sapiens
NGLEAWWEV

SEQ ID NO: 19858 - protein, 9 aa, Homo Sapiens
PDYYNTLLQ

SEQ ID NO: 19859 - protein, 9 aa, Homo Sapiens
KPFNQRLIV

SEQ ID NO: 19860 - protein, 9 aa, Homo Sapiens
GTPGGGGGA

SEQ ID NO: 19861 - protein, 9 aa, Homo Sapiens
YHQSMSQNY

SEQ ID NO: 19862 - protein, 9 aa, Homo Sapiens
AQPTDSEKE

SEQ ID NO: 19863 - protein, 9 aa, Homo Sapiens
ENAQPTDSE

SEQ ID NO: 19864 - protein, 9 aa, Homo Sapiens
LCSKPFRVI

SEQ ID NO: 19865 - protein, 9 aa, Homo Sapiens
GMYGLDFYV

SEQ ID NO: 19866 - protein, 9 aa, Homo Sapiens
VQTDYTFPL

SEQ ID NO: 19867 - protein, 9 aa, Homo Sapiens
WTQPPPHPS

SEQ ID NO: 19868 - protein, 9 aa, Homo Sapiens
EIDCLCTQK

SEQ ID NO: 19869 - protein, 9 aa, Homo Sapiens
LTLCPLGTE

SEQ ID NO: 19870 - protein, 9 aa, Homo Sapiens
PLELLQERP

SEQ ID NO: 19871 - protein, 9 aa, Homo Sapiens
TECALLGVV

SEQ ID NO: 19872 - protein, 9 aa, Homo Sapiens
SLTHSESKV

SEQ ID NO: 19873 - protein, 9 aa, Homo Sapiens
VLTDGAKLK

SEQ ID NO: 19874 - protein, 9 aa, Homo Sapiens
SHSEEDEAE

SEQ ID NO: 19875 - protein, 9 aa, Homo Sapiens
LGFHGGHFV

SEQ ID NO: 19876 - protein, 9 aa, Homo Sapiens
WQQVFDDKA

SEQ ID NO: 19877 - protein, 9 aa, Homo Sapiens
HQGENLDKN

SEQ ID NO: 19878 - protein, 9 aa, Homo Sapiens
LMSVVCIKD

SEQ ID NO: 19879 - protein, 9 aa, Homo Sapiens
KSQDQWDGL

SEQ ID NO: 19880 - protein, 9 aa, Homo Sapiens
DQEEQAGPS

SEQ ID NO: 19881 - protein, 9 aa, Homo Sapiens
ENSFRYWPR

SEQ ID NO: 19882 - protein, 9 aa, Homo Sapiens
RRHCGEKPY

SEQ ID NO: 19883 - protein, 9 aa, Homo Sapiens
HAKRVTIMH

SEQ ID NO: 19884 - protein, 9 aa, Homo Sapiens
LRDRFDGAL

SEQ ID NO: 19885 - protein, 9 aa, Homo Sapiens
VIMKGTHLP

SEQ ID NO: 19886 - protein, 9 aa, Homo Sapiens
CCVCVLHPV

SEQ ID NO: 19887 - protein, 9 aa, Homo Sapiens
NCLEDLLCI

SEQ ID NO: 19888 - protein, 9 aa, Homo Sapiens
AKLNRQDVS

SEQ ID NO: 19889 - protein, 9 aa, Homo Sapiens
AWWEVHKVG

SEQ ID NO: 19890 - protein, 9 aa, Homo Sapiens
RMKRRMQNL

SEQ ID NO: 19891 - protein, 9 aa, Homo Sapiens
GDCSDELGC

SEQ ID NO: 19892 - protein, 9 aa, Homo Sapiens
GRHGESKTI

SEQ ID NO: 19893 - protein, 9 aa, Homo Sapiens
DAPAEPDAG

SEQ ID NO: 19894 - protein, 9 aa, Homo Sapiens
TSTQGKHRA

SEQ ID NO: 19895 - protein, 9 aa, Homo Sapiens
SEQLTFSLS

SEQ ID NO: 19896 - protein, 9 aa, Homo Sapiens
TTHGVFVLG

SEQ ID NO: 19897 - protein, 9 aa, Homo Sapiens
TLRNAPSKD

SEQ ID NO: 19898 - protein, 9 aa, Homo Sapiens
ESLSAPEKI

SEQ ID NO: 19899 - protein, 9 aa, Homo Sapiens
LEDLKEHLP

SEQ ID NO: 19900 - protein, 9 aa, Homo Sapiens
CGLGKATRV

SEQ ID NO: 19901 - protein, 9 aa, Homo Sapiens
EKGVVKEWL

SEQ ID NO: 19902 - protein, 9 aa, Homo Sapiens
DLSGSRQGS

SEQ ID NO: 19903 - protein, 9 aa, Homo Sapiens
KMYLDKIIR

SEQ ID NO: 19904 - protein, 9 aa, Homo Sapiens
NDRPQEIAM

SEQ ID NO: 19905 - protein, 9 aa, Homo Sapiens
VSEAPINYT

SEQ ID NO: 19906 - protein, 9 aa, Homo Sapiens
FKDTMYLTQ

SEQ ID NO: 19907 - protein, 9 aa, Homo Sapiens
EPVPLSKVT

SEQ ID NO: 19908 - protein, 9 aa, Homo Sapiens
PDAQTELEV

SEQ ID NO: 19909 - protein, 9 aa, Homo Sapiens
SVQTDYTFP

SEQ ID NO: 19910 - protein, 9 aa, Homo Sapiens
HEHRSDCEN

SEQ ID NO: 19911 - protein, 9 aa, Homo Sapiens
FISINVGNL

SEQ ID NO: 19912 - protein, 9 aa, Homo Sapiens
LIKLKELHL

SEQ ID NO: 19913 - protein, 9 aa, Homo Sapiens
PAQGYSSPG

SEQ ID NO: 19914 - protein, 9 aa, Homo Sapiens
APAEVNSGG

SEQ ID NO: 19915 - protein, 9 aa, Homo Sapiens
NSKKHIQPD

SEQ ID NO: 19916 - protein, 9 aa, Homo Sapiens
QCGKAYGWC

SEQ ID NO: 19917 - protein, 9 aa, Homo Sapiens
PQIKALMTG

SEQ ID NO: 19918 - protein, 9 aa, Homo Sapiens
RCRACGALR

SEQ ID NO: 19919 - protein, 9 aa, Homo Sapiens
HTFLDVSLS

SEQ ID NO: 19920 - protein, 9 aa, Homo Sapiens
FSTEVTLNT

SEQ ID NO: 19921 - protein, 9 aa, Homo Sapiens
PKAEKEKIA

SEQ ID NO: 19922 - protein, 9 aa, Homo Sapiens
ILINDKEEL

SEQ ID NO: 19923 - protein, 9 aa, Homo Sapiens
EDNPLEATV

SEQ ID NO: 19924 - protein, 9 aa, Homo Sapiens
GQGGPASTL

SEQ ID NO: 19925 - protein, 9 aa, Homo Sapiens
PIKEILGAS

SEQ ID NO: 19926 - protein, 9 aa, Homo Sapiens
SPGRAGGEE

SEQ ID NO: 19927 - protein, 9 aa, Homo Sapiens
VEVKAKKRI

SEQ ID NO: 19928 - protein, 9 aa, Homo Sapiens
ADMLSQAIG

SEQ ID NO: 19929 - protein, 9 aa, Homo Sapiens
ENPPIFDQP

SEQ ID NO: 19930 - protein, 9 aa, Homo Sapiens
RRRSRFVVR

SEQ ID NO: 19931 - protein, 9 aa, Homo Sapiens
LSYRPWDSN

SEQ ID NO: 19932 - protein, 9 aa, Homo Sapiens
GILVGNVTG

SEQ ID NO: 19933 - protein, 9 aa, Homo Sapiens
KRPFKCQWC

SEQ ID NO: 19934 - protein, 9 aa, Homo Sapiens
LKVELKRLQ

SEQ ID NO: 19935 - protein, 9 aa, Homo Sapiens
DKEEDKQEE

SEQ ID NO: 19936 - protein, 9 aa, Homo Sapiens
EILSETKNP

SEQ ID NO: 19937 - protein, 9 aa, Homo Sapiens
AAEKSRKSN

SEQ ID NO: 19938 - protein, 9 aa, Homo Sapiens
RKLLEAVEP

SEQ ID NO: 19939 - protein, 9 aa, Homo Sapiens
LQHQERHLA

SEQ ID NO: 19940 - protein, 9 aa, Homo Sapiens
QPDYYNTLL

SEQ ID NO: 19941 - protein, 9 aa, Homo Sapiens
LQKIVKMSI

SEQ ID NO: 19942 - protein, 9 aa, Homo Sapiens
GLSADMLSQ

SEQ ID NO: 19943 - protein, 9 aa, Homo Sapiens
IKDSVSVAT

SEQ ID NO: 19944 - protein, 9 aa, Homo Sapiens
LFHTLNEDL

SEQ ID NO: 19945 - protein, 9 aa, Homo Sapiens
HSTKRPFKC

SEQ ID NO: 19946 - protein, 9 aa, Homo Sapiens
MYGLDFYVV

SEQ ID NO: 19947 - protein, 9 aa, Homo Sapiens
NVASLWQEL

SEQ ID NO: 19948 - protein, 9 aa, Homo Sapiens
FRKAHETAF

SEQ ID NO: 19949 - protein, 9 aa, Homo Sapiens
KPALPSASF

SEQ ID NO: 19950 - protein, 9 aa, Homo Sapiens
MLDGSYSVG

SEQ ID NO: 19951 - protein, 9 aa, Homo Sapiens
ISVATPGSS

SEQ ID NO: 19952 - protein, 9 aa, Homo Sapiens
LRKKILIAI

SEQ ID NO: 19953 - protein, 9 aa, Homo Sapiens
LRLYLGTVL

SEQ ID NO: 19954 - protein, 9 aa, Homo Sapiens
KVGLLGDKG

SEQ ID NO: 19955 - protein, 9 aa, Homo Sapiens
AVHVACADS

SEQ ID NO: 19956 - protein, 9 aa, Homo Sapiens
DLTVLIAME

SEQ ID NO: 19957 - protein, 9 aa, Homo Sapiens
VNAGQMLHG

SEQ ID NO: 19958 - protein, 9 aa, Homo Sapiens
RGWQQMLKV

SEQ ID NO: 19959 - protein, 9 aa, Homo Sapiens
CDRQMIFNM

SEQ ID NO: 19960 - protein, 9 aa, Homo Sapiens
LFFYFVGYI

SEQ ID NO: 19961 - protein, 9 aa, Homo Sapiens
NDQLYVSEA

SEQ ID NO: 19962 - protein, 9 aa, Homo Sapiens
GERDNAKLQ

SEQ ID NO: 19963 - protein, 9 aa, Homo Sapiens
PAQQYSLLA

SEQ ID NO: 19964 - protein, 9 aa, Homo Sapiens
RKHDGQFAV

SEQ ID NO: 19965 - protein, 9 aa, Homo Sapiens
SQVNTLRVK

SEQ ID NO: 19966 - protein, 9 aa, Homo Sapiens
LEPKAVHVA

SEQ ID NO: 19967 - protein, 9 aa, Homo Sapiens
ASLWQELAA

SEQ ID NO: 19968 - protein, 9 aa, Homo Sapiens
MLAHKIQSP

SEQ ID NO: 19969 - protein, 9 aa, Homo Sapiens
RADAWLFRK

SEQ ID NO: 19970 - protein, 9 aa, Homo Sapiens
ASGSSVTCL

SEQ ID NO: 19971 - protein, 9 aa, Homo Sapiens
GFGEDSACT

SEQ ID NO: 19972 - protein, 9 aa, Homo Sapiens
YINHPVYTP

SEQ ID NO: 19973 - protein, 9 aa, Homo Sapiens
ALQGQGLLL

SEQ ID NO: 19974 - protein, 9 aa, Homo Sapiens
IQPLSAASE

SEQ ID NO: 19975 - protein, 9 aa, Homo Sapiens
DQTDSWNDR

SEQ ID NO: 19976 - protein, 9 aa, Homo Sapiens
KPAPEWASI

SEQ ID NO: 19977 - protein, 9 aa, Homo Sapiens
GQMLHGTGG

SEQ ID NO: 19978 - protein, 9 aa, Homo Sapiens
SVLENAPLC

SEQ ID NO: 19979 - protein, 9 aa, Homo Sapiens
ELQSAFEET

SEQ ID NO: 19980 - protein, 9 aa, Homo Sapiens
ISYTGEEVP

SEQ ID NO: 19981 - protein, 9 aa, Homo Sapiens
TMPQIKALM

SEQ ID NO: 19982 - protein, 9 aa, Homo Sapiens
CCDCRKPAP

SEQ ID NO: 19983 - protein, 9 aa, Homo Sapiens
GTELAPRAH

SEQ ID NO: 19984 - protein, 9 aa, Homo Sapiens
ITILGSNFG

SEQ ID NO: 19985 - protein, 9 aa, Homo Sapiens
NSFYTLPRL

SEQ ID NO: 19986 - protein, 9 aa, Homo Sapiens
FGEDSACTS

SEQ ID NO: 19987 - protein, 9 aa, Homo Sapiens
PGGGGGAAV

SEQ ID NO: 19988 - protein, 9 aa, Homo Sapiens
PAGTFYQEQ

SEQ ID NO: 19989 - protein, 9 aa, Homo Sapiens
DCRKPAPEW

SEQ ID NO: 19990 - protein, 9 aa, Homo Sapiens
KSVLDKMMV

SEQ ID NO: 19991 - protein, 9 aa, Homo Sapiens
QLPDTESGY

SEQ ID NO: 19992 - protein, 9 aa, Homo Sapiens
LQHIFSAKS

SEQ ID NO: 19993 - protein, 9 aa, Homo Sapiens
NLRHIIFHS

SEQ ID NO: 19994 - protein, 9 aa, Homo Sapiens
DHMKVALDK

SEQ ID NO: 19995 - protein, 9 aa, Homo Sapiens
PPATKIKRE

SEQ ID NO: 19996 - protein, 9 aa, Homo Sapiens
KEPEPTPGL

SEQ ID NO: 19997 - protein, 9 aa, Homo Sapiens
GNGNGHEHR

SEQ ID NO: 19998 - protein, 9 aa, Homo Sapiens
YKIYLTLHK

SEQ ID NO: 19999 - protein, 9 aa, Homo Sapiens
NDYLRKMNK

SEQ ID NO: 20000 - protein, 9 aa, Homo Sapiens
GPVLCRDKM

SEQ ID NO: 20001 - protein, 9 aa, Homo Sapiens
TAAYLRMHA

SEQ ID NO: 20002 - protein, 9 aa, Homo Sapiens
VRNGIRTGF

SEQ ID NO: 20003 - protein, 9 aa, Homo Sapiens
VNENPPIFD

SEQ ID NO: 20004 - protein, 9 aa, Homo Sapiens
HMSYEAGIL

SEQ ID NO: 20005 - protein, 9 aa, Homo Sapiens
VTCLDGTRS

SEQ ID NO: 20006 - protein, 9 aa, Homo Sapiens
SPSPLPTSP

SEQ ID NO: 20007 - protein, 9 aa, Homo Sapiens
NVATGTFAL

SEQ ID NO: 20008 - protein, 9 aa, Homo Sapiens
QLFLFYGKG

SEQ ID NO: 20009 - protein, 9 aa, Homo Sapiens
FGYRGTDCR

SEQ ID NO: 20010 - protein, 9 aa, Homo Sapiens
DGWTPLYCA

SEQ ID NO: 20011 - protein, 9 aa, Homo Sapiens
PFTTPVLVC

SEQ ID NO: 20012 - protein, 9 aa, Homo Sapiens
KQKSVGQKR

SEQ ID NO: 20013 - protein, 9 aa, Homo Sapiens
LLTGGCPLL

SEQ ID NO: 20014 - protein, 9 aa, Homo Sapiens
GGNLVSMLL

SEQ ID NO: 20015 - protein, 9 aa, Homo Sapiens
NTGTLRNAP

SEQ ID NO: 20016 - protein, 9 aa, Homo Sapiens
ASGSQNPGK

SEQ ID NO: 20017 - protein, 9 aa, Homo Sapiens
ATHAPSITL

SEQ ID NO: 20018 - protein, 9 aa, Homo Sapiens
CADGANDCG

SEQ ID NO: 20019 - protein, 9 aa, Homo Sapiens
YDACLCGSV

SEQ ID NO: 20020 - protein, 9 aa, Homo Sapiens
LGLLNNILL

SEQ ID NO: 20021 - protein, 9 aa, Homo Sapiens
EELLDRLTS

SEQ ID NO: 20022 - protein, 9 aa, Homo Sapiens
LGVPWPLLP

SEQ ID NO: 20023 - protein, 9 aa, Homo Sapiens
PSGALHRNR

SEQ ID NO: 20024 - protein, 9 aa, Homo Sapiens
DRLTSHSML

SEQ ID NO: 20025 - protein, 9 aa, Homo Sapiens
VPVLSGDAT

SEQ ID NO: 20026 - protein, 9 aa, Homo Sapiens
IIKIDIRLE

SEQ ID NO: 20027 - protein, 9 aa, Homo Sapiens
QAECLKPFN

SEQ ID NO: 20028 - protein, 9 aa, Homo Sapiens
HVSTEPSCP

SEQ ID NO: 20029 - protein, 9 aa, Homo Sapiens
QTTAPAALE

SEQ ID NO: 20030 - protein, 9 aa, Homo Sapiens
ESSHSWLSW

SEQ ID NO: 20031 - protein, 9 aa, Homo Sapiens
SEIAIDNYD

SEQ ID NO: 20032 - protein, 9 aa, Homo Sapiens
SILSVTSRD

SEQ ID NO: 20033 - protein, 9 aa, Homo Sapiens
GASLSLHFE

SEQ ID NO: 20034 - protein, 9 aa, Homo Sapiens
VQWMVVRNC

SEQ ID NO: 20035 - protein, 9 aa, Homo Sapiens
WQVSLPELE

SEQ ID NO: 20036 - protein, 9 aa, Homo Sapiens
NKEGVFDHM

SEQ ID NO: 20037 - protein, 9 aa, Homo Sapiens
VFDHMKVAL

SEQ ID NO: 20038 - protein, 9 aa, Homo Sapiens
NGNGHEHRS

SEQ ID NO: 20039 - protein, 9 aa, Homo Sapiens
VAVAKGKTF

SEQ ID NO: 20040 - protein, 9 aa, Homo Sapiens
HSEEDEAED

SEQ ID NO: 20041 - protein, 9 aa, Homo Sapiens
GEPLAAKKE

SEQ ID NO: 20042 - protein, 9 aa, Homo Sapiens
QNSLIWVAV

SEQ ID NO: 20043 - protein, 9 aa, Homo Sapiens
KLSYRPWDS

SEQ ID NO: 20044 - protein, 9 aa, Homo Sapiens
DCAVGVQWP

SEQ ID NO: 20045 - protein, 9 aa, Homo Sapiens
ADSLRPASA

SEQ ID NO: 20046 - protein, 9 aa, Homo Sapiens
VLIAMEPLI

SEQ ID NO: 20047 - protein, 9 aa, Homo Sapiens
QSMSQNYGL

SEQ ID NO: 20048 - protein, 9 aa, Homo Sapiens
DVSSEATLG

SEQ ID NO: 20049 - protein, 9 aa, Homo Sapiens
TRPPDQPEG

SEQ ID NO: 20050 - protein, 9 aa, Homo Sapiens
MATRPPDQP

SEQ ID NO: 20051 - protein, 9 aa, Homo Sapiens
DEHLYKTVP

SEQ ID NO: 20052 - protein, 9 aa, Homo Sapiens
EKDLTVLIA

SEQ ID NO: 20053 - protein, 9 aa, Homo Sapiens
VLDKMMVEQ

SEQ ID NO: 20054 - protein, 9 aa, Homo Sapiens
GHVVLALGR

SEQ ID NO: 20055 - protein, 9 aa, Homo Sapiens
TFEISIGKK

SEQ ID NO: 20056 - protein, 9 aa, Homo Sapiens
EHQDSVEGL

SEQ ID NO: 20057 - protein, 9 aa, Homo Sapiens
LGTELAPRA

SEQ ID NO: 20058 - protein, 9 aa, Homo Sapiens
VLERCPHRP

SEQ ID NO: 20059 - protein, 9 aa, Homo Sapiens
RGLLAEVAG

SEQ ID NO: 20060 - protein, 9 aa, Homo Sapiens
IIADQEEQA

SEQ ID NO: 20061 - protein, 9 aa, Homo Sapiens
DRADAWLFR

SEQ ID NO: 20062 - protein, 9 aa, Homo Sapiens
PAAAAIDEK

SEQ ID NO: 20063 - protein, 9 aa, Homo Sapiens
LRGRKPALP

SEQ ID NO: 20064 - protein, 9 aa, Homo Sapiens
VVTDLKQDY

SEQ ID NO: 20065 - protein, 9 aa, Homo Sapiens
LCPLGTELA

SEQ ID NO: 20066 - protein, 9 aa, Homo Sapiens
SKPFRVICI

SEQ ID NO: 20067 - protein, 9 aa, Homo Sapiens
LLDLCYNRI

SEQ ID NO: 20068 - protein, 9 aa, Homo Sapiens
KPPPLGLCN

SEQ ID NO: 20069 - protein, 9 aa, Homo Sapiens
TGERSNDKR

SEQ ID NO: 20070 - protein, 9 aa, Homo Sapiens
PDSWGSDAQ

SEQ ID NO: 20071 - protein, 9 aa, Homo Sapiens
LCLMSVVCI

SEQ ID NO: 20072 - protein, 9 aa, Homo Sapiens
KLEKLNLVA

SEQ ID NO: 20073 - protein, 9 aa, Homo Sapiens
PGRAGGEEG

SEQ ID NO: 20074 - protein, 9 aa, Homo Sapiens
RESDNTWIS

SEQ ID NO: 20075 - protein, 9 aa, Homo Sapiens
DKMEEWSAS

SEQ ID NO: 20076 - protein, 9 aa, Homo Sapiens
GASKAHMAA

SEQ ID NO: 20077 - protein, 9 aa, Homo Sapiens
IQECFSRSR

SEQ ID NO: 20078 - protein, 9 aa, Homo Sapiens
AALEAQTTA

SEQ ID NO: 20079 - protein, 9 aa, Homo Sapiens
GSACLDWQS

SEQ ID NO: 20080 - protein, 9 aa, Homo Sapiens
LSHLTHHKR

SEQ ID NO: 20081 - protein, 9 aa, Homo Sapiens
YTVAVAKGK

SEQ ID NO: 20082 - protein, 9 aa, Homo Sapiens
KSTVSTELA

SEQ ID NO: 20083 - protein, 9 aa, Homo Sapiens
QNLKAGRFH

SEQ ID NO: 20084 - protein, 9 aa, Homo Sapiens
LSTKDEDIT

SEQ ID NO: 20085 - protein, 9 aa, Homo Sapiens
TESNKVPLH

SEQ ID NO: 20086 - protein, 9 aa, Homo Sapiens
HRFNGNSTG

SEQ ID NO: 20087 - protein, 9 aa, Homo Sapiens
MISDLFINN

SEQ ID NO: 20088 - protein, 9 aa, Homo Sapiens
TDCRNNVHY

SEQ ID NO: 20089 - protein, 9 aa, Homo Sapiens
RAKMTQLPK

SEQ ID NO: 20090 - protein, 9 aa, Homo Sapiens
SAESKEEEL

SEQ ID NO: 20091 - protein, 9 aa, Homo Sapiens
DKIIRGNQL

SEQ ID NO: 20092 - protein, 9 aa, Homo Sapiens
ILQLGLELK

SEQ ID NO: 20093 - protein, 9 aa, Homo Sapiens
PRSDRSPSP

SEQ ID NO: 20094 - protein, 9 aa, Homo Sapiens
AQKWCSNTP

SEQ ID NO: 20095 - protein, 9 aa, Homo Sapiens
IDIRLERSM

SEQ ID NO: 20096 - protein, 9 aa, Homo Sapiens
NTSAAQPQY

SEQ ID NO: 20097 - protein, 9 aa, Homo Sapiens
EDFACQRLK

SEQ ID NO: 20098 - protein, 9 aa, Homo Sapiens
HTLNEDLFQ

SEQ ID NO: 20099 - protein, 9 aa, Homo Sapiens
KKQIQLKSR

SEQ ID NO: 20100 - protein, 9 aa, Homo Sapiens
FCRLDEYNQ

SEQ ID NO: 20101 - protein, 9 aa, Homo Sapiens
YSWKLWCMY

SEQ ID NO: 20102 - protein, 9 aa, Homo Sapiens
AQTELEVLL

SEQ ID NO: 20103 - protein, 9 aa, Homo Sapiens
KIVIRHAHQ

SEQ ID NO: 20104 - protein, 9 aa, Homo Sapiens
SEKGVVKEW

SEQ ID NO: 20105 - protein, 9 aa, Homo Sapiens
IMPVKYEQN

SEQ ID NO: 20106 - protein, 9 aa, Homo Sapiens
KINNREQKL

SEQ ID NO: 20107 - protein, 9 aa, Homo Sapiens
LLYELKLNR

SEQ ID NO: 20108 - protein, 9 aa, Homo Sapiens
AGSGSFGIS

SEQ ID NO: 20109 - protein, 9 aa, Homo Sapiens
RSAQGRKKA

SEQ ID NO: 20110 - protein, 9 aa, Homo Sapiens
PAVHFPQVV

SEQ ID NO: 20111 - protein, 9 aa, Homo Sapiens
FLFKVLLVE

SEQ ID NO: 20112 - protein, 9 aa, Homo Sapiens
HLRDRTCRA

SEQ ID NO: 20113 - protein, 9 aa, Homo Sapiens
KGWESHMVE

SEQ ID NO: 20114 - protein, 9 aa, Homo Sapiens
NEQKRKSAR

SEQ ID NO: 20115 - protein, 9 aa, Homo Sapiens
FAALLHFFL

SEQ ID NO: 20116 - protein, 9 aa, Homo Sapiens
TPSAFLEPF

SEQ ID NO: 20117 - protein, 9 aa, Homo Sapiens
IIWFIQLTG

SEQ ID NO: 20118 - protein, 9 aa, Homo Sapiens
DPKNLENRA

SEQ ID NO: 20119 - protein, 9 aa, Homo Sapiens
AGAGYILQD

SEQ ID NO: 20120 - protein, 9 aa, Homo Sapiens
VKKQIQLKS

SEQ ID NO: 20121 - protein, 9 aa, Homo Sapiens
FSGSQPYFQ

SEQ ID NO: 20122 - protein, 9 aa, Homo Sapiens
STPATTSTK

SEQ ID NO: 20123 - protein, 9 aa, Homo Sapiens
EARRPRGQD

SEQ ID NO: 20124 - protein, 9 aa, Homo Sapiens
ITLLGFQNM

SEQ ID NO: 20125 - protein, 9 aa, Homo Sapiens
MKEKRKMKR

SEQ ID NO: 20126 - protein, 9 aa, Homo Sapiens
SNGTVTPSA

SEQ ID NO: 20127 - protein, 9 aa, Homo Sapiens
MCGHVVLAL

SEQ ID NO: 20128 - protein, 9 aa, Homo Sapiens
TLGLLFQLV

SEQ ID NO: 20129 - protein, 9 aa, Homo Sapiens
GGLRLLDLC

SEQ ID NO: 20130 - protein, 9 aa, Homo Sapiens
ITDETRIFQ

SEQ ID NO: 20131 - protein, 9 aa, Homo Sapiens
RESSQRGFY

SEQ ID NO: 20132 - protein, 9 aa, Homo Sapiens
EVLKLLYRG

SEQ ID NO: 20133 - protein, 9 aa, Homo Sapiens
IVGNQTDQE

SEQ ID NO: 20134 - protein, 9 aa, Homo Sapiens
SLIIILPAQ

SEQ ID NO: 20135 - protein, 9 aa, Homo Sapiens
IVKMSIIWF

SEQ ID NO: 20136 - protein, 9 aa, Homo Sapiens
FICKQCGKA

SEQ ID NO: 20137 - protein, 9 aa, Homo Sapiens
SLGCLGALG

SEQ ID NO: 20138 - protein, 9 aa, Homo Sapiens
HLAKEQLQK

SEQ ID NO: 20139 - protein, 9 aa, Homo Sapiens
ISIGKKDEV

SEQ ID NO: 20140 - protein, 9 aa, Homo Sapiens
LEKMYLDKI

SEQ ID NO: 20141 - protein, 9 aa, Homo Sapiens
PSETSVYFC

SEQ ID NO: 20142 - protein, 9 aa, Homo Sapiens
VLQNSIHSL

SEQ ID NO: 20143 - protein, 9 aa, Homo Sapiens
SGSRQGSAE

SEQ ID NO: 20144 - protein, 9 aa, Homo Sapiens
QSAFEETGK

SEQ ID NO: 20145 - protein, 9 aa, Homo Sapiens
CPHRPILQA

SEQ ID NO: 20146 - protein, 9 aa, Homo Sapiens
TSATESNKV

SEQ ID NO: 20147 - protein, 9 aa, Homo Sapiens
QGLLLYNSA

SEQ ID NO: 20148 - protein, 9 aa, Homo Sapiens
TADSLRPAS

SEQ ID NO: 20149 - protein, 9 aa, Homo Sapiens
QWWPHKDGT

SEQ ID NO: 20150 - protein, 9 aa, Homo Sapiens
PEVKHLCPN

SEQ ID NO: 20151 - protein, 9 aa, Homo Sapiens
RLLDLCYNR

SEQ ID NO: 20152 - protein, 9 aa, Homo Sapiens
EHRSDCENE

SEQ ID NO: 20153 - protein, 9 aa, Homo Sapiens
WIVPSGLAP

SEQ ID NO: 20154 - protein, 9 aa, Homo Sapiens
ALSVQTDYT

SEQ ID NO: 20155 - protein, 9 aa, Homo Sapiens
VVKLEKLNL

SEQ ID NO: 20156 - protein, 9 aa, Homo Sapiens
PPLGLCNYP

SEQ ID NO: 20157 - protein, 9 aa, Homo Sapiens
KYIRELWRK

SEQ ID NO: 20158 - protein, 9 aa, Homo Sapiens
AGLPKPKRG

SEQ ID NO: 20159 - protein, 9 aa, Homo Sapiens
HAWLRPEID

SEQ ID NO: 20160 - protein, 9 aa, Homo Sapiens
CKYVAVELQ

SEQ ID NO: 20161 - protein, 9 aa, Homo Sapiens
LTDSVTDVR

SEQ ID NO: 20162 - protein, 9 aa, Homo Sapiens
TVAVAKGKT

SEQ ID NO: 20163 - protein, 9 aa, Homo Sapiens
AVHFPQVVK

SEQ ID NO: 20164 - protein, 9 aa, Homo Sapiens
DNIKRLEQE

SEQ ID NO: 20165 - protein, 9 aa, Homo Sapiens
LYHQRWLWI

SEQ ID NO: 20166 - protein, 9 aa, Homo Sapiens
EEGRGGRGT

SEQ ID NO: 20167 - protein, 9 aa, Homo Sapiens
MSIIWFIQL

SEQ ID NO: 20168 - protein, 9 aa, Homo Sapiens
GQLPDTESG

SEQ ID NO: 20169 - protein, 9 aa, Homo Sapiens
LADVAQKWC

SEQ ID NO: 20170 - protein, 9 aa, Homo Sapiens
ISRKLFHTL

SEQ ID NO: 20171 - protein, 9 aa, Homo Sapiens
QVLKDLFCN

SEQ ID NO: 20172 - protein, 9 aa, Homo Sapiens
PLCHSVIHI

SEQ ID NO: 20173 - protein, 9 aa, Homo Sapiens
SVRYTHKLC

SEQ ID NO: 20174 - protein, 9 aa, Homo Sapiens
RVLFNLLPG

SEQ ID NO: 20175 - protein, 9 aa, Homo Sapiens
FNQRLIVLD

SEQ ID NO: 20176 - protein, 9 aa, Homo Sapiens
KGSIVWQQV

SEQ ID NO: 20177 - protein, 9 aa, Homo Sapiens
KKVEDALSL

SEQ ID NO: 20178 - protein, 9 aa, Homo Sapiens
TKNPLRVQP

SEQ ID NO: 20179 - protein, 9 aa, Homo Sapiens
AVELQSAFE

SEQ ID NO: 20180 - protein, 9 aa, Homo Sapiens
ITLFEAHMA

SEQ ID NO: 20181 - protein, 9 aa, Homo Sapiens
GPASTLAQT

SEQ ID NO: 20182 - protein, 9 aa, Homo Sapiens
AWQVSLPEL

SEQ ID NO: 20183 - protein, 9 aa, Homo Sapiens
EDNIKRLEQ

SEQ ID NO: 20184 - protein, 9 aa, Homo Sapiens
GGAGDASLG

SEQ ID NO: 20185 - protein, 9 aa, Homo Sapiens
QRGFYACSV

SEQ ID NO: 20186 - protein, 9 aa, Homo Sapiens
WKLWCMYIS

SEQ ID NO: 20187 - protein, 9 aa, Homo Sapiens
YKTTVCENA

SEQ ID NO: 20188 - protein, 9 aa, Homo Sapiens
LQLGLELKP

SEQ ID NO: 20189 - protein, 9 aa, Homo Sapiens
QVLGAHRDI

SEQ ID NO: 20190 - protein, 9 aa, Homo Sapiens
KMMVEQTDL

SEQ ID NO: 20191 - protein, 9 aa, Homo Sapiens
SEATLGLLF

SEQ ID NO: 20192 - protein, 9 aa, Homo Sapiens
RSNGTVTPS

SEQ ID NO: 20193 - protein, 9 aa, Homo Sapiens
PLLEVLSPQ

SEQ ID NO: 20194 - protein, 9 aa, Homo Sapiens
FACQRLKGM

SEQ ID NO: 20195 - protein, 9 aa, Homo Sapiens
KNLVPVAAA

SEQ ID NO: 20196 - protein, 9 aa, Homo Sapiens
GTYIEELIK

SEQ ID NO: 20197 - protein, 9 aa, Homo Sapiens
SLNSVPTNL

SEQ ID NO: 20198 - protein, 9 aa, Homo Sapiens
ALKALNAHR

SEQ ID NO: 20199 - protein, 9 aa, Homo Sapiens
LMSLVGYVL

SEQ ID NO: 20200 - protein, 9 aa, Homo Sapiens
KPFICKQCG

SEQ ID NO: 20201 - protein, 9 aa, Homo Sapiens
TVLIAMEPL

SEQ ID NO: 20202 - protein, 9 aa, Homo Sapiens
SSHRYASGH

SEQ ID NO: 20203 - protein, 9 aa, Homo Sapiens
TDGAKLKKC

SEQ ID NO: 20204 - protein, 9 aa, Homo Sapiens
AEPDAGAAP

SEQ ID NO: 20205 - protein, 9 aa, Homo Sapiens
WLFICHKWL

SEQ ID NO: 20206 - protein, 9 aa, Homo Sapiens
RELQHQERH

SEQ ID NO: 20207 - protein, 9 aa, Homo Sapiens
LTSHSMLPS

SEQ ID NO: 20208 - protein, 9 aa, Homo Sapiens
SRFVVRRRS

SEQ ID NO: 20209 - protein, 9 aa, Homo Sapiens
LSGDATFPK

SEQ ID NO: 20210 - protein, 9 aa, Homo Sapiens
FSFNTSAAQ

SEQ ID NO: 20211 - protein, 9 aa, Homo Sapiens
QLADVAQKW

SEQ ID NO: 20212 - protein, 9 aa, Homo Sapiens
GAGDASLGF

SEQ ID NO: 20213 - protein, 9 aa, Homo Sapiens
ACYHKCLQL

SEQ ID NO: 20214 - protein, 9 aa, Homo Sapiens
EVLTDGAKL

SEQ ID NO: 20215 - protein, 9 aa, Homo Sapiens
DPRIVVTHC

SEQ ID NO: 20216 - protein, 9 aa, Homo Sapiens
LGPLPDCAE

SEQ ID NO: 20217 - protein, 9 aa, Homo Sapiens
ASHSEEDEA

SEQ ID NO: 20218 - protein, 9 aa, Homo Sapiens
FCRDCGQGF

SEQ ID NO: 20219 - protein, 9 aa, Homo Sapiens
KRPKNQLFL

SEQ ID NO: 20220 - protein, 9 aa, Homo Sapiens
IMNTMEKTI

SEQ ID NO: 20221 - protein, 9 aa, Homo Sapiens
TLCDFSIPE

SEQ ID NO: 20222 - protein, 9 aa, Homo Sapiens
KIIYEEALK

SEQ ID NO: 20223 - protein, 9 aa, Homo Sapiens
WNTGTLRNA

SEQ ID NO: 20224 - protein, 9 aa, Homo Sapiens
NQVASPQIM

SEQ ID NO: 20225 - protein, 9 aa, Homo Sapiens
HGVFVLGPF

SEQ ID NO: 20226 - protein, 9 aa, Homo Sapiens
VTNISSAST

SEQ ID NO: 20227 - protein, 9 aa, Homo Sapiens
TGSPAAAAI

SEQ ID NO: 20228 - protein, 9 aa, Homo Sapiens
FLDVSLSEA

SEQ ID NO: 20229 - protein, 9 aa, Homo Sapiens
ADAWLFRKA

SEQ ID NO: 20230 - protein, 9 aa, Homo Sapiens
PLGLCNYPS

SEQ ID NO: 20231 - protein, 9 aa, Homo Sapiens
FQLVLKGWE

SEQ ID NO: 20232 - protein, 9 aa, Homo Sapiens
CRETHKITV

SEQ ID NO: 20233 - protein, 9 aa, Homo Sapiens
LQTHLRRHC

SEQ ID NO: 20234 - protein, 9 aa, Homo Sapiens
SWLSWPLCV

SEQ ID NO: 20235 - protein, 9 aa, Homo Sapiens
APKPHEKAL

SEQ ID NO: 20236 - protein, 9 aa, Homo Sapiens
LGKATRVSN

SEQ ID NO: 20237 - protein, 9 aa, Homo Sapiens
TIASEHSAW

SEQ ID NO: 20238 - protein, 9 aa, Homo Sapiens
STYRKFSTE

SEQ ID NO: 20239 - protein, 9 aa, Homo Sapiens
GLLKDSEQL

SEQ ID NO: 20240 - protein, 9 aa, Homo Sapiens
LYRGADINY

SEQ ID NO: 20241 - protein, 9 aa, Homo Sapiens
GCGLQGALL

SEQ ID NO: 20242 - protein, 9 aa, Homo Sapiens
YCAASCNNV

SEQ ID NO: 20243 - protein, 9 aa, Homo Sapiens
TSDPLELLQ

SEQ ID NO: 20244 - protein, 9 aa, Homo Sapiens
LEQSIQSAK

SEQ ID NO: 20245 - protein, 9 aa, Homo Sapiens
STSLLCSRL

SEQ ID NO: 20246 - protein, 9 aa, Homo Sapiens
LAPESKDAL

SEQ ID NO: 20247 - protein, 9 aa, Homo Sapiens
VHFPQVVKE

SEQ ID NO: 20248 - protein, 9 aa, Homo Sapiens
PGLQPEPRY

SEQ ID NO: 20249 - protein, 9 aa, Homo Sapiens
MKLMKTVMA

SEQ ID NO: 20250 - protein, 9 aa, Homo Sapiens
LSAPEKITL

SEQ ID NO: 20251 - protein, 9 aa, Homo Sapiens
DSDGWTPLY

SEQ ID NO: 20252 - protein, 9 aa, Homo Sapiens
TIQNINPSQ

SEQ ID NO: 20253 - protein, 9 aa, Homo Sapiens
QRIHSTKRP

SEQ ID NO: 20254 - protein, 9 aa, Homo Sapiens
EEDKQEESS

SEQ ID NO: 20255 - protein, 9 aa, Homo Sapiens
VISYTGEEV

SEQ ID NO: 20256 - protein, 9 aa, Homo Sapiens
EDSACTSET

SEQ ID NO: 20257 - protein, 9 aa, Homo Sapiens
AGGEEGRGG

SEQ ID NO: 20258 - protein, 9 aa, Homo Sapiens
ASPQIMQRT

SEQ ID NO: 20259 - protein, 9 aa, Homo Sapiens
AAFFREHLV

SEQ ID NO: 20260 - protein, 9 aa, Homo Sapiens
VKSVQRGLL

SEQ ID NO: 20261 - protein, 9 aa, Homo Sapiens
YSAPRELTG

SEQ ID NO: 20262 - protein, 9 aa, Homo Sapiens
SVRGNEPRS

SEQ ID NO: 20263 - protein, 9 aa, Homo Sapiens
PASTLAQTA

SEQ ID NO: 20264 - protein, 9 aa, Homo Sapiens
LQGQGLLLY

SEQ ID NO: 20265 - protein, 9 aa, Homo Sapiens
QYQVKKQIQ

SEQ ID NO: 20266 - protein, 9 aa, Homo Sapiens
TKQGDPHEL

SEQ ID NO: 20267 - protein, 9 aa, Homo Sapiens
SKAHMAATM

SEQ ID NO: 20268 - protein, 9 aa, Homo Sapiens
LFRKAHETA

SEQ ID NO: 20269 - protein, 9 aa, Homo Sapiens
SDGIPMCKR

SEQ ID NO: 20270 - protein, 9 aa, Homo Sapiens
ELIFGYRGT

SEQ ID NO: 20271 - protein, 9 aa, Homo Sapiens
FLKITSTSL

SEQ ID NO: 20272 - protein, 9 aa, Homo Sapiens
AKGSRSQGP

SEQ ID NO: 20273 - protein, 9 aa, Homo Sapiens
IRSAQGRKK

SEQ ID NO: 20274 - protein, 9 aa, Homo Sapiens
NGNSTGNLL

SEQ ID NO: 20275 - protein, 9 aa, Homo Sapiens
ILGPPGVDG

SEQ ID NO: 20276 - protein, 9 aa, Homo Sapiens
EMESLSAPE

SEQ ID NO: 20277 - protein, 9 aa, Homo Sapiens
ADDCGDCSD

SEQ ID NO: 20278 - protein, 9 aa, Homo Sapiens
RHIWLFICH

SEQ ID NO: 20279 - protein, 9 aa, Homo Sapiens
NISSASTGH

SEQ ID NO: 20280 - protein, 9 aa, Homo Sapiens
PKNLENRAL

SEQ ID NO: 20281 - protein, 9 aa, Homo Sapiens
APDAPAEPD

SEQ ID NO: 20282 - protein, 9 aa, Homo Sapiens
MFLAIRSQH

SEQ ID NO: 20283 - protein, 9 aa, Homo Sapiens
HVQWMVVRN

SEQ ID NO: 20284 - protein, 9 aa, Homo Sapiens
KEGVFDHMK

SEQ ID NO: 20285 - protein, 9 aa, Homo Sapiens
LSRKLLEAV

SEQ ID NO: 20286 - protein, 9 aa, Homo Sapiens
MLKVELKRL

SEQ ID NO: 20287 - protein, 9 aa, Homo Sapiens
DLQWWPHKD

SEQ ID NO: 20288 - protein, 9 aa, Homo Sapiens
TLRVKSREV

SEQ ID NO: 20289 - protein, 9 aa, Homo Sapiens
IWLFICHKW

SEQ ID NO: 20290 - protein, 9 aa, Homo Sapiens
ANGQHDISF

SEQ ID NO: 20291 - protein, 9 aa, Homo Sapiens
PSIGMYGLD

SEQ ID NO: 20292 - protein, 9 aa, Homo Sapiens
KHRAVSTCS

SEQ ID NO: 20293 - protein, 9 aa, Homo Sapiens
NHPVYTPPT

SEQ ID NO: 20294 - protein, 9 aa, Homo Sapiens
ELLKQVRLQ

SEQ ID NO: 20295 - protein, 9 aa, Homo Sapiens
LLNPAVHFP

SEQ ID NO: 20296 - protein, 9 aa, Homo Sapiens
GYSSPGIQS

SEQ ID NO: 20297 - protein, 9 aa, Homo Sapiens
GDINWIIPD

SEQ ID NO: 20298 - protein, 9 aa, Homo Sapiens
VGYICGESA

SEQ ID NO: 20299 - protein, 9 aa, Homo Sapiens
EQNSLIWVA

SEQ ID NO: 20300 - protein, 9 aa, Homo Sapiens
HVLQNSIHS

SEQ ID NO: 20301 - protein, 9 aa, Homo Sapiens
HRSADAVYQ

SEQ ID NO: 20302 - protein, 9 aa, Homo Sapiens
ELPGPPGLP

SEQ ID NO: 20303 - protein, 9 aa, Homo Sapiens
WRERYEDSH

SEQ ID NO: 20304 - protein, 9 aa, Homo Sapiens
DRLILINDK

SEQ ID NO: 20305 - protein, 9 aa, Homo Sapiens
DTSLQNDYL

SEQ ID NO: 20306 - protein, 9 aa, Homo Sapiens
FTTPVLVCQ

SEQ ID NO: 20307 - protein, 9 aa, Homo Sapiens
GNSESWTQP

SEQ ID NO: 20308 - protein, 9 aa, Homo Sapiens
APAEPDAGA

SEQ ID NO: 20309 - protein, 9 aa, Homo Sapiens
VLSGDATFP

SEQ ID NO: 20310 - protein, 9 aa, Homo Sapiens
PFLFKVLLV

SEQ ID NO: 20311 - protein, 9 aa, Homo Sapiens
SHSIFSVKI

SEQ ID NO: 20312 - protein, 9 aa, Homo Sapiens
NENPPIFDQ

SEQ ID NO: 20313 - protein, 9 aa, Homo Sapiens
SMDENLMHM

SEQ ID NO: 20314 - protein, 9 aa, Homo Sapiens
STKDEDITK

SEQ ID NO: 20315 - protein, 9 aa, Homo Sapiens
NTWISYSEN

SEQ ID NO: 20316 - protein, 9 aa, Homo Sapiens
CPLLHCFVI

SEQ ID NO: 20317 - protein, 9 aa, Homo Sapiens
RLSASEIRN

SEQ ID NO: 20318 - protein, 9 aa, Homo Sapiens
ADGANDCGA

SEQ ID NO: 20319 - protein, 9 aa, Homo Sapiens
YILLGLTVL

SEQ ID NO: 20320 - protein, 9 aa, Homo Sapiens
RVTIMHKDI

SEQ ID NO: 20321 - protein, 9 aa, Homo Sapiens
QLMSLVGYV

SEQ ID NO: 20322 - protein, 9 aa, Homo Sapiens
TRGAPKPHE

SEQ ID NO: 20323 - protein, 9 aa, Homo Sapiens
SGKSPSPLP

SEQ ID NO: 20324 - protein, 9 aa, Homo Sapiens
SDPLELLQE

SEQ ID NO: 20325 - protein, 9 aa, Homo Sapiens
ISSASTGHA

SEQ ID NO: 20326 - protein, 9 aa, Homo Sapiens
DQALSKEED

SEQ ID NO: 20327 - protein, 9 aa, Homo Sapiens
LSLHFERAP

SEQ ID NO: 20328 - protein, 9 aa, Homo Sapiens
HLSELAEEE

SEQ ID NO: 20329 - protein, 9 aa, Homo Sapiens
SWGSDAQQS

SEQ ID NO: 20330 - protein, 9 aa, Homo Sapiens
LLGVVTDLK

SEQ ID NO: 20331 - protein, 9 aa, Homo Sapiens
LYNSAAAAP

SEQ ID NO: 20332 - protein, 9 aa, Homo Sapiens
ACREMESLS

SEQ ID NO: 20333 - protein, 9 aa, Homo Sapiens
RSMHNSTYG

SEQ ID NO: 20334 - protein, 9 aa, Homo Sapiens
TYTVAVAKG

SEQ ID NO: 20335 - protein, 9 aa, Homo Sapiens
SGSPADVIQ

SEQ ID NO: 20336 - protein, 9 aa, Homo Sapiens
DKSEECNRS

SEQ ID NO: 20337 - protein, 9 aa, Homo Sapiens
ANGGASLSL

SEQ ID NO: 20338 - protein, 9 aa, Homo Sapiens
GKHRAVSTC

SEQ ID NO: 20339 - protein, 9 aa, Homo Sapiens
SEYVQGKSP

SEQ ID NO: 20340 - protein, 9 aa, Homo Sapiens
TDHNKSSEV

SEQ ID NO: 20341 - protein, 9 aa, Homo Sapiens
KKDLRDRER

SEQ ID NO: 20342 - protein, 9 aa, Homo Sapiens
HGYSWKLWC

SEQ ID NO: 20343 - protein, 9 aa, Homo Sapiens
VDTECSHAK

SEQ ID NO: 20344 - protein, 9 aa, Homo Sapiens
HRRSLEAKD

SEQ ID NO: 20345 - protein, 9 aa, Homo Sapiens
FKAIDSSKK

SEQ ID NO: 20346 - protein, 9 aa, Homo Sapiens
APEFAMDYK

SEQ ID NO: 20347 - protein, 9 aa, Homo Sapiens
GGLCLMSVV

SEQ ID NO: 20348 - protein, 9 aa, Homo Sapiens
DQPEGPHTS

SEQ ID NO: 20349 - protein, 9 aa, Homo Sapiens
GDGNSESWT

SEQ ID NO: 20350 - protein, 9 aa, Homo Sapiens
AKLQEFANA

SEQ ID NO: 20351 - protein, 9 aa, Homo Sapiens
RPPEHQDSV

SEQ ID NO: 20352 - protein, 9 aa, Homo Sapiens
MCADGANDC

SEQ ID NO: 20353 - protein, 9 aa, Homo Sapiens
SPQAHLGAL

SEQ ID NO: 20354 - protein, 9 aa, Homo Sapiens
TVVFEYPLT

SEQ ID NO: 20355 - protein, 9 aa, Homo Sapiens
IGMYGLDFY

SEQ ID NO: 20356 - protein, 9 aa, Homo Sapiens
AQQELKHRQ

SEQ ID NO: 20357 - protein, 9 aa, Homo Sapiens
DTESGYTEQ

SEQ ID NO: 20358 - protein, 9 aa, Homo Sapiens
THGVFVLGP

SEQ ID NO: 20359 - protein, 9 aa, Homo Sapiens
LGLTVLGAF

SEQ ID NO: 20360 - protein, 9 aa, Homo Sapiens
DLLLVICHH

SEQ ID NO: 20361 - protein, 9 aa, Homo Sapiens
YIEIVTILI

SEQ ID NO: 20362 - protein, 9 aa, Homo Sapiens
ESGYTEQLF

SEQ ID NO: 20363 - protein, 9 aa, Homo Sapiens
GNQTDQEMV

SEQ ID NO: 20364 - protein, 9 aa, Homo Sapiens
RSDRSPSPS

SEQ ID NO: 20365 - protein, 9 aa, Homo Sapiens
RKNLRREQH

SEQ ID NO: 20366 - protein, 9 aa, Homo Sapiens
GEQFSFNTS

SEQ ID NO: 20367 - protein, 9 aa, Homo Sapiens
VALQFQKAC

SEQ ID NO: 20368 - protein, 9 aa, Homo Sapiens
CLGALGPAC

SEQ ID NO: 20369 - protein, 9 aa, Homo Sapiens
PLRSLRKDA

SEQ ID NO: 20370 - protein, 9 aa, Homo Sapiens
CNYPSSRAM

SEQ ID NO: 20371 - protein, 9 aa, Homo Sapiens
SLEAKDIFA

SEQ ID NO: 20372 - protein, 9 aa, Homo Sapiens
YTHKLCLLK

SEQ ID NO: 20373 - protein, 9 aa, Homo Sapiens
DETRIFQVL

SEQ ID NO: 20374 - protein, 9 aa, Homo Sapiens
VLALSVQTD

SEQ ID NO: 20375 - protein, 9 aa, Homo Sapiens
RLDEYNQLQ

SEQ ID NO: 20376 - protein, 9 aa, Homo Sapiens
EECNRSWPF

SEQ ID NO: 20377 - protein, 9 aa, Homo Sapiens
PSPLPTSPG

SEQ ID NO: 20378 - protein, 9 aa, Homo Sapiens
FLGLTEFFL

SEQ ID NO: 20379 - protein, 9 aa, Homo Sapiens
ALLHFFLLA

SEQ ID NO: 20380 - protein, 9 aa, Homo Sapiens
AFFREHLVR

SEQ ID NO: 20381 - protein, 9 aa, Homo Sapiens
VYIGSACLD

SEQ ID NO: 20382 - protein, 9 aa, Homo Sapiens
SINVGNLLI

SEQ ID NO: 20383 - protein, 9 aa, Homo Sapiens
NRKRHELAF

SEQ ID NO: 20384 - protein, 9 aa, Homo Sapiens
AHVQWMVVR

SEQ ID NO: 20385 - protein, 9 aa, Homo Sapiens
SRSIDAAFF

SEQ ID NO: 20386 - protein, 9 aa, Homo Sapiens
QLYVSEAPI

SEQ ID NO: 20387 - protein, 9 aa, Homo Sapiens
QMSTLMWRG

SEQ ID NO: 20388 - protein, 9 aa, Homo Sapiens
NSFRYWPRL

SEQ ID NO: 20389 - protein, 9 aa, Homo Sapiens
AHVRVCIPL

SEQ ID NO: 20390 - protein, 9 aa, Homo Sapiens
RLSRKLLEA

SEQ ID NO: 20391 - protein, 9 aa, Homo Sapiens
RGNEPRSDR

SEQ ID NO: 20392 - protein, 9 aa, Homo Sapiens
SETSVYFCA

SEQ ID NO: 20393 - protein, 9 aa, Homo Sapiens
HLTHHKRIQ

SEQ ID NO: 20394 - protein, 9 aa, Homo Sapiens
LSASEIRNL

SEQ ID NO: 20395 - protein, 9 aa, Homo Sapiens
FLAIRSQHS

SEQ ID NO: 20396 - protein, 9 aa, Homo Sapiens
SDVVDRVSD

SEQ ID NO: 20397 - protein, 9 aa, Homo Sapiens
HRSDCENEE

SEQ ID NO: 20398 - protein, 9 aa, Homo Sapiens
MQNLDNLGV

SEQ ID NO: 20399 - protein, 9 aa, Homo Sapiens
RRSRFVVRR

SEQ ID NO: 20400 - protein, 9 aa, Homo Sapiens
LNVPAFVAA

SEQ ID NO: 20401 - protein, 9 aa, Homo Sapiens
QQAGAVPLL

SEQ ID NO: 20402 - protein, 9 aa, Homo Sapiens
IQLKSRGVK

SEQ ID NO: 20403 - protein, 9 aa, Homo Sapiens
ADHPQHLRD

SEQ ID NO: 20404 - protein, 9 aa, Homo Sapiens
EPKAVHVAC

SEQ ID NO: 20405 - protein, 9 aa, Homo Sapiens
VFVLGPFDD

SEQ ID NO: 20406 - protein, 9 aa, Homo Sapiens
SCPRLSRKL

SEQ ID NO: 20407 - protein, 9 aa, Homo Sapiens
IRHAHQIAL

SEQ ID NO: 20408 - protein, 9 aa, Homo Sapiens
GALHRNRKM

SEQ ID NO: 20409 - protein, 9 aa, Homo Sapiens
TTLSDVVDR

SEQ ID NO: 20410 - protein, 9 aa, Homo Sapiens
LRVLYGNRG

SEQ ID NO: 20411 - protein, 9 aa, Homo Sapiens
NKVPLHASL

SEQ ID NO: 20412 - protein, 9 aa, Homo Sapiens
LDLCYNRIQ

SEQ ID NO: 20413 - protein, 9 aa, Homo Sapiens
PKAVHVACA

SEQ ID NO: 20414 - protein, 9 aa, Homo Sapiens
DCGQGFTLK

SEQ ID NO: 20415 - protein, 9 aa, Homo Sapiens
SQKELALLQ

SEQ ID NO: 20416 - protein, 9 aa, Homo Sapiens
AGKNARSIL

SEQ ID NO: 20417 - protein, 9 aa, Homo Sapiens
DVSLSEALY

SEQ ID NO: 20418 - protein, 9 aa, Homo Sapiens
FRVICIYIA

SEQ ID NO: 20419 - protein, 9 aa, Homo Sapiens
LSMFLAIRS

SEQ ID NO: 20420 - protein, 9 aa, Homo Sapiens
STQGKHRAV

SEQ ID NO: 20421 - protein, 9 aa, Homo Sapiens
INNYQVKCI

SEQ ID NO: 20422 - protein, 9 aa, Homo Sapiens
AMITELRSI

SEQ ID NO: 20423 - protein, 9 aa, Homo Sapiens
TKRPFKCQW

SEQ ID NO: 20424 - protein, 9 aa, Homo Sapiens
SPYSNPHRM

SEQ ID NO: 20425 - protein, 9 aa, Homo Sapiens
DILHRRSLE

SEQ ID NO: 20426 - protein, 9 aa, Homo Sapiens
KMSIIWFIQ

SEQ ID NO: 20427 - protein, 9 aa, Homo Sapiens
QSAESKEEE

SEQ ID NO: 20428 - protein, 9 aa, Homo Sapiens
TEISRKLFH

SEQ ID NO: 20429 - protein, 9 aa, Homo Sapiens
ITSDPLELL

SEQ ID NO: 20430 - protein, 9 aa, Homo Sapiens
SHDKEEDKQ

SEQ ID NO: 20431 - protein, 9 aa, Homo Sapiens
RKMKRNQVA

SEQ ID NO: 20432 - protein, 9 aa, Homo Sapiens
LDVSLSEAL

SEQ ID NO: 20433 - protein, 9 aa, Homo Sapiens
DASLGFHGG

SEQ ID NO: 20434 - protein, 9 aa, Homo Sapiens
QPQKIIYEE

SEQ ID NO: 20435 - protein, 9 aa, Homo Sapiens
KAQTVLHEQ

SEQ ID NO: 20436 - protein, 9 aa, Homo Sapiens
EFPALQETN

SEQ ID NO: 20437 - protein, 9 aa, Homo Sapiens
NARSILNSA

SEQ ID NO: 20438 - protein, 9 aa, Homo Sapiens
LNAHRSADA

SEQ ID NO: 20439 - protein, 9 aa, Homo Sapiens
LSVQTDYTF

SEQ ID NO: 20440 - protein, 9 aa, Homo Sapiens
DGTYIEELI

SEQ ID NO: 20441 - protein, 9 aa, Homo Sapiens
RKRYMQELL

SEQ ID NO: 20442 - protein, 9 aa, Homo Sapiens
NGHEHRSDC

SEQ ID NO: 20443 - protein, 9 aa, Homo Sapiens
MVFDLVTRQ

SEQ ID NO: 20444 - protein, 9 aa, Homo Sapiens
FQKACRVTE

SEQ ID NO: 20445 - protein, 9 aa, Homo Sapiens
PNNVTCVFD

SEQ ID NO: 20446 - protein, 9 aa, Homo Sapiens
CLTLCDFSI

SEQ ID NO: 20447 - protein, 9 aa, Homo Sapiens
EVKHLCPNV

SEQ ID NO: 20448 - protein, 9 aa, Homo Sapiens
RNQALAALL

SEQ ID NO: 20449 - protein, 9 aa, Homo Sapiens
CYNRIQRIP

SEQ ID NO: 20450 - protein, 9 aa, Homo Sapiens
APAALEAQT

SEQ ID NO: 20451 - protein, 9 aa, Homo Sapiens
MSQNYGLIH

SEQ ID NO: 20452 - protein, 9 aa, Homo Sapiens
LKQVRLQYI

SEQ ID NO: 20453 - protein, 9 aa, Homo Sapiens
SSASQKELA

SEQ ID NO: 20454 - protein, 9 aa, Homo Sapiens
SWTQPPPHP

SEQ ID NO: 20455 - protein, 9 aa, Homo Sapiens
LIFLRKKIL

SEQ ID NO: 20456 - protein, 9 aa, Homo Sapiens
YFIQPLSAA

SEQ ID NO: 20457 - protein, 9 aa, Homo Sapiens
IREVSFEST

SEQ ID NO: 20458 - protein, 9 aa, Homo Sapiens
QHDISFSVA

SEQ ID NO: 20459 - protein, 9 aa, Homo Sapiens
TDVRVAENN

SEQ ID NO: 20460 - protein, 9 aa, Homo Sapiens
DVVDRVSDT

SEQ ID NO: 20461 - protein, 9 aa, Homo Sapiens
VLSPQAHLG

SEQ ID NO: 20462 - protein, 9 aa, Homo Sapiens
GYILQDFNE

SEQ ID NO: 20463 - protein, 9 aa, Homo Sapiens
LKLCKNAGM

SEQ ID NO: 20464 - protein, 9 aa, Homo Sapiens
IDNYDSSGA

SEQ ID NO: 20465 - protein, 9 aa, Homo Sapiens
LNRKEKTAA

SEQ ID NO: 20466 - protein, 9 aa, Homo Sapiens
ATVAMEPGP

SEQ ID NO: 20467 - protein, 9 aa, Homo Sapiens
RGRKPALPS

SEQ ID NO: 20468 - protein, 9 aa, Homo Sapiens
AHGYSWKLW

SEQ ID NO: 20469 - protein, 9 aa, Homo Sapiens
WLNVPAFVA

SEQ ID NO: 20470 - protein, 9 aa, Homo Sapiens
VGQKRNQCL

SEQ ID NO: 20471 - protein, 9 aa, Homo Sapiens
QNPGKPRVG

SEQ ID NO: 20472 - protein, 9 aa, Homo Sapiens
KIYLTLHKP

SEQ ID NO: 20473 - protein, 9 aa, Homo Sapiens
ISSARSGLC

SEQ ID NO: 20474 - protein, 9 aa, Homo Sapiens
NHQRIHSTK

SEQ ID NO: 20475 - protein, 9 aa, Homo Sapiens
LKHRQRAEI

SEQ ID NO: 20476 - protein, 9 aa, Homo Sapiens
ESHMVEGQV

SEQ ID NO: 20477 - protein, 9 aa, Homo Sapiens
RIHSTKRPF

SEQ ID NO: 20478 - protein, 9 aa, Homo Sapiens
EPQPQKIIY

SEQ ID NO: 20479 - protein, 9 aa, Homo Sapiens
FALVNSTVT

SEQ ID NO: 20480 - protein, 9 aa, Homo Sapiens
NHSYFFKDT

SEQ ID NO: 20481 - protein, 9 aa, Homo Sapiens
DVIQEFAMT

SEQ ID NO: 20482 - protein, 9 aa, Homo Sapiens
AQGYSSPGI

SEQ ID NO: 20483 - protein, 9 aa, Homo Sapiens
FAVIQLVGM

SEQ ID NO: 20484 - protein, 9 aa, Homo Sapiens
SEAPDIWRI

SEQ ID NO: 20485 - protein, 9 aa, Homo Sapiens
DMETESDAE

SEQ ID NO: 20486 - protein, 9 aa, Homo Sapiens
WQQMLKVEL

SEQ ID NO: 20487 - protein, 9 aa, Homo Sapiens
EVPEITRTV

SEQ ID NO: 20488 - protein, 9 aa, Homo Sapiens
QARSLSVEF

SEQ ID NO: 20489 - protein, 9 aa, Homo Sapiens
ITVFYIAEG

SEQ ID NO: 20490 - protein, 9 aa, Homo Sapiens
WLWIVPSGL

SEQ ID NO: 20491 - protein, 9 aa, Homo Sapiens
ESKVKEHTF

SEQ ID NO: 20492 - protein, 9 aa, Homo Sapiens
VSRSNGTVT

SEQ ID NO: 20493 - protein, 9 aa, Homo Sapiens
TDSEKEIYN

SEQ ID NO: 20494 - protein, 9 aa, Homo Sapiens
GLGPLPDCA

SEQ ID NO: 20495 - protein, 9 aa, Homo Sapiens
DNLGVPWPL

SEQ ID NO: 20496 - protein, 9 aa, Homo Sapiens
KSCRPNNVT

SEQ ID NO: 20497 - protein, 9 aa, Homo Sapiens
CLTADSLRP

SEQ ID NO: 20498 - protein, 9 aa, Homo Sapiens
QQVFDDKAK

SEQ ID NO: 20499 - protein, 9 aa, Homo Sapiens
QRGLLAEVA

SEQ ID NO: 20500 - protein, 9 aa, Homo Sapiens
GTNNSRVLF

SEQ ID NO: 20501 - protein, 9 aa, Homo Sapiens
ESNKVPLHA

SEQ ID NO: 20502 - protein, 9 aa, Homo Sapiens
KDALDVSSE

SEQ ID NO: 20503 - protein, 9 aa, Homo Sapiens
IEKQRQKME

SEQ ID NO: 20504 - protein, 9 aa, Homo Sapiens
GESAAWRIY

SEQ ID NO: 20505 - protein, 9 aa, Homo Sapiens
PFRVICIYI

SEQ ID NO: 20506 - protein, 9 aa, Homo Sapiens
NNILLTYCM

SEQ ID NO: 20507 - protein, 9 aa, Homo Sapiens
LLRGWQQML

SEQ ID NO: 20508 - protein, 9 aa, Homo Sapiens
QPEPRYGYA

SEQ ID NO: 20509 - protein, 9 aa, Homo Sapiens
ILGSNFGVQ

SEQ ID NO: 20510 - protein, 9 aa, Homo Sapiens
YMQELLKQV

SEQ ID NO: 20511 - protein, 9 aa, Homo Sapiens
GGEEGRGGR

SEQ ID NO: 20512 - protein, 9 aa, Homo Sapiens
GLEAWWEVH

SEQ ID NO: 20513 - protein, 9 aa, Homo Sapiens
YQEQQAQTQ

SEQ ID NO: 20514 - protein, 9 aa, Homo Sapiens
RPAQGYSSP

SEQ ID NO: 20515 - protein, 9 aa, Homo Sapiens
TLASAVPSE

SEQ ID NO: 20516 - protein, 9 aa, Homo Sapiens
NFTDKSLFY

SEQ ID NO: 20517 - protein, 9 aa, Homo Sapiens
VFPSKRWGL

SEQ ID NO: 20518 - protein, 9 aa, Homo Sapiens
AAAAIDEKP

SEQ ID NO: 20519 - protein, 9 aa, Homo Sapiens
ETRIFQVLG

SEQ ID NO: 20520 - protein, 9 aa, Homo Sapiens
SEEVSLQKI

SEQ ID NO: 20521 - protein, 9 aa, Homo Sapiens
DSVTDVRVA

SEQ ID NO: 20522 - protein, 9 aa, Homo Sapiens
KGGQSAESK

SEQ ID NO: 20523 - protein, 9 aa, Homo Sapiens
TKRHKFEDI

SEQ ID NO: 20524 - protein, 9 aa, Homo Sapiens
MYLALVKLF

SEQ ID NO: 20525 - protein, 9 aa, Homo Sapiens
LAKSDEHLY

SEQ ID NO: 20526 - protein, 9 aa, Homo Sapiens
LCRDKMEEW

SEQ ID NO: 20527 - protein, 9 aa, Homo Sapiens
NQALAALLR

SEQ ID NO: 20528 - protein, 9 aa, Homo Sapiens
YRPWDSNEL

SEQ ID NO: 20529 - protein, 9 aa, Homo Sapiens
ITELRSINA

SEQ ID NO: 20530 - protein, 9 aa, Homo Sapiens
WPLCVMYAV

SEQ ID NO: 20531 - protein, 9 aa, Homo Sapiens
VSMLLIACA

SEQ ID NO: 20532 - protein, 9 aa, Homo Sapiens
TDSWNDRPQ

SEQ ID NO: 20533 - protein, 9 aa, Homo Sapiens
GCLGALGPA

SEQ ID NO: 20534 - protein, 9 aa, Homo Sapiens
GRAGGEEGR

SEQ ID NO: 20535 - protein, 9 aa, Homo Sapiens
QEEQAGPSC

SEQ ID NO: 20536 - protein, 9 aa, Homo Sapiens
PAQGMDIEE

SEQ ID NO: 20537 - protein, 9 aa, Homo Sapiens
HQEEAQYGA

SEQ ID NO: 20538 - protein, 9 aa, Homo Sapiens
CQNLKAGRF

SEQ ID NO: 20539 - protein, 9 aa, Homo Sapiens
GFSEPEYLA

SEQ ID NO: 20540 - protein, 9 aa, Homo Sapiens
YLRKMNKYL

SEQ ID NO: 20541 - protein, 9 aa, Homo Sapiens
KQGDPHELR

SEQ ID NO: 20542 - protein, 9 aa, Homo Sapiens
DISFSVADT

SEQ ID NO: 20543 - protein, 9 aa, Homo Sapiens
PDKSEECNR

SEQ ID NO: 20544 - protein, 9 aa, Homo Sapiens
QHQERHLAK

SEQ ID NO: 20545 - protein, 9 aa, Homo Sapiens
YLALVKLFN

SEQ ID NO: 20546 - protein, 9 aa, Homo Sapiens
DADLNPIKG

SEQ ID NO: 20547 - protein, 9 aa, Homo Sapiens
SQAIGPLTS

SEQ ID NO: 20548 - protein, 9 aa, Homo Sapiens
IYKIYLTLH

SEQ ID NO: 20549 - protein, 9 aa, Homo Sapiens
IIILPAQGM

SEQ ID NO: 20550 - protein, 9 aa, Homo Sapiens
GYRGTDCRN

SEQ ID NO: 20551 - protein, 9 aa, Homo Sapiens
LCAANILVG

SEQ ID NO: 20552 - protein, 9 aa, Homo Sapiens
VQKSGKVSK

SEQ ID NO: 20553 - protein, 9 aa, Homo Sapiens
CHKWLSVDT

SEQ ID NO: 20554 - protein, 9 aa, Homo Sapiens
TLLGFQNMS

SEQ ID NO: 20555 - protein, 9 aa, Homo Sapiens
LASAVPSET

SEQ ID NO: 20556 - protein, 9 aa, Homo Sapiens
MPVKYEQNS

SEQ ID NO: 20557 - protein, 9 aa, Homo Sapiens
SNPHRMSHY

SEQ ID NO: 20558 - protein, 9 aa, Homo Sapiens
WEVHKVGLL

SEQ ID NO: 20559 - protein, 9 aa, Homo Sapiens
SSVFKAIDS

SEQ ID NO: 20560 - protein, 9 aa, Homo Sapiens
LFQLVLKGW

SEQ ID NO: 20561 - protein, 9 aa, Homo Sapiens
VNSGGLTYI

SEQ ID NO: 20562 - protein, 9 aa, Homo Sapiens
HFPQVVKEC

SEQ ID NO: 20563 - protein, 9 aa, Homo Sapiens
KTVMAVLGA

SEQ ID NO: 20564 - protein, 9 aa, Homo Sapiens
LKGGNCLED

SEQ ID NO: 20565 - protein, 9 aa, Homo Sapiens
MNYVHRDLC

SEQ ID NO: 20566 - protein, 9 aa, Homo Sapiens
YKYIRELWR

SEQ ID NO: 20567 - protein, 9 aa, Homo Sapiens
VAKGKTFGT

SEQ ID NO: 20568 - protein, 9 aa, Homo Sapiens
NPAVHFPQV

SEQ ID NO: 20569 - protein, 9 aa, Homo Sapiens
VAMEPGPIA

SEQ ID NO: 20570 - protein, 9 aa, Homo Sapiens
VVQVLFQNT

SEQ ID NO: 20571 - protein, 9 aa, Homo Sapiens
IKYDPSIGM

SEQ ID NO: 20572 - protein, 9 aa, Homo Sapiens
AAPSEAPDI

SEQ ID NO: 20573 - protein, 9 aa, Homo Sapiens
DFSEDNPLE

SEQ ID NO: 20574 - protein, 9 aa, Homo Sapiens
QCHHILHTA

SEQ ID NO: 20575 - protein, 9 aa, Homo Sapiens
EPSCPGRGK

SEQ ID NO: 20576 - protein, 9 aa, Homo Sapiens
RSGLCGLGS

SEQ ID NO: 20577 - protein, 9 aa, Homo Sapiens
GAYKYIREL

SEQ ID NO: 20578 - protein, 9 aa, Homo Sapiens
RDLLASHSE

SEQ ID NO: 20579 - protein, 9 aa, Homo Sapiens
INNREQKLH

SEQ ID NO: 20580 - protein, 9 aa, Homo Sapiens
PHRVRLPKS

SEQ ID NO: 20581 - protein, 9 aa, Homo Sapiens
TNVASLWQE

SEQ ID NO: 20582 - protein, 9 aa, Homo Sapiens
LTVLIAMEP

SEQ ID NO: 20583 - protein, 9 aa, Homo Sapiens
WGSDAQQST

SEQ ID NO: 20584 - protein, 9 aa, Homo Sapiens
PDNHSYFFK

SEQ ID NO: 20585 - protein, 9 aa, Homo Sapiens
ELKHRQRAE

SEQ ID NO: 20586 - protein, 9 aa, Homo Sapiens
AGDASLGFH

SEQ ID NO: 20587 - protein, 9 aa, Homo Sapiens
RDKMEEWSA

SEQ ID NO: 20588 - protein, 9 aa, Homo Sapiens
PAPGRPRQL

SEQ ID NO: 20589 - protein, 9 aa, Homo Sapiens
PTDSEKEIY

SEQ ID NO: 20590 - protein, 9 aa, Homo Sapiens
QYSLLAKYA

SEQ ID NO: 20591 - protein, 9 aa, Homo Sapiens
AIDEKPKET

SEQ ID NO: 20592 - protein, 9 aa, Homo Sapiens
PPIATHAPS

SEQ ID NO: 20593 - protein, 9 aa, Homo Sapiens
AEKSRKSND

SEQ ID NO: 20594 - protein, 9 aa, Homo Sapiens
QGFTLKPNL

SEQ ID NO: 20595 - protein, 9 aa, Homo Sapiens
LLKLCKNAG

SEQ ID NO: 20596 - protein, 9 aa, Homo Sapiens
YVLRFLPAF

SEQ ID NO: 20597 - protein, 9 aa, Homo Sapiens
ADIELSRNQ

SEQ ID NO: 20598 - protein, 9 aa, Homo Sapiens
LDLSGSRQG

SEQ ID NO: 20599 - protein, 9 aa, Homo Sapiens
VACADSLPR

SEQ ID NO: 20600 - protein, 9 aa, Homo Sapiens
RQMIFNMLK

SEQ ID NO: 20601 - protein, 9 aa, Homo Sapiens
SRVLFNLLP

SEQ ID NO: 20602 - protein, 9 aa, Homo Sapiens
HSPCGACTL

SEQ ID NO: 20603 - protein, 9 aa, Homo Sapiens
STVSTELAL

SEQ ID NO: 20604 - protein, 9 aa, Homo Sapiens
LGNMGKAKG

SEQ ID NO: 20605 - protein, 9 aa, Homo Sapiens
EEDILSMFL

SEQ ID NO: 20606 - protein, 9 aa, Homo Sapiens
SFESTGESE

SEQ ID NO: 20607 - protein, 9 aa, Homo Sapiens
NECGAKGSW

SEQ ID NO: 20608 - protein, 9 aa, Homo Sapiens
RSCKRPKNQ

SEQ ID NO: 20609 - protein, 9 aa, Homo Sapiens
VELQSAFEE

SEQ ID NO: 20610 - protein, 9 aa, Homo Sapiens
GLGKATRVS

SEQ ID NO: 20611 - protein, 9 aa, Homo Sapiens
SQRGFYACS

SEQ ID NO: 20612 - protein, 9 aa, Homo Sapiens
QPLLEVLSP

SEQ ID NO: 20613 - protein, 9 aa, Homo Sapiens
RPKNQLFLF

SEQ ID NO: 20614 - protein, 9 aa, Homo Sapiens
KSFLDLVVK

SEQ ID NO: 20615 - protein, 9 aa, Homo Sapiens
ALSKEEDME

SEQ ID NO: 20616 - protein, 9 aa, Homo Sapiens
PGILGPPGV

SEQ ID NO: 20617 - protein, 9 aa, Homo Sapiens
AVFPSKRWG

SEQ ID NO: 20618 - protein, 9 aa, Homo Sapiens
NLENRALQP

SEQ ID NO: 20619 - protein, 9 aa, Homo Sapiens
IFLGLTEFF

SEQ ID NO: 20620 - protein, 9 aa, Homo Sapiens
QKMELAKQQ

SEQ ID NO: 20621 - protein, 9 aa, Homo Sapiens
VSVATRDQD

SEQ ID NO: 20622 - protein, 9 aa, Homo Sapiens
QRQAEKEEE

SEQ ID NO: 20623 - protein, 9 aa, Homo Sapiens
EYLAEYSAE

SEQ ID NO: 20624 - protein, 9 aa, Homo Sapiens
EGPQIAVRM

SEQ ID NO: 20625 - protein, 9 aa, Homo Sapiens
HTRQARSLS

SEQ ID NO: 20626 - protein, 9 aa, Homo Sapiens
GDEQKRGAE

SEQ ID NO: 20627 - protein, 9 aa, Homo Sapiens
SFLDLVVKL

SEQ ID NO: 20628 - protein, 9 aa, Homo Sapiens
LGLCNYPSS

SEQ ID NO: 20629 - protein, 9 aa, Homo Sapiens
PPHRVRLPK

SEQ ID NO: 20630 - protein, 9 aa, Homo Sapiens
KYDPSIGMY

SEQ ID NO: 20631 - protein, 9 aa, Homo Sapiens
SHSWLSWPL

SEQ ID NO: 20632 - protein, 9 aa, Homo Sapiens
LCYNRIQRI

SEQ ID NO: 20633 - protein, 9 aa, Homo Sapiens
SVGQKRNQC

SEQ ID NO: 20634 - protein, 9 aa, Homo Sapiens
VLVCQLEQG

SEQ ID NO: 20635 - protein, 9 aa, Homo Sapiens
LEDLLCILK

SEQ ID NO: 20636 - protein, 9 aa, Homo Sapiens
HKANGQHDI

SEQ ID NO: 20637 - protein, 9 aa, Homo Sapiens
ATLGLLFQL

SEQ ID NO: 20638 - protein, 9 aa, Homo Sapiens
DTPEGTIIG

SEQ ID NO: 20639 - protein, 9 aa, Homo Sapiens
YLDLSGSRQ

SEQ ID NO: 20640 - protein, 9 aa, Homo Sapiens
PEGTIIGAV

SEQ ID NO: 20641 - protein, 9 aa, Homo Sapiens
SAVPSETSV

SEQ ID NO: 20642 - protein, 9 aa, Homo Sapiens
LHFFLLAAF

SEQ ID NO: 20643 - protein, 9 aa, Homo Sapiens
IASEHSAWP

SEQ ID NO: 20644 - protein, 9 aa, Homo Sapiens
HAKGSRSQG

SEQ ID NO: 20645 - protein, 9 aa, Homo Sapiens
QSAKETEKS

SEQ ID NO: 20646 - protein, 9 aa, Homo Sapiens
APTDLVFML

SEQ ID NO: 20647 - protein, 9 aa, Homo Sapiens
KRVVQVLFQ

SEQ ID NO: 20648 - protein, 9 aa, Homo Sapiens
PHRMSHYTI

SEQ ID NO: 20649 - protein, 9 aa, Homo Sapiens
FSEPVPLSK

SEQ ID NO: 20650 - protein, 9 aa, Homo Sapiens
DEYNQLQLQ

SEQ ID NO: 20651 - protein, 9 aa, Homo Sapiens
LSPQAHLGA

SEQ ID NO: 20652 - protein, 9 aa, Homo Sapiens
RALDRESVF

SEQ ID NO: 20653 - protein, 9 aa, Homo Sapiens
SEHLSELAE

SEQ ID NO: 20654 - protein, 9 aa, Homo Sapiens
TSTSLLCSR

SEQ ID NO: 20655 - protein, 9 aa, Homo Sapiens
ALDVSSEAT

SEQ ID NO: 20656 - protein, 9 aa, Homo Sapiens
PDAPAEPDA

SEQ ID NO: 20657 - protein, 9 aa, Homo Sapiens
KRHKFEDIE

SEQ ID NO: 20658 - protein, 9 aa, Homo Sapiens
LGVVTDLKQ

SEQ ID NO: 20659 - protein, 9 aa, Homo Sapiens
VLGAFLNLV

SEQ ID NO: 20660 - protein, 9 aa, Homo Sapiens
AHELNEQKR

SEQ ID NO: 20661 - protein, 9 aa, Homo Sapiens
VAVELQSAF

SEQ ID NO: 20662 - protein, 9 aa, Homo Sapiens
SYLFIMVAI

SEQ ID NO: 20663 - protein, 9 aa, Homo Sapiens
VLSLEKKDL

SEQ ID NO: 20664 - protein, 9 aa, Homo Sapiens
SKDALDVSS

SEQ ID NO: 20665 - protein, 9 aa, Homo Sapiens
LELKPKSLD

SEQ ID NO: 20666 - protein, 9 aa, Homo Sapiens
VKVQTTKQG

SEQ ID NO: 20667 - protein, 9 aa, Homo Sapiens
GNLLIVFDD

SEQ ID NO: 20668 - protein, 9 aa, Homo Sapiens
QGQGLLLYN

SEQ ID NO: 20669 - protein, 9 aa, Homo Sapiens
CSAKAPNDF

SEQ ID NO: 20670 - protein, 9 aa, Homo Sapiens
KGKTFGTFS

SEQ ID NO: 20671 - protein, 9 aa, Homo Sapiens
HDKEEDKQE

SEQ ID NO: 20672 - protein, 9 aa, Homo Sapiens
SLSAPEKIT

SEQ ID NO: 20673 - protein, 9 aa, Homo Sapiens
FYQEQQAQT

SEQ ID NO: 20674 - protein, 9 aa, Homo Sapiens
LWPDKSEEC

SEQ ID NO: 20675 - protein, 9 aa, Homo Sapiens
ELVATVAME

SEQ ID NO: 20676 - protein, 9 aa, Homo Sapiens
HLCPNVPII

SEQ ID NO: 20677 - protein, 9 aa, Homo Sapiens
QDLESHMRE

SEQ ID NO: 20678 - protein, 9 aa, Homo Sapiens
LSVTSRDSE

SEQ ID NO: 20679 - protein, 9 aa, Homo Sapiens
EFAMDYKTT

SEQ ID NO: 20680 - protein, 9 aa, Homo Sapiens
CVGMCADGA

SEQ ID NO: 20681 - protein, 9 aa, Homo Sapiens
AAYLRMHAV

SEQ ID NO: 20682 - protein, 9 aa, Homo Sapiens
KRRMQNLDN

SEQ ID NO: 20683 - protein, 9 aa, Homo Sapiens
LGGGGLCLM

SEQ ID NO: 20684 - protein, 9 aa, Homo Sapiens
TNNSRVLFN

SEQ ID NO: 20685 - protein, 9 aa, Homo Sapiens
VPAFVAAVA

SEQ ID NO: 20686 - protein, 9 aa, Homo Sapiens
SPDCAVGVQ

SEQ ID NO: 20687 - protein, 9 aa, Homo Sapiens
EDKPPHRVR

SEQ ID NO: 20688 - protein, 9 aa, Homo Sapiens
IFHSGNNPY

SEQ ID NO: 20689 - protein, 9 aa, Homo Sapiens
LGPFDDLKH

SEQ ID NO: 20690 - protein, 9 aa, Homo Sapiens
KGGNCLEDL

SEQ ID NO: 20691 - protein, 9 aa, Homo Sapiens
GMGHNVATG

SEQ ID NO: 20692 - protein, 9 aa, Homo Sapiens
VLGVLNRKR

SEQ ID NO: 20693 - protein, 9 aa, Homo Sapiens
FVGYIEIVT

SEQ ID NO: 20694 - protein, 9 aa, Homo Sapiens
SWNDRPQEI

SEQ ID NO: 20695 - protein, 9 aa, Homo Sapiens
LENAPLCHS

SEQ ID NO: 20696 - protein, 9 aa, Homo Sapiens
TENSFYTLP

SEQ ID NO: 20697 - protein, 9 aa, Homo Sapiens
NNSRVLFNL

SEQ ID NO: 20698 - protein, 9 aa, Homo Sapiens
KTECALLGV

SEQ ID NO: 20699 - protein, 9 aa, Homo Sapiens
AKKEQPGGA

SEQ ID NO: 20700 - protein, 9 aa, Homo Sapiens
SVPTNLAQQ

SEQ ID NO: 20701 - protein, 9 aa, Homo Sapiens
RPRGQDGKP

SEQ ID NO: 20702 - protein, 9 aa, Homo Sapiens
NLMHMSYEA

SEQ ID NO: 20703 - protein, 9 aa, Homo Sapiens
LINFTDKSL

SEQ ID NO: 20704 - protein, 9 aa, Homo Sapiens
SIGMYGLDF

SEQ ID NO: 20705 - protein, 9 aa, Homo Sapiens
ALSLSPAPT

SEQ ID NO: 20706 - protein, 9 aa, Homo Sapiens
MSYEAGILE

SEQ ID NO: 20707 - protein, 9 aa, Homo Sapiens
YLSSPDCAV

SEQ ID NO: 20708 - protein, 9 aa, Homo Sapiens
QKACRVTET

SEQ ID NO: 20709 - protein, 9 aa, Homo Sapiens
EKVRTLVFA

SEQ ID NO: 20710 - protein, 9 aa, Homo Sapiens
LLAAFTWMF

SEQ ID NO: 20711 - protein, 9 aa, Homo Sapiens
KTFEISIGK

SEQ ID NO: 20712 - protein, 9 aa, Homo Sapiens
PSWLNVPAF

SEQ ID NO: 20713 - protein, 9 aa, Homo Sapiens
RGDLEDLKE

SEQ ID NO: 20714 - protein, 9 aa, Homo Sapiens
GACTLWRKD

SEQ ID NO: 20715 - protein, 9 aa, Homo Sapiens
DKGRVQAEC

SEQ ID NO: 20716 - protein, 9 aa, Homo Sapiens
PQHLRDRTC

SEQ ID NO: 20717 - protein, 9 aa, Homo Sapiens
YRKFSTEVT

SEQ ID NO: 20718 - protein, 9 aa, Homo Sapiens
VKMSIIWFI

SEQ ID NO: 20719 - protein, 9 aa, Homo Sapiens
HVYIGSACL

SEQ ID NO: 20720 - protein, 9 aa, Homo Sapiens
LLYNSAAAA

SEQ ID NO: 20721 - protein, 9 aa, Homo Sapiens
CQRLKGMKD

SEQ ID NO: 20722 - protein, 9 aa, Homo Sapiens
KSDEHLYKT

SEQ ID NO: 20723 - protein, 9 aa, Homo Sapiens
FEYPLTIQN

SEQ ID NO: 20724 - protein, 9 aa, Homo Sapiens
HMYLALVKL

SEQ ID NO: 20725 - protein, 9 aa, Homo Sapiens
MSQTSSYFM

SEQ ID NO: 20726 - protein, 9 aa, Homo Sapiens
IGSACLDWQ

SEQ ID NO: 20727 - protein, 9 aa, Homo Sapiens
KALHTEPQN

SEQ ID NO: 20728 - protein, 9 aa, Homo Sapiens
QLGLELKPK

SEQ ID NO: 20729 - protein, 9 aa, Homo Sapiens
FHSGNNPYG

SEQ ID NO: 20730 - protein, 9 aa, Homo Sapiens
ECSHAKGSR

SEQ ID NO: 20731 - protein, 9 aa, Homo Sapiens
CCYDCVDCK

SEQ ID NO: 20732 - protein, 9 aa, Homo Sapiens
PKEPEPTPG

SEQ ID NO: 20733 - protein, 9 aa, Homo Sapiens
GILQLGLEL

SEQ ID NO: 20734 - protein, 9 aa, Homo Sapiens
SASQKELAL

SEQ ID NO: 20735 - protein, 9 aa, Homo Sapiens
DGSVRYTHK

SEQ ID NO: 20736 - protein, 9 aa, Homo Sapiens
EVEVKNAKL

SEQ ID NO: 20737 - protein, 9 aa, Homo Sapiens
SHLTHHKRI

SEQ ID NO: 20738 - protein, 9 aa, Homo Sapiens
TLSYQKSGK

SEQ ID NO: 20739 - protein, 9 aa, Homo Sapiens
AAHELNEQK

SEQ ID NO: 20740 - protein, 9 aa, Homo Sapiens
RVLGVLNRK

SEQ ID NO: 20741 - protein, 9 aa, Homo Sapiens
QQELKHRQR

SEQ ID NO: 20742 - protein, 9 aa, Homo Sapiens
PDIWRIVSL

SEQ ID NO: 20743 - protein, 9 aa, Homo Sapiens
KVKEHTFIS

SEQ ID NO: 20744 - protein, 9 aa, Homo Sapiens
MLFVREPLE

SEQ ID NO: 20745 - protein, 9 aa, Homo Sapiens
EGGRENSFR

SEQ ID NO: 20746 - protein, 9 aa, Homo Sapiens
VPSETSVYF

SEQ ID NO: 20747 - protein, 9 aa, Homo Sapiens
EGQVKEQRL

SEQ ID NO: 20748 - protein, 9 aa, Homo Sapiens
NGGASLSLH

SEQ ID NO: 20749 - protein, 9 aa, Homo Sapiens
SHMRELIYT

SEQ ID NO: 20750 - protein, 9 aa, Homo Sapiens
DLCYNRIQR

SEQ ID NO: 20751 - protein, 9 aa, Homo Sapiens
GLELKPKSL

SEQ ID NO: 20752 - protein, 9 aa, Homo Sapiens
DQDGTYIEE

SEQ ID NO: 20753 - protein, 9 aa, Homo Sapiens
CGESAAWRI

SEQ ID NO: 20754 - protein, 9 aa, Homo Sapiens
EDSHQEEAQ

SEQ ID NO: 20755 - protein, 9 aa, Homo Sapiens
GNLVSMLLI

SEQ ID NO: 20756 - protein, 9 aa, Homo Sapiens
RRAPEKELP

SEQ ID NO: 20757 - protein, 9 aa, Homo Sapiens
GYICGESAA

SEQ ID NO: 20758 - protein, 9 aa, Homo Sapiens
NFSGSQPYF

SEQ ID NO: 20759 - protein, 9 aa, Homo Sapiens
SQDQWDGLG

SEQ ID NO: 20760 - protein, 9 aa, Homo Sapiens
AKGEPGSNV

SEQ ID NO: 20761 - protein, 9 aa, Homo Sapiens
REILDAMNP

SEQ ID NO: 20762 - protein, 9 aa, Homo Sapiens
QLVLKGWES

SEQ ID NO: 20763 - protein, 9 aa, Homo Sapiens
ALNAHRSAD

SEQ ID NO: 20764 - protein, 9 aa, Homo Sapiens
YYAGKNARS

SEQ ID NO: 20765 - protein, 9 aa, Homo Sapiens
NPDCGIPLS

SEQ ID NO: 20766 - protein, 9 aa, Homo Sapiens
CTSINVLCV

SEQ ID NO: 20767 - protein, 9 aa, Homo Sapiens
KTAAEKSRK

SEQ ID NO: 20768 - protein, 9 aa, Homo Sapiens
YIGSACLDW

SEQ ID NO: 20769 - protein, 9 aa, Homo Sapiens
VTDVRVAEN

SEQ ID NO: 20770 - protein, 9 aa, Homo Sapiens
PRAEVRCRA

SEQ ID NO: 20771 - protein, 9 aa, Homo Sapiens
IDICALFKS

SEQ ID NO: 20772 - protein, 9 aa, Homo Sapiens
FEAHMARCT

SEQ ID NO: 20773 - protein, 9 aa, Homo Sapiens
LMWRGPEDV

SEQ ID NO: 20774 - protein, 9 aa, Homo Sapiens
TVMAVLGAF

SEQ ID NO: 20775 - protein, 9 aa, Homo Sapiens
LLKQVRLQY

SEQ ID NO: 20776 - protein, 9 aa, Homo Sapiens
VDADLNPIK

SEQ ID NO: 20777 - protein, 9 aa, Homo Sapiens
FEASECKES

SEQ ID NO: 20778 - protein, 9 aa, Homo Sapiens
LESHMRELI

SEQ ID NO: 20779 - protein, 9 aa, Homo Sapiens
KLMKEKRKM

SEQ ID NO: 20780 - protein, 9 aa, Homo Sapiens
GAPSVENVR

SEQ ID NO: 20781 - protein, 9 aa, Homo Sapiens
KALNAHRSA

SEQ ID NO: 20782 - protein, 9 aa, Homo Sapiens
TAPTDLVFM

SEQ ID NO: 20783 - protein, 9 aa, Homo Sapiens
LLYRGADIN

SEQ ID NO: 20784 - protein, 9 aa, Homo Sapiens
LLLIFLRKK

SEQ ID NO: 20785 - protein, 9 aa, Homo Sapiens
KMTSSDVEA

SEQ ID NO: 20786 - protein, 9 aa, Homo Sapiens
LGLELKPKS

SEQ ID NO: 20787 - protein, 9 aa, Homo Sapiens
AKGSWQVGI

SEQ ID NO: 20788 - protein, 9 aa, Homo Sapiens
TDEVLKLLY

SEQ ID NO: 20789 - protein, 9 aa, Homo Sapiens
LDLVVKLEK

SEQ ID NO: 20790 - protein, 9 aa, Homo Sapiens
HDSPDSSPP

SEQ ID NO: 20791 - protein, 9 aa, Homo Sapiens
HQRIHSTKR

SEQ ID NO: 20792 - protein, 9 aa, Homo Sapiens
TALDVQKSG

SEQ ID NO: 20793 - protein, 9 aa, Homo Sapiens
FKVLLVETP

SEQ ID NO: 20794 - protein, 9 aa, Homo Sapiens
LLGFQNMSW

SEQ ID NO: 20795 - protein, 9 aa, Homo Sapiens
PEPRYGYAP

SEQ ID NO: 20796 - protein, 9 aa, Homo Sapiens
SMCGHVVLA

SEQ ID NO: 20797 - protein, 9 aa, Homo Sapiens
LDKMMVEQT

SEQ ID NO: 20798 - protein, 9 aa, Homo Sapiens
GELFDPDIQ

SEQ ID NO: 20799 - protein, 9 aa, Homo Sapiens
PLAAKKEQP

SEQ ID NO: 20800 - protein, 9 aa, Homo Sapiens
LSWPLCVMY

SEQ ID NO: 20801 - protein, 9 aa, Homo Sapiens
SLVGYVLRF

SEQ ID NO: 20802 - protein, 9 aa, Homo Sapiens
QNDYLRKMN

SEQ ID NO: 20803 - protein, 9 aa, Homo Sapiens
LRKHDGQFA

SEQ ID NO: 20804 - protein, 9 aa, Homo Sapiens
HNVATGTFA

SEQ ID NO: 20805 - protein, 9 aa, Homo Sapiens
SDNTWISYS

SEQ ID NO: 20806 - protein, 9 aa, Homo Sapiens
DEDITKTFE

SEQ ID NO: 20807 - protein, 9 aa, Homo Sapiens
LKSDGIPMC

SEQ ID NO: 20808 - protein, 9 aa, Homo Sapiens
GLCLMSVVC

SEQ ID NO: 20809 - protein, 9 aa, Homo Sapiens
NPGKPRVGK

SEQ ID NO: 20810 - protein, 9 aa, Homo Sapiens
PLERLVSAF

SEQ ID NO: 20811 - protein, 9 aa, Homo Sapiens
TILGSNFGV

SEQ ID NO: 20812 - protein, 9 aa, Homo Sapiens
NAKLEEEQS

SEQ ID NO: 20813 - protein, 9 aa, Homo Sapiens
SASTENSFY

SEQ ID NO: 20814 - protein, 9 aa, Homo Sapiens
EEDEAEDSA

SEQ ID NO: 20815 - protein, 9 aa, Homo Sapiens
QDGTYIEEL

SEQ ID NO: 20816 - protein, 9 aa, Homo Sapiens
HRYASGHKN

SEQ ID NO: 20817 - protein, 9 aa, Homo Sapiens
GVPWPLLPG

SEQ ID NO: 20818 - protein, 9 aa, Homo Sapiens
AVLGAFVVC

SEQ ID NO: 20819 - protein, 9 aa, Homo Sapiens
NLVSMLLIA

SEQ ID NO: 20820 - protein, 9 aa, Homo Sapiens
IATHAPSIT

SEQ ID NO: 20821 - protein, 9 aa, Homo Sapiens
STTCGLGKA

SEQ ID NO: 20822 - protein, 9 aa, Homo Sapiens
GVFDHMKVA

SEQ ID NO: 20823 - protein, 9 aa, Homo Sapiens
VVCIKDGCG

SEQ ID NO: 20824 - protein, 9 aa, Homo Sapiens
STLAQTAAG

SEQ ID NO: 20825 - protein, 9 aa, Homo Sapiens
GGYSVCGET

SEQ ID NO: 20826 - protein, 9 aa, Homo Sapiens
AIPRGKIYK

SEQ ID NO: 20827 - protein, 9 aa, Homo Sapiens
DEVLSLEKK

SEQ ID NO: 20828 - protein, 9 aa, Homo Sapiens
DNAKLQEFA

SEQ ID NO: 20829 - protein, 9 aa, Homo Sapiens
LIIILPAQG

SEQ ID NO: 20830 - protein, 9 aa, Homo Sapiens
DCVDCKAGS

SEQ ID NO: 20831 - protein, 9 aa, Homo Sapiens
VLSILLDLA

SEQ ID NO: 20832 - protein, 9 aa, Homo Sapiens
ERYEDSHQE

SEQ ID NO: 20833 - protein, 9 aa, Homo Sapiens
LQNSIHSLT

SEQ ID NO: 20834 - protein, 9 aa, Homo Sapiens
RLTSHSMLP

SEQ ID NO: 20835 - protein, 9 aa, Homo Sapiens
AVAKGKTFG

SEQ ID NO: 20836 - protein, 9 aa, Homo Sapiens
QQSTSGQPY

SEQ ID NO: 20837 - protein, 9 aa, Homo Sapiens
TMRLCSAKA

SEQ ID NO: 20838 - protein, 9 aa, Homo Sapiens
PQIAVRMLA

SEQ ID NO: 20839 - protein, 9 aa, Homo Sapiens
KNAGMNVDI

SEQ ID NO: 20840 - protein, 9 aa, Homo Sapiens
VGNQTDQEM

SEQ ID NO: 20841 - protein, 9 aa, Homo Sapiens
GLTVLGAFL

SEQ ID NO: 20842 - protein, 9 aa, Homo Sapiens
TKLSYRPWD

SEQ ID NO: 20843 - protein, 9 aa, Homo Sapiens
SSQRGFYAC

SEQ ID NO: 20844 - protein, 9 aa, Homo Sapiens
SKTIASEHS

SEQ ID NO: 20845 - protein, 9 aa, Homo Sapiens
STEPSCPGR

SEQ ID NO: 20846 - protein, 9 aa, Homo Sapiens
HIQPDYYNT

SEQ ID NO: 20847 - protein, 9 aa, Homo Sapiens
EAHKINNRE

SEQ ID NO: 20848 - protein, 9 aa, Homo Sapiens
YLRMHAVKD

SEQ ID NO: 20849 - protein, 9 aa, Homo Sapiens
ALEAQTTAP

SEQ ID NO: 20850 - protein, 9 aa, Homo Sapiens
NDVNENPPI

SEQ ID NO: 20851 - protein, 9 aa, Homo Sapiens
IADQEEQAG

SEQ ID NO: 20852 - protein, 9 aa, Homo Sapiens
ERCPHRPIL

SEQ ID NO: 20853 - protein, 9 aa, Homo Sapiens
SSPPRRPQH

SEQ ID NO: 20854 - protein, 9 aa, Homo Sapiens
TIMHKDIQL

SEQ ID NO: 20855 - protein, 9 aa, Homo Sapiens
ECNRSWPFN

SEQ ID NO: 20856 - protein, 9 aa, Homo Sapiens
SNVDQGPKG

SEQ ID NO: 20857 - protein, 9 aa, Homo Sapiens
SQTSSYFML

SEQ ID NO: 20858 - protein, 9 aa, Homo Sapiens
WNDRPQEIA

SEQ ID NO: 20859 - protein, 9 aa, Homo Sapiens
LLEVLSPQA

SEQ ID NO: 20860 - protein, 9 aa, Homo Sapiens
GVVTDLKQD

SEQ ID NO: 20861 - protein, 9 aa, Homo Sapiens
FIGMYSAPR

SEQ ID NO: 20862 - protein, 9 aa, Homo Sapiens
TESGYTEQL

SEQ ID NO: 20863 - protein, 9 aa, Homo Sapiens
MLIAFTKRH

SEQ ID NO: 20864 - protein, 9 aa, Homo Sapiens
PFICKQCGK

SEQ ID NO: 20865 - protein, 9 aa, Homo Sapiens
KTIASEHSA

SEQ ID NO: 20866 - protein, 9 aa, Homo Sapiens
ALDCCVCVL

SEQ ID NO: 20867 - protein, 9 aa, Homo Sapiens
GAPCQNLKA

SEQ ID NO: 20868 - protein, 9 aa, Homo Sapiens
LCKNAGMNV

SEQ ID NO: 20869 - protein, 9 aa, Homo Sapiens
LFEAHMARC

SEQ ID NO: 20870 - protein, 9 aa, Homo Sapiens
ELKLNRKTL

SEQ ID NO: 20871 - protein, 9 aa, Homo Sapiens
RVQAECLKP

SEQ ID NO: 20872 - protein, 9 aa, Homo Sapiens
SHRYASGHK

SEQ ID NO: 20873 - protein, 9 aa, Homo Sapiens
EAYFIQPLS

SEQ ID NO: 20874 - protein, 9 aa, Homo Sapiens
RETHKITVF

SEQ ID NO: 20875 - protein, 9 aa, Homo Sapiens
LSETKNPLR

SEQ ID NO: 20876 - protein, 9 aa, Homo Sapiens
SETKNPLRV

SEQ ID NO: 20877 - protein, 9 aa, Homo Sapiens
LAQTAAGGQ

SEQ ID NO: 20878 - protein, 9 aa, Homo Sapiens
KKHIQPDYY

SEQ ID NO: 20879 - protein, 9 aa, Homo Sapiens
SIQSAKETE

SEQ ID NO: 20880 - protein, 9 aa, Homo Sapiens
GGQSAESKE

SEQ ID NO: 20881 - protein, 9 aa, Homo Sapiens
ACTSETEQD

SEQ ID NO: 20882 - protein, 9 aa, Homo Sapiens
PEFAMDYKT

SEQ ID NO: 20883 - protein, 9 aa, Homo Sapiens
RNMSYRKKS

SEQ ID NO: 20884 - protein, 9 aa, Homo Sapiens
SLHFERAPF

SEQ ID NO: 20885 - protein, 9 aa, Homo Sapiens
FYTLPRLKT

SEQ ID NO: 20886 - protein, 9 aa, Homo Sapiens
DILSMFLAI

SEQ ID NO: 20887 - protein, 9 aa, Homo Sapiens
PIATHAPSI

SEQ ID NO: 20888 - protein, 9 aa, Homo Sapiens
LRMHAVKDH

SEQ ID NO: 20889 - protein, 9 aa, Homo Sapiens
NLLIVFDDD

SEQ ID NO: 20890 - protein, 9 aa, Homo Sapiens
EVTLNTVGH

SEQ ID NO: 20891 - protein, 9 aa, Homo Sapiens
DGLGPLPDC

SEQ ID NO: 20892 - protein, 9 aa, Homo Sapiens
SILLDLAPN

SEQ ID NO: 20893 - protein, 9 aa, Homo Sapiens
LLSTKDEDI

SEQ ID NO: 20894 - protein, 9 aa, Homo Sapiens
GQFAVIQLV

SEQ ID NO: 20895 - protein, 9 aa, Homo Sapiens
LHSPCGACT

SEQ ID NO: 20896 - protein, 9 aa, Homo Sapiens
SAQQELKHR

SEQ ID NO: 20897 - protein, 9 aa, Homo Sapiens
LKLNRKTLV

SEQ ID NO: 20898 - protein, 9 aa, Homo Sapiens
QNMSWIRGR

SEQ ID NO: 20899 - protein, 9 aa, Homo Sapiens
ASLSLHFER

SEQ ID NO: 20900 - protein, 9 aa, Homo Sapiens
CKAGSYRQN

SEQ ID NO: 20901 - protein, 9 aa, Homo Sapiens
FYIPYQPKD

SEQ ID NO: 20902 - protein, 9 aa, Homo Sapiens
VGNLLIVFD

SEQ ID NO: 20903 - protein, 9 aa, Homo Sapiens
RCTSINVLC

SEQ ID NO: 20904 - protein, 9 aa, Homo Sapiens
TAAEKSRKS

SEQ ID NO: 20905 - protein, 9 aa, Homo Sapiens
VPLKGGNCL

SEQ ID NO: 20906 - protein, 9 aa, Homo Sapiens
CREMESLSA

SEQ ID NO: 20907 - protein, 9 aa, Homo Sapiens
KITLFEAHM

SEQ ID NO: 20908 - protein, 9 aa, Homo Sapiens
THTALEQMQ

SEQ ID NO: 20909 - protein, 9 aa, Homo Sapiens
CRVTETLSA

SEQ ID NO: 20910 - protein, 9 aa, Homo Sapiens
CDCRKPAPE

SEQ ID NO: 20911 - protein, 9 aa, Homo Sapiens
LDRLTSHSM

SEQ ID NO: 20912 - protein, 9 aa, Homo Sapiens
VREPLERLV

SEQ ID NO: 20913 - protein, 9 aa, Homo Sapiens
GEKVRTLVF

SEQ ID NO: 20914 - protein, 9 aa, Homo Sapiens
SELAEEEYE

SEQ ID NO: 20915 - protein, 9 aa, Homo Sapiens
SYQKSGKHS

SEQ ID NO: 20916 - protein, 9 aa, Homo Sapiens
SWLNVPAFV

SEQ ID NO: 20917 - protein, 9 aa, Homo Sapiens
QKRKSARRK

SEQ ID NO: 20918 - protein, 9 aa, Homo Sapiens
EQFSFNTSA

SEQ ID NO: 20919 - protein, 9 aa, Homo Sapiens
YHQRWLWIV

SEQ ID NO: 20920 - protein, 9 aa, Homo Sapiens
RIFQVLGAH

SEQ ID NO: 20921 - protein, 9 aa, Homo Sapiens
EPGTNNSRV

SEQ ID NO: 20922 - protein, 9 aa, Homo Sapiens
GENLDKNLV

SEQ ID NO: 20923 - protein, 9 aa, Homo Sapiens
ECALLGVVT

SEQ ID NO: 20924 - protein, 9 aa, Homo Sapiens
EVLSILLDL

SEQ ID NO: 20925 - protein, 9 aa, Homo Sapiens
VSTTLSDVV

SEQ ID NO: 20926 - protein, 9 aa, Homo Sapiens
WWEVHKVGL

SEQ ID NO: 20927 - protein, 9 aa, Homo Sapiens
KGVVKEWLS

SEQ ID NO: 20928 - protein, 9 aa, Homo Sapiens
LEERKSSVF

SEQ ID NO: 20929 - protein, 9 aa, Homo Sapiens
LGCLGALGP

SEQ ID NO: 20930 - protein, 9 aa, Homo Sapiens
CLDWQSLGQ

SEQ ID NO: 20931 - protein, 9 aa, Homo Sapiens
AGAVPLLCQ

SEQ ID NO: 20932 - protein, 9 aa, Homo Sapiens
ELAEEEYEA

SEQ ID NO: 20933 - protein, 9 aa, Homo Sapiens
LAGLPKPKR

SEQ ID NO: 20934 - protein, 9 aa, Homo Sapiens
GIQECFSRS

SEQ ID NO: 20935 - protein, 9 aa, Homo Sapiens
ILLDLAPNS

SEQ ID NO: 20936 - protein, 9 aa, Homo Sapiens
SEPVPLSKV

SEQ ID NO: 20937 - protein, 9 aa, Homo Sapiens
QVTSATESN

SEQ ID NO: 20938 - protein, 9 aa, Homo Sapiens
EVIMKGTHL

SEQ ID NO: 20939 - protein, 9 aa, Homo Sapiens
AVPSETSVY

SEQ ID NO: 20940 - protein, 9 aa, Homo Sapiens
SGSQPYFQS

SEQ ID NO: 20941 - protein, 9 aa, Homo Sapiens
NMLIAFTKR

SEQ ID NO: 20942 - protein, 9 aa, Homo Sapiens
KLKKCFNKV

SEQ ID NO: 20943 - protein, 9 aa, Homo Sapiens
LHNDQLYVS

SEQ ID NO: 20944 - protein, 9 aa, Homo Sapiens
AQLGCIPMQ

SEQ ID NO: 20945 - protein, 9 aa, Homo Sapiens
SPDSSPPRR

SEQ ID NO: 20946 - protein, 9 aa, Homo Sapiens
LTGGCPLLH

SEQ ID NO: 20947 - protein, 9 aa, Homo Sapiens
RLCSAKAPN

SEQ ID NO: 20948 - protein, 9 aa, Homo Sapiens
TTRLPVTNI

SEQ ID NO: 20949 - protein, 9 aa, Homo Sapiens
SARRYEFRP

SEQ ID NO: 20950 - protein, 9 aa, Homo Sapiens
SVKILQIED

SEQ ID NO: 20951 - protein, 9 aa, Homo Sapiens
PLNIDICAL

SEQ ID NO: 20952 - protein, 9 aa, Homo Sapiens
PSRRRRSRF

SEQ ID NO: 20953 - protein, 9 aa, Homo Sapiens
VFKAIDSSK

SEQ ID NO: 20954 - protein, 9 aa, Homo Sapiens
RGRVLGVLN

SEQ ID NO: 20955 - protein, 9 aa, Homo Sapiens
KQCGKAYGW

SEQ ID NO: 20956 - protein, 9 aa, Homo Sapiens
WRKNLRREQ

SEQ ID NO: 20957 - protein, 9 aa, Homo Sapiens
YGGRVHNEF

SEQ ID NO: 20958 - protein, 9 aa, Homo Sapiens
CPKEPEPTP

SEQ ID NO: 20959 - protein, 9 aa, Homo Sapiens
SRKLFHTLN

SEQ ID NO: 20960 - protein, 9 aa, Homo Sapiens
DICALFKSY

SEQ ID NO: 20961 - protein, 9 aa, Homo Sapiens
PDCAVGVQW

SEQ ID NO: 20962 - protein, 9 aa, Homo Sapiens
YSSPGIQSG

SEQ ID NO: 20963 - protein, 9 aa, Homo Sapiens
PGRPRQLVE

SEQ ID NO: 20964 - protein, 9 aa, Homo Sapiens
VSLSEALYP

SEQ ID NO: 20965 - protein, 9 aa, Homo Sapiens
QPVGQSNFL

SEQ ID NO: 20966 - protein, 9 aa, Homo Sapiens
LDEYNQLQL

SEQ ID NO: 20967 - protein, 9 aa, Homo Sapiens
HCGEKPYIC

SEQ ID NO: 20968 - protein, 9 aa, Homo Sapiens
MVPLNIDIC

SEQ ID NO: 20969 - protein, 9 aa, Homo Sapiens
LPCFEASEC

SEQ ID NO: 20970 - protein, 9 aa, Homo Sapiens
SSGICPVLE

SEQ ID NO: 20971 - protein, 9 aa, Homo Sapiens
PQIMQRTSA

SEQ ID NO: 20972 - protein, 9 aa, Homo Sapiens
RTLLKLCKN

SEQ ID NO: 20973 - protein, 9 aa, Homo Sapiens
GNMGKAKGF

SEQ ID NO: 20974 - protein, 9 aa, Homo Sapiens
PADVIQEFA

SEQ ID NO: 20975 - protein, 9 aa, Homo Sapiens
STENSFYTL

SEQ ID NO: 20976 - protein, 9 aa, Homo Sapiens
IPSEIAIDN

SEQ ID NO: 20977 - protein, 9 aa, Homo Sapiens
TQLPKAEKE

SEQ ID NO: 20978 - protein, 9 aa, Homo Sapiens
LTADSLRPA

SEQ ID NO: 20979 - protein, 9 aa, Homo Sapiens
ARCTSINVL

SEQ ID NO: 20980 - protein, 9 aa, Homo Sapiens
FINNYQVKC

SEQ ID NO: 20981 - protein, 9 aa, Homo Sapiens
LNEQKRKSA

SEQ ID NO: 20982 - protein, 9 aa, Homo Sapiens
TSLQNDYLR

SEQ ID NO: 20983 - protein, 9 aa, Homo Sapiens
ISPYSNPHR

SEQ ID NO: 20984 - protein, 9 aa, Homo Sapiens
VYITNYHLY

SEQ ID NO: 20985 - protein, 9 aa, Homo Sapiens
KHDGQFAVI

SEQ ID NO: 20986 - protein, 9 aa, Homo Sapiens
TGNLLCFHK

SEQ ID NO: 20987 - protein, 9 aa, Homo Sapiens
TSHSMLPSD

SEQ ID NO: 20988 - protein, 9 aa, Homo Sapiens
ASAAPAPGR

SEQ ID NO: 20989 - protein, 9 aa, Homo Sapiens
NGNECGAKG

SEQ ID NO: 20990 - protein, 9 aa, Homo Sapiens
IQPDYYNTL

SEQ ID NO: 20991 - protein, 9 aa, Homo Sapiens
FHTLNEDLF

SEQ ID NO: 20992 - protein, 9 aa, Homo Sapiens
INDKEELLK

SEQ ID NO: 20993 - protein, 9 aa, Homo Sapiens
RKPALPSAS

SEQ ID NO: 20994 - protein, 9 aa, Homo Sapiens
TDSVTDVRV

SEQ ID NO: 20995 - protein, 9 aa, Homo Sapiens
IIHISDVFR

SEQ ID NO: 20996 - protein, 9 aa, Homo Sapiens
MAMITELRS

SEQ ID NO: 20997 - protein, 9 aa, Homo Sapiens
NPHRMSHYT

SEQ ID NO: 20998 - protein, 9 aa, Homo Sapiens
MQRTSADRF

SEQ ID NO: 20999 - protein, 9 aa, Homo Sapiens
QGSVEVKAK

SEQ ID NO: 21000 - protein, 9 aa, Homo Sapiens
LDKNLVPVA

SEQ ID NO: 21001 - protein, 9 aa, Homo Sapiens
GDSQQAGAV

SEQ ID NO: 21002 - protein, 9 aa, Homo Sapiens
KAGSYRQNP

SEQ ID NO: 21003 - protein, 9 aa, Homo Sapiens
SEDNPLEAT

SEQ ID NO: 21004 - protein, 9 aa, Homo Sapiens
LLKDSEQLT

SEQ ID NO: 21005 - protein, 9 aa, Homo Sapiens
VVLALGRFA

SEQ ID NO: 21006 - protein, 9 aa, Homo Sapiens
VFEDFACQR

SEQ ID NO: 21007 - protein, 9 aa, Homo Sapiens
EKQLQHIFS

SEQ ID NO: 21008 - protein, 9 aa, Homo Sapiens
LILINDKEE

SEQ ID NO: 21009 - protein, 9 aa, Homo Sapiens
EASNKKKVE

SEQ ID NO: 21010 - protein, 9 aa, Homo Sapiens
FFYFVGYIE

SEQ ID NO: 21011 - protein, 9 aa, Homo Sapiens
KEKTAAEKS

SEQ ID NO: 21012 - protein, 9 aa, Homo Sapiens
LLFQLVLKG

SEQ ID NO: 21013 - protein, 9 aa, Homo Sapiens
RPPDQPEGP

SEQ ID NO: 21014 - protein, 9 aa, Homo Sapiens
YRGTDCRNN

SEQ ID NO: 21015 - protein, 9 aa, Homo Sapiens
LVTRQVFDI

SEQ ID NO: 21016 - protein, 9 aa, Homo Sapiens
LQETNYSIY

SEQ ID NO: 21017 - protein, 9 aa, Homo Sapiens
ECLKPFNQR

SEQ ID NO: 21018 - protein, 9 aa, Homo Sapiens
PLTIQNINP

SEQ ID NO: 21019 - protein, 9 aa, Homo Sapiens
PVLVCQLEQ

SEQ ID NO: 21020 - protein, 9 aa, Homo Sapiens
SREQVLCVF

SEQ ID NO: 21021 - protein, 9 aa, Homo Sapiens
LCVRASLIE

SEQ ID NO: 21022 - protein, 9 aa, Homo Sapiens
YEEELLYEL

SEQ ID NO: 21023 - protein, 9 aa, Homo Sapiens
FENAQPTDS

SEQ ID NO: 21024 - protein, 9 aa, Homo Sapiens
QMLKVELKR

SEQ ID NO: 21025 - protein, 9 aa, Homo Sapiens
SPLPTSPGS

SEQ ID NO: 21026 - protein, 9 aa, Homo Sapiens
DIELSRNQA

SEQ ID NO: 21027 - protein, 9 aa, Homo Sapiens
VMAVLGAFV

SEQ ID NO: 21028 - protein, 9 aa, Homo Sapiens
AQPAHVRVC

SEQ ID NO: 21029 - protein, 9 aa, Homo Sapiens
FSIREVSFE

SEQ ID NO: 21030 - protein, 9 aa, Homo Sapiens
SDSGTSVSK

SEQ ID NO: 21031 - protein, 9 aa, Homo Sapiens
AVIQLVGML

SEQ ID NO: 21032 - protein, 9 aa, Homo Sapiens
VEGQVKEQR

SEQ ID NO: 21033 - protein, 9 aa, Homo Sapiens
GHNVATGTF

SEQ ID NO: 21034 - protein, 9 aa, Homo Sapiens
VLGNLLIII

SEQ ID NO: 21035 - protein, 9 aa, Homo Sapiens
PKRGPQSLD

SEQ ID NO: 21036 - protein, 9 aa, Homo Sapiens
ERRAPEKEL

SEQ ID NO: 21037 - protein, 9 aa, Homo Sapiens
HHVSTEPSC

SEQ ID NO: 21038 - protein, 9 aa, Homo Sapiens
KSSEVSQSE

SEQ ID NO: 21039 - protein, 9 aa, Homo Sapiens
GVGPWQCPK

SEQ ID NO: 21040 - protein, 9 aa, Homo Sapiens
EIPMRKKER

SEQ ID NO: 21041 - protein, 9 aa, Homo Sapiens
RMATRPPDQ

SEQ ID NO: 21042 - protein, 9 aa, Homo Sapiens
VGLLGDKGR

SEQ ID NO: 21043 - protein, 9 aa, Homo Sapiens
TPSGALHRN

SEQ ID NO: 21044 - protein, 9 aa, Homo Sapiens
TGTLRNAPS

SEQ ID NO: 21045 - protein, 9 aa, Homo Sapiens
SACTSETEQ

SEQ ID NO: 21046 - protein, 9 aa, Homo Sapiens
YQVKKQIQL

SEQ ID NO: 21047 - protein, 9 aa, Homo Sapiens
LEAWWEVHK

SEQ ID NO: 21048 - protein, 9 aa, Homo Sapiens
DIAESQVNT

SEQ ID NO: 21049 - protein, 9 aa, Homo Sapiens
CGAKGSWQV

SEQ ID NO: 21050 - protein, 9 aa, Homo Sapiens
RICVVNFEA

SEQ ID NO: 21051 - protein, 9 aa, Homo Sapiens
GQGLLLYNS

SEQ ID NO: 21052 - protein, 9 aa, Homo Sapiens
CHHILHTAE

SEQ ID NO: 21053 - protein, 9 aa, Homo Sapiens
GHEHRSDCE

SEQ ID NO: 21054 - protein, 9 aa, Homo Sapiens
VVNTMRLCS

SEQ ID NO: 21055 - protein, 9 aa, Homo Sapiens
GRALRGRKP

SEQ ID NO: 21056 - protein, 9 aa, Homo Sapiens
TQNQSSASQ

SEQ ID NO: 21057 - protein, 9 aa, Homo Sapiens
HNSTYGLCG

SEQ ID NO: 21058 - protein, 9 aa, Homo Sapiens
DIIGFTRLA

SEQ ID NO: 21059 - protein, 9 aa, Homo Sapiens
GLTDSVTDV

SEQ ID NO: 21060 - protein, 9 aa, Homo Sapiens
YGGAGDASL

SEQ ID NO: 21061 - protein, 9 aa, Homo Sapiens
AERRAPEKE

SEQ ID NO: 21062 - protein, 9 aa, Homo Sapiens
VKQLEDNIK

SEQ ID NO: 21063 - protein, 9 aa, Homo Sapiens
QGDPHELRN

SEQ ID NO: 21064 - protein, 9 aa, Homo Sapiens
SDDEIPMRK

SEQ ID NO: 21065 - protein, 9 aa, Homo Sapiens
GMVFDLVTR

SEQ ID NO: 21066 - protein, 9 aa, Homo Sapiens
FFREHLVRD

SEQ ID NO: 21067 - protein, 9 aa, Homo Sapiens
GGASLSLHF

SEQ ID NO: 21068 - protein, 9 aa, Homo Sapiens
RVICIYIAF

SEQ ID NO: 21069 - protein, 9 aa, Homo Sapiens
VLFNLLPGP

SEQ ID NO: 21070 - protein, 9 aa, Homo Sapiens
CKNAGMNVD

SEQ ID NO: 21071 - protein, 9 aa, Homo Sapiens
RSNDKRICV

SEQ ID NO: 21072 - protein, 9 aa, Homo Sapiens
LSRNQALAA

SEQ ID NO: 21073 - protein, 9 aa, Homo Sapiens
TPEVKHLCP

SEQ ID NO: 21074 - protein, 9 aa, Homo Sapiens
KKDEVISSL

SEQ ID NO: 21075 - protein, 9 aa, Homo Sapiens
PFTALSLSP

SEQ ID NO: 21076 - protein, 9 aa, Homo Sapiens
WRGPEDVSW

SEQ ID NO: 21077 - protein, 9 aa, Homo Sapiens
CDFSIPEEL

SEQ ID NO: 21078 - protein, 9 aa, Homo Sapiens
VKEQRLAGN

SEQ ID NO: 21079 - protein, 9 aa, Homo Sapiens
EKQKSVGQK

SEQ ID NO: 21080 - protein, 9 aa, Homo Sapiens
TSWGAVFPS

SEQ ID NO: 21081 - protein, 9 aa, Homo Sapiens
QGASGSQNP

SEQ ID NO: 21082 - protein, 9 aa, Homo Sapiens
NYDSSGASK

SEQ ID NO: 21083 - protein, 9 aa, Homo Sapiens
EQSIQSAKE

SEQ ID NO: 21084 - protein, 9 aa, Homo Sapiens
TSEKGVVKE

SEQ ID NO: 21085 - protein, 9 aa, Homo Sapiens
PVYTPPTYG

SEQ ID NO: 21086 - protein, 9 aa, Homo Sapiens
IFSAKSSRF

SEQ ID NO: 21087 - protein, 9 aa, Homo Sapiens
KNARSILNS

SEQ ID NO: 21088 - protein, 9 aa, Homo Sapiens
LFKVLLVET

SEQ ID NO: 21089 - protein, 9 aa, Homo Sapiens
DAWLFRKAH

SEQ ID NO: 21090 - protein, 9 aa, Homo Sapiens
GLQPEPRYG

SEQ ID NO: 21091 - protein, 9 aa, Homo Sapiens
EAKSVLDKM

SEQ ID NO: 21092 - protein, 9 aa, Homo Sapiens
FDPDIQVLK

SEQ ID NO: 21093 - protein, 9 aa, Homo Sapiens
AECLKPFNQ

SEQ ID NO: 21094 - protein, 9 aa, Homo Sapiens
KKKVEDALS

SEQ ID NO: 21095 - protein, 9 aa, Homo Sapiens
RESVFAYEL

SEQ ID NO: 21096 - protein, 9 aa, Homo Sapiens
SSHSWLSWP

SEQ ID NO: 21097 - protein, 9 aa, Homo Sapiens
HSLSPSEYV

SEQ ID NO: 21098 - protein, 9 aa, Homo Sapiens
WTPEVKHLC

SEQ ID NO: 21099 - protein, 9 aa, Homo Sapiens
VENVRNGIR

SEQ ID NO: 21100 - protein, 9 aa, Homo Sapiens
RTFKDTMYL

SEQ ID NO: 21101 - protein, 9 aa, Homo Sapiens
RMLAHKIQS

SEQ ID NO: 21102 - protein, 9 aa, Homo Sapiens
VLCVRASLI

SEQ ID NO: 21103 - protein, 9 aa, Homo Sapiens
ICGESAAWR

SEQ ID NO: 21104 - protein, 9 aa, Homo Sapiens
SGSFGISVA

SEQ ID NO: 21105 - protein, 9 aa, Homo Sapiens
HIIFHSGNN

SEQ ID NO: 21106 - protein, 9 aa, Homo Sapiens
SLPDTQVLL

SEQ ID NO: 21107 - protein, 9 aa, Homo Sapiens
RDRLILIND

SEQ ID NO: 21108 - protein, 9 aa, Homo Sapiens
HHILHTAEK

SEQ ID NO: 21109 - protein, 9 aa, Homo Sapiens
LKKRVVQVL

SEQ ID NO: 21110 - protein, 9 aa, Homo Sapiens
DIIADQEEQ

SEQ ID NO: 21111 - protein, 9 aa, Homo Sapiens
LPKAEKEKI

SEQ ID NO: 21112 - protein, 9 aa, Homo Sapiens
SIHSLTLCS

SEQ ID NO: 21113 - protein, 9 aa, Homo Sapiens
QRLAGNGLE

SEQ ID NO: 21114 - protein, 9 aa, Homo Sapiens
DEDKPPHRV

SEQ ID NO: 21115 - protein, 9 aa, Homo Sapiens
IFGMGHNVA

SEQ ID NO: 21116 - protein, 9 aa, Homo Sapiens
SFPSARRYE

SEQ ID NO: 21117 - protein, 9 aa, Homo Sapiens
WLRPEIDCL

SEQ ID NO: 21118 - protein, 9 aa, Homo Sapiens
GRVQAECLK

SEQ ID NO: 21119 - protein, 9 aa, Homo Sapiens
QGGPASTLA

SEQ ID NO: 21120 - protein, 9 aa, Homo Sapiens
HSQMSTLMW

SEQ ID NO: 21121 - protein, 9 aa, Homo Sapiens
TELEVLLNM

SEQ ID NO: 21122 - protein, 9 aa, Homo Sapiens
EVYEDTPEG

SEQ ID NO: 21123 - protein, 9 aa, Homo Sapiens
VKHLCPNVP

SEQ ID NO: 21124 - protein, 9 aa, Homo Sapiens
ISRLSASEI

SEQ ID NO: 21125 - protein, 9 aa, Homo Sapiens
ILVSYLFIM

SEQ ID NO: 21126 - protein, 9 aa, Homo Sapiens
AHKINNREQ

SEQ ID NO: 21127 - protein, 9 aa, Homo Sapiens
VASPQIMQR

SEQ ID NO: 21128 - protein, 9 aa, Homo Sapiens
RREQHAQQW

SEQ ID NO: 21129 - protein, 9 aa, Homo Sapiens
HKINNREQK

SEQ ID NO: 21130 - protein, 9 aa, Homo Sapiens
GAPAPLLFL

SEQ ID NO: 21131 - protein, 9 aa, Homo Sapiens
TPLYCAASC

SEQ ID NO: 21132 - protein, 9 aa, Homo Sapiens
NAGQMLHGT

SEQ ID NO: 21133 - protein, 9 aa, Homo Sapiens
GRVYITNYH

SEQ ID NO: 21134 - protein, 9 aa, Homo Sapiens
TYDLLLVIC

SEQ ID NO: 21135 - protein, 9 aa, Homo Sapiens
AAPGACYHK

SEQ ID NO: 21136 - protein, 9 aa, Homo Sapiens
DLFINNYQV

SEQ ID NO: 21137 - protein, 9 aa, Homo Sapiens
AMEPGPIAP

SEQ ID NO: 21138 - protein, 9 aa, Homo Sapiens
EKPFICKQC

SEQ ID NO: 21139 - protein, 9 aa, Homo Sapiens
DRFRMKRRM

SEQ ID NO: 21140 - protein, 9 aa, Homo Sapiens
SSEATLGLL

SEQ ID NO: 21141 - protein, 9 aa, Homo Sapiens
NVVNTMRLC

SEQ ID NO: 21142 - protein, 9 aa, Homo Sapiens
QDGKPVRKG

SEQ ID NO: 21143 - protein, 9 aa, Homo Sapiens
VGKSTVSTE

SEQ ID NO: 21144 - protein, 9 aa, Homo Sapiens
KYVAVELQS

SEQ ID NO: 21145 - protein, 9 aa, Homo Sapiens
AYKYIRELW

SEQ ID NO: 21146 - protein, 9 aa, Homo Sapiens
LKELWKLIM

SEQ ID NO: 21147 - protein, 9 aa, Homo Sapiens
DRESVFAYE

SEQ ID NO: 21148 - protein, 9 aa, Homo Sapiens
SRRRRSRFV

SEQ ID NO: 21149 - protein, 9 aa, Homo Sapiens
VQTTKQGDP

SEQ ID NO: 21150 - protein, 9 aa, Homo Sapiens
RGTDCRNNV

SEQ ID NO: 21151 - protein, 9 aa, Homo Sapiens
QTDQEMVSA

SEQ ID NO: 21152 - protein, 9 aa, Homo Sapiens
MSVVCIKDG

SEQ ID NO: 21153 - protein, 9 aa, Homo Sapiens
IQVLKDLFC

SEQ ID NO: 21154 - protein, 9 aa, Homo Sapiens
TVSTELALA

SEQ ID NO: 21155 - protein, 9 aa, Homo Sapiens
TRPLRSLRK

SEQ ID NO: 21156 - protein, 9 aa, Homo Sapiens
REPLERLVS

SEQ ID NO: 21157 - protein, 9 aa, Homo Sapiens
NFGVQAGDI

SEQ ID NO: 21158 - protein, 9 aa, Homo Sapiens
ITTYDLLLV

SEQ ID NO: 21159 - protein, 9 aa, Homo Sapiens
CSKPFRVIC

SEQ ID NO: 21160 - protein, 9 aa, Homo Sapiens
SGICPVLEF

SEQ ID NO: 21161 - protein, 9 aa, Homo Sapiens
APESKDALD

SEQ ID NO: 21162 - protein, 9 aa, Homo Sapiens
ISINVGNLL

SEQ ID NO: 21163 - protein, 9 aa, Homo Sapiens
SPRGILVGN

SEQ ID NO: 21164 - protein, 9 aa, Homo Sapiens
SASEIRNLN

SEQ ID NO: 21165 - protein, 9 aa, Homo Sapiens
YSSMCGHVV

SEQ ID NO: 21166 - protein, 9 aa, Homo Sapiens
GPWQCPKEP

SEQ ID NO: 21167 - protein, 9 aa, Homo Sapiens
LQPEPRYGY

SEQ ID NO: 21168 - protein, 9 aa, Homo Sapiens
HTALEQMQR

SEQ ID NO: 21169 - protein, 9 aa, Homo Sapiens
SHRPPEHQD

SEQ ID NO: 21170 - protein, 9 aa, Homo Sapiens
NILLTYCMY

SEQ ID NO: 21171 - protein, 9 aa, Homo Sapiens
DNYDSSGAS

SEQ ID NO: 21172 - protein, 9 aa, Homo Sapiens
KPIIKIDIR

SEQ ID NO: 21173 - protein, 9 aa, Homo Sapiens
CKRPKNQLF

SEQ ID NO: 21174 - protein, 9 aa, Homo Sapiens
RLVSQPVGQ

SEQ ID NO: 21175 - protein, 9 aa, Homo Sapiens
SLWQELAAV

SEQ ID NO: 21176 - protein, 9 aa, Homo Sapiens
VATRDQDGV

SEQ ID NO: 21177 - protein, 9 aa, Homo Sapiens
FFFIFLGLT

SEQ ID NO: 21178 - protein, 9 aa, Homo Sapiens
GYVLRFLPA

SEQ ID NO: 21179 - protein, 9 aa, Homo Sapiens
NMGKAKGFF

SEQ ID NO: 21180 - protein, 9 aa, Homo Sapiens
KIMAMITEL

SEQ ID NO: 21181 - protein, 9 aa, Homo Sapiens
VDFSEDNPL

SEQ ID NO: 21182 - protein, 9 aa, Homo Sapiens
TELAPRAHV

SEQ ID NO: 21183 - protein, 9 aa, Homo Sapiens
APAPLLFLN

SEQ ID NO: 21184 - protein, 9 aa, Homo Sapiens
NFLKITSTS

SEQ ID NO: 21185 - protein, 9 aa, Homo Sapiens
DCCVCVLHP

SEQ ID NO: 21186 - protein, 9 aa, Homo Sapiens
LVVKLEKLN

SEQ ID NO: 21187 - protein, 9 aa, Homo Sapiens
ITVPRSMHN

SEQ ID NO: 21188 - protein, 9 aa, Homo Sapiens
FFQSSGICP

SEQ ID NO: 21189 - protein, 9 aa, Homo Sapiens
EEINTDHNK

SEQ ID NO: 21190 - protein, 9 aa, Homo Sapiens
VSTELALAL

SEQ ID NO: 21191 - protein, 9 aa, Homo Sapiens
LGSNFGVQA

SEQ ID NO: 21192 - protein, 9 aa, Homo Sapiens
AAVPGISAM

SEQ ID NO: 21193 - protein, 9 aa, Homo Sapiens
NVGNLLIVF

SEQ ID NO: 21194 - protein, 9 aa, Homo Sapiens
GQPLLEVLS

SEQ ID NO: 21195 - protein, 9 aa, Homo Sapiens
QVLFQNTRA

SEQ ID NO: 21196 - protein, 9 aa, Homo Sapiens
PEHSPRGIL

SEQ ID NO: 21197 - protein, 9 aa, Homo Sapiens
LKLLYRGAD

SEQ ID NO: 21198 - protein, 9 aa, Homo Sapiens
QRQKMELAK

SEQ ID NO: 21199 - protein, 9 aa, Homo Sapiens
CLCGSVLLK

SEQ ID NO: 21200 - protein, 9 aa, Homo Sapiens
SLGFHGGHF

SEQ ID NO: 21201 - protein, 9 aa, Homo Sapiens
NPLEATVHW

SEQ ID NO: 21202 - protein, 9 aa, Homo Sapiens
GSPADVIQE

SEQ ID NO: 21203 - protein, 9 aa, Homo Sapiens
RKEKTAAEK

SEQ ID NO: 21204 - protein, 9 aa, Homo Sapiens
QMIFNMLKR

SEQ ID NO: 21205 - protein, 9 aa, Homo Sapiens
PELEDRLQC

SEQ ID NO: 21206 - protein, 9 aa, Homo Sapiens
SVTSRDSEC

SEQ ID NO: 21207 - protein, 9 aa, Homo Sapiens
HRVRLPKSL

SEQ ID NO: 21208 - protein, 9 aa, Homo Sapiens
CPVLEFSKI

SEQ ID NO: 21209 - protein, 9 aa, Homo Sapiens
DSGTSVSKN

SEQ ID NO: 21210 - protein, 9 aa, Homo Sapiens
SSRNMSYRK

SEQ ID NO: 21211 - protein, 9 aa, Homo Sapiens
DQLYVSEAP

SEQ ID NO: 21212 - protein, 9 aa, Homo Sapiens
TKGSSSPTT

SEQ ID NO: 21213 - protein, 9 aa, Homo Sapiens
FAMDYKTTV

SEQ ID NO: 21214 - protein, 9 aa, Homo Sapiens
GQSAESKEE

SEQ ID NO: 21215 - protein, 9 aa, Homo Sapiens
VGPWQCPKE

SEQ ID NO: 21216 - protein, 9 aa, Homo Sapiens
MWRGPEDVS

SEQ ID NO: 21217 - protein, 9 aa, Homo Sapiens
TSSDVEAGS

SEQ ID NO: 21218 - protein, 9 aa, Homo Sapiens
ILPAQGMDI

SEQ ID NO: 21219 - protein, 9 aa, Homo Sapiens
QKASSHRYA

SEQ ID NO: 21220 - protein, 9 aa, Homo Sapiens
QEVIMKGTH

SEQ ID NO: 21221 - protein, 9 aa, Homo Sapiens
ASQKELALL

SEQ ID NO: 21222 - protein, 9 aa, Homo Sapiens
RAGGEEGRG

SEQ ID NO: 21223 - protein, 9 aa, Homo Sapiens
QCPKEPEPT

SEQ ID NO: 21224 - protein, 9 aa, Homo Sapiens
GLPELPGPP

SEQ ID NO: 21225 - protein, 9 aa, Homo Sapiens
DQEFYIPYQ

SEQ ID NO: 21226 - protein, 9 aa, Homo Sapiens
ARSGLCGLG

SEQ ID NO: 21227 - protein, 9 aa, Homo Sapiens
KEILGASKA

SEQ ID NO: 21228 - protein, 9 aa, Homo Sapiens
PLKGGNCLE

SEQ ID NO: 21229 - protein, 9 aa, Homo Sapiens
CRLDEYNQL

SEQ ID NO: 21230 - protein, 9 aa, Homo Sapiens
IAESQVNTL

SEQ ID NO: 21231 - protein, 9 aa, Homo Sapiens
NSIHSLTLC

SEQ ID NO: 21232 - protein, 9 aa, Homo Sapiens
LCPNVPIIL

SEQ ID NO: 21233 - protein, 9 aa, Homo Sapiens
VGMCADGAN

SEQ ID NO: 21234 - protein, 9 aa, Homo Sapiens
DLESHMREL

SEQ ID NO: 21235 - protein, 9 aa, Homo Sapiens
KSGKHSLGS

SEQ ID NO: 21236 - protein, 9 aa, Homo Sapiens
PRFVHTRQA

SEQ ID NO: 21237 - protein, 9 aa, Homo Sapiens
QKSGKHSLG

SEQ ID NO: 21238 - protein, 9 aa, Homo Sapiens
LSEALYPVF

SEQ ID NO: 21239 - protein, 9 aa, Homo Sapiens
YYLDLSGSR

SEQ ID NO: 21240 - protein, 9 aa, Homo Sapiens
LDKIIRGNQ

SEQ ID NO: 21241 - protein, 9 aa, Homo Sapiens
KLEEEQSSS

SEQ ID NO: 21242 - protein, 9 aa, Homo Sapiens
KKAEKDLTV

SEQ ID NO: 21243 - protein, 9 aa, Homo Sapiens
VLFQNTRAR

SEQ ID NO: 21244 - protein, 9 aa, Homo Sapiens
FGAGNCKPT

SEQ ID NO: 21245 - protein, 9 aa, Homo Sapiens
DEIPMRKKE

SEQ ID NO: 21246 - protein, 9 aa, Homo Sapiens
SIDAAFFRE

SEQ ID NO: 21247 - protein, 9 aa, Homo Sapiens
RHGESKTIA

SEQ ID NO: 21248 - protein, 9 aa, Homo Sapiens
LTLCDFSIP

SEQ ID NO: 21249 - protein, 9 aa, Homo Sapiens
AGNGLEAWW

SEQ ID NO: 21250 - protein, 9 aa, Homo Sapiens
TPVLVCQLE

SEQ ID NO: 21251 - protein, 9 aa, Homo Sapiens
EDTPEGTII

SEQ ID NO: 21252 - protein, 9 aa, Homo Sapiens
CVVNFEACR

SEQ ID NO: 21253 - protein, 9 aa, Homo Sapiens
SMHNSTYGL

SEQ ID NO: 21254 - protein, 9 aa, Homo Sapiens
ARSLSVEFE

SEQ ID NO: 21255 - protein, 9 aa, Homo Sapiens
SHAKGSRSQ

SEQ ID NO: 21256 - protein, 9 aa, Homo Sapiens
GTDCRNNVH

SEQ ID NO: 21257 - protein, 9 aa, Homo Sapiens
SFGISVATP

SEQ ID NO: 21258 - protein, 9 aa, Homo Sapiens
ARSILNSAM

SEQ ID NO: 21259 - protein, 9 aa, Homo Sapiens
EAHMARCTS

SEQ ID NO: 21260 - protein, 9 aa, Homo Sapiens
RGKIYKIYL

SEQ ID NO: 21261 - protein, 9 aa, Homo Sapiens
NLVFGAGNC

SEQ ID NO: 21262 - protein, 9 aa, Homo Sapiens
NRALQPSDL

SEQ ID NO: 21263 - protein, 9 aa, Homo Sapiens
DDADDCGDC

SEQ ID NO: 21264 - protein, 9 aa, Homo Sapiens
KMLFVREPL

SEQ ID NO: 21265 - protein, 9 aa, Homo Sapiens
LLVETPLSI

SEQ ID NO: 21266 - protein, 9 aa, Homo Sapiens
TPATTSTKG

SEQ ID NO: 21267 - protein, 9 aa, Homo Sapiens
PRGKIYKIY

SEQ ID NO: 21268 - protein, 9 aa, Homo Sapiens
ESKTIASEH

SEQ ID NO: 21269 - protein, 9 aa, Homo Sapiens
THSESKVKE

SEQ ID NO: 21270 - protein, 9 aa, Homo Sapiens
EPGSNVDQG

SEQ ID NO: 21271 - protein, 9 aa, Homo Sapiens
KMELAKQQQ

SEQ ID NO: 21272 - protein, 9 aa, Homo Sapiens
FFFRTPTYN

SEQ ID NO: 21273 - protein, 9 aa, Homo Sapiens
PRSMHNSTY

SEQ ID NO: 21274 - protein, 9 aa, Homo Sapiens
SEAPINYTN

SEQ ID NO: 21275 - protein, 9 aa, Homo Sapiens
LIVLDLGGG

SEQ ID NO: 21276 - protein, 9 aa, Homo Sapiens
IHISDVFRN

SEQ ID NO: 21277 - protein, 9 aa, Homo Sapiens
HSESKVKEH

SEQ ID NO: 21278 - protein, 9 aa, Homo Sapiens
LWIVPSGLA

SEQ ID NO: 21279 - protein, 9 aa, Homo Sapiens
AYDACLCGS

SEQ ID NO: 21280 - protein, 9 aa, Homo Sapiens
HHKRIQTRV

SEQ ID NO: 21281 - protein, 9 aa, Homo Sapiens
CYHKCLQLL

SEQ ID NO: 21282 - protein, 9 aa, Homo Sapiens
MKDEDKPPH

SEQ ID NO: 21283 - protein, 9 aa, Homo Sapiens
HSPRGILVG

SEQ ID NO: 21284 - protein, 9 aa, Homo Sapiens
QPLSAASER

SEQ ID NO: 21285 - protein, 9 aa, Homo Sapiens
LSQAIGPLT

SEQ ID NO: 21286 - protein, 9 aa, Homo Sapiens
VKLEKLNLV

SEQ ID NO: 21287 - protein, 9 aa, Homo Sapiens
NAPSKDTQR

SEQ ID NO: 21288 - protein, 9 aa, Homo Sapiens
KETEKSLHL

SEQ ID NO: 21289 - protein, 9 aa, Homo Sapiens
QQYSLLAKY

SEQ ID NO: 21290 - protein, 9 aa, Homo Sapiens
FPSARRYEF

SEQ ID NO: 21291 - protein, 9 aa, Homo Sapiens
APEKITLFE

SEQ ID NO: 21292 - protein, 9 aa, Homo Sapiens
VRESDNTWI

SEQ ID NO: 21293 - protein, 9 aa, Homo Sapiens
SGIQECFSR

SEQ ID NO: 21294 - protein, 9 aa, Homo Sapiens
DGCGLQGAL

SEQ ID NO: 21295 - protein, 9 aa, Homo Sapiens
RLIVLDLGG

SEQ ID NO: 21296 - protein, 9 aa, Homo Sapiens
PELPGPPGL

SEQ ID NO: 21297 - protein, 9 aa, Homo Sapiens
TLDVLERCP

SEQ ID NO: 21298 - protein, 9 aa, Homo Sapiens
RHKFEDIET

SEQ ID NO: 21299 - protein, 9 aa, Homo Sapiens
PPTVTMPQI

SEQ ID NO: 21300 - protein, 9 aa, Homo Sapiens
HKVGLLGDK

SEQ ID NO: 21301 - protein, 9 aa, Homo Sapiens
NLHSPCGAC

SEQ ID NO: 21302 - protein, 9 aa, Homo Sapiens
LLDLAPNSS

SEQ ID NO: 21303 - protein, 9 aa, Homo Sapiens
SGSQNPGKP

SEQ ID NO: 21304 - protein, 9 aa, Homo Sapiens
NTMRLCSAK

SEQ ID NO: 21305 - protein, 9 aa, Homo Sapiens
PAPLLFLNK

SEQ ID NO: 21306 - protein, 9 aa, Homo Sapiens
EIAIDNYDS

SEQ ID NO: 21307 - protein, 9 aa, Homo Sapiens
LKIMAMITE

SEQ ID NO: 21308 - protein, 9 aa, Homo Sapiens
VLLVETPLS

SEQ ID NO: 21309 - protein, 9 aa, Homo Sapiens
IMKGTHLPA

SEQ ID NO: 21310 - protein, 9 aa, Homo Sapiens
KDPKNLENR

SEQ ID NO: 21311 - protein, 9 aa, Homo Sapiens
ELLYELKLN

SEQ ID NO: 21312 - protein, 9 aa, Homo Sapiens
CAEQFCRLD

SEQ ID NO: 21313 - protein, 9 aa, Homo Sapiens
ARRYEFRPP

SEQ ID NO: 21314 - protein, 9 aa, Homo Sapiens
EILDAMNPD

SEQ ID NO: 21315 - protein, 9 aa, Homo Sapiens
KNAKLEEEQ

SEQ ID NO: 21316 - protein, 9 aa, Homo Sapiens
IAVRMLAHK

SEQ ID NO: 21317 - protein, 9 aa, Homo Sapiens
PAHVRVCIP

SEQ ID NO: 21318 - protein, 9 aa, Homo Sapiens
PPPLGLCNY

SEQ ID NO: 21319 - protein, 9 aa, Homo Sapiens
PYSNPHRMS

SEQ ID NO: 21320 - protein, 9 aa, Homo Sapiens
HGESKTIAS

SEQ ID NO: 21321 - protein, 9 aa, Homo Sapiens
TSVSKNRCH

SEQ ID NO: 21322 - protein, 9 aa, Homo Sapiens
SQQAGAVPL

SEQ ID NO: 21323 - protein, 9 aa, Homo Sapiens
QGFSEPEYL

SEQ ID NO: 21324 - protein, 9 aa, Homo Sapiens
YVAVELQSA

SEQ ID NO: 21325 - protein, 9 aa, Homo Sapiens
QSIQSAKET

SEQ ID NO: 21326 - protein, 9 aa, Homo Sapiens
VVDRVSDTP

SEQ ID NO: 21327 - protein, 9 aa, Homo Sapiens
HMVEGQVKE

SEQ ID NO: 21328 - protein, 9 aa, Homo Sapiens
QCRETHKIT

SEQ ID NO: 21329 - protein, 9 aa, Homo Sapiens
KLLYRGADI

SEQ ID NO: 21330 - protein, 9 aa, Homo Sapiens
ICLTADSLR

SEQ ID NO: 21331 - protein, 9 aa, Homo Sapiens
LDQDGTYIE

SEQ ID NO: 21332 - protein, 9 aa, Homo Sapiens
SAKETEKSL

SEQ ID NO: 21333 - protein, 9 aa, Homo Sapiens
VPLSKVTEL

SEQ ID NO: 21334 - protein, 9 aa, Homo Sapiens
KAEKEKIAE

SEQ ID NO: 21335 - protein, 9 aa, Homo Sapiens
YEFRPPRRL

SEQ ID NO: 21336 - protein, 9 aa, Homo Sapiens
RENSFRYWP

SEQ ID NO: 21337 - protein, 9 aa, Homo Sapiens
RSCSLGCLG

SEQ ID NO: 21338 - protein, 9 aa, Homo Sapiens
EKVTGGNLV

SEQ ID NO: 21339 - protein, 9 aa, Homo Sapiens
VRMLAHKIQ

SEQ ID NO: 21340 - protein, 9 aa, Homo Sapiens
SIREVSFES

SEQ ID NO: 21341 - protein, 9 aa, Homo Sapiens
QKWCSNTPF

SEQ ID NO: 21342 - protein, 9 aa, Homo Sapiens
EQMQRQAEK

SEQ ID NO: 21343 - protein, 9 aa, Homo Sapiens
HRAVSTCSC

SEQ ID NO: 21344 - protein, 9 aa, Homo Sapiens
NLRREQHAQ

SEQ ID NO: 21345 - protein, 9 aa, Homo Sapiens
HVACADSLP

SEQ ID NO: 21346 - protein, 9 aa, Homo Sapiens
CGEKPYICE

SEQ ID NO: 21347 - protein, 9 aa, Homo Sapiens
TSAAQPQYF

SEQ ID NO: 21348 - protein, 9 aa, Homo Sapiens
PEHQDSVEG

SEQ ID NO: 21349 - protein, 9 aa, Homo Sapiens
AGDGNSESW

SEQ ID NO: 21350 - protein, 9 aa, Homo Sapiens
KLNRQDVSG

SEQ ID NO: 21351 - protein, 9 aa, Homo Sapiens
KIDIRLERS

SEQ ID NO: 21352 - protein, 9 aa, Homo Sapiens
VFDLVTRQV

SEQ ID NO: 21353 - protein, 9 aa, Homo Sapiens
HSIFSVKIL

SEQ ID NO: 21354 - protein, 9 aa, Homo Sapiens
EDKQEESSW

SEQ ID NO: 21355 - protein, 9 aa, Homo Sapiens
RYEFRPPRR

SEQ ID NO: 21356 - protein, 9 aa, Homo Sapiens
TRQARSLSV

SEQ ID NO: 21357 - protein, 9 aa, Homo Sapiens
FPQVVKECR

SEQ ID NO: 21358 - protein, 9 aa, Homo Sapiens
YFVGYIEIV

SEQ ID NO: 21359 - protein, 9 aa, Homo Sapiens
GYSWKLWCM

SEQ ID NO: 21360 - protein, 9 aa, Homo Sapiens
HMRELIYTD

SEQ ID NO: 21361 - protein, 9 aa, Homo Sapiens
DITLLGFQN

SEQ ID NO: 21362 - protein, 9 aa, Homo Sapiens
LTDGAKLKK

SEQ ID NO: 21363 - protein, 9 aa, Homo Sapiens
AEVRCRACG

SEQ ID NO: 21364 - protein, 9 aa, Homo Sapiens
THHKRIQTR

SEQ ID NO: 21365 - protein, 9 aa, Homo Sapiens
SLSLHFERA

SEQ ID NO: 21366 - protein, 9 aa, Homo Sapiens
IALDCCVCV

SEQ ID NO: 21367 - protein, 9 aa, Homo Sapiens
RIVVTHCLV

SEQ ID NO: 21368 - protein, 9 aa, Homo Sapiens
FVVRRRSFS

SEQ ID NO: 21369 - protein, 9 aa, Homo Sapiens
KSPSPLPTS

SEQ ID NO: 21370 - protein, 9 aa, Homo Sapiens
SRLVSQPVG

SEQ ID NO: 21371 - protein, 9 aa, Homo Sapiens
AIFGMGHNV

SEQ ID NO: 21372 - protein, 9 aa, Homo Sapiens
SGLCGLGSC

SEQ ID NO: 21373 - protein, 9 aa, Homo Sapiens
EEAKSVLDK

SEQ ID NO: 21374 - protein, 9 aa, Homo Sapiens
YELKLNRKT

SEQ ID NO: 21375 - protein, 9 aa, Homo Sapiens
RSLEAKDIF

SEQ ID NO: 21376 - protein, 9 aa, Homo Sapiens
AKMTQLPKA

SEQ ID NO: 21377 - protein, 9 aa, Homo Sapiens
EASECKESS

SEQ ID NO: 21378 - protein, 9 aa, Homo Sapiens
DVRVAENNQ

SEQ ID NO: 21379 - protein, 9 aa, Homo Sapiens
EVLSLEKKD

SEQ ID NO: 21380 - protein, 9 aa, Homo Sapiens
LLNNILLTY

SEQ ID NO: 21381 - protein, 9 aa, Homo Sapiens
AGTFYQEQQ

SEQ ID NO: 21382 - protein, 9 aa, Homo Sapiens
GLLNNILLT

SEQ ID NO: 21383 - protein, 9 aa, Homo Sapiens
DMLSQAIGP

SEQ ID NO: 21384 - protein, 9 aa, Homo Sapiens
GETRGAPKP

SEQ ID NO: 21385 - protein, 9 aa, Homo Sapiens
SQMSTLMWR

SEQ ID NO: 21386 - protein, 9 aa, Homo Sapiens
LERLVSAFR

SEQ ID NO: 21387 - protein, 9 aa, Homo Sapiens
KHIQPDYYN

SEQ ID NO: 21388 - protein, 9 aa, Homo Sapiens
ALLGVVTDL

SEQ ID NO: 21389 - protein, 9 aa, Homo Sapiens
AKKRIPPPF

SEQ ID NO: 21390 - protein, 9 aa, Homo Sapiens
SMFLAIRSQ

SEQ ID NO: 21391 - protein, 9 aa, Homo Sapiens
DPSIGMYGL

SEQ ID NO: 21392 - protein, 9 aa, Homo Sapiens
ALDVQKSGK

SEQ ID NO: 21393 - protein, 9 aa, Homo Sapiens
RYGYAPNQG

SEQ ID NO: 21394 - protein, 9 aa, Homo Sapiens
AVRMLAHKI

SEQ ID NO: 21395 - protein, 9 aa, Homo Sapiens
DGNSESWTQ

SEQ ID NO: 21396 - protein, 9 aa, Homo Sapiens
YASGHKNTR

SEQ ID NO: 21397 - protein, 9 aa, Homo Sapiens
GAVFPSKRW

SEQ ID NO: 21398 - protein, 9 aa, Homo Sapiens
KNLRREQHA

SEQ ID NO: 21399 - protein, 9 aa, Homo Sapiens
DFSIPEELE

SEQ ID NO: 21400 - protein, 9 aa, Homo Sapiens
DLLSTKDED

SEQ ID NO: 21401 - protein, 9 aa, Homo Sapiens
WQEVIMKGT

SEQ ID NO: 21402 - protein, 9 aa, Homo Sapiens
GASGSQNPG

SEQ ID NO: 21403 - protein, 9 aa, Homo Sapiens
EQGASGSQN

SEQ ID NO: 21404 - protein, 9 aa, Homo Sapiens
LEILSETKN

SEQ ID NO: 21405 - protein, 9 aa, Homo Sapiens
FTALSLSPA

SEQ ID NO: 21406 - protein, 9 aa, Homo Sapiens
ICKIVIRHA

SEQ ID NO: 21407 - protein, 9 aa, Homo Sapiens
DKMMVEQTD

SEQ ID NO: 21408 - protein, 9 aa, Homo Sapiens
SRNMSYRKK

SEQ ID NO: 21409 - protein, 9 aa, Homo Sapiens
ADVIQEFAM

SEQ ID NO: 21410 - protein, 9 aa, Homo Sapiens
WLSWPLCVM

SEQ ID NO: 21411 - protein, 9 aa, Homo Sapiens
QDQWDGLGP

SEQ ID NO: 21412 - protein, 9 aa, Homo Sapiens
KSVGQKRNQ

SEQ ID NO: 21413 - protein, 9 aa, Homo Sapiens
GISVATPGS

SEQ ID NO: 21414 - protein, 9 aa, Homo Sapiens
RHDSPDSSP

SEQ ID NO: 21415 - protein, 9 aa, Homo Sapiens
INTDHNKSS

SEQ ID NO: 21416 - protein, 9 aa, Homo Sapiens
TSADRFRMK

SEQ ID NO: 21417 - protein, 9 aa, Homo Sapiens
QNQSSASQK

SEQ ID NO: 21418 - protein, 9 aa, Homo Sapiens
LCGLGSCLP

SEQ ID NO: 21419 - protein, 9 aa, Homo Sapiens
EPRYGYAPN

SEQ ID NO: 21420 - protein, 9 aa, Homo Sapiens
HEAAYDACL

SEQ ID NO: 21421 - protein, 9 aa, Homo Sapiens
EQQAQTQQF

SEQ ID NO: 21422 - protein, 9 aa, Homo Sapiens
PYFQSFPNL

SEQ ID NO: 21423 - protein, 9 aa, Homo Sapiens
SQIEKQRQK

SEQ ID NO: 21424 - protein, 9 aa, Homo Sapiens
TIYLSSPDC

SEQ ID NO: 21425 - protein, 9 aa, Homo Sapiens
TLPSWLNVP

SEQ ID NO: 21426 - protein, 9 aa, Homo Sapiens
ESTGESEWK

SEQ ID NO: 21427 - protein, 9 aa, Homo Sapiens
TSRDSECDV

SEQ ID NO: 21428 - protein, 9 aa, Homo Sapiens
MKRRMQNLD

SEQ ID NO: 21429 - protein, 9 aa, Homo Sapiens
GNGLEAWWE

SEQ ID NO: 21430 - protein, 9 aa, Homo Sapiens
KATRVSNQN

SEQ ID NO: 21431 - protein, 9 aa, Homo Sapiens
TVLGAFLNL

SEQ ID NO: 21432 - protein, 9 aa, Homo Sapiens
VHRDLCAAN

SEQ ID NO: 21433 - protein, 9 aa, Homo Sapiens
LGPPGVDGV

SEQ ID NO: 21434 - protein, 9 aa, Homo Sapiens
WQELAAVIY

SEQ ID NO: 21435 - protein, 9 aa, Homo Sapiens
PRLSRKLLE

SEQ ID NO: 21436 - protein, 9 aa, Homo Sapiens
GGLLKDSEQ

SEQ ID NO: 21437 - protein, 9 aa, Homo Sapiens
RPWDSNELV

SEQ ID NO: 21438 - protein, 9 aa, Homo Sapiens
RNAPSKDTQ

SEQ ID NO: 21439 - protein, 9 aa, Homo Sapiens
FEDFACQRL

SEQ ID NO: 21440 - protein, 9 aa, Homo Sapiens
PGAPAPLLF

SEQ ID NO: 21441 - protein, 9 aa, Homo Sapiens
ACTLWRKDV

SEQ ID NO: 21442 - protein, 9 aa, Homo Sapiens
VLDQDGTYI

SEQ ID NO: 21443 - protein, 9 aa, Homo Sapiens
INSKKHIQP

SEQ ID NO: 21444 - protein, 9 aa, Homo Sapiens
KEQRLAGNG

SEQ ID NO: 21445 - protein, 9 aa, Homo Sapiens
KPKRGPQSL

SEQ ID NO: 21446 - protein, 9 aa, Homo Sapiens
IHSLTLCSG

SEQ ID NO: 21447 - protein, 9 aa, Homo Sapiens
KVEDALSLI

SEQ ID NO: 21448 - protein, 9 aa, Homo Sapiens
IFLRKKILI

SEQ ID NO: 21449 - protein, 9 aa, Homo Sapiens
SWKLWCMYI

SEQ ID NO: 21450 - protein, 9 aa, Homo Sapiens
SPQIMQRTS

SEQ ID NO: 21451 - protein, 9 aa, Homo Sapiens
SACLDWQSL

SEQ ID NO: 21452 - protein, 9 aa, Homo Sapiens
GPQIAVRML

SEQ ID NO: 21453 - protein, 9 aa, Homo Sapiens
LGASKAHMA

SEQ ID NO: 21454 - protein, 9 aa, Homo Sapiens
KFSTEVTLN

SEQ ID NO: 21455 - protein, 9 aa, Homo Sapiens
VEVKNAKLE

SEQ ID NO: 21456 - protein, 9 aa, Homo Sapiens
LTIQNINPS

SEQ ID NO: 21457 - protein, 9 aa, Homo Sapiens
GRPRQLVEE

SEQ ID NO: 21458 - protein, 9 aa, Homo Sapiens
LFFFIFLGL

SEQ ID NO: 21459 - protein, 9 aa, Homo Sapiens
RRYEFRPPR

SEQ ID NO: 21460 - protein, 9 aa, Homo Sapiens
ESQVNTLRV

SEQ ID NO: 21461 - protein, 9 aa, Homo Sapiens
EAWWEVHKV

SEQ ID NO: 21462 - protein, 9 aa, Homo Sapiens
HDRLINFTD

SEQ ID NO: 21463 - protein, 9 aa, Homo Sapiens
DLGGGGLCL

SEQ ID NO: 21464 - protein, 9 aa, Homo Sapiens
FFLLAAFTW

SEQ ID NO: 21465 - protein, 9 aa, Homo Sapiens
LGAFLNLVV

SEQ ID NO: 21466 - protein, 9 aa, Homo Sapiens
CPRLSRKLL

SEQ ID NO: 21467 - protein, 9 aa, Homo Sapiens
QEQQAQTQQ

SEQ ID NO: 21468 - protein, 9 aa, Homo Sapiens
RASLIEKLM

SEQ ID NO: 21469 - protein, 9 aa, Homo Sapiens
DSVSVATRD

SEQ ID NO: 21470 - protein, 9 aa, Homo Sapiens
EEDMETESD

SEQ ID NO: 21471 - protein, 9 aa, Homo Sapiens
SKVKEHTFI

SEQ ID NO: 21472 - protein, 9 aa, Homo Sapiens
LGLTDSVTD

SEQ ID NO: 21473 - protein, 9 aa, Homo Sapiens
KQLEDNIKR

SEQ ID NO: 21474 - protein, 9 aa, Homo Sapiens
EQGLPELPG

SEQ ID NO: 21475 - protein, 9 aa, Homo Sapiens
ENLVFGAGN

SEQ ID NO: 21476 - protein, 9 aa, Homo Sapiens
PRIVVTHCL

SEQ ID NO: 21477 - protein, 9 aa, Homo Sapiens
FFRTPTYNL

SEQ ID NO: 21478 - protein, 9 aa, Homo Sapiens
LRTFKDTMY

SEQ ID NO: 21479 - protein, 9 aa, Homo Sapiens
CIKDGCGLQ

SEQ ID NO: 21480 - protein, 9 aa, Homo Sapiens
GNSTGNLLC

SEQ ID NO: 21481 - protein, 9 aa, Homo Sapiens
PLSAASERL

SEQ ID NO: 21482 - protein, 9 aa, Homo Sapiens
LYVSEAPIN

SEQ ID NO: 21483 - protein, 9 aa, Homo Sapiens
PGSNVDQGP

SEQ ID NO: 21484 - protein, 9 aa, Homo Sapiens
KGSRSQGPE

SEQ ID NO: 21485 - protein, 9 aa, Homo Sapiens
DYKTTVCEN

SEQ ID NO: 21486 - protein, 9 aa, Homo Sapiens
LAEEEYEAH

SEQ ID NO: 21487 - protein, 9 aa, Homo Sapiens
INVLCVRAS

SEQ ID NO: 21488 - protein, 9 aa, Homo Sapiens
APPATKIKR

SEQ ID NO: 21489 - protein, 9 aa, Homo Sapiens
GAAVPGISA

SEQ ID NO: 21490 - protein, 9 aa, Homo Sapiens
SVVCIKDGC

SEQ ID NO: 21491 - protein, 9 aa, Homo Sapiens
VFAYELVVT

SEQ ID NO: 21492 - protein, 9 aa, Homo Sapiens
KGERDNAKL

SEQ ID NO: 21493 - protein, 9 aa, Homo Sapiens
KGSWQVGIQ

SEQ ID NO: 21494 - protein, 9 aa, Homo Sapiens
NLGVPWPLL

SEQ ID NO: 21495 - protein, 9 aa, Homo Sapiens
DVLERCPHR

SEQ ID NO: 21496 - protein, 9 aa, Homo Sapiens
KLCLLKWIS

SEQ ID NO: 21497 - protein, 9 aa, Homo Sapiens
ALEQMQRQA

SEQ ID NO: 21498 - protein, 9 aa, Homo Sapiens
NRKMAAWPF

SEQ ID NO: 21499 - protein, 9 aa, Homo Sapiens
HRPPEHQDS

SEQ ID NO: 21500 - protein, 9 aa, Homo Sapiens
ELLQERPFL

SEQ ID NO: 21501 - protein, 9 aa, Homo Sapiens
AVPLLCQLD

SEQ ID NO: 21502 - protein, 9 aa, Homo Sapiens
DLNPIKGGG

SEQ ID NO: 21503 - protein, 9 aa, Homo Sapiens
GVFVLGPFD

SEQ ID NO: 21504 - protein, 9 aa, Homo Sapiens
SHMVEGQVK

SEQ ID NO: 21505 - protein, 9 aa, Homo Sapiens
SEECNRSWP

SEQ ID NO: 21506 - protein, 9 aa, Homo Sapiens
DSQQAGAVP

SEQ ID NO: 21507 - protein, 9 aa, Homo Sapiens
FNGNSTGNL

SEQ ID NO: 21508 - protein, 9 aa, Homo Sapiens
KEHLPGQTV

SEQ ID NO: 21509 - protein, 9 aa, Homo Sapiens
QAGPSCDKH

SEQ ID NO: 21510 - protein, 9 aa, Homo Sapiens
GSIVWQQVF

SEQ ID NO: 21511 - protein, 9 aa, Homo Sapiens
TSFPSARRY

SEQ ID NO: 21512 - protein, 9 aa, Homo Sapiens
GYIEIVTIL

SEQ ID NO: 21513 - protein, 9 aa, Homo Sapiens
TGGCPLLHC

SEQ ID NO: 21514 - protein, 9 aa, Homo Sapiens
NYVHRDLCA

SEQ ID NO: 21515 - protein, 9 aa, Homo Sapiens
IDEKPKETY

SEQ ID NO: 21516 - protein, 9 aa, Homo Sapiens
THLPAEVWE

SEQ ID NO: 21517 - protein, 9 aa, Homo Sapiens
LERCPHRPI

SEQ ID NO: 21518 - protein, 9 aa, Homo Sapiens
VSILYADII

SEQ ID NO: 21519 - protein, 9 aa, Homo Sapiens
VHKVGLLGD

SEQ ID NO: 21520 - protein, 9 aa, Homo Sapiens
IVLDLGGGG

SEQ ID NO: 21521 - protein, 9 aa, Homo Sapiens
EAPDIWRIV

SEQ ID NO: 21522 - protein, 9 aa, Homo Sapiens
GFQNMSWIR

SEQ ID NO: 21523 - protein, 9 aa, Homo Sapiens
SKVTELDEV

SEQ ID NO: 21524 - protein, 9 aa, Homo Sapiens
HVVLALGRF

SEQ ID NO: 21525 - protein, 9 aa, Homo Sapiens
LKAGRFHCQ

SEQ ID NO: 21526 - protein, 9 aa, Homo Sapiens
MAVLGAFVV

SEQ ID NO: 21527 - protein, 9 aa, Homo Sapiens
PCGACTLWR

SEQ ID NO: 21528 - protein, 9 aa, Homo Sapiens
LAKYAAATG

SEQ ID NO: 21529 - protein, 9 aa, Homo Sapiens
RSREQVLCV

SEQ ID NO: 21530 - protein, 9 aa, Homo Sapiens
RRPRGQDGK

SEQ ID NO: 21531 - protein, 9 aa, Homo Sapiens
VFEYPLTIQ

SEQ ID NO: 21532 - protein, 9 aa, Homo Sapiens
FQQLADVAQ

SEQ ID NO: 21533 - protein, 9 aa, Homo Sapiens
GTVTPSAFL

SEQ ID NO: 21534 - protein, 9 aa, Homo Sapiens
LAIRSQHSG

SEQ ID NO: 21535 - protein, 9 aa, Homo Sapiens
GKKDEVISS

SEQ ID NO: 21536 - protein, 9 aa, Homo Sapiens
SRLSASEIR

SEQ ID NO: 21537 - protein, 9 aa, Homo Sapiens
ESAAWRIYV

SEQ ID NO: 21538 - protein, 9 aa, Homo Sapiens
QPYFQSFPN

SEQ ID NO: 21539 - protein, 9 aa, Homo Sapiens
ERHLAKEQL

SEQ ID NO: 21540 - protein, 9 aa, Homo Sapiens
QAQLGCIPM

SEQ ID NO: 21541 - protein, 9 aa, Homo Sapiens
IYHQSMSQN

SEQ ID NO: 21542 - protein, 9 aa, Homo Sapiens
KMTQLPKAE

SEQ ID NO: 21543 - protein, 9 aa, Homo Sapiens
RGRALRGRK

SEQ ID NO: 21544 - protein, 9 aa, Homo Sapiens
PMCKRNVMI

SEQ ID NO: 21545 - protein, 9 aa, Homo Sapiens
HSLTLCSGA

SEQ ID NO: 21546 - protein, 9 aa, Homo Sapiens
ILSVMAYDR

SEQ ID NO: 21547 - protein, 9 aa, Homo Sapiens
QKGDEKLRC

SEQ ID NO: 21548 - protein, 9 aa, Homo Sapiens
QPQTLVQFV

SEQ ID NO: 21549 - protein, 9 aa, Homo Sapiens
NRNNTREKS

SEQ ID NO: 21550 - protein, 9 aa, Homo Sapiens
AINQGLQFS

SEQ ID NO: 21551 - protein, 9 aa, Homo Sapiens
INYGHASKY

SEQ ID NO: 21552 - protein, 9 aa, Homo Sapiens
RTATSSPHS

SEQ ID NO: 21553 - protein, 9 aa, Homo Sapiens
THRLAEMIY

SEQ ID NO: 21554 - protein, 9 aa, Homo Sapiens
PEGNIELPP

SEQ ID NO: 21555 - protein, 9 aa, Homo Sapiens
EKLRCDSAD

SEQ ID NO: 21556 - protein, 9 aa, Homo Sapiens
EGNIELPPS

SEQ ID NO: 21557 - protein, 9 aa, Homo Sapiens
INQGLQFSA

SEQ ID NO: 21558 - protein, 9 aa, Homo Sapiens
AEKKMVKIT

SEQ ID NO: 21559 - protein, 9 aa, Homo Sapiens
TPFNPHRVF

SEQ ID NO: 21560 - protein, 9 aa, Homo Sapiens
GRTVIAPQG

SEQ ID NO: 21561 - protein, 9 aa, Homo Sapiens
RHQGGWYYC

SEQ ID NO: 21562 - protein, 9 aa, Homo Sapiens
NNTEESLFH

SEQ ID NO: 21563 - protein, 9 aa, Homo Sapiens
ELKTVTTGS

SEQ ID NO: 21564 - protein, 9 aa, Homo Sapiens
TGEEPYTCP

SEQ ID NO: 21565 - protein, 9 aa, Homo Sapiens
HYFIDWDGE

SEQ ID NO: 21566 - protein, 9 aa, Homo Sapiens
SEESTALHS

SEQ ID NO: 21567 - protein, 9 aa, Homo Sapiens
ERAGKEENG

SEQ ID NO: 21568 - protein, 9 aa, Homo Sapiens
KGDEKLRCD

SEQ ID NO: 21569 - protein, 9 aa, Homo Sapiens
RKPFEAVFK

SEQ ID NO: 21570 - protein, 9 aa, Homo Sapiens
QLQEQKTAI

SEQ ID NO: 21571 - protein, 9 aa, Homo Sapiens
PGGPWIQGN

SEQ ID NO: 21572 - protein, 9 aa, Homo Sapiens
DRKALRLRE

SEQ ID NO: 21573 - protein, 9 aa, Homo Sapiens
WFKFQVDDE

SEQ ID NO: 21574 - protein, 9 aa, Homo Sapiens
ISELREPVQ

SEQ ID NO: 21575 - protein, 9 aa, Homo Sapiens
RISVLKLLG

SEQ ID NO: 21576 - protein, 9 aa, Homo Sapiens
PFEAVFKFS

SEQ ID NO: 21577 - protein, 9 aa, Homo Sapiens
ERTFSINEE

SEQ ID NO: 21578 - protein, 9 aa, Homo Sapiens
GSAEEFPNM

SEQ ID NO: 21579 - protein, 9 aa, Homo Sapiens
SVSVQDVIL

SEQ ID NO: 21580 - protein, 9 aa, Homo Sapiens
FNPHRVFWH

SEQ ID NO: 21581 - protein, 9 aa, Homo Sapiens
NSWFDPSWC

SEQ ID NO: 21582 - protein, 9 aa, Homo Sapiens
ISSQCLRLS

SEQ ID NO: 21583 - protein, 9 aa, Homo Sapiens
QGSAYSHLT

SEQ ID NO: 21584 - protein, 9 aa, Homo Sapiens
LDCQELLKH

SEQ ID NO: 21585 - protein, 9 aa, Homo Sapiens
AGKITANEL

SEQ ID NO: 21586 - protein, 9 aa, Homo Sapiens
KPFEAVFKF

SEQ ID NO: 21587 - protein, 9 aa, Homo Sapiens
MKDELAMVT

SEQ ID NO: 21588 - protein, 9 aa, Homo Sapiens
ELFILSVMA

SEQ ID NO: 21589 - protein, 9 aa, Homo Sapiens
AFELKYEQT

SEQ ID NO: 21590 - protein, 9 aa, Homo Sapiens
ARIYYLWTY

SEQ ID NO: 21591 - protein, 9 aa, Homo Sapiens
YSMGTEEIT

SEQ ID NO: 21592 - protein, 9 aa, Homo Sapiens
DWDGEIFRY

SEQ ID NO: 21593 - protein, 9 aa, Homo Sapiens
QNSNNSKPL

SEQ ID NO: 21594 - protein, 9 aa, Homo Sapiens
KSNTQGSAY

SEQ ID NO: 21595 - protein, 9 aa, Homo Sapiens
EPYTCPACR

SEQ ID NO: 21596 - protein, 9 aa, Homo Sapiens
NRALLSCNA

SEQ ID NO: 21597 - protein, 9 aa, Homo Sapiens
IIHTGEEPY

SEQ ID NO: 21598 - protein, 9 aa, Homo Sapiens
RIQPVEDII

SEQ ID NO: 21599 - protein, 9 aa, Homo Sapiens
WCKRMLLTL

SEQ ID NO: 21600 - protein, 9 aa, Homo Sapiens
SCKIYEKPN

SEQ ID NO: 21601 - protein, 9 aa, Homo Sapiens
KQHYFIDWD

SEQ ID NO: 21602 - protein, 9 aa, Homo Sapiens
DVVAVEAAG

SEQ ID NO: 21603 - protein, 9 aa, Homo Sapiens
TDPDAKKPR

SEQ ID NO: 21604 - protein, 9 aa, Homo Sapiens
EEPYTCPAC

SEQ ID NO: 21605 - protein, 9 aa, Homo Sapiens
NLHGNSKVN

SEQ ID NO: 21606 - protein, 9 aa, Homo Sapiens
YNKQHVLET

SEQ ID NO: 21607 - protein, 9 aa, Homo Sapiens
STGLVRPVR

SEQ ID NO: 21608 - protein, 9 aa, Homo Sapiens
HEGCVPRYH

SEQ ID NO: 21609 - protein, 9 aa, Homo Sapiens
NPHRVFWHK

SEQ ID NO: 21610 - protein, 9 aa, Homo Sapiens
AREQPILST

SEQ ID NO: 21611 - protein, 9 aa, Homo Sapiens
LHSSQDATG

SEQ ID NO: 21612 - protein, 9 aa, Homo Sapiens
RRKSNTQGS

SEQ ID NO: 21613 - protein, 9 aa, Homo Sapiens
EIQEMKDEL

SEQ ID NO: 21614 - protein, 9 aa, Homo Sapiens
YYLWTYINE

SEQ ID NO: 21615 - protein, 9 aa, Homo Sapiens
FQVDDEDLQ

SEQ ID NO: 21616 - protein, 9 aa, Homo Sapiens
KFPCGSAEE

SEQ ID NO: 21617 - protein, 9 aa, Homo Sapiens
RALLSCNAE

SEQ ID NO: 21618 - protein, 9 aa, Homo Sapiens
KHKSLPLHN

SEQ ID NO: 21619 - protein, 9 aa, Homo Sapiens
HSCYNDCTF

SEQ ID NO: 21620 - protein, 9 aa, Homo Sapiens
LTFRDAAIQ

SEQ ID NO: 21621 - protein, 9 aa, Homo Sapiens
VGDKIATWK

SEQ ID NO: 21622 - protein, 9 aa, Homo Sapiens
QCRRKRTYW

SEQ ID NO: 21623 - protein, 9 aa, Homo Sapiens
FINHKKQWI

SEQ ID NO: 21624 - protein, 9 aa, Homo Sapiens
AVRIQPVED

SEQ ID NO: 21625 - protein, 9 aa, Homo Sapiens
ENIDYCPGN

SEQ ID NO: 21626 - protein, 9 aa, Homo Sapiens
QVKLLEKPV

SEQ ID NO: 21627 - protein, 9 aa, Homo Sapiens
GDKIATWKA

SEQ ID NO: 21628 - protein, 9 aa, Homo Sapiens
QCLRLSRRA

SEQ ID NO: 21629 - protein, 9 aa, Homo Sapiens
TFSINEEEP

SEQ ID NO: 21630 - protein, 9 aa, Homo Sapiens
QGLQFSAGS

SEQ ID NO: 21631 - protein, 9 aa, Homo Sapiens
PVQTQCDCC

SEQ ID NO: 21632 - protein, 9 aa, Homo Sapiens
VEAAGLSCR

SEQ ID NO: 21633 - protein, 9 aa, Homo Sapiens
NNLHGNSKV

SEQ ID NO: 21634 - protein, 9 aa, Homo Sapiens
NAHKILPGP

SEQ ID NO: 21635 - protein, 9 aa, Homo Sapiens
FHICSPLSG

SEQ ID NO: 21636 - protein, 9 aa, Homo Sapiens
LLEKPVVHL

SEQ ID NO: 21637 - protein, 9 aa, Homo Sapiens
DFLDCQELL

SEQ ID NO: 21638 - protein, 9 aa, Homo Sapiens
KSMAKLMNN

SEQ ID NO: 21639 - protein, 9 aa, Homo Sapiens
ASAHPRGPE

SEQ ID NO: 21640 - protein, 9 aa, Homo Sapiens
NTTTTMSNA

SEQ ID NO: 21641 - protein, 9 aa, Homo Sapiens
YCPGNNCKN

SEQ ID NO: 21642 - protein, 9 aa, Homo Sapiens
VRYYNKQHV

SEQ ID NO: 21643 - protein, 9 aa, Homo Sapiens
LAINQGLQF

SEQ ID NO: 21644 - protein, 9 aa, Homo Sapiens
VLNTDPDAK

SEQ ID NO: 21645 - protein, 9 aa, Homo Sapiens
LWEGKDIAA

SEQ ID NO: 21646 - protein, 9 aa, Homo Sapiens
DLISELREP

SEQ ID NO: 21647 - protein, 9 aa, Homo Sapiens
RPAPGLLAP

SEQ ID NO: 21648 - protein, 9 aa, Homo Sapiens
SRDFLDCQE

SEQ ID NO: 21649 - protein, 9 aa, Homo Sapiens
FEAVFKFSA

SEQ ID NO: 21650 - protein, 9 aa, Homo Sapiens
AHKILPGPL

SEQ ID NO: 21651 - protein, 9 aa, Homo Sapiens
CPIDRKPFE

SEQ ID NO: 21652 - protein, 9 aa, Homo Sapiens
LREPVQTQC

SEQ ID NO: 21653 - protein, 9 aa, Homo Sapiens
KAHKRFQCK

SEQ ID NO: 21654 - protein, 9 aa, Homo Sapiens
EESLFHICS

SEQ ID NO: 21655 - protein, 9 aa, Homo Sapiens
FNAHKILPG

SEQ ID NO: 21656 - protein, 9 aa, Homo Sapiens
VILLATGLH

SEQ ID NO: 21657 - protein, 9 aa, Homo Sapiens
TAREQPILS

SEQ ID NO: 21658 - protein, 9 aa, Homo Sapiens
QGPSERTFS

SEQ ID NO: 21659 - protein, 9 aa, Homo Sapiens
ENAFLDRKA

SEQ ID NO: 21660 - protein, 9 aa, Homo Sapiens
YVSGMFRFG

SEQ ID NO: 21661 - protein, 9 aa, Homo Sapiens
CSRDFLDCQ

SEQ ID NO: 21662 - protein, 9 aa, Homo Sapiens
EAVFKFSAL

SEQ ID NO: 21663 - protein, 9 aa, Homo Sapiens
NELETKQSY

SEQ ID NO: 21664 - protein, 9 aa, Homo Sapiens
GNMSRTATS

SEQ ID NO: 21665 - protein, 9 aa, Homo Sapiens
RDFLDCQEL

SEQ ID NO: 21666 - protein, 9 aa, Homo Sapiens
DAKKPRFAS

SEQ ID NO: 21667 - protein, 9 aa, Homo Sapiens
DVRISVLKL

SEQ ID NO: 21668 - protein, 9 aa, Homo Sapiens
HFFEDPEGN

SEQ ID NO: 21669 - protein, 9 aa, Homo Sapiens
DHQQPPQHS

SEQ ID NO: 21670 - protein, 9 aa, Homo Sapiens
AEREEKRGL

SEQ ID NO: 21671 - protein, 9 aa, Homo Sapiens
EWFKFQVDD

SEQ ID NO: 21672 - protein, 9 aa, Homo Sapiens
TLLRVSVSP

SEQ ID NO: 21673 - protein, 9 aa, Homo Sapiens
LPLHNRNNT

SEQ ID NO: 21674 - protein, 9 aa, Homo Sapiens
SNVINYGHA

SEQ ID NO: 21675 - protein, 9 aa, Homo Sapiens
GPWIQGNVY

SEQ ID NO: 21676 - protein, 9 aa, Homo Sapiens
MFQHHEGCV

SEQ ID NO: 21677 - protein, 9 aa, Homo Sapiens
VFCSLIVWF

SEQ ID NO: 21678 - protein, 9 aa, Homo Sapiens
SSLPSIPAP

SEQ ID NO: 21679 - protein, 9 aa, Homo Sapiens
SVGCAVFCS

SEQ ID NO: 21680 - protein, 9 aa, Homo Sapiens
PQPQTLVQF

SEQ ID NO: 21681 - protein, 9 aa, Homo Sapiens
EPVQTQCDC

SEQ ID NO: 21682 - protein, 9 aa, Homo Sapiens
VAFNYLKIV

SEQ ID NO: 21683 - protein, 9 aa, Homo Sapiens
YEQTLRADP

SEQ ID NO: 21684 - protein, 9 aa, Homo Sapiens
RKSNTQGSA

SEQ ID NO: 21685 - protein, 9 aa, Homo Sapiens
FIAGAKMTL

SEQ ID NO: 21686 - protein, 9 aa, Homo Sapiens
HNRNNTREK

SEQ ID NO: 21687 - protein, 9 aa, Homo Sapiens
NNKIHSCYN

SEQ ID NO: 21688 - protein, 9 aa, Homo Sapiens
HHEGCVPRY

SEQ ID NO: 21689 - protein, 9 aa, Homo Sapiens
TVIAPQGYP

SEQ ID NO: 21690 - protein, 9 aa, Homo Sapiens
ELREPVQTQ

SEQ ID NO: 21691 - protein, 9 aa, Homo Sapiens
IDRKPFEAV

SEQ ID NO: 21692 - protein, 9 aa, Homo Sapiens
RTHRLAEMI

SEQ ID NO: 21693 - protein, 9 aa, Homo Sapiens
NTQGSAYSH

SEQ ID NO: 21694 - protein, 9 aa, Homo Sapiens
GNSKVNLHG

SEQ ID NO: 21695 - protein, 9 aa, Homo Sapiens
QKTAIREEL

SEQ ID NO: 21696 - protein, 9 aa, Homo Sapiens
KETQFHESE

SEQ ID NO: 21697 - protein, 9 aa, Homo Sapiens
HPTYELKTV

SEQ ID NO: 21698 - protein, 9 aa, Homo Sapiens
QSSTVLTGM

SEQ ID NO: 21699 - protein, 9 aa, Homo Sapiens
NHSKKGADH

SEQ ID NO: 21700 - protein, 9 aa, Homo Sapiens
GGPWIQGNV

SEQ ID NO: 21701 - protein, 9 aa, Homo Sapiens
GGSPRGRPA

SEQ ID NO: 21702 - protein, 9 aa, Homo Sapiens
RSLALTAAA

SEQ ID NO: 21703 - protein, 9 aa, Homo Sapiens
QASAHPRGP

SEQ ID NO: 21704 - protein, 9 aa, Homo Sapiens
TQGSAYSHL

SEQ ID NO: 21705 - protein, 9 aa, Homo Sapiens
TREAGCMAA

SEQ ID NO: 21706 - protein, 9 aa, Homo Sapiens
TGLVRPVRA

SEQ ID NO: 21707 - protein, 9 aa, Homo Sapiens
SCGCSFGYR

SEQ ID NO: 21708 - protein, 9 aa, Homo Sapiens
LLGSSGDLQ

SEQ ID NO: 21709 - protein, 9 aa, Homo Sapiens
DQASAHPRG

SEQ ID NO: 21710 - protein, 9 aa, Homo Sapiens
CLRKAHKRF

SEQ ID NO: 21711 - protein, 9 aa, Homo Sapiens
LLLLGSSGD

SEQ ID NO: 21712 - protein, 9 aa, Homo Sapiens
GGWYYCKAE

SEQ ID NO: 21713 - protein, 9 aa, Homo Sapiens
PPHSTGLVR

SEQ ID NO: 21714 - protein, 9 aa, Homo Sapiens
ALHSSQDAT

SEQ ID NO: 21715 - protein, 9 aa, Homo Sapiens
NQKGDEKLR

SEQ ID NO: 21716 - protein, 9 aa, Homo Sapiens
SKKGADHQQ

SEQ ID NO: 21717 - protein, 9 aa, Homo Sapiens
TAVRIQPVE

SEQ ID NO: 21718 - protein, 9 aa, Homo Sapiens
VIAPQGYPN

SEQ ID NO: 21719 - protein, 9 aa, Homo Sapiens
RPSANRGNF

SEQ ID NO: 21720 - protein, 9 aa, Homo Sapiens
WTYINEALK

SEQ ID NO: 21721 - protein, 9 aa, Homo Sapiens
CQELLKHQR

SEQ ID NO: 21722 - protein, 9 aa, Homo Sapiens
AGKEENGEE

SEQ ID NO: 21723 - protein, 9 aa, Homo Sapiens
DLFNAHKIL

SEQ ID NO: 21724 - protein, 9 aa, Homo Sapiens
EGKDIAAVQ

SEQ ID NO: 21725 - protein, 9 aa, Homo Sapiens
YEIFVCENA

SEQ ID NO: 21726 - protein, 9 aa, Homo Sapiens
PSWCKRMLL

SEQ ID NO: 21727 - protein, 9 aa, Homo Sapiens
NKQHVLETA

SEQ ID NO: 21728 - protein, 9 aa, Homo Sapiens
IHWDQASAH

SEQ ID NO: 21729 - protein, 9 aa, Homo Sapiens
YFIDWDGEI

SEQ ID NO: 21730 - protein, 9 aa, Homo Sapiens
HWDQASAHP

SEQ ID NO: 21731 - protein, 9 aa, Homo Sapiens
VPSPVRTLL

SEQ ID NO: 21732 - protein, 9 aa, Homo Sapiens
NGRTVIAPQ

SEQ ID NO: 21733 - protein, 9 aa, Homo Sapiens
CKRMLLTLK

SEQ ID NO: 21734 - protein, 9 aa, Homo Sapiens
KVLEMPSEA

SEQ ID NO: 21735 - protein, 9 aa, Homo Sapiens
CQENGRTVI

SEQ ID NO: 21736 - protein, 9 aa, Homo Sapiens
QTLVQFVLQ

SEQ ID NO: 21737 - protein, 9 aa, Homo Sapiens
NTGTLQFCQ

SEQ ID NO: 21738 - protein, 9 aa, Homo Sapiens
PTYELKTVT

SEQ ID NO: 21739 - protein, 9 aa, Homo Sapiens
FPCGSAEEF

SEQ ID NO: 21740 - protein, 9 aa, Homo Sapiens
LVQFVLQAE

SEQ ID NO: 21741 - protein, 9 aa, Homo Sapiens
SAYSHLTEF

SEQ ID NO: 21742 - protein, 9 aa, Homo Sapiens
HENGNMSRT

SEQ ID NO: 21743 - protein, 9 aa, Homo Sapiens
LTAAAEHKL

SEQ ID NO: 21744 - protein, 9 aa, Homo Sapiens
PHSTGLVRP

SEQ ID NO: 21745 - protein, 9 aa, Homo Sapiens
AGCMAAGVV

SEQ ID NO: 21746 - protein, 9 aa, Homo Sapiens
REPVQTQCD

SEQ ID NO: 21747 - protein, 9 aa, Homo Sapiens
VLEMPSEAC

SEQ ID NO: 21748 - protein, 9 aa, Homo Sapiens
LTVKDLLLL

SEQ ID NO: 21749 - protein, 9 aa, Homo Sapiens
FVRYYNKQH

SEQ ID NO: 21750 - protein, 9 aa, Homo Sapiens
RKETQFHES

SEQ ID NO: 21751 - protein, 9 aa, Homo Sapiens
EENIDYCPG

SEQ ID NO: 21752 - protein, 9 aa, Homo Sapiens
GKEENGEEE

SEQ ID NO: 21753 - protein, 9 aa, Homo Sapiens
DRKPFEAVF

SEQ ID NO: 21754 - protein, 9 aa, Homo Sapiens
RATLDVVAV

SEQ ID NO: 21755 - protein, 9 aa, Homo Sapiens
NCEENIDYC

SEQ ID NO: 21756 - protein, 9 aa, Homo Sapiens
CDVNRALLS

SEQ ID NO: 21757 - protein, 9 aa, Homo Sapiens
FSAGSVARI

SEQ ID NO: 21758 - protein, 9 aa, Homo Sapiens
KADMLEKGQ

SEQ ID NO: 21759 - protein, 9 aa, Homo Sapiens
WQTYVSGMF

SEQ ID NO: 21760 - protein, 9 aa, Homo Sapiens
KPVVHLGVG

SEQ ID NO: 21761 - protein, 9 aa, Homo Sapiens
CAVFCSLIV

SEQ ID NO: 21762 - protein, 9 aa, Homo Sapiens
AQNSNNSKP

SEQ ID NO: 21763 - protein, 9 aa, Homo Sapiens
SELREPVQT

SEQ ID NO: 21764 - protein, 9 aa, Homo Sapiens
FQHHEGCVP

SEQ ID NO: 21765 - protein, 9 aa, Homo Sapiens
PSPVRTLLR

SEQ ID NO: 21766 - protein, 9 aa, Homo Sapiens
GNIELPPSL

SEQ ID NO: 21767 - protein, 9 aa, Homo Sapiens
DVAAEKKMV

SEQ ID NO: 21768 - protein, 9 aa, Homo Sapiens
SANRGNFSP

SEQ ID NO: 21769 - protein, 9 aa, Homo Sapiens
LVRPVRAQG

SEQ ID NO: 21770 - protein, 9 aa, Homo Sapiens
DLVKGTNYQ

SEQ ID NO: 21771 - protein, 9 aa, Homo Sapiens
KTAIREELN

SEQ ID NO: 21772 - protein, 9 aa, Homo Sapiens
VLLEAGAFP

SEQ ID NO: 21773 - protein, 9 aa, Homo Sapiens
ISVLKLLGI

SEQ ID NO: 21774 - protein, 9 aa, Homo Sapiens
SKFFDDPVL

SEQ ID NO: 21775 - protein, 9 aa, Homo Sapiens
EESTALHSS

SEQ ID NO: 21776 - protein, 9 aa, Homo Sapiens
KQHVLETAA

SEQ ID NO: 21777 - protein, 9 aa, Homo Sapiens
YELKTVTTG

SEQ ID NO: 21778 - protein, 9 aa, Homo Sapiens
NTEESLFHI

SEQ ID NO: 21779 - protein, 9 aa, Homo Sapiens
LLQLQEQKT

SEQ ID NO: 21780 - protein, 9 aa, Homo Sapiens
CRTHRLAEM

SEQ ID NO: 21781 - protein, 9 aa, Homo Sapiens
TQFHESEGR

SEQ ID NO: 21782 - protein, 9 aa, Homo Sapiens
AAEKKMVKI

SEQ ID NO: 21783 - protein, 9 aa, Homo Sapiens
LFNAHKILP

SEQ ID NO: 21784 - protein, 9 aa, Homo Sapiens
SWCKRMLLT

SEQ ID NO: 21785 - protein, 9 aa, Homo Sapiens
AEEFPNMPV

SEQ ID NO: 21786 - protein, 9 aa, Homo Sapiens
TLDVVAVEA

SEQ ID NO: 21787 - protein, 9 aa, Homo Sapiens
GKAFNNYST

SEQ ID NO: 21788 - protein, 9 aa, Homo Sapiens
TALHSSQDA

SEQ ID NO: 21789 - protein, 9 aa, Homo Sapiens
TVLTGMRPG

SEQ ID NO: 21790 - protein, 9 aa, Homo Sapiens
QPILSTRAH

SEQ ID NO: 21791 - protein, 9 aa, Homo Sapiens
EAGCMAAGV

SEQ ID NO: 21792 - protein, 9 aa, Homo Sapiens
KKPRFASNL

SEQ ID NO: 21793 - protein, 9 aa, Homo Sapiens
EDLFNAHKI

SEQ ID NO: 21794 - protein, 9 aa, Homo Sapiens
ATWKACGLA

SEQ ID NO: 21795 - protein, 9 aa, Homo Sapiens
STVLTGMRP

SEQ ID NO: 21796 - protein, 9 aa, Homo Sapiens
AKMTLPEGI

SEQ ID NO: 21797 - protein, 9 aa, Homo Sapiens
WNSEWFKFQ

SEQ ID NO: 21798 - protein, 9 aa, Homo Sapiens
HCAARVGHT

SEQ ID NO: 21799 - protein, 9 aa, Homo Sapiens
FLFINHKKQ

SEQ ID NO: 21800 - protein, 9 aa, Homo Sapiens
AFLFINHKK

SEQ ID NO: 21801 - protein, 9 aa, Homo Sapiens
PDAKKPRFA

SEQ ID NO: 21802 - protein, 9 aa, Homo Sapiens
LPWGVDKYL

SEQ ID NO: 21803 - protein, 9 aa, Homo Sapiens
LEKPVVHLG

SEQ ID NO: 21804 - protein, 9 aa, Homo Sapiens
SRTATSSPH

SEQ ID NO: 21805 - protein, 9 aa, Homo Sapiens
FILSVMAYD

SEQ ID NO: 21806 - protein, 9 aa, Homo Sapiens
LKLLGIILA

SEQ ID NO: 21807 - protein, 9 aa, Homo Sapiens
EAVSSNVIN

SEQ ID NO: 21808 - protein, 9 aa, Homo Sapiens
GWYYCKAEN

SEQ ID NO: 21809 - protein, 9 aa, Homo Sapiens
FFEDPEGNI

SEQ ID NO: 21810 - protein, 9 aa, Homo Sapiens
ILSTRAHVF

SEQ ID NO: 21811 - protein, 9 aa, Homo Sapiens
LQEQKTAIR

SEQ ID NO: 21812 - protein, 9 aa, Homo Sapiens
SSNVINYGH

SEQ ID NO: 21813 - protein, 9 aa, Homo Sapiens
PPASSLPSI

SEQ ID NO: 21814 - protein, 9 aa, Homo Sapiens
ESLFHICSP

SEQ ID NO: 21815 - protein, 9 aa, Homo Sapiens
MIYWIRCLH

SEQ ID NO: 21816 - protein, 9 aa, Homo Sapiens
GKITANELE

SEQ ID NO: 21817 - protein, 9 aa, Homo Sapiens
CEENIDYCP

SEQ ID NO: 21818 - protein, 9 aa, Homo Sapiens
INTGTLQFC

SEQ ID NO: 21819 - protein, 9 aa, Homo Sapiens
LLLGSSGDL

SEQ ID NO: 21820 - protein, 9 aa, Homo Sapiens
KVNLHGCRD

SEQ ID NO: 21821 - protein, 9 aa, Homo Sapiens
NIELPPSLK

SEQ ID NO: 21822 - protein, 9 aa, Homo Sapiens
KEIAAACIH

SEQ ID NO: 21823 - protein, 9 aa, Homo Sapiens
QVDDEDLQD

SEQ ID NO: 21824 - protein, 9 aa, Homo Sapiens
PEFAMYYEI

SEQ ID NO: 21825 - protein, 9 aa, Homo Sapiens
AVSSNVINY

SEQ ID NO: 21826 - protein, 9 aa, Homo Sapiens
YYEIFVCEN

SEQ ID NO: 21827 - protein, 9 aa, Homo Sapiens
RDAAIQFSL

SEQ ID NO: 21828 - protein, 9 aa, Homo Sapiens
DCQELLKHQ

SEQ ID NO: 21829 - protein, 9 aa, Homo Sapiens
ALTAAAEHK

SEQ ID NO: 21830 - protein, 9 aa, Homo Sapiens
REQPILSTR

SEQ ID NO: 21831 - protein, 9 aa, Homo Sapiens
QFSAGSVAR

SEQ ID NO: 21832 - protein, 9 aa, Homo Sapiens
ITANELETK

SEQ ID NO: 21833 - protein, 9 aa, Homo Sapiens
DPCKGGYVA

SEQ ID NO: 21834 - protein, 9 aa, Homo Sapiens
CKIYEKPNS

SEQ ID NO: 21835 - protein, 9 aa, Homo Sapiens
PSERTFSIN

SEQ ID NO: 21836 - protein, 9 aa, Homo Sapiens
LQFCQASDT

SEQ ID NO: 21837 - protein, 9 aa, Homo Sapiens
HKRFQCKEI

SEQ ID NO: 21838 - protein, 9 aa, Homo Sapiens
TTTTMSNAT

SEQ ID NO: 21839 - protein, 9 aa, Homo Sapiens
IAFLFINHK

SEQ ID NO: 21840 - protein, 9 aa, Homo Sapiens
KYLDYLCIK

SEQ ID NO: 21841 - protein, 9 aa, Homo Sapiens
GADHQQPPQ

SEQ ID NO: 21842 - protein, 9 aa, Homo Sapiens
KVCGCDVNR

SEQ ID NO: 21843 - protein, 9 aa, Homo Sapiens
VEDIISAVW

SEQ ID NO: 21844 - protein, 9 aa, Homo Sapiens
GMRPGMEYT

SEQ ID NO: 21845 - protein, 9 aa, Homo Sapiens
EREEKRGLG

SEQ ID NO: 21846 - protein, 9 aa, Homo Sapiens
RLQKEIQEM

SEQ ID NO: 21847 - protein, 9 aa, Homo Sapiens
KGTNYQVAC

SEQ ID NO: 21848 - protein, 9 aa, Homo Sapiens
RAQNSNNSK

SEQ ID NO: 21849 - protein, 9 aa, Homo Sapiens
WDQASAHPR

SEQ ID NO: 21850 - protein, 9 aa, Homo Sapiens
SNTQGSAYS

SEQ ID NO: 21851 - protein, 9 aa, Homo Sapiens
EIAAACIHM

SEQ ID NO: 21852 - protein, 9 aa, Homo Sapiens
NQGLQFSAG

SEQ ID NO: 21853 - protein, 9 aa, Homo Sapiens
MLEKGQVGH

SEQ ID NO: 21854 - protein, 9 aa, Homo Sapiens
GLQFSAGSV

SEQ ID NO: 21855 - protein, 9 aa, Homo Sapiens
TLPEGIQRE

SEQ ID NO: 21856 - protein, 9 aa, Homo Sapiens
LKYEQTLRA

SEQ ID NO: 21857 - protein, 9 aa, Homo Sapiens
RTLLRVSVS

SEQ ID NO: 21858 - protein, 9 aa, Homo Sapiens
GSCGCSFGY

SEQ ID NO: 21859 - protein, 9 aa, Homo Sapiens
ANRGNFSPE

SEQ ID NO: 21860 - protein, 9 aa, Homo Sapiens
SSQCLRLSR

SEQ ID NO: 21861 - protein, 9 aa, Homo Sapiens
WCQENGRTV

SEQ ID NO: 21862 - protein, 9 aa, Homo Sapiens
PKFPCGSAE

SEQ ID NO: 21863 - protein, 9 aa, Homo Sapiens
ANELETKQS

SEQ ID NO: 21864 - protein, 9 aa, Homo Sapiens
NSKVNLHGC

SEQ ID NO: 21865 - protein, 9 aa, Homo Sapiens
MPSEACAFL

SEQ ID NO: 21866 - protein, 9 aa, Homo Sapiens
KGADHQQPP

SEQ ID NO: 21867 - protein, 9 aa, Homo Sapiens
FCQASDTEE

SEQ ID NO: 21868 - protein, 9 aa, Homo Sapiens
TLVQFVLQA

SEQ ID NO: 21869 - protein, 9 aa, Homo Sapiens
TFSCLQNLT

SEQ ID NO: 21870 - protein, 9 aa, Homo Sapiens
VNRALLSCN

SEQ ID NO: 21871 - protein, 9 aa, Homo Sapiens
SELFILSVM

SEQ ID NO: 21872 - protein, 9 aa, Homo Sapiens
MRPGMEYTV

SEQ ID NO: 21873 - protein, 9 aa, Homo Sapiens
PFNPHRVFW

SEQ ID NO: 21874 - protein, 9 aa, Homo Sapiens
ADDTFSCLQ

SEQ ID NO: 21875 - protein, 9 aa, Homo Sapiens
HVLETAAKH

SEQ ID NO: 21876 - protein, 9 aa, Homo Sapiens
NMSRTATSS

SEQ ID NO: 21877 - protein, 9 aa, Homo Sapiens
REAGCMAAG

SEQ ID NO: 21878 - protein, 9 aa, Homo Sapiens
LFHICSPLS

SEQ ID NO: 21879 - protein, 9 aa, Homo Sapiens
IADDTFSCL

SEQ ID NO: 21880 - protein, 9 aa, Homo Sapiens
NYDVRISVL

SEQ ID NO: 21881 - protein, 9 aa, Homo Sapiens
GSPRGRPAP

SEQ ID NO: 21882 - protein, 9 aa, Homo Sapiens
ELKYEQTLR

SEQ ID NO: 21883 - protein, 9 aa, Homo Sapiens
AQVKLLEKP

SEQ ID NO: 21884 - protein, 9 aa, Homo Sapiens
DLWEGKDIA

SEQ ID NO: 21885 - protein, 9 aa, Homo Sapiens
GCDVNRALL

SEQ ID NO: 21886 - protein, 9 aa, Homo Sapiens
PVRTLLRVS

SEQ ID NO: 21887 - protein, 9 aa, Homo Sapiens
GSAYSHLTE

SEQ ID NO: 21888 - protein, 9 aa, Homo Sapiens
TAAAEHKLK

SEQ ID NO: 21889 - protein, 9 aa, Homo Sapiens
ARKLNTTTT

SEQ ID NO: 21890 - protein, 9 aa, Homo Sapiens
TLQFCQASD

SEQ ID NO: 21891 - protein, 9 aa, Homo Sapiens
VDVAAEKKM

SEQ ID NO: 21892 - protein, 9 aa, Homo Sapiens
KFQVDDEDL

SEQ ID NO: 21893 - protein, 9 aa, Homo Sapiens
QHYFIDWDG

SEQ ID NO: 21894 - protein, 9 aa, Homo Sapiens
LSTRAHVFQ

SEQ ID NO: 21895 - protein, 9 aa, Homo Sapiens
IATWKACGL

SEQ ID NO: 21896 - protein, 9 aa, Homo Sapiens
LEKGQVGHI

SEQ ID NO: 21897 - protein, 9 aa, Homo Sapiens
DEGCLRKAH

SEQ ID NO: 21898 - protein, 9 aa, Homo Sapiens
AACIHMMPN

SEQ ID NO: 21899 - protein, 9 aa, Homo Sapiens
AFIAGAKMT

SEQ ID NO: 21900 - protein, 9 aa, Homo Sapiens
GQVGHIRAE

SEQ ID NO: 21901 - protein, 9 aa, Homo Sapiens
SLPSIPAPL

SEQ ID NO: 21902 - protein, 9 aa, Homo Sapiens
VRISVLKLL

SEQ ID NO: 21903 - protein, 9 aa, Homo Sapiens
VDKYLDYLC

SEQ ID NO: 21904 - protein, 9 aa, Homo Sapiens
PNKAFELKY

SEQ ID NO: 21905 - protein, 9 aa, Homo Sapiens
PCKGGYVAF

SEQ ID NO: 21906 - protein, 9 aa, Homo Sapiens
FRDAAIQFS

SEQ ID NO: 21907 - protein, 9 aa, Homo Sapiens
MAKLMNNVF

SEQ ID NO: 21908 - protein, 9 aa, Homo Sapiens
AFLDRKALR

SEQ ID NO: 21909 - protein, 9 aa, Homo Sapiens
TANELETKQ

SEQ ID NO: 21910 - protein, 9 aa, Homo Sapiens
NMDYSMGTE

SEQ ID NO: 21911 - protein, 9 aa, Homo Sapiens
SKVNLHGCR

SEQ ID NO: 21912 - protein, 9 aa, Homo Sapiens
EERAGKEEN

SEQ ID NO: 21913 - protein, 9 aa, Homo Sapiens
KNNKIHSCY

SEQ ID NO: 21914 - protein, 9 aa, Homo Sapiens
GMFRFGKVD

SEQ ID NO: 21915 - protein, 9 aa, Homo Sapiens
AFNNYSTLM

SEQ ID NO: 21916 - protein, 9 aa, Homo Sapiens
SIPAPLHEA

SEQ ID NO: 21917 - protein, 9 aa, Homo Sapiens
ACSRDFLDC

SEQ ID NO: 21918 - protein, 9 aa, Homo Sapiens
NVINYGHAS

SEQ ID NO: 21919 - protein, 9 aa, Homo Sapiens
HICSPLSGA

SEQ ID NO: 21920 - protein, 9 aa, Homo Sapiens
DDTFSCLQN

SEQ ID NO: 21921 - protein, 9 aa, Homo Sapiens
LLPWGVDKY

SEQ ID NO: 21922 - protein, 9 aa, Homo Sapiens
CSLIVWFFV

SEQ ID NO: 21923 - protein, 9 aa, Homo Sapiens
NTDPDAKKP

SEQ ID NO: 21924 - protein, 9 aa, Homo Sapiens
LFILSVMAY

SEQ ID NO: 21925 - protein, 9 aa, Homo Sapiens
SLFHICSPL

SEQ ID NO: 21926 - protein, 9 aa, Homo Sapiens
CIHMMPNAV

SEQ ID NO: 21927 - protein, 9 aa, Homo Sapiens
VKLLEKPVV

SEQ ID NO: 21928 - protein, 9 aa, Homo Sapiens
PVEDIISAV

SEQ ID NO: 21929 - protein, 9 aa, Homo Sapiens
YVAFNYLKI

SEQ ID NO: 21930 - protein, 9 aa, Homo Sapiens
SSTVLTGMR

SEQ ID NO: 21931 - protein, 9 aa, Homo Sapiens
ECGKAFNNY

SEQ ID NO: 21932 - protein, 9 aa, Homo Sapiens
QHVLETAAK

SEQ ID NO: 21933 - protein, 9 aa, Homo Sapiens
DPEGNIELP

SEQ ID NO: 21934 - protein, 9 aa, Homo Sapiens
EDPEGNIEL

SEQ ID NO: 21935 - protein, 9 aa, Homo Sapiens
YLDYLCIKH

SEQ ID NO: 21936 - protein, 9 aa, Homo Sapiens
HHPTYELKT

SEQ ID NO: 21937 - protein, 9 aa, Homo Sapiens
FLDRKALRL

SEQ ID NO: 21938 - protein, 9 aa, Homo Sapiens
PASSLPSIP

SEQ ID NO: 21939 - protein, 9 aa, Homo Sapiens
MDYSMGTEE

SEQ ID NO: 21940 - protein, 9 aa, Homo Sapiens
VINYGHASK

SEQ ID NO: 21941 - protein, 9 aa, Homo Sapiens
PLHNRNNTR

SEQ ID NO: 21942 - protein, 9 aa, Homo Sapiens
RSVSVQDVI

SEQ ID NO: 21943 - protein, 9 aa, Homo Sapiens
SCLQNLTEL

SEQ ID NO: 21944 - protein, 9 aa, Homo Sapiens
AGAKMTLPE

SEQ ID NO: 21945 - protein, 9 aa, Homo Sapiens
GLGLVLLRG

SEQ ID NO: 21946 - protein, 9 aa, Homo Sapiens
SCYNDCTFS

SEQ ID NO: 21947 - protein, 9 aa, Homo Sapiens
LVKGTNYQV

SEQ ID NO: 21948 - protein, 9 aa, Homo Sapiens
MTLPEGIQR

SEQ ID NO: 21949 - protein, 9 aa, Homo Sapiens
ATLDVVAVE

SEQ ID NO: 21950 - protein, 9 aa, Homo Sapiens
CLRLSRRAL

SEQ ID NO: 21951 - protein, 9 aa, Homo Sapiens
LMNNVFGKR

SEQ ID NO: 21952 - protein, 9 aa, Homo Sapiens
KKGADHQQP

SEQ ID NO: 21953 - protein, 9 aa, Homo Sapiens
DVNRALLSC

SEQ ID NO: 21954 - protein, 9 aa, Homo Sapiens
GNNLHGNSK

SEQ ID NO: 21955 - protein, 9 aa, Homo Sapiens
AFPALLEIQ

SEQ ID NO: 21956 - protein, 9 aa, Homo Sapiens
EAGAFPGGS

SEQ ID NO: 21957 - protein, 9 aa, Homo Sapiens
HKSLPLHNR

SEQ ID NO: 21958 - protein, 9 aa, Homo Sapiens
KEENQKGDE

SEQ ID NO: 21959 - protein, 9 aa, Homo Sapiens
LKRSLALTA

SEQ ID NO: 21960 - protein, 9 aa, Homo Sapiens
MFRFGKVDV

SEQ ID NO: 21961 - protein, 9 aa, Homo Sapiens
IQEMKDELA

SEQ ID NO: 21962 - protein, 9 aa, Homo Sapiens
ESEGRQAAF

SEQ ID NO: 21963 - protein, 9 aa, Homo Sapiens
FDDPVLLEL

SEQ ID NO: 21964 - protein, 9 aa, Homo Sapiens
SSPPHSTGL

SEQ ID NO: 21965 - protein, 9 aa, Homo Sapiens
FAPPNMDYS

SEQ ID NO: 21966 - protein, 9 aa, Homo Sapiens
ALDEMFQHH

SEQ ID NO: 21967 - protein, 9 aa, Homo Sapiens
DEKLRCDSA

SEQ ID NO: 21968 - protein, 9 aa, Homo Sapiens
LHGNSKVNL

SEQ ID NO: 21969 - protein, 9 aa, Homo Sapiens
VRIQPVEDI

SEQ ID NO: 21970 - protein, 9 aa, Homo Sapiens
VLKLLGIIL

SEQ ID NO: 21971 - protein, 9 aa, Homo Sapiens
VGCAVFCSL

SEQ ID NO: 21972 - protein, 9 aa, Homo Sapiens
VDQTPFNPH

SEQ ID NO: 21973 - protein, 9 aa, Homo Sapiens
VAVEAAGLS

SEQ ID NO: 21974 - protein, 9 aa, Homo Sapiens
FRAGSCGCS

SEQ ID NO: 21975 - protein, 9 aa, Homo Sapiens
AGSCGCSFG

SEQ ID NO: 21976 - protein, 9 aa, Homo Sapiens
VQDVILLAT

SEQ ID NO: 21977 - protein, 9 aa, Homo Sapiens
RLAEMIYWI

SEQ ID NO: 21978 - protein, 9 aa, Homo Sapiens
KEIQEMKDE

SEQ ID NO: 21979 - protein, 9 aa, Homo Sapiens
AMYYEIFVC

SEQ ID NO: 21980 - protein, 9 aa, Homo Sapiens
PIDRKPFEA

SEQ ID NO: 21981 - protein, 9 aa, Homo Sapiens
RVGHTNMVK

SEQ ID NO: 21982 - protein, 9 aa, Homo Sapiens
PRPSANRGN

SEQ ID NO: 21983 - protein, 9 aa, Homo Sapiens
APPNMDYSM

SEQ ID NO: 21984 - protein, 9 aa, Homo Sapiens
CKGGYVAFN

SEQ ID NO: 21985 - protein, 9 aa, Homo Sapiens
VQFVLQAEM

SEQ ID NO: 21986 - protein, 9 aa, Homo Sapiens
DPSWCKRML

SEQ ID NO: 21987 - protein, 9 aa, Homo Sapiens
QPVEDIISA

SEQ ID NO: 21988 - protein, 9 aa, Homo Sapiens
YYNKQHVLE

SEQ ID NO: 21989 - protein, 9 aa, Homo Sapiens
SLIVWFFVC

SEQ ID NO: 21990 - protein, 9 aa, Homo Sapiens
GCLRKAHKR

SEQ ID NO: 21991 - protein, 9 aa, Homo Sapiens
GRKETQFHE

SEQ ID NO: 21992 - protein, 9 aa, Homo Sapiens
RYYNKQHVL

SEQ ID NO: 21993 - protein, 9 aa, Homo Sapiens
ESTALHSSQ

SEQ ID NO: 21994 - protein, 9 aa, Homo Sapiens
GLVRPVRAQ

SEQ ID NO: 21995 - protein, 9 aa, Homo Sapiens
HSTGLVRPV

SEQ ID NO: 21996 - protein, 9 aa, Homo Sapiens
GAKMTLPEG

SEQ ID NO: 21997 - protein, 9 aa, Homo Sapiens
CRRKRTYWN

SEQ ID NO: 21998 - protein, 9 aa, Homo Sapiens
LISSQCLRL

SEQ ID NO: 21999 - protein, 9 aa, Homo Sapiens
GRTREAGCM

SEQ ID NO: 22000 - protein, 9 aa, Homo Sapiens
KFFDDPVLL

SEQ ID NO: 22001 - protein, 9 aa, Homo Sapiens
IQISLFVVL

SEQ ID NO: 22002 - protein, 9 aa, Homo Sapiens
PCGSAEEFP

SEQ ID NO: 22003 - protein, 9 aa, Homo Sapiens
VDLWEGKDI

SEQ ID NO: 22004 - protein, 9 aa, Homo Sapiens
NRGNFSPER

SEQ ID NO: 22005 - protein, 9 aa, Homo Sapiens
LNTDPDAKK

SEQ ID NO: 22006 - protein, 9 aa, Homo Sapiens
FPALLEIQI

SEQ ID NO: 22007 - protein, 9 aa, Homo Sapiens
LDVVAVEAA

SEQ ID NO: 22008 - protein, 9 aa, Homo Sapiens
CAARVGHTN

SEQ ID NO: 22009 - protein, 9 aa, Homo Sapiens
IAGAKMTLP

SEQ ID NO: 22010 - protein, 9 aa, Homo Sapiens
FHKEIAAAC

SEQ ID NO: 22011 - protein, 9 aa, Homo Sapiens
RAGKEENGE

SEQ ID NO: 22012 - protein, 9 aa, Homo Sapiens
LEIQISLFV

SEQ ID NO: 22013 - protein, 9 aa, Homo Sapiens
LQFSAGSVA

SEQ ID NO: 22014 - protein, 9 aa, Homo Sapiens
TPLHCAARV

SEQ ID NO: 22015 - protein, 9 aa, Homo Sapiens
EIQISLFVV

SEQ ID NO: 22016 - protein, 9 aa, Homo Sapiens
PQTLVQFVL

SEQ ID NO: 22017 - protein, 9 aa, Homo Sapiens
DYSMGTEEI

SEQ ID NO: 22018 - protein, 9 aa, Homo Sapiens
GRSEESTAL

SEQ ID NO: 22019 - protein, 9 aa, Homo Sapiens
SGMFRFGKV

SEQ ID NO: 22020 - protein, 9 aa, Homo Sapiens
AEMIYWIRC

SEQ ID NO: 22021 - protein, 9 aa, Homo Sapiens
LDEMFQHHE

SEQ ID NO: 22022 - protein, 9 aa, Homo Sapiens
IQRHQGGWY

SEQ ID NO: 22023 - protein, 9 aa, Homo Sapiens
LRKAHKRFQ

SEQ ID NO: 22024 - protein, 9 aa, Homo Sapiens
TKNNKIHSC

SEQ ID NO: 22025 - protein, 9 aa, Homo Sapiens
WEGKDIAAV

SEQ ID NO: 22026 - protein, 9 aa, Homo Sapiens
TPGGPWIQG

SEQ ID NO: 22027 - protein, 9 aa, Homo Sapiens
VSGMFRFGK

SEQ ID NO: 22028 - protein, 9 aa, Homo Sapiens
GCMAAGVVI

SEQ ID NO: 22029 - protein, 9 aa, Homo Sapiens
IDYCPGNNC

SEQ ID NO: 22030 - protein, 9 aa, Homo Sapiens
SEACAFLIT

SEQ ID NO: 22031 - protein, 9 aa, Homo Sapiens
EQPILSTRA

SEQ ID NO: 22032 - protein, 9 aa, Homo Sapiens
QEQKTAIRE

SEQ ID NO: 22033 - protein, 9 aa, Homo Sapiens
TFRDAAIQF

SEQ ID NO: 22034 - protein, 9 aa, Homo Sapiens
DKIATWKAC

SEQ ID NO: 22035 - protein, 9 aa, Homo Sapiens
PHRVFWHKN

SEQ ID NO: 22036 - protein, 9 aa, Homo Sapiens
ENGEEEGDQ

SEQ ID NO: 22037 - protein, 9 aa, Homo Sapiens
DPVLLELAK

SEQ ID NO: 22038 - protein, 9 aa, Homo Sapiens
QENGRTVIA

SEQ ID NO: 22039 - protein, 9 aa, Homo Sapiens
NGNMSRTAT

SEQ ID NO: 22040 - protein, 9 aa, Homo Sapiens
HESEGRQAA

SEQ ID NO: 22041 - protein, 9 aa, Homo Sapiens
FIDWDGEIF

SEQ ID NO: 22042 - protein, 9 aa, Homo Sapiens
QGNVYIHPT

SEQ ID NO: 22043 - protein, 9 aa, Homo Sapiens
FRFGKVDVT

SEQ ID NO: 22044 - protein, 9 aa, Homo Sapiens
GFRAGSCGC

SEQ ID NO: 22045 - protein, 9 aa, Homo Sapiens
TGTLQFCQA

SEQ ID NO: 22046 - protein, 9 aa, Homo Sapiens
LHCAARVGH

SEQ ID NO: 22047 - protein, 9 aa, Homo Sapiens
TLLQLQEQK

SEQ ID NO: 22048 - protein, 9 aa, Homo Sapiens
KGQVGHIRA

SEQ ID NO: 22049 - protein, 9 aa, Homo Sapiens
WIQGNVYIH

SEQ ID NO: 22050 - protein, 9 aa, Homo Sapiens
SVLKLLGII

SEQ ID NO: 22051 - protein, 9 aa, Homo Sapiens
SPVRTLLRV

SEQ ID NO: 22052 - protein, 9 aa, Homo Sapiens
DMLEKGQVG

SEQ ID NO: 22053 - protein, 9 aa, Homo Sapiens
DDPVLLELA

SEQ ID NO: 22054 - protein, 9 aa, Homo Sapiens
CGCDVNRAL

SEQ ID NO: 22055 - protein, 9 aa, Homo Sapiens
KHENGNMSR

SEQ ID NO: 22056 - protein, 9 aa, Homo Sapiens
KIHSCYNDC

SEQ ID NO: 22057 - protein, 9 aa, Homo Sapiens
GDEKLRCDS

SEQ ID NO: 22058 - protein, 9 aa, Homo Sapiens
STAREQPIL

SEQ ID NO: 22059 - protein, 9 aa, Homo Sapiens
DAAIQFSLE

SEQ ID NO: 22060 - protein, 9 aa, Homo Sapiens
DPDAKKPRF

SEQ ID NO: 22061 - protein, 9 aa, Homo Sapiens
VLTGMRPGM

SEQ ID NO: 22062 - protein, 9 aa, Homo Sapiens
QPRPSANRG

SEQ ID NO: 22063 - protein, 9 aa, Homo Sapiens
GSKSMAKLM

SEQ ID NO: 22064 - protein, 9 aa, Homo Sapiens
AGAFPGGSI

SEQ ID NO: 22065 - protein, 9 aa, Homo Sapiens
EMKDELAMV

SEQ ID NO: 22066 - protein, 9 aa, Homo Sapiens
QNCEENIDY

SEQ ID NO: 22067 - protein, 9 aa, Homo Sapiens
LLEAGAFPG

SEQ ID NO: 22068 - protein, 9 aa, Homo Sapiens
VKDLLLLGS

SEQ ID NO: 22069 - protein, 9 aa, Homo Sapiens
RKADMLEKG

SEQ ID NO: 22070 - protein, 9 aa, Homo Sapiens
GKDIAAVQR

SEQ ID NO: 22071 - protein, 9 aa, Homo Sapiens
RSEESTALH

SEQ ID NO: 22072 - protein, 9 aa, Homo Sapiens
ISKFFDDPV

SEQ ID NO: 22073 - protein, 9 aa, Homo Sapiens
SISCKIYEK

SEQ ID NO: 22074 - protein, 9 aa, Homo Sapiens
CLQNLTELS

SEQ ID NO: 22075 - protein, 9 aa, Homo Sapiens
ISCKIYEKP

SEQ ID NO: 22076 - protein, 9 aa, Homo Sapiens
HTPGGPWIQ

SEQ ID NO: 22077 - protein, 9 aa, Homo Sapiens
KEENGEEEG

SEQ ID NO: 22078 - protein, 9 aa, Homo Sapiens
RVGDKIATW

SEQ ID NO: 22079 - protein, 9 aa, Homo Sapiens
SAEEFPNMP

SEQ ID NO: 22080 - protein, 9 aa, Homo Sapiens
KMVKITSEI

SEQ ID NO: 22081 - protein, 9 aa, Homo Sapiens
MSRTATSSP

SEQ ID NO: 22082 - protein, 9 aa, Homo Sapiens
LTGMRPGME

SEQ ID NO: 22083 - protein, 9 aa, Homo Sapiens
WGVDKYLDY

SEQ ID NO: 22084 - protein, 9 aa, Homo Sapiens
AVEAAGLSC

SEQ ID NO: 22085 - protein, 9 aa, Homo Sapiens
VSSNVINYG

SEQ ID NO: 22086 - protein, 9 aa, Homo Sapiens
NIQRHQGGW

SEQ ID NO: 22087 - protein, 9 aa, Homo Sapiens
LLRAQNSNN

SEQ ID NO: 22088 - protein, 9 aa, Homo Sapiens
KKMVKITSE

SEQ ID NO: 22089 - protein, 9 aa, Homo Sapiens
ADHQQPPQH

SEQ ID NO: 22090 - protein, 9 aa, Homo Sapiens
ASSLPSIPA

SEQ ID NO: 22091 - protein, 9 aa, Homo Sapiens
VSVQDVILL

SEQ ID NO: 22092 - protein, 9 aa, Homo Sapiens
TYELKTVTT

SEQ ID NO: 22093 - protein, 9 aa, Homo Sapiens
ETQFHESEG

SEQ ID NO: 22094 - protein, 9 aa, Homo Sapiens
IYYLWTYIN

SEQ ID NO: 22095 - protein, 9 aa, Homo Sapiens
MVKITSEIP

SEQ ID NO: 22096 - protein, 9 aa, Homo Sapiens
LSRDLLRAQ

SEQ ID NO: 22097 - protein, 9 aa, Homo Sapiens
WKACGLALA

SEQ ID NO: 22098 - protein, 9 aa, Homo Sapiens
FKFQVDDED

SEQ ID NO: 22099 - protein, 9 aa, Homo Sapiens
IQPVEDIIS

SEQ ID NO: 22100 - protein, 9 aa, Homo Sapiens
DIAAVQRTL

SEQ ID NO: 22101 - protein, 9 aa, Homo Sapiens
YDVRISVLK

SEQ ID NO: 22102 - protein, 9 aa, Homo Sapiens
LWTYINEAL

SEQ ID NO: 22103 - protein, 9 aa, Homo Sapiens
DKYLDYLCI

SEQ ID NO: 22104 - protein, 9 aa, Homo Sapiens
HKEIAAACI

SEQ ID NO: 22105 - protein, 9 aa, Homo Sapiens
GCAVFCSLI

SEQ ID NO: 22106 - protein, 9 aa, Homo Sapiens
VSAGKITAN

SEQ ID NO: 22107 - protein, 9 aa, Homo Sapiens
EMFQHHEGC

SEQ ID NO: 22108 - protein, 9 aa, Homo Sapiens
SPPHSTGLV

SEQ ID NO: 22109 - protein, 9 aa, Homo Sapiens
EKRGLGLVL

SEQ ID NO: 22110 - protein, 9 aa, Homo Sapiens
ISELFILSV

SEQ ID NO: 22111 - protein, 9 aa, Homo Sapiens
REEKRGLGL

SEQ ID NO: 22112 - protein, 9 aa, Homo Sapiens
SVQDVILLA

SEQ ID NO: 22113 - protein, 9 aa, Homo Sapiens
VPLISSQCL

SEQ ID NO: 22114 - protein, 9 aa, Homo Sapiens
LAEMIYWIR

SEQ ID NO: 22115 - protein, 9 aa, Homo Sapiens
AEDLFNAHK

SEQ ID NO: 22116 - protein, 9 aa, Homo Sapiens
SRDLLRAQN

SEQ ID NO: 22117 - protein, 9 aa, Homo Sapiens
KAFELKYEQ

SEQ ID NO: 22118 - protein, 9 aa, Homo Sapiens
GEEPYTCPA

SEQ ID NO: 22119 - protein, 9 aa, Homo Sapiens
TYVSGMFRF

SEQ ID NO: 22120 - protein, 9 aa, Homo Sapiens
CGCSFGYRS

SEQ ID NO: 22121 - protein, 9 aa, Homo Sapiens
VCGCDVNRA

SEQ ID NO: 22122 - protein, 9 aa, Homo Sapiens
DTARIYYLW

SEQ ID NO: 22123 - protein, 9 aa, Homo Sapiens
HPRGPEIEP

SEQ ID NO: 22124 - protein, 9 aa, Homo Sapiens
EGCLRKAHK

SEQ ID NO: 22125 - protein, 9 aa, Homo Sapiens
QFVLQAEMD

SEQ ID NO: 22126 - protein, 9 aa, Homo Sapiens
GCSFGYRSG

SEQ ID NO: 22127 - protein, 9 aa, Homo Sapiens
SAGKITANE

SEQ ID NO: 22128 - protein, 9 aa, Homo Sapiens
QIIHTGEEP

SEQ ID NO: 22129 - protein, 9 aa, Homo Sapiens
AAIQFSLEE

SEQ ID NO: 22130 - protein, 9 aa, Homo Sapiens
QFCQASDTE

SEQ ID NO: 22131 - protein, 9 aa, Homo Sapiens
GSLTFRDAA

SEQ ID NO: 22132 - protein, 9 aa, Homo Sapiens
RTVIAPQGY

SEQ ID NO: 22133 - protein, 9 aa, Homo Sapiens
FHESEGRQA

SEQ ID NO: 22134 - protein, 9 aa, Homo Sapiens
ADMLEKGQV

SEQ ID NO: 22135 - protein, 9 aa, Homo Sapiens
SEWFKFQVD

SEQ ID NO: 22136 - protein, 9 aa, Homo Sapiens
SMAKLMNNV

SEQ ID NO: 22137 - protein, 9 aa, Homo Sapiens
PSIPAPLHE

SEQ ID NO: 22138 - protein, 9 aa, Homo Sapiens
MGSLTFRDA

SEQ ID NO: 22139 - protein, 9 aa, Homo Sapiens
QISLFVVLV

SEQ ID NO: 22140 - protein, 9 aa, Homo Sapiens
ARVGHTNMV

SEQ ID NO: 22141 - protein, 9 aa, Homo Sapiens
SSGQCRRKR

SEQ ID NO: 22142 - protein, 9 aa, Homo Sapiens
FVLQAEMDC

SEQ ID NO: 22143 - protein, 9 aa, Homo Sapiens
KAFNNYSTL

SEQ ID NO: 22144 - protein, 9 aa, Homo Sapiens
MAAGVVIGA

SEQ ID NO: 22145 - protein, 9 aa, Homo Sapiens
AHKRFQCKE

SEQ ID NO: 22146 - protein, 9 aa, Homo Sapiens
LEAGAFPGG

SEQ ID NO: 22147 - protein, 9 aa, Homo Sapiens
KIATWKACG

SEQ ID NO: 22148 - protein, 9 aa, Homo Sapiens
HGNSKVNLH

SEQ ID NO: 22149 - protein, 9 aa, Homo Sapiens
HTGEEPYTC

SEQ ID NO: 22150 - protein, 9 aa, Homo Sapiens
NYSTLMKHK

SEQ ID NO: 22151 - protein, 9 aa, Homo Sapiens
KDLLLLGSS

SEQ ID NO: 22152 - protein, 9 aa, Homo Sapiens
QEMKDELAM

SEQ ID NO: 22153 - protein, 9 aa, Homo Sapiens
FSINEEEPE

SEQ ID NO: 22154 - protein, 9 aa, Homo Sapiens
RVLLEAGAF

SEQ ID NO: 22155 - protein, 9 aa, Homo Sapiens
INHKKQWIP

SEQ ID NO: 22156 - protein, 9 aa, Homo Sapiens
FEDPEGNIE

SEQ ID NO: 22157 - protein, 9 aa, Homo Sapiens
VFAPPNMDY

SEQ ID NO: 22158 - protein, 9 aa, Homo Sapiens
KMTLPEGIQ

SEQ ID NO: 22159 - protein, 9 aa, Homo Sapiens
LKQHYFIDW

SEQ ID NO: 22160 - protein, 9 aa, Homo Sapiens
EMPSEACAF

SEQ ID NO: 22161 - protein, 9 aa, Homo Sapiens
KRGLGLVLL

SEQ ID NO: 22162 - protein, 9 aa, Homo Sapiens
GVDKYLDYL

SEQ ID NO: 22163 - protein, 9 aa, Homo Sapiens
LEMPSEACA

SEQ ID NO: 22164 - protein, 9 aa, Homo Sapiens
AKLMNNVFG

SEQ ID NO: 22165 - protein, 9 aa, Homo Sapiens
CEEFRSISC

SEQ ID NO: 22166 - protein, 9 aa, Homo Sapiens
DQTPFNPHR

SEQ ID NO: 22167 - protein, 9 aa, Homo Sapiens
KALRLREEN

SEQ ID NO: 22168 - protein, 9 aa, Homo Sapiens
FFDDPVLLE

SEQ ID NO: 22169 - protein, 9 aa, Homo Sapiens
QDVILLATG

SEQ ID NO: 22170 - protein, 9 aa, Homo Sapiens
IQGNVYIHP

SEQ ID NO: 22171 - protein, 9 aa, Homo Sapiens
PVLLELAKQ

SEQ ID NO: 22172 - protein, 9 aa, Homo Sapiens
SWFDPSWCK

SEQ ID NO: 22173 - protein, 9 aa, Homo Sapiens
EEFRSISCK

SEQ ID NO: 22174 - protein, 9 aa, Homo Sapiens
LRVSVSPGQ

SEQ ID NO: 22175 - protein, 9 aa, Homo Sapiens
LPSIPAPLH

SEQ ID NO: 22176 - protein, 9 aa, Homo Sapiens
RSISCKIYE

SEQ ID NO: 22177 - protein, 9 aa, Homo Sapiens
LFINHKKQW

SEQ ID NO: 22178 - protein, 9 aa, Homo Sapiens
LDLVKGTNY

SEQ ID NO: 22179 - protein, 9 aa, Homo Sapiens
MYYEIFVCE

SEQ ID NO: 22180 - protein, 9 aa, Homo Sapiens
RKLNTTTTM

SEQ ID NO: 22181 - protein, 9 aa, Homo Sapiens
EACAFLITV

SEQ ID NO: 22182 - protein, 9 aa, Homo Sapiens
PPNMDYSMG

SEQ ID NO: 22183 - protein, 9 aa, Homo Sapiens
AHPRGPEIE

SEQ ID NO: 22184 - protein, 9 aa, Homo Sapiens
QKEIQEMKD

SEQ ID NO: 22185 - protein, 9 aa, Homo Sapiens
PNMDYSMGT

SEQ ID NO: 22186 - protein, 9 aa, Homo Sapiens
RKALRLREE

SEQ ID NO: 22187 - protein, 9 aa, Homo Sapiens
VTAVRIQPV

SEQ ID NO: 22188 - protein, 9 aa, Homo Sapiens
NAFLDRKAL

SEQ ID NO: 22189 - protein, 9 aa, Homo Sapiens
VAAEKKMVK

SEQ ID NO: 22190 - protein, 9 aa, Homo Sapiens
PWGVDKYLD

SEQ ID NO: 22191 - protein, 9 aa, Homo Sapiens
KLLEKPVVH

SEQ ID NO: 22192 - protein, 9 aa, Homo Sapiens
RAGSCGCSF

SEQ ID NO: 22193 - protein, 9 aa, Homo Sapiens
GYVAFNYLK

SEQ ID NO: 22194 - protein, 9 aa, Homo Sapiens
SKSMAKLMN

SEQ ID NO: 22195 - protein, 9 aa, Homo Sapiens
KITANELET

SEQ ID NO: 22196 - protein, 9 aa, Homo Sapiens
LRAQNSNNS

SEQ ID NO: 22197 - protein, 9 aa, Homo Sapiens
KDIAAVQRT

SEQ ID NO: 22198 - protein, 9 aa, Homo Sapiens
EFAMYYEIF

SEQ ID NO: 22199 - protein, 9 aa, Homo Sapiens
LLEIQISLF

SEQ ID NO: 22200 - protein, 9 aa, Homo Sapiens
GQCRRKRTY

SEQ ID NO: 22201 - protein, 9 aa, Homo Sapiens
AVFCSLIVW

SEQ ID NO: 22202 - protein, 9 aa, Homo Sapiens
QRHQGGWYY

SEQ ID NO: 22203 - protein, 9 aa, Homo Sapiens
NKIHSCYND

SEQ ID NO: 22204 - protein, 9 aa, Homo Sapiens
QGGWYYCKA

SEQ ID NO: 22205 - protein, 9 aa, Homo Sapiens
PRGRPAPGL

SEQ ID NO: 22206 - protein, 9 aa, Homo Sapiens
IAAVQRTLM

SEQ ID NO: 22207 - protein, 9 aa, Homo Sapiens
NHKKQWIPL

SEQ ID NO: 22208 - protein, 9 aa, Homo Sapiens
DLLRAQNSN

SEQ ID NO: 22209 - protein, 9 aa, Homo Sapiens
HQQPPQHSK

SEQ ID NO: 22210 - protein, 9 aa, Homo Sapiens
PVVHLGVGT

SEQ ID NO: 22211 - protein, 9 aa, Homo Sapiens
QAEREEKRG

SEQ ID NO: 22212 - protein, 9 aa, Homo Sapiens
HHHPTYELK

SEQ ID NO: 22213 - protein, 9 aa, Homo Sapiens
ACAFLITVY

SEQ ID NO: 22214 - protein, 9 aa, Homo Sapiens
EKKMVKITS

SEQ ID NO: 22215 - protein, 9 aa, Homo Sapiens
GTNYQVACQ

SEQ ID NO: 22216 - protein, 9 aa, Homo Sapiens
VVAVEAAGL

SEQ ID NO: 22217 - protein, 9 aa, Homo Sapiens
FELKYEQTL

SEQ ID NO: 22218 - protein, 9 aa, Homo Sapiens
TWKACGLAL

SEQ ID NO: 22219 - protein, 9 aa, Homo Sapiens
WYYCKAENG

SEQ ID NO: 22220 - protein, 9 aa, Homo Sapiens
WDGEIFRYV

SEQ ID NO: 22221 - protein, 9 aa, Homo Sapiens
CMAAGVVIG

SEQ ID NO: 22222 - protein, 9 aa, Homo Sapiens
SLALTAAAE

SEQ ID NO: 22223 - protein, 9 aa, Homo Sapiens
NSEWFKFQV

SEQ ID NO: 22224 - protein, 9 aa, Homo Sapiens
IAAACIHMM

SEQ ID NO: 22225 - protein, 9 aa, Homo Sapiens
PLISSQCLR

SEQ ID NO: 22226 - protein, 9 aa, Homo Sapiens
NYGHASKYG

SEQ ID NO: 22227 - protein, 9 aa, Homo Sapiens
HRVFWHKNE

SEQ ID NO: 22228 - protein, 9 aa, Homo Sapiens
LNTTTTMSN

SEQ ID NO: 22229 - protein, 9 aa, Homo Sapiens
RKAHKRFQC

SEQ ID NO: 22230 - protein, 9 aa, Homo Sapiens
CGSAEEFPN

SEQ ID NO: 22231 - protein, 9 aa, Homo Sapiens
EKPVVHLGV

SEQ ID NO: 22232 - protein, 9 aa, Homo Sapiens
TVKDLLLLG

SEQ ID NO: 22233 - protein, 9 aa, Homo Sapiens
FLDCQELLK

SEQ ID NO: 22234 - protein, 9 aa, Homo Sapiens
RTFSINEEE

SEQ ID NO: 22235 - protein, 9 aa, Homo Sapiens
CGKAFNNYS

SEQ ID NO: 22236 - protein, 9 aa, Homo Sapiens
EFRSISCKI

SEQ ID NO: 22237 - protein, 9 aa, Homo Sapiens
KILPGPLSP

SEQ ID NO: 22238 - protein, 9 aa, Homo Sapiens
HSSGQCRRK

SEQ ID NO: 22239 - protein, 9 aa, Homo Sapiens
DLLLLGSSG

SEQ ID NO: 22240 - protein, 9 aa, Homo Sapiens
SAHPRGPEI

SEQ ID NO: 22241 - protein, 9 aa, Homo Sapiens
RTREAGCMA

SEQ ID NO: 22242 - protein, 9 aa, Homo Sapiens
NYQVACQKY

SEQ ID NO: 22243 - protein, 9 aa, Homo Sapiens
TGMRPGMEY

SEQ ID NO: 22244 - protein, 9 aa, Homo Sapiens
YLWTYINEA

SEQ ID NO: 22245 - protein, 9 aa, Homo Sapiens
HQGGWYYCK

SEQ ID NO: 22246 - protein, 9 aa, Homo Sapiens
TEESLFHIC

SEQ ID NO: 22247 - protein, 9 aa, Homo Sapiens
KLMNNVFGK

SEQ ID NO: 22248 - protein, 9 aa, Homo Sapiens
GAFPGGSIY

SEQ ID NO: 22249 - protein, 9 aa, Homo Sapiens
EEKRGLGLV

SEQ ID NO: 22250 - protein, 9 aa, Homo Sapiens
AAACIHMMP

SEQ ID NO: 22251 - protein, 9 aa, Homo Sapiens
IHTGEEPYT

SEQ ID NO: 22252 - protein, 9 aa, Homo Sapiens
CSFGYRSGG

SEQ ID NO: 22253 - protein, 9 aa, Homo Sapiens
TNYQVACQK

SEQ ID NO: 22254 - protein, 9 aa, Homo Sapiens
EEFPNMPVF

SEQ ID NO: 22255 - protein, 9 aa, Homo Sapiens
PILSTRAHV

SEQ ID NO: 22256 - protein, 9 aa, Homo Sapiens
QHHEGCVPR

SEQ ID NO: 22257 - protein, 9 aa, Homo Sapiens
STALHSSQD

SEQ ID NO: 22258 - protein, 9 aa, Homo Sapiens
NIDYCPGNN

SEQ ID NO: 22259 - protein, 9 aa, Homo Sapiens
FPGGSIYNN

SEQ ID NO: 22260 - protein, 9 aa, Homo Sapiens
SLTFRDAAI

SEQ ID NO: 22261 - protein, 9 aa, Homo Sapiens
FAMYYEIFV

SEQ ID NO: 22262 - protein, 9 aa, Homo Sapiens
HKILPGPLS

SEQ ID NO: 22263 - protein, 9 aa, Homo Sapiens
AARVGHTNM

SEQ ID NO: 22264 - protein, 9 aa, Homo Sapiens
IHSCYNDCT

SEQ ID NO: 22265 - protein, 9 aa, Homo Sapiens
RGNFSPERF

SEQ ID NO: 22266 - protein, 9 aa, Homo Sapiens
FRSISCKIY

SEQ ID NO: 22267 - protein, 9 aa, Homo Sapiens
LQLQEQKTA

SEQ ID NO: 22268 - protein, 9 aa, Homo Sapiens
DVILLATGL

SEQ ID NO: 22269 - protein, 9 aa, Homo Sapiens
QFHESEGRQ

SEQ ID NO: 22270 - protein, 9 aa, Homo Sapiens
EQKTAIREE

SEQ ID NO: 22271 - protein, 9 aa, Homo Sapiens
FDPSWCKRM

SEQ ID NO: 22272 - protein, 9 aa, Homo Sapiens
LALTAAAEH

SEQ ID NO: 22273 - protein, 9 aa, Homo Sapiens
EENQKGDEK

SEQ ID NO: 22274 - protein, 9 aa, Homo Sapiens
RIYYLWTYI

SEQ ID NO: 22275 - protein, 9 aa, Homo Sapiens
VLLELAKQD

SEQ ID NO: 22276 - protein, 9 aa, Homo Sapiens
NGEEEGDQG

SEQ ID NO: 22277 - protein, 9 aa, Homo Sapiens
RPPASSLPS

SEQ ID NO: 22278 - protein, 9 aa, Homo Sapiens
AFNYLKIVL

SEQ ID NO: 22279 - protein, 9 aa, Homo Sapiens
AKKPRFASN

SEQ ID NO: 22280 - protein, 9 aa, Homo Sapiens
LHNRNNTRE

SEQ ID NO: 22281 - protein, 9 aa, Homo Sapiens
HLKRSLALT

SEQ ID NO: 22282 - protein, 9 aa, Homo Sapiens
LGSSGDLQQ

SEQ ID NO: 22283 - protein, 9 aa, Homo Sapiens
LISELREPV

SEQ ID NO: 22284 - protein, 9 aa, Homo Sapiens
QTYVSGMFR

SEQ ID NO: 22285 - protein, 9 aa, Homo Sapiens
KLNTTTTMS

SEQ ID NO: 22286 - protein, 9 aa, Homo Sapiens
PSEACAFLI

SEQ ID NO: 22287 - protein, 9 aa, Homo Sapiens
IDWDGEIFR

SEQ ID NO: 22288 - protein, 9 aa, Homo Sapiens
HSKKGADHQ

SEQ ID NO: 22289 - protein, 9 aa, Homo Sapiens
AVPLISSQC

SEQ ID NO: 22290 - protein, 9 aa, Homo Sapiens
PALLEIQIS

SEQ ID NO: 22291 - protein, 9 aa, Homo Sapiens
EMIYWIRCL

SEQ ID NO: 22292 - protein, 9 aa, Homo Sapiens
GRPAPGLLA

SEQ ID NO: 22293 - protein, 9 aa, Homo Sapiens
PLHCAARVG

SEQ ID NO: 22294 - protein, 9 aa, Homo Sapiens
AFPGGSIYN

SEQ ID NO: 22295 - protein, 9 aa, Homo Sapiens
ALLEIQISL

SEQ ID NO: 22296 - protein, 9 aa, Homo Sapiens
DTFSCLQNL

SEQ ID NO: 22297 - protein, 9 aa, Homo Sapiens
NNYSTLMKH

SEQ ID NO: 22298 - protein, 9 aa, Homo Sapiens
MNNVFGKRR

SEQ ID NO: 22299 - protein, 9 aa, Homo Sapiens
RGRPAPGLL

SEQ ID NO: 22300 - protein, 9 aa, Homo Sapiens
IIAFLFINH

SEQ ID NO: 22301 - protein, 9 aa, Homo Sapiens
ILDLVKGTN

SEQ ID NO: 22302 - protein, 9 aa, Homo Sapiens
KGGYVAFNY

SEQ ID NO: 22303 - protein, 9 aa, Homo Sapiens
TQGPSERTF

SEQ ID NO: 22304 - protein, 9 aa, Homo Sapiens
WFDPSWCKR

SEQ ID NO: 22305 - protein, 9 aa, Homo Sapiens
VRTLLRVSV

SEQ ID NO: 22306 - protein, 9 aa, Homo Sapiens
CQASDTEED

SEQ ID NO: 22307 - protein, 9 aa, Homo Sapiens
YSTLMKHKI

SEQ ID NO: 22308 - protein, 9 aa, Homo Sapiens
SQCLRLSRR

SEQ ID NO: 22309 - protein, 9 aa, Homo Sapiens
SLPLHNRNN

SEQ ID NO: 22310 - protein, 9 aa, Homo Sapiens
DEMFQHHEG

SEQ ID NO: 22311 - protein, 9 aa, Homo Sapiens
LKTVTTGSP

SEQ ID NO: 22312 - protein, 9 aa, Homo Sapiens
ENQKGDEKL

SEQ ID NO: 22313 - protein, 9 aa, Homo Sapiens
RIADDTFSC

SEQ ID NO: 22314 - protein, 9 aa, Homo Sapiens
HRSVSVQDV

SEQ ID NO: 22315 - protein, 9 aa, Homo Sapiens
HRLAEMIYW

SEQ ID NO: 22316 - protein, 9 aa, Homo Sapiens
RDLLRAQNS

SEQ ID NO: 22317 - protein, 9 aa, Homo Sapiens
GPSERTFSI

SEQ ID NO: 22318 - protein, 9 aa, Homo Sapiens
HKKQWIPLL

SEQ ID NO: 22319 - protein, 9 aa, Homo Sapiens
LDRKALRLR

SEQ ID NO: 22320 - protein, 9 aa, Homo Sapiens
LLRVSVSPG

SEQ ID NO: 22321 - protein, 9 aa, Homo Sapiens
GTLQFCQAS

SEQ ID NO: 22322 - protein, 9 aa, Homo Sapiens
DYCPGNNCK

SEQ ID NO: 22323 - protein, 9 aa, Homo Sapiens
IFVCENAKP

SEQ ID NO: 22324 - protein, 9 aa, Homo Sapiens
EIFVCENAK

SEQ ID NO: 22325 - protein, 9 aa, Homo Sapiens
ENGNMSRTA

SEQ ID NO: 22326 - protein, 9 aa, Homo Sapiens
LQKEIQEMK

SEQ ID NO: 22327 - protein, 9 aa, Homo Sapiens
RENAFLDRK

SEQ ID NO: 22328 - protein, 9 aa, Homo Sapiens
SPRGRPAPG

SEQ ID NO: 22329 - protein, 9 aa, Homo Sapiens
FNNYSTLMK

SEQ ID NO: 22330 - protein, 9 aa, Homo Sapiens
TARIYYLWT

SEQ ID NO: 22331 - protein, 9 aa, Homo Sapiens
PWIQGNVYI

SEQ ID NO: 22332 - protein, 9 aa, Homo Sapiens
VGHTNMVKL

SEQ ID NO: 22333 - protein, 9 aa, Homo Sapiens
KSLPLHNRN

SEQ ID NO: 22334 - protein, 9 aa, Homo Sapiens
EKGQVGHIR

SEQ ID NO: 22335 - protein, 9 aa, Homo Sapiens
AHHHPTYEL

SEQ ID NO: 22336 - protein, 9 aa, Homo Sapiens
VKGTNYQVA

SEQ ID NO: 22337 - protein, 9 aa, Homo Sapiens
EENGEEEGD

SEQ ID NO: 22338 - protein, 9 aa, Homo Sapiens
FCSLIVWFF

SEQ ID NO: 22339 - protein, 9 aa, Homo Sapiens
QTPFNPHRV

SEQ ID NO: 22340 - protein, 9 aa, Homo Sapiens
HQIIHTGEE

SEQ ID NO: 22341 - protein, 9 aa, Homo Sapiens
SERTFSINE

SEQ ID NO: 22342 - protein, 9 aa, Homo Sapiens
KRSLALTAA

SEQ ID NO: 22343 - protein, 9 aa, Homo Sapiens
GGYVAFNYL

SEQ ID NO: 22344 - protein, 9 aa, Homo Sapiens
SGQCRRKRT

SEQ ID NO: 22345 - protein, 9 aa, Homo Sapiens
PSANRGNFS

SEQ ID NO: 22346 - protein, 9 aa, Homo Sapiens
GNFSPERFL

SEQ ID NO: 22347 - protein, 9 aa, Homo Sapiens
NKAFELKYE

SEQ ID NO: 22348 - protein, 9 aa, Homo Sapiens
RGLGLVLLR

SEQ ID NO: 22349 - protein, 9 aa, Homo Sapiens
KYEQTLRAD

SEQ ID NO: 22350 - protein, 9 aa, Homo Sapiens
FSCLQNLTE

SEQ ID NO: 22351 - protein, 9 aa, Homo Sapiens
ENGRTVIAP

SEQ ID NO: 22352 - protein, 9 aa, Homo Sapiens
ACIHMMPNA

SEQ ID NO: 22353 - protein, 9 aa, Homo Sapiens
WLVTATGTN

SEQ ID NO: 22354 - protein, 9 aa, Homo Sapiens
IVNEMSNLS

SEQ ID NO: 22355 - protein, 9 aa, Homo Sapiens
ISLNNLSED

SEQ ID NO: 22356 - protein, 9 aa, Homo Sapiens
GYEKDNECH

SEQ ID NO: 22357 - protein, 9 aa, Homo Sapiens
DANDIPELL

SEQ ID NO: 22358 - protein, 9 aa, Homo Sapiens
CQNSPMARL

SEQ ID NO: 22359 - protein, 9 aa, Homo Sapiens
MKRLAAGCF

SEQ ID NO: 22360 - protein, 9 aa, Homo Sapiens
SAVTRNYSQ

SEQ ID NO: 22361 - protein, 9 aa, Homo Sapiens
DQSNQSVLI

SEQ ID NO: 22362 - protein, 9 aa, Homo Sapiens
FPKSTNFRA

SEQ ID NO: 22363 - protein, 9 aa, Homo Sapiens
INRLSIPSA

SEQ ID NO: 22364 - protein, 9 aa, Homo Sapiens
PELFSNTPT

SEQ ID NO: 22365 - protein, 9 aa, Homo Sapiens
ELLSDQHKA

SEQ ID NO: 22366 - protein, 9 aa, Homo Sapiens
IIAGRESRP

SEQ ID NO: 22367 - protein, 9 aa, Homo Sapiens
EAEETDPPS

SEQ ID NO: 22368 - protein, 9 aa, Homo Sapiens
RSLRTEVTS

SEQ ID NO: 22369 - protein, 9 aa, Homo Sapiens
SQRACSPVI

SEQ ID NO: 22370 - protein, 9 aa, Homo Sapiens
SFEDPELKS

SEQ ID NO: 22371 - protein, 9 aa, Homo Sapiens
EFNWQKEVS

SEQ ID NO: 22372 - protein, 9 aa, Homo Sapiens
CFRERCGFH

SEQ ID NO: 22373 - protein, 9 aa, Homo Sapiens
MKYASGGEV

SEQ ID NO: 22374 - protein, 9 aa, Homo Sapiens
AGPDFQINV

SEQ ID NO: 22375 - protein, 9 aa, Homo Sapiens
PWKIETTEK

SEQ ID NO: 22376 - protein, 9 aa, Homo Sapiens
EYSPEEKSE

SEQ ID NO: 22377 - protein, 9 aa, Homo Sapiens
KCFQVPQQK

SEQ ID NO: 22378 - protein, 9 aa, Homo Sapiens
GATEKIKKG

SEQ ID NO: 22379 - protein, 9 aa, Homo Sapiens
SALLGASTV

SEQ ID NO: 22380 - protein, 9 aa, Homo Sapiens
PGFNDCGSR

SEQ ID NO: 22381 - protein, 9 aa, Homo Sapiens
TGSLSGIIE

SEQ ID NO: 22382 - protein, 9 aa, Homo Sapiens
YLRTITHIV

SEQ ID NO: 22383 - protein, 9 aa, Homo Sapiens
VVPTPALAR

SEQ ID NO: 22384 - protein, 9 aa, Homo Sapiens
LDMGFKPQI

SEQ ID NO: 22385 - protein, 9 aa, Homo Sapiens
WSKVEPAEL

SEQ ID NO: 22386 - protein, 9 aa, Homo Sapiens
PGPQALRGD

SEQ ID NO: 22387 - protein, 9 aa, Homo Sapiens
ELLSPFELY

SEQ ID NO: 22388 - protein, 9 aa, Homo Sapiens
MASLSLPGS

SEQ ID NO: 22389 - protein, 9 aa, Homo Sapiens
THRSTQSGD

SEQ ID NO: 22390 - protein, 9 aa, Homo Sapiens
DMGFKPQIR

SEQ ID NO: 22391 - protein, 9 aa, Homo Sapiens
TSKSRSAQR

SEQ ID NO: 22392 - protein, 9 aa, Homo Sapiens
EPPGERGLP

SEQ ID NO: 22393 - protein, 9 aa, Homo Sapiens
ACKTCRKAF

SEQ ID NO: 22394 - protein, 9 aa, Homo Sapiens
GDSVEKIQG

SEQ ID NO: 22395 - protein, 9 aa, Homo Sapiens
NVVSSTVTG

SEQ ID NO: 22396 - protein, 9 aa, Homo Sapiens
KRERLGRFL

SEQ ID NO: 22397 - protein, 9 aa, Homo Sapiens
FHEESTQVQ

SEQ ID NO: 22398 - protein, 9 aa, Homo Sapiens
LGASTVRSP

SEQ ID NO: 22399 - protein, 9 aa, Homo Sapiens
WPLRDCQAW

SEQ ID NO: 22400 - protein, 9 aa, Homo Sapiens
ILASCVSEN

SEQ ID NO: 22401 - protein, 9 aa, Homo Sapiens
SPGNGSLRK

SEQ ID NO: 22402 - protein, 9 aa, Homo Sapiens
IDQLLNIDI

SEQ ID NO: 22403 - protein, 9 aa, Homo Sapiens
LSIEQRVNE

SEQ ID NO: 22404 - protein, 9 aa, Homo Sapiens
IDTEKLSAG

SEQ ID NO: 22405 - protein, 9 aa, Homo Sapiens
AEHYDRVHL

SEQ ID NO: 22406 - protein, 9 aa, Homo Sapiens
ACSPVITCS

SEQ ID NO: 22407 - protein, 9 aa, Homo Sapiens
DNDMLEAAK

SEQ ID NO: 22408 - protein, 9 aa, Homo Sapiens
PELKSSFSQ

SEQ ID NO: 22409 - protein, 9 aa, Homo Sapiens
TPLFYPGMN

SEQ ID NO: 22410 - protein, 9 aa, Homo Sapiens
TLQELWCPC

SEQ ID NO: 22411 - protein, 9 aa, Homo Sapiens
LSNEIEAIE

SEQ ID NO: 22412 - protein, 9 aa, Homo Sapiens
GQGGYPGTP

SEQ ID NO: 22413 - protein, 9 aa, Homo Sapiens
SEVLRNESL

SEQ ID NO: 22414 - protein, 9 aa, Homo Sapiens
SQEGNHYFY

SEQ ID NO: 22415 - protein, 9 aa, Homo Sapiens
IKRRKHQND

SEQ ID NO: 22416 - protein, 9 aa, Homo Sapiens
AQRSKSKSS

SEQ ID NO: 22417 - protein, 9 aa, Homo Sapiens
NWMKAVQMC

SEQ ID NO: 22418 - protein, 9 aa, Homo Sapiens
HGSDPGFAE

SEQ ID NO: 22419 - protein, 9 aa, Homo Sapiens
LLSPFELYF

SEQ ID NO: 22420 - protein, 9 aa, Homo Sapiens
KYGHYKRGI

SEQ ID NO: 22421 - protein, 9 aa, Homo Sapiens
SDKNGIPSS

SEQ ID NO: 22422 - protein, 9 aa, Homo Sapiens
RKGLLTSLY

SEQ ID NO: 22423 - protein, 9 aa, Homo Sapiens
DKRSVTSSS

SEQ ID NO: 22424 - protein, 9 aa, Homo Sapiens
GLRGVHYIT

SEQ ID NO: 22425 - protein, 9 aa, Homo Sapiens
ASSYGAQLG

SEQ ID NO: 22426 - protein, 9 aa, Homo Sapiens
KSRSSTPVQ

SEQ ID NO: 22427 - protein, 9 aa, Homo Sapiens
EKLFKTDEA

SEQ ID NO: 22428 - protein, 9 aa, Homo Sapiens
DPTLYIVQR

SEQ ID NO: 22429 - protein, 9 aa, Homo Sapiens
SRERALNYY

SEQ ID NO: 22430 - protein, 9 aa, Homo Sapiens
YAIYGLQPN

SEQ ID NO: 22431 - protein, 9 aa, Homo Sapiens
HIYTIAFGI

SEQ ID NO: 22432 - protein, 9 aa, Homo Sapiens
CPAPAQTPP

SEQ ID NO: 22433 - protein, 9 aa, Homo Sapiens
KASDKEEAP

SEQ ID NO: 22434 - protein, 9 aa, Homo Sapiens
WAFSKAGEV

SEQ ID NO: 22435 - protein, 9 aa, Homo Sapiens
SNAAYPVLG

SEQ ID NO: 22436 - protein, 9 aa, Homo Sapiens
MLFKVVRYE

SEQ ID NO: 22437 - protein, 9 aa, Homo Sapiens
SHCLDMAPK

SEQ ID NO: 22438 - protein, 9 aa, Homo Sapiens
GRLCNIEPH

SEQ ID NO: 22439 - protein, 9 aa, Homo Sapiens
TPWHSPTED

SEQ ID NO: 22440 - protein, 9 aa, Homo Sapiens
KIKHPVYSL

SEQ ID NO: 22441 - protein, 9 aa, Homo Sapiens
YAYDITFNP

SEQ ID NO: 22442 - protein, 9 aa, Homo Sapiens
GILNQSQIK

SEQ ID NO: 22443 - protein, 9 aa, Homo Sapiens
TLSNASGNF

SEQ ID NO: 22444 - protein, 9 aa, Homo Sapiens
GCSWIAVLA

SEQ ID NO: 22445 - protein, 9 aa, Homo Sapiens
PLDMQILHQ

SEQ ID NO: 22446 - protein, 9 aa, Homo Sapiens
NYSQKSINS

SEQ ID NO: 22447 - protein, 9 aa, Homo Sapiens
NYLLESRHR

SEQ ID NO: 22448 - protein, 9 aa, Homo Sapiens
LCYSHAFAP

SEQ ID NO: 22449 - protein, 9 aa, Homo Sapiens
NQAVAILLQ

SEQ ID NO: 22450 - protein, 9 aa, Homo Sapiens
SNNKVGDFV

SEQ ID NO: 22451 - protein, 9 aa, Homo Sapiens
MVSKDARQQ

SEQ ID NO: 22452 - protein, 9 aa, Homo Sapiens
KLLLENPEK

SEQ ID NO: 22453 - protein, 9 aa, Homo Sapiens
NIEPHERCF

SEQ ID NO: 22454 - protein, 9 aa, Homo Sapiens
ECGTYSLCS

SEQ ID NO: 22455 - protein, 9 aa, Homo Sapiens
VKSLQRQWG

SEQ ID NO: 22456 - protein, 9 aa, Homo Sapiens
YSHAFAPER

SEQ ID NO: 22457 - protein, 9 aa, Homo Sapiens
WAEAGPEAP

SEQ ID NO: 22458 - protein, 9 aa, Homo Sapiens
KAWLQEGAE

SEQ ID NO: 22459 - protein, 9 aa, Homo Sapiens
KNVEKALHQ

SEQ ID NO: 22460 - protein, 9 aa, Homo Sapiens
TSPSSSVVN

SEQ ID NO: 22461 - protein, 9 aa, Homo Sapiens
VKSRWVLLK

SEQ ID NO: 22462 - protein, 9 aa, Homo Sapiens
LWTGTPLFY

SEQ ID NO: 22463 - protein, 9 aa, Homo Sapiens
EKLSKEERK

SEQ ID NO: 22464 - protein, 9 aa, Homo Sapiens
MQTYEEVGH

SEQ ID NO: 22465 - protein, 9 aa, Homo Sapiens
YENINRLSI

SEQ ID NO: 22466 - protein, 9 aa, Homo Sapiens
ACNENQGRC

SEQ ID NO: 22467 - protein, 9 aa, Homo Sapiens
SNNSNPVEN

SEQ ID NO: 22468 - protein, 9 aa, Homo Sapiens
NAAYPVLGP

SEQ ID NO: 22469 - protein, 9 aa, Homo Sapiens
LHSLNLSMN

SEQ ID NO: 22470 - protein, 9 aa, Homo Sapiens
ADYAKHKCT

SEQ ID NO: 22471 - protein, 9 aa, Homo Sapiens
QKHSSTSTP

SEQ ID NO: 22472 - protein, 9 aa, Homo Sapiens
QLLEKNEEK

SEQ ID NO: 22473 - protein, 9 aa, Homo Sapiens
HVCKLFDIR

SEQ ID NO: 22474 - protein, 9 aa, Homo Sapiens
TIQEVQPEQ

SEQ ID NO: 22475 - protein, 9 aa, Homo Sapiens
WSRIRAHSQ

SEQ ID NO: 22476 - protein, 9 aa, Homo Sapiens
AGPKGAPER

SEQ ID NO: 22477 - protein, 9 aa, Homo Sapiens
TDAIFCENT

SEQ ID NO: 22478 - protein, 9 aa, Homo Sapiens
SPKFHSLHF

SEQ ID NO: 22479 - protein, 9 aa, Homo Sapiens
PLSQRACSP

SEQ ID NO: 22480 - protein, 9 aa, Homo Sapiens
STSKSRSAQ

SEQ ID NO: 22481 - protein, 9 aa, Homo Sapiens
KMKKQYRNL

SEQ ID NO: 22482 - protein, 9 aa, Homo Sapiens
EDPSLLVTL

SEQ ID NO: 22483 - protein, 9 aa, Homo Sapiens
AQRSVIKPS

SEQ ID NO: 22484 - protein, 9 aa, Homo Sapiens
GKRVDTAEV

SEQ ID NO: 22485 - protein, 9 aa, Homo Sapiens
ESPKFHSLH

SEQ ID NO: 22486 - protein, 9 aa, Homo Sapiens
VISINLTGP

SEQ ID NO: 22487 - protein, 9 aa, Homo Sapiens
VNNLASGDA

SEQ ID NO: 22488 - protein, 9 aa, Homo Sapiens
LHAGNLDGE

SEQ ID NO: 22489 - protein, 9 aa, Homo Sapiens
AKFHVPSFH

SEQ ID NO: 22490 - protein, 9 aa, Homo Sapiens
GILNYATRL

SEQ ID NO: 22491 - protein, 9 aa, Homo Sapiens
PSSKDDRDE

SEQ ID NO: 22492 - protein, 9 aa, Homo Sapiens
LDLKFNMEQ

SEQ ID NO: 22493 - protein, 9 aa, Homo Sapiens
QAVAILLQN

SEQ ID NO: 22494 - protein, 9 aa, Homo Sapiens
FGRKFLVNV

SEQ ID NO: 22495 - protein, 9 aa, Homo Sapiens
ELMEFSDLK

SEQ ID NO: 22496 - protein, 9 aa, Homo Sapiens
PKAVSVVEL

SEQ ID NO: 22497 - protein, 9 aa, Homo Sapiens
MVISINLTG

SEQ ID NO: 22498 - protein, 9 aa, Homo Sapiens
MWRLLACAS

SEQ ID NO: 22499 - protein, 9 aa, Homo Sapiens
SRQSKISLN

SEQ ID NO: 22500 - protein, 9 aa, Homo Sapiens
YLDLAGLRG

SEQ ID NO: 22501 - protein, 9 aa, Homo Sapiens
VPVYIYSPK

SEQ ID NO: 22502 - protein, 9 aa, Homo Sapiens
ASDKAGIIW

SEQ ID NO: 22503 - protein, 9 aa, Homo Sapiens
LYVMEMSDN

SEQ ID NO: 22504 - protein, 9 aa, Homo Sapiens
MLCYSHAFA

SEQ ID NO: 22505 - protein, 9 aa, Homo Sapiens
HERCFLGNG

SEQ ID NO: 22506 - protein, 9 aa, Homo Sapiens
EGPSNGESA

SEQ ID NO: 22507 - protein, 9 aa, Homo Sapiens
CSTELTNFY

SEQ ID NO: 22508 - protein, 9 aa, Homo Sapiens
MIPPSSPRK

SEQ ID NO: 22509 - protein, 9 aa, Homo Sapiens
VTEIHLYFK

SEQ ID NO: 22510 - protein, 9 aa, Homo Sapiens
SGTTSSNNT

SEQ ID NO: 22511 - protein, 9 aa, Homo Sapiens
NHAHYEWYL

SEQ ID NO: 22512 - protein, 9 aa, Homo Sapiens
PEEKSEPPA

SEQ ID NO: 22513 - protein, 9 aa, Homo Sapiens
PQELGTQAT

SEQ ID NO: 22514 - protein, 9 aa, Homo Sapiens
FGLRNSEPF

SEQ ID NO: 22515 - protein, 9 aa, Homo Sapiens
KEEVKQEEC

SEQ ID NO: 22516 - protein, 9 aa, Homo Sapiens
DTHWVGAWW

SEQ ID NO: 22517 - protein, 9 aa, Homo Sapiens
KQYRNLNTW

SEQ ID NO: 22518 - protein, 9 aa, Homo Sapiens
AATAALHPA

SEQ ID NO: 22519 - protein, 9 aa, Homo Sapiens
YEEVGHDAL

SEQ ID NO: 22520 - protein, 9 aa, Homo Sapiens
HGGYRCACT

SEQ ID NO: 22521 - protein, 9 aa, Homo Sapiens
VMVHKHREL

SEQ ID NO: 22522 - protein, 9 aa, Homo Sapiens
NLYFYDATR

SEQ ID NO: 22523 - protein, 9 aa, Homo Sapiens
VTQDIALKT

SEQ ID NO: 22524 - protein, 9 aa, Homo Sapiens
TDPPSTCQL

SEQ ID NO: 22525 - protein, 9 aa, Homo Sapiens
GFNKQCSEL

SEQ ID NO: 22526 - protein, 9 aa, Homo Sapiens
LNPIIYCLH

SEQ ID NO: 22527 - protein, 9 aa, Homo Sapiens
YVMEMSDNP

SEQ ID NO: 22528 - protein, 9 aa, Homo Sapiens
EPVAKTKME

SEQ ID NO: 22529 - protein, 9 aa, Homo Sapiens
RRSTLMQHQ

SEQ ID NO: 22530 - protein, 9 aa, Homo Sapiens
FRINCNIFS

SEQ ID NO: 22531 - protein, 9 aa, Homo Sapiens
KVEPAELRE

SEQ ID NO: 22532 - protein, 9 aa, Homo Sapiens
QTATDVSKS

SEQ ID NO: 22533 - protein, 9 aa, Homo Sapiens
KVDISVLHQ

SEQ ID NO: 22534 - protein, 9 aa, Homo Sapiens
VVIYGLVAE

SEQ ID NO: 22535 - protein, 9 aa, Homo Sapiens
DCGSRLSGN

SEQ ID NO: 22536 - protein, 9 aa, Homo Sapiens
EAKYVEEGE

SEQ ID NO: 22537 - protein, 9 aa, Homo Sapiens
LARSAAKRR

SEQ ID NO: 22538 - protein, 9 aa, Homo Sapiens
LIWVRYKRN

SEQ ID NO: 22539 - protein, 9 aa, Homo Sapiens
YIVQRPLPG

SEQ ID NO: 22540 - protein, 9 aa, Homo Sapiens
HPRKASDKE

SEQ ID NO: 22541 - protein, 9 aa, Homo Sapiens
TPSRLSAAA

SEQ ID NO: 22542 - protein, 9 aa, Homo Sapiens
LVCLGMLCY

SEQ ID NO: 22543 - protein, 9 aa, Homo Sapiens
QFSSRVRTK

SEQ ID NO: 22544 - protein, 9 aa, Homo Sapiens
AAGRQSTTH

SEQ ID NO: 22545 - protein, 9 aa, Homo Sapiens
PAGRASLLP

SEQ ID NO: 22546 - protein, 9 aa, Homo Sapiens
DLPVHPRAA

SEQ ID NO: 22547 - protein, 9 aa, Homo Sapiens
GERVLYNSV

SEQ ID NO: 22548 - protein, 9 aa, Homo Sapiens
STPPCHPDY

SEQ ID NO: 22549 - protein, 9 aa, Homo Sapiens
NEIEAIEKA

SEQ ID NO: 22550 - protein, 9 aa, Homo Sapiens
GPLYTTSPA

SEQ ID NO: 22551 - protein, 9 aa, Homo Sapiens
NIDIAAAFA

SEQ ID NO: 22552 - protein, 9 aa, Homo Sapiens
TLKKRKLIH

SEQ ID NO: 22553 - protein, 9 aa, Homo Sapiens
RVNEMASDD

SEQ ID NO: 22554 - protein, 9 aa, Homo Sapiens
YQGSYDEQY

SEQ ID NO: 22555 - protein, 9 aa, Homo Sapiens
AGRASLLPM

SEQ ID NO: 22556 - protein, 9 aa, Homo Sapiens
RSAAKRRNV

SEQ ID NO: 22557 - protein, 9 aa, Homo Sapiens
TTSAGGNTA

SEQ ID NO: 22558 - protein, 9 aa, Homo Sapiens
ELQEVVQVS

SEQ ID NO: 22559 - protein, 9 aa, Homo Sapiens
ERREDNNEE

SEQ ID NO: 22560 - protein, 9 aa, Homo Sapiens
SPTEDNVAT

SEQ ID NO: 22561 - protein, 9 aa, Homo Sapiens
TMSPVLLLD

SEQ ID NO: 22562 - protein, 9 aa, Homo Sapiens
SIEVNETIT

SEQ ID NO: 22563 - protein, 9 aa, Homo Sapiens
LSGEFFNNL

SEQ ID NO: 22564 - protein, 9 aa, Homo Sapiens
DKREWKSKR

SEQ ID NO: 22565 - protein, 9 aa, Homo Sapiens
GLWTGTPLF

SEQ ID NO: 22566 - protein, 9 aa, Homo Sapiens
VQADREDSQ

SEQ ID NO: 22567 - protein, 9 aa, Homo Sapiens
HKKSLFDKK

SEQ ID NO: 22568 - protein, 9 aa, Homo Sapiens
IRWYRNTKL

SEQ ID NO: 22569 - protein, 9 aa, Homo Sapiens
LEMCLSALQ

SEQ ID NO: 22570 - protein, 9 aa, Homo Sapiens
NFDRDNVRI

SEQ ID NO: 22571 - protein, 9 aa, Homo Sapiens
HYKRGILWK

SEQ ID NO: 22572 - protein, 9 aa, Homo Sapiens
GTPLFYPGM

SEQ ID NO: 22573 - protein, 9 aa, Homo Sapiens
TSFFDKNRT

SEQ ID NO: 22574 - protein, 9 aa, Homo Sapiens
KFHVPSFHV

SEQ ID NO: 22575 - protein, 9 aa, Homo Sapiens
CLGWDFPKS

SEQ ID NO: 22576 - protein, 9 aa, Homo Sapiens
VETYFHQFG

SEQ ID NO: 22577 - protein, 9 aa, Homo Sapiens
RLKLPLIPL

SEQ ID NO: 22578 - protein, 9 aa, Homo Sapiens
KDSTSVYNT

SEQ ID NO: 22579 - protein, 9 aa, Homo Sapiens
HIDKIEQQS

SEQ ID NO: 22580 - protein, 9 aa, Homo Sapiens
ITIEPKRAT

SEQ ID NO: 22581 - protein, 9 aa, Homo Sapiens
EADSWVDTK

SEQ ID NO: 22582 - protein, 9 aa, Homo Sapiens
QYAYDITFN

SEQ ID NO: 22583 - protein, 9 aa, Homo Sapiens
DQLKRLHTF

SEQ ID NO: 22584 - protein, 9 aa, Homo Sapiens
SCWLQGAPG

SEQ ID NO: 22585 - protein, 9 aa, Homo Sapiens
AKLMASTSP

SEQ ID NO: 22586 - protein, 9 aa, Homo Sapiens
SGALGSSQT

SEQ ID NO: 22587 - protein, 9 aa, Homo Sapiens
AYYFECNDT

SEQ ID NO: 22588 - protein, 9 aa, Homo Sapiens
PHRPIPECG

SEQ ID NO: 22589 - protein, 9 aa, Homo Sapiens
IRALDSPRS

SEQ ID NO: 22590 - protein, 9 aa, Homo Sapiens
HLTNSACHE

SEQ ID NO: 22591 - protein, 9 aa, Homo Sapiens
KGLWTGTPL

SEQ ID NO: 22592 - protein, 9 aa, Homo Sapiens
GEEKREHAS

SEQ ID NO: 22593 - protein, 9 aa, Homo Sapiens
RPRRVASDG

SEQ ID NO: 22594 - protein, 9 aa, Homo Sapiens
ASERDFLKF

SEQ ID NO: 22595 - protein, 9 aa, Homo Sapiens
EVYRFFLAV

SEQ ID NO: 22596 - protein, 9 aa, Homo Sapiens
GPQALRGDD

SEQ ID NO: 22597 - protein, 9 aa, Homo Sapiens
DWCKDNFVN

SEQ ID NO: 22598 - protein, 9 aa, Homo Sapiens
GGDELEMCL

SEQ ID NO: 22599 - protein, 9 aa, Homo Sapiens
GNVTVENPE

SEQ ID NO: 22600 - protein, 9 aa, Homo Sapiens
QADREDSQE

SEQ ID NO: 22601 - protein, 9 aa, Homo Sapiens
AVFAVFQTT

SEQ ID NO: 22602 - protein, 9 aa, Homo Sapiens
GEKFGTVSS

SEQ ID NO: 22603 - protein, 9 aa, Homo Sapiens
VFAVFQTTF

SEQ ID NO: 22604 - protein, 9 aa, Homo Sapiens
GPIINHITL

SEQ ID NO: 22605 - protein, 9 aa, Homo Sapiens
LNELMNVYQ

SEQ ID NO: 22606 - protein, 9 aa, Homo Sapiens
QELMKIYGQ

SEQ ID NO: 22607 - protein, 9 aa, Homo Sapiens
HSLNLSMNP

SEQ ID NO: 22608 - protein, 9 aa, Homo Sapiens
AEAQRIMRE

SEQ ID NO: 22609 - protein, 9 aa, Homo Sapiens
ETLSNASGN

SEQ ID NO: 22610 - protein, 9 aa, Homo Sapiens
IKSQNKEDY

SEQ ID NO: 22611 - protein, 9 aa, Homo Sapiens
GEIQVVDPL

SEQ ID NO: 22612 - protein, 9 aa, Homo Sapiens
EWRLKLPLI

SEQ ID NO: 22613 - protein, 9 aa, Homo Sapiens
SGSKDSGSP

SEQ ID NO: 22614 - protein, 9 aa, Homo Sapiens
PRSGGARGF

SEQ ID NO: 22615 - protein, 9 aa, Homo Sapiens
SKKGPTASG

SEQ ID NO: 22616 - protein, 9 aa, Homo Sapiens
CVSENKRIS

SEQ ID NO: 22617 - protein, 9 aa, Homo Sapiens
SDLKSDSEE

SEQ ID NO: 22618 - protein, 9 aa, Homo Sapiens
YNLQMLEAQ

SEQ ID NO: 22619 - protein, 9 aa, Homo Sapiens
KVKSSLVNE

SEQ ID NO: 22620 - protein, 9 aa, Homo Sapiens
LMRGHRRRL

SEQ ID NO: 22621 - protein, 9 aa, Homo Sapiens
CKAKFHVPS

SEQ ID NO: 22622 - protein, 9 aa, Homo Sapiens
DYLRTITHI

SEQ ID NO: 22623 - protein, 9 aa, Homo Sapiens
VELYGILDP

SEQ ID NO: 22624 - protein, 9 aa, Homo Sapiens
QLLNIDIAA

SEQ ID NO: 22625 - protein, 9 aa, Homo Sapiens
FYLPVTPKA

SEQ ID NO: 22626 - protein, 9 aa, Homo Sapiens
AGNENEPCE

SEQ ID NO: 22627 - protein, 9 aa, Homo Sapiens
RKSFSIGLN

SEQ ID NO: 22628 - protein, 9 aa, Homo Sapiens
PPGGQQPGW

SEQ ID NO: 22629 - protein, 9 aa, Homo Sapiens
LHDCLMKAR

SEQ ID NO: 22630 - protein, 9 aa, Homo Sapiens
INSTRYNTE

SEQ ID NO: 22631 - protein, 9 aa, Homo Sapiens
EAQGSMKQA

SEQ ID NO: 22632 - protein, 9 aa, Homo Sapiens
FNMQTETVM

SEQ ID NO: 22633 - protein, 9 aa, Homo Sapiens
SPSFSGSKD

SEQ ID NO: 22634 - protein, 9 aa, Homo Sapiens
KTKMEVTGL

SEQ ID NO: 22635 - protein, 9 aa, Homo Sapiens
VACGEPVAK

SEQ ID NO: 22636 - protein, 9 aa, Homo Sapiens
TTKCFQVPQ

SEQ ID NO: 22637 - protein, 9 aa, Homo Sapiens
NDLMSDLLS

SEQ ID NO: 22638 - protein, 9 aa, Homo Sapiens
EAPVRAEFR

SEQ ID NO: 22639 - protein, 9 aa, Homo Sapiens
PTVVPTPAL

SEQ ID NO: 22640 - protein, 9 aa, Homo Sapiens
SFIKSQNKE

SEQ ID NO: 22641 - protein, 9 aa, Homo Sapiens
LTVLETCIK

SEQ ID NO: 22642 - protein, 9 aa, Homo Sapiens
KWCLGWDFP

SEQ ID NO: 22643 - protein, 9 aa, Homo Sapiens
SSSKKRKFL

SEQ ID NO: 22644 - protein, 9 aa, Homo Sapiens
DDYFYHDKL

SEQ ID NO: 22645 - protein, 9 aa, Homo Sapiens
FFNGKDSED

SEQ ID NO: 22646 - protein, 9 aa, Homo Sapiens
LGTQATIHL

SEQ ID NO: 22647 - protein, 9 aa, Homo Sapiens
REAEAAPGR

SEQ ID NO: 22648 - protein, 9 aa, Homo Sapiens
LVEPVKKHE

SEQ ID NO: 22649 - protein, 9 aa, Homo Sapiens
GSRLSGNIG

SEQ ID NO: 22650 - protein, 9 aa, Homo Sapiens
APALDFTVK

SEQ ID NO: 22651 - protein, 9 aa, Homo Sapiens
EGEIVMVHK

SEQ ID NO: 22652 - protein, 9 aa, Homo Sapiens
FEDPELKSS

SEQ ID NO: 22653 - protein, 9 aa, Homo Sapiens
IEADQVSVE

SEQ ID NO: 22654 - protein, 9 aa, Homo Sapiens
VIKPSALLG

SEQ ID NO: 22655 - protein, 9 aa, Homo Sapiens
IINHITLLE

SEQ ID NO: 22656 - protein, 9 aa, Homo Sapiens
RGRTTSAGG

SEQ ID NO: 22657 - protein, 9 aa, Homo Sapiens
SLNHVRHVI

SEQ ID NO: 22658 - protein, 9 aa, Homo Sapiens
FWPNAEVYR

SEQ ID NO: 22659 - protein, 9 aa, Homo Sapiens
HSQFIAYPI

SEQ ID NO: 22660 - protein, 9 aa, Homo Sapiens
GRPGALAGS

SEQ ID NO: 22661 - protein, 9 aa, Homo Sapiens
RQKSGNQKG

SEQ ID NO: 22662 - protein, 9 aa, Homo Sapiens
AAPTSPSSS

SEQ ID NO: 22663 - protein, 9 aa, Homo Sapiens
PGDKRSVTS

SEQ ID NO: 22664 - protein, 9 aa, Homo Sapiens
AGKTIALLF

SEQ ID NO: 22665 - protein, 9 aa, Homo Sapiens
RDNKKTQII

SEQ ID NO: 22666 - protein, 9 aa, Homo Sapiens
MENYRLESG

SEQ ID NO: 22667 - protein, 9 aa, Homo Sapiens
KIYGQDPVS

SEQ ID NO: 22668 - protein, 9 aa, Homo Sapiens
ALQVAEHYD

SEQ ID NO: 22669 - protein, 9 aa, Homo Sapiens
NVTVENPED

SEQ ID NO: 22670 - protein, 9 aa, Homo Sapiens
AAPGRPGAL

SEQ ID NO: 22671 - protein, 9 aa, Homo Sapiens
RGFFAPGHG

SEQ ID NO: 22672 - protein, 9 aa, Homo Sapiens
SGYEKDNEC

SEQ ID NO: 22673 - protein, 9 aa, Homo Sapiens
DNFVNSKNM

SEQ ID NO: 22674 - protein, 9 aa, Homo Sapiens
LLPSVGYNG

SEQ ID NO: 22675 - protein, 9 aa, Homo Sapiens
CQSRRKKNE

SEQ ID NO: 22676 - protein, 9 aa, Homo Sapiens
SPTFPPVAM

SEQ ID NO: 22677 - protein, 9 aa, Homo Sapiens
VQRPLPGYP

SEQ ID NO: 22678 - protein, 9 aa, Homo Sapiens
SYDEQYATE

SEQ ID NO: 22679 - protein, 9 aa, Homo Sapiens
QTESHDLPV

SEQ ID NO: 22680 - protein, 9 aa, Homo Sapiens
HDCLMKARK

SEQ ID NO: 22681 - protein, 9 aa, Homo Sapiens
GAWDFLCVR

SEQ ID NO: 22682 - protein, 9 aa, Homo Sapiens
LMEFSDLKS

SEQ ID NO: 22683 - protein, 9 aa, Homo Sapiens
ELQSKVRNP

SEQ ID NO: 22684 - protein, 9 aa, Homo Sapiens
GDSSAPMQN

SEQ ID NO: 22685 - protein, 9 aa, Homo Sapiens
DKEEAPLRE

SEQ ID NO: 22686 - protein, 9 aa, Homo Sapiens
DITFNPDTA

SEQ ID NO: 22687 - protein, 9 aa, Homo Sapiens
YNSVSQEDV

SEQ ID NO: 22688 - protein, 9 aa, Homo Sapiens
HRSTQSGDA

SEQ ID NO: 22689 - protein, 9 aa, Homo Sapiens
GGQQPGWQS

SEQ ID NO: 22690 - protein, 9 aa, Homo Sapiens
RFTCFAICS

SEQ ID NO: 22691 - protein, 9 aa, Homo Sapiens
QQSDCKILD

SEQ ID NO: 22692 - protein, 9 aa, Homo Sapiens
NFYRALPLF

SEQ ID NO: 22693 - protein, 9 aa, Homo Sapiens
IMKQMGYLT

SEQ ID NO: 22694 - protein, 9 aa, Homo Sapiens
KSYHTGCFR

SEQ ID NO: 22695 - protein, 9 aa, Homo Sapiens
CIKSCGKRF

SEQ ID NO: 22696 - protein, 9 aa, Homo Sapiens
REWAEAQRI

SEQ ID NO: 22697 - protein, 9 aa, Homo Sapiens
SQETSFFDK

SEQ ID NO: 22698 - protein, 9 aa, Homo Sapiens
KKRKLIHTR

SEQ ID NO: 22699 - protein, 9 aa, Homo Sapiens
VFWYVQYPN

SEQ ID NO: 22700 - protein, 9 aa, Homo Sapiens
YLLESRHRF

SEQ ID NO: 22701 - protein, 9 aa, Homo Sapiens
NLECKIRKL

SEQ ID NO: 22702 - protein, 9 aa, Homo Sapiens
KRVDTAEVQ

SEQ ID NO: 22703 - protein, 9 aa, Homo Sapiens
FLKFTLENY

SEQ ID NO: 22704 - protein, 9 aa, Homo Sapiens
KISKAVKRA

SEQ ID NO: 22705 - protein, 9 aa, Homo Sapiens
EVLRNESLE

SEQ ID NO: 22706 - protein, 9 aa, Homo Sapiens
LAKEMSKLT

SEQ ID NO: 22707 - protein, 9 aa, Homo Sapiens
SLSFGLHRL

SEQ ID NO: 22708 - protein, 9 aa, Homo Sapiens
PYACKTCRK

SEQ ID NO: 22709 - protein, 9 aa, Homo Sapiens
EEFVPEVKE

SEQ ID NO: 22710 - protein, 9 aa, Homo Sapiens
WKHYIYLWI

SEQ ID NO: 22711 - protein, 9 aa, Homo Sapiens
ETEGPSNGE

SEQ ID NO: 22712 - protein, 9 aa, Homo Sapiens
SKIKHPVYS

SEQ ID NO: 22713 - protein, 9 aa, Homo Sapiens
KGAHLVGLM

SEQ ID NO: 22714 - protein, 9 aa, Homo Sapiens
EPHERCFLG

SEQ ID NO: 22715 - protein, 9 aa, Homo Sapiens
EPQLQWSHL

SEQ ID NO: 22716 - protein, 9 aa, Homo Sapiens
LDAINPLLT

SEQ ID NO: 22717 - protein, 9 aa, Homo Sapiens
PEWRLKLPL

SEQ ID NO: 22718 - protein, 9 aa, Homo Sapiens
LTDAIFCEN

SEQ ID NO: 22719 - protein, 9 aa, Homo Sapiens
ITLLTDAIF

SEQ ID NO: 22720 - protein, 9 aa, Homo Sapiens
RELRARQQC

SEQ ID NO: 22721 - protein, 9 aa, Homo Sapiens
SVSTAAQPN

SEQ ID NO: 22722 - protein, 9 aa, Homo Sapiens
KSEQLHHLM

SEQ ID NO: 22723 - protein, 9 aa, Homo Sapiens
PALDFTVKN

SEQ ID NO: 22724 - protein, 9 aa, Homo Sapiens
NMGSNNKVG

SEQ ID NO: 22725 - protein, 9 aa, Homo Sapiens
QKGELKVSH

SEQ ID NO: 22726 - protein, 9 aa, Homo Sapiens
HEKPYLPPT

SEQ ID NO: 22727 - protein, 9 aa, Homo Sapiens
QESLIWVRY

SEQ ID NO: 22728 - protein, 9 aa, Homo Sapiens
FNLDSHCST

SEQ ID NO: 22729 - protein, 9 aa, Homo Sapiens
VDHVRLLVP

SEQ ID NO: 22730 - protein, 9 aa, Homo Sapiens
KTISNNDDV

SEQ ID NO: 22731 - protein, 9 aa, Homo Sapiens
PLLFICDNL

SEQ ID NO: 22732 - protein, 9 aa, Homo Sapiens
YEPGPQALR

SEQ ID NO: 22733 - protein, 9 aa, Homo Sapiens
SERDFLKFT

SEQ ID NO: 22734 - protein, 9 aa, Homo Sapiens
TTDDDAVSK

SEQ ID NO: 22735 - protein, 9 aa, Homo Sapiens
DGSEASVEW

SEQ ID NO: 22736 - protein, 9 aa, Homo Sapiens
SKAGEVVPA

SEQ ID NO: 22737 - protein, 9 aa, Homo Sapiens
VRTKFPLGR

SEQ ID NO: 22738 - protein, 9 aa, Homo Sapiens
IEQDNDMLE

SEQ ID NO: 22739 - protein, 9 aa, Homo Sapiens
CVRLLLLRV

SEQ ID NO: 22740 - protein, 9 aa, Homo Sapiens
PRHQELFNE

SEQ ID NO: 22741 - protein, 9 aa, Homo Sapiens
DGYACNENQ

SEQ ID NO: 22742 - protein, 9 aa, Homo Sapiens
VEWSSERQD

SEQ ID NO: 22743 - protein, 9 aa, Homo Sapiens
FSSGQYASS

SEQ ID NO: 22744 - protein, 9 aa, Homo Sapiens
IKEHMQMLQ

SEQ ID NO: 22745 - protein, 9 aa, Homo Sapiens
AIQELMKIY

SEQ ID NO: 22746 - protein, 9 aa, Homo Sapiens
EAGPEAPGG

SEQ ID NO: 22747 - protein, 9 aa, Homo Sapiens
ARLEQMVIS

SEQ ID NO: 22748 - protein, 9 aa, Homo Sapiens
FFKDVESDF

SEQ ID NO: 22749 - protein, 9 aa, Homo Sapiens
TCFAICSCW

SEQ ID NO: 22750 - protein, 9 aa, Homo Sapiens
VMKYASGGE

SEQ ID NO: 22751 - protein, 9 aa, Homo Sapiens
QYVCLHAHA

SEQ ID NO: 22752 - protein, 9 aa, Homo Sapiens
HEESTQVQL

SEQ ID NO: 22753 - protein, 9 aa, Homo Sapiens
YEWYLKIQL

SEQ ID NO: 22754 - protein, 9 aa, Homo Sapiens
QIKLLLENP

SEQ ID NO: 22755 - protein, 9 aa, Homo Sapiens
KPQIRKIVD

SEQ ID NO: 22756 - protein, 9 aa, Homo Sapiens
AVSVVELYG

SEQ ID NO: 22757 - protein, 9 aa, Homo Sapiens
SQMLNGFPR

SEQ ID NO: 22758 - protein, 9 aa, Homo Sapiens
GSFIKSQNK

SEQ ID NO: 22759 - protein, 9 aa, Homo Sapiens
GFFAPGHGP

SEQ ID NO: 22760 - protein, 9 aa, Homo Sapiens
QELWCPCPH

SEQ ID NO: 22761 - protein, 9 aa, Homo Sapiens
LKSSMSFQN

SEQ ID NO: 22762 - protein, 9 aa, Homo Sapiens
SYRSLSGCP

SEQ ID NO: 22763 - protein, 9 aa, Homo Sapiens
GQQPGWQSS

SEQ ID NO: 22764 - protein, 9 aa, Homo Sapiens
VSGNPYVFW

SEQ ID NO: 22765 - protein, 9 aa, Homo Sapiens
MTNNTTSKE

SEQ ID NO: 22766 - protein, 9 aa, Homo Sapiens
ANCGSTTAQ

SEQ ID NO: 22767 - protein, 9 aa, Homo Sapiens
ELMKIYGQD

SEQ ID NO: 22768 - protein, 9 aa, Homo Sapiens
TDNYESESG

SEQ ID NO: 22769 - protein, 9 aa, Homo Sapiens
QPGILNYAT

SEQ ID NO: 22770 - protein, 9 aa, Homo Sapiens
PDELKDKLP

SEQ ID NO: 22771 - protein, 9 aa, Homo Sapiens
NTIKPDVQK

SEQ ID NO: 22772 - protein, 9 aa, Homo Sapiens
GQKAGPHRV

SEQ ID NO: 22773 - protein, 9 aa, Homo Sapiens
PAEPQLQWS

SEQ ID NO: 22774 - protein, 9 aa, Homo Sapiens
AICSCWGFW

SEQ ID NO: 22775 - protein, 9 aa, Homo Sapiens
NNSSTLKKR

SEQ ID NO: 22776 - protein, 9 aa, Homo Sapiens
NSVSQEDVE

SEQ ID NO: 22777 - protein, 9 aa, Homo Sapiens
SIEQRVNEM

SEQ ID NO: 22778 - protein, 9 aa, Homo Sapiens
QTVESTVVR

SEQ ID NO: 22779 - protein, 9 aa, Homo Sapiens
GYPGTPRNR

SEQ ID NO: 22780 - protein, 9 aa, Homo Sapiens
TVVRKNNLK

SEQ ID NO: 22781 - protein, 9 aa, Homo Sapiens
IIYCLHNQE

SEQ ID NO: 22782 - protein, 9 aa, Homo Sapiens
DNKKTQIIP

SEQ ID NO: 22783 - protein, 9 aa, Homo Sapiens
GGGDVSLTL

SEQ ID NO: 22784 - protein, 9 aa, Homo Sapiens
HDDYFYHDK

SEQ ID NO: 22785 - protein, 9 aa, Homo Sapiens
EVRVCAFPG

SEQ ID NO: 22786 - protein, 9 aa, Homo Sapiens
EEAKYVEEG

SEQ ID NO: 22787 - protein, 9 aa, Homo Sapiens
PEEDAAPTS

SEQ ID NO: 22788 - protein, 9 aa, Homo Sapiens
SLLPMPLSG

SEQ ID NO: 22789 - protein, 9 aa, Homo Sapiens
YYSKKGRKS

SEQ ID NO: 22790 - protein, 9 aa, Homo Sapiens
RHVIQHDGR

SEQ ID NO: 22791 - protein, 9 aa, Homo Sapiens
RQSKISLNN

SEQ ID NO: 22792 - protein, 9 aa, Homo Sapiens
ACGEPVAKT

SEQ ID NO: 22793 - protein, 9 aa, Homo Sapiens
ETPRETYRK

SEQ ID NO: 22794 - protein, 9 aa, Homo Sapiens
RKRLKAYVL

SEQ ID NO: 22795 - protein, 9 aa, Homo Sapiens
SRLSGNIGN

SEQ ID NO: 22796 - protein, 9 aa, Homo Sapiens
SLKVPDSRK

SEQ ID NO: 22797 - protein, 9 aa, Homo Sapiens
DVQESLIWV

SEQ ID NO: 22798 - protein, 9 aa, Homo Sapiens
TPPCHPDYR

SEQ ID NO: 22799 - protein, 9 aa, Homo Sapiens
AKFSSGQYA

SEQ ID NO: 22800 - protein, 9 aa, Homo Sapiens
AFPGRDRRT

SEQ ID NO: 22801 - protein, 9 aa, Homo Sapiens
LMKARKVRG

SEQ ID NO: 22802 - protein, 9 aa, Homo Sapiens
NNKGAHLVG

SEQ ID NO: 22803 - protein, 9 aa, Homo Sapiens
PALELVEPV

SEQ ID NO: 22804 - protein, 9 aa, Homo Sapiens
WETQPGFYL

SEQ ID NO: 22805 - protein, 9 aa, Homo Sapiens
SNTIKPDVQ

SEQ ID NO: 22806 - protein, 9 aa, Homo Sapiens
RARNDLMSD

SEQ ID NO: 22807 - protein, 9 aa, Homo Sapiens
STLKKRKLI

SEQ ID NO: 22808 - protein, 9 aa, Homo Sapiens
QAHLAPDCP

SEQ ID NO: 22809 - protein, 9 aa, Homo Sapiens
NHIDTEKLS

SEQ ID NO: 22810 - protein, 9 aa, Homo Sapiens
NGVCENTHG

SEQ ID NO: 22811 - protein, 9 aa, Homo Sapiens
TEIKDGEKF

SEQ ID NO: 22812 - protein, 9 aa, Homo Sapiens
IYLDKEKRK

SEQ ID NO: 22813 - protein, 9 aa, Homo Sapiens
DHKPAFNMQ

SEQ ID NO: 22814 - protein, 9 aa, Homo Sapiens
ETYFHQFGH

SEQ ID NO: 22815 - protein, 9 aa, Homo Sapiens
PLLTDFDFQ

SEQ ID NO: 22816 - protein, 9 aa, Homo Sapiens
YVYLVSEMC

SEQ ID NO: 22817 - protein, 9 aa, Homo Sapiens
RVCAFPGRD

SEQ ID NO: 22818 - protein, 9 aa, Homo Sapiens
MQLDNVVSS

SEQ ID NO: 22819 - protein, 9 aa, Homo Sapiens
TIFTMSPVL

SEQ ID NO: 22820 - protein, 9 aa, Homo Sapiens
IARDTLTRL

SEQ ID NO: 22821 - protein, 9 aa, Homo Sapiens
RALNYYGLY

SEQ ID NO: 22822 - protein, 9 aa, Homo Sapiens
SCHVRNGTY

SEQ ID NO: 22823 - protein, 9 aa, Homo Sapiens
IQNLECKIR

SEQ ID NO: 22824 - protein, 9 aa, Homo Sapiens
VCRQGMFNC

SEQ ID NO: 22825 - protein, 9 aa, Homo Sapiens
QLAFNARKL

SEQ ID NO: 22826 - protein, 9 aa, Homo Sapiens
AAPPSLSFG

SEQ ID NO: 22827 - protein, 9 aa, Homo Sapiens
SHCSTELTN

SEQ ID NO: 22828 - protein, 9 aa, Homo Sapiens
IAKQLENDN

SEQ ID NO: 22829 - protein, 9 aa, Homo Sapiens
ENENISKQL

SEQ ID NO: 22830 - protein, 9 aa, Homo Sapiens
YWLVTATGT

SEQ ID NO: 22831 - protein, 9 aa, Homo Sapiens
MAPKRPSDS

SEQ ID NO: 22832 - protein, 9 aa, Homo Sapiens
GEIIAGRES

SEQ ID NO: 22833 - protein, 9 aa, Homo Sapiens
MNAFRKEKD

SEQ ID NO: 22834 - protein, 9 aa, Homo Sapiens
NTTSKEVSE

SEQ ID NO: 22835 - protein, 9 aa, Homo Sapiens
VVRKNNLKD

SEQ ID NO: 22836 - protein, 9 aa, Homo Sapiens
NYRLESGYE

SEQ ID NO: 22837 - protein, 9 aa, Homo Sapiens
LVFYSGKPV

SEQ ID NO: 22838 - protein, 9 aa, Homo Sapiens
RREDNNEEL

SEQ ID NO: 22839 - protein, 9 aa, Homo Sapiens
RSEPDIPES

SEQ ID NO: 22840 - protein, 9 aa, Homo Sapiens
ELVQQLIEN

SEQ ID NO: 22841 - protein, 9 aa, Homo Sapiens
KVPDSRKKV

SEQ ID NO: 22842 - protein, 9 aa, Homo Sapiens
KSQSQRRAG

SEQ ID NO: 22843 - protein, 9 aa, Homo Sapiens
AELRETLIL

SEQ ID NO: 22844 - protein, 9 aa, Homo Sapiens
EPDIPESSR

SEQ ID NO: 22845 - protein, 9 aa, Homo Sapiens
KATACVVDR

SEQ ID NO: 22846 - protein, 9 aa, Homo Sapiens
KRSVTSSSF

SEQ ID NO: 22847 - protein, 9 aa, Homo Sapiens
SSTSVHPSD

SEQ ID NO: 22848 - protein, 9 aa, Homo Sapiens
PIPECGTYS

SEQ ID NO: 22849 - protein, 9 aa, Homo Sapiens
HRALAVDAN

SEQ ID NO: 22850 - protein, 9 aa, Homo Sapiens
LANPPSNIN

SEQ ID NO: 22851 - protein, 9 aa, Homo Sapiens
ELQWSHLAS

SEQ ID NO: 22852 - protein, 9 aa, Homo Sapiens
KSQNKEDYA

SEQ ID NO: 22853 - protein, 9 aa, Homo Sapiens
INPLLTDFD

SEQ ID NO: 22854 - protein, 9 aa, Homo Sapiens
VEAYRQEAK

SEQ ID NO: 22855 - protein, 9 aa, Homo Sapiens
VKNVEKALH

SEQ ID NO: 22856 - protein, 9 aa, Homo Sapiens
SEQLHHLMC

SEQ ID NO: 22857 - protein, 9 aa, Homo Sapiens
VRGRTTSAG

SEQ ID NO: 22858 - protein, 9 aa, Homo Sapiens
KGKIFNKMQ

SEQ ID NO: 22859 - protein, 9 aa, Homo Sapiens
VRKSQSQRR

SEQ ID NO: 22860 - protein, 9 aa, Homo Sapiens
WARNRAHLS

SEQ ID NO: 22861 - protein, 9 aa, Homo Sapiens
HMKDGEDLK

SEQ ID NO: 22862 - protein, 9 aa, Homo Sapiens
ENHAHYEWY

SEQ ID NO: 22863 - protein, 9 aa, Homo Sapiens
GDTCQPGIL

SEQ ID NO: 22864 - protein, 9 aa, Homo Sapiens
LQEIMKQMG

SEQ ID NO: 22865 - protein, 9 aa, Homo Sapiens
CIQNLECKI

SEQ ID NO: 22866 - protein, 9 aa, Homo Sapiens
GTPAVELLQ

SEQ ID NO: 22867 - protein, 9 aa, Homo Sapiens
EAKLECEQE

SEQ ID NO: 22868 - protein, 9 aa, Homo Sapiens
GDDYISHCH

SEQ ID NO: 22869 - protein, 9 aa, Homo Sapiens
SAYWLVTAT

SEQ ID NO: 22870 - protein, 9 aa, Homo Sapiens
EKFGTVSSQ

SEQ ID NO: 22871 - protein, 9 aa, Homo Sapiens
FNVKFYAPD

SEQ ID NO: 22872 - protein, 9 aa, Homo Sapiens
GRKSFSIGL

SEQ ID NO: 22873 - protein, 9 aa, Homo Sapiens
RLQQNLFGR

SEQ ID NO: 22874 - protein, 9 aa, Homo Sapiens
QEAKTHRRH

SEQ ID NO: 22875 - protein, 9 aa, Homo Sapiens
KAGEVVPAF

SEQ ID NO: 22876 - protein, 9 aa, Homo Sapiens
PGGQQPGWQ

SEQ ID NO: 22877 - protein, 9 aa, Homo Sapiens
AAVTVQLFQ

SEQ ID NO: 22878 - protein, 9 aa, Homo Sapiens
VRFKKDALR

SEQ ID NO: 22879 - protein, 9 aa, Homo Sapiens
APTSPSSSV

SEQ ID NO: 22880 - protein, 9 aa, Homo Sapiens
VYRFFLAVH

SEQ ID NO: 22881 - protein, 9 aa, Homo Sapiens
ERRSPSSKD

SEQ ID NO: 22882 - protein, 9 aa, Homo Sapiens
REVAASCWL

SEQ ID NO: 22883 - protein, 9 aa, Homo Sapiens
PVSFEDPEL

SEQ ID NO: 22884 - protein, 9 aa, Homo Sapiens
QHRQYVCLH

SEQ ID NO: 22885 - protein, 9 aa, Homo Sapiens
AAKRRNVKR

SEQ ID NO: 22886 - protein, 9 aa, Homo Sapiens
LRIAAGKTI

SEQ ID NO: 22887 - protein, 9 aa, Homo Sapiens
LYQSPPVRY

SEQ ID NO: 22888 - protein, 9 aa, Homo Sapiens
PDFQINVEV

SEQ ID NO: 22889 - protein, 9 aa, Homo Sapiens
MIKNFDRDN

SEQ ID NO: 22890 - protein, 9 aa, Homo Sapiens
MSFQNIIEG

SEQ ID NO: 22891 - protein, 9 aa, Homo Sapiens
CTAPKMPKF

SEQ ID NO: 22892 - protein, 9 aa, Homo Sapiens
DLKEVDLLY

SEQ ID NO: 22893 - protein, 9 aa, Homo Sapiens
LCLARSAAK

SEQ ID NO: 22894 - protein, 9 aa, Homo Sapiens
STITEGTLL

SEQ ID NO: 22895 - protein, 9 aa, Homo Sapiens
KFPLGRYGT

SEQ ID NO: 22896 - protein, 9 aa, Homo Sapiens
PQALRGDDF

SEQ ID NO: 22897 - protein, 9 aa, Homo Sapiens
SGNFAIRLL

SEQ ID NO: 22898 - protein, 9 aa, Homo Sapiens
QPEQVLVIS

SEQ ID NO: 22899 - protein, 9 aa, Homo Sapiens
VATPSRLSA

SEQ ID NO: 22900 - protein, 9 aa, Homo Sapiens
PVGGKRVDT

SEQ ID NO: 22901 - protein, 9 aa, Homo Sapiens
SSPRKDGVD

SEQ ID NO: 22902 - protein, 9 aa, Homo Sapiens
WCLGWDFPK

SEQ ID NO: 22903 - protein, 9 aa, Homo Sapiens
HELDYQRLL

SEQ ID NO: 22904 - protein, 9 aa, Homo Sapiens
AELLQSDKN

SEQ ID NO: 22905 - protein, 9 aa, Homo Sapiens
LELVEPVKK

SEQ ID NO: 22906 - protein, 9 aa, Homo Sapiens
GFKPQIRKI

SEQ ID NO: 22907 - protein, 9 aa, Homo Sapiens
AFSKAGEVV

SEQ ID NO: 22908 - protein, 9 aa, Homo Sapiens
PFDPFDLFD

SEQ ID NO: 22909 - protein, 9 aa, Homo Sapiens
LYNSVSQED

SEQ ID NO: 22910 - protein, 9 aa, Homo Sapiens
HWIAQALQP

SEQ ID NO: 22911 - protein, 9 aa, Homo Sapiens
TAWLEWWHV

SEQ ID NO: 22912 - protein, 9 aa, Homo Sapiens
PGAEAPVRA

SEQ ID NO: 22913 - protein, 9 aa, Homo Sapiens
KNRTGDLIS

SEQ ID NO: 22914 - protein, 9 aa, Homo Sapiens
HCLDMAPKR

SEQ ID NO: 22915 - protein, 9 aa, Homo Sapiens
LRLGKSKAP

SEQ ID NO: 22916 - protein, 9 aa, Homo Sapiens
RIAAGKTIA

SEQ ID NO: 22917 - protein, 9 aa, Homo Sapiens
QGSMKQALG

SEQ ID NO: 22918 - protein, 9 aa, Homo Sapiens
GNYASYRSL

SEQ ID NO: 22919 - protein, 9 aa, Homo Sapiens
SHKATACVV

SEQ ID NO: 22920 - protein, 9 aa, Homo Sapiens
CNENQGRCY

SEQ ID NO: 22921 - protein, 9 aa, Homo Sapiens
FTMMLARVC

SEQ ID NO: 22922 - protein, 9 aa, Homo Sapiens
MNPLAMRLP

SEQ ID NO: 22923 - protein, 9 aa, Homo Sapiens
IHTETKPFK

SEQ ID NO: 22924 - protein, 9 aa, Homo Sapiens
WQHRQYVCL

SEQ ID NO: 22925 - protein, 9 aa, Homo Sapiens
PCENENISK

SEQ ID NO: 22926 - protein, 9 aa, Homo Sapiens
LSDQSNQSV

SEQ ID NO: 22927 - protein, 9 aa, Homo Sapiens
VCKLFDIRN

SEQ ID NO: 22928 - protein, 9 aa, Homo Sapiens
FTLAEDLNL

SEQ ID NO: 22929 - protein, 9 aa, Homo Sapiens
GNIGNLSST

SEQ ID NO: 22930 - protein, 9 aa, Homo Sapiens
WLQGAPGLC

SEQ ID NO: 22931 - protein, 9 aa, Homo Sapiens
GKTIALLFE

SEQ ID NO: 22932 - protein, 9 aa, Homo Sapiens
DKAGIIWSW

SEQ ID NO: 22933 - protein, 9 aa, Homo Sapiens
WSLEITCIE

SEQ ID NO: 22934 - protein, 9 aa, Homo Sapiens
GCFAGLLIL

SEQ ID NO: 22935 - protein, 9 aa, Homo Sapiens
LDACALMRG

SEQ ID NO: 22936 - protein, 9 aa, Homo Sapiens
LFSNTPTSV

SEQ ID NO: 22937 - protein, 9 aa, Homo Sapiens
PTSPSSSVV

SEQ ID NO: 22938 - protein, 9 aa, Homo Sapiens
SKSRSAQRS

SEQ ID NO: 22939 - protein, 9 aa, Homo Sapiens
PSFSGSKDS

SEQ ID NO: 22940 - protein, 9 aa, Homo Sapiens
KSDIVNEMS

SEQ ID NO: 22941 - protein, 9 aa, Homo Sapiens
ISACVLNFY

SEQ ID NO: 22942 - protein, 9 aa, Homo Sapiens
GTQATIHLT

SEQ ID NO: 22943 - protein, 9 aa, Homo Sapiens
ELSQTLDFK

SEQ ID NO: 22944 - protein, 9 aa, Homo Sapiens
YDGLQAGAV

SEQ ID NO: 22945 - protein, 9 aa, Homo Sapiens
HLLFFNGKD

SEQ ID NO: 22946 - protein, 9 aa, Homo Sapiens
SWVDTKRTP

SEQ ID NO: 22947 - protein, 9 aa, Homo Sapiens
MRRQFLAPN

SEQ ID NO: 22948 - protein, 9 aa, Homo Sapiens
YSSSISHKA

SEQ ID NO: 22949 - protein, 9 aa, Homo Sapiens
VSAVVDAGS

SEQ ID NO: 22950 - protein, 9 aa, Homo Sapiens
LPSVGYNGA

SEQ ID NO: 22951 - protein, 9 aa, Homo Sapiens
GHYKRGILW

SEQ ID NO: 22952 - protein, 9 aa, Homo Sapiens
CVLNFYRAL

SEQ ID NO: 22953 - protein, 9 aa, Homo Sapiens
YERREDNNE

SEQ ID NO: 22954 - protein, 9 aa, Homo Sapiens
ASQMRMVVL

SEQ ID NO: 22955 - protein, 9 aa, Homo Sapiens
GWILTTKCF

SEQ ID NO: 22956 - protein, 9 aa, Homo Sapiens
NPLLTDFDF

SEQ ID NO: 22957 - protein, 9 aa, Homo Sapiens
EVEEAKYVE

SEQ ID NO: 22958 - protein, 9 aa, Homo Sapiens
GDELEMCLS

SEQ ID NO: 22959 - protein, 9 aa, Homo Sapiens
LLSRGDNIN

SEQ ID NO: 22960 - protein, 9 aa, Homo Sapiens
LAPDCPAPA

SEQ ID NO: 22961 - protein, 9 aa, Homo Sapiens
EKIKKGLSD

SEQ ID NO: 22962 - protein, 9 aa, Homo Sapiens
REIDPDQLK

SEQ ID NO: 22963 - protein, 9 aa, Homo Sapiens
GRYPHMKDG

SEQ ID NO: 22964 - protein, 9 aa, Homo Sapiens
FGDSGRIYY

SEQ ID NO: 22965 - protein, 9 aa, Homo Sapiens
QRLKERTGP

SEQ ID NO: 22966 - protein, 9 aa, Homo Sapiens
TWAEAGPEA

SEQ ID NO: 22967 - protein, 9 aa, Homo Sapiens
LVSLITLLT

SEQ ID NO: 22968 - protein, 9 aa, Homo Sapiens
GYFHASSYG

SEQ ID NO: 22969 - protein, 9 aa, Homo Sapiens
GLQAGAVDH

SEQ ID NO: 22970 - protein, 9 aa, Homo Sapiens
SLQRQWGAS

SEQ ID NO: 22971 - protein, 9 aa, Homo Sapiens
WKPGSNTIK

SEQ ID NO: 22972 - protein, 9 aa, Homo Sapiens
CGTYSLCSS

SEQ ID NO: 22973 - protein, 9 aa, Homo Sapiens
QCPSRGRHG

SEQ ID NO: 22974 - protein, 9 aa, Homo Sapiens
YDFFLPVRE

SEQ ID NO: 22975 - protein, 9 aa, Homo Sapiens
LLQSDKNGI

SEQ ID NO: 22976 - protein, 9 aa, Homo Sapiens
NISKQLHLC

SEQ ID NO: 22977 - protein, 9 aa, Homo Sapiens
ANKPKQEPE

SEQ ID NO: 22978 - protein, 9 aa, Homo Sapiens
ASNAAYPVL

SEQ ID NO: 22979 - protein, 9 aa, Homo Sapiens
QNTVKQSSL

SEQ ID NO: 22980 - protein, 9 aa, Homo Sapiens
EPGDKRSVT

SEQ ID NO: 22981 - protein, 9 aa, Homo Sapiens
SGCSWIAVL

SEQ ID NO: 22982 - protein, 9 aa, Homo Sapiens
AGLRGVHYI

SEQ ID NO: 22983 - protein, 9 aa, Homo Sapiens
MPPSHELDY

SEQ ID NO: 22984 - protein, 9 aa, Homo Sapiens
ASCVSENKR

SEQ ID NO: 22985 - protein, 9 aa, Homo Sapiens
ACQSRRKKN

SEQ ID NO: 22986 - protein, 9 aa, Homo Sapiens
SETPRETYR

SEQ ID NO: 22987 - protein, 9 aa, Homo Sapiens
SQTDFLTPP

SEQ ID NO: 22988 - protein, 9 aa, Homo Sapiens
RGDNINAFD

SEQ ID NO: 22989 - protein, 9 aa, Homo Sapiens
NFSESPKFH

SEQ ID NO: 22990 - protein, 9 aa, Homo Sapiens
RYPHMKDGE

SEQ ID NO: 22991 - protein, 9 aa, Homo Sapiens
GRQRLKERT

SEQ ID NO: 22992 - protein, 9 aa, Homo Sapiens
DLHSLNLSM

SEQ ID NO: 22993 - protein, 9 aa, Homo Sapiens
NENISKQLH

SEQ ID NO: 22994 - protein, 9 aa, Homo Sapiens
FMKALFDYN

SEQ ID NO: 22995 - protein, 9 aa, Homo Sapiens
PVAKTKMEV

SEQ ID NO: 22996 - protein, 9 aa, Homo Sapiens
FRRKELSQT

SEQ ID NO: 22997 - protein, 9 aa, Homo Sapiens
SSGQYASSR

SEQ ID NO: 22998 - protein, 9 aa, Homo Sapiens
KTKKHQLEV

SEQ ID NO: 22999 - protein, 9 aa, Homo Sapiens
VEPVKKHEV

SEQ ID NO: 23000 - protein, 9 aa, Homo Sapiens
GVVTKPASM

SEQ ID NO: 23001 - protein, 9 aa, Homo Sapiens
RDGSEASVE

SEQ ID NO: 23002 - protein, 9 aa, Homo Sapiens
SNDIRKSVP

SEQ ID NO: 23003 - protein, 9 aa, Homo Sapiens
TFTVSAQKN

SEQ ID NO: 23004 - protein, 9 aa, Homo Sapiens
LMQHQKVHS

SEQ ID NO: 23005 - protein, 9 aa, Homo Sapiens
SLITLLTDA

SEQ ID NO: 23006 - protein, 9 aa, Homo Sapiens
GIYLDKEKR

SEQ ID NO: 23007 - protein, 9 aa, Homo Sapiens
EAKTHRRHI

SEQ ID NO: 23008 - protein, 9 aa, Homo Sapiens
ELEMCLSAL

SEQ ID NO: 23009 - protein, 9 aa, Homo Sapiens
KNEYLQGLE

SEQ ID NO: 23010 - protein, 9 aa, Homo Sapiens
TCQPGILNY

SEQ ID NO: 23011 - protein, 9 aa, Homo Sapiens
EDPDSVTPI

SEQ ID NO: 23012 - protein, 9 aa, Homo Sapiens
REDPDSVTP

SEQ ID NO: 23013 - protein, 9 aa, Homo Sapiens
DDYISHCHP

SEQ ID NO: 23014 - protein, 9 aa, Homo Sapiens
GLRNSEPFD

SEQ ID NO: 23015 - protein, 9 aa, Homo Sapiens
SAQRDLDKV

SEQ ID NO: 23016 - protein, 9 aa, Homo Sapiens
ELYVMEMSD

SEQ ID NO: 23017 - protein, 9 aa, Homo Sapiens
QGSGSGQCP

SEQ ID NO: 23018 - protein, 9 aa, Homo Sapiens
VSKSSNIEE

SEQ ID NO: 23019 - protein, 9 aa, Homo Sapiens
HAGNLDGED

SEQ ID NO: 23020 - protein, 9 aa, Homo Sapiens
QEKRHWKHY

SEQ ID NO: 23021 - protein, 9 aa, Homo Sapiens
YTTSPAGPG

SEQ ID NO: 23022 - protein, 9 aa, Homo Sapiens
HRQYVCLHA

SEQ ID NO: 23023 - protein, 9 aa, Homo Sapiens
LEAQGSMKQ

SEQ ID NO: 23024 - protein, 9 aa, Homo Sapiens
AGWKPGSNT

SEQ ID NO: 23025 - protein, 9 aa, Homo Sapiens
QVIHTETKP

SEQ ID NO: 23026 - protein, 9 aa, Homo Sapiens
NKDAVAFTC

SEQ ID NO: 23027 - protein, 9 aa, Homo Sapiens
GILLKSSMS

SEQ ID NO: 23028 - protein, 9 aa, Homo Sapiens
STRYNTELC

SEQ ID NO: 23029 - protein, 9 aa, Homo Sapiens
FNKQCSELV

SEQ ID NO: 23030 - protein, 9 aa, Homo Sapiens
LESGYEKHL

SEQ ID NO: 23031 - protein, 9 aa, Homo Sapiens
STRGQLKPQ

SEQ ID NO: 23032 - protein, 9 aa, Homo Sapiens
SLFLSPPSP

SEQ ID NO: 23033 - protein, 9 aa, Homo Sapiens
VTPIDVLWI

SEQ ID NO: 23034 - protein, 9 aa, Homo Sapiens
ATFTMMLAR

SEQ ID NO: 23035 - protein, 9 aa, Homo Sapiens
VVDPLPQVQ

SEQ ID NO: 23036 - protein, 9 aa, Homo Sapiens
RRKKNEYLQ

SEQ ID NO: 23037 - protein, 9 aa, Homo Sapiens
LDLAGLRGV

SEQ ID NO: 23038 - protein, 9 aa, Homo Sapiens
VCGPLYTTS

SEQ ID NO: 23039 - protein, 9 aa, Homo Sapiens
HITGNYASY

SEQ ID NO: 23040 - protein, 9 aa, Homo Sapiens
DVFLRRHMP

SEQ ID NO: 23041 - protein, 9 aa, Homo Sapiens
HHLMCTRKR

SEQ ID NO: 23042 - protein, 9 aa, Homo Sapiens
TPKAWLQEG

SEQ ID NO: 23043 - protein, 9 aa, Homo Sapiens
SHRANWMKA

SEQ ID NO: 23044 - protein, 9 aa, Homo Sapiens
DEQYATEGR

SEQ ID NO: 23045 - protein, 9 aa, Homo Sapiens
APEQPGEEK

SEQ ID NO: 23046 - protein, 9 aa, Homo Sapiens
TTSPAGPGR

SEQ ID NO: 23047 - protein, 9 aa, Homo Sapiens
EALSVRQRL

SEQ ID NO: 23048 - protein, 9 aa, Homo Sapiens
KDNFVNSKN

SEQ ID NO: 23049 - protein, 9 aa, Homo Sapiens
CGKGYFADY

SEQ ID NO: 23050 - protein, 9 aa, Homo Sapiens
KVELQEVVQ

SEQ ID NO: 23051 - protein, 9 aa, Homo Sapiens
GLLGLSLHY

SEQ ID NO: 23052 - protein, 9 aa, Homo Sapiens
KARKVRGLQ

SEQ ID NO: 23053 - protein, 9 aa, Homo Sapiens
CSPVITCSW

SEQ ID NO: 23054 - protein, 9 aa, Homo Sapiens
KKTQIIPRH

SEQ ID NO: 23055 - protein, 9 aa, Homo Sapiens
VFILGRAYA

SEQ ID NO: 23056 - protein, 9 aa, Homo Sapiens
PSSPRKDGV

SEQ ID NO: 23057 - protein, 9 aa, Homo Sapiens
MKARKVRGL

SEQ ID NO: 23058 - protein, 9 aa, Homo Sapiens
IEQQSDCKI

SEQ ID NO: 23059 - protein, 9 aa, Homo Sapiens
ALDSPRSLR

SEQ ID NO: 23060 - protein, 9 aa, Homo Sapiens
LVTLADIYR

SEQ ID NO: 23061 - protein, 9 aa, Homo Sapiens
ACVLNFYRA

SEQ ID NO: 23062 - protein, 9 aa, Homo Sapiens
DLDKVKSSL

SEQ ID NO: 23063 - protein, 9 aa, Homo Sapiens
YACKTCRKA

SEQ ID NO: 23064 - protein, 9 aa, Homo Sapiens
NEYLQGLEA

SEQ ID NO: 23065 - protein, 9 aa, Homo Sapiens
SLNNLSEDG

SEQ ID NO: 23066 - protein, 9 aa, Homo Sapiens
TDHVVVPLL

SEQ ID NO: 23067 - protein, 9 aa, Homo Sapiens
GCVTGHFTL

SEQ ID NO: 23068 - protein, 9 aa, Homo Sapiens
SYHTGCFRC

SEQ ID NO: 23069 - protein, 9 aa, Homo Sapiens
LTTKCFQVP

SEQ ID NO: 23070 - protein, 9 aa, Homo Sapiens
MCYFLTNLS

SEQ ID NO: 23071 - protein, 9 aa, Homo Sapiens
GNAEQPRGP

SEQ ID NO: 23072 - protein, 9 aa, Homo Sapiens
MLARVCLCP

SEQ ID NO: 23073 - protein, 9 aa, Homo Sapiens
RGKPGAEAP

SEQ ID NO: 23074 - protein, 9 aa, Homo Sapiens
EPAELRETL

SEQ ID NO: 23075 - protein, 9 aa, Homo Sapiens
YFRRKELSQ

SEQ ID NO: 23076 - protein, 9 aa, Homo Sapiens
YTNDPTVKP

SEQ ID NO: 23077 - protein, 9 aa, Homo Sapiens
PVITCSWIR

SEQ ID NO: 23078 - protein, 9 aa, Homo Sapiens
RQRHGPSYN

SEQ ID NO: 23079 - protein, 9 aa, Homo Sapiens
CLDMAPKRP

SEQ ID NO: 23080 - protein, 9 aa, Homo Sapiens
DYQRLLEYL

SEQ ID NO: 23081 - protein, 9 aa, Homo Sapiens
ENPVFAGVR

SEQ ID NO: 23082 - protein, 9 aa, Homo Sapiens
DLKSDSEEK

SEQ ID NO: 23083 - protein, 9 aa, Homo Sapiens
DYAKHKCTA

SEQ ID NO: 23084 - protein, 9 aa, Homo Sapiens
LVSEMCHNG

SEQ ID NO: 23085 - protein, 9 aa, Homo Sapiens
PAGWKPGSN

SEQ ID NO: 23086 - protein, 9 aa, Homo Sapiens
SKISKAVKR

SEQ ID NO: 23087 - protein, 9 aa, Homo Sapiens
RRANLTSIL

SEQ ID NO: 23088 - protein, 9 aa, Homo Sapiens
DNVRIPGML

SEQ ID NO: 23089 - protein, 9 aa, Homo Sapiens
ARGFFAPGH

SEQ ID NO: 23090 - protein, 9 aa, Homo Sapiens
QLKPQELGT

SEQ ID NO: 23091 - protein, 9 aa, Homo Sapiens
KIKKGLSDF

SEQ ID NO: 23092 - protein, 9 aa, Homo Sapiens
TLYLVMKYA

SEQ ID NO: 23093 - protein, 9 aa, Homo Sapiens
FKDVESDFA

SEQ ID NO: 23094 - protein, 9 aa, Homo Sapiens
ILIQRVHYA

SEQ ID NO: 23095 - protein, 9 aa, Homo Sapiens
FVVIYGLVA

SEQ ID NO: 23096 - protein, 9 aa, Homo Sapiens
EEVGHDALE

SEQ ID NO: 23097 - protein, 9 aa, Homo Sapiens
PRETYRKVM

SEQ ID NO: 23098 - protein, 9 aa, Homo Sapiens
EKQFVERKC

SEQ ID NO: 23099 - protein, 9 aa, Homo Sapiens
NQKGELKVS

SEQ ID NO: 23100 - protein, 9 aa, Homo Sapiens
YSEVLRNES

SEQ ID NO: 23101 - protein, 9 aa, Homo Sapiens
YGELMVSKD

SEQ ID NO: 23102 - protein, 9 aa, Homo Sapiens
PPCHPDYRA

SEQ ID NO: 23103 - protein, 9 aa, Homo Sapiens
GSLRKALIG

SEQ ID NO: 23104 - protein, 9 aa, Homo Sapiens
GPQGEIGPQ

SEQ ID NO: 23105 - protein, 9 aa, Homo Sapiens
ECATPAALA

SEQ ID NO: 23106 - protein, 9 aa, Homo Sapiens
EEVEEAKYV

SEQ ID NO: 23107 - protein, 9 aa, Homo Sapiens
EKSEPPAPN

SEQ ID NO: 23108 - protein, 9 aa, Homo Sapiens
KMTNNTTSK

SEQ ID NO: 23109 - protein, 9 aa, Homo Sapiens
WILTTKCFQ

SEQ ID NO: 23110 - protein, 9 aa, Homo Sapiens
TGSSRTFPE

SEQ ID NO: 23111 - protein, 9 aa, Homo Sapiens
TSSNNTMVA

SEQ ID NO: 23112 - protein, 9 aa, Homo Sapiens
EQVPHCICA

SEQ ID NO: 23113 - protein, 9 aa, Homo Sapiens
HDFVVIYGL

SEQ ID NO: 23114 - protein, 9 aa, Homo Sapiens
YAPDPAQLS

SEQ ID NO: 23115 - protein, 9 aa, Homo Sapiens
PKGAPERAA

SEQ ID NO: 23116 - protein, 9 aa, Homo Sapiens
KTPGPLPVL

SEQ ID NO: 23117 - protein, 9 aa, Homo Sapiens
SVTSSSFSG

SEQ ID NO: 23118 - protein, 9 aa, Homo Sapiens
VQQAAAGPK

SEQ ID NO: 23119 - protein, 9 aa, Homo Sapiens
HQHVLSNLQ

SEQ ID NO: 23120 - protein, 9 aa, Homo Sapiens
KDARQQQLA

SEQ ID NO: 23121 - protein, 9 aa, Homo Sapiens
GVSLLLPSV

SEQ ID NO: 23122 - protein, 9 aa, Homo Sapiens
LQVAEHYDR

SEQ ID NO: 23123 - protein, 9 aa, Homo Sapiens
PFGPPLDMQ

SEQ ID NO: 23124 - protein, 9 aa, Homo Sapiens
LLSTAEAAV

SEQ ID NO: 23125 - protein, 9 aa, Homo Sapiens
SFEVRVCAF

SEQ ID NO: 23126 - protein, 9 aa, Homo Sapiens
LRNSEPFDP

SEQ ID NO: 23127 - protein, 9 aa, Homo Sapiens
SVGYNGAIL

SEQ ID NO: 23128 - protein, 9 aa, Homo Sapiens
PTAAGKEAP

SEQ ID NO: 23129 - protein, 9 aa, Homo Sapiens
YFADYAKHK

SEQ ID NO: 23130 - protein, 9 aa, Homo Sapiens
IEAIEKAVI

SEQ ID NO: 23131 - protein, 9 aa, Homo Sapiens
EEAEETDPP

SEQ ID NO: 23132 - protein, 9 aa, Homo Sapiens
KRPSDSPSL

SEQ ID NO: 23133 - protein, 9 aa, Homo Sapiens
KHYIYLWIN

SEQ ID NO: 23134 - protein, 9 aa, Homo Sapiens
KTHRRHINS

SEQ ID NO: 23135 - protein, 9 aa, Homo Sapiens
RVQTNSQCL

SEQ ID NO: 23136 - protein, 9 aa, Homo Sapiens
PPFCSETPR

SEQ ID NO: 23137 - protein, 9 aa, Homo Sapiens
ITFNPDTAH

SEQ ID NO: 23138 - protein, 9 aa, Homo Sapiens
AKEMSKLTD

SEQ ID NO: 23139 - protein, 9 aa, Homo Sapiens
GGRKSFSIG

SEQ ID NO: 23140 - protein, 9 aa, Homo Sapiens
MQCFRERCG

SEQ ID NO: 23141 - protein, 9 aa, Homo Sapiens
KHSSTSTPL

SEQ ID NO: 23142 - protein, 9 aa, Homo Sapiens
GDSGEYKII

SEQ ID NO: 23143 - protein, 9 aa, Homo Sapiens
DFGVIVGSI

SEQ ID NO: 23144 - protein, 9 aa, Homo Sapiens
HAGIVFKSY

SEQ ID NO: 23145 - protein, 9 aa, Homo Sapiens
SLNLSMNPL

SEQ ID NO: 23146 - protein, 9 aa, Homo Sapiens
FNGKDSEDV

SEQ ID NO: 23147 - protein, 9 aa, Homo Sapiens
LKRLHTFGN

SEQ ID NO: 23148 - protein, 9 aa, Homo Sapiens
KLSKEERKH

SEQ ID NO: 23149 - protein, 9 aa, Homo Sapiens
LQEAKLECE

SEQ ID NO: 23150 - protein, 9 aa, Homo Sapiens
RQYVCLHAH

SEQ ID NO: 23151 - protein, 9 aa, Homo Sapiens
PMQNTDCCH

SEQ ID NO: 23152 - protein, 9 aa, Homo Sapiens
NLTSILIQR

SEQ ID NO: 23153 - protein, 9 aa, Homo Sapiens
KPGAEAPVR

SEQ ID NO: 23154 - protein, 9 aa, Homo Sapiens
AKYVEEGEE

SEQ ID NO: 23155 - protein, 9 aa, Homo Sapiens
RSKIFIPNP

SEQ ID NO: 23156 - protein, 9 aa, Homo Sapiens
QLSRPRRVA

SEQ ID NO: 23157 - protein, 9 aa, Homo Sapiens
TYEEVGHDA

SEQ ID NO: 23158 - protein, 9 aa, Homo Sapiens
TESHDLPVH

SEQ ID NO: 23159 - protein, 9 aa, Homo Sapiens
AHLAPDCPA

SEQ ID NO: 23160 - protein, 9 aa, Homo Sapiens
GTTSSNNTM

SEQ ID NO: 23161 - protein, 9 aa, Homo Sapiens
TIHLTAFGR

SEQ ID NO: 23162 - protein, 9 aa, Homo Sapiens
DTCQPGILN

SEQ ID NO: 23163 - protein, 9 aa, Homo Sapiens
YAYKFDFHW

SEQ ID NO: 23164 - protein, 9 aa, Homo Sapiens
LAGLRGVHY

SEQ ID NO: 23165 - protein, 9 aa, Homo Sapiens
GKINRFIIP

SEQ ID NO: 23166 - protein, 9 aa, Homo Sapiens
SSDCTTGSS

SEQ ID NO: 23167 - protein, 9 aa, Homo Sapiens
KRLAAGCFA

SEQ ID NO: 23168 - protein, 9 aa, Homo Sapiens
NPDELSKPN

SEQ ID NO: 23169 - protein, 9 aa, Homo Sapiens
ASDKEEAPL

SEQ ID NO: 23170 - protein, 9 aa, Homo Sapiens
EMSNLSQGD

SEQ ID NO: 23171 - protein, 9 aa, Homo Sapiens
TSGTTSSNN

SEQ ID NO: 23172 - protein, 9 aa, Homo Sapiens
VEEAKYVEE

SEQ ID NO: 23173 - protein, 9 aa, Homo Sapiens
NLGSLSPLG

SEQ ID NO: 23174 - protein, 9 aa, Homo Sapiens
NTHGGYRCA

SEQ ID NO: 23175 - protein, 9 aa, Homo Sapiens
EDAAPTSPS

SEQ ID NO: 23176 - protein, 9 aa, Homo Sapiens
LYARTLRAV

SEQ ID NO: 23177 - protein, 9 aa, Homo Sapiens
PIEPGDKRS

SEQ ID NO: 23178 - protein, 9 aa, Homo Sapiens
ILKPMGLMV

SEQ ID NO: 23179 - protein, 9 aa, Homo Sapiens
AWQHRQYVC

SEQ ID NO: 23180 - protein, 9 aa, Homo Sapiens
SPFELYFNP

SEQ ID NO: 23181 - protein, 9 aa, Homo Sapiens
NSPMARLGV

SEQ ID NO: 23182 - protein, 9 aa, Homo Sapiens
AIDQFVRTE

SEQ ID NO: 23183 - protein, 9 aa, Homo Sapiens
EGKMFMKAL

SEQ ID NO: 23184 - protein, 9 aa, Homo Sapiens
QKLRKRLKA

SEQ ID NO: 23185 - protein, 9 aa, Homo Sapiens
LKEVDLLYV

SEQ ID NO: 23186 - protein, 9 aa, Homo Sapiens
PSYNLVTLL

SEQ ID NO: 23187 - protein, 9 aa, Homo Sapiens
QKSGNQKGE

SEQ ID NO: 23188 - protein, 9 aa, Homo Sapiens
NGESAAEKR

SEQ ID NO: 23189 - protein, 9 aa, Homo Sapiens
DLDYLRTIT

SEQ ID NO: 23190 - protein, 9 aa, Homo Sapiens
CGEPVAKTK

SEQ ID NO: 23191 - protein, 9 aa, Homo Sapiens
TVSLFSFQH

SEQ ID NO: 23192 - protein, 9 aa, Homo Sapiens
TATGTNRGF

SEQ ID NO: 23193 - protein, 9 aa, Homo Sapiens
EPKRATVEG

SEQ ID NO: 23194 - protein, 9 aa, Homo Sapiens
WRQRHGPSY

SEQ ID NO: 23195 - protein, 9 aa, Homo Sapiens
LNFYRALPL

SEQ ID NO: 23196 - protein, 9 aa, Homo Sapiens
FSESPKFHS

SEQ ID NO: 23197 - protein, 9 aa, Homo Sapiens
NVFLAIAVN

SEQ ID NO: 23198 - protein, 9 aa, Homo Sapiens
DRARELQWS

SEQ ID NO: 23199 - protein, 9 aa, Homo Sapiens
LSFGLHRLL

SEQ ID NO: 23200 - protein, 9 aa, Homo Sapiens
IATDNYESE

SEQ ID NO: 23201 - protein, 9 aa, Homo Sapiens
SLPLLFICD

SEQ ID NO: 23202 - protein, 9 aa, Homo Sapiens
ELFSNTPTS

SEQ ID NO: 23203 - protein, 9 aa, Homo Sapiens
KQMGYLTIG

SEQ ID NO: 23204 - protein, 9 aa, Homo Sapiens
QRPLPGYPD

SEQ ID NO: 23205 - protein, 9 aa, Homo Sapiens
YRLESGYEK

SEQ ID NO: 23206 - protein, 9 aa, Homo Sapiens
SAVVDAGSS

SEQ ID NO: 23207 - protein, 9 aa, Homo Sapiens
KKHQLEVDE

SEQ ID NO: 23208 - protein, 9 aa, Homo Sapiens
LLLENPEKI

SEQ ID NO: 23209 - protein, 9 aa, Homo Sapiens
VFLAIAVNN

SEQ ID NO: 23210 - protein, 9 aa, Homo Sapiens
AVPVEKEQV

SEQ ID NO: 23211 - protein, 9 aa, Homo Sapiens
IFEVVWAAI

SEQ ID NO: 23212 - protein, 9 aa, Homo Sapiens
RLLACASAP

SEQ ID NO: 23213 - protein, 9 aa, Homo Sapiens
NENEPCEAD

SEQ ID NO: 23214 - protein, 9 aa, Homo Sapiens
KHRELDRSG

SEQ ID NO: 23215 - protein, 9 aa, Homo Sapiens
SFLCFCRLL

SEQ ID NO: 23216 - protein, 9 aa, Homo Sapiens
HLFNGQAFS

SEQ ID NO: 23217 - protein, 9 aa, Homo Sapiens
YQRLLEYLK

SEQ ID NO: 23218 - protein, 9 aa, Homo Sapiens
VPSFHVDVP

SEQ ID NO: 23219 - protein, 9 aa, Homo Sapiens
EGDDYISHC

SEQ ID NO: 23220 - protein, 9 aa, Homo Sapiens
TKGDSVEKI

SEQ ID NO: 23221 - protein, 9 aa, Homo Sapiens
CASAPLLRV

SEQ ID NO: 23222 - protein, 9 aa, Homo Sapiens
VPLYQSPPV

SEQ ID NO: 23223 - protein, 9 aa, Homo Sapiens
VQPEQVLVI

SEQ ID NO: 23224 - protein, 9 aa, Homo Sapiens
RVRTKFPLG

SEQ ID NO: 23225 - protein, 9 aa, Homo Sapiens
HRGPAGGGE

SEQ ID NO: 23226 - protein, 9 aa, Homo Sapiens
QVLVISLGT

SEQ ID NO: 23227 - protein, 9 aa, Homo Sapiens
RAYARATTI

SEQ ID NO: 23228 - protein, 9 aa, Homo Sapiens
TRGQLKPQE

SEQ ID NO: 23229 - protein, 9 aa, Homo Sapiens
RLAAGCFAG

SEQ ID NO: 23230 - protein, 9 aa, Homo Sapiens
HSQKHSSTS

SEQ ID NO: 23231 - protein, 9 aa, Homo Sapiens
FKKDALRFL

SEQ ID NO: 23232 - protein, 9 aa, Homo Sapiens
DSNYVYLVS

SEQ ID NO: 23233 - protein, 9 aa, Homo Sapiens
SSTPVQNSE

SEQ ID NO: 23234 - protein, 9 aa, Homo Sapiens
FNGQAFSGE

SEQ ID NO: 23235 - protein, 9 aa, Homo Sapiens
SFSGSKDSG

SEQ ID NO: 23236 - protein, 9 aa, Homo Sapiens
GDGGYFHAS

SEQ ID NO: 23237 - protein, 9 aa, Homo Sapiens
PNSMSRVSN

SEQ ID NO: 23238 - protein, 9 aa, Homo Sapiens
AVNNLASGD

SEQ ID NO: 23239 - protein, 9 aa, Homo Sapiens
SKEGKMFMK

SEQ ID NO: 23240 - protein, 9 aa, Homo Sapiens
EIQVVDPLP

SEQ ID NO: 23241 - protein, 9 aa, Homo Sapiens
SDIVNEMSN

SEQ ID NO: 23242 - protein, 9 aa, Homo Sapiens
WAAPPSLSF

SEQ ID NO: 23243 - protein, 9 aa, Homo Sapiens
RSSTPVQNS

SEQ ID NO: 23244 - protein, 9 aa, Homo Sapiens
LYTTSPAGP

SEQ ID NO: 23245 - protein, 9 aa, Homo Sapiens
FIPNPRTLF

SEQ ID NO: 23246 - protein, 9 aa, Homo Sapiens
PSPELFSNT

SEQ ID NO: 23247 - protein, 9 aa, Homo Sapiens
TTLVGNVLI

SEQ ID NO: 23248 - protein, 9 aa, Homo Sapiens
QNSPMARLG

SEQ ID NO: 23249 - protein, 9 aa, Homo Sapiens
LSLPGSDCS

SEQ ID NO: 23250 - protein, 9 aa, Homo Sapiens
NQKLRKRLK

SEQ ID NO: 23251 - protein, 9 aa, Homo Sapiens
RAVDTSEQE

SEQ ID NO: 23252 - protein, 9 aa, Homo Sapiens
VCLGMLCYS

SEQ ID NO: 23253 - protein, 9 aa, Homo Sapiens
YDRVHLRST

SEQ ID NO: 23254 - protein, 9 aa, Homo Sapiens
IHLYFKEEV

SEQ ID NO: 23255 - protein, 9 aa, Homo Sapiens
WRLKLPLIP

SEQ ID NO: 23256 - protein, 9 aa, Homo Sapiens
DKFHIYTIA

SEQ ID NO: 23257 - protein, 9 aa, Homo Sapiens
AVVDAGSSI

SEQ ID NO: 23258 - protein, 9 aa, Homo Sapiens
RWVDHKPAF

SEQ ID NO: 23259 - protein, 9 aa, Homo Sapiens
SLRTEVTSK

SEQ ID NO: 23260 - protein, 9 aa, Homo Sapiens
SPKYVSMCD

SEQ ID NO: 23261 - protein, 9 aa, Homo Sapiens
LKLPLIPLV

SEQ ID NO: 23262 - protein, 9 aa, Homo Sapiens
WDFLCVRLL

SEQ ID NO: 23263 - protein, 9 aa, Homo Sapiens
AVTVQLFQE

SEQ ID NO: 23264 - protein, 9 aa, Homo Sapiens
PSKMTNNTT

SEQ ID NO: 23265 - protein, 9 aa, Homo Sapiens
GKSKAPETP

SEQ ID NO: 23266 - protein, 9 aa, Homo Sapiens
YLVMKYASG

SEQ ID NO: 23267 - protein, 9 aa, Homo Sapiens
DSTSVYNTG

SEQ ID NO: 23268 - protein, 9 aa, Homo Sapiens
TDVSKSSNI

SEQ ID NO: 23269 - protein, 9 aa, Homo Sapiens
APAQIPTVV

SEQ ID NO: 23270 - protein, 9 aa, Homo Sapiens
LPLIPLVPV

SEQ ID NO: 23271 - protein, 9 aa, Homo Sapiens
LEDLKEVDL

SEQ ID NO: 23272 - protein, 9 aa, Homo Sapiens
RQSTTHSGP

SEQ ID NO: 23273 - protein, 9 aa, Homo Sapiens
KVRNPRANF

SEQ ID NO: 23274 - protein, 9 aa, Homo Sapiens
DSGRIYYCK

SEQ ID NO: 23275 - protein, 9 aa, Homo Sapiens
EYKIILVVR

SEQ ID NO: 23276 - protein, 9 aa, Homo Sapiens
EKVEVAFDH

SEQ ID NO: 23277 - protein, 9 aa, Homo Sapiens
EVETYFHQF

SEQ ID NO: 23278 - protein, 9 aa, Homo Sapiens
QMRMVVLPC

SEQ ID NO: 23279 - protein, 9 aa, Homo Sapiens
LRNESLESP

SEQ ID NO: 23280 - protein, 9 aa, Homo Sapiens
DHVCKLFDI

SEQ ID NO: 23281 - protein, 9 aa, Homo Sapiens
SFYIGLGFR

SEQ ID NO: 23282 - protein, 9 aa, Homo Sapiens
CPCPHIRRA

SEQ ID NO: 23283 - protein, 9 aa, Homo Sapiens
HQVIHTETK

SEQ ID NO: 23284 - protein, 9 aa, Homo Sapiens
VTGNMGSNN

SEQ ID NO: 23285 - protein, 9 aa, Homo Sapiens
VSLTLHGLQ

SEQ ID NO: 23286 - protein, 9 aa, Homo Sapiens
QKEVSSFLQ

SEQ ID NO: 23287 - protein, 9 aa, Homo Sapiens
LGSLSPLGI

SEQ ID NO: 23288 - protein, 9 aa, Homo Sapiens
GNRFTCFAI

SEQ ID NO: 23289 - protein, 9 aa, Homo Sapiens
AEAGEIIAG

SEQ ID NO: 23290 - protein, 9 aa, Homo Sapiens
GGYPGTPRN

SEQ ID NO: 23291 - protein, 9 aa, Homo Sapiens
QYRNLNTWI

SEQ ID NO: 23292 - protein, 9 aa, Homo Sapiens
GRQSTTHSG

SEQ ID NO: 23293 - protein, 9 aa, Homo Sapiens
LIDLSSNDI

SEQ ID NO: 23294 - protein, 9 aa, Homo Sapiens
KPMGLMVEA

SEQ ID NO: 23295 - protein, 9 aa, Homo Sapiens
IRAHSQNTV

SEQ ID NO: 23296 - protein, 9 aa, Homo Sapiens
ESHVTQDIA

SEQ ID NO: 23297 - protein, 9 aa, Homo Sapiens
ESDFAKQFL

SEQ ID NO: 23298 - protein, 9 aa, Homo Sapiens
CCPLWSGDR

SEQ ID NO: 23299 - protein, 9 aa, Homo Sapiens
VLQQLKGLQ

SEQ ID NO: 23300 - protein, 9 aa, Homo Sapiens
DSVTPIDVL

SEQ ID NO: 23301 - protein, 9 aa, Homo Sapiens
LQSKVRNPR

SEQ ID NO: 23302 - protein, 9 aa, Homo Sapiens
VGYNGAILA

SEQ ID NO: 23303 - protein, 9 aa, Homo Sapiens
TSSPTFPPV

SEQ ID NO: 23304 - protein, 9 aa, Homo Sapiens
LLVTLADIY

SEQ ID NO: 23305 - protein, 9 aa, Homo Sapiens
FLAIAVNNL

SEQ ID NO: 23306 - protein, 9 aa, Homo Sapiens
RALDSPRSL

SEQ ID NO: 23307 - protein, 9 aa, Homo Sapiens
NPIIYCLHN

SEQ ID NO: 23308 - protein, 9 aa, Homo Sapiens
GAITIEPKR

SEQ ID NO: 23309 - protein, 9 aa, Homo Sapiens
NGTIFTMSP

SEQ ID NO: 23310 - protein, 9 aa, Homo Sapiens
STVLANPPS

SEQ ID NO: 23311 - protein, 9 aa, Homo Sapiens
CNDTFQVHI

SEQ ID NO: 23312 - protein, 9 aa, Homo Sapiens
TASQMRMVV

SEQ ID NO: 23313 - protein, 9 aa, Homo Sapiens
FVFILGRAY

SEQ ID NO: 23314 - protein, 9 aa, Homo Sapiens
TATDVSKSS

SEQ ID NO: 23315 - protein, 9 aa, Homo Sapiens
KQLENDNKN

SEQ ID NO: 23316 - protein, 9 aa, Homo Sapiens
VESDFAKQF

SEQ ID NO: 23317 - protein, 9 aa, Homo Sapiens
SQLTSLLYS

SEQ ID NO: 23318 - protein, 9 aa, Homo Sapiens
ISHKATACV

SEQ ID NO: 23319 - protein, 9 aa, Homo Sapiens
STSVYNTGE

SEQ ID NO: 23320 - protein, 9 aa, Homo Sapiens
GTPRNRMVR

SEQ ID NO: 23321 - protein, 9 aa, Homo Sapiens
LSIARDTLT

SEQ ID NO: 23322 - protein, 9 aa, Homo Sapiens
TKFPLGRYG

SEQ ID NO: 23323 - protein, 9 aa, Homo Sapiens
TMLPGEHQH

SEQ ID NO: 23324 - protein, 9 aa, Homo Sapiens
EALQVAEHY

SEQ ID NO: 23325 - protein, 9 aa, Homo Sapiens
NINRLSIPS

SEQ ID NO: 23326 - protein, 9 aa, Homo Sapiens
KSGNQKGEL

SEQ ID NO: 23327 - protein, 9 aa, Homo Sapiens
MVQSTVLAN

SEQ ID NO: 23328 - protein, 9 aa, Homo Sapiens
MIKEHMQML

SEQ ID NO: 23329 - protein, 9 aa, Homo Sapiens
YRSMVPWKI

SEQ ID NO: 23330 - protein, 9 aa, Homo Sapiens
MRMVVLPCL

SEQ ID NO: 23331 - protein, 9 aa, Homo Sapiens
AREVAASCW

SEQ ID NO: 23332 - protein, 9 aa, Homo Sapiens
PECGTYSLC

SEQ ID NO: 23333 - protein, 9 aa, Homo Sapiens
LREIDPDQL

SEQ ID NO: 23334 - protein, 9 aa, Homo Sapiens
VQESLIWVR

SEQ ID NO: 23335 - protein, 9 aa, Homo Sapiens
FGPPLDMQI

SEQ ID NO: 23336 - protein, 9 aa, Homo Sapiens
ASTVRSPCT

SEQ ID NO: 23337 - protein, 9 aa, Homo Sapiens
LKSDSEEKP

SEQ ID NO: 23338 - protein, 9 aa, Homo Sapiens
IKGEELVQQ

SEQ ID NO: 23339 - protein, 9 aa, Homo Sapiens
LSPLGIRLS

SEQ ID NO: 23340 - protein, 9 aa, Homo Sapiens
FYAPDPAQL

SEQ ID NO: 23341 - protein, 9 aa, Homo Sapiens
DSQGSEHLF

SEQ ID NO: 23342 - protein, 9 aa, Homo Sapiens
RDHVCKLFD

SEQ ID NO: 23343 - protein, 9 aa, Homo Sapiens
GNKDQSVKF

SEQ ID NO: 23344 - protein, 9 aa, Homo Sapiens
AYPITLFVE

SEQ ID NO: 23345 - protein, 9 aa, Homo Sapiens
HYEWYLKIQ

SEQ ID NO: 23346 - protein, 9 aa, Homo Sapiens
ELLQSDKNG

SEQ ID NO: 23347 - protein, 9 aa, Homo Sapiens
VDHKPAFNM

SEQ ID NO: 23348 - protein, 9 aa, Homo Sapiens
KLVLPDEAI

SEQ ID NO: 23349 - protein, 9 aa, Homo Sapiens
TVESTVVRK

SEQ ID NO: 23350 - protein, 9 aa, Homo Sapiens
KIEQQSDCK

SEQ ID NO: 23351 - protein, 9 aa, Homo Sapiens
LSTAEAAVY

SEQ ID NO: 23352 - protein, 9 aa, Homo Sapiens
PLPGFNDCG

SEQ ID NO: 23353 - protein, 9 aa, Homo Sapiens
VGSFIKSQN

SEQ ID NO: 23354 - protein, 9 aa, Homo Sapiens
LVLLNIFTN

SEQ ID NO: 23355 - protein, 9 aa, Homo Sapiens
EGEPGPQGE

SEQ ID NO: 23356 - protein, 9 aa, Homo Sapiens
FAKQFLQAA

SEQ ID NO: 23357 - protein, 9 aa, Homo Sapiens
ACFIKRRKH

SEQ ID NO: 23358 - protein, 9 aa, Homo Sapiens
LQDAGWKTK

SEQ ID NO: 23359 - protein, 9 aa, Homo Sapiens
FLCVRLLLL

SEQ ID NO: 23360 - protein, 9 aa, Homo Sapiens
RRGGRGPHR

SEQ ID NO: 23361 - protein, 9 aa, Homo Sapiens
LSRPRRVAS

SEQ ID NO: 23362 - protein, 9 aa, Homo Sapiens
LSMSINTFP

SEQ ID NO: 23363 - protein, 9 aa, Homo Sapiens
FDFHWIAQA

SEQ ID NO: 23364 - protein, 9 aa, Homo Sapiens
EDPTLYIVQ

SEQ ID NO: 23365 - protein, 9 aa, Homo Sapiens
FKEEVKQEE

SEQ ID NO: 23366 - protein, 9 aa, Homo Sapiens
RKTHRSTQS

SEQ ID NO: 23367 - protein, 9 aa, Homo Sapiens
MLPGEHQHV

SEQ ID NO: 23368 - protein, 9 aa, Homo Sapiens
LELLSPFEL

SEQ ID NO: 23369 - protein, 9 aa, Homo Sapiens
ECEQEQRRH

SEQ ID NO: 23370 - protein, 9 aa, Homo Sapiens
FHIYTIAFG

SEQ ID NO: 23371 - protein, 9 aa, Homo Sapiens
WGKQDGGKG

SEQ ID NO: 23372 - protein, 9 aa, Homo Sapiens
LAENHAHYE

SEQ ID NO: 23373 - protein, 9 aa, Homo Sapiens
SSAAAAAAT

SEQ ID NO: 23374 - protein, 9 aa, Homo Sapiens
SVKFRKLMG

SEQ ID NO: 23375 - protein, 9 aa, Homo Sapiens
SVLQQLKGL

SEQ ID NO: 23376 - protein, 9 aa, Homo Sapiens
AWDFLCVRL

SEQ ID NO: 23377 - protein, 9 aa, Homo Sapiens
IREDPDSVT

SEQ ID NO: 23378 - protein, 9 aa, Homo Sapiens
YRFFLAVHG

SEQ ID NO: 23379 - protein, 9 aa, Homo Sapiens
LVQKKDTAH

SEQ ID NO: 23380 - protein, 9 aa, Homo Sapiens
EVVQVSAGD

SEQ ID NO: 23381 - protein, 9 aa, Homo Sapiens
KNVSLKCSI

SEQ ID NO: 23382 - protein, 9 aa, Homo Sapiens
SMVPWKIET

SEQ ID NO: 23383 - protein, 9 aa, Homo Sapiens
RSPCTPPSW

SEQ ID NO: 23384 - protein, 9 aa, Homo Sapiens
AGAVDHVRL

SEQ ID NO: 23385 - protein, 9 aa, Homo Sapiens
ASHRANWMK

SEQ ID NO: 23386 - protein, 9 aa, Homo Sapiens
NIIQTAIDQ

SEQ ID NO: 23387 - protein, 9 aa, Homo Sapiens
AAGKEAPRG

SEQ ID NO: 23388 - protein, 9 aa, Homo Sapiens
ILGRAYARA

SEQ ID NO: 23389 - protein, 9 aa, Homo Sapiens
TRLHDFAEG

SEQ ID NO: 23390 - protein, 9 aa, Homo Sapiens
PASMPKNKE

SEQ ID NO: 23391 - protein, 9 aa, Homo Sapiens
CLHNQEVKR

SEQ ID NO: 23392 - protein, 9 aa, Homo Sapiens
ENIENGNVT

SEQ ID NO: 23393 - protein, 9 aa, Homo Sapiens
SNGESAAEK

SEQ ID NO: 23394 - protein, 9 aa, Homo Sapiens
KKGPTASGN

SEQ ID NO: 23395 - protein, 9 aa, Homo Sapiens
ASQMLNGFP

SEQ ID NO: 23396 - protein, 9 aa, Homo Sapiens
YRALPLFVI

SEQ ID NO: 23397 - protein, 9 aa, Homo Sapiens
NAEQPRGPS

SEQ ID NO: 23398 - protein, 9 aa, Homo Sapiens
DVWSLEITC

SEQ ID NO: 23399 - protein, 9 aa, Homo Sapiens
YSPEEKSEP

SEQ ID NO: 23400 - protein, 9 aa, Homo Sapiens
TSNFRTIDL

SEQ ID NO: 23401 - protein, 9 aa, Homo Sapiens
TLAEDLNLL

SEQ ID NO: 23402 - protein, 9 aa, Homo Sapiens
PIINHITLL

SEQ ID NO: 23403 - protein, 9 aa, Homo Sapiens
YATEGRYSL

SEQ ID NO: 23404 - protein, 9 aa, Homo Sapiens
ISINLTGPL

SEQ ID NO: 23405 - protein, 9 aa, Homo Sapiens
GTAWLEWWH

SEQ ID NO: 23406 - protein, 9 aa, Homo Sapiens
IQEKRHWKH

SEQ ID NO: 23407 - protein, 9 aa, Homo Sapiens
NNLASGDAG

SEQ ID NO: 23408 - protein, 9 aa, Homo Sapiens
KIETTEKKT

SEQ ID NO: 23409 - protein, 9 aa, Homo Sapiens
RTDLSGYLP

SEQ ID NO: 23410 - protein, 9 aa, Homo Sapiens
DDAVSKMKM

SEQ ID NO: 23411 - protein, 9 aa, Homo Sapiens
CFCRLLSTA

SEQ ID NO: 23412 - protein, 9 aa, Homo Sapiens
RKASDKEEA

SEQ ID NO: 23413 - protein, 9 aa, Homo Sapiens
PRKASDKEE

SEQ ID NO: 23414 - protein, 9 aa, Homo Sapiens
VNHIDTEKL

SEQ ID NO: 23415 - protein, 9 aa, Homo Sapiens
NSEPFDPFD

SEQ ID NO: 23416 - protein, 9 aa, Homo Sapiens
AYKFDFHWI

SEQ ID NO: 23417 - protein, 9 aa, Homo Sapiens
YSVSGNPYV

SEQ ID NO: 23418 - protein, 9 aa, Homo Sapiens
NKMQRLINE

SEQ ID NO: 23419 - protein, 9 aa, Homo Sapiens
GSSQTDFLT

SEQ ID NO: 23420 - protein, 9 aa, Homo Sapiens
LAKLHWEDG

SEQ ID NO: 23421 - protein, 9 aa, Homo Sapiens
LRARQQCYR

SEQ ID NO: 23422 - protein, 9 aa, Homo Sapiens
SPRSLRTEV

SEQ ID NO: 23423 - protein, 9 aa, Homo Sapiens
RNPRANFDQ

SEQ ID NO: 23424 - protein, 9 aa, Homo Sapiens
TVPECATPA

SEQ ID NO: 23425 - protein, 9 aa, Homo Sapiens
LSGIIEADQ

SEQ ID NO: 23426 - protein, 9 aa, Homo Sapiens
SLLVTLADI

SEQ ID NO: 23427 - protein, 9 aa, Homo Sapiens
LPVHPRAAG

SEQ ID NO: 23428 - protein, 9 aa, Homo Sapiens
KMKKTESGM

SEQ ID NO: 23429 - protein, 9 aa, Homo Sapiens
TGNYASYRS

SEQ ID NO: 23430 - protein, 9 aa, Homo Sapiens
FTPWHSPTE

SEQ ID NO: 23431 - protein, 9 aa, Homo Sapiens
AGEKLEKEA

SEQ ID NO: 23432 - protein, 9 aa, Homo Sapiens
DSPRSLRTE

SEQ ID NO: 23433 - protein, 9 aa, Homo Sapiens
MSHKKSLFD

SEQ ID NO: 23434 - protein, 9 aa, Homo Sapiens
KELSQTLDF

SEQ ID NO: 23435 - protein, 9 aa, Homo Sapiens
LKTVSAVVD

SEQ ID NO: 23436 - protein, 9 aa, Homo Sapiens
WIAVLALCS

SEQ ID NO: 23437 - protein, 9 aa, Homo Sapiens
EFSDLKSDS

SEQ ID NO: 23438 - protein, 9 aa, Homo Sapiens
HYFYEIITE

SEQ ID NO: 23439 - protein, 9 aa, Homo Sapiens
GPSNGESAA

SEQ ID NO: 23440 - protein, 9 aa, Homo Sapiens
GSKAPLCPG

SEQ ID NO: 23441 - protein, 9 aa, Homo Sapiens
DIEGKINRF

SEQ ID NO: 23442 - protein, 9 aa, Homo Sapiens
LKVKRSKLA

SEQ ID NO: 23443 - protein, 9 aa, Homo Sapiens
ECKIRKLVC

SEQ ID NO: 23444 - protein, 9 aa, Homo Sapiens
RLSIPSASG

SEQ ID NO: 23445 - protein, 9 aa, Homo Sapiens
NKPKQEPEV

SEQ ID NO: 23446 - protein, 9 aa, Homo Sapiens
PVTPKAWLQ

SEQ ID NO: 23447 - protein, 9 aa, Homo Sapiens
GKSYHTGCF

SEQ ID NO: 23448 - protein, 9 aa, Homo Sapiens
VVTKPASMP

SEQ ID NO: 23449 - protein, 9 aa, Homo Sapiens
SGATEKIKK

SEQ ID NO: 23450 - protein, 9 aa, Homo Sapiens
DSCSQLTSL

SEQ ID NO: 23451 - protein, 9 aa, Homo Sapiens
GSSRTFPEH

SEQ ID NO: 23452 - protein, 9 aa, Homo Sapiens
SRSYSEVLR

SEQ ID NO: 23453 - protein, 9 aa, Homo Sapiens
MSDLLSEAK

SEQ ID NO: 23454 - protein, 9 aa, Homo Sapiens
SAPMQNTDC

SEQ ID NO: 23455 - protein, 9 aa, Homo Sapiens
DLDACALMR

SEQ ID NO: 23456 - protein, 9 aa, Homo Sapiens
ARELQWSHL

SEQ ID NO: 23457 - protein, 9 aa, Homo Sapiens
LQQNLFGRK

SEQ ID NO: 23458 - protein, 9 aa, Homo Sapiens
PPLDMQILH

SEQ ID NO: 23459 - protein, 9 aa, Homo Sapiens
PRRVASDGG

SEQ ID NO: 23460 - protein, 9 aa, Homo Sapiens
LVTFFRTDL

SEQ ID NO: 23461 - protein, 9 aa, Homo Sapiens
ERLEKMKKQ

SEQ ID NO: 23462 - protein, 9 aa, Homo Sapiens
AGPEDPSLL

SEQ ID NO: 23463 - protein, 9 aa, Homo Sapiens
RSQEAAVTV

SEQ ID NO: 23464 - protein, 9 aa, Homo Sapiens
FSDLKSDSE

SEQ ID NO: 23465 - protein, 9 aa, Homo Sapiens
PSVSTAAQP

SEQ ID NO: 23466 - protein, 9 aa, Homo Sapiens
LTRLHDFAE

SEQ ID NO: 23467 - protein, 9 aa, Homo Sapiens
YYFECNDTF

SEQ ID NO: 23468 - protein, 9 aa, Homo Sapiens
LQAGAVDHV

SEQ ID NO: 23469 - protein, 9 aa, Homo Sapiens
DELSKPNMI

SEQ ID NO: 23470 - protein, 9 aa, Homo Sapiens
PADRARELQ

SEQ ID NO: 23471 - protein, 9 aa, Homo Sapiens
LVTATGTNR

SEQ ID NO: 23472 - protein, 9 aa, Homo Sapiens
ISCHVRNGT

SEQ ID NO: 23473 - protein, 9 aa, Homo Sapiens
EKMKKQYRN

SEQ ID NO: 23474 - protein, 9 aa, Homo Sapiens
QPTAAGKEA

SEQ ID NO: 23475 - protein, 9 aa, Homo Sapiens
KYVEEGEEE

SEQ ID NO: 23476 - protein, 9 aa, Homo Sapiens
NLQMLEAQG

SEQ ID NO: 23477 - protein, 9 aa, Homo Sapiens
RERLGRFLS

SEQ ID NO: 23478 - protein, 9 aa, Homo Sapiens
GPPWANCGS

SEQ ID NO: 23479 - protein, 9 aa, Homo Sapiens
GHYPNTIAQ

SEQ ID NO: 23480 - protein, 9 aa, Homo Sapiens
QLELLSPFE

SEQ ID NO: 23481 - protein, 9 aa, Homo Sapiens
VDPLPQVQA

SEQ ID NO: 23482 - protein, 9 aa, Homo Sapiens
DSVEKIQGT

SEQ ID NO: 23483 - protein, 9 aa, Homo Sapiens
QKELKEIRA

SEQ ID NO: 23484 - protein, 9 aa, Homo Sapiens
GVPYKQWKI

SEQ ID NO: 23485 - protein, 9 aa, Homo Sapiens
TVLETCIKS

SEQ ID NO: 23486 - protein, 9 aa, Homo Sapiens
IQLSIEQRV

SEQ ID NO: 23487 - protein, 9 aa, Homo Sapiens
PSNGESAAE

SEQ ID NO: 23488 - protein, 9 aa, Homo Sapiens
QSKISLNNL

SEQ ID NO: 23489 - protein, 9 aa, Homo Sapiens
DALRFLSPF

SEQ ID NO: 23490 - protein, 9 aa, Homo Sapiens
QMVISINLT

SEQ ID NO: 23491 - protein, 9 aa, Homo Sapiens
LWSGDRSPC

SEQ ID NO: 23492 - protein, 9 aa, Homo Sapiens
DAINPLLTD

SEQ ID NO: 23493 - protein, 9 aa, Homo Sapiens
CKIRKLVCE

SEQ ID NO: 23494 - protein, 9 aa, Homo Sapiens
KNALDLKFN

SEQ ID NO: 23495 - protein, 9 aa, Homo Sapiens
SQMRMVVLP

SEQ ID NO: 23496 - protein, 9 aa, Homo Sapiens
QTLDFKKDT

SEQ ID NO: 23497 - protein, 9 aa, Homo Sapiens
VSKDARQQQ

SEQ ID NO: 23498 - protein, 9 aa, Homo Sapiens
EDLKEVDLL

SEQ ID NO: 23499 - protein, 9 aa, Homo Sapiens
RSAQRSKSK

SEQ ID NO: 23500 - protein, 9 aa, Homo Sapiens
PDSVTPIDV

SEQ ID NO: 23501 - protein, 9 aa, Homo Sapiens
AHSQNTVKQ

SEQ ID NO: 23502 - protein, 9 aa, Homo Sapiens
SSSTSVHPS

SEQ ID NO: 23503 - protein, 9 aa, Homo Sapiens
QIPTVVPTP

SEQ ID NO: 23504 - protein, 9 aa, Homo Sapiens
GLGLSNEIE

SEQ ID NO: 23505 - protein, 9 aa, Homo Sapiens
IKLLLENPE

SEQ ID NO: 23506 - protein, 9 aa, Homo Sapiens
IGKFCLQYG

SEQ ID NO: 23507 - protein, 9 aa, Homo Sapiens
AKTHRRHIN

SEQ ID NO: 23508 - protein, 9 aa, Homo Sapiens
MKGDFSVCR

SEQ ID NO: 23509 - protein, 9 aa, Homo Sapiens
FNENPVFAG

SEQ ID NO: 23510 - protein, 9 aa, Homo Sapiens
DSHLHTPMC

SEQ ID NO: 23511 - protein, 9 aa, Homo Sapiens
EEKREHASR

SEQ ID NO: 23512 - protein, 9 aa, Homo Sapiens
NLVTFFRTD

SEQ ID NO: 23513 - protein, 9 aa, Homo Sapiens
CSQLTSLLY

SEQ ID NO: 23514 - protein, 9 aa, Homo Sapiens
LGGGDELEM

SEQ ID NO: 23515 - protein, 9 aa, Homo Sapiens
QEIMKQMGY

SEQ ID NO: 23516 - protein, 9 aa, Homo Sapiens
PYLPPTVSL

SEQ ID NO: 23517 - protein, 9 aa, Homo Sapiens
APKRPSDSP

SEQ ID NO: 23518 - protein, 9 aa, Homo Sapiens
DDYVQLAFN

SEQ ID NO: 23519 - protein, 9 aa, Homo Sapiens
LAFMELDAG

SEQ ID NO: 23520 - protein, 9 aa, Homo Sapiens
EQLHHLMCT

SEQ ID NO: 23521 - protein, 9 aa, Homo Sapiens
RSPSSKDDR

SEQ ID NO: 23522 - protein, 9 aa, Homo Sapiens
GGDVSLTLH

SEQ ID NO: 23523 - protein, 9 aa, Homo Sapiens
DGLQAGAVD

SEQ ID NO: 23524 - protein, 9 aa, Homo Sapiens
KRKTHRSTQ

SEQ ID NO: 23525 - protein, 9 aa, Homo Sapiens
HQELFNENP

SEQ ID NO: 23526 - protein, 9 aa, Homo Sapiens
FWGLVFYSG

SEQ ID NO: 23527 - protein, 9 aa, Homo Sapiens
MASNAAYPV

SEQ ID NO: 23528 - protein, 9 aa, Homo Sapiens
KVKRSKLAL

SEQ ID NO: 23529 - protein, 9 aa, Homo Sapiens
PVYIYSPKY

SEQ ID NO: 23530 - protein, 9 aa, Homo Sapiens
FQEADSWVD

SEQ ID NO: 23531 - protein, 9 aa, Homo Sapiens
SRHRFRVAD

SEQ ID NO: 23532 - protein, 9 aa, Homo Sapiens
PDIPESSRQ

SEQ ID NO: 23533 - protein, 9 aa, Homo Sapiens
RFYLPVTPK

SEQ ID NO: 23534 - protein, 9 aa, Homo Sapiens
AAAGPKGAP

SEQ ID NO: 23535 - protein, 9 aa, Homo Sapiens
DGTFTVSAQ

SEQ ID NO: 23536 - protein, 9 aa, Homo Sapiens
LPPTVSLFS

SEQ ID NO: 23537 - protein, 9 aa, Homo Sapiens
TPAVELLQT

SEQ ID NO: 23538 - protein, 9 aa, Homo Sapiens
HSQNTVKQS

SEQ ID NO: 23539 - protein, 9 aa, Homo Sapiens
PPMVQSTVL

SEQ ID NO: 23540 - protein, 9 aa, Homo Sapiens
MVPWKIETT

SEQ ID NO: 23541 - protein, 9 aa, Homo Sapiens
KGRNAATAE

SEQ ID NO: 23542 - protein, 9 aa, Homo Sapiens
PSPHSQKHS

SEQ ID NO: 23543 - protein, 9 aa, Homo Sapiens
RRWNYPIPV

SEQ ID NO: 23544 - protein, 9 aa, Homo Sapiens
TMMLARVCL

SEQ ID NO: 23545 - protein, 9 aa, Homo Sapiens
SDPGFAESW

SEQ ID NO: 23546 - protein, 9 aa, Homo Sapiens
NENQGRCYN

SEQ ID NO: 23547 - protein, 9 aa, Homo Sapiens
ILTTKCFQV

SEQ ID NO: 23548 - protein, 9 aa, Homo Sapiens
LAEDLNLLI

SEQ ID NO: 23549 - protein, 9 aa, Homo Sapiens
RWNYPIPVC

SEQ ID NO: 23550 - protein, 9 aa, Homo Sapiens
SYSEVLRNE

SEQ ID NO: 23551 - protein, 9 aa, Homo Sapiens
ATASQMRMV

SEQ ID NO: 23552 - protein, 9 aa, Homo Sapiens
TRFNLDSHC

SEQ ID NO: 23553 - protein, 9 aa, Homo Sapiens
VFLRRHMPP

SEQ ID NO: 23554 - protein, 9 aa, Homo Sapiens
RHWKHYIYL

SEQ ID NO: 23555 - protein, 9 aa, Homo Sapiens
VLLSMSINT

SEQ ID NO: 23556 - protein, 9 aa, Homo Sapiens
QQMLKEVSK

SEQ ID NO: 23557 - protein, 9 aa, Homo Sapiens
ALRFLSPFW

SEQ ID NO: 23558 - protein, 9 aa, Homo Sapiens
YFECNDTFQ

SEQ ID NO: 23559 - protein, 9 aa, Homo Sapiens
ISTITEGTL

SEQ ID NO: 23560 - protein, 9 aa, Homo Sapiens
LNHVRHVIQ

SEQ ID NO: 23561 - protein, 9 aa, Homo Sapiens
NVSLKCSIE

SEQ ID NO: 23562 - protein, 9 aa, Homo Sapiens
VESTVVRKN

SEQ ID NO: 23563 - protein, 9 aa, Homo Sapiens
PPWANCGST

SEQ ID NO: 23564 - protein, 9 aa, Homo Sapiens
EIVMVHKHR

SEQ ID NO: 23565 - protein, 9 aa, Homo Sapiens
MLNGFPRDR

SEQ ID NO: 23566 - protein, 9 aa, Homo Sapiens
CSETPRETY

SEQ ID NO: 23567 - protein, 9 aa, Homo Sapiens
QAPEQPGEE

SEQ ID NO: 23568 - protein, 9 aa, Homo Sapiens
ELVEPVKKH

SEQ ID NO: 23569 - protein, 9 aa, Homo Sapiens
ACALMRGHR

SEQ ID NO: 23570 - protein, 9 aa, Homo Sapiens
DGRRYPGTP

SEQ ID NO: 23571 - protein, 9 aa, Homo Sapiens
KPAVHTKVV

SEQ ID NO: 23572 - protein, 9 aa, Homo Sapiens
PGFYLVLLN

SEQ ID NO: 23573 - protein, 9 aa, Homo Sapiens
RLAFMELDA

SEQ ID NO: 23574 - protein, 9 aa, Homo Sapiens
FELYFNPHL

SEQ ID NO: 23575 - protein, 9 aa, Homo Sapiens
VCAFPGRDR

SEQ ID NO: 23576 - protein, 9 aa, Homo Sapiens
NFLAKEMSK

SEQ ID NO: 23577 - protein, 9 aa, Homo Sapiens
RRYPGTPAV

SEQ ID NO: 23578 - protein, 9 aa, Homo Sapiens
SSKDDRDER

SEQ ID NO: 23579 - protein, 9 aa, Homo Sapiens
TLEDLKEVD

SEQ ID NO: 23580 - protein, 9 aa, Homo Sapiens
KDDRDERES

SEQ ID NO: 23581 - protein, 9 aa, Homo Sapiens
YHTGCFRCI

SEQ ID NO: 23582 - protein, 9 aa, Homo Sapiens
TQATIHLTA

SEQ ID NO: 23583 - protein, 9 aa, Homo Sapiens
DHDFVVIYG

SEQ ID NO: 23584 - protein, 9 aa, Homo Sapiens
VPECATPAA

SEQ ID NO: 23585 - protein, 9 aa, Homo Sapiens
LSSTRGQLK

SEQ ID NO: 23586 - protein, 9 aa, Homo Sapiens
GRGPHRGPA

SEQ ID NO: 23587 - protein, 9 aa, Homo Sapiens
MVHKHRELD

SEQ ID NO: 23588 - protein, 9 aa, Homo Sapiens
LSRERALNY

SEQ ID NO: 23589 - protein, 9 aa, Homo Sapiens
MGYLTIGGQ

SEQ ID NO: 23590 - protein, 9 aa, Homo Sapiens
NWQKEVSSF

SEQ ID NO: 23591 - protein, 9 aa, Homo Sapiens
EKPYACKTC

SEQ ID NO: 23592 - protein, 9 aa, Homo Sapiens
TEKIKKGLS

SEQ ID NO: 23593 - protein, 9 aa, Homo Sapiens
GPSYNLVTL

SEQ ID NO: 23594 - protein, 9 aa, Homo Sapiens
DMLFKVVRY

SEQ ID NO: 23595 - protein, 9 aa, Homo Sapiens
SNFSVQQVE

SEQ ID NO: 23596 - protein, 9 aa, Homo Sapiens
AVITDHVVV

SEQ ID NO: 23597 - protein, 9 aa, Homo Sapiens
LQKLTSNFR

SEQ ID NO: 23598 - protein, 9 aa, Homo Sapiens
PCNNKGAHL

SEQ ID NO: 23599 - protein, 9 aa, Homo Sapiens
LGLPDAGKA

SEQ ID NO: 23600 - protein, 9 aa, Homo Sapiens
HLYFKEEVK

SEQ ID NO: 23601 - protein, 9 aa, Homo Sapiens
ADQEGAMFV

SEQ ID NO: 23602 - protein, 9 aa, Homo Sapiens
MGSNNKVGD

SEQ ID NO: 23603 - protein, 9 aa, Homo Sapiens
KNGLDMLFK

SEQ ID NO: 23604 - protein, 9 aa, Homo Sapiens
ENINRLSIP

SEQ ID NO: 23605 - protein, 9 aa, Homo Sapiens
VHPRAAGAS

SEQ ID NO: 23606 - protein, 9 aa, Homo Sapiens
RANWMKAVQ

SEQ ID NO: 23607 - protein, 9 aa, Homo Sapiens
VVDAGSSIN

SEQ ID NO: 23608 - protein, 9 aa, Homo Sapiens
VPEVKEVVS

SEQ ID NO: 23609 - protein, 9 aa, Homo Sapiens
EGKINRFII

SEQ ID NO: 23610 - protein, 9 aa, Homo Sapiens
ENYRLESGY

SEQ ID NO: 23611 - protein, 9 aa, Homo Sapiens
RNYLLESRH

SEQ ID NO: 23612 - protein, 9 aa, Homo Sapiens
AYRQEAKTH

SEQ ID NO: 23613 - protein, 9 aa, Homo Sapiens
RGQLKPQEL

SEQ ID NO: 23614 - protein, 9 aa, Homo Sapiens
VSTAAQPNW

SEQ ID NO: 23615 - protein, 9 aa, Homo Sapiens
QDGYACNEN

SEQ ID NO: 23616 - protein, 9 aa, Homo Sapiens
SRKKMKKTE

SEQ ID NO: 23617 - protein, 9 aa, Homo Sapiens
GNQKGELKV

SEQ ID NO: 23618 - protein, 9 aa, Homo Sapiens
VRHVIQHDG

SEQ ID NO: 23619 - protein, 9 aa, Homo Sapiens
AVSNFSVQQ

SEQ ID NO: 23620 - protein, 9 aa, Homo Sapiens
TNNTTSKEV

SEQ ID NO: 23621 - protein, 9 aa, Homo Sapiens
PTASGNLIP

SEQ ID NO: 23622 - protein, 9 aa, Homo Sapiens
NDTFQVHIQ

SEQ ID NO: 23623 - protein, 9 aa, Homo Sapiens
PEQVLVISL

SEQ ID NO: 23624 - protein, 9 aa, Homo Sapiens
NSSTLKKRK

SEQ ID NO: 23625 - protein, 9 aa, Homo Sapiens
TIAQKHGFR

SEQ ID NO: 23626 - protein, 9 aa, Homo Sapiens
KQWKILNEI

SEQ ID NO: 23627 - protein, 9 aa, Homo Sapiens
PGADQEGAM

SEQ ID NO: 23628 - protein, 9 aa, Homo Sapiens
IEGKINRFI

SEQ ID NO: 23629 - protein, 9 aa, Homo Sapiens
IPEYSPEEK

SEQ ID NO: 23630 - protein, 9 aa, Homo Sapiens
MLEAQGSMK

SEQ ID NO: 23631 - protein, 9 aa, Homo Sapiens
LKAYVLLSS

SEQ ID NO: 23632 - protein, 9 aa, Homo Sapiens
SLPSKMTNN

SEQ ID NO: 23633 - protein, 9 aa, Homo Sapiens
KEGEPGPQG

SEQ ID NO: 23634 - protein, 9 aa, Homo Sapiens
LDSHCSTEL

SEQ ID NO: 23635 - protein, 9 aa, Homo Sapiens
NYVYLVSEM

SEQ ID NO: 23636 - protein, 9 aa, Homo Sapiens
LGSSQTDFL

SEQ ID NO: 23637 - protein, 9 aa, Homo Sapiens
CENTHGGYR

SEQ ID NO: 23638 - protein, 9 aa, Homo Sapiens
SLSGIIEAD

SEQ ID NO: 23639 - protein, 9 aa, Homo Sapiens
PKYVSMCDS

SEQ ID NO: 23640 - protein, 9 aa, Homo Sapiens
PGWLVTLSY

SEQ ID NO: 23641 - protein, 9 aa, Homo Sapiens
NFSVQQVEK

SEQ ID NO: 23642 - protein, 9 aa, Homo Sapiens
EFLAKLHWE

SEQ ID NO: 23643 - protein, 9 aa, Homo Sapiens
GGYFHASSY

SEQ ID NO: 23644 - protein, 9 aa, Homo Sapiens
TIEPKRATV

SEQ ID NO: 23645 - protein, 9 aa, Homo Sapiens
GEVVPAFLV

SEQ ID NO: 23646 - protein, 9 aa, Homo Sapiens
KRRGGRGPH

SEQ ID NO: 23647 - protein, 9 aa, Homo Sapiens
RNGTYLQRV

SEQ ID NO: 23648 - protein, 9 aa, Homo Sapiens
RDLDKVKSS

SEQ ID NO: 23649 - protein, 9 aa, Homo Sapiens
GGGDELEMC

SEQ ID NO: 23650 - protein, 9 aa, Homo Sapiens
GSEHLFNGQ

SEQ ID NO: 23651 - protein, 9 aa, Homo Sapiens
DKNGIPSSP

SEQ ID NO: 23652 - protein, 9 aa, Homo Sapiens
TITHIVFVD

SEQ ID NO: 23653 - protein, 9 aa, Homo Sapiens
PKMPKFILY

SEQ ID NO: 23654 - protein, 9 aa, Homo Sapiens
HYDRVHLRS

SEQ ID NO: 23655 - protein, 9 aa, Homo Sapiens
NFRTIDLSN

SEQ ID NO: 23656 - protein, 9 aa, Homo Sapiens
LLVVLLSMS

SEQ ID NO: 23657 - protein, 9 aa, Homo Sapiens
TFNPDTAHK

SEQ ID NO: 23658 - protein, 9 aa, Homo Sapiens
LIITPTDTH

SEQ ID NO: 23659 - protein, 9 aa, Homo Sapiens
QLLESVLQQ

SEQ ID NO: 23660 - protein, 9 aa, Homo Sapiens
LRARNDLMS

SEQ ID NO: 23661 - protein, 9 aa, Homo Sapiens
YQSPPVRYL

SEQ ID NO: 23662 - protein, 9 aa, Homo Sapiens
GLVFYSGKP

SEQ ID NO: 23663 - protein, 9 aa, Homo Sapiens
VYQHVLDKF

SEQ ID NO: 23664 - protein, 9 aa, Homo Sapiens
GKDSEDVSS

SEQ ID NO: 23665 - protein, 9 aa, Homo Sapiens
LVMKYASGG

SEQ ID NO: 23666 - protein, 9 aa, Homo Sapiens
FDRDNVRIP

SEQ ID NO: 23667 - protein, 9 aa, Homo Sapiens
IVMVHKHRE

SEQ ID NO: 23668 - protein, 9 aa, Homo Sapiens
QGRYPHMKD

SEQ ID NO: 23669 - protein, 9 aa, Homo Sapiens
LHAGIVFKS

SEQ ID NO: 23670 - protein, 9 aa, Homo Sapiens
EPGPQALRG

SEQ ID NO: 23671 - protein, 9 aa, Homo Sapiens
AVAILLQND

SEQ ID NO: 23672 - protein, 9 aa, Homo Sapiens
PVKKHEVPA

SEQ ID NO: 23673 - protein, 9 aa, Homo Sapiens
NKDQSVKFR

SEQ ID NO: 23674 - protein, 9 aa, Homo Sapiens
FYLVLLNIF

SEQ ID NO: 23675 - protein, 9 aa, Homo Sapiens
VKFYAPDPA

SEQ ID NO: 23676 - protein, 9 aa, Homo Sapiens
AGIVFKSYE

SEQ ID NO: 23677 - protein, 9 aa, Homo Sapiens
DVSKSSNIE

SEQ ID NO: 23678 - protein, 9 aa, Homo Sapiens
NELMNVYQH

SEQ ID NO: 23679 - protein, 9 aa, Homo Sapiens
TEKLSAGEE

SEQ ID NO: 23680 - protein, 9 aa, Homo Sapiens
CSQEGNHYF

SEQ ID NO: 23681 - protein, 9 aa, Homo Sapiens
RTTDKMTTE

SEQ ID NO: 23682 - protein, 9 aa, Homo Sapiens
IQLLSDQSN

SEQ ID NO: 23683 - protein, 9 aa, Homo Sapiens
HSPTEDNVA

SEQ ID NO: 23684 - protein, 9 aa, Homo Sapiens
NPDTAHKYL

SEQ ID NO: 23685 - protein, 9 aa, Homo Sapiens
WSWAVACDE

SEQ ID NO: 23686 - protein, 9 aa, Homo Sapiens
PVQNSEIQE

SEQ ID NO: 23687 - protein, 9 aa, Homo Sapiens
VFYSGKPVC

SEQ ID NO: 23688 - protein, 9 aa, Homo Sapiens
AVDANDIPE

SEQ ID NO: 23689 - protein, 9 aa, Homo Sapiens
QDNDMLEAA

SEQ ID NO: 23690 - protein, 9 aa, Homo Sapiens
LFIPCENEN

SEQ ID NO: 23691 - protein, 9 aa, Homo Sapiens
ANLGSLSPL

SEQ ID NO: 23692 - protein, 9 aa, Homo Sapiens
EKECCPLWS

SEQ ID NO: 23693 - protein, 9 aa, Homo Sapiens
LRAVDTSEQ

SEQ ID NO: 23694 - protein, 9 aa, Homo Sapiens
RGDDFSDCY

SEQ ID NO: 23695 - protein, 9 aa, Homo Sapiens
YVFWYVQYP

SEQ ID NO: 23696 - protein, 9 aa, Homo Sapiens
ETKSKIKHP

SEQ ID NO: 23697 - protein, 9 aa, Homo Sapiens
PFDDDKFHI

SEQ ID NO: 23698 - protein, 9 aa, Homo Sapiens
VSLLLPSVG

SEQ ID NO: 23699 - protein, 9 aa, Homo Sapiens
PWANCGSTT

SEQ ID NO: 23700 - protein, 9 aa, Homo Sapiens
EETDPPSTC

SEQ ID NO: 23701 - protein, 9 aa, Homo Sapiens
GEPVAKTKM

SEQ ID NO: 23702 - protein, 9 aa, Homo Sapiens
GSRMNVSRT

SEQ ID NO: 23703 - protein, 9 aa, Homo Sapiens
EQQSDCKIL

SEQ ID NO: 23704 - protein, 9 aa, Homo Sapiens
EIMKQMGYL

SEQ ID NO: 23705 - protein, 9 aa, Homo Sapiens
GGGSKAPLC

SEQ ID NO: 23706 - protein, 9 aa, Homo Sapiens
KSSMSFQNI

SEQ ID NO: 23707 - protein, 9 aa, Homo Sapiens
YSQKSINSI

SEQ ID NO: 23708 - protein, 9 aa, Homo Sapiens
RSLDMNAFR

SEQ ID NO: 23709 - protein, 9 aa, Homo Sapiens
SDIIMQLDN

SEQ ID NO: 23710 - protein, 9 aa, Homo Sapiens
DAGWKTKKH

SEQ ID NO: 23711 - protein, 9 aa, Homo Sapiens
QGMFNCTYY

SEQ ID NO: 23712 - protein, 9 aa, Homo Sapiens
RNGVCENTH

SEQ ID NO: 23713 - protein, 9 aa, Homo Sapiens
RHMPPEVYD

SEQ ID NO: 23714 - protein, 9 aa, Homo Sapiens
APPGRQRLK

SEQ ID NO: 23715 - protein, 9 aa, Homo Sapiens
ATDNYESES

SEQ ID NO: 23716 - protein, 9 aa, Homo Sapiens
GPSAKLMAS

SEQ ID NO: 23717 - protein, 9 aa, Homo Sapiens
GIRLLGFNK

SEQ ID NO: 23718 - protein, 9 aa, Homo Sapiens
GWLVTLSYA

SEQ ID NO: 23719 - protein, 9 aa, Homo Sapiens
SKSSNIEES

SEQ ID NO: 23720 - protein, 9 aa, Homo Sapiens
RQGMFNCTY

SEQ ID NO: 23721 - protein, 9 aa, Homo Sapiens
RQWGASPSR

SEQ ID NO: 23722 - protein, 9 aa, Homo Sapiens
QFIAYPITL

SEQ ID NO: 23723 - protein, 9 aa, Homo Sapiens
SKVRNPRAN

SEQ ID NO: 23724 - protein, 9 aa, Homo Sapiens
ILLQNDTKG

SEQ ID NO: 23725 - protein, 9 aa, Homo Sapiens
NLRIAAGKT

SEQ ID NO: 23726 - protein, 9 aa, Homo Sapiens
NTKLVLPDE

SEQ ID NO: 23727 - protein, 9 aa, Homo Sapiens
SNFRTIDLS

SEQ ID NO: 23728 - protein, 9 aa, Homo Sapiens
MSSEFLAKL

SEQ ID NO: 23729 - protein, 9 aa, Homo Sapiens
SLLYSFCQQ

SEQ ID NO: 23730 - protein, 9 aa, Homo Sapiens
DQEGAMFVH

SEQ ID NO: 23731 - protein, 9 aa, Homo Sapiens
REDNNEELE

SEQ ID NO: 23732 - protein, 9 aa, Homo Sapiens
AFNMQTETV

SEQ ID NO: 23733 - protein, 9 aa, Homo Sapiens
KMKMGRYWS

SEQ ID NO: 23734 - protein, 9 aa, Homo Sapiens
DLSSNDIRK

SEQ ID NO: 23735 - protein, 9 aa, Homo Sapiens
QSDKNGIPS

SEQ ID NO: 23736 - protein, 9 aa, Homo Sapiens
VSKMKMGRY

SEQ ID NO: 23737 - protein, 9 aa, Homo Sapiens
SSMSFQNII

SEQ ID NO: 23738 - protein, 9 aa, Homo Sapiens
DSSAPMQNT

SEQ ID NO: 23739 - protein, 9 aa, Homo Sapiens
SRELYVMEM

SEQ ID NO: 23740 - protein, 9 aa, Homo Sapiens
RKVRGLQPE

SEQ ID NO: 23741 - protein, 9 aa, Homo Sapiens
AYMMNVCSP

SEQ ID NO: 23742 - protein, 9 aa, Homo Sapiens
QTAIDQFVR

SEQ ID NO: 23743 - protein, 9 aa, Homo Sapiens
SRIRAHSQN

SEQ ID NO: 23744 - protein, 9 aa, Homo Sapiens
YMMNVCSPA

SEQ ID NO: 23745 - protein, 9 aa, Homo Sapiens
NVCSPADQD

SEQ ID NO: 23746 - protein, 9 aa, Homo Sapiens
GNGSLRKAL

SEQ ID NO: 23747 - protein, 9 aa, Homo Sapiens
TDLDAINPL

SEQ ID NO: 23748 - protein, 9 aa, Homo Sapiens
LDYLRTITH

SEQ ID NO: 23749 - protein, 9 aa, Homo Sapiens
GEIVMVHKH

SEQ ID NO: 23750 - protein, 9 aa, Homo Sapiens
PHMKDGEDL

SEQ ID NO: 23751 - protein, 9 aa, Homo Sapiens
NIENGNVTV

SEQ ID NO: 23752 - protein, 9 aa, Homo Sapiens
DSWVDTKRT

SEQ ID NO: 23753 - protein, 9 aa, Homo Sapiens
HMPPEVYDA

SEQ ID NO: 23754 - protein, 9 aa, Homo Sapiens
NASGNFAIR

SEQ ID NO: 23755 - protein, 9 aa, Homo Sapiens
LVGNVLIWP

SEQ ID NO: 23756 - protein, 9 aa, Homo Sapiens
EELVQQLIE

SEQ ID NO: 23757 - protein, 9 aa, Homo Sapiens
LFKTDEASA

SEQ ID NO: 23758 - protein, 9 aa, Homo Sapiens
APPSLSFGL

SEQ ID NO: 23759 - protein, 9 aa, Homo Sapiens
GAESSSTSV

SEQ ID NO: 23760 - protein, 9 aa, Homo Sapiens
CATPAALAY

SEQ ID NO: 23761 - protein, 9 aa, Homo Sapiens
AGCFAGLLI

SEQ ID NO: 23762 - protein, 9 aa, Homo Sapiens
LESRHRFRV

SEQ ID NO: 23763 - protein, 9 aa, Homo Sapiens
LNNLSEDGA

SEQ ID NO: 23764 - protein, 9 aa, Homo Sapiens
SKDARQQQL

SEQ ID NO: 23765 - protein, 9 aa, Homo Sapiens
RTKFPLGRY

SEQ ID NO: 23766 - protein, 9 aa, Homo Sapiens
RACSPVITC

SEQ ID NO: 23767 - protein, 9 aa, Homo Sapiens
NIGNLSSTR

SEQ ID NO: 23768 - protein, 9 aa, Homo Sapiens
LVQQLIENS

SEQ ID NO: 23769 - protein, 9 aa, Homo Sapiens
AAGCFAGLL

SEQ ID NO: 23770 - protein, 9 aa, Homo Sapiens
VSENKRISL

SEQ ID NO: 23771 - protein, 9 aa, Homo Sapiens
GYACNENQG

SEQ ID NO: 23772 - protein, 9 aa, Homo Sapiens
PPSLSFGLH

SEQ ID NO: 23773 - protein, 9 aa, Homo Sapiens
VLLKSIDLV

SEQ ID NO: 23774 - protein, 9 aa, Homo Sapiens
KLLLSRGDN

SEQ ID NO: 23775 - protein, 9 aa, Homo Sapiens
NPEKIWSSM

SEQ ID NO: 23776 - protein, 9 aa, Homo Sapiens
SVYNTGESC

SEQ ID NO: 23777 - protein, 9 aa, Homo Sapiens
ETDPPSTCQ

SEQ ID NO: 23778 - protein, 9 aa, Homo Sapiens
CLSRKKMKK

SEQ ID NO: 23779 - protein, 9 aa, Homo Sapiens
SKGKIFNKM

SEQ ID NO: 23780 - protein, 9 aa, Homo Sapiens
ASGNFAIRL

SEQ ID NO: 23781 - protein, 9 aa, Homo Sapiens
ICIATDNYE

SEQ ID NO: 23782 - protein, 9 aa, Homo Sapiens
ANLTSILIQ

SEQ ID NO: 23783 - protein, 9 aa, Homo Sapiens
RSYSEVLRN

SEQ ID NO: 23784 - protein, 9 aa, Homo Sapiens
HYNSLSELR

SEQ ID NO: 23785 - protein, 9 aa, Homo Sapiens
YSGKPVCHS

SEQ ID NO: 23786 - protein, 9 aa, Homo Sapiens
DACALMRGH

SEQ ID NO: 23787 - protein, 9 aa, Homo Sapiens
DKIEQQSDC

SEQ ID NO: 23788 - protein, 9 aa, Homo Sapiens
IYGQDPVSF

SEQ ID NO: 23789 - protein, 9 aa, Homo Sapiens
AVHTKVVHY

SEQ ID NO: 23790 - protein, 9 aa, Homo Sapiens
CPSPHSQKH

SEQ ID NO: 23791 - protein, 9 aa, Homo Sapiens
VRWSKVEPA

SEQ ID NO: 23792 - protein, 9 aa, Homo Sapiens
CEADKSHPE

SEQ ID NO: 23793 - protein, 9 aa, Homo Sapiens
FGVIVGSIF

SEQ ID NO: 23794 - protein, 9 aa, Homo Sapiens
AAGKTIALL

SEQ ID NO: 23795 - protein, 9 aa, Homo Sapiens
LLQNDTKGK

SEQ ID NO: 23796 - protein, 9 aa, Homo Sapiens
QGGGLRPKE

SEQ ID NO: 23797 - protein, 9 aa, Homo Sapiens
CAFPGRDRR

SEQ ID NO: 23798 - protein, 9 aa, Homo Sapiens
RSTLMQHQK

SEQ ID NO: 23799 - protein, 9 aa, Homo Sapiens
PGDSSAPMQ

SEQ ID NO: 23800 - protein, 9 aa, Homo Sapiens
EGEEAEETD

SEQ ID NO: 23801 - protein, 9 aa, Homo Sapiens
LSYAIYGLQ

SEQ ID NO: 23802 - protein, 9 aa, Homo Sapiens
MPPEVYDAV

SEQ ID NO: 23803 - protein, 9 aa, Homo Sapiens
CYLDLAGLR

SEQ ID NO: 23804 - protein, 9 aa, Homo Sapiens
QYATEGRYS

SEQ ID NO: 23805 - protein, 9 aa, Homo Sapiens
QLSIEQRVN

SEQ ID NO: 23806 - protein, 9 aa, Homo Sapiens
SGNQKGELK

SEQ ID NO: 23807 - protein, 9 aa, Homo Sapiens
CLKYGHYKR

SEQ ID NO: 23808 - protein, 9 aa, Homo Sapiens
SQFIAYPIT

SEQ ID NO: 23809 - protein, 9 aa, Homo Sapiens
CYSHAFAPE

SEQ ID NO: 23810 - protein, 9 aa, Homo Sapiens
GEFFNNLYF

SEQ ID NO: 23811 - protein, 9 aa, Homo Sapiens
GQLKPQELG

SEQ ID NO: 23812 - protein, 9 aa, Homo Sapiens
VPHCICANG

SEQ ID NO: 23813 - protein, 9 aa, Homo Sapiens
TLSYAIYGL

SEQ ID NO: 23814 - protein, 9 aa, Homo Sapiens
VRQRLKLGK

SEQ ID NO: 23815 - protein, 9 aa, Homo Sapiens
RVRKSQSQR

SEQ ID NO: 23816 - protein, 9 aa, Homo Sapiens
RLESGYEKH

SEQ ID NO: 23817 - protein, 9 aa, Homo Sapiens
LGLVSGQKA

SEQ ID NO: 23818 - protein, 9 aa, Homo Sapiens
LIPLVPVSA

SEQ ID NO: 23819 - protein, 9 aa, Homo Sapiens
NNTTSKEVS

SEQ ID NO: 23820 - protein, 9 aa, Homo Sapiens
RGAVAPCQN

SEQ ID NO: 23821 - protein, 9 aa, Homo Sapiens
FLAPNLKAG

SEQ ID NO: 23822 - protein, 9 aa, Homo Sapiens
ESTVVRKNN

SEQ ID NO: 23823 - protein, 9 aa, Homo Sapiens
LGRAYARAT

SEQ ID NO: 23824 - protein, 9 aa, Homo Sapiens
NGGERVLYN

SEQ ID NO: 23825 - protein, 9 aa, Homo Sapiens
STVVRKNNL

SEQ ID NO: 23826 - protein, 9 aa, Homo Sapiens
MSDNPGVHE

SEQ ID NO: 23827 - protein, 9 aa, Homo Sapiens
NFSEKVEVA

SEQ ID NO: 23828 - protein, 9 aa, Homo Sapiens
RNYSQKSIN

SEQ ID NO: 23829 - protein, 9 aa, Homo Sapiens
PPVRYLSPK

SEQ ID NO: 23830 - protein, 9 aa, Homo Sapiens
DFLCVRLLL

SEQ ID NO: 23831 - protein, 9 aa, Homo Sapiens
KAGPHRVAG

SEQ ID NO: 23832 - protein, 9 aa, Homo Sapiens
TQIIPRHLQ

SEQ ID NO: 23833 - protein, 9 aa, Homo Sapiens
KCSIEVNET

SEQ ID NO: 23834 - protein, 9 aa, Homo Sapiens
ERALNYYGL

SEQ ID NO: 23835 - protein, 9 aa, Homo Sapiens
LGLSNEIEA

SEQ ID NO: 23836 - protein, 9 aa, Homo Sapiens
HKATACVVD

SEQ ID NO: 23837 - protein, 9 aa, Homo Sapiens
AASCWLQGA

SEQ ID NO: 23838 - protein, 9 aa, Homo Sapiens
EQRKGLLTS

SEQ ID NO: 23839 - protein, 9 aa, Homo Sapiens
VSFEDPELK

SEQ ID NO: 23840 - protein, 9 aa, Homo Sapiens
RGQGGYPGT

SEQ ID NO: 23841 - protein, 9 aa, Homo Sapiens
PVAMVPSQA

SEQ ID NO: 23842 - protein, 9 aa, Homo Sapiens
KIILVVRND

SEQ ID NO: 23843 - protein, 9 aa, Homo Sapiens
WRLLACASA

SEQ ID NO: 23844 - protein, 9 aa, Homo Sapiens
SDKEEAPLR

SEQ ID NO: 23845 - protein, 9 aa, Homo Sapiens
SVVELYGIL

SEQ ID NO: 23846 - protein, 9 aa, Homo Sapiens
SQKSINSIL

SEQ ID NO: 23847 - protein, 9 aa, Homo Sapiens
QGNRFTCFA

SEQ ID NO: 23848 - protein, 9 aa, Homo Sapiens
SRRKKNEYL

SEQ ID NO: 23849 - protein, 9 aa, Homo Sapiens
ANDIPELLS

SEQ ID NO: 23850 - protein, 9 aa, Homo Sapiens
AAATAALHP

SEQ ID NO: 23851 - protein, 9 aa, Homo Sapiens
KINRFIIPR

SEQ ID NO: 23852 - protein, 9 aa, Homo Sapiens
ETSFFDKNR

SEQ ID NO: 23853 - protein, 9 aa, Homo Sapiens
TPTDTHWVG

SEQ ID NO: 23854 - protein, 9 aa, Homo Sapiens
RPPGGQQPG

SEQ ID NO: 23855 - protein, 9 aa, Homo Sapiens
QDAVSNFSV

SEQ ID NO: 23856 - protein, 9 aa, Homo Sapiens
AVTRNYSQK

SEQ ID NO: 23857 - protein, 9 aa, Homo Sapiens
KGKGPPWAN

SEQ ID NO: 23858 - protein, 9 aa, Homo Sapiens
NQSVLIQKQ

SEQ ID NO: 23859 - protein, 9 aa, Homo Sapiens
PDQLKRLHT

SEQ ID NO: 23860 - protein, 9 aa, Homo Sapiens
VGHDALEDP

SEQ ID NO: 23861 - protein, 9 aa, Homo Sapiens
GKGHVGTVR

SEQ ID NO: 23862 - protein, 9 aa, Homo Sapiens
KHPVYSLYF

SEQ ID NO: 23863 - protein, 9 aa, Homo Sapiens
VKSEQLHHL

SEQ ID NO: 23864 - protein, 9 aa, Homo Sapiens
DAPPAKFSS

SEQ ID NO: 23865 - protein, 9 aa, Homo Sapiens
PRKDGVDGL

SEQ ID NO: 23866 - protein, 9 aa, Homo Sapiens
LKFNMEQLK

SEQ ID NO: 23867 - protein, 9 aa, Homo Sapiens
MGLMVEASP

SEQ ID NO: 23868 - protein, 9 aa, Homo Sapiens
LDVFLRRHM

SEQ ID NO: 23869 - protein, 9 aa, Homo Sapiens
DIPESSRQE

SEQ ID NO: 23870 - protein, 9 aa, Homo Sapiens
HWKHYIYLW

SEQ ID NO: 23871 - protein, 9 aa, Homo Sapiens
QMYDYSLYM

SEQ ID NO: 23872 - protein, 9 aa, Homo Sapiens
AKTKMEVTG

SEQ ID NO: 23873 - protein, 9 aa, Homo Sapiens
FNWQKEVSS

SEQ ID NO: 23874 - protein, 9 aa, Homo Sapiens
LLESVLQQL

SEQ ID NO: 23875 - protein, 9 aa, Homo Sapiens
NNSNPVENK

SEQ ID NO: 23876 - protein, 9 aa, Homo Sapiens
SVLHQGENL

SEQ ID NO: 23877 - protein, 9 aa, Homo Sapiens
SKIFIPNPR

SEQ ID NO: 23878 - protein, 9 aa, Homo Sapiens
LQDIEGKIN

SEQ ID NO: 23879 - protein, 9 aa, Homo Sapiens
QSGDAFHGE

SEQ ID NO: 23880 - protein, 9 aa, Homo Sapiens
LNPKAVSVV

SEQ ID NO: 23881 - protein, 9 aa, Homo Sapiens
EAIEKAVIW

SEQ ID NO: 23882 - protein, 9 aa, Homo Sapiens
PWAFSKAGE

SEQ ID NO: 23883 - protein, 9 aa, Homo Sapiens
VITDHVVVP

SEQ ID NO: 23884 - protein, 9 aa, Homo Sapiens
DCTTGSSRT

SEQ ID NO: 23885 - protein, 9 aa, Homo Sapiens
QRVNEMASD

SEQ ID NO: 23886 - protein, 9 aa, Homo Sapiens
TKKHQLEVD

SEQ ID NO: 23887 - protein, 9 aa, Homo Sapiens
MKKTESGMY

SEQ ID NO: 23888 - protein, 9 aa, Homo Sapiens
LLSDQHKAG

SEQ ID NO: 23889 - protein, 9 aa, Homo Sapiens
SPRKDGVDG

SEQ ID NO: 23890 - protein, 9 aa, Homo Sapiens
NGFVFILGR

SEQ ID NO: 23891 - protein, 9 aa, Homo Sapiens
DLMSDLLSE

SEQ ID NO: 23892 - protein, 9 aa, Homo Sapiens
CFAICSCWG

SEQ ID NO: 23893 - protein, 9 aa, Homo Sapiens
KMQRLINED

SEQ ID NO: 23894 - protein, 9 aa, Homo Sapiens
GVCENTHGG

SEQ ID NO: 23895 - protein, 9 aa, Homo Sapiens
KSEPPAPNI

SEQ ID NO: 23896 - protein, 9 aa, Homo Sapiens
LKEVSKRFG

SEQ ID NO: 23897 - protein, 9 aa, Homo Sapiens
PGTPRNRMV

SEQ ID NO: 23898 - protein, 9 aa, Homo Sapiens
IPTVVPTPA

SEQ ID NO: 23899 - protein, 9 aa, Homo Sapiens
GQAEETDPP

SEQ ID NO: 23900 - protein, 9 aa, Homo Sapiens
ATERVQTNS

SEQ ID NO: 23901 - protein, 9 aa, Homo Sapiens
DNYESESGS

SEQ ID NO: 23902 - protein, 9 aa, Homo Sapiens
STTHSGPGV

SEQ ID NO: 23903 - protein, 9 aa, Homo Sapiens
QNLFGRKFL

SEQ ID NO: 23904 - protein, 9 aa, Homo Sapiens
EQKELKEIR

SEQ ID NO: 23905 - protein, 9 aa, Homo Sapiens
WCPCPHIRR

SEQ ID NO: 23906 - protein, 9 aa, Homo Sapiens
SNNDDVQKA

SEQ ID NO: 23907 - protein, 9 aa, Homo Sapiens
RVFIEQDND

SEQ ID NO: 23908 - protein, 9 aa, Homo Sapiens
ALSVRQRLK

SEQ ID NO: 23909 - protein, 9 aa, Homo Sapiens
PGFAESWGH

SEQ ID NO: 23910 - protein, 9 aa, Homo Sapiens
LEKMKKQYR

SEQ ID NO: 23911 - protein, 9 aa, Homo Sapiens
SGSGQCPSR

SEQ ID NO: 23912 - protein, 9 aa, Homo Sapiens
PVENKDAVA

SEQ ID NO: 23913 - protein, 9 aa, Homo Sapiens
PSALLGAST

SEQ ID NO: 23914 - protein, 9 aa, Homo Sapiens
LHNQEVKRA

SEQ ID NO: 23915 - protein, 9 aa, Homo Sapiens
FVERKCTQL

SEQ ID NO: 23916 - protein, 9 aa, Homo Sapiens
SQSQRRAGQ

SEQ ID NO: 23917 - protein, 9 aa, Homo Sapiens
WANCGSTTA

SEQ ID NO: 23918 - protein, 9 aa, Homo Sapiens
DFQINVEVY

SEQ ID NO: 23919 - protein, 9 aa, Homo Sapiens
LPMIKEHMQ

SEQ ID NO: 23920 - protein, 9 aa, Homo Sapiens
PKFHSLHFL

SEQ ID NO: 23921 - protein, 9 aa, Homo Sapiens
NGKDSEDVS

SEQ ID NO: 23922 - protein, 9 aa, Homo Sapiens
MPKFILYAF

SEQ ID NO: 23923 - protein, 9 aa, Homo Sapiens
IKHPVYSLY

SEQ ID NO: 23924 - protein, 9 aa, Homo Sapiens
SKAPETPME

SEQ ID NO: 23925 - protein, 9 aa, Homo Sapiens
ADSWVDTKR

SEQ ID NO: 23926 - protein, 9 aa, Homo Sapiens
MDRSLDMNA

SEQ ID NO: 23927 - protein, 9 aa, Homo Sapiens
TATERVQTN

SEQ ID NO: 23928 - protein, 9 aa, Homo Sapiens
GGARGFFAP

SEQ ID NO: 23929 - protein, 9 aa, Homo Sapiens
RLEKMKKQY

SEQ ID NO: 23930 - protein, 9 aa, Homo Sapiens
GAEAGEIIA

SEQ ID NO: 23931 - protein, 9 aa, Homo Sapiens
GEELVQQLI

SEQ ID NO: 23932 - protein, 9 aa, Homo Sapiens
NLSSTRGQL

SEQ ID NO: 23933 - protein, 9 aa, Homo Sapiens
WVWARNRAH

SEQ ID NO: 23934 - protein, 9 aa, Homo Sapiens
SKKGRKSYK

SEQ ID NO: 23935 - protein, 9 aa, Homo Sapiens
FQINVEVYS

SEQ ID NO: 23936 - protein, 9 aa, Homo Sapiens
PLWSGDRSP

SEQ ID NO: 23937 - protein, 9 aa, Homo Sapiens
PEKPAVHTK

SEQ ID NO: 23938 - protein, 9 aa, Homo Sapiens
RLKERTGPA

SEQ ID NO: 23939 - protein, 9 aa, Homo Sapiens
VKRSKLALS

SEQ ID NO: 23940 - protein, 9 aa, Homo Sapiens
GELMVSKDA

SEQ ID NO: 23941 - protein, 9 aa, Homo Sapiens
LVSTVPECA

SEQ ID NO: 23942 - protein, 9 aa, Homo Sapiens
LKDKLPERQ

SEQ ID NO: 23943 - protein, 9 aa, Homo Sapiens
NSLYSIYNF

SEQ ID NO: 23944 - protein, 9 aa, Homo Sapiens
ANFLAKEMS

SEQ ID NO: 23945 - protein, 9 aa, Homo Sapiens
GKTISNNDD

SEQ ID NO: 23946 - protein, 9 aa, Homo Sapiens
LYLVMKYAS

SEQ ID NO: 23947 - protein, 9 aa, Homo Sapiens
RTISCHVRN

SEQ ID NO: 23948 - protein, 9 aa, Homo Sapiens
YIGLGFRIN

SEQ ID NO: 23949 - protein, 9 aa, Homo Sapiens
DFFLPVREM

SEQ ID NO: 23950 - protein, 9 aa, Homo Sapiens
KSDSEEKPC

SEQ ID NO: 23951 - protein, 9 aa, Homo Sapiens
SPGDSSAPM

SEQ ID NO: 23952 - protein, 9 aa, Homo Sapiens
GAEAPVRAE

SEQ ID NO: 23953 - protein, 9 aa, Homo Sapiens
LRRANLTSI

SEQ ID NO: 23954 - protein, 9 aa, Homo Sapiens
ERVQTNSQC

SEQ ID NO: 23955 - protein, 9 aa, Homo Sapiens
GKIFNKMQR

SEQ ID NO: 23956 - protein, 9 aa, Homo Sapiens
TLYIVQRPL

SEQ ID NO: 23957 - protein, 9 aa, Homo Sapiens
NLDSHCSTE

SEQ ID NO: 23958 - protein, 9 aa, Homo Sapiens
VNLRIAAGK

SEQ ID NO: 23959 - protein, 9 aa, Homo Sapiens
SEFLAKLHW

SEQ ID NO: 23960 - protein, 9 aa, Homo Sapiens
SRVRTKFPL

SEQ ID NO: 23961 - protein, 9 aa, Homo Sapiens
QQAAAGPKG

SEQ ID NO: 23962 - protein, 9 aa, Homo Sapiens
NPYVFWYVQ

SEQ ID NO: 23963 - protein, 9 aa, Homo Sapiens
LTYNPDELS

SEQ ID NO: 23964 - protein, 9 aa, Homo Sapiens
THPRKASDK

SEQ ID NO: 23965 - protein, 9 aa, Homo Sapiens
LLKEKQFVE

SEQ ID NO: 23966 - protein, 9 aa, Homo Sapiens
KLPLIPLVP

SEQ ID NO: 23967 - protein, 9 aa, Homo Sapiens
FPGRDRRTE

SEQ ID NO: 23968 - protein, 9 aa, Homo Sapiens
QPPLPGFND

SEQ ID NO: 23969 - protein, 9 aa, Homo Sapiens
VSKGKIFNK

SEQ ID NO: 23970 - protein, 9 aa, Homo Sapiens
GFNDCGSRL

SEQ ID NO: 23971 - protein, 9 aa, Homo Sapiens
QGSEHLFNG

SEQ ID NO: 23972 - protein, 9 aa, Homo Sapiens
MKDGEDLKD

SEQ ID NO: 23973 - protein, 9 aa, Homo Sapiens
APDCPAPAQ

SEQ ID NO: 23974 - protein, 9 aa, Homo Sapiens
VSVAARDGT

SEQ ID NO: 23975 - protein, 9 aa, Homo Sapiens
HSLHFLNFP

SEQ ID NO: 23976 - protein, 9 aa, Homo Sapiens
SPEEKSEPP

SEQ ID NO: 23977 - protein, 9 aa, Homo Sapiens
FADYAKHKC

SEQ ID NO: 23978 - protein, 9 aa, Homo Sapiens
IHLTAFGRE

SEQ ID NO: 23979 - protein, 9 aa, Homo Sapiens
RVASDGGAV

SEQ ID NO: 23980 - protein, 9 aa, Homo Sapiens
SGQCPSRGR

SEQ ID NO: 23981 - protein, 9 aa, Homo Sapiens
GTFTVSAQK

SEQ ID NO: 23982 - protein, 9 aa, Homo Sapiens
NGNVTVENP

SEQ ID NO: 23983 - protein, 9 aa, Homo Sapiens
NKQCSELVD

SEQ ID NO: 23984 - protein, 9 aa, Homo Sapiens
KVEVAFDHM

SEQ ID NO: 23985 - protein, 9 aa, Homo Sapiens
YLPPTVSLF

SEQ ID NO: 23986 - protein, 9 aa, Homo Sapiens
RARELQWSH

SEQ ID NO: 23987 - protein, 9 aa, Homo Sapiens
PGMQEPPGE

SEQ ID NO: 23988 - protein, 9 aa, Homo Sapiens
LGDSGEYKI

SEQ ID NO: 23989 - protein, 9 aa, Homo Sapiens
RIMRELRNR

SEQ ID NO: 23990 - protein, 9 aa, Homo Sapiens
YPGTPAVEL

SEQ ID NO: 23991 - protein, 9 aa, Homo Sapiens
WKIETTEKK

SEQ ID NO: 23992 - protein, 9 aa, Homo Sapiens
GREGSRMNV

SEQ ID NO: 23993 - protein, 9 aa, Homo Sapiens
RNSTPPCHP

SEQ ID NO: 23994 - protein, 9 aa, Homo Sapiens
VYQEKLSKE

SEQ ID NO: 23995 - protein, 9 aa, Homo Sapiens
EVVPAFLVE

SEQ ID NO: 23996 - protein, 9 aa, Homo Sapiens
FCSETPRET

SEQ ID NO: 23997 - protein, 9 aa, Homo Sapiens
KEVDLLYVQ

SEQ ID NO: 23998 - protein, 9 aa, Homo Sapiens
SQIKEDTSF

SEQ ID NO: 23999 - protein, 9 aa, Homo Sapiens
IEPGDKRSV

SEQ ID NO: 24000 - protein, 9 aa, Homo Sapiens
VPLLLKVKR

SEQ ID NO: 24001 - protein, 9 aa, Homo Sapiens
PLYQSPPVR

SEQ ID NO: 24002 - protein, 9 aa, Homo Sapiens
GIIWSWAVA

SEQ ID NO: 24003 - protein, 9 aa, Homo Sapiens
LPSKMTNNT

SEQ ID NO: 24004 - protein, 9 aa, Homo Sapiens
KGILLKSSM

SEQ ID NO: 24005 - protein, 9 aa, Homo Sapiens
TDKMTTEFF

SEQ ID NO: 24006 - protein, 9 aa, Homo Sapiens
MMLARVCLC

SEQ ID NO: 24007 - protein, 9 aa, Homo Sapiens
RFILGLPDA

SEQ ID NO: 24008 - protein, 9 aa, Homo Sapiens
AEGAITIEP

SEQ ID NO: 24009 - protein, 9 aa, Homo Sapiens
TVVPTPALA

SEQ ID NO: 24010 - protein, 9 aa, Homo Sapiens
AHYEWYLKI

SEQ ID NO: 24011 - protein, 9 aa, Homo Sapiens
SMSINTFPV

SEQ ID NO: 24012 - protein, 9 aa, Homo Sapiens
YSPKYVSMC

SEQ ID NO: 24013 - protein, 9 aa, Homo Sapiens
STPVQNSEI

SEQ ID NO: 24014 - protein, 9 aa, Homo Sapiens
NAATAEARH

SEQ ID NO: 24015 - protein, 9 aa, Homo Sapiens
LTSLLYSFC

SEQ ID NO: 24016 - protein, 9 aa, Homo Sapiens
TTGSSRTFP

SEQ ID NO: 24017 - protein, 9 aa, Homo Sapiens
RIRAHSQNT

SEQ ID NO: 24018 - protein, 9 aa, Homo Sapiens
IWSWAVACD

SEQ ID NO: 24019 - protein, 9 aa, Homo Sapiens
GVNHIDTEK

SEQ ID NO: 24020 - protein, 9 aa, Homo Sapiens
ATGNAEQPR

SEQ ID NO: 24021 - protein, 9 aa, Homo Sapiens
GRRYPGTPA

SEQ ID NO: 24022 - protein, 9 aa, Homo Sapiens
VKKHSQFIA

SEQ ID NO: 24023 - protein, 9 aa, Homo Sapiens
DKLPERQPR

SEQ ID NO: 24024 - protein, 9 aa, Homo Sapiens
KRHWKHYIY

SEQ ID NO: 24025 - protein, 9 aa, Homo Sapiens
KRRKHQNDV

SEQ ID NO: 24026 - protein, 9 aa, Homo Sapiens
AQIPTVVPT

SEQ ID NO: 24027 - protein, 9 aa, Homo Sapiens
NDIRKSVPR

SEQ ID NO: 24028 - protein, 9 aa, Homo Sapiens
RYNTELCRP

SEQ ID NO: 24029 - protein, 9 aa, Homo Sapiens
EVQPEQVLV

SEQ ID NO: 24030 - protein, 9 aa, Homo Sapiens
LKGRNAATA

SEQ ID NO: 24031 - protein, 9 aa, Homo Sapiens
SLSGEFFNN

SEQ ID NO: 24032 - protein, 9 aa, Homo Sapiens
TVEKPYACK

SEQ ID NO: 24033 - protein, 9 aa, Homo Sapiens
HTGCFRCIV

SEQ ID NO: 24034 - protein, 9 aa, Homo Sapiens
PNAEVYRFF

SEQ ID NO: 24035 - protein, 9 aa, Homo Sapiens
SPNFSEKVE

SEQ ID NO: 24036 - protein, 9 aa, Homo Sapiens
RHGPSYNLV

SEQ ID NO: 24037 - protein, 9 aa, Homo Sapiens
FHASSYGAQ

SEQ ID NO: 24038 - protein, 9 aa, Homo Sapiens
QTDFLTPPV

SEQ ID NO: 24039 - protein, 9 aa, Homo Sapiens
ALGLVSGQK

SEQ ID NO: 24040 - protein, 9 aa, Homo Sapiens
RKGWLSLHA

SEQ ID NO: 24041 - protein, 9 aa, Homo Sapiens
HASSYGAQL

SEQ ID NO: 24042 - protein, 9 aa, Homo Sapiens
SILIQRVHY

SEQ ID NO: 24043 - protein, 9 aa, Homo Sapiens
SVEKIQGTQ

SEQ ID NO: 24044 - protein, 9 aa, Homo Sapiens
LGFRINCNI

SEQ ID NO: 24045 - protein, 9 aa, Homo Sapiens
ESLIWVRYK

SEQ ID NO: 24046 - protein, 9 aa, Homo Sapiens
THQVIHTET

SEQ ID NO: 24047 - protein, 9 aa, Homo Sapiens
TISCHVRNG

SEQ ID NO: 24048 - protein, 9 aa, Homo Sapiens
QHVLSNLQS

SEQ ID NO: 24049 - protein, 9 aa, Homo Sapiens
YGQDPVSFQ

SEQ ID NO: 24050 - protein, 9 aa, Homo Sapiens
EWWHVQPTL

SEQ ID NO: 24051 - protein, 9 aa, Homo Sapiens
YSIYNFCSK

SEQ ID NO: 24052 - protein, 9 aa, Homo Sapiens
PVHPRAAGA

SEQ ID NO: 24053 - protein, 9 aa, Homo Sapiens
VSNFSVQQV

SEQ ID NO: 24054 - protein, 9 aa, Homo Sapiens
DRDNVRIPG

SEQ ID NO: 24055 - protein, 9 aa, Homo Sapiens
NNDDVQKAD

SEQ ID NO: 24056 - protein, 9 aa, Homo Sapiens
TERVQTNSQ

SEQ ID NO: 24057 - protein, 9 aa, Homo Sapiens
AINPLLTDF

SEQ ID NO: 24058 - protein, 9 aa, Homo Sapiens
ELMVSKDAR

SEQ ID NO: 24059 - protein, 9 aa, Homo Sapiens
EVPVRGRTT

SEQ ID NO: 24060 - protein, 9 aa, Homo Sapiens
TPVQNSEIQ

SEQ ID NO: 24061 - protein, 9 aa, Homo Sapiens
QQLKGLQEF

SEQ ID NO: 24062 - protein, 9 aa, Homo Sapiens
FAICSCWGF

SEQ ID NO: 24063 - protein, 9 aa, Homo Sapiens
FTCFAICSC

SEQ ID NO: 24064 - protein, 9 aa, Homo Sapiens
KKKMEALSV

SEQ ID NO: 24065 - protein, 9 aa, Homo Sapiens
PRSLRTEVT

SEQ ID NO: 24066 - protein, 9 aa, Homo Sapiens
IDPDQLKRL

SEQ ID NO: 24067 - protein, 9 aa, Homo Sapiens
YIYSPKYVS

SEQ ID NO: 24068 - protein, 9 aa, Homo Sapiens
IEPHERCFL

SEQ ID NO: 24069 - protein, 9 aa, Homo Sapiens
GMEPGADQE

SEQ ID NO: 24070 - protein, 9 aa, Homo Sapiens
ESLGVPYKQ

SEQ ID NO: 24071 - protein, 9 aa, Homo Sapiens
ALRGDDFSD

SEQ ID NO: 24072 - protein, 9 aa, Homo Sapiens
WHSPTEDNV

SEQ ID NO: 24073 - protein, 9 aa, Homo Sapiens
PDAGKAHLQ

SEQ ID NO: 24074 - protein, 9 aa, Homo Sapiens
PEAPGGLSP

SEQ ID NO: 24075 - protein, 9 aa, Homo Sapiens
YLVSEMCHN

SEQ ID NO: 24076 - protein, 9 aa, Homo Sapiens
HINDHDFVV

SEQ ID NO: 24077 - protein, 9 aa, Homo Sapiens
TRTTDKMTT

SEQ ID NO: 24078 - protein, 9 aa, Homo Sapiens
GSEASVEWS

SEQ ID NO: 24079 - protein, 9 aa, Homo Sapiens
SKRFGDERG

SEQ ID NO: 24080 - protein, 9 aa, Homo Sapiens
SEMCHNGEM

SEQ ID NO: 24081 - protein, 9 aa, Homo Sapiens
STRTTDKMT

SEQ ID NO: 24082 - protein, 9 aa, Homo Sapiens
EVGHDALED

SEQ ID NO: 24083 - protein, 9 aa, Homo Sapiens
RLSAAAAAA

SEQ ID NO: 24084 - protein, 9 aa, Homo Sapiens
IIWSWAVAC

SEQ ID NO: 24085 - protein, 9 aa, Homo Sapiens
WLEWWHVQP

SEQ ID NO: 24086 - protein, 9 aa, Homo Sapiens
ATDVSKSSN

SEQ ID NO: 24087 - protein, 9 aa, Homo Sapiens
ILNYATRLG

SEQ ID NO: 24088 - protein, 9 aa, Homo Sapiens
ALNYYGLYD

SEQ ID NO: 24089 - protein, 9 aa, Homo Sapiens
KDALRFLSP

SEQ ID NO: 24090 - protein, 9 aa, Homo Sapiens
ARGSLKVPD

SEQ ID NO: 24091 - protein, 9 aa, Homo Sapiens
WSLRANKPK

SEQ ID NO: 24092 - protein, 9 aa, Homo Sapiens
TPIDVLWIK

SEQ ID NO: 24093 - protein, 9 aa, Homo Sapiens
IKNFDRDNV

SEQ ID NO: 24094 - protein, 9 aa, Homo Sapiens
DRSLDMNAF

SEQ ID NO: 24095 - protein, 9 aa, Homo Sapiens
PPSSPRKDG

SEQ ID NO: 24096 - protein, 9 aa, Homo Sapiens
KFDFHWIAQ

SEQ ID NO: 24097 - protein, 9 aa, Homo Sapiens
LGKSKAPET

SEQ ID NO: 24098 - protein, 9 aa, Homo Sapiens
HRANWMKAV

SEQ ID NO: 24099 - protein, 9 aa, Homo Sapiens
EKIQGTQQR

SEQ ID NO: 24100 - protein, 9 aa, Homo Sapiens
MAVFAVFQT

SEQ ID NO: 24101 - protein, 9 aa, Homo Sapiens
LKCSIEVNE

SEQ ID NO: 24102 - protein, 9 aa, Homo Sapiens
KAVKRARAA

SEQ ID NO: 24103 - protein, 9 aa, Homo Sapiens
KDNECHVTP

SEQ ID NO: 24104 - protein, 9 aa, Homo Sapiens
LFEKSGYEK

SEQ ID NO: 24105 - protein, 9 aa, Homo Sapiens
STVPECATP

SEQ ID NO: 24106 - protein, 9 aa, Homo Sapiens
LGGYERRED

SEQ ID NO: 24107 - protein, 9 aa, Homo Sapiens
DIIMQLDNV

SEQ ID NO: 24108 - protein, 9 aa, Homo Sapiens
SKEERKHKE

SEQ ID NO: 24109 - protein, 9 aa, Homo Sapiens
QNDTKGKVR

SEQ ID NO: 24110 - protein, 9 aa, Homo Sapiens
EAEAAPGRP

SEQ ID NO: 24111 - protein, 9 aa, Homo Sapiens
DGGYFHASS

SEQ ID NO: 24112 - protein, 9 aa, Homo Sapiens
PNFSEKVEV

SEQ ID NO: 24113 - protein, 9 aa, Homo Sapiens
ILGLPDAGK

SEQ ID NO: 24114 - protein, 9 aa, Homo Sapiens
AEAPVRAEF

SEQ ID NO: 24115 - protein, 9 aa, Homo Sapiens
LALCSSSCP

SEQ ID NO: 24116 - protein, 9 aa, Homo Sapiens
YQHVLDKFE

SEQ ID NO: 24117 - protein, 9 aa, Homo Sapiens
LFYPGMNSI

SEQ ID NO: 24118 - protein, 9 aa, Homo Sapiens
DCIQNLECK

SEQ ID NO: 24119 - protein, 9 aa, Homo Sapiens
KMTTEFFQN

SEQ ID NO: 24120 - protein, 9 aa, Homo Sapiens
KSKRFSPQP

SEQ ID NO: 24121 - protein, 9 aa, Homo Sapiens
TIRWYRNTK

SEQ ID NO: 24122 - protein, 9 aa, Homo Sapiens
ISVLHQGEN

SEQ ID NO: 24123 - protein, 9 aa, Homo Sapiens
RLEQMVISI

SEQ ID NO: 24124 - protein, 9 aa, Homo Sapiens
EPGPQGEIG

SEQ ID NO: 24125 - protein, 9 aa, Homo Sapiens
AILLQNDTK

SEQ ID NO: 24126 - protein, 9 aa, Homo Sapiens
TAIDQFVRT

SEQ ID NO: 24127 - protein, 9 aa, Homo Sapiens
LSKPNMIDA

SEQ ID NO: 24128 - protein, 9 aa, Homo Sapiens
AMGKSYHTG

SEQ ID NO: 24129 - protein, 9 aa, Homo Sapiens
HDALEDPMP

SEQ ID NO: 24130 - protein, 9 aa, Homo Sapiens
NHITLLEGV

SEQ ID NO: 24131 - protein, 9 aa, Homo Sapiens
KPYLPPTVS

SEQ ID NO: 24132 - protein, 9 aa, Homo Sapiens
KDKLPERQP

SEQ ID NO: 24133 - protein, 9 aa, Homo Sapiens
LPLLFICDN

SEQ ID NO: 24134 - protein, 9 aa, Homo Sapiens
GAAGRQSTT

SEQ ID NO: 24135 - protein, 9 aa, Homo Sapiens
HIGKFCLQY

SEQ ID NO: 24136 - protein, 9 aa, Homo Sapiens
RELYVMEMS

SEQ ID NO: 24137 - protein, 9 aa, Homo Sapiens
HTKVVHYRK

SEQ ID NO: 24138 - protein, 9 aa, Homo Sapiens
GMEPGGGDV

SEQ ID NO: 24139 - protein, 9 aa, Homo Sapiens
EPEEDAAPT

SEQ ID NO: 24140 - protein, 9 aa, Homo Sapiens
YASYRSLSG

SEQ ID NO: 24141 - protein, 9 aa, Homo Sapiens
IDKIEQQSD

SEQ ID NO: 24142 - protein, 9 aa, Homo Sapiens
MEMSDNPGV

SEQ ID NO: 24143 - protein, 9 aa, Homo Sapiens
VEVAFDHMK

SEQ ID NO: 24144 - protein, 9 aa, Homo Sapiens
VLKTVSAVV

SEQ ID NO: 24145 - protein, 9 aa, Homo Sapiens
SCCRSEPDI

SEQ ID NO: 24146 - protein, 9 aa, Homo Sapiens
SHLHTPMCY

SEQ ID NO: 24147 - protein, 9 aa, Homo Sapiens
FYYSKKGRK

SEQ ID NO: 24148 - protein, 9 aa, Homo Sapiens
LLGASTVRS

SEQ ID NO: 24149 - protein, 9 aa, Homo Sapiens
QSTTHSGPG

SEQ ID NO: 24150 - protein, 9 aa, Homo Sapiens
RVSNNPQGI

SEQ ID NO: 24151 - protein, 9 aa, Homo Sapiens
YTCVCRQGM

SEQ ID NO: 24152 - protein, 9 aa, Homo Sapiens
SQKHSSTST

SEQ ID NO: 24153 - protein, 9 aa, Homo Sapiens
SHKKSLFDK

SEQ ID NO: 24154 - protein, 9 aa, Homo Sapiens
DKMTTEFFQ

SEQ ID NO: 24155 - protein, 9 aa, Homo Sapiens
YDFWGLVFY

SEQ ID NO: 24156 - protein, 9 aa, Homo Sapiens
SGNDDYVQL

SEQ ID NO: 24157 - protein, 9 aa, Homo Sapiens
ILNQSQIKE

SEQ ID NO: 24158 - protein, 9 aa, Homo Sapiens
VFKSYECRL

SEQ ID NO: 24159 - protein, 9 aa, Homo Sapiens
RSRPPGGQQ

SEQ ID NO: 24160 - protein, 9 aa, Homo Sapiens
QWRQRHGPS

SEQ ID NO: 24161 - protein, 9 aa, Homo Sapiens
LKPMGLMVE

SEQ ID NO: 24162 - protein, 9 aa, Homo Sapiens
CIATDNYES

SEQ ID NO: 24163 - protein, 9 aa, Homo Sapiens
VDANDIPEL

SEQ ID NO: 24164 - protein, 9 aa, Homo Sapiens
GEEAEETDP

SEQ ID NO: 24165 - protein, 9 aa, Homo Sapiens
QSTVLANPP

SEQ ID NO: 24166 - protein, 9 aa, Homo Sapiens
TRNYSQKSI

SEQ ID NO: 24167 - protein, 9 aa, Homo Sapiens
SGEYKIILV

SEQ ID NO: 24168 - protein, 9 aa, Homo Sapiens
ELDYQRLLE

SEQ ID NO: 24169 - protein, 9 aa, Homo Sapiens
SPFCVLLFG

SEQ ID NO: 24170 - protein, 9 aa, Homo Sapiens
KLEKEARSL

SEQ ID NO: 24171 - protein, 9 aa, Homo Sapiens
AGRESRPHS

SEQ ID NO: 24172 - protein, 9 aa, Homo Sapiens
PYKQWKILN

SEQ ID NO: 24173 - protein, 9 aa, Homo Sapiens
APVRAEFRQ

SEQ ID NO: 24174 - protein, 9 aa, Homo Sapiens
SDVQESLIW

SEQ ID NO: 24175 - protein, 9 aa, Homo Sapiens
VFTPWHSPT

SEQ ID NO: 24176 - protein, 9 aa, Homo Sapiens
IYTNDPTVK

SEQ ID NO: 24177 - protein, 9 aa, Homo Sapiens
HKPAFNMQT

SEQ ID NO: 24178 - protein, 9 aa, Homo Sapiens
IKKGLSDFL

SEQ ID NO: 24179 - protein, 9 aa, Homo Sapiens
GPKGAPERA

SEQ ID NO: 24180 - protein, 9 aa, Homo Sapiens
LLSDQSNQS

SEQ ID NO: 24181 - protein, 9 aa, Homo Sapiens
LETCIKSCG

SEQ ID NO: 24182 - protein, 9 aa, Homo Sapiens
GYERREDNN

SEQ ID NO: 24183 - protein, 9 aa, Homo Sapiens
SSRVRTKFP

SEQ ID NO: 24184 - protein, 9 aa, Homo Sapiens
GAGNENEPC

SEQ ID NO: 24185 - protein, 9 aa, Homo Sapiens
IAVNNLASG

SEQ ID NO: 24186 - protein, 9 aa, Homo Sapiens
DPELKSSFS

SEQ ID NO: 24187 - protein, 9 aa, Homo Sapiens
WGLVFYSGK

SEQ ID NO: 24188 - protein, 9 aa, Homo Sapiens
AITIEPKRA

SEQ ID NO: 24189 - protein, 9 aa, Homo Sapiens
LAIAVNNLA

SEQ ID NO: 24190 - protein, 9 aa, Homo Sapiens
IAVLALCSS

SEQ ID NO: 24191 - protein, 9 aa, Homo Sapiens
ISGIYLDKE

SEQ ID NO: 24192 - protein, 9 aa, Homo Sapiens
EQYATEGRY

SEQ ID NO: 24193 - protein, 9 aa, Homo Sapiens
QGMFSYDFF

SEQ ID NO: 24194 - protein, 9 aa, Homo Sapiens
NTPTSVIIS

SEQ ID NO: 24195 - protein, 9 aa, Homo Sapiens
TTDKMTTEF

SEQ ID NO: 24196 - protein, 9 aa, Homo Sapiens
AVATPSRLS

SEQ ID NO: 24197 - protein, 9 aa, Homo Sapiens
KPAFNMQTE

SEQ ID NO: 24198 - protein, 9 aa, Homo Sapiens
GLGFRINCN

SEQ ID NO: 24199 - protein, 9 aa, Homo Sapiens
ASCWLQGAP

SEQ ID NO: 24200 - protein, 9 aa, Homo Sapiens
IYYCKHCDF

SEQ ID NO: 24201 - protein, 9 aa, Homo Sapiens
FNKMQRLIN

SEQ ID NO: 24202 - protein, 9 aa, Homo Sapiens
KFHIYTIAF

SEQ ID NO: 24203 - protein, 9 aa, Homo Sapiens
SEPDIPESS

SEQ ID NO: 24204 - protein, 9 aa, Homo Sapiens
ELRNSTPPC

SEQ ID NO: 24205 - protein, 9 aa, Homo Sapiens
YKFDFHWIA

SEQ ID NO: 24206 - protein, 9 aa, Homo Sapiens
PMVQSTVLA

SEQ ID NO: 24207 - protein, 9 aa, Homo Sapiens
FSNTPTSVI

SEQ ID NO: 24208 - protein, 9 aa, Homo Sapiens
TYSSSISHK

SEQ ID NO: 24209 - protein, 9 aa, Homo Sapiens
DLDAINPLL

SEQ ID NO: 24210 - protein, 9 aa, Homo Sapiens
DLAGLRGVH

SEQ ID NO: 24211 - protein, 9 aa, Homo Sapiens
GNENEPCEA

SEQ ID NO: 24212 - protein, 9 aa, Homo Sapiens
PQLQWSHLA

SEQ ID NO: 24213 - protein, 9 aa, Homo Sapiens
RQQCYRWKI

SEQ ID NO: 24214 - protein, 9 aa, Homo Sapiens
PDELSKPNM

SEQ ID NO: 24215 - protein, 9 aa, Homo Sapiens
LEKNEEKLC

SEQ ID NO: 24216 - protein, 9 aa, Homo Sapiens
CTTGSSRTF

SEQ ID NO: 24217 - protein, 9 aa, Homo Sapiens
TPGMQEPPG

SEQ ID NO: 24218 - protein, 9 aa, Homo Sapiens
KSLQRQWGA

SEQ ID NO: 24219 - protein, 9 aa, Homo Sapiens
CQPGILNYA

SEQ ID NO: 24220 - protein, 9 aa, Homo Sapiens
KISLNNLSE

SEQ ID NO: 24221 - protein, 9 aa, Homo Sapiens
KGYFADYAK

SEQ ID NO: 24222 - protein, 9 aa, Homo Sapiens
PTDTHWVGA

SEQ ID NO: 24223 - protein, 9 aa, Homo Sapiens
KKQYRNLNT

SEQ ID NO: 24224 - protein, 9 aa, Homo Sapiens
KMPKFILYA

SEQ ID NO: 24225 - protein, 9 aa, Homo Sapiens
LSQTLDFKK

SEQ ID NO: 24226 - protein, 9 aa, Homo Sapiens
EQVPLLLKV

SEQ ID NO: 24227 - protein, 9 aa, Homo Sapiens
WCKDNFVNS

SEQ ID NO: 24228 - protein, 9 aa, Homo Sapiens
WDKREWKSK

SEQ ID NO: 24229 - protein, 9 aa, Homo Sapiens
PPGRQRLKE

SEQ ID NO: 24230 - protein, 9 aa, Homo Sapiens
SKMKMGRYW

SEQ ID NO: 24231 - protein, 9 aa, Homo Sapiens
MGATGNAEQ

SEQ ID NO: 24232 - protein, 9 aa, Homo Sapiens
LENPEKIWS

SEQ ID NO: 24233 - protein, 9 aa, Homo Sapiens
GRTTSAGGN

SEQ ID NO: 24234 - protein, 9 aa, Homo Sapiens
DPSLLVTLA

SEQ ID NO: 24235 - protein, 9 aa, Homo Sapiens
GALGSSQTD

SEQ ID NO: 24236 - protein, 9 aa, Homo Sapiens
QIKEDTSFF

SEQ ID NO: 24237 - protein, 9 aa, Homo Sapiens
IPPSSPRKD

SEQ ID NO: 24238 - protein, 9 aa, Homo Sapiens
HCSTELTNF

SEQ ID NO: 24239 - protein, 9 aa, Homo Sapiens
LLYSFCQQS

SEQ ID NO: 24240 - protein, 9 aa, Homo Sapiens
WIAQALQPH

SEQ ID NO: 24241 - protein, 9 aa, Homo Sapiens
DYISHCHPP

SEQ ID NO: 24242 - protein, 9 aa, Homo Sapiens
PEYKNGLDM

SEQ ID NO: 24243 - protein, 9 aa, Homo Sapiens
LLVEQKELK

SEQ ID NO: 24244 - protein, 9 aa, Homo Sapiens
LGWDFPKST

SEQ ID NO: 24245 - protein, 9 aa, Homo Sapiens
RLLGFNKQC

SEQ ID NO: 24246 - protein, 9 aa, Homo Sapiens
GLCSQEGNH

SEQ ID NO: 24247 - protein, 9 aa, Homo Sapiens
GRIYYCKHC

SEQ ID NO: 24248 - protein, 9 aa, Homo Sapiens
AGWKTKKHQ

SEQ ID NO: 24249 - protein, 9 aa, Homo Sapiens
SPVITCSWI

SEQ ID NO: 24250 - protein, 9 aa, Homo Sapiens
TTHSGPGVN

SEQ ID NO: 24251 - protein, 9 aa, Homo Sapiens
TPRETYRKV

SEQ ID NO: 24252 - protein, 9 aa, Homo Sapiens
CGPLYTTSP

SEQ ID NO: 24253 - protein, 9 aa, Homo Sapiens
DTLTRLHDF

SEQ ID NO: 24254 - protein, 9 aa, Homo Sapiens
PILKPMGLM

SEQ ID NO: 24255 - protein, 9 aa, Homo Sapiens
LCSQEGNHY

SEQ ID NO: 24256 - protein, 9 aa, Homo Sapiens
PDLDYLRTI

SEQ ID NO: 24257 - protein, 9 aa, Homo Sapiens
GDVSLTLHG

SEQ ID NO: 24258 - protein, 9 aa, Homo Sapiens
LFNGQAFSG

SEQ ID NO: 24259 - protein, 9 aa, Homo Sapiens
PGEEKREHA

SEQ ID NO: 24260 - protein, 9 aa, Homo Sapiens
VRLLLLRVQ

SEQ ID NO: 24261 - protein, 9 aa, Homo Sapiens
VRYLSPKKG

SEQ ID NO: 24262 - protein, 9 aa, Homo Sapiens
AQRDLDKVK

SEQ ID NO: 24263 - protein, 9 aa, Homo Sapiens
AGRQSTTHS

SEQ ID NO: 24264 - protein, 9 aa, Homo Sapiens
GRNAATAEA

SEQ ID NO: 24265 - protein, 9 aa, Homo Sapiens
KSTRTTDKM

SEQ ID NO: 24266 - protein, 9 aa, Homo Sapiens
EPGGGDVSL

SEQ ID NO: 24267 - protein, 9 aa, Homo Sapiens
GSDPGFAES

SEQ ID NO: 24268 - protein, 9 aa, Homo Sapiens
CRLLSTAEA

SEQ ID NO: 24269 - protein, 9 aa, Homo Sapiens
FNPDTAHKY

SEQ ID NO: 24270 - protein, 9 aa, Homo Sapiens
DRMLDMGFK

SEQ ID NO: 24271 - protein, 9 aa, Homo Sapiens
KRLKAYVLL

SEQ ID NO: 24272 - protein, 9 aa, Homo Sapiens
LVGSFIKSQ

SEQ ID NO: 24273 - protein, 9 aa, Homo Sapiens
YQGMFSYDF

SEQ ID NO: 24274 - protein, 9 aa, Homo Sapiens
QAEETDPPS

SEQ ID NO: 24275 - protein, 9 aa, Homo Sapiens
CYTCVCRQG

SEQ ID NO: 24276 - protein, 9 aa, Homo Sapiens
LKFTLENYV

SEQ ID NO: 24277 - protein, 9 aa, Homo Sapiens
QRQWGASPS

SEQ ID NO: 24278 - protein, 9 aa, Homo Sapiens
TAALHPALG

SEQ ID NO: 24279 - protein, 9 aa, Homo Sapiens
MKQMGYLTI

SEQ ID NO: 24280 - protein, 9 aa, Homo Sapiens
KPSALLGAS

SEQ ID NO: 24281 - protein, 9 aa, Homo Sapiens
GLSRERALN

SEQ ID NO: 24282 - protein, 9 aa, Homo Sapiens
QHSLPLLFI

SEQ ID NO: 24283 - protein, 9 aa, Homo Sapiens
GYEKHLIIK

SEQ ID NO: 24284 - protein, 9 aa, Homo Sapiens
GWLSLHAGN

SEQ ID NO: 24285 - protein, 9 aa, Homo Sapiens
YSLYMWSLG

SEQ ID NO: 24286 - protein, 9 aa, Homo Sapiens
SDKDSTSVY

SEQ ID NO: 24287 - protein, 9 aa, Homo Sapiens
GKMFMKALF

SEQ ID NO: 24288 - protein, 9 aa, Homo Sapiens
IVRLLVEQK

SEQ ID NO: 24289 - protein, 9 aa, Homo Sapiens
VRVCAFPGR

SEQ ID NO: 24290 - protein, 9 aa, Homo Sapiens
AFSRRSTLM

SEQ ID NO: 24291 - protein, 9 aa, Homo Sapiens
ARTLRAVDT

SEQ ID NO: 24292 - protein, 9 aa, Homo Sapiens
LAAGCFAGL

SEQ ID NO: 24293 - protein, 9 aa, Homo Sapiens
NENPVFAGV

SEQ ID NO: 24294 - protein, 9 aa, Homo Sapiens
MEPGGGDVS

SEQ ID NO: 24295 - protein, 9 aa, Homo Sapiens
RWSKVEPAE

SEQ ID NO: 24296 - protein, 9 aa, Homo Sapiens
GIIEADQVS

SEQ ID NO: 24297 - protein, 9 aa, Homo Sapiens
CLARSAAKR

SEQ ID NO: 24298 - protein, 9 aa, Homo Sapiens
NEMSNLSQG

SEQ ID NO: 24299 - protein, 9 aa, Homo Sapiens
DISVLHQGE

SEQ ID NO: 24300 - protein, 9 aa, Homo Sapiens
VIYGLVAEL

SEQ ID NO: 24301 - protein, 9 aa, Homo Sapiens
SQTLDFKKD

SEQ ID NO: 24302 - protein, 9 aa, Homo Sapiens
NLFGRKFLV

SEQ ID NO: 24303 - protein, 9 aa, Homo Sapiens
LQEVVQVSA

SEQ ID NO: 24304 - protein, 9 aa, Homo Sapiens
TGNAEQPRG

SEQ ID NO: 24305 - protein, 9 aa, Homo Sapiens
QDGGKGHVG

SEQ ID NO: 24306 - protein, 9 aa, Homo Sapiens
YARTLRAVD

SEQ ID NO: 24307 - protein, 9 aa, Homo Sapiens
DLKFNMEQL

SEQ ID NO: 24308 - protein, 9 aa, Homo Sapiens
LSKEERKHK

SEQ ID NO: 24309 - protein, 9 aa, Homo Sapiens
LPEKPAVHT

SEQ ID NO: 24310 - protein, 9 aa, Homo Sapiens
TASRDHVCK

SEQ ID NO: 24311 - protein, 9 aa, Homo Sapiens
RALAVDAND

SEQ ID NO: 24312 - protein, 9 aa, Homo Sapiens
MSPVLLLDT

SEQ ID NO: 24313 - protein, 9 aa, Homo Sapiens
LYSIYNFCS

SEQ ID NO: 24314 - protein, 9 aa, Homo Sapiens
MQTVESTVV

SEQ ID NO: 24315 - protein, 9 aa, Homo Sapiens
GKEGEPGPQ

SEQ ID NO: 24316 - protein, 9 aa, Homo Sapiens
GSSGATEKI

SEQ ID NO: 24317 - protein, 9 aa, Homo Sapiens
QLLSDQSNQ

SEQ ID NO: 24318 - protein, 9 aa, Homo Sapiens
DCPAPAQTP

SEQ ID NO: 24319 - protein, 9 aa, Homo Sapiens
REANFLAKE

SEQ ID NO: 24320 - protein, 9 aa, Homo Sapiens
FILGLPDAG

SEQ ID NO: 24321 - protein, 9 aa, Homo Sapiens
VVELYGILD

SEQ ID NO: 24322 - protein, 9 aa, Homo Sapiens
LQNDTKGKV

SEQ ID NO: 24323 - protein, 9 aa, Homo Sapiens
GRAYARATT

SEQ ID NO: 24324 - protein, 9 aa, Homo Sapiens
HLHTPMCYF

SEQ ID NO: 24325 - protein, 9 aa, Homo Sapiens
QKLTSNFRT

SEQ ID NO: 24326 - protein, 9 aa, Homo Sapiens
LGVVTKPAS

SEQ ID NO: 24327 - protein, 9 aa, Homo Sapiens
KLPERQPRF

SEQ ID NO: 24328 - protein, 9 aa, Homo Sapiens
RIYYCKHCD

SEQ ID NO: 24329 - protein, 9 aa, Homo Sapiens
SKISLNNLS

SEQ ID NO: 24330 - protein, 9 aa, Homo Sapiens
DFIQSHIGK

SEQ ID NO: 24331 - protein, 9 aa, Homo Sapiens
AEVYRFFLA

SEQ ID NO: 24332 - protein, 9 aa, Homo Sapiens
RVLYNSVSQ

SEQ ID NO: 24333 - protein, 9 aa, Homo Sapiens
PLLLKVKRS

SEQ ID NO: 24334 - protein, 9 aa, Homo Sapiens
VHTKVVHYR

SEQ ID NO: 24335 - protein, 9 aa, Homo Sapiens
RELQWSHLA

SEQ ID NO: 24336 - protein, 9 aa, Homo Sapiens
SLRKALIGP

SEQ ID NO: 24337 - protein, 9 aa, Homo Sapiens
CHVRNGTYL

SEQ ID NO: 24338 - protein, 9 aa, Homo Sapiens
LLEKNEEKL

SEQ ID NO: 24339 - protein, 9 aa, Homo Sapiens
RTITHIVFV

SEQ ID NO: 24340 - protein, 9 aa, Homo Sapiens
FILGRAYAR

SEQ ID NO: 24341 - protein, 9 aa, Homo Sapiens
VDVWSLEIT

SEQ ID NO: 24342 - protein, 9 aa, Homo Sapiens
PSAKLMAST

SEQ ID NO: 24343 - protein, 9 aa, Homo Sapiens
YCLHNQEVK

SEQ ID NO: 24344 - protein, 9 aa, Homo Sapiens
VHPSDPVEA

SEQ ID NO: 24345 - protein, 9 aa, Homo Sapiens
VTSGTTSSN

SEQ ID NO: 24346 - protein, 9 aa, Homo Sapiens
VEQKELKEI

SEQ ID NO: 24347 - protein, 9 aa, Homo Sapiens
EHYDRVHLR

SEQ ID NO: 24348 - protein, 9 aa, Homo Sapiens
MEKECCPLW

SEQ ID NO: 24349 - protein, 9 aa, Homo Sapiens
EDLASQMLN

SEQ ID NO: 24350 - protein, 9 aa, Homo Sapiens
WKTKKHQLE

SEQ ID NO: 24351 - protein, 9 aa, Homo Sapiens
LDKVKSSLV

SEQ ID NO: 24352 - protein, 9 aa, Homo Sapiens
PTEDNVATN

SEQ ID NO: 24353 - protein, 9 aa, Homo Sapiens
GLVSGQKAG

SEQ ID NO: 24354 - protein, 9 aa, Homo Sapiens
ESIYTNDPT

SEQ ID NO: 24355 - protein, 9 aa, Homo Sapiens
SRPPGGQQP

SEQ ID NO: 24356 - protein, 9 aa, Homo Sapiens
LYGELMVSK

SEQ ID NO: 24357 - protein, 9 aa, Homo Sapiens
EGDGGYFHA

SEQ ID NO: 24358 - protein, 9 aa, Homo Sapiens
VQCKAKFHV

SEQ ID NO: 24359 - protein, 9 aa, Homo Sapiens
NKDWCKDNF

SEQ ID NO: 24360 - protein, 9 aa, Homo Sapiens
TASGNLIPQ

SEQ ID NO: 24361 - protein, 9 aa, Homo Sapiens
PELLSDQHK

SEQ ID NO: 24362 - protein, 9 aa, Homo Sapiens
ALDLKFNME

SEQ ID NO: 24363 - protein, 9 aa, Homo Sapiens
MKKQYRNLN

SEQ ID NO: 24364 - protein, 9 aa, Homo Sapiens
TNDPTVKPI

SEQ ID NO: 24365 - protein, 9 aa, Homo Sapiens
TSLLYSFCQ

SEQ ID NO: 24366 - protein, 9 aa, Homo Sapiens
QLDNVVSST

SEQ ID NO: 24367 - protein, 9 aa, Homo Sapiens
YKRGILWKK

SEQ ID NO: 24368 - protein, 9 aa, Homo Sapiens
VGNVLIWPM

SEQ ID NO: 24369 - protein, 9 aa, Homo Sapiens
HGPSYNLVT

SEQ ID NO: 24370 - protein, 9 aa, Homo Sapiens
KTQIIPRHL

SEQ ID NO: 24371 - protein, 9 aa, Homo Sapiens
ISPDELKDK

SEQ ID NO: 24372 - protein, 9 aa, Homo Sapiens
HSSTSTPLE

SEQ ID NO: 24373 - protein, 9 aa, Homo Sapiens
RLLRISTIT

SEQ ID NO: 24374 - protein, 9 aa, Homo Sapiens
LARLEQMVI

SEQ ID NO: 24375 - protein, 9 aa, Homo Sapiens
SRSAQRSKS

SEQ ID NO: 24376 - protein, 9 aa, Homo Sapiens
KGDFSVCRN

SEQ ID NO: 24377 - protein, 9 aa, Homo Sapiens
PHSQKHSST

SEQ ID NO: 24378 - protein, 9 aa, Homo Sapiens
KAELLQSDK

SEQ ID NO: 24379 - protein, 9 aa, Homo Sapiens
KETAGEKLE

SEQ ID NO: 24380 - protein, 9 aa, Homo Sapiens
LLTASRDHV

SEQ ID NO: 24381 - protein, 9 aa, Homo Sapiens
KDVESDFAK

SEQ ID NO: 24382 - protein, 9 aa, Homo Sapiens
FLEGFHEES

SEQ ID NO: 24383 - protein, 9 aa, Homo Sapiens
VTMATFTMM

SEQ ID NO: 24384 - protein, 9 aa, Homo Sapiens
NYPIPVCLA

SEQ ID NO: 24385 - protein, 9 aa, Homo Sapiens
SEKVEVAFD

SEQ ID NO: 24386 - protein, 9 aa, Homo Sapiens
NSRSYSEVL

SEQ ID NO: 24387 - protein, 9 aa, Homo Sapiens
PGRQRLKER

SEQ ID NO: 24388 - protein, 9 aa, Homo Sapiens
NNTMVAPTD

SEQ ID NO: 24389 - protein, 9 aa, Homo Sapiens
QKSINSILD

SEQ ID NO: 24390 - protein, 9 aa, Homo Sapiens
PEDPSLLVT

SEQ ID NO: 24391 - protein, 9 aa, Homo Sapiens
TLVGNVLIW

SEQ ID NO: 24392 - protein, 9 aa, Homo Sapiens
GNKDWCKDN

SEQ ID NO: 24393 - protein, 9 aa, Homo Sapiens
IAEGAITIE

SEQ ID NO: 24394 - protein, 9 aa, Homo Sapiens
RDFLKFTLE

SEQ ID NO: 24395 - protein, 9 aa, Homo Sapiens
TETKPFKCN

SEQ ID NO: 24396 - protein, 9 aa, Homo Sapiens
RARPDHTRL

SEQ ID NO: 24397 - protein, 9 aa, Homo Sapiens
PLGVVTKPA

SEQ ID NO: 24398 - protein, 9 aa, Homo Sapiens
AKSTRTTDK

SEQ ID NO: 24399 - protein, 9 aa, Homo Sapiens
FLRSQEAAV

SEQ ID NO: 24400 - protein, 9 aa, Homo Sapiens
QDAGWKTKK

SEQ ID NO: 24401 - protein, 9 aa, Homo Sapiens
DKGIKGEEL

SEQ ID NO: 24402 - protein, 9 aa, Homo Sapiens
RLKAYVLLS

SEQ ID NO: 24403 - protein, 9 aa, Homo Sapiens
WAEAQRIMR

SEQ ID NO: 24404 - protein, 9 aa, Homo Sapiens
FLRRHMPPE

SEQ ID NO: 24405 - protein, 9 aa, Homo Sapiens
GKPGAEAPV

SEQ ID NO: 24406 - protein, 9 aa, Homo Sapiens
IDQFVRTEE

SEQ ID NO: 24407 - protein, 9 aa, Homo Sapiens
FSGSKDSGS

SEQ ID NO: 24408 - protein, 9 aa, Homo Sapiens
KVDVWSLEI

SEQ ID NO: 24409 - protein, 9 aa, Homo Sapiens
HVVVPLLSK

SEQ ID NO: 24410 - protein, 9 aa, Homo Sapiens
VLPMIKEHM

SEQ ID NO: 24411 - protein, 9 aa, Homo Sapiens
TVLANPPSN

SEQ ID NO: 24412 - protein, 9 aa, Homo Sapiens
ENPEKIWSS

SEQ ID NO: 24413 - protein, 9 aa, Homo Sapiens
SIARDTLTR

SEQ ID NO: 24414 - protein, 9 aa, Homo Sapiens
GPPLDMQIL

SEQ ID NO: 24415 - protein, 9 aa, Homo Sapiens
DDKFHIYTI

SEQ ID NO: 24416 - protein, 9 aa, Homo Sapiens
LKSIDLVSS

SEQ ID NO: 24417 - protein, 9 aa, Homo Sapiens
VNSLYSIYN

SEQ ID NO: 24418 - protein, 9 aa, Homo Sapiens
EEDAAPTSP

SEQ ID NO: 24419 - protein, 9 aa, Homo Sapiens
RKFLVNVGQ

SEQ ID NO: 24420 - protein, 9 aa, Homo Sapiens
DMAPKRPSD

SEQ ID NO: 24421 - protein, 9 aa, Homo Sapiens
RDTLTRLHD

SEQ ID NO: 24422 - protein, 9 aa, Homo Sapiens
RISTITEGT

SEQ ID NO: 24423 - protein, 9 aa, Homo Sapiens
FKSYECRLK

SEQ ID NO: 24424 - protein, 9 aa, Homo Sapiens
LGVPYKQWK

SEQ ID NO: 24425 - protein, 9 aa, Homo Sapiens
GLSNEIEAI

SEQ ID NO: 24426 - protein, 9 aa, Homo Sapiens
QRHGPSYNL

SEQ ID NO: 24427 - protein, 9 aa, Homo Sapiens
IGNLSSTRG

SEQ ID NO: 24428 - protein, 9 aa, Homo Sapiens
IYCLHNQEV

SEQ ID NO: 24429 - protein, 9 aa, Homo Sapiens
LDYQRLLEY

SEQ ID NO: 24430 - protein, 9 aa, Homo Sapiens
LNGFPRDRV

SEQ ID NO: 24431 - protein, 9 aa, Homo Sapiens
YDITFNPDT

SEQ ID NO: 24432 - protein, 9 aa, Homo Sapiens
QSNQSVLIQ

SEQ ID NO: 24433 - protein, 9 aa, Homo Sapiens
RHQELFNEN

SEQ ID NO: 24434 - protein, 9 aa, Homo Sapiens
EIKDGEKFG

SEQ ID NO: 24435 - protein, 9 aa, Homo Sapiens
FSSRVRTKF

SEQ ID NO: 24436 - protein, 9 aa, Homo Sapiens
TDFGDSGRI

SEQ ID NO: 24437 - protein, 9 aa, Homo Sapiens
WLSLHAGNL

SEQ ID NO: 24438 - protein, 9 aa, Homo Sapiens
TPMCYFLTN

SEQ ID NO: 24439 - protein, 9 aa, Homo Sapiens
SGYEKHLII

SEQ ID NO: 24440 - protein, 9 aa, Homo Sapiens
NSNPVENKD

SEQ ID NO: 24441 - protein, 9 aa, Homo Sapiens
LSNASGNFA

SEQ ID NO: 24442 - protein, 9 aa, Homo Sapiens
QALRGDDFS

SEQ ID NO: 24443 - protein, 9 aa, Homo Sapiens
GLMVEASPR

SEQ ID NO: 24444 - protein, 9 aa, Homo Sapiens
VRNGTYLQR

SEQ ID NO: 24445 - protein, 9 aa, Homo Sapiens
DIVNEMSNL

SEQ ID NO: 24446 - protein, 9 aa, Homo Sapiens
DFPKSTNFR

SEQ ID NO: 24447 - protein, 9 aa, Homo Sapiens
KTNLVTFFR

SEQ ID NO: 24448 - protein, 9 aa, Homo Sapiens
LSVRQRLKL

SEQ ID NO: 24449 - protein, 9 aa, Homo Sapiens
CLMKARKVR

SEQ ID NO: 24450 - protein, 9 aa, Homo Sapiens
FGTVSSQKQ

SEQ ID NO: 24451 - protein, 9 aa, Homo Sapiens
GGERVLYNS

SEQ ID NO: 24452 - protein, 9 aa, Homo Sapiens
ETAGEKLEK

SEQ ID NO: 24453 - protein, 9 aa, Homo Sapiens
ESRHRFRVA

SEQ ID NO: 24454 - protein, 9 aa, Homo Sapiens
SSEFLAKLH

SEQ ID NO: 24455 - protein, 9 aa, Homo Sapiens
SMSFQNIIE

SEQ ID NO: 24456 - protein, 9 aa, Homo Sapiens
LVQGRYPHM

SEQ ID NO: 24457 - protein, 9 aa, Homo Sapiens
DLQKLTSNF

SEQ ID NO: 24458 - protein, 9 aa, Homo Sapiens
KLRKRLKAY

SEQ ID NO: 24459 - protein, 9 aa, Homo Sapiens
FGRSKIFIP

SEQ ID NO: 24460 - protein, 9 aa, Homo Sapiens
LFFNGKDSE

SEQ ID NO: 24461 - protein, 9 aa, Homo Sapiens
NRLSIPSAS

SEQ ID NO: 24462 - protein, 9 aa, Homo Sapiens
DFQEADSWV

SEQ ID NO: 24463 - protein, 9 aa, Homo Sapiens
VTLSYAIYG

SEQ ID NO: 24464 - protein, 9 aa, Homo Sapiens
VQLAFNARK

SEQ ID NO: 24465 - protein, 9 aa, Homo Sapiens
WTGTPLFYP

SEQ ID NO: 24466 - protein, 9 aa, Homo Sapiens
MEFSDLKSD

SEQ ID NO: 24467 - protein, 9 aa, Homo Sapiens
DDDKFHIYT

SEQ ID NO: 24468 - protein, 9 aa, Homo Sapiens
LQRQWGASP

SEQ ID NO: 24469 - protein, 9 aa, Homo Sapiens
SAAKRRNVK

SEQ ID NO: 24470 - protein, 9 aa, Homo Sapiens
MNVSRTLTH

SEQ ID NO: 24471 - protein, 9 aa, Homo Sapiens
VIVGSIFEV

SEQ ID NO: 24472 - protein, 9 aa, Homo Sapiens
IKDGEKFGT

SEQ ID NO: 24473 - protein, 9 aa, Homo Sapiens
TQPGFYLVL

SEQ ID NO: 24474 - protein, 9 aa, Homo Sapiens
NKGAHLVGL

SEQ ID NO: 24475 - protein, 9 aa, Homo Sapiens
KSKIKHPVY

SEQ ID NO: 24476 - protein, 9 aa, Homo Sapiens
TLTRLHDFA

SEQ ID NO: 24477 - protein, 9 aa, Homo Sapiens
GGGLRPKEI

SEQ ID NO: 24478 - protein, 9 aa, Homo Sapiens
KEHMQMLQN

SEQ ID NO: 24479 - protein, 9 aa, Homo Sapiens
SRDHVCKLF

SEQ ID NO: 24480 - protein, 9 aa, Homo Sapiens
EVGQAEETD

SEQ ID NO: 24481 - protein, 9 aa, Homo Sapiens
EESTQVQLQ

SEQ ID NO: 24482 - protein, 9 aa, Homo Sapiens
SFFDKNRTG

SEQ ID NO: 24483 - protein, 9 aa, Homo Sapiens
LNFGNKDQS

SEQ ID NO: 24484 - protein, 9 aa, Homo Sapiens
AKRRNVKRH

SEQ ID NO: 24485 - protein, 9 aa, Homo Sapiens
ISLNHVRHV

SEQ ID NO: 24486 - protein, 9 aa, Homo Sapiens
KAVSVVELY

SEQ ID NO: 24487 - protein, 9 aa, Homo Sapiens
TSRLACFIK

SEQ ID NO: 24488 - protein, 9 aa, Homo Sapiens
HSKKGPTAS

SEQ ID NO: 24489 - protein, 9 aa, Homo Sapiens
SKVEPAELR

SEQ ID NO: 24490 - protein, 9 aa, Homo Sapiens
AEETDPPST

SEQ ID NO: 24491 - protein, 9 aa, Homo Sapiens
LCVRLLLLR

SEQ ID NO: 24492 - protein, 9 aa, Homo Sapiens
QGMEPGADQ

SEQ ID NO: 24493 - protein, 9 aa, Homo Sapiens
LTSNFRTID

SEQ ID NO: 24494 - protein, 9 aa, Homo Sapiens
EHWVWARNR

SEQ ID NO: 24495 - protein, 9 aa, Homo Sapiens
GFYLVLLNI

SEQ ID NO: 24496 - protein, 9 aa, Homo Sapiens
GKNVSLKCS

SEQ ID NO: 24497 - protein, 9 aa, Homo Sapiens
QGGYPGTPR

SEQ ID NO: 24498 - protein, 9 aa, Homo Sapiens
VDTKRTPGV

SEQ ID NO: 24499 - protein, 9 aa, Homo Sapiens
DLKGRNAAT

SEQ ID NO: 24500 - protein, 9 aa, Homo Sapiens
VELQEVVQV

SEQ ID NO: 24501 - protein, 9 aa, Homo Sapiens
HIDTEKLSA

SEQ ID NO: 24502 - protein, 9 aa, Homo Sapiens
QCYRWKIYA

SEQ ID NO: 24503 - protein, 9 aa, Homo Sapiens
IGTTLVGNV

SEQ ID NO: 24504 - protein, 9 aa, Homo Sapiens
VPWKIETTE

SEQ ID NO: 24505 - protein, 9 aa, Homo Sapiens
NDHDFVVIY

SEQ ID NO: 24506 - protein, 9 aa, Homo Sapiens
LEEFVPEVK

SEQ ID NO: 24507 - protein, 9 aa, Homo Sapiens
KYVSMCDSL

SEQ ID NO: 24508 - protein, 9 aa, Homo Sapiens
NSQCLSVEQ

SEQ ID NO: 24509 - protein, 9 aa, Homo Sapiens
PEKSESHVT

SEQ ID NO: 24510 - protein, 9 aa, Homo Sapiens
PVGWILTTK

SEQ ID NO: 24511 - protein, 9 aa, Homo Sapiens
VAARDGTFT

SEQ ID NO: 24512 - protein, 9 aa, Homo Sapiens
SQEAAVTVQ

SEQ ID NO: 24513 - protein, 9 aa, Homo Sapiens
PFCSETPRE

SEQ ID NO: 24514 - protein, 9 aa, Homo Sapiens
SNNTMVAPT

SEQ ID NO: 24515 - protein, 9 aa, Homo Sapiens
WPNAEVYRF

SEQ ID NO: 24516 - protein, 9 aa, Homo Sapiens
LRANKPKQE

SEQ ID NO: 24517 - protein, 9 aa, Homo Sapiens
NAEVYRFFL

SEQ ID NO: 24518 - protein, 9 aa, Homo Sapiens
LPFDDDKFH

SEQ ID NO: 24519 - protein, 9 aa, Homo Sapiens
PEYSPEEKS

SEQ ID NO: 24520 - protein, 9 aa, Homo Sapiens
QSPSFSGSK

SEQ ID NO: 24521 - protein, 9 aa, Homo Sapiens
KTHRSTQSG

SEQ ID NO: 24522 - protein, 9 aa, Homo Sapiens
YKNGLDMLF

SEQ ID NO: 24523 - protein, 9 aa, Homo Sapiens
SKDSGSPKH

SEQ ID NO: 24524 - protein, 9 aa, Homo Sapiens
ASAQRDLDK

SEQ ID NO: 24525 - protein, 9 aa, Homo Sapiens
AVNSLYSIY

SEQ ID NO: 24526 - protein, 9 aa, Homo Sapiens
FKTDEASAQ

SEQ ID NO: 24527 - protein, 9 aa, Homo Sapiens
RLLLLRVQT

SEQ ID NO: 24528 - protein, 9 aa, Homo Sapiens
LDMQILHQV

SEQ ID NO: 24529 - protein, 9 aa, Homo Sapiens
LLESRHRFR

SEQ ID NO: 24530 - protein, 9 aa, Homo Sapiens
GEYKIILVV

SEQ ID NO: 24531 - protein, 9 aa, Homo Sapiens
EGGGSKAPL

SEQ ID NO: 24532 - protein, 9 aa, Homo Sapiens
NFGNKDQSV

SEQ ID NO: 24533 - protein, 9 aa, Homo Sapiens
KRRNVKRHQ

SEQ ID NO: 24534 - protein, 9 aa, Homo Sapiens
YFHQFGHVM

SEQ ID NO: 24535 - protein, 9 aa, Homo Sapiens
KEVSSFLQE

SEQ ID NO: 24536 - protein, 9 aa, Homo Sapiens
EKLSAGEEH

SEQ ID NO: 24537 - protein, 9 aa, Homo Sapiens
VLYNSVSQE

SEQ ID NO: 24538 - protein, 9 aa, Homo Sapiens
RKKNEYLQG

SEQ ID NO: 24539 - protein, 9 aa, Homo Sapiens
ELYFNPHLV

SEQ ID NO: 24540 - protein, 9 aa, Homo Sapiens
QLKGLQEFL

SEQ ID NO: 24541 - protein, 9 aa, Homo Sapiens
SGNIGNLSS

SEQ ID NO: 24542 - protein, 9 aa, Homo Sapiens
KAGIIWSWA

SEQ ID NO: 24543 - protein, 9 aa, Homo Sapiens
TNLVTFFRT

SEQ ID NO: 24544 - protein, 9 aa, Homo Sapiens
KFHSLHFLN

SEQ ID NO: 24545 - protein, 9 aa, Homo Sapiens
DIGGRKSFS

SEQ ID NO: 24546 - protein, 9 aa, Homo Sapiens
LMKIYGQDP

SEQ ID NO: 24547 - protein, 9 aa, Homo Sapiens
QGEIGPQGI

SEQ ID NO: 24548 - protein, 9 aa, Homo Sapiens
LKERTGPAG

SEQ ID NO: 24549 - protein, 9 aa, Homo Sapiens
KIFIPNPRT

SEQ ID NO: 24550 - protein, 9 aa, Homo Sapiens
PLYTTSPAG

SEQ ID NO: 24551 - protein, 9 aa, Homo Sapiens
GAHLVGLMW

SEQ ID NO: 24552 - protein, 9 aa, Homo Sapiens
LGMLCYSHA

SEQ ID NO: 24553 - protein, 9 aa, Homo Sapiens
ARDTLTRLH

SEQ ID NO: 24554 - protein, 9 aa, Homo Sapiens
IVGSIFEVV

SEQ ID NO: 24555 - protein, 9 aa, Homo Sapiens
YSKKGRKSY

SEQ ID NO: 24556 - protein, 9 aa, Homo Sapiens
SFSIGLNDQ

SEQ ID NO: 24557 - protein, 9 aa, Homo Sapiens
RVPILKPMG

SEQ ID NO: 24558 - protein, 9 aa, Homo Sapiens
AENHAHYEW

SEQ ID NO: 24559 - protein, 9 aa, Homo Sapiens
AEAGPEAPG

SEQ ID NO: 24560 - protein, 9 aa, Homo Sapiens
RKLIHTREK

SEQ ID NO: 24561 - protein, 9 aa, Homo Sapiens
CPLWSGDRS

SEQ ID NO: 24562 - protein, 9 aa, Homo Sapiens
GTTLVGNVL

SEQ ID NO: 24563 - protein, 9 aa, Homo Sapiens
KNGTIFTMS

SEQ ID NO: 24564 - protein, 9 aa, Homo Sapiens
CSIEVNETI

SEQ ID NO: 24565 - protein, 9 aa, Homo Sapiens
GTIFTMSPV

SEQ ID NO: 24566 - protein, 9 aa, Homo Sapiens
LITLLTDAI

SEQ ID NO: 24567 - protein, 9 aa, Homo Sapiens
TRTISCHVR

SEQ ID NO: 24568 - protein, 9 aa, Homo Sapiens
NLSMNPLAM

SEQ ID NO: 24569 - protein, 9 aa, Homo Sapiens
IFTMSPVLL

SEQ ID NO: 24570 - protein, 9 aa, Homo Sapiens
NDIPELLSS

SEQ ID NO: 24571 - protein, 9 aa, Homo Sapiens
LSLHAGNLD

SEQ ID NO: 24572 - protein, 9 aa, Homo Sapiens
SVRQRLKLG

SEQ ID NO: 24573 - protein, 9 aa, Homo Sapiens
QRPAEPQLQ

SEQ ID NO: 24574 - protein, 9 aa, Homo Sapiens
QWGASPSRE

SEQ ID NO: 24575 - protein, 9 aa, Homo Sapiens
LEKLFKTDE

SEQ ID NO: 24576 - protein, 9 aa, Homo Sapiens
GNHYFYEII

SEQ ID NO: 24577 - protein, 9 aa, Homo Sapiens
DELKDKLPE

SEQ ID NO: 24578 - protein, 9 aa, Homo Sapiens
AIQLSIEQR

SEQ ID NO: 24579 - protein, 9 aa, Homo Sapiens
PVRGRTTSA

SEQ ID NO: 24580 - protein, 9 aa, Homo Sapiens
VDTAEVQKV

SEQ ID NO: 24581 - protein, 9 aa, Homo Sapiens
GARGFFAPG

SEQ ID NO: 24582 - protein, 9 aa, Homo Sapiens
ENQGRCYNG

SEQ ID NO: 24583 - protein, 9 aa, Homo Sapiens
EQDNDMLEA

SEQ ID NO: 24584 - protein, 9 aa, Homo Sapiens
AEETEGPSN

SEQ ID NO: 24585 - protein, 9 aa, Homo Sapiens
DFEISGIYL

SEQ ID NO: 24586 - protein, 9 aa, Homo Sapiens
AVDTSEQER

SEQ ID NO: 24587 - protein, 9 aa, Homo Sapiens
TVSAVVDAG

SEQ ID NO: 24588 - protein, 9 aa, Homo Sapiens
AQGMEPGAD

SEQ ID NO: 24589 - protein, 9 aa, Homo Sapiens
RLACFIKRR

SEQ ID NO: 24590 - protein, 9 aa, Homo Sapiens
MEAESIYTN

SEQ ID NO: 24591 - protein, 9 aa, Homo Sapiens
KTVSAVVDA

SEQ ID NO: 24592 - protein, 9 aa, Homo Sapiens
KDQSVKFRK

SEQ ID NO: 24593 - protein, 9 aa, Homo Sapiens
FNDCGSRLS

SEQ ID NO: 24594 - protein, 9 aa, Homo Sapiens
ARNDLMSDL

SEQ ID NO: 24595 - protein, 9 aa, Homo Sapiens
LVSGQKAGP

SEQ ID NO: 24596 - protein, 9 aa, Homo Sapiens
KEVSKRFGD

SEQ ID NO: 24597 - protein, 9 aa, Homo Sapiens
HTVEKPYAC

SEQ ID NO: 24598 - protein, 9 aa, Homo Sapiens
PRFILGLPD

SEQ ID NO: 24599 - protein, 9 aa, Homo Sapiens
DKVKSSLVN

SEQ ID NO: 24600 - protein, 9 aa, Homo Sapiens
LSLHYNSLS

SEQ ID NO: 24601 - protein, 9 aa, Homo Sapiens
NDLLKEKQF

SEQ ID NO: 24602 - protein, 9 aa, Homo Sapiens
RKDGVDGLP

SEQ ID NO: 24603 - protein, 9 aa, Homo Sapiens
WKSKRFSPQ

SEQ ID NO: 24604 - protein, 9 aa, Homo Sapiens
ARDGTFTVS

SEQ ID NO: 24605 - protein, 9 aa, Homo Sapiens
SAQRSKSKS

SEQ ID NO: 24606 - protein, 9 aa, Homo Sapiens
MRLPAGRAS

SEQ ID NO: 24607 - protein, 9 aa, Homo Sapiens
MGPSAKLMA

SEQ ID NO: 24608 - protein, 9 aa, Homo Sapiens
KSRWVLLKS

SEQ ID NO: 24609 - protein, 9 aa, Homo Sapiens
MSINTFPVL

SEQ ID NO: 24610 - protein, 9 aa, Homo Sapiens
TKLVLPDEA

SEQ ID NO: 24611 - protein, 9 aa, Homo Sapiens
KYASGGEVF

SEQ ID NO: 24612 - protein, 9 aa, Homo Sapiens
HTPMCYFLT

SEQ ID NO: 24613 - protein, 9 aa, Homo Sapiens
VCLAQCGGA

SEQ ID NO: 24614 - protein, 9 aa, Homo Sapiens
SLIGTTLVG

SEQ ID NO: 24615 - protein, 9 aa, Homo Sapiens
LMNVYQHVL

SEQ ID NO: 24616 - protein, 9 aa, Homo Sapiens
LDSPRSLRT

SEQ ID NO: 24617 - protein, 9 aa, Homo Sapiens
AYLHAGIVF

SEQ ID NO: 24618 - protein, 9 aa, Homo Sapiens
CPRFILGLP

SEQ ID NO: 24619 - protein, 9 aa, Homo Sapiens
EAAVTVQLF

SEQ ID NO: 24620 - protein, 9 aa, Homo Sapiens
AAGPKGAPE

SEQ ID NO: 24621 - protein, 9 aa, Homo Sapiens
TAAGKEAPR

SEQ ID NO: 24622 - protein, 9 aa, Homo Sapiens
PKNGTIFTM

SEQ ID NO: 24623 - protein, 9 aa, Homo Sapiens
DSHCSTELT

SEQ ID NO: 24624 - protein, 9 aa, Homo Sapiens
VSSFLQEGA

SEQ ID NO: 24625 - protein, 9 aa, Homo Sapiens
QNSEIQETC

SEQ ID NO: 24626 - protein, 9 aa, Homo Sapiens
KAPETPMEE

SEQ ID NO: 24627 - protein, 9 aa, Homo Sapiens
ASYRSLSGC

SEQ ID NO: 24628 - protein, 9 aa, Homo Sapiens
FEKSGYEKD

SEQ ID NO: 24629 - protein, 9 aa, Homo Sapiens
ISLIGTTLV

SEQ ID NO: 24630 - protein, 9 aa, Homo Sapiens
YRSLSGCPR

SEQ ID NO: 24631 - protein, 9 aa, Homo Sapiens
EEEEVEEAK

SEQ ID NO: 24632 - protein, 9 aa, Homo Sapiens
PGRPGALAG

SEQ ID NO: 24633 - protein, 9 aa, Homo Sapiens
FICDNLRDP

SEQ ID NO: 24634 - protein, 9 aa, Homo Sapiens
SNEIEAIEK

SEQ ID NO: 24635 - protein, 9 aa, Homo Sapiens
ASLLPMPLS

SEQ ID NO: 24636 - protein, 9 aa, Homo Sapiens
EQPGEEKRE

SEQ ID NO: 24637 - protein, 9 aa, Homo Sapiens
SPDELKDKL

SEQ ID NO: 24638 - protein, 9 aa, Homo Sapiens
SEASVEWSS

SEQ ID NO: 24639 - protein, 9 aa, Homo Sapiens
QIIPRHLQL

SEQ ID NO: 24640 - protein, 9 aa, Homo Sapiens
QAGAVDHVR

SEQ ID NO: 24641 - protein, 9 aa, Homo Sapiens
EHQHVLSNL

SEQ ID NO: 24642 - protein, 9 aa, Homo Sapiens
RLSGNIGNL

SEQ ID NO: 24643 - protein, 9 aa, Homo Sapiens
EIDPDQLKR

SEQ ID NO: 24644 - protein, 9 aa, Homo Sapiens
KSGYEKDNE

SEQ ID NO: 24645 - protein, 9 aa, Homo Sapiens
QRKGLLTSL

SEQ ID NO: 24646 - protein, 9 aa, Homo Sapiens
AVLALCSSS

SEQ ID NO: 24647 - protein, 9 aa, Homo Sapiens
TAAQPNWNL

SEQ ID NO: 24648 - protein, 9 aa, Homo Sapiens
ASPSVSTAA

SEQ ID NO: 24649 - protein, 9 aa, Homo Sapiens
ESHDLPVHP

SEQ ID NO: 24650 - protein, 9 aa, Homo Sapiens
VQGRYPHMK

SEQ ID NO: 24651 - protein, 9 aa, Homo Sapiens
KEQVPHCIC

SEQ ID NO: 24652 - protein, 9 aa, Homo Sapiens
DSGEYKIIL

SEQ ID NO: 24653 - protein, 9 aa, Homo Sapiens
VVVPLLSKL

SEQ ID NO: 24654 - protein, 9 aa, Homo Sapiens
EKNEEKLCI

SEQ ID NO: 24655 - protein, 9 aa, Homo Sapiens
EKDNECHVT

SEQ ID NO: 24656 - protein, 9 aa, Homo Sapiens
NVKFYAPDP

SEQ ID NO: 24657 - protein, 9 aa, Homo Sapiens
VREANFLAK

SEQ ID NO: 24658 - protein, 9 aa, Homo Sapiens
ERLGRFLSP

SEQ ID NO: 24659 - protein, 9 aa, Homo Sapiens
DQHKAGYGG

SEQ ID NO: 24660 - protein, 9 aa, Homo Sapiens
STVRSPCTP

SEQ ID NO: 24661 - protein, 9 aa, Homo Sapiens
MKRERLGRF

SEQ ID NO: 24662 - protein, 9 aa, Homo Sapiens
DLASQMLNG

SEQ ID NO: 24663 - protein, 9 aa, Homo Sapiens
RGSLKVPDS

SEQ ID NO: 24664 - protein, 9 aa, Homo Sapiens
MNVCSPADQ

SEQ ID NO: 24665 - protein, 9 aa, Homo Sapiens
VCENTHGGY

SEQ ID NO: 24666 - protein, 9 aa, Homo Sapiens
PKRPSDSPS

SEQ ID NO: 24667 - protein, 9 aa, Homo Sapiens
SVAARDGTF

SEQ ID NO: 24668 - protein, 9 aa, Homo Sapiens
ETCIKSCGK

SEQ ID NO: 24669 - protein, 9 aa, Homo Sapiens
TGTPLFYPG

SEQ ID NO: 24670 - protein, 9 aa, Homo Sapiens
SNASGNFAI

SEQ ID NO: 24671 - protein, 9 aa, Homo Sapiens
LQQMLKEVS

SEQ ID NO: 24672 - protein, 9 aa, Homo Sapiens
RPGALAGSP

SEQ ID NO: 24673 - protein, 9 aa, Homo Sapiens
GEKLEKEAR

SEQ ID NO: 24674 - protein, 9 aa, Homo Sapiens
PFELYFNPH

SEQ ID NO: 24675 - protein, 9 aa, Homo Sapiens
LQQLKGLQE

SEQ ID NO: 24676 - protein, 9 aa, Homo Sapiens
SRLSAAAAA

SEQ ID NO: 24677 - protein, 9 aa, Homo Sapiens
TFFRTDLSG

SEQ ID NO: 24678 - protein, 9 aa, Homo Sapiens
SCVSENKRI

SEQ ID NO: 24679 - protein, 9 aa, Homo Sapiens
VDISVLHQG

SEQ ID NO: 24680 - protein, 9 aa, Homo Sapiens
TTSSNNTMV

SEQ ID NO: 24681 - protein, 9 aa, Homo Sapiens
ALDFTVKNV

SEQ ID NO: 24682 - protein, 9 aa, Homo Sapiens
QTNSQCLSV

SEQ ID NO: 24683 - protein, 9 aa, Homo Sapiens
QAAAGPKGA

SEQ ID NO: 24684 - protein, 9 aa, Homo Sapiens
AKLHWEDGF

SEQ ID NO: 24685 - protein, 9 aa, Homo Sapiens
AGIIWSWAV

SEQ ID NO: 24686 - protein, 9 aa, Homo Sapiens
EQVLVISLG

SEQ ID NO: 24687 - protein, 9 aa, Homo Sapiens
VSVVELYGI

SEQ ID NO: 24688 - protein, 9 aa, Homo Sapiens
MAAAWPLRD

SEQ ID NO: 24689 - protein, 9 aa, Homo Sapiens
VSLKCSIEV

SEQ ID NO: 24690 - protein, 9 aa, Homo Sapiens
QFVERKCTQ

SEQ ID NO: 24691 - protein, 9 aa, Homo Sapiens
WYRNTKLVL

SEQ ID NO: 24692 - protein, 9 aa, Homo Sapiens
HMQMLQNPD

SEQ ID NO: 24693 - protein, 9 aa, Homo Sapiens
EITCIELAE

SEQ ID NO: 24694 - protein, 9 aa, Homo Sapiens
NEPCEADKS

SEQ ID NO: 24695 - protein, 9 aa, Homo Sapiens
AEARGSLKV

SEQ ID NO: 24696 - protein, 9 aa, Homo Sapiens
RNTKLVLPD

SEQ ID NO: 24697 - protein, 9 aa, Homo Sapiens
KGIKGEELV

SEQ ID NO: 24698 - protein, 9 aa, Homo Sapiens
WASHRANWM

SEQ ID NO: 24699 - protein, 9 aa, Homo Sapiens
LTASRDHVC

SEQ ID NO: 24700 - protein, 9 aa, Homo Sapiens
VLRARNDLM

SEQ ID NO: 24701 - protein, 9 aa, Homo Sapiens
LLGFNKQCS

SEQ ID NO: 24702 - protein, 9 aa, Homo Sapiens
SEGDDYISH

SEQ ID NO: 24703 - protein, 9 aa, Homo Sapiens
PPTVSLFSF

SEQ ID NO: 24704 - protein, 9 aa, Homo Sapiens
NSPNSMSRV

SEQ ID NO: 24705 - protein, 9 aa, Homo Sapiens
GKGYFADYA

SEQ ID NO: 24706 - protein, 9 aa, Homo Sapiens
DPDQLKRLH

SEQ ID NO: 24707 - protein, 9 aa, Homo Sapiens
KNGIPSSPQ

SEQ ID NO: 24708 - protein, 9 aa, Homo Sapiens
ARDLKGRNA

SEQ ID NO: 24709 - protein, 9 aa, Homo Sapiens
PTLYIVQRP

SEQ ID NO: 24710 - protein, 9 aa, Homo Sapiens
MQNTDCCHS

SEQ ID NO: 24711 - protein, 9 aa, Homo Sapiens
NYYGLYDDR

SEQ ID NO: 24712 - protein, 9 aa, Homo Sapiens
EANFLAKEM

SEQ ID NO: 24713 - protein, 9 aa, Homo Sapiens
PAFNMQTET

SEQ ID NO: 24714 - protein, 9 aa, Homo Sapiens
WDFPKSTNF

SEQ ID NO: 24715 - protein, 9 aa, Homo Sapiens
VAPCQNSPM

SEQ ID NO: 24716 - protein, 9 aa, Homo Sapiens
QSHIGKFCL

SEQ ID NO: 24717 - protein, 9 aa, Homo Sapiens
EGAITIEPK

SEQ ID NO: 24718 - protein, 9 aa, Homo Sapiens
KFGTVSSQK

SEQ ID NO: 24719 - protein, 9 aa, Homo Sapiens
RLGKSKAPE

SEQ ID NO: 24720 - protein, 9 aa, Homo Sapiens
LKYGHYKRG

SEQ ID NO: 24721 - protein, 9 aa, Homo Sapiens
FSFNVKFYA

SEQ ID NO: 24722 - protein, 9 aa, Homo Sapiens
KECCPLWSG

SEQ ID NO: 24723 - protein, 9 aa, Homo Sapiens
DKVDISVLH

SEQ ID NO: 24724 - protein, 9 aa, Homo Sapiens
NPKAVSVVE

SEQ ID NO: 24725 - protein, 9 aa, Homo Sapiens
IISLNHVRH

SEQ ID NO: 24726 - protein, 9 aa, Homo Sapiens
LEGFHEEST

SEQ ID NO: 24727 - protein, 9 aa, Homo Sapiens
EADQVSVEG

SEQ ID NO: 24728 - protein, 9 aa, Homo Sapiens
AAWPLRDCQ

SEQ ID NO: 24729 - protein, 9 aa, Homo Sapiens
LRKALIGPL

SEQ ID NO: 24730 - protein, 9 aa, Homo Sapiens
DSCLSRKKM

SEQ ID NO: 24731 - protein, 9 aa, Homo Sapiens
FDFIQSHIG

SEQ ID NO: 24732 - protein, 9 aa, Homo Sapiens
PAELRETLI

SEQ ID NO: 24733 - protein, 9 aa, Homo Sapiens
KHSQFIAYP

SEQ ID NO: 24734 - protein, 9 aa, Homo Sapiens
FFNNLYFYD

SEQ ID NO: 24735 - protein, 9 aa, Homo Sapiens
IRLLGFNKQ

SEQ ID NO: 24736 - protein, 9 aa, Homo Sapiens
SMSRVSNNP

SEQ ID NO: 24737 - protein, 9 aa, Homo Sapiens
FLAKEMSKL

SEQ ID NO: 24738 - protein, 9 aa, Homo Sapiens
AIAVNNLAS

SEQ ID NO: 24739 - protein, 9 aa, Homo Sapiens
RDGTFTVSA

SEQ ID NO: 24740 - protein, 9 aa, Homo Sapiens
PTVSLFSFQ

SEQ ID NO: 24741 - protein, 9 aa, Homo Sapiens
TFPPVAMVP

SEQ ID NO: 24742 - protein, 9 aa, Homo Sapiens
SLDMNAFRK

SEQ ID NO: 24743 - protein, 9 aa, Homo Sapiens
RVDTAEVQK

SEQ ID NO: 24744 - protein, 9 aa, Homo Sapiens
SPELFSNTP

SEQ ID NO: 24745 - protein, 9 aa, Homo Sapiens
QFGHVMHQL

SEQ ID NO: 24746 - protein, 9 aa, Homo Sapiens
SDKAGIIWS

SEQ ID NO: 24747 - protein, 9 aa, Homo Sapiens
CEQEQRRHT

SEQ ID NO: 24748 - protein, 9 aa, Homo Sapiens
SKDDRDERE

SEQ ID NO: 24749 - protein, 9 aa, Homo Sapiens
FFDKNRTGD

SEQ ID NO: 24750 - protein, 9 aa, Homo Sapiens
INHITLLEG

SEQ ID NO: 24751 - protein, 9 aa, Homo Sapiens
ELKSSFSQS

SEQ ID NO: 24752 - protein, 9 aa, Homo Sapiens
DQDAVSNFS

SEQ ID NO: 24753 - protein, 9 aa, Homo Sapiens
TLRAVDTSE

SEQ ID NO: 24754 - protein, 9 aa, Homo Sapiens
VFIEQDNDM

SEQ ID NO: 24755 - protein, 9 aa, Homo Sapiens
AGEVVPAFL

SEQ ID NO: 24756 - protein, 9 aa, Homo Sapiens
TGCFRCIVC

SEQ ID NO: 24757 - protein, 9 aa, Homo Sapiens
ASVEWSSER

SEQ ID NO: 24758 - protein, 9 aa, Homo Sapiens
DYSLYMWSL

SEQ ID NO: 24759 - protein, 9 aa, Homo Sapiens
PTFPPVAMV

SEQ ID NO: 24760 - protein, 9 aa, Homo Sapiens
ARDNKKTQI

SEQ ID NO: 24761 - protein, 9 aa, Homo Sapiens
LQHSLPLLF

SEQ ID NO: 24762 - protein, 9 aa, Homo Sapiens
QRSVIKPSA

SEQ ID NO: 24763 - protein, 9 aa, Homo Sapiens
NDDYVQLAF

SEQ ID NO: 24764 - protein, 9 aa, Homo Sapiens
EEKSEPPAP

SEQ ID NO: 24765 - protein, 9 aa, Homo Sapiens
SSFLQEGAV

SEQ ID NO: 24766 - protein, 9 aa, Homo Sapiens
AHVYAMKIL

SEQ ID NO: 24767 - protein, 9 aa, Homo Sapiens
GATGNAEQP

SEQ ID NO: 24768 - protein, 9 aa, Homo Sapiens
TGNMGSNNK

SEQ ID NO: 24769 - protein, 9 aa, Homo Sapiens
SGIIEADQV

SEQ ID NO: 24770 - protein, 9 aa, Homo Sapiens
RKSQSQRRA

SEQ ID NO: 24771 - protein, 9 aa, Homo Sapiens
LLACASAPL

SEQ ID NO: 24772 - protein, 9 aa, Homo Sapiens
IDLSSNDIR

SEQ ID NO: 24773 - protein, 9 aa, Homo Sapiens
EDPELKSSF

SEQ ID NO: 24774 - protein, 9 aa, Homo Sapiens
SACVLNFYR

SEQ ID NO: 24775 - protein, 9 aa, Homo Sapiens
MYDYSLYMW

SEQ ID NO: 24776 - protein, 9 aa, Homo Sapiens
LLSMSINTF

SEQ ID NO: 24777 - protein, 9 aa, Homo Sapiens
NSTPPCHPD

SEQ ID NO: 24778 - protein, 9 aa, Homo Sapiens
PAQIPTVVP

SEQ ID NO: 24779 - protein, 9 aa, Homo Sapiens
PCQNSPMAR

SEQ ID NO: 24780 - protein, 9 aa, Homo Sapiens
GNMGSNNKV

SEQ ID NO: 24781 - protein, 9 aa, Homo Sapiens
HQFGHVMHQ

SEQ ID NO: 24782 - protein, 9 aa, Homo Sapiens
RNDLMSDLL

SEQ ID NO: 24783 - protein, 9 aa, Homo Sapiens
LLKSSMSFQ

SEQ ID NO: 24784 - protein, 9 aa, Homo Sapiens
KKDALRFLS

SEQ ID NO: 24785 - protein, 9 aa, Homo Sapiens
RMRRQFLAP

SEQ ID NO: 24786 - protein, 9 aa, Homo Sapiens
RHRFRVADL

SEQ ID NO: 24787 - protein, 9 aa, Homo Sapiens
LEWWHVQPT

SEQ ID NO: 24788 - protein, 9 aa, Homo Sapiens
TAEVQKVCN

SEQ ID NO: 24789 - protein, 9 aa, Homo Sapiens
RNSEPFDPF

SEQ ID NO: 24790 - protein, 9 aa, Homo Sapiens
GQCPSRGRH

SEQ ID NO: 24791 - protein, 9 aa, Homo Sapiens
DYVQLAFNA

SEQ ID NO: 24792 - protein, 9 aa, Homo Sapiens
ETKPFKCNE

SEQ ID NO: 24793 - protein, 9 aa, Homo Sapiens
GSNTIKPDV

SEQ ID NO: 24794 - protein, 9 aa, Homo Sapiens
GLPDAGKAH

SEQ ID NO: 24795 - protein, 9 aa, Homo Sapiens
IETTEKKTI

SEQ ID NO: 24796 - protein, 9 aa, Homo Sapiens
VPVRGRTTS

SEQ ID NO: 24797 - protein, 9 aa, Homo Sapiens
LAYYFECND

SEQ ID NO: 24798 - protein, 9 aa, Homo Sapiens
QGSYDEQYA

SEQ ID NO: 24799 - protein, 9 aa, Homo Sapiens
HLAPDCPAP

SEQ ID NO: 24800 - protein, 9 aa, Homo Sapiens
ALELVEPVK

SEQ ID NO: 24801 - protein, 9 aa, Homo Sapiens
ALPEKPAVH

SEQ ID NO: 24802 - protein, 9 aa, Homo Sapiens
VHIDKIEQQ

SEQ ID NO: 24803 - protein, 9 aa, Homo Sapiens
LYMWSLGCM

SEQ ID NO: 24804 - protein, 9 aa, Homo Sapiens
TMATFTMML

SEQ ID NO: 24805 - protein, 9 aa, Homo Sapiens
ECNDTFQVH

SEQ ID NO: 24806 - protein, 9 aa, Homo Sapiens
AARDLKGRN

SEQ ID NO: 24807 - protein, 9 aa, Homo Sapiens
SPPSPAPKN

SEQ ID NO: 24808 - protein, 9 aa, Homo Sapiens
SCLKYGHYK

SEQ ID NO: 24809 - protein, 9 aa, Homo Sapiens
TGHFTLAED

SEQ ID NO: 24810 - protein, 9 aa, Homo Sapiens
MSNLSQGDA

SEQ ID NO: 24811 - protein, 9 aa, Homo Sapiens
SSNDIRKSV

SEQ ID NO: 24812 - protein, 9 aa, Homo Sapiens
LASCVSENK

SEQ ID NO: 24813 - protein, 9 aa, Homo Sapiens
PGTPGMQEP

SEQ ID NO: 24814 - protein, 9 aa, Homo Sapiens
PPAKFSSGQ

SEQ ID NO: 24815 - protein, 9 aa, Homo Sapiens
YGHYKRGIL

SEQ ID NO: 24816 - protein, 9 aa, Homo Sapiens
IFIPNPRTL

SEQ ID NO: 24817 - protein, 9 aa, Homo Sapiens
SPSSKDDRD

SEQ ID NO: 24818 - protein, 9 aa, Homo Sapiens
EAEARGSLK

SEQ ID NO: 24819 - protein, 9 aa, Homo Sapiens
SGQKAGPHR

SEQ ID NO: 24820 - protein, 9 aa, Homo Sapiens
TKPASMPKN

SEQ ID NO: 24821 - protein, 9 aa, Homo Sapiens
CKDNFVNSK

SEQ ID NO: 24822 - protein, 9 aa, Homo Sapiens
KRKLIHTRE

SEQ ID NO: 24823 - protein, 9 aa, Homo Sapiens
VLETCIKSC

SEQ ID NO: 24824 - protein, 9 aa, Homo Sapiens
APCQNSPMA

SEQ ID NO: 24825 - protein, 9 aa, Homo Sapiens
FSGMGPSAK

SEQ ID NO: 24826 - protein, 9 aa, Homo Sapiens
QQPGWQSSG

SEQ ID NO: 24827 - protein, 9 aa, Homo Sapiens
VLALCSSSC

SEQ ID NO: 24828 - protein, 9 aa, Homo Sapiens
EPEGPIINH

SEQ ID NO: 24829 - protein, 9 aa, Homo Sapiens
MATFTMMLA

SEQ ID NO: 24830 - protein, 9 aa, Homo Sapiens
ENTHGGYRC

SEQ ID NO: 24831 - protein, 9 aa, Homo Sapiens
QHKAGYGGS

SEQ ID NO: 24832 - protein, 9 aa, Homo Sapiens
GLDMLFKVV

SEQ ID NO: 24833 - protein, 9 aa, Homo Sapiens
SSPTFPPVA

SEQ ID NO: 24834 - protein, 9 aa, Homo Sapiens
KIRKLVCEK

SEQ ID NO: 24835 - protein, 9 aa, Homo Sapiens
VQSTVLANP

SEQ ID NO: 24836 - protein, 9 aa, Homo Sapiens
KKMEALSVR

SEQ ID NO: 24837 - protein, 9 aa, Homo Sapiens
YQMYDYSLY

SEQ ID NO: 24838 - protein, 9 aa, Homo Sapiens
SHVTQDIAL

SEQ ID NO: 24839 - protein, 9 aa, Homo Sapiens
TDEASAQLL

SEQ ID NO: 24840 - protein, 9 aa, Homo Sapiens
YLDKEKRKR

SEQ ID NO: 24841 - protein, 9 aa, Homo Sapiens
KEEAPLREQ

SEQ ID NO: 24842 - protein, 9 aa, Homo Sapiens
RPIPECGTY

SEQ ID NO: 24843 - protein, 9 aa, Homo Sapiens
FNNLYFYDA

SEQ ID NO: 24844 - protein, 9 aa, Homo Sapiens
LFGRKFLVN

SEQ ID NO: 24845 - protein, 9 aa, Homo Sapiens
PGSNTIKPD

SEQ ID NO: 24846 - protein, 9 aa, Homo Sapiens
CFWPNAEVY

SEQ ID NO: 24847 - protein, 9 aa, Homo Sapiens
PMCYFLTNL

SEQ ID NO: 24848 - protein, 9 aa, Homo Sapiens
LDMNAFRKE

SEQ ID NO: 24849 - protein, 9 aa, Homo Sapiens
DHVVVPLLS

SEQ ID NO: 24850 - protein, 9 aa, Homo Sapiens
SWIAVLALC

SEQ ID NO: 24851 - protein, 9 aa, Homo Sapiens
IVFKSYECR

SEQ ID NO: 24852 - protein, 9 aa, Homo Sapiens
IVSDVQESL

SEQ ID NO: 24853 - protein, 9 aa, Homo Sapiens
FTVKNVEKA

SEQ ID NO: 24854 - protein, 9 aa, Homo Sapiens
ANWMKAVQM

SEQ ID NO: 24855 - protein, 9 aa, Homo Sapiens
MERLAFMEL

SEQ ID NO: 24856 - protein, 9 aa, Homo Sapiens
HRNYLLESR

SEQ ID NO: 24857 - protein, 9 aa, Homo Sapiens
YACNENQGR

SEQ ID NO: 24858 - protein, 9 aa, Homo Sapiens
CVTGHFTLA

SEQ ID NO: 24859 - protein, 9 aa, Homo Sapiens
SPPVRYLSP

SEQ ID NO: 24860 - protein, 9 aa, Homo Sapiens
NSMSRVSNN

SEQ ID NO: 24861 - protein, 9 aa, Homo Sapiens
DPGFAESWG

SEQ ID NO: 24862 - protein, 9 aa, Homo Sapiens
FIKRRKHQN

SEQ ID NO: 24863 - protein, 9 aa, Homo Sapiens
IIQTAIDQF

SEQ ID NO: 24864 - protein, 9 aa, Homo Sapiens
LLTDFDFQG

SEQ ID NO: 24865 - protein, 9 aa, Homo Sapiens
SISHKATAC

SEQ ID NO: 24866 - protein, 9 aa, Homo Sapiens
LLLKVKRSK

SEQ ID NO: 24867 - protein, 9 aa, Homo Sapiens
EGSRMNVSR

SEQ ID NO: 24868 - protein, 9 aa, Homo Sapiens
GRSKIFIPN

SEQ ID NO: 24869 - protein, 9 aa, Homo Sapiens
MRGHRRRLL

SEQ ID NO: 24870 - protein, 9 aa, Homo Sapiens
SAKLMASTS

SEQ ID NO: 24871 - protein, 9 aa, Homo Sapiens
LQSDKNGIP

SEQ ID NO: 24872 - protein, 9 aa, Homo Sapiens
SRWVLLKSI

SEQ ID NO: 24873 - protein, 9 aa, Homo Sapiens
KQDGGKGHV

SEQ ID NO: 24874 - protein, 9 aa, Homo Sapiens
LSQRACSPV

SEQ ID NO: 24875 - protein, 9 aa, Homo Sapiens
ERLAFMELD

SEQ ID NO: 24876 - protein, 9 aa, Homo Sapiens
SDQHKAGYG

SEQ ID NO: 24877 - protein, 9 aa, Homo Sapiens
TEGTLLSVI

SEQ ID NO: 24878 - protein, 9 aa, Homo Sapiens
VLRNESLES

SEQ ID NO: 24879 - protein, 9 aa, Homo Sapiens
LLATASQMR

SEQ ID NO: 24880 - protein, 9 aa, Homo Sapiens
SLLLPSVGY

SEQ ID NO: 24881 - protein, 9 aa, Homo Sapiens
LKKRKLIHT

SEQ ID NO: 24882 - protein, 9 aa, Homo Sapiens
KTIALLFEL

SEQ ID NO: 24883 - protein, 9 aa, Homo Sapiens
EDAPPAKFS

SEQ ID NO: 24884 - protein, 9 aa, Homo Sapiens
DSPFCVLLF

SEQ ID NO: 24885 - protein, 9 aa, Homo Sapiens
EVLKTVSAV

SEQ ID NO: 24886 - protein, 9 aa, Homo Sapiens
EQGKTISNN

SEQ ID NO: 24887 - protein, 9 aa, Homo Sapiens
CYFLTNLSF

SEQ ID NO: 24888 - protein, 9 aa, Homo Sapiens
EVSKRFGDE

SEQ ID NO: 24889 - protein, 9 aa, Homo Sapiens
THGGYRCAC

SEQ ID NO: 24890 - protein, 9 aa, Homo Sapiens
VGGKRVDTA

SEQ ID NO: 24891 - protein, 9 aa, Homo Sapiens
FLCFCRLLS

SEQ ID NO: 24892 - protein, 9 aa, Homo Sapiens
GWDFPKSTN

SEQ ID NO: 24893 - protein, 9 aa, Homo Sapiens
RMLDMGFKP

SEQ ID NO: 24894 - protein, 9 aa, Homo Sapiens
VLEEFVPEV

SEQ ID NO: 24895 - protein, 9 aa, Homo Sapiens
ISHCHPPDQ

SEQ ID NO: 24896 - protein, 9 aa, Homo Sapiens
KKNEYLQGL

SEQ ID NO: 24897 - protein, 9 aa, Homo Sapiens
QELGTQATI

SEQ ID NO: 24898 - protein, 9 aa, Homo Sapiens
NFAIRLLKI

SEQ ID NO: 24899 - protein, 9 aa, Homo Sapiens
RANLTSILI

SEQ ID NO: 24900 - protein, 9 aa, Homo Sapiens
YLHAGIVFK

SEQ ID NO: 24901 - protein, 9 aa, Homo Sapiens
LLETKSKIK

SEQ ID NO: 24902 - protein, 9 aa, Homo Sapiens
QEAKLECEQ

SEQ ID NO: 24903 - protein, 9 aa, Homo Sapiens
VPVEKEQVP

SEQ ID NO: 24904 - protein, 9 aa, Homo Sapiens
HAYMMNVCS

SEQ ID NO: 24905 - protein, 9 aa, Homo Sapiens
NVEVYSCCT

SEQ ID NO: 24906 - protein, 9 aa, Homo Sapiens
EIEAIEKAV

SEQ ID NO: 24907 - protein, 9 aa, Homo Sapiens
QEKLSKEER

SEQ ID NO: 24908 - protein, 9 aa, Homo Sapiens
LLKSIDLVS

SEQ ID NO: 24909 - protein, 9 aa, Homo Sapiens
SDCTTGSSR

SEQ ID NO: 24910 - protein, 9 aa, Homo Sapiens
GKQDGGKGH

SEQ ID NO: 24911 - protein, 9 aa, Homo Sapiens
SGLLGLSLH

SEQ ID NO: 24912 - protein, 9 aa, Homo Sapiens
AESIYTNDP

SEQ ID NO: 24913 - protein, 9 aa, Homo Sapiens
DSCLKYGHY

SEQ ID NO: 24914 - protein, 9 aa, Homo Sapiens
LHHLMCTRK

SEQ ID NO: 24915 - protein, 9 aa, Homo Sapiens
RTTSAGGNT

SEQ ID NO: 24916 - protein, 9 aa, Homo Sapiens
GNDDYVQLA

SEQ ID NO: 24917 - protein, 9 aa, Homo Sapiens
FTLENYVKN

SEQ ID NO: 24918 - protein, 9 aa, Homo Sapiens
FDKNRTGDL

SEQ ID NO: 24919 - protein, 9 aa, Homo Sapiens
QMHQQQQQQ

SEQ ID NO: 24920 - protein, 9 aa, Homo Sapiens
GPEDPSLLV

SEQ ID NO: 24921 - protein, 9 aa, Homo Sapiens
LNYATRLGR

SEQ ID NO: 24922 - protein, 9 aa, Homo Sapiens
ENWSLRANK

SEQ ID NO: 24923 - protein, 9 aa, Homo Sapiens
NSTRYNTEL

SEQ ID NO: 24924 - protein, 9 aa, Homo Sapiens
RQRLKERTG

SEQ ID NO: 24925 - protein, 9 aa, Homo Sapiens
SGIYLDKEK

SEQ ID NO: 24926 - protein, 9 aa, Homo Sapiens
GAVAPCQNS

SEQ ID NO: 24927 - protein, 9 aa, Homo Sapiens
QLTYNPDEL

SEQ ID NO: 24928 - protein, 9 aa, Homo Sapiens
TQSGDAFHG

SEQ ID NO: 24929 - protein, 9 aa, Homo Sapiens
HVTQDIALK

SEQ ID NO: 24930 - protein, 9 aa, Homo Sapiens
SRVSNNPQG

SEQ ID NO: 24931 - protein, 9 aa, Homo Sapiens
IAGRESRPH

SEQ ID NO: 24932 - protein, 9 aa, Homo Sapiens
NALDLKFNM

SEQ ID NO: 24933 - protein, 9 aa, Homo Sapiens
GGTAWLEWW

SEQ ID NO: 24934 - protein, 9 aa, Homo Sapiens
EETEGPSNG

SEQ ID NO: 24935 - protein, 9 aa, Homo Sapiens
KGWLSLHAG

SEQ ID NO: 24936 - protein, 9 aa, Homo Sapiens
IENGNVTVE

SEQ ID NO: 24937 - protein, 9 aa, Homo Sapiens
RRVASDGGA

SEQ ID NO: 24938 - protein, 9 aa, Homo Sapiens
DTEKLSAGE

SEQ ID NO: 24939 - protein, 9 aa, Homo Sapiens
KALIGPLGK

SEQ ID NO: 24940 - protein, 9 aa, Homo Sapiens
EARGSLKVP

SEQ ID NO: 24941 - protein, 9 aa, Homo Sapiens
YLVLLNIFT

SEQ ID NO: 24942 - protein, 9 aa, Homo Sapiens
RPICIATDN

SEQ ID NO: 24943 - protein, 9 aa, Homo Sapiens
RDNVRIPGM

SEQ ID NO: 24944 - protein, 9 aa, Homo Sapiens
PVTLQELWC

SEQ ID NO: 24945 - protein, 9 aa, Homo Sapiens
VQKKDTAHV

SEQ ID NO: 24946 - protein, 9 aa, Homo Sapiens
VSTVPECAT

SEQ ID NO: 24947 - protein, 9 aa, Homo Sapiens
LFLSPPSPA

SEQ ID NO: 24948 - protein, 9 aa, Homo Sapiens
TVENPEDPQ

SEQ ID NO: 24949 - protein, 9 aa, Homo Sapiens
RDLKGRNAA

SEQ ID NO: 24950 - protein, 9 aa, Homo Sapiens
SLEITCIEL

SEQ ID NO: 24951 - protein, 9 aa, Homo Sapiens
LMSDLLSEA

SEQ ID NO: 24952 - protein, 9 aa, Homo Sapiens
EEEVEEAKY

SEQ ID NO: 24953 - protein, 9 aa, Homo Sapiens
LVVLLSMSI

SEQ ID NO: 24954 - protein, 9 aa, Homo Sapiens
VEKIQGTQQ

SEQ ID NO: 24955 - protein, 9 aa, Homo Sapiens
TDDDAVSKM

SEQ ID NO: 24956 - protein, 9 aa, Homo Sapiens
ENKRISLAG

SEQ ID NO: 24957 - protein, 9 aa, Homo Sapiens
AVAPCQNSP

SEQ ID NO: 24958 - protein, 9 aa, Homo Sapiens
KYMDRSLDM

SEQ ID NO: 24959 - protein, 9 aa, Homo Sapiens
VENKDAVAF

SEQ ID NO: 24960 - protein, 9 aa, Homo Sapiens
PLIPLVPVS

SEQ ID NO: 24961 - protein, 9 aa, Homo Sapiens
QRSKSKSSS

SEQ ID NO: 24962 - protein, 9 aa, Homo Sapiens
LRTITHIVF

SEQ ID NO: 24963 - protein, 9 aa, Homo Sapiens
KGDSVEKIQ

SEQ ID NO: 24964 - protein, 9 aa, Homo Sapiens
HNQEVKRAL

SEQ ID NO: 24965 - protein, 9 aa, Homo Sapiens
GPTASGNLI

SEQ ID NO: 24966 - protein, 9 aa, Homo Sapiens
QVPLLLKVK

SEQ ID NO: 24967 - protein, 9 aa, Homo Sapiens
VEKEQVPHC

SEQ ID NO: 24968 - protein, 9 aa, Homo Sapiens
LVEQKELKE

SEQ ID NO: 24969 - protein, 9 aa, Homo Sapiens
PWHSPTEDN

SEQ ID NO: 24970 - protein, 9 aa, Homo Sapiens
YNPDELSKP

SEQ ID NO: 24971 - protein, 9 aa, Homo Sapiens
SLVGSFIKS

SEQ ID NO: 24972 - protein, 9 aa, Homo Sapiens
LSGNDDYVQ

SEQ ID NO: 24973 - protein, 9 aa, Homo Sapiens
QCFRERCGF

SEQ ID NO: 24974 - protein, 9 aa, Homo Sapiens
TKCFQVPQQ

SEQ ID NO: 24975 - protein, 9 aa, Homo Sapiens
QRIMRELRN

SEQ ID NO: 24976 - protein, 9 aa, Homo Sapiens
FECNDTFQV

SEQ ID NO: 24977 - protein, 9 aa, Homo Sapiens
APRARPDHT

SEQ ID NO: 24978 - protein, 9 aa, Homo Sapiens
VNEMSNLSQ

SEQ ID NO: 24979 - protein, 9 aa, Homo Sapiens
KPYACKTCR

SEQ ID NO: 24980 - protein, 9 aa, Homo Sapiens
KERTGPAGP

SEQ ID NO: 24981 - protein, 9 aa, Homo Sapiens
FSYDFFLPV

SEQ ID NO: 24982 - protein, 9 aa, Homo Sapiens
TRYNTELCR

SEQ ID NO: 24983 - protein, 9 aa, Homo Sapiens
KNFDRDNVR

SEQ ID NO: 24984 - protein, 9 aa, Homo Sapiens
VPLTLEDLK

SEQ ID NO: 24985 - protein, 9 aa, Homo Sapiens
FTMSPVLLL

SEQ ID NO: 24986 - protein, 9 aa, Homo Sapiens
SRPRRVASD

SEQ ID NO: 24987 - protein, 9 aa, Homo Sapiens
ALMRGHRRR

SEQ ID NO: 24988 - protein, 9 aa, Homo Sapiens
LECKIRKLV

SEQ ID NO: 24989 - protein, 9 aa, Homo Sapiens
AGPEAPGGL

SEQ ID NO: 24990 - protein, 9 aa, Homo Sapiens
NKVGDFVAT

SEQ ID NO: 24991 - protein, 9 aa, Homo Sapiens
DFWGLVFYS

SEQ ID NO: 24992 - protein, 9 aa, Homo Sapiens
PVRAEFRQH

SEQ ID NO: 24993 - protein, 9 aa, Homo Sapiens
KAPLCPGPP

SEQ ID NO: 24994 - protein, 9 aa, Homo Sapiens
TDTHWVGAW

SEQ ID NO: 24995 - protein, 9 aa, Homo Sapiens
LNLSMNPLA

SEQ ID NO: 24996 - protein, 9 aa, Homo Sapiens
YVCLHAHAH

SEQ ID NO: 24997 - protein, 9 aa, Homo Sapiens
ESSSTSVHP

SEQ ID NO: 24998 - protein, 9 aa, Homo Sapiens
IYNFCSKPW

SEQ ID NO: 24999 - protein, 9 aa, Homo Sapiens
SSQTDFLTP

SEQ ID NO: 25000 - protein, 9 aa, Homo Sapiens
EIIAGRESR

SEQ ID NO: 25001 - protein, 9 aa, Homo Sapiens
FRTIDLSNN

SEQ ID NO: 25002 - protein, 9 aa, Homo Sapiens
WMKAVQMCS

SEQ ID NO: 25003 - protein, 9 aa, Homo Sapiens
EKLEKEARS

SEQ ID NO: 25004 - protein, 9 aa, Homo Sapiens
KHLTNSACH

SEQ ID NO: 25005 - protein, 9 aa, Homo Sapiens
VTATGTNRG

SEQ ID NO: 25006 - protein, 9 aa, Homo Sapiens
AAQPNWNLD

SEQ ID NO: 25007 - protein, 9 aa, Homo Sapiens
SQNTVKQSS

SEQ ID NO: 25008 - protein, 9 aa, Homo Sapiens
LEPEGPIIN

SEQ ID NO: 25009 - protein, 9 aa, Homo Sapiens
NLAVITDHV

SEQ ID NO: 25010 - protein, 9 aa, Homo Sapiens
SLSLPGSDC

SEQ ID NO: 25011 - protein, 9 aa, Homo Sapiens
AVDHVRLLV

SEQ ID NO: 25012 - protein, 9 aa, Homo Sapiens
SPNSMSRVS

SEQ ID NO: 25013 - protein, 9 aa, Homo Sapiens
PCYTCVCRQ

SEQ ID NO: 25014 - protein, 9 aa, Homo Sapiens
KAKFHVPSF

SEQ ID NO: 25015 - protein, 9 aa, Homo Sapiens
SDFAKQFLQ

SEQ ID NO: 25016 - protein, 9 aa, Homo Sapiens
LAPNLKAGR

SEQ ID NO: 25017 - protein, 9 aa, Homo Sapiens
DAVSKMKMG

SEQ ID NO: 25018 - protein, 9 aa, Homo Sapiens
RSVTSSSFS

SEQ ID NO: 25019 - protein, 9 aa, Homo Sapiens
KQFVERKCT

SEQ ID NO: 25020 - protein, 9 aa, Homo Sapiens
GKGPPWANC

SEQ ID NO: 25021 - protein, 9 aa, Homo Sapiens
AVSKMKMGR

SEQ ID NO: 25022 - protein, 9 aa, Homo Sapiens
KLIDLSSND

SEQ ID NO: 25023 - protein, 9 aa, Homo Sapiens
RRHMPPEVY

SEQ ID NO: 25024 - protein, 9 aa, Homo Sapiens
ESFLEGFHE

SEQ ID NO: 25025 - protein, 9 aa, Homo Sapiens
LSMNPLAMR

SEQ ID NO: 25026 - protein, 9 aa, Homo Sapiens
APKMPKFIL

SEQ ID NO: 25027 - protein, 9 aa, Homo Sapiens
SGILNQSQI

SEQ ID NO: 25028 - protein, 9 aa, Homo Sapiens
PFCVLLFGS

SEQ ID NO: 25029 - protein, 9 aa, Homo Sapiens
ISNNDDVQK

SEQ ID NO: 25030 - protein, 9 aa, Homo Sapiens
FHSLHFLNF

SEQ ID NO: 25031 - protein, 9 aa, Homo Sapiens
HLMCTRKRH

SEQ ID NO: 25032 - protein, 9 aa, Homo Sapiens
NHYFYEIIT

SEQ ID NO: 25033 - protein, 9 aa, Homo Sapiens
MGKSYHTGC

SEQ ID NO: 25034 - protein, 9 aa, Homo Sapiens
YGIRLLGFN

SEQ ID NO: 25035 - protein, 9 aa, Homo Sapiens
SQRRAGQLI

SEQ ID NO: 25036 - protein, 9 aa, Homo Sapiens
RLQEAKLEC

SEQ ID NO: 25037 - protein, 9 aa, Homo Sapiens
VIHTETKPF

SEQ ID NO: 25038 - protein, 9 aa, Homo Sapiens
LAVITDHVV

SEQ ID NO: 25039 - protein, 9 aa, Homo Sapiens
PHERCFLGN

SEQ ID NO: 25040 - protein, 9 aa, Homo Sapiens
LLLPSVGYN

SEQ ID NO: 25041 - protein, 9 aa, Homo Sapiens
EASVEWSSE

SEQ ID NO: 25042 - protein, 9 aa, Homo Sapiens
CPSRGRHGS

SEQ ID NO: 25043 - protein, 9 aa, Homo Sapiens
SSNNTMVAP

SEQ ID NO: 25044 - protein, 9 aa, Homo Sapiens
SERRSPSSK

SEQ ID NO: 25045 - protein, 9 aa, Homo Sapiens
FEVRVCAFP

SEQ ID NO: 25046 - protein, 9 aa, Homo Sapiens
DNINAFDKK

SEQ ID NO: 25047 - protein, 9 aa, Homo Sapiens
SLYMWSLGC

SEQ ID NO: 25048 - protein, 9 aa, Homo Sapiens
CNIEPHERC

SEQ ID NO: 25049 - protein, 9 aa, Homo Sapiens
SNPVENKDA

SEQ ID NO: 25050 - protein, 9 aa, Homo Sapiens
KLTSNFRTI

SEQ ID NO: 25051 - protein, 9 aa, Homo Sapiens
QPGEEKREH

SEQ ID NO: 25052 - protein, 9 aa, Homo Sapiens
DEQRKGLLT

SEQ ID NO: 25053 - protein, 9 aa, Homo Sapiens
DQSVKFRKL

SEQ ID NO: 25054 - protein, 9 aa, Homo Sapiens
VVLLSMSIN

SEQ ID NO: 25055 - protein, 9 aa, Homo Sapiens
LYQGMFSYD

SEQ ID NO: 25056 - protein, 9 aa, Homo Sapiens
VMEMSDNPG

SEQ ID NO: 25057 - protein, 9 aa, Homo Sapiens
HKHRELDRS

SEQ ID NO: 25058 - protein, 9 aa, Homo Sapiens
ATAALHPAL

SEQ ID NO: 25059 - protein, 9 aa, Homo Sapiens
PLGIRLSDE

SEQ ID NO: 25060 - protein, 9 aa, Homo Sapiens
SLRLGKSKA

SEQ ID NO: 25061 - protein, 9 aa, Homo Sapiens
QEGNHYFYE

SEQ ID NO: 25062 - protein, 9 aa, Homo Sapiens
VSKRFGDER

SEQ ID NO: 25063 - protein, 9 aa, Homo Sapiens
ELFNENPVF

SEQ ID NO: 25064 - protein, 9 aa, Homo Sapiens
ELWCPCPHI

SEQ ID NO: 25065 - protein, 9 aa, Homo Sapiens
LESVLQQLK

SEQ ID NO: 25066 - protein, 9 aa, Homo Sapiens
LFDKKRSER

SEQ ID NO: 25067 - protein, 9 aa, Homo Sapiens
EKPAVHTKV

SEQ ID NO: 25068 - protein, 9 aa, Homo Sapiens
KHSKKGPTA

SEQ ID NO: 25069 - protein, 9 aa, Homo Sapiens
VLGGYERRE

SEQ ID NO: 25070 - protein, 9 aa, Homo Sapiens
VLHQGENLF

SEQ ID NO: 25071 - protein, 9 aa, Homo Sapiens
RLPAGRASL

SEQ ID NO: 25072 - protein, 9 aa, Homo Sapiens
EKSGYEKDN

SEQ ID NO: 25073 - protein, 9 aa, Homo Sapiens
QCKAKFHVP

SEQ ID NO: 25074 - protein, 9 aa, Homo Sapiens
KTDEASAQL

SEQ ID NO: 25075 - protein, 9 aa, Homo Sapiens
SIYTNDPTV

SEQ ID NO: 25076 - protein, 9 aa, Homo Sapiens
AAAAATAAL

SEQ ID NO: 25077 - protein, 9 aa, Homo Sapiens
EVAFDHMKV

SEQ ID NO: 25078 - protein, 9 aa, Homo Sapiens
QVPHCICAN

SEQ ID NO: 25079 - protein, 9 aa, Homo Sapiens
NDCGSRLSG

SEQ ID NO: 25080 - protein, 9 aa, Homo Sapiens
LLRISTITE

SEQ ID NO: 25081 - protein, 9 aa, Homo Sapiens
DTAEVQKVC

SEQ ID NO: 25082 - protein, 9 aa, Homo Sapiens
LLAYYFECN

SEQ ID NO: 25083 - protein, 9 aa, Homo Sapiens
IAYPITLFV

SEQ ID NO: 25084 - protein, 9 aa, Homo Sapiens
RFNLDSHCS

SEQ ID NO: 25085 - protein, 9 aa, Homo Sapiens
MMNVCSPAD

SEQ ID NO: 25086 - protein, 9 aa, Homo Sapiens
EEVPVRGRT

SEQ ID NO: 25087 - protein, 9 aa, Homo Sapiens
EMSDNPGVH

SEQ ID NO: 25088 - protein, 9 aa, Homo Sapiens
ALGGGDELE

SEQ ID NO: 25089 - protein, 9 aa, Homo Sapiens
MSRVSNNPQ

SEQ ID NO: 25090 - protein, 9 aa, Homo Sapiens
FFRTDLSGY

SEQ ID NO: 25091 - protein, 9 aa, Homo Sapiens
YLPVTPKAW

SEQ ID NO: 25092 - protein, 9 aa, Homo Sapiens
EVKEVVSHK

SEQ ID NO: 25093 - protein, 9 aa, Homo Sapiens
KFTLENYVK

SEQ ID NO: 25094 - protein, 9 aa, Homo Sapiens
STAAQPNWN

SEQ ID NO: 25095 - protein, 9 aa, Homo Sapiens
SGRIYYCKH

SEQ ID NO: 25096 - protein, 9 aa, Homo Sapiens
LRFLSPFWR

SEQ ID NO: 25097 - protein, 9 aa, Homo Sapiens
QLKRLHTFG

SEQ ID NO: 25098 - protein, 9 aa, Homo Sapiens
TSVHPSDPV

SEQ ID NO: 25099 - protein, 9 aa, Homo Sapiens
EKTLYLVMK

SEQ ID NO: 25100 - protein, 9 aa, Homo Sapiens
MSKISKAVK

SEQ ID NO: 25101 - protein, 9 aa, Homo Sapiens
KPGSNTIKP

SEQ ID NO: 25102 - protein, 9 aa, Homo Sapiens
IAAGKTIAL

SEQ ID NO: 25103 - protein, 9 aa, Homo Sapiens
AESSSTSVH

SEQ ID NO: 25104 - protein, 9 aa, Homo Sapiens
DKNRTGDLI

SEQ ID NO: 25105 - protein, 9 aa, Homo Sapiens
LETKSKIKH

SEQ ID NO: 25106 - protein, 9 aa, Homo Sapiens
QKKDTAHVY

SEQ ID NO: 25107 - protein, 9 aa, Homo Sapiens
YISHCHPPD

SEQ ID NO: 25108 - protein, 9 aa, Homo Sapiens
FLAKLHWED

SEQ ID NO: 25109 - protein, 9 aa, Homo Sapiens
FPGTPGMQE

SEQ ID NO: 25110 - protein, 9 aa, Homo Sapiens
CRSEPDIPE

SEQ ID NO: 25111 - protein, 9 aa, Homo Sapiens
LLENPEKIW

SEQ ID NO: 25112 - protein, 9 aa, Homo Sapiens
PAVNSLYSI

SEQ ID NO: 25113 - protein, 9 aa, Homo Sapiens
YFKEEVKQE

SEQ ID NO: 25114 - protein, 9 aa, Homo Sapiens
MAAPRARPD

SEQ ID NO: 25115 - protein, 9 aa, Homo Sapiens
MFSYDFFLP

SEQ ID NO: 25116 - protein, 9 aa, Homo Sapiens
PKFILYAFH

SEQ ID NO: 25117 - protein, 9 aa, Homo Sapiens
HRPIPECGT

SEQ ID NO: 25118 - protein, 9 aa, Homo Sapiens
QMGYLTIGG

SEQ ID NO: 25119 - protein, 9 aa, Homo Sapiens
FFAPGHGPR

SEQ ID NO: 25120 - protein, 9 aa, Homo Sapiens
QQGSGSGQC

SEQ ID NO: 25121 - protein, 9 aa, Homo Sapiens
YPGTPRNRM

SEQ ID NO: 25122 - protein, 9 aa, Homo Sapiens
PNPRTLFKL

SEQ ID NO: 25123 - protein, 9 aa, Homo Sapiens
KWGKQDGGK

SEQ ID NO: 25124 - protein, 9 aa, Homo Sapiens
WVDTKRTPG

SEQ ID NO: 25125 - protein, 9 aa, Homo Sapiens
VSGQKAGPH

SEQ ID NO: 25126 - protein, 9 aa, Homo Sapiens
SNYVYLVSE

SEQ ID NO: 25127 - protein, 9 aa, Homo Sapiens
QEPPGERGL

SEQ ID NO: 25128 - protein, 9 aa, Homo Sapiens
RANKPKQEP

SEQ ID NO: 25129 - protein, 9 aa, Homo Sapiens
MQPTAAGKE

SEQ ID NO: 25130 - protein, 9 aa, Homo Sapiens
AYDITFNPD

SEQ ID NO: 25131 - protein, 9 aa, Homo Sapiens
NWSLRANKP

SEQ ID NO: 25132 - protein, 9 aa, Homo Sapiens
VGWILTTKC

SEQ ID NO: 25133 - protein, 9 aa, Homo Sapiens
DTAHVYAMK

SEQ ID NO: 25134 - protein, 9 aa, Homo Sapiens
QATIHLTAF

SEQ ID NO: 25135 - protein, 9 aa, Homo Sapiens
EGNHYFYEI

SEQ ID NO: 25136 - protein, 9 aa, Homo Sapiens
HTETKPFKC

SEQ ID NO: 25137 - protein, 9 aa, Homo Sapiens
SVKSLQRQW

SEQ ID NO: 25138 - protein, 9 aa, Homo Sapiens
IQEVQPEQV

SEQ ID NO: 25139 - protein, 9 aa, Homo Sapiens
PGGGDVSLT

SEQ ID NO: 25140 - protein, 9 aa, Homo Sapiens
PAWQHRQYV

SEQ ID NO: 25141 - protein, 9 aa, Homo Sapiens
NNKVGDFVA

SEQ ID NO: 25142 - protein, 9 aa, Homo Sapiens
KKLIDLSSN

SEQ ID NO: 25143 - protein, 9 aa, Homo Sapiens
VYIYSPKYV

SEQ ID NO: 25144 - protein, 9 aa, Homo Sapiens
PCEADKSHP

SEQ ID NO: 25145 - protein, 9 aa, Homo Sapiens
KKMKKTESG

SEQ ID NO: 25146 - protein, 9 aa, Homo Sapiens
SCLSRKKMK

SEQ ID NO: 25147 - protein, 9 aa, Homo Sapiens
SVTPIDVLW

SEQ ID NO: 25148 - protein, 9 aa, Homo Sapiens
DNVVSSTVT

SEQ ID NO: 25149 - protein, 9 aa, Homo Sapiens
MARQKSGNQ

SEQ ID NO: 25150 - protein, 9 aa, Homo Sapiens
TEGPSNGES

SEQ ID NO: 25151 - protein, 9 aa, Homo Sapiens
NYASYRSLS

SEQ ID NO: 25152 - protein, 9 aa, Homo Sapiens
VPILKPMGL

SEQ ID NO: 25153 - protein, 9 aa, Homo Sapiens
YSGILNQSQ

SEQ ID NO: 25154 - protein, 9 aa, Homo Sapiens
LEKEARSLY

SEQ ID NO: 25155 - protein, 9 aa, Homo Sapiens
EPFDPFDLF

SEQ ID NO: 25156 - protein, 9 aa, Homo Sapiens
DPLPQVQAV

SEQ ID NO: 25157 - protein, 9 aa, Homo Sapiens
GAVDHVRLL

SEQ ID NO: 25158 - protein, 9 aa, Homo Sapiens
TQDIALKTR

SEQ ID NO: 25159 - protein, 9 aa, Homo Sapiens
TLLTDAIFC

SEQ ID NO: 25160 - protein, 9 aa, Homo Sapiens
VSEMCHNGE

SEQ ID NO: 25161 - protein, 9 aa, Homo Sapiens
EFVPEVKEV

SEQ ID NO: 25162 - protein, 9 aa, Homo Sapiens
QVVDPLPQV

SEQ ID NO: 25163 - protein, 9 aa, Homo Sapiens
SGNPYVFWY

SEQ ID NO: 25164 - protein, 9 aa, Homo Sapiens
VKTEGGGSK

SEQ ID NO: 25165 - protein, 9 aa, Homo Sapiens
TLMQHQKVH

SEQ ID NO: 25166 - protein, 9 aa, Homo Sapiens
VEPAELRET

SEQ ID NO: 25167 - protein, 9 aa, Homo Sapiens
PECATPAAL

SEQ ID NO: 25168 - protein, 9 aa, Homo Sapiens
VSDVQESLI

SEQ ID NO: 25169 - protein, 9 aa, Homo Sapiens
MVYQEKLSK

SEQ ID NO: 25170 - protein, 9 aa, Homo Sapiens
SRSSTPVQN

SEQ ID NO: 25171 - protein, 9 aa, Homo Sapiens
SPLGVVTKP

SEQ ID NO: 25172 - protein, 9 aa, Homo Sapiens
GGRGPHRGP

SEQ ID NO: 25173 - protein, 9 aa, Homo Sapiens
FSIGLNDQV

SEQ ID NO: 25174 - protein, 9 aa, Homo Sapiens
GEPGPQGEI

SEQ ID NO: 25175 - protein, 9 aa, Homo Sapiens
AAAATAALH

SEQ ID NO: 25176 - protein, 9 aa, Homo Sapiens
EKEQVPHCI

SEQ ID NO: 25177 - protein, 9 aa, Homo Sapiens
IQVVDPLPQ

SEQ ID NO: 25178 - protein, 9 aa, Homo Sapiens
TAHVYAMKI

SEQ ID NO: 25179 - protein, 9 aa, Homo Sapiens
KLECEQEQR

SEQ ID NO: 25180 - protein, 9 aa, Homo Sapiens
LEITCIELA

SEQ ID NO: 25181 - protein, 9 aa, Homo Sapiens
ERVLYNSVS

SEQ ID NO: 25182 - protein, 9 aa, Homo Sapiens
PEVKEVVSH

SEQ ID NO: 25183 - protein, 9 aa, Homo Sapiens
NQSQIKEDT

SEQ ID NO: 25184 - protein, 9 aa, Homo Sapiens
SKRFSPQPG

SEQ ID NO: 25185 - protein, 9 aa, Homo Sapiens
SPHSQKHSS

SEQ ID NO: 25186 - protein, 9 aa, Homo Sapiens
SFNVKFYAP

SEQ ID NO: 25187 - protein, 9 aa, Homo Sapiens
VTVQLFQEE

SEQ ID NO: 25188 - protein, 9 aa, Homo Sapiens
STSVHPSDP

SEQ ID NO: 25189 - protein, 9 aa, Homo Sapiens
GGNKDWCKD

SEQ ID NO: 25190 - protein, 9 aa, Homo Sapiens
QAMGKSYHT

SEQ ID NO: 25191 - protein, 9 aa, Homo Sapiens
LRSQEAAVT

SEQ ID NO: 25192 - protein, 9 aa, Homo Sapiens
LEQMVISIN

SEQ ID NO: 25193 - protein, 9 aa, Homo Sapiens
LCFCRLLST

SEQ ID NO: 25194 - protein, 9 aa, Homo Sapiens
GFRINCNIF

SEQ ID NO: 25195 - protein, 9 aa, Homo Sapiens
GEHQHVLSN

SEQ ID NO: 25196 - protein, 9 aa, Homo Sapiens
DVSLTLHGL

SEQ ID NO: 25197 - protein, 9 aa, Homo Sapiens
DFGDSGRIY

SEQ ID NO: 25198 - protein, 9 aa, Homo Sapiens
YAKHKCTAC

SEQ ID NO: 25199 - protein, 9 aa, Homo Sapiens
LQELWCPCP

SEQ ID NO: 25200 - protein, 9 aa, Homo Sapiens
LPGEHQHVL

SEQ ID NO: 25201 - protein, 9 aa, Homo Sapiens
STQSGDAFH

SEQ ID NO: 25202 - protein, 9 aa, Homo Sapiens
VAKTKMEVT

SEQ ID NO: 25203 - protein, 9 aa, Homo Sapiens
INDHDFVVI

SEQ ID NO: 25204 - protein, 9 aa, Homo Sapiens
EKRHWKHYI

SEQ ID NO: 25205 - protein, 9 aa, Homo Sapiens
GIKGEELVQ

SEQ ID NO: 25206 - protein, 9 aa, Homo Sapiens
RSMVPWKIE

SEQ ID NO: 25207 - protein, 9 aa, Homo Sapiens
LTLEDLKEV

SEQ ID NO: 25208 - protein, 9 aa, Homo Sapiens
LKVPDSRKK

SEQ ID NO: 25209 - protein, 9 aa, Homo Sapiens
RETYRKVMN

SEQ ID NO: 25210 - protein, 9 aa, Homo Sapiens
PEGPIINHI

SEQ ID NO: 25211 - protein, 9 aa, Homo Sapiens
RERALNYYG

SEQ ID NO: 25212 - protein, 9 aa, Homo Sapiens
MNVYQHVLD

SEQ ID NO: 25213 - protein, 9 aa, Homo Sapiens
TRELRARQQ

SEQ ID NO: 25214 - protein, 9 aa, Homo Sapiens
RAHSQNTVK

SEQ ID NO: 25215 - protein, 9 aa, Homo Sapiens
HVIQHDGRN

SEQ ID NO: 25216 - protein, 9 aa, Homo Sapiens
LRKRLKAYV

SEQ ID NO: 25217 - protein, 9 aa, Homo Sapiens
EMSHKKSLF

SEQ ID NO: 25218 - protein, 9 aa, Homo Sapiens
SLRANKPKQ

SEQ ID NO: 25219 - protein, 9 aa, Homo Sapiens
AKLECEQEQ

SEQ ID NO: 25220 - protein, 9 aa, Homo Sapiens
LPAGRASLL

SEQ ID NO: 25221 - protein, 9 aa, Homo Sapiens
SRMNVSRTL

SEQ ID NO: 25222 - protein, 9 aa, Homo Sapiens
PAKFSSGQY

SEQ ID NO: 25223 - protein, 9 aa, Homo Sapiens
LPVTPKAWL

SEQ ID NO: 25224 - protein, 9 aa, Homo Sapiens
EGPIINHIT

SEQ ID NO: 25225 - protein, 9 aa, Homo Sapiens
RNAATAEAR

SEQ ID NO: 25226 - protein, 9 aa, Homo Sapiens
SEHLFNGQA

SEQ ID NO: 25227 - protein, 9 aa, Homo Sapiens
KKSLFDKKR

SEQ ID NO: 25228 - protein, 9 aa, Homo Sapiens
RASLLPMPL

SEQ ID NO: 25229 - protein, 9 aa, Homo Sapiens
IPECGTYSL

SEQ ID NO: 25230 - protein, 9 aa, Homo Sapiens
KDSGSPKHQ

SEQ ID NO: 25231 - protein, 9 aa, Homo Sapiens
PQGGGLRPK

SEQ ID NO: 25232 - protein, 9 aa, Homo Sapiens
EAGEIIAGR

SEQ ID NO: 25233 - protein, 9 aa, Homo Sapiens
SVIKPSALL

SEQ ID NO: 25234 - protein, 9 aa, Homo Sapiens
EVSSFLQEG

SEQ ID NO: 25235 - protein, 9 aa, Homo Sapiens
CSWIAVLAL

SEQ ID NO: 25236 - protein, 9 aa, Homo Sapiens
QSQRRAGQL

SEQ ID NO: 25237 - protein, 9 aa, Homo Sapiens
LQMLEAQGS

SEQ ID NO: 25238 - protein, 9 aa, Homo Sapiens
KHTKQLLEK

SEQ ID NO: 25239 - protein, 9 aa, Homo Sapiens
LRNSTPPCH

SEQ ID NO: 25240 - protein, 9 aa, Homo Sapiens
SNTPTSVII

SEQ ID NO: 25241 - protein, 9 aa, Homo Sapiens
LAVDANDIP

SEQ ID NO: 25242 - protein, 9 aa, Homo Sapiens
DFLKFTLEN

SEQ ID NO: 25243 - protein, 9 aa, Homo Sapiens
NKRISLAGC

SEQ ID NO: 25244 - protein, 9 aa, Homo Sapiens
PSRLSAAAA

SEQ ID NO: 25245 - protein, 9 aa, Homo Sapiens
SGMGPSAKL

SEQ ID NO: 25246 - protein, 9 aa, Homo Sapiens
FKPQIRKIV

SEQ ID NO: 25247 - protein, 9 aa, Homo Sapiens
PQAHLAPDC

SEQ ID NO: 25248 - protein, 9 aa, Homo Sapiens
ECCPLWSGD

SEQ ID NO: 25249 - protein, 9 aa, Homo Sapiens
NGSLRKALI

SEQ ID NO: 25250 - protein, 9 aa, Homo Sapiens
IMQLDNVVS

SEQ ID NO: 25251 - protein, 9 aa, Homo Sapiens
SRLACFIKR

SEQ ID NO: 25252 - protein, 9 aa, Homo Sapiens
ILLKSSMSF

SEQ ID NO: 25253 - protein, 9 aa, Homo Sapiens
SESHVTQDI

SEQ ID NO: 25254 - protein, 9 aa, Homo Sapiens
VTFFRTDLS

SEQ ID NO: 25255 - protein, 9 aa, Homo Sapiens
IILVVRNDL

SEQ ID NO: 25256 - protein, 9 aa, Homo Sapiens
SSTRGQLKP

SEQ ID NO: 25257 - protein, 9 aa, Homo Sapiens
LHYNSLSEL

SEQ ID NO: 25258 - protein, 9 aa, Homo Sapiens
LLLSRGDNI

SEQ ID NO: 25259 - protein, 9 aa, Homo Sapiens
IAQKHGFRD

SEQ ID NO: 25260 - protein, 9 aa, Homo Sapiens
AAAWPLRDC

SEQ ID NO: 25261 - protein, 9 aa, Homo Sapiens
TSILIQRVH

SEQ ID NO: 25262 - protein, 9 aa, Homo Sapiens
PELQSKVRN

SEQ ID NO: 25263 - protein, 9 aa, Homo Sapiens
QRCLRVKTR

SEQ ID NO: 25264 - protein, 9 aa, Homo Sapiens
VTVENPEDP

SEQ ID NO: 25265 - protein, 9 aa, Homo Sapiens
ASLSLPGSD

SEQ ID NO: 25266 - protein, 9 aa, Homo Sapiens
LSRKKMKKT

SEQ ID NO: 25267 - protein, 9 aa, Homo Sapiens
PVEKEQVPH

SEQ ID NO: 25268 - protein, 9 aa, Homo Sapiens
PQGEIGPQG

SEQ ID NO: 25269 - protein, 9 aa, Homo Sapiens
PVCLAQCGG

SEQ ID NO: 25270 - protein, 9 aa, Homo Sapiens
KEERKHKEA

SEQ ID NO: 25271 - protein, 9 aa, Homo Sapiens
DGEKFGTVS

SEQ ID NO: 25272 - protein, 9 aa, Homo Sapiens
KFGLRNSEP

SEQ ID NO: 25273 - protein, 9 aa, Homo Sapiens
GGYERREDN

SEQ ID NO: 25274 - protein, 9 aa, Homo Sapiens
HVRNGTYLQ

SEQ ID NO: 25275 - protein, 9 aa, Homo Sapiens
ENISKQLHL

SEQ ID NO: 25276 - protein, 9 aa, Homo Sapiens
GRASLLPMP

SEQ ID NO: 25277 - protein, 9 aa, Homo Sapiens
MGFKPQIRK

SEQ ID NO: 25278 - protein, 9 aa, Homo Sapiens
GVIVGSIFE

SEQ ID NO: 25279 - protein, 9 aa, Homo Sapiens
FSKAGEVVP

SEQ ID NO: 25280 - protein, 9 aa, Homo Sapiens
GHDALEDPM

SEQ ID NO: 25281 - protein, 9 aa, Homo Sapiens
PPLPGFNDC

SEQ ID NO: 25282 - protein, 9 aa, Homo Sapiens
RFKKDALRF

SEQ ID NO: 25283 - protein, 9 aa, Homo Sapiens
HVPSFHVDV

SEQ ID NO: 25284 - protein, 9 aa, Homo Sapiens
FLSPPSPAP

SEQ ID NO: 25285 - protein, 9 aa, Homo Sapiens
KPQELGTQA

SEQ ID NO: 25286 - protein, 9 aa, Homo Sapiens
EAYRQEAKT

SEQ ID NO: 25287 - protein, 9 aa, Homo Sapiens
LPDAGKAHL

SEQ ID NO: 25288 - protein, 9 aa, Homo Sapiens
AWLEWWHVQ

SEQ ID NO: 25289 - protein, 9 aa, Homo Sapiens
DGGKGHVGT

SEQ ID NO: 25290 - protein, 9 aa, Homo Sapiens
RLLVEQKEL

SEQ ID NO: 25291 - protein, 9 aa, Homo Sapiens
VAEHYDRVH

SEQ ID NO: 25292 - protein, 9 aa, Homo Sapiens
AQIKLLLEN

SEQ ID NO: 25293 - protein, 9 aa, Homo Sapiens
AGKEAPRGP

SEQ ID NO: 25294 - protein, 9 aa, Homo Sapiens
THWVGAWWF

SEQ ID NO: 25295 - protein, 9 aa, Homo Sapiens
PSLLVTLAD

SEQ ID NO: 25296 - protein, 9 aa, Homo Sapiens
KSFSIGLND

SEQ ID NO: 25297 - protein, 9 aa, Homo Sapiens
SVSGNPYVF

SEQ ID NO: 25298 - protein, 9 aa, Homo Sapiens
EPCEADKSH

SEQ ID NO: 25299 - protein, 9 aa, Homo Sapiens
EAQRIMREL

SEQ ID NO: 25300 - protein, 9 aa, Homo Sapiens
ALAVDANDI

SEQ ID NO: 25301 - protein, 9 aa, Homo Sapiens
RGGRGPHRG

SEQ ID NO: 25302 - protein, 9 aa, Homo Sapiens
MKTPGPLPV

SEQ ID NO: 25303 - protein, 9 aa, Homo Sapiens
REWKSKRFS

SEQ ID NO: 25304 - protein, 9 aa, Homo Sapiens
EKEARSLYE

SEQ ID NO: 25305 - protein, 9 aa, Homo Sapiens
IPNPRTLFK

SEQ ID NO: 25306 - protein, 9 aa, Homo Sapiens
FHQFGHVMH

SEQ ID NO: 25307 - protein, 9 aa, Homo Sapiens
RIVRLLVEQ

SEQ ID NO: 25308 - protein, 9 aa, Homo Sapiens
PPELLSDQH

SEQ ID NO: 25309 - protein, 9 aa, Homo Sapiens
DEVETYFHQ

SEQ ID NO: 25310 - protein, 9 aa, Homo Sapiens
FGNKDQSVK

SEQ ID NO: 25311 - protein, 9 aa, Homo Sapiens
CHPDYRALD

SEQ ID NO: 25312 - protein, 9 aa, Homo Sapiens
INRFIIPRE

SEQ ID NO: 25313 - protein, 9 aa, Homo Sapiens
GIDQLLNID

SEQ ID NO: 25314 - protein, 9 aa, Homo Sapiens
THSGPGVNS

SEQ ID NO: 25315 - protein, 9 aa, Homo Sapiens
VRKNNLKDL

SEQ ID NO: 25316 - protein, 9 aa, Homo Sapiens
PLFYPGMNS

SEQ ID NO: 25317 - protein, 9 aa, Homo Sapiens
ACASAPLLR

SEQ ID NO: 25318 - protein, 9 aa, Homo Sapiens
SSTLKKRKL

SEQ ID NO: 25319 - protein, 9 aa, Homo Sapiens
GHFTLAEDL

SEQ ID NO: 25320 - protein, 9 aa, Homo Sapiens
EQMVISINL

SEQ ID NO: 25321 - protein, 9 aa, Homo Sapiens
LRGDDFSDC

SEQ ID NO: 25322 - protein, 9 aa, Homo Sapiens
ENKDAVAFT

SEQ ID NO: 25323 - protein, 9 aa, Homo Sapiens
LLNIDIAAA

SEQ ID NO: 25324 - protein, 9 aa, Homo Sapiens
CWLQGAPGL

SEQ ID NO: 25325 - protein, 9 aa, Homo Sapiens
INVEVYSCC

SEQ ID NO: 25326 - protein, 9 aa, Homo Sapiens
FSEKVEVAF

SEQ ID NO: 25327 - protein, 8 aa, Homo Sapiens
YNQDTALG

SEQ ID NO: 25328 - protein, 9 aa, Homo Sapiens
DAAPTSPSS

SEQ ID NO: 25329 - protein, 9 aa, Homo Sapiens
PDCPAPAQT

SEQ ID NO: 25330 - protein, 9 aa, Homo Sapiens
ITPTDTHWV

SEQ ID NO: 25331 - protein, 9 aa, Homo Sapiens
QEADSWVDT

SEQ ID NO: 25332 - protein, 9 aa, Homo Sapiens
AAPRARPDH

SEQ ID NO: 25333 - protein, 9 aa, Homo Sapiens
FIAYPITLF

SEQ ID NO: 25334 - protein, 9 aa, Homo Sapiens
DKDSTSVYN

SEQ ID NO: 25335 - protein, 9 aa, Homo Sapiens
FVRFKKDAL

SEQ ID NO: 25336 - protein, 9 aa, Homo Sapiens
LSSNDIRKS

SEQ ID NO: 25337 - protein, 9 aa, Homo Sapiens
KKDTAHVYA

SEQ ID NO: 25338 - protein, 9 aa, Homo Sapiens
EVAASCWLQ

SEQ ID NO: 25339 - protein, 9 aa, Homo Sapiens
GTPGMQEPP

SEQ ID NO: 25340 - protein, 9 aa, Homo Sapiens
LMVSKDARQ

SEQ ID NO: 25341 - protein, 9 aa, Homo Sapiens
LACASAPLL

SEQ ID NO: 25342 - protein, 9 aa, Homo Sapiens
ENEPCEADK

SEQ ID NO: 25343 - protein, 9 aa, Homo Sapiens
IKPSALLGA

SEQ ID NO: 25344 - protein, 9 aa, Homo Sapiens
FKHSKKGPT

SEQ ID NO: 25345 - protein, 9 aa, Homo Sapiens
NCGSTTAQS

SEQ ID NO: 25346 - protein, 9 aa, Homo Sapiens
CRQGMFNCT

SEQ ID NO: 25347 - protein, 9 aa, Homo Sapiens
MEPGADQEG

SEQ ID NO: 25348 - protein, 9 aa, Homo Sapiens
LACFIKRRK

SEQ ID NO: 25349 - protein, 9 aa, Homo Sapiens
GSLSGIIEA

SEQ ID NO: 25350 - protein, 9 aa, Homo Sapiens
ATEKIKKGL

SEQ ID NO: 25351 - protein, 9 aa, Homo Sapiens
GADQEGAMF

SEQ ID NO: 25352 - protein, 9 aa, Homo Sapiens
APGRPGALA

SEQ ID NO: 25353 - protein, 9 aa, Homo Sapiens
KREWKSKRF

SEQ ID NO: 25354 - protein, 9 aa, Homo Sapiens
PGPQGEIGP

SEQ ID NO: 25355 - protein, 9 aa, Homo Sapiens
AGEIIAGRE

SEQ ID NO: 25356 - protein, 9 aa, Homo Sapiens
ACTAPKMPK

SEQ ID NO: 25357 - protein, 9 aa, Homo Sapiens
QEAAVTVQL

SEQ ID NO: 25358 - protein, 9 aa, Homo Sapiens
LVYENINRL

SEQ ID NO: 25359 - protein, 9 aa, Homo Sapiens
PSPAPKNGS

SEQ ID NO: 25360 - protein, 9 aa, Homo Sapiens
TVKNVEKAL

SEQ ID NO: 25361 - protein, 9 aa, Homo Sapiens
ELMNVYQHV

SEQ ID NO: 25362 - protein, 9 aa, Homo Sapiens
YKQWKILNE

SEQ ID NO: 25363 - protein, 9 aa, Homo Sapiens
GIVFKSYEC

SEQ ID NO: 25364 - protein, 9 aa, Homo Sapiens
VLDQDAVSN

SEQ ID NO: 25365 - protein, 9 aa, Homo Sapiens
GYFADYAKH

SEQ ID NO: 25366 - protein, 9 aa, Homo Sapiens
ELSKPNMID

SEQ ID NO: 25367 - protein, 9 aa, Homo Sapiens
EISGIYLDK

SEQ ID NO: 25368 - protein, 9 aa, Homo Sapiens
MKIYGQDPV

SEQ ID NO: 25369 - protein, 9 aa, Homo Sapiens
DPPSTCQLW

SEQ ID NO: 25370 - protein, 9 aa, Homo Sapiens
HWVGAWWFG

SEQ ID NO: 25371 - protein, 9 aa, Homo Sapiens
WHVQPTLDL

SEQ ID NO: 25372 - protein, 9 aa, Homo Sapiens
HWVWARNRA

SEQ ID NO: 25373 - protein, 9 aa, Homo Sapiens
QVLGGYERR

SEQ ID NO: 25374 - protein, 9 aa, Homo Sapiens
LKEKQFVER

SEQ ID NO: 25375 - protein, 9 aa, Homo Sapiens
ILLVVLLSM

SEQ ID NO: 25376 - protein, 9 aa, Homo Sapiens
CFIKRRKHQ

SEQ ID NO: 25377 - protein, 9 aa, Homo Sapiens
SLHAGNLDG

SEQ ID NO: 25378 - protein, 9 aa, Homo Sapiens
DCLMKARKV

SEQ ID NO: 25379 - protein, 9 aa, Homo Sapiens
NDDVQKADV

SEQ ID NO: 25380 - protein, 9 aa, Homo Sapiens
GLNELMNVY

SEQ ID NO: 25381 - protein, 9 aa, Homo Sapiens
ESCCRSEPD

SEQ ID NO: 25382 - protein, 9 aa, Homo Sapiens
GSLFLSPPS

SEQ ID NO: 25383 - protein, 9 aa, Homo Sapiens
KSLFDKKRS

SEQ ID NO: 25384 - protein, 9 aa, Homo Sapiens
GSYDEQYAT

SEQ ID NO: 25385 - protein, 9 aa, Homo Sapiens
NNLSEDGAQ

SEQ ID NO: 25386 - protein, 9 aa, Homo Sapiens
TYNPDELSK

SEQ ID NO: 25387 - protein, 9 aa, Homo Sapiens
RWYRNTKLV

SEQ ID NO: 25388 - protein, 9 aa, Homo Sapiens
VRLLVEQKE

SEQ ID NO: 25389 - protein, 9 aa, Homo Sapiens
YRQEAKTHR

SEQ ID NO: 25390 - protein, 9 aa, Homo Sapiens
IIEADQVSV

SEQ ID NO: 25391 - protein, 9 aa, Homo Sapiens
ARQQCYRWK

SEQ ID NO: 25392 - protein, 9 aa, Homo Sapiens
FNMEQLKDS

SEQ ID NO: 25393 - protein, 9 aa, Homo Sapiens
REGSRMNVS

SEQ ID NO: 25394 - protein, 9 aa, Homo Sapiens
APSAYWLVT

SEQ ID NO: 25395 - protein, 9 aa, Homo Sapiens
ALTVLETCI

SEQ ID NO: 25396 - protein, 9 aa, Homo Sapiens
TEGGGSKAP

SEQ ID NO: 25397 - protein, 9 aa, Homo Sapiens
KEGKMFMKA

SEQ ID NO: 25398 - protein, 9 aa, Homo Sapiens
LTNSACHEH

SEQ ID NO: 25399 - protein, 9 aa, Homo Sapiens
TFTMMLARV

SEQ ID NO: 25400 - protein, 9 aa, Homo Sapiens
VHKHRELDR

SEQ ID NO: 25401 - protein, 9 aa, Homo Sapiens
NPRANFDQS

SEQ ID NO: 25402 - protein, 9 aa, Homo Sapiens
VRSPCTPPS

SEQ ID NO: 25403 - protein, 9 aa, Homo Sapiens
GLSLHYNSL

SEQ ID NO: 25404 - protein, 9 aa, Homo Sapiens
GASTVRSPC

SEQ ID NO: 25405 - protein, 9 aa, Homo Sapiens
RMNVSRTLT

SEQ ID NO: 25406 - protein, 9 aa, Homo Sapiens
TDFLTPPVG

SEQ ID NO: 25407 - protein, 9 aa, Homo Sapiens
EQRVNEMAS

SEQ ID NO: 25408 - protein, 9 aa, Homo Sapiens
ALLGASTVR

SEQ ID NO: 25409 - protein, 9 aa, Homo Sapiens
EWAEAQRIM

SEQ ID NO: 25410 - protein, 9 aa, Homo Sapiens
APDPAQLSE

SEQ ID NO: 25411 - protein, 9 aa, Homo Sapiens
VWSLEITCI

SEQ ID NO: 25412 - protein, 9 aa, Homo Sapiens
ERDFLKFTL

SEQ ID NO: 25413 - protein, 9 aa, Homo Sapiens
APMQNTDCC

SEQ ID NO: 25414 - protein, 9 aa, Homo Sapiens
FDFEISGIY

SEQ ID NO: 25415 - protein, 9 aa, Homo Sapiens
TSVYNTGES

SEQ ID NO: 25416 - protein, 9 aa, Homo Sapiens
CCRSEPDIP

SEQ ID NO: 25417 - protein, 9 aa, Homo Sapiens
GMFSYDFFL

SEQ ID NO: 25418 - protein, 9 aa, Homo Sapiens
HSLPLLFIC

SEQ ID NO: 25419 - protein, 9 aa, Homo Sapiens
AYWLVTATG

SEQ ID NO: 25420 - protein, 9 aa, Homo Sapiens
TCIKSCGKR

SEQ ID NO: 25421 - protein, 9 aa, Homo Sapiens
APPAKFSSG

SEQ ID NO: 25422 - protein, 9 aa, Homo Sapiens
RQFLAPNLK

SEQ ID NO: 25423 - protein, 9 aa, Homo Sapiens
KTEGGGSKA

SEQ ID NO: 25424 - protein, 9 aa, Homo Sapiens
LNYYGLYDD

SEQ ID NO: 25425 - protein, 9 aa, Homo Sapiens
MEALSVRQR

SEQ ID NO: 25426 - protein, 9 aa, Homo Sapiens
AAYPVLGPG

SEQ ID NO: 25427 - protein, 9 aa, Homo Sapiens
NRFTCFAIC

SEQ ID NO: 25428 - protein, 9 aa, Homo Sapiens
EKPYLPPTV

SEQ ID NO: 25429 - protein, 9 aa, Homo Sapiens
AQAPEQPGE

SEQ ID NO: 25430 - protein, 9 aa, Homo Sapiens
KLVYENINR

SEQ ID NO: 25431 - protein, 9 aa, Homo Sapiens
LCNIEPHER

SEQ ID NO: 25432 - protein, 9 aa, Homo Sapiens
IKSCGKRFH

SEQ ID NO: 25433 - protein, 9 aa, Homo Sapiens
GSKDSGSPK

SEQ ID NO: 25434 - protein, 9 aa, Homo Sapiens
KLQEIMKQM

SEQ ID NO: 25435 - protein, 9 aa, Homo Sapiens
GDKRSVTSS

SEQ ID NO: 25436 - protein, 9 aa, Homo Sapiens
KNEEKLCIK

SEQ ID NO: 25437 - protein, 9 aa, Homo Sapiens
SYDFFLPVR

SEQ ID NO: 25438 - protein, 9 aa, Homo Sapiens
GWKTKKHQL

SEQ ID NO: 25439 - protein, 9 aa, Homo Sapiens
PSLSFGLHR

SEQ ID NO: 25440 - protein, 9 aa, Homo Sapiens
VLNFYRALP

SEQ ID NO: 25441 - protein, 9 aa, Homo Sapiens
KDSEDVSSF

SEQ ID NO: 25442 - protein, 9 aa, Homo Sapiens
SQGSEHLFN

SEQ ID NO: 25443 - protein, 9 aa, Homo Sapiens
GKEAPRGPW

SEQ ID NO: 25444 - protein, 9 aa, Homo Sapiens
KDWCKDNFV

SEQ ID NO: 25445 - protein, 9 aa, Homo Sapiens
RRSPSSKDD

SEQ ID NO: 25446 - protein, 9 aa, Homo Sapiens
IGLGFRINC

SEQ ID NO: 25447 - protein, 9 aa, Homo Sapiens
VPFGPPLDM

SEQ ID NO: 25448 - protein, 9 aa, Homo Sapiens
KFILYAFHS

SEQ ID NO: 25449 - protein, 9 aa, Homo Sapiens
QINVEVYSC

SEQ ID NO: 25450 - protein, 9 aa, Homo Sapiens
DPDSVTPID

SEQ ID NO: 25451 - protein, 9 aa, Homo Sapiens
GGKGHVGTV

SEQ ID NO: 25452 - protein, 9 aa, Homo Sapiens
LNQSQIKED

SEQ ID NO: 25453 - protein, 9 aa, Homo Sapiens
STLMQHQKV

SEQ ID NO: 25454 - protein, 9 aa, Homo Sapiens
LWCPCPHIR

SEQ ID NO: 25455 - protein, 9 aa, Homo Sapiens
RPAEPQLQW

SEQ ID NO: 25456 - protein, 9 aa, Homo Sapiens
PAVHTKVVH

SEQ ID NO: 25457 - protein, 9 aa, Homo Sapiens
SSSSDCTTG

SEQ ID NO: 25458 - protein, 9 aa, Homo Sapiens
IPCENENIS

SEQ ID NO: 25459 - protein, 9 aa, Homo Sapiens
IYSPKYVSM

SEQ ID NO: 25460 - protein, 9 aa, Homo Sapiens
YKIILVVRN

SEQ ID NO: 25461 - protein, 9 aa, Homo Sapiens
RKALIGPLG

SEQ ID NO: 25462 - protein, 9 aa, Homo Sapiens
FSRRSTLMQ

SEQ ID NO: 25463 - protein, 9 aa, Homo Sapiens
AQKHGFRDL

SEQ ID NO: 25464 - protein, 9 aa, Homo Sapiens
FDDDKFHIY

SEQ ID NO: 25465 - protein, 9 aa, Homo Sapiens
LLFICDNLR

SEQ ID NO: 25466 - protein, 9 aa, Homo Sapiens
GPEAPGGLS

SEQ ID NO: 25467 - protein, 9 aa, Homo Sapiens
RKKMKKTES

SEQ ID NO: 25468 - protein, 9 aa, Homo Sapiens
LMEKECCPL

SEQ ID NO: 25469 - protein, 9 aa, Homo Sapiens
MHQQQQQQP

SEQ ID NO: 25470 - protein, 9 aa, Homo Sapiens
LYFKEEVKQ

SEQ ID NO: 25471 - protein, 9 aa, Homo Sapiens
LDFTVKNVE

SEQ ID NO: 25472 - protein, 9 aa, Homo Sapiens
QSRRKKNEY

SEQ ID NO: 25473 - protein, 9 aa, Homo Sapiens
PMGLMVEAS

SEQ ID NO: 25474 - protein, 9 aa, Homo Sapiens
SVEWSSERQ

SEQ ID NO: 25475 - protein, 9 aa, Homo Sapiens
GQDEQRKGL

SEQ ID NO: 25476 - protein, 9 aa, Homo Sapiens
AARDNKKTQ

SEQ ID NO: 25477 - protein, 9 aa, Homo Sapiens
GMLCYSHAF

SEQ ID NO: 25478 - protein, 9 aa, Homo Sapiens
SIYNFCSKP

SEQ ID NO: 25479 - protein, 9 aa, Homo Sapiens
PIIYCLHNQ

SEQ ID NO: 25480 - protein, 9 aa, Homo Sapiens
GSGSGQCPS

SEQ ID NO: 25481 - protein, 9 aa, Homo Sapiens
QKWCLGWDF

SEQ ID NO: 25482 - protein, 9 aa, Homo Sapiens
WVDHKPAFN

SEQ ID NO: 25483 - protein, 9 aa, Homo Sapiens
IEQRVNEMA

SEQ ID NO: 25484 - protein, 9 aa, Homo Sapiens
GFHEESTQV

SEQ ID NO: 25485 - protein, 9 aa, Homo Sapiens
SKAVKRARA

SEQ ID NO: 25486 - protein, 9 aa, Homo Sapiens
FVPEVKEVV

SEQ ID NO: 25487 - protein, 9 aa, Homo Sapiens
KPASMPKNK

SEQ ID NO: 25488 - protein, 9 aa, Homo Sapiens
PPHRPIPEC

SEQ ID NO: 25489 - protein, 9 aa, Homo Sapiens
LSDQHKAGY

SEQ ID NO: 25490 - protein, 9 aa, Homo Sapiens
HVRHVIQHD

SEQ ID NO: 25491 - protein, 9 aa, Homo Sapiens
DELEMCLSA

SEQ ID NO: 25492 - protein, 9 aa, Homo Sapiens
TCVCRQGMF

SEQ ID NO: 25493 - protein, 9 aa, Homo Sapiens
SPSVSTAAQ

SEQ ID NO: 25494 - protein, 9 aa, Homo Sapiens
KMFMKALFD

SEQ ID NO: 25495 - protein, 9 aa, Homo Sapiens
CGSRLSGNI

SEQ ID NO: 25496 - protein, 9 aa, Homo Sapiens
PYVFWYVQY

SEQ ID NO: 25497 - protein, 9 aa, Homo Sapiens
CASLQQNLE

SEQ ID NO: 25498 - protein, 9 aa, Homo Sapiens
SSAPMQNTD

SEQ ID NO: 25499 - protein, 9 aa, Homo Sapiens
VEKPYACKT

SEQ ID NO: 25500 - protein, 9 aa, Homo Sapiens
VYENINRLS

SEQ ID NO: 25501 - protein, 9 aa, Homo Sapiens
QNIIQTAID

SEQ ID NO: 25502 - protein, 9 aa, Homo Sapiens
TNSQCLSVE

SEQ ID NO: 25503 - protein, 9 aa, Homo Sapiens
EAESIYTND

SEQ ID NO: 25504 - protein, 9 aa, Homo Sapiens
LDQDAVSNF

SEQ ID NO: 25505 - protein, 9 aa, Homo Sapiens
EHLFNGQAF

SEQ ID NO: 25506 - protein, 9 aa, Homo Sapiens
TVRSPCTPP

SEQ ID NO: 25507 - protein, 9 aa, Homo Sapiens
SPLGIRLSD

SEQ ID NO: 25508 - protein, 9 aa, Homo Sapiens
IMRELRNRN

SEQ ID NO: 25509 - protein, 9 aa, Homo Sapiens
GSLSPLGIR

SEQ ID NO: 25510 - protein, 9 aa, Homo Sapiens
AQPNWNLDE

SEQ ID NO: 25511 - protein, 9 aa, Homo Sapiens
KDGVDGLPK

SEQ ID NO: 25512 - protein, 9 aa, Homo Sapiens
SHIGKFCLQ

SEQ ID NO: 25513 - protein, 9 aa, Homo Sapiens
KGLLTSLYS

SEQ ID NO: 25514 - protein, 9 aa, Homo Sapiens
LMCTRKRHR

SEQ ID NO: 25515 - protein, 9 aa, Homo Sapiens
QELFNENPV

SEQ ID NO: 25516 - protein, 9 aa, Homo Sapiens
EYKNGLDML

SEQ ID NO: 25517 - protein, 9 aa, Homo Sapiens
PIPVCLAQC

SEQ ID NO: 25518 - protein, 9 aa, Homo Sapiens
TKQLLEKNE

SEQ ID NO: 25519 - protein, 9 aa, Homo Sapiens
SIGLNDQVH

SEQ ID NO: 25520 - protein, 9 aa, Homo Sapiens
AWPLRDCQA

SEQ ID NO: 25521 - protein, 9 aa, Homo Sapiens
VPYKQWKIL

SEQ ID NO: 25522 - protein, 9 aa, Homo Sapiens
KFNMEQLKD

SEQ ID NO: 25523 - protein, 9 aa, Homo Sapiens
NHVRHVIQH

SEQ ID NO: 25524 - protein, 9 aa, Homo Sapiens
EPGADQEGA

SEQ ID NO: 25525 - protein, 9 aa, Homo Sapiens
EWKSKRFSP

SEQ ID NO: 25526 - protein, 9 aa, Homo Sapiens
VKKHEVPAK

SEQ ID NO: 25527 - protein, 9 aa, Homo Sapiens
YVQLAFNAR

SEQ ID NO: 25528 - protein, 9 aa, Homo Sapiens
SLGVPYKQW

SEQ ID NO: 25529 - protein, 9 aa, Homo Sapiens
EKSESHVTQ

SEQ ID NO: 25530 - protein, 9 aa, Homo Sapiens
HYPNTIAQK

SEQ ID NO: 25531 - protein, 9 aa, Homo Sapiens
QAVATPSRL

SEQ ID NO: 25532 - protein, 9 aa, Homo Sapiens
FGLHRLLFL

SEQ ID NO: 25533 - protein, 9 aa, Homo Sapiens
QRDGSEASV

SEQ ID NO: 25534 - protein, 9 aa, Homo Sapiens
LIGTTLVGN

SEQ ID NO: 25535 - protein, 9 aa, Homo Sapiens
TKSKIKHPV

SEQ ID NO: 25536 - protein, 9 aa, Homo Sapiens
AKQLENDNK

SEQ ID NO: 25537 - protein, 9 aa, Homo Sapiens
SFGLHRLLF

SEQ ID NO: 25538 - protein, 9 aa, Homo Sapiens
LVTLSYAIY

SEQ ID NO: 25539 - protein, 9 aa, Homo Sapiens
KSSNIEESV

SEQ ID NO: 25540 - protein, 9 aa, Homo Sapiens
MLDMGFKPQ

SEQ ID NO: 25541 - protein, 9 aa, Homo Sapiens
QDIEGKINR

SEQ ID NO: 25542 - protein, 9 aa, Homo Sapiens
LDMAPKRPS

SEQ ID NO: 25543 - protein, 9 aa, Homo Sapiens
NGFPRDRVS

SEQ ID NO: 25544 - protein, 9 aa, Homo Sapiens
QLTSLLYSF

SEQ ID NO: 25545 - protein, 9 aa, Homo Sapiens
VYLVSEMCH

SEQ ID NO: 25546 - protein, 9 aa, Homo Sapiens
DQLLNIDIA

SEQ ID NO: 25547 - protein, 9 aa, Homo Sapiens
NKKTQIIPR

SEQ ID NO: 25548 - protein, 9 aa, Homo Sapiens
NVYQHVLDK

SEQ ID NO: 25549 - protein, 9 aa, Homo Sapiens
NTIAQKHGF

SEQ ID NO: 25550 - protein, 9 aa, Homo Sapiens
LHTPMCYFL

SEQ ID NO: 25551 - protein, 9 aa, Homo Sapiens
EAPGGLSPE

SEQ ID NO: 25552 - protein, 9 aa, Homo Sapiens
NRFIIPRET

SEQ ID NO: 25553 - protein, 9 aa, Homo Sapiens
PRARPDHTR

SEQ ID NO: 25554 - protein, 9 aa, Homo Sapiens
SMNPLAMRL

SEQ ID NO: 25555 - protein, 9 aa, Homo Sapiens
GNPYVFWYV

SEQ ID NO: 25556 - protein, 9 aa, Homo Sapiens
HLEKLFKTD

SEQ ID NO: 25557 - protein, 9 aa, Homo Sapiens
KQLLEKNEE

SEQ ID NO: 25558 - protein, 9 aa, Homo Sapiens
TAGEKLEKE

SEQ ID NO: 25559 - protein, 9 aa, Homo Sapiens
VTRNYSQKS

SEQ ID NO: 25560 - protein, 9 aa, Homo Sapiens
SKMTNNTTS

SEQ ID NO: 25561 - protein, 9 aa, Homo Sapiens
DFHWIAQAL

SEQ ID NO: 25562 - protein, 9 aa, Homo Sapiens
SIFEVVWAA

SEQ ID NO: 25563 - protein, 9 aa, Homo Sapiens
ARSAAKRRN

SEQ ID NO: 25564 - protein, 9 aa, Homo Sapiens
VSLITLLTD

SEQ ID NO: 25565 - protein, 9 aa, Homo Sapiens
LKSSFSQSF

SEQ ID NO: 25566 - protein, 9 aa, Homo Sapiens
EPVKKHEVP

SEQ ID NO: 25567 - protein, 9 aa, Homo Sapiens
TPRNRMVRG

SEQ ID NO: 25568 - protein, 9 aa, Homo Sapiens
QGKTISNND

SEQ ID NO: 25569 - protein, 9 aa, Homo Sapiens
GMQEPPGER

SEQ ID NO: 25570 - protein, 9 aa, Homo Sapiens
NYESESGSM

SEQ ID NO: 25571 - protein, 9 aa, Homo Sapiens
KGAPERAAE

SEQ ID NO: 25572 - protein, 9 aa, Homo Sapiens
EPADRAREL

SEQ ID NO: 25573 - protein, 9 aa, Homo Sapiens
DHLEKLFKT

SEQ ID NO: 25574 - protein, 9 aa, Homo Sapiens
FEISGIYLD

SEQ ID NO: 25575 - protein, 9 aa, Homo Sapiens
CVCRQGMFN

SEQ ID NO: 25576 - protein, 9 aa, Homo Sapiens
DEDKVDISV

SEQ ID NO: 25577 - protein, 9 aa, Homo Sapiens
PGNGSLRKA

SEQ ID NO: 25578 - protein, 9 aa, Homo Sapiens
KQDGYACNE

SEQ ID NO: 25579 - protein, 9 aa, Homo Sapiens
RCYLDLAGL

SEQ ID NO: 25580 - protein, 9 aa, Homo Sapiens
FYIGLGFRI

SEQ ID NO: 25581 - protein, 9 aa, Homo Sapiens
VLANPPSNI

SEQ ID NO: 25582 - protein, 9 aa, Homo Sapiens
ATIHLTAFG

SEQ ID NO: 25583 - protein, 9 aa, Homo Sapiens
ALGSSQTDF

SEQ ID NO: 25584 - protein, 9 aa, Homo Sapiens
GKVDVWSLE

SEQ ID NO: 25585 - protein, 9 aa, Homo Sapiens
PKAWLQEGA

SEQ ID NO: 25586 - protein, 9 aa, Homo Sapiens
SHCHPPDQK

SEQ ID NO: 25587 - protein, 9 aa, Homo Sapiens
KIFNKMQRL

SEQ ID NO: 25588 - protein, 9 aa, Homo Sapiens
GSGQCPSRG

SEQ ID NO: 25589 - protein, 9 aa, Homo Sapiens
QSKVRNPRA

SEQ ID NO: 25590 - protein, 9 aa, Homo Sapiens
KLFKTDEAS

SEQ ID NO: 25591 - protein, 9 aa, Homo Sapiens
SLKCSIEVN

SEQ ID NO: 25592 - protein, 9 aa, Homo Sapiens
RDLDACALM

SEQ ID NO: 25593 - protein, 9 aa, Homo Sapiens
FIPCENENI

SEQ ID NO: 25594 - protein, 9 aa, Homo Sapiens
TEIHLYFKE

SEQ ID NO: 25595 - protein, 9 aa, Homo Sapiens
LEMSHKKSL

SEQ ID NO: 25596 - protein, 9 aa, Homo Sapiens
KRFSPQPGT

SEQ ID NO: 25597 - protein, 9 aa, Homo Sapiens
ELGTQATIH

SEQ ID NO: 25598 - protein, 9 aa, Homo Sapiens
LQPPLPGFN

SEQ ID NO: 25599 - protein, 9 aa, Homo Sapiens
IGGRKSFSI

SEQ ID NO: 25600 - protein, 9 aa, Homo Sapiens
SSISHKATA

SEQ ID NO: 25601 - protein, 9 aa, Homo Sapiens
YMDRSLDMN

SEQ ID NO: 25602 - protein, 9 aa, Homo Sapiens
KIQGTQQRQ

SEQ ID NO: 25603 - protein, 9 aa, Homo Sapiens
PNTIAQKHG

SEQ ID NO: 25604 - protein, 9 aa, Homo Sapiens
IPVCLAQCG

SEQ ID NO: 25605 - protein, 9 aa, Homo Sapiens
PICIATDNY

SEQ ID NO: 25606 - protein, 9 aa, Homo Sapiens
YFHASSYGA

SEQ ID NO: 25607 - protein, 9 aa, Homo Sapiens
IQELMKIYG

SEQ ID NO: 25608 - protein, 9 aa, Homo Sapiens
KFYAPDPAQ

SEQ ID NO: 25609 - protein, 9 aa, Homo Sapiens
VQWRQRHGP

SEQ ID NO: 25610 - protein, 9 aa, Homo Sapiens
QPGFYLVLL

SEQ ID NO: 25611 - protein, 9 aa, Homo Sapiens
PEQPGEEKR

SEQ ID NO: 25612 - protein, 9 aa, Homo Sapiens
LKGQDEQRK

SEQ ID NO: 25613 - protein, 9 aa, Homo Sapiens
PEHWVWARN

SEQ ID NO: 25614 - protein, 9 aa, Homo Sapiens
QSPPVRYLS

SEQ ID NO: 25615 - protein, 9 aa, Homo Sapiens
AGNLDGEDH

SEQ ID NO: 25616 - protein, 9 aa, Homo Sapiens
IEPKRATVE

SEQ ID NO: 25617 - protein, 9 aa, Homo Sapiens
HALGGGDEL

SEQ ID NO: 25618 - protein, 9 aa, Homo Sapiens
PGTPAVELL

SEQ ID NO: 25619 - protein, 9 aa, Homo Sapiens
CALMRGHRR

SEQ ID NO: 25620 - protein, 9 aa, Homo Sapiens
FCRLLSTAE

SEQ ID NO: 25621 - protein, 9 aa, Homo Sapiens
LLTDAIFCE

SEQ ID NO: 25622 - protein, 9 aa, Homo Sapiens
ITWAEAGPE

SEQ ID NO: 25623 - protein, 9 aa, Homo Sapiens
MQILHQVLD

SEQ ID NO: 25624 - protein, 9 aa, Homo Sapiens
SHLLFFNGK

SEQ ID NO: 25625 - protein, 9 aa, Homo Sapiens
QQTATDVSK

SEQ ID NO: 25626 - protein, 9 aa, Homo Sapiens
FRTDLSGYL

SEQ ID NO: 25627 - protein, 9 aa, Homo Sapiens
KGQDEQRKG

SEQ ID NO: 25628 - protein, 9 aa, Homo Sapiens
IQGTQQRQL

SEQ ID NO: 25629 - protein, 9 aa, Homo Sapiens
QQCYRWKIY

SEQ ID NO: 25630 - protein, 9 aa, Homo Sapiens
SLSPLGIRL

SEQ ID NO: 25631 - protein, 9 aa, Homo Sapiens
LDMLFKVVR

SEQ ID NO: 25632 - protein, 9 aa, Homo Sapiens
LDNVVSSTV

SEQ ID NO: 25633 - protein, 9 aa, Homo Sapiens
MFMKALFDY

SEQ ID NO: 25634 - protein, 9 aa, Homo Sapiens
ATHQVIHTE

SEQ ID NO: 25635 - protein, 9 aa, Homo Sapiens
SLHYNSLSE

SEQ ID NO: 25636 - protein, 9 aa, Homo Sapiens
LYIVQRPLP

SEQ ID NO: 25637 - protein, 9 aa, Homo Sapiens
NSLHFTVNW

SEQ ID NO: 25638 - protein, 9 aa, Homo Sapiens
YPNTIAQKH

SEQ ID NO: 25639 - protein, 9 aa, Homo Sapiens
NNLYFYDAT

SEQ ID NO: 25640 - protein, 9 aa, Homo Sapiens
PVHIDKIEQ

SEQ ID NO: 25641 - protein, 9 aa, Homo Sapiens
MLMKRLAAG

SEQ ID NO: 25642 - protein, 9 aa, Homo Sapiens
GNLSSTRGQ

SEQ ID NO: 25643 - protein, 9 aa, Homo Sapiens
PCHPDYRAL

SEQ ID NO: 25644 - protein, 9 aa, Homo Sapiens
QRDLDKVKS

SEQ ID NO: 25645 - protein, 9 aa, Homo Sapiens
NMEQLKDSI

SEQ ID NO: 25646 - protein, 9 aa, Homo Sapiens
PPRMRRQFL

SEQ ID NO: 25647 - protein, 9 aa, Homo Sapiens
RLVQKKDTA

SEQ ID NO: 25648 - protein, 9 aa, Homo Sapiens
VAMVPSQAP

SEQ ID NO: 25649 - protein, 9 aa, Homo Sapiens
EGFHEESTQ

SEQ ID NO: 25650 - protein, 9 aa, Homo Sapiens
SLIWVRYKR

SEQ ID NO: 25651 - protein, 9 aa, Homo Sapiens
LSRGDNINA

SEQ ID NO: 25652 - protein, 9 aa, Homo Sapiens
GPDFQINVE

SEQ ID NO: 25653 - protein, 9 aa, Homo Sapiens
MKALFDYNP

SEQ ID NO: 25654 - protein, 9 aa, Homo Sapiens
DFVVIYGLV

SEQ ID NO: 25655 - protein, 9 aa, Homo Sapiens
AEAAPGRPG

SEQ ID NO: 25656 - protein, 9 aa, Homo Sapiens
ESVLQQLKG

SEQ ID NO: 25657 - protein, 9 aa, Homo Sapiens
ERCYLDLAG

SEQ ID NO: 25658 - protein, 9 aa, Homo Sapiens
IITPTDTHW

SEQ ID NO: 25659 - protein, 9 aa, Homo Sapiens
ITGNYASYR

SEQ ID NO: 25660 - protein, 9 aa, Homo Sapiens
LMKRLAAGC

SEQ ID NO: 25661 - protein, 9 aa, Homo Sapiens
GSNNKVGDF

SEQ ID NO: 25662 - protein, 9 aa, Homo Sapiens
QRQLSRPRR

SEQ ID NO: 25663 - protein, 9 aa, Homo Sapiens
SSGATEKIK

SEQ ID NO: 25664 - protein, 9 aa, Homo Sapiens
KSESHVTQD

SEQ ID NO: 25665 - protein, 9 aa, Homo Sapiens
QLENDNKNY

SEQ ID NO: 25666 - protein, 9 aa, Homo Sapiens
WLVTLSYAI

SEQ ID NO: 25667 - protein, 9 aa, Homo Sapiens
SESPKFHSL

SEQ ID NO: 25668 - protein, 9 aa, Homo Sapiens
WVLLKSIDL

SEQ ID NO: 25669 - protein, 9 aa, Homo Sapiens
SHAYMMNVC

SEQ ID NO: 25670 - protein, 9 aa, Homo Sapiens
KSRSAQRSK

SEQ ID NO: 25671 - protein, 9 aa, Homo Sapiens
PAPAQIPTV

SEQ ID NO: 25672 - protein, 9 aa, Homo Sapiens
PPSHELDYQ

SEQ ID NO: 25673 - protein, 9 aa, Homo Sapiens
THTVEKPYA

SEQ ID NO: 25674 - protein, 9 aa, Homo Sapiens
SVHPSDPVE

SEQ ID NO: 25675 - protein, 9 aa, Homo Sapiens
LTSILIQRV

SEQ ID NO: 25676 - protein, 9 aa, Homo Sapiens
SLHFTVNWE

SEQ ID NO: 25677 - protein, 9 aa, Homo Sapiens
WGASPSRER

SEQ ID NO: 25678 - protein, 9 aa, Homo Sapiens
ARKVRGLQP

SEQ ID NO: 25679 - protein, 9 aa, Homo Sapiens
GKVELQEVV

SEQ ID NO: 25680 - protein, 9 aa, Homo Sapiens
QSVKFRKLM

SEQ ID NO: 25681 - protein, 9 aa, Homo Sapiens
VDTSEQERM

SEQ ID NO: 25682 - protein, 9 aa, Homo Sapiens
NDMLEAAKA

SEQ ID NO: 25683 - protein, 9 aa, Homo Sapiens
KMIKNFDRD

SEQ ID NO: 25684 - protein, 9 aa, Homo Sapiens
QMLKEVSKR

SEQ ID NO: 25685 - protein, 9 aa, Homo Sapiens
GSLKVPDSR

SEQ ID NO: 25686 - protein, 9 aa, Homo Sapiens
VWARNRAHL

SEQ ID NO: 25687 - protein, 9 aa, Homo Sapiens
HFTLAEDLN

SEQ ID NO: 25688 - protein, 9 aa, Homo Sapiens
SGEFFNNLY

SEQ ID NO: 25689 - protein, 9 aa, Homo Sapiens
ELKDKLPER

SEQ ID NO: 25690 - protein, 9 aa, Homo Sapiens
GMGPSAKLM

SEQ ID NO: 25691 - protein, 9 aa, Homo Sapiens
GKFCLQYGA

SEQ ID NO: 25692 - protein, 9 aa, Homo Sapiens
IVQRPLPGY

SEQ ID NO: 25693 - protein, 9 aa, Homo Sapiens
PRMRRQFLA

SEQ ID NO: 25694 - protein, 9 aa, Homo Sapiens
SNQSVLIQK

SEQ ID NO: 25695 - protein, 9 aa, Homo Sapiens
RSGGARGFF

SEQ ID NO: 25696 - protein, 9 aa, Homo Sapiens
CNNKGAHLV

SEQ ID NO: 25697 - protein, 9 aa, Homo Sapiens
AARDGTFTV

SEQ ID NO: 25698 - protein, 9 aa, Homo Sapiens
AESLGVPYK

SEQ ID NO: 25699 - protein, 9 aa, Homo Sapiens
NPVENKDAV

SEQ ID NO: 25700 - protein, 9 aa, Homo Sapiens
QEVQPEQVL

SEQ ID NO: 25701 - protein, 9 aa, Homo Sapiens
VAILLQNDT

SEQ ID NO: 25702 - protein, 9 aa, Homo Sapiens
LQWSHLASL

SEQ ID NO: 25703 - protein, 9 aa, Homo Sapiens
GGKRVDTAE

SEQ ID NO: 25704 - protein, 9 aa, Homo Sapiens
NVSRTLTHS

SEQ ID NO: 25705 - protein, 9 aa, Homo Sapiens
MQRCLRVKT

SEQ ID NO: 25706 - protein, 9 aa, Homo Sapiens
RYPGTPAVE

SEQ ID NO: 25707 - protein, 9 aa, Homo Sapiens
QNLECKIRK

SEQ ID NO: 25708 - protein, 9 aa, Homo Sapiens
SHDLPVHPR

SEQ ID NO: 25709 - protein, 9 aa, Homo Sapiens
QMLNGFPRD

SEQ ID NO: 25710 - protein, 9 aa, Homo Sapiens
VTLQELWCP

SEQ ID NO: 25711 - protein, 9 aa, Homo Sapiens
SGGARGFFA

SEQ ID NO: 25712 - protein, 9 aa, Homo Sapiens
HDLPVHPRA

SEQ ID NO: 25713 - protein, 9 aa, Homo Sapiens
EDKVDISVL

SEQ ID NO: 25714 - protein, 9 aa, Homo Sapiens
VTGHFTLAE

SEQ ID NO: 25715 - protein, 9 aa, Homo Sapiens
EIHLYFKEE

SEQ ID NO: 25716 - protein, 9 aa, Homo Sapiens
EFFNNLYFY

SEQ ID NO: 25717 - protein, 9 aa, Homo Sapiens
MQHQKVHSG

SEQ ID NO: 25718 - protein, 9 aa, Homo Sapiens
SLYSIYNFC

SEQ ID NO: 25719 - protein, 9 aa, Homo Sapiens
HTKQLLEKN

SEQ ID NO: 25720 - protein, 9 aa, Homo Sapiens
LRRHMPPEV

SEQ ID NO: 25721 - protein, 9 aa, Homo Sapiens
SHELDYQRL

SEQ ID NO: 25722 - protein, 9 aa, Homo Sapiens
YNTELCRPF

SEQ ID NO: 25723 - protein, 9 aa, Homo Sapiens
SLFDKKRSE

SEQ ID NO: 25724 - protein, 9 aa, Homo Sapiens
EAGPDFQIN

SEQ ID NO: 25725 - protein, 9 aa, Homo Sapiens
AQGSMKQAL

SEQ ID NO: 25726 - protein, 9 aa, Homo Sapiens
DLVSTVPEC

SEQ ID NO: 25727 - protein, 9 aa, Homo Sapiens
RWVLLKSID

SEQ ID NO: 25728 - protein, 9 aa, Homo Sapiens
PSEGDDYIS

SEQ ID NO: 25729 - protein, 9 aa, Homo Sapiens
WQKEVSSFL

SEQ ID NO: 25730 - protein, 9 aa, Homo Sapiens
PSLVGSFIK

SEQ ID NO: 25731 - protein, 9 aa, Homo Sapiens
GDSGRIYYC

SEQ ID NO: 25732 - protein, 9 aa, Homo Sapiens
QSQIKEDTS

SEQ ID NO: 25733 - protein, 9 aa, Homo Sapiens
YQEKLSKEE

SEQ ID NO: 25734 - protein, 9 aa, Homo Sapiens
LKPQELGTQ

SEQ ID NO: 25735 - protein, 9 aa, Homo Sapiens
LECEQEQRR

SEQ ID NO: 25736 - protein, 9 aa, Homo Sapiens
RDGRRYPGT

SEQ ID NO: 25737 - protein, 9 aa, Homo Sapiens
ASRDHVCKL

SEQ ID NO: 25738 - protein, 9 aa, Homo Sapiens
FHVPSFHVD

SEQ ID NO: 25739 - protein, 9 aa, Homo Sapiens
DAVSNFSVQ

SEQ ID NO: 25740 - protein, 9 aa, Homo Sapiens
HYIYLWINY

SEQ ID NO: 25741 - protein, 9 aa, Homo Sapiens
LRISTITEG

SEQ ID NO: 25742 - protein, 9 aa, Homo Sapiens
KGEELVQQL

SEQ ID NO: 25743 - protein, 9 aa, Homo Sapiens
ITDHVVVPL

SEQ ID NO: 25744 - protein, 9 aa, Homo Sapiens
QNSPNSMSR

SEQ ID NO: 25745 - protein, 9 aa, Homo Sapiens
QKHGFRDLR

SEQ ID NO: 25746 - protein, 9 aa, Homo Sapiens
TAPKMPKFI

SEQ ID NO: 25747 - protein, 9 aa, Homo Sapiens
MQEPPGERG

SEQ ID NO: 25748 - protein, 9 aa, Homo Sapiens
GRKFLVNVG

SEQ ID NO: 25749 - protein, 9 aa, Homo Sapiens
VYNTGESCR

SEQ ID NO: 25750 - protein, 9 aa, Homo Sapiens
KSIDLVSSV

SEQ ID NO: 25751 - protein, 9 aa, Homo Sapiens
FYRALPLFV

SEQ ID NO: 25752 - protein, 9 aa, Homo Sapiens
QINSTRYNT

SEQ ID NO: 25753 - protein, 9 aa, Homo Sapiens
PGILNYATR

SEQ ID NO: 25754 - protein, 9 aa, Homo Sapiens
SFLEGFHEE

SEQ ID NO: 25755 - protein, 9 aa, Homo Sapiens
KMEAESIYT

SEQ ID NO: 25756 - protein, 9 aa, Homo Sapiens
PMIKEHMQM

SEQ ID NO: 25757 - protein, 9 aa, Homo Sapiens
VKEVVSHKY

SEQ ID NO: 25758 - protein, 9 aa, Homo Sapiens
SRGDNINAF

SEQ ID NO: 25759 - protein, 9 aa, Homo Sapiens
TYFHQFGHV

SEQ ID NO: 25760 - protein, 9 aa, Homo Sapiens
SYAIYGLQP

SEQ ID NO: 25761 - protein, 9 aa, Homo Sapiens
VTKPASMPK

SEQ ID NO: 25762 - protein, 9 aa, Homo Sapiens
ADRARELQW

SEQ ID NO: 25763 - protein, 9 aa, Homo Sapiens
LASQMLNGF

SEQ ID NO: 25764 - protein, 9 aa, Homo Sapiens
RRKELSQTL

SEQ ID NO: 25765 - protein, 9 aa, Homo Sapiens
AQRIMRELR

SEQ ID NO: 25766 - protein, 9 aa, Homo Sapiens
SSSDCTTGS

SEQ ID NO: 25767 - protein, 9 aa, Homo Sapiens
LGEIQVVDP

SEQ ID NO: 25768 - protein, 9 aa, Homo Sapiens
PSVGYNGAI

SEQ ID NO: 25769 - protein, 9 aa, Homo Sapiens
DSSSKKRKF

SEQ ID NO: 25770 - protein, 9 aa, Homo Sapiens
LSPPSPAPK

SEQ ID NO: 25771 - protein, 9 aa, Homo Sapiens
LLKVKRSKL

SEQ ID NO: 25772 - protein, 9 aa, Homo Sapiens
LENWSLRAN

SEQ ID NO: 25773 - protein, 9 aa, Homo Sapiens
ITEGTLLSV

SEQ ID NO: 25774 - protein, 9 aa, Homo Sapiens
VQNIIQTAI

SEQ ID NO: 25775 - protein, 9 aa, Homo Sapiens
KDGEKFGTV

SEQ ID NO: 25776 - protein, 9 aa, Homo Sapiens
TEDNVATNL

SEQ ID NO: 25777 - protein, 9 aa, Homo Sapiens
KAYVLLSSE

SEQ ID NO: 25778 - protein, 9 aa, Homo Sapiens
VGQAEETDP

SEQ ID NO: 25779 - protein, 9 aa, Homo Sapiens
KGPPWANCG

SEQ ID NO: 25780 - protein, 9 aa, Homo Sapiens
QDEQRKGLL

SEQ ID NO: 25781 - protein, 9 aa, Homo Sapiens
FIQSHIGKF

SEQ ID NO: 25782 - protein, 9 aa, Homo Sapiens
QQNLFGRKF

SEQ ID NO: 25783 - protein, 9 aa, Homo Sapiens
QPGWQSSGG

SEQ ID NO: 25784 - protein, 9 aa, Homo Sapiens
RVCGPLYTT

SEQ ID NO: 25785 - protein, 9 aa, Homo Sapiens
RSTQSGDAF

SEQ ID NO: 25786 - protein, 9 aa, Homo Sapiens
QKAGPHRVA

SEQ ID NO: 25787 - protein, 9 aa, Homo Sapiens
LGFNKQCSE

SEQ ID NO: 25788 - protein, 9 aa, Homo Sapiens
LLGLSLHYN

SEQ ID NO: 25789 - protein, 9 aa, Homo Sapiens
KLMASTSPK

SEQ ID NO: 25790 - protein, 9 aa, Homo Sapiens
GPHRGPAGG

SEQ ID NO: 25791 - protein, 9 aa, Homo Sapiens
QETSFFDKN

SEQ ID NO: 25792 - protein, 9 aa, Homo Sapiens
RKELSQTLD

SEQ ID NO: 25793 - protein, 9 aa, Homo Sapiens
WWHVQPTLD

SEQ ID NO: 25794 - protein, 9 aa, Homo Sapiens
KSKAPETPM

SEQ ID NO: 25795 - protein, 9 aa, Homo Sapiens
KMEALSVRQ

SEQ ID NO: 25796 - protein, 9 aa, Homo Sapiens
KDTAHVYAM

SEQ ID NO: 25797 - protein, 9 aa, Homo Sapiens
QRACSPVIT

SEQ ID NO: 25798 - protein, 9 aa, Homo Sapiens
KKHSQFIAY

SEQ ID NO: 25799 - protein, 9 aa, Homo Sapiens
FIKSQNKED

SEQ ID NO: 25800 - protein, 9 aa, Homo Sapiens
ESGYEKHLI

SEQ ID NO: 25801 - protein, 9 aa, Homo Sapiens
MKAVQMCSK

SEQ ID NO: 25802 - protein, 9 aa, Homo Sapiens
IIMQLDNVV

SEQ ID NO: 25803 - protein, 9 aa, Homo Sapiens
VKLLLSRGD

SEQ ID NO: 25804 - protein, 9 aa, Homo Sapiens
FYSGKPVCH

SEQ ID NO: 25805 - protein, 9 aa, Homo Sapiens
RLCNIEPHE

SEQ ID NO: 25806 - protein, 9 aa, Homo Sapiens
DVESDFAKQ

SEQ ID NO: 25807 - protein, 9 aa, Homo Sapiens
DLLKEKQFV

SEQ ID NO: 25808 - protein, 9 aa, Homo Sapiens
EAAPGRPGA

SEQ ID NO: 25809 - protein, 9 aa, Homo Sapiens
ATPSRLSAA

SEQ ID NO: 25810 - protein, 9 aa, Homo Sapiens
KLSAGEEHL

SEQ ID NO: 25811 - protein, 9 aa, Homo Sapiens
CENENISKQ

SEQ ID NO: 25812 - protein, 9 aa, Homo Sapiens
LNIDIAAAF

SEQ ID NO: 25813 - protein, 9 aa, Homo Sapiens
KFSSGQYAS

SEQ ID NO: 25814 - protein, 9 aa, Homo Sapiens
YPHMKDGED

SEQ ID NO: 25815 - protein, 9 aa, Homo Sapiens
KTLYLVMKY

SEQ ID NO: 25816 - protein, 9 aa, Homo Sapiens
LQRPAEPQL

SEQ ID NO: 25817 - protein, 9 aa, Homo Sapiens
PSKEGKMFM

SEQ ID NO: 25818 - protein, 9 aa, Homo Sapiens
NTELCRPFE

SEQ ID NO: 25819 - protein, 9 aa, Homo Sapiens
ETQPGFYLV

SEQ ID NO: 25820 - protein, 9 aa, Homo Sapiens
QTYEEVGHD

SEQ ID NO: 25821 - protein, 9 aa, Homo Sapiens
KGPTASGNL

SEQ ID NO: 25822 - protein, 9 aa, Homo Sapiens
RSVIKPSAL

SEQ ID NO: 25823 - protein, 9 aa, Homo Sapiens
SCSQLTSLL

SEQ ID NO: 25824 - protein, 9 aa, Homo Sapiens
LFNENPVFA

SEQ ID NO: 25825 - protein, 9 aa, Homo Sapiens
KLHWEDGFA

SEQ ID NO: 25826 - protein, 9 aa, Homo Sapiens
LATASQMRM

SEQ ID NO: 25827 - protein, 9 aa, Homo Sapiens
PSHAYMMNV

SEQ ID NO: 25828 - protein, 9 aa, Homo Sapiens
KGHVGTVRS

SEQ ID NO: 25829 - protein, 9 aa, Homo Sapiens
VQTNSQCLS

SEQ ID NO: 25830 - protein, 9 aa, Homo Sapiens
PPSPAPKNG

SEQ ID NO: 25831 - protein, 9 aa, Homo Sapiens
LSGNIGNLS

SEQ ID NO: 25832 - protein, 9 aa, Homo Sapiens
WNYPIPVCL

SEQ ID NO: 25833 - protein, 9 aa, Homo Sapiens
SRVFIEQDN

SEQ ID NO: 25834 - protein, 9 aa, Homo Sapiens
QLHHLMCTR

SEQ ID NO: 25835 - protein, 9 aa, Homo Sapiens
YEKDNECHV

SEQ ID NO: 25836 - protein, 9 aa, Homo Sapiens
YMWSLGCML

SEQ ID NO: 25837 - protein, 9 aa, Homo Sapiens
PPVAMVPSQ

SEQ ID NO: 25838 - protein, 9 aa, Homo Sapiens
SGIDQLLNI

SEQ ID NO: 25839 - protein, 9 aa, Homo Sapiens
VSRTLTHSI

SEQ ID NO: 25840 - protein, 9 aa, Homo Sapiens
VRNPRANFD

SEQ ID NO: 25841 - protein, 9 aa, Homo Sapiens
KEKQFVERK

SEQ ID NO: 25842 - protein, 9 aa, Homo Sapiens
HAHYEWYLK

SEQ ID NO: 25843 - protein, 9 aa, Homo Sapiens
SPAPKNGSS

SEQ ID NO: 25844 - protein, 9 aa, Homo Sapiens
EHMQMLQNP

SEQ ID NO: 25845 - protein, 9 aa, Homo Sapiens
GWKPGSNTI

SEQ ID NO: 25846 - protein, 9 aa, Homo Sapiens
KEMSKLTDY

SEQ ID NO: 25847 - protein, 9 aa, Homo Sapiens
KSDKDSTSV

SEQ ID NO: 25848 - protein, 9 aa, Homo Sapiens
RARQQCYRW

SEQ ID NO: 25849 - protein, 9 aa, Homo Sapiens
LFICDNLRD

SEQ ID NO: 25850 - protein, 9 aa, Homo Sapiens
PHRGPAGGG

SEQ ID NO: 25851 - protein, 9 aa, Homo Sapiens
NPSHAYMMN

SEQ ID NO: 25852 - protein, 9 aa, Homo Sapiens
FIEQDNDML

SEQ ID NO: 25853 - protein, 9 aa, Homo Sapiens
GGSKAPLCP

SEQ ID NO: 25854 - protein, 9 aa, Homo Sapiens
SQINSTRYN

SEQ ID NO: 25855 - protein, 9 aa, Homo Sapiens
MLKEVSKRF

SEQ ID NO: 25856 - protein, 9 aa, Homo Sapiens
IKSDIVNEM

SEQ ID NO: 25857 - protein, 9 aa, Homo Sapiens
RMVVLPCLG

SEQ ID NO: 25858 - protein, 9 aa, Homo Sapiens
IPSPELFSN

SEQ ID NO: 25859 - protein, 9 aa, Homo Sapiens
PLTLEDLKE

SEQ ID NO: 25860 - protein, 9 aa, Homo Sapiens
SKAPLCPGP

SEQ ID NO: 25861 - protein, 9 aa, Homo Sapiens
YRNTKLVLP

SEQ ID NO: 25862 - protein, 9 aa, Homo Sapiens
IQTAIDQFV

SEQ ID NO: 25863 - protein, 9 aa, Homo Sapiens
LSPFELYFN

SEQ ID NO: 25864 - protein, 9 aa, Homo Sapiens
RRQFLAPNL

SEQ ID NO: 25865 - protein, 9 aa, Homo Sapiens
IFNKMQRLI

SEQ ID NO: 25866 - protein, 9 aa, Homo Sapiens
AEPQLQWSH

SEQ ID NO: 25867 - protein, 9 aa, Homo Sapiens
PGKVELQEV

SEQ ID NO: 25868 - protein, 9 aa, Homo Sapiens
PVRYLSPKK

SEQ ID NO: 25869 - protein, 9 aa, Homo Sapiens
KEAPRGPWV

SEQ ID NO: 25870 - protein, 9 aa, Homo Sapiens
RQLSRPRRV

SEQ ID NO: 25871 - protein, 9 aa, Homo Sapiens
QFLAPNLKA

SEQ ID NO: 25872 - protein, 9 aa, Homo Sapiens
LGIRLSDEY

SEQ ID NO: 25873 - protein, 9 aa, Homo Sapiens
ENGNVTVEN

SEQ ID NO: 25874 - protein, 9 aa, Homo Sapiens
LLFFNGKDS

SEQ ID NO: 25875 - protein, 9 aa, Homo Sapiens
GDNINAFDK

SEQ ID NO: 25876 - protein, 9 aa, Homo Sapiens
SSSISHKAT

SEQ ID NO: 25877 - protein, 9 aa, Homo Sapiens
SEPFDPFDL

SEQ ID NO: 25878 - protein, 9 aa, Homo Sapiens
IDIAAAFAG

SEQ ID NO: 25879 - protein, 9 aa, Homo Sapiens
SENKRISLA

SEQ ID NO: 25880 - protein, 9 aa, Homo Sapiens
RTLRAVDTS

SEQ ID NO: 25881 - protein, 9 aa, Homo Sapiens
TISNNDDVQ

SEQ ID NO: 25882 - protein, 9 aa, Homo Sapiens
PSHELDYQR

SEQ ID NO: 25883 - protein, 9 aa, Homo Sapiens
TNSACHEHP

SEQ ID NO: 25884 - protein, 9 aa, Homo Sapiens
APAWQHRQY

SEQ ID NO: 25885 - protein, 9 aa, Homo Sapiens
PGEHQHVLS

SEQ ID NO: 25886 - protein, 9 aa, Homo Sapiens
PSAYWLVTA

SEQ ID NO: 25887 - protein, 9 aa, Homo Sapiens
QLQWSHLAS

SEQ ID NO: 25888 - protein, 9 aa, Homo Sapiens
VAASCWLQG

SEQ ID NO: 25889 - protein, 9 aa, Homo Sapiens
HKAGYGGSH

SEQ ID NO: 25890 - protein, 9 aa, Homo Sapiens
GFVFILGRA

SEQ ID NO: 25891 - protein, 9 aa, Homo Sapiens
RLLSTAEAA

SEQ ID NO: 25892 - protein, 9 aa, Homo Sapiens
CLGMLCYSH

SEQ ID NO: 25893 - protein, 9 aa, Homo Sapiens
DMQILHQVL

SEQ ID NO: 25894 - protein, 9 aa, Homo Sapiens
IQSHIGKFC

SEQ ID NO: 25895 - protein, 9 aa, Homo Sapiens
DFAKQFLQA

SEQ ID NO: 25896 - protein, 9 aa, Homo Sapiens
ELRARQQCY

SEQ ID NO: 25897 - protein, 9 aa, Homo Sapiens
HVLSNLQSR

SEQ ID NO: 25898 - protein, 9 aa, Homo Sapiens
SRVCGPLYT

SEQ ID NO: 25899 - protein, 9 aa, Homo Sapiens
GNFAIRLLK

SEQ ID NO: 25900 - protein, 9 aa, Homo Sapiens
DFTVKNVEK

SEQ ID NO: 25901 - protein, 9 aa, Homo Sapiens
SRRSTLMQH

SEQ ID NO: 25902 - protein, 9 aa, Homo Sapiens
FHWIAQALQ

SEQ ID NO: 25903 - protein, 9 aa, Homo Sapiens
ISKAVKRAR

SEQ ID NO: 25904 - protein, 9 aa, Homo Sapiens
TITEGTLLS

SEQ ID NO: 25905 - protein, 9 aa, Homo Sapiens
YDYSLYMWS

SEQ ID NO: 25906 - protein, 9 aa, Homo Sapiens
RGPHRGPAG

SEQ ID NO: 25907 - protein, 9 aa, Homo Sapiens
VQNSEIQET

SEQ ID NO: 25908 - protein, 9 aa, Homo Sapiens
YPIPVCLAQ

SEQ ID NO: 25909 - protein, 9 aa, Homo Sapiens
QMLEAQGSM

SEQ ID NO: 25910 - protein, 9 aa, Homo Sapiens
LGLSLHYNS

SEQ ID NO: 25911 - protein, 9 aa, Homo Sapiens
RQEAKTHRR

SEQ ID NO: 25912 - protein, 9 aa, Homo Sapiens
SDQSNQSVL

SEQ ID NO: 25913 - protein, 9 aa, Homo Sapiens
YLAENHAHY

SEQ ID NO: 25914 - protein, 9 aa, Homo Sapiens
ITHIVFVDF

SEQ ID NO: 25915 - protein, 9 aa, Homo Sapiens
DMNAFRKEK

SEQ ID NO: 25916 - protein, 9 aa, Homo Sapiens
FPPVAMVPS

SEQ ID NO: 25917 - protein, 9 aa, Homo Sapiens
LPGFNDCGS

SEQ ID NO: 25918 - protein, 9 aa, Homo Sapiens
VTPKAWLQE

SEQ ID NO: 25919 - protein, 9 aa, Homo Sapiens
GSLRLGKSK

SEQ ID NO: 25920 - protein, 9 aa, Homo Sapiens
NGLDMLFKV

SEQ ID NO: 25921 - protein, 9 aa, Homo Sapiens
ARQKSGNQK

SEQ ID NO: 25922 - protein, 9 aa, Homo Sapiens
CSFYIGLGF

SEQ ID NO: 25923 - protein, 9 aa, Homo Sapiens
QEVVQVSAG

SEQ ID NO: 25924 - protein, 9 aa, Homo Sapiens
YDEQYATEG

SEQ ID NO: 25925 - protein, 9 aa, Homo Sapiens
DDDAVSKMK

SEQ ID NO: 25926 - protein, 9 aa, Homo Sapiens
QVAEHYDRV

SEQ ID NO: 25927 - protein, 9 aa, Homo Sapiens
IKDFFEVAN

SEQ ID NO: 25928 - protein, 9 aa, Homo Sapiens
AEQCDASIT

SEQ ID NO: 25929 - protein, 9 aa, Homo Sapiens
GKALRPHPA

SEQ ID NO: 25930 - protein, 9 aa, Homo Sapiens
LTTHRQLMQ

SEQ ID NO: 25931 - protein, 9 aa, Homo Sapiens
AFLLHHRLK

SEQ ID NO: 25932 - protein, 9 aa, Homo Sapiens
VATKCIRPR

SEQ ID NO: 25933 - protein, 9 aa, Homo Sapiens
VRQKTVQDT

SEQ ID NO: 25934 - protein, 9 aa, Homo Sapiens
CVPYPTASL

SEQ ID NO: 25935 - protein, 9 aa, Homo Sapiens
ETYLNLHWV

SEQ ID NO: 25936 - protein, 9 aa, Homo Sapiens
ENIKKYYYI

SEQ ID NO: 25937 - protein, 9 aa, Homo Sapiens
LCPSSTQHA

SEQ ID NO: 25938 - protein, 9 aa, Homo Sapiens
LREELSKAM

SEQ ID NO: 25939 - protein, 9 aa, Homo Sapiens
DMALCNLPP

SEQ ID NO: 25940 - protein, 9 aa, Homo Sapiens
FLLHPSIRL

SEQ ID NO: 25941 - protein, 9 aa, Homo Sapiens
IVTEDSFCC

SEQ ID NO: 25942 - protein, 9 aa, Homo Sapiens
CAVWWPGQT

SEQ ID NO: 25943 - protein, 9 aa, Homo Sapiens
QTEENAVWI

SEQ ID NO: 25944 - protein, 9 aa, Homo Sapiens
RVYHLTQYE

SEQ ID NO: 25945 - protein, 9 aa, Homo Sapiens
RTLPSALPS

SEQ ID NO: 25946 - protein, 9 aa, Homo Sapiens
REQKLGETL

SEQ ID NO: 25947 - protein, 9 aa, Homo Sapiens
DIHFFEDID

SEQ ID NO: 25948 - protein, 9 aa, Homo Sapiens
MGYEMCKPD

SEQ ID NO: 25949 - protein, 9 aa, Homo Sapiens
EGLCKTVWY

SEQ ID NO: 25950 - protein, 9 aa, Homo Sapiens
PPKTSRTLQ

SEQ ID NO: 25951 - protein, 9 aa, Homo Sapiens
LTIYLVVAL

SEQ ID NO: 25952 - protein, 9 aa, Homo Sapiens
VNRHSLEVR

SEQ ID NO: 25953 - protein, 9 aa, Homo Sapiens
NRAKNRYVN

SEQ ID NO: 25954 - protein, 9 aa, Homo Sapiens
TATEETKQD

SEQ ID NO: 25955 - protein, 9 aa, Homo Sapiens
NSDSAAPTT

SEQ ID NO: 25956 - protein, 9 aa, Homo Sapiens
AHVDQRSGE

SEQ ID NO: 25957 - protein, 9 aa, Homo Sapiens
QKIKEEITQ

SEQ ID NO: 25958 - protein, 9 aa, Homo Sapiens
DLTKQGVLF

SEQ ID NO: 25959 - protein, 9 aa, Homo Sapiens
QADLLTIYL

SEQ ID NO: 25960 - protein, 9 aa, Homo Sapiens
KFTHREGDR

SEQ ID NO: 25961 - protein, 9 aa, Homo Sapiens
GCYHKPRKA

SEQ ID NO: 25962 - protein, 9 aa, Homo Sapiens
LLYLANLNQ

SEQ ID NO: 25963 - protein, 9 aa, Homo Sapiens
SLTSCVPYP

SEQ ID NO: 25964 - protein, 9 aa, Homo Sapiens
FTGQKCKTD

SEQ ID NO: 25965 - protein, 9 aa, Homo Sapiens
GYPVICMTA

SEQ ID NO: 25966 - protein, 9 aa, Homo Sapiens
ANKIRYQLR

SEQ ID NO: 25967 - protein, 9 aa, Homo Sapiens
NAIALDFHY

SEQ ID NO: 25968 - protein, 9 aa, Homo Sapiens
SLNWTKIIK

SEQ ID NO: 25969 - protein, 9 aa, Homo Sapiens
VSAPRVGEK

SEQ ID NO: 25970 - protein, 9 aa, Homo Sapiens
EQFHETFDC

SEQ ID NO: 25971 - protein, 9 aa, Homo Sapiens
VASSLTSSC

SEQ ID NO: 25972 - protein, 9 aa, Homo Sapiens
EPLRKPSRR

SEQ ID NO: 25973 - protein, 9 aa, Homo Sapiens
AALLGRLSH

SEQ ID NO: 25974 - protein, 9 aa, Homo Sapiens
CDASITIDQ

SEQ ID NO: 25975 - protein, 9 aa, Homo Sapiens
NFKFDIWSL

SEQ ID NO: 25976 - protein, 9 aa, Homo Sapiens
NKEIMMQLG

SEQ ID NO: 25977 - protein, 9 aa, Homo Sapiens
YDILYPAAP

SEQ ID NO: 25978 - protein, 9 aa, Homo Sapiens
KLQKLPEHW

SEQ ID NO: 25979 - protein, 9 aa, Homo Sapiens
AIKLVNMLD

SEQ ID NO: 25980 - protein, 9 aa, Homo Sapiens
TTDPAVRFH

SEQ ID NO: 25981 - protein, 9 aa, Homo Sapiens
HPPVFEKKF

SEQ ID NO: 25982 - protein, 9 aa, Homo Sapiens
QEFLRWRDT

SEQ ID NO: 25983 - protein, 9 aa, Homo Sapiens
GGIQTVEDQ

SEQ ID NO: 25984 - protein, 9 aa, Homo Sapiens
LANHNITHT

SEQ ID NO: 25985 - protein, 9 aa, Homo Sapiens
CTTTKDILC

SEQ ID NO: 25986 - protein, 9 aa, Homo Sapiens
ATCIPNFSY

SEQ ID NO: 25987 - protein, 9 aa, Homo Sapiens
EPRIFRIKL

SEQ ID NO: 25988 - protein, 9 aa, Homo Sapiens
FRQHLGWKW

SEQ ID NO: 25989 - protein, 9 aa, Homo Sapiens
SENIKKYYY

SEQ ID NO: 25990 - protein, 9 aa, Homo Sapiens
SKTFKNCFK

SEQ ID NO: 25991 - protein, 9 aa, Homo Sapiens
KIHTGDRPY

SEQ ID NO: 25992 - protein, 9 aa, Homo Sapiens
MLPNEILNR

SEQ ID NO: 25993 - protein, 9 aa, Homo Sapiens
VPSCGAFAS

SEQ ID NO: 25994 - protein, 9 aa, Homo Sapiens
KQLRFSMDI

SEQ ID NO: 25995 - protein, 9 aa, Homo Sapiens
KTRDVTNDV

SEQ ID NO: 25996 - protein, 9 aa, Homo Sapiens
RMLPELHLN

SEQ ID NO: 25997 - protein, 9 aa, Homo Sapiens
VTSLDLKTS

SEQ ID NO: 25998 - protein, 9 aa, Homo Sapiens
DGKLHFGIH

SEQ ID NO: 25999 - protein, 9 aa, Homo Sapiens
LTENLTGSN

SEQ ID NO: 26000 - protein, 9 aa, Homo Sapiens
QCCHRAELE

SEQ ID NO: 26001 - protein, 9 aa, Homo Sapiens
PAPSMTNGC

SEQ ID NO: 26002 - protein, 9 aa, Homo Sapiens
PQVIQQYLS

SEQ ID NO: 26003 - protein, 9 aa, Homo Sapiens
SDCSSECIK

SEQ ID NO: 26004 - protein, 9 aa, Homo Sapiens
DNDKDESEV

SEQ ID NO: 26005 - protein, 9 aa, Homo Sapiens
FGQHSSRVV

SEQ ID NO: 26006 - protein, 9 aa, Homo Sapiens
RTFSFSLPI

SEQ ID NO: 26007 - protein, 9 aa, Homo Sapiens
TNPHKDICP

SEQ ID NO: 26008 - protein, 9 aa, Homo Sapiens
DGFHPHQLA

SEQ ID NO: 26009 - protein, 9 aa, Homo Sapiens
KTFKNCFKS

SEQ ID NO: 26010 - protein, 9 aa, Homo Sapiens
LPSPGYLGR

SEQ ID NO: 26011 - protein, 9 aa, Homo Sapiens
RLNALLQPG

SEQ ID NO: 26012 - protein, 9 aa, Homo Sapiens
AMGTGRIGG

SEQ ID NO: 26013 - protein, 9 aa, Homo Sapiens
TIGKYCGDS

SEQ ID NO: 26014 - protein, 9 aa, Homo Sapiens
GESNSLTSC

SEQ ID NO: 26015 - protein, 9 aa, Homo Sapiens
YRDGVPKGQ

SEQ ID NO: 26016 - protein, 9 aa, Homo Sapiens
FEMKMPTLV

SEQ ID NO: 26017 - protein, 9 aa, Homo Sapiens
GKPPRPNGP

SEQ ID NO: 26018 - protein, 9 aa, Homo Sapiens
SGLIEHERV

SEQ ID NO: 26019 - protein, 9 aa, Homo Sapiens
PAPATHNIE

SEQ ID NO: 26020 - protein, 9 aa, Homo Sapiens
GLPHFGQHS

SEQ ID NO: 26021 - protein, 9 aa, Homo Sapiens
CPSPTPEAK

SEQ ID NO: 26022 - protein, 9 aa, Homo Sapiens
SVESSPPCI

SEQ ID NO: 26023 - protein, 9 aa, Homo Sapiens
SSGRQLHCC

SEQ ID NO: 26024 - protein, 9 aa, Homo Sapiens
FPEVRVYHL

SEQ ID NO: 26025 - protein, 9 aa, Homo Sapiens
LLRHQCCHR

SEQ ID NO: 26026 - protein, 9 aa, Homo Sapiens
LKFTHREGD

SEQ ID NO: 26027 - protein, 9 aa, Homo Sapiens
LSHLAKVQP

SEQ ID NO: 26028 - protein, 9 aa, Homo Sapiens
QTQELHYKY

SEQ ID NO: 26029 - protein, 9 aa, Homo Sapiens
PHPAAVAAA

SEQ ID NO: 26030 - protein, 9 aa, Homo Sapiens
NGQAPGAEP

SEQ ID NO: 26031 - protein, 9 aa, Homo Sapiens
SPDACVPPT

SEQ ID NO: 26032 - protein, 9 aa, Homo Sapiens
IHPRDVEAI

SEQ ID NO: 26033 - protein, 9 aa, Homo Sapiens
TLPSALPSP

SEQ ID NO: 26034 - protein, 9 aa, Homo Sapiens
HCDCAKGLS

SEQ ID NO: 26035 - protein, 9 aa, Homo Sapiens
IVIKSIVNL

SEQ ID NO: 26036 - protein, 9 aa, Homo Sapiens
DVNRHKQVI

SEQ ID NO: 26037 - protein, 9 aa, Homo Sapiens
NLLLQCFDN

SEQ ID NO: 26038 - protein, 9 aa, Homo Sapiens
DICPEKLSY

SEQ ID NO: 26039 - protein, 9 aa, Homo Sapiens
VGFEYEGKT

SEQ ID NO: 26040 - protein, 9 aa, Homo Sapiens
CFPEVRVYH

SEQ ID NO: 26041 - protein, 9 aa, Homo Sapiens
EGSEPRIFR

SEQ ID NO: 26042 - protein, 9 aa, Homo Sapiens
QFNICAKTA

SEQ ID NO: 26043 - protein, 9 aa, Homo Sapiens
KIKKKLEIA

SEQ ID NO: 26044 - protein, 9 aa, Homo Sapiens
EVTVEAWEV

SEQ ID NO: 26045 - protein, 9 aa, Homo Sapiens
HVESRMEKM

SEQ ID NO: 26046 - protein, 9 aa, Homo Sapiens
QHASASANG

SEQ ID NO: 26047 - protein, 9 aa, Homo Sapiens
SPASSLSQV

SEQ ID NO: 26048 - protein, 9 aa, Homo Sapiens
ASSLTSSCT

SEQ ID NO: 26049 - protein, 9 aa, Homo Sapiens
LFFGGPKNL

SEQ ID NO: 26050 - protein, 9 aa, Homo Sapiens
AFCKFSSFE

SEQ ID NO: 26051 - protein, 9 aa, Homo Sapiens
TQHASASAN

SEQ ID NO: 26052 - protein, 9 aa, Homo Sapiens
PPEAHNPGC

SEQ ID NO: 26053 - protein, 9 aa, Homo Sapiens
KIIKTIVDD

SEQ ID NO: 26054 - protein, 9 aa, Homo Sapiens
LMLSCLIRH

SEQ ID NO: 26055 - protein, 9 aa, Homo Sapiens
AHPRHPWPA

SEQ ID NO: 26056 - protein, 9 aa, Homo Sapiens
ASYPPGGFS

SEQ ID NO: 26057 - protein, 9 aa, Homo Sapiens
PEQWIPRTY

SEQ ID NO: 26058 - protein, 9 aa, Homo Sapiens
TESRSKTEG

SEQ ID NO: 26059 - protein, 9 aa, Homo Sapiens
PNEILNRGP

SEQ ID NO: 26060 - protein, 9 aa, Homo Sapiens
KKKLEIALE

SEQ ID NO: 26061 - protein, 9 aa, Homo Sapiens
TITEYEGHA

SEQ ID NO: 26062 - protein, 9 aa, Homo Sapiens
DNQSDAGGT

SEQ ID NO: 26063 - protein, 9 aa, Homo Sapiens
THFWAVVCY

SEQ ID NO: 26064 - protein, 9 aa, Homo Sapiens
KEFRNLSLR

SEQ ID NO: 26065 - protein, 9 aa, Homo Sapiens
FLSTAQGNT

SEQ ID NO: 26066 - protein, 9 aa, Homo Sapiens
MQTNAMYLK

SEQ ID NO: 26067 - protein, 9 aa, Homo Sapiens
PNPIKSLEK

SEQ ID NO: 26068 - protein, 9 aa, Homo Sapiens
RGMPRSRAV

SEQ ID NO: 26069 - protein, 9 aa, Homo Sapiens
QLLFFWNTS

SEQ ID NO: 26070 - protein, 9 aa, Homo Sapiens
LYEEIFSLA

SEQ ID NO: 26071 - protein, 9 aa, Homo Sapiens
TKTNESKEK

SEQ ID NO: 26072 - protein, 9 aa, Homo Sapiens
RILTPEVML

SEQ ID NO: 26073 - protein, 9 aa, Homo Sapiens
TETPTVSIK

SEQ ID NO: 26074 - protein, 9 aa, Homo Sapiens
AMSNGWEIE

SEQ ID NO: 26075 - protein, 9 aa, Homo Sapiens
GQAPGAEPA

SEQ ID NO: 26076 - protein, 9 aa, Homo Sapiens
NSLYQLLYL

SEQ ID NO: 26077 - protein, 9 aa, Homo Sapiens
TENLTGSNR

SEQ ID NO: 26078 - protein, 9 aa, Homo Sapiens
NPLAPPLVT

SEQ ID NO: 26079 - protein, 9 aa, Homo Sapiens
EKFNLDIST

SEQ ID NO: 26080 - protein, 9 aa, Homo Sapiens
DDVTESVKH

SEQ ID NO: 26081 - protein, 9 aa, Homo Sapiens
PTTLEAAEA

SEQ ID NO: 26082 - protein, 9 aa, Homo Sapiens
LIYQQATCI

SEQ ID NO: 26083 - protein, 9 aa, Homo Sapiens
FLQNLSVPH

SEQ ID NO: 26084 - protein, 9 aa, Homo Sapiens
KNMQPSKIS

SEQ ID NO: 26085 - protein, 9 aa, Homo Sapiens
NVEKPDNDK

SEQ ID NO: 26086 - protein, 9 aa, Homo Sapiens
QFHETFDCP

SEQ ID NO: 26087 - protein, 9 aa, Homo Sapiens
HFGIHPDDT

SEQ ID NO: 26088 - protein, 9 aa, Homo Sapiens
KNHDSAGVI

SEQ ID NO: 26089 - protein, 9 aa, Homo Sapiens
AQLIRRSQS

SEQ ID NO: 26090 - protein, 9 aa, Homo Sapiens
CMGCLHWLE

SEQ ID NO: 26091 - protein, 9 aa, Homo Sapiens
NTNLLLQCF

SEQ ID NO: 26092 - protein, 9 aa, Homo Sapiens
LNPLAPPLV

SEQ ID NO: 26093 - protein, 9 aa, Homo Sapiens
EPLVEQLRA

SEQ ID NO: 26094 - protein, 9 aa, Homo Sapiens
VSNPPKPLK

SEQ ID NO: 26095 - protein, 9 aa, Homo Sapiens
TEYEGHALS

SEQ ID NO: 26096 - protein, 9 aa, Homo Sapiens
AEKEREALT

SEQ ID NO: 26097 - protein, 9 aa, Homo Sapiens
RKAPQLLSQ

SEQ ID NO: 26098 - protein, 9 aa, Homo Sapiens
WWPGQTGES

SEQ ID NO: 26099 - protein, 9 aa, Homo Sapiens
NPIKSLEKE

SEQ ID NO: 26100 - protein, 9 aa, Homo Sapiens
PPCITHSPQ

SEQ ID NO: 26101 - protein, 9 aa, Homo Sapiens
FACEEYAHN

SEQ ID NO: 26102 - protein, 9 aa, Homo Sapiens
DLKPKNLLY

SEQ ID NO: 26103 - protein, 9 aa, Homo Sapiens
EDCPKAANS

SEQ ID NO: 26104 - protein, 9 aa, Homo Sapiens
VTNTSLVST

SEQ ID NO: 26105 - protein, 9 aa, Homo Sapiens
NLYSERRDI

SEQ ID NO: 26106 - protein, 9 aa, Homo Sapiens
HEHGVLELV

SEQ ID NO: 26107 - protein, 9 aa, Homo Sapiens
SVYKSLVSG

SEQ ID NO: 26108 - protein, 9 aa, Homo Sapiens
FVLDKIQKY

SEQ ID NO: 26109 - protein, 9 aa, Homo Sapiens
LNPTAHCNV

SEQ ID NO: 26110 - protein, 9 aa, Homo Sapiens
IKIHKKRVS

SEQ ID NO: 26111 - protein, 9 aa, Homo Sapiens
DEEEEDIHF

SEQ ID NO: 26112 - protein, 9 aa, Homo Sapiens
QFHVKEDIP

SEQ ID NO: 26113 - protein, 9 aa, Homo Sapiens
SCMFSLMNI

SEQ ID NO: 26114 - protein, 9 aa, Homo Sapiens
LPRNGQAPG

SEQ ID NO: 26115 - protein, 9 aa, Homo Sapiens
HNIEDEILG

SEQ ID NO: 26116 - protein, 9 aa, Homo Sapiens
MRSSMLQDP

SEQ ID NO: 26117 - protein, 9 aa, Homo Sapiens
EKQQKAQAE

SEQ ID NO: 26118 - protein, 9 aa, Homo Sapiens
DDIGIDSLD

SEQ ID NO: 26119 - protein, 9 aa, Homo Sapiens
HFFEDIDSD

SEQ ID NO: 26120 - protein, 9 aa, Homo Sapiens
GDWLKLDMP

SEQ ID NO: 26121 - protein, 9 aa, Homo Sapiens
VNCQYSLAT

SEQ ID NO: 26122 - protein, 9 aa, Homo Sapiens
LRKVLGKCK

SEQ ID NO: 26123 - protein, 9 aa, Homo Sapiens
LLHHRLKGR

SEQ ID NO: 26124 - protein, 9 aa, Homo Sapiens
DNIRTIVSL

SEQ ID NO: 26125 - protein, 9 aa, Homo Sapiens
LWQNALLQK

SEQ ID NO: 26126 - protein, 9 aa, Homo Sapiens
RSTQSVKST

SEQ ID NO: 26127 - protein, 9 aa, Homo Sapiens
IFHNFREIE

SEQ ID NO: 26128 - protein, 9 aa, Homo Sapiens
QKTLSPREL

SEQ ID NO: 26129 - protein, 9 aa, Homo Sapiens
AGWIFNRWE

SEQ ID NO: 26130 - protein, 9 aa, Homo Sapiens
LHPSIRLGH

SEQ ID NO: 26131 - protein, 9 aa, Homo Sapiens
RDFEMKMPT

SEQ ID NO: 26132 - protein, 9 aa, Homo Sapiens
VSARIDKKG

SEQ ID NO: 26133 - protein, 9 aa, Homo Sapiens
DEMFDNTAS

SEQ ID NO: 26134 - protein, 9 aa, Homo Sapiens
HRRVPSEQT

SEQ ID NO: 26135 - protein, 9 aa, Homo Sapiens
QQLQQQSQQ

SEQ ID NO: 26136 - protein, 9 aa, Homo Sapiens
PQTPLAMDR

SEQ ID NO: 26137 - protein, 9 aa, Homo Sapiens
HLPFSRSRL

SEQ ID NO: 26138 - protein, 9 aa, Homo Sapiens
LLMARLCQS

SEQ ID NO: 26139 - protein, 9 aa, Homo Sapiens
SPAGQSTCG

SEQ ID NO: 26140 - protein, 9 aa, Homo Sapiens
VESFYCLCH

SEQ ID NO: 26141 - protein, 9 aa, Homo Sapiens
AHASDNARI

SEQ ID NO: 26142 - protein, 9 aa, Homo Sapiens
MDTTMEANL

SEQ ID NO: 26143 - protein, 9 aa, Homo Sapiens
IKKKLEIAL

SEQ ID NO: 26144 - protein, 9 aa, Homo Sapiens
GEKAEKEFI

SEQ ID NO: 26145 - protein, 9 aa, Homo Sapiens
MVVNGSRNG

SEQ ID NO: 26146 - protein, 9 aa, Homo Sapiens
QPGGVLTIS

SEQ ID NO: 26147 - protein, 9 aa, Homo Sapiens
AGGTLTSSV

SEQ ID NO: 26148 - protein, 9 aa, Homo Sapiens
YGGDSTRGM

SEQ ID NO: 26149 - protein, 9 aa, Homo Sapiens
LQNARLSSE

SEQ ID NO: 26150 - protein, 9 aa, Homo Sapiens
SDLIEGLCK

SEQ ID NO: 26151 - protein, 9 aa, Homo Sapiens
NAEQCDASI

SEQ ID NO: 26152 - protein, 9 aa, Homo Sapiens
NGLNPTAHC

SEQ ID NO: 26153 - protein, 9 aa, Homo Sapiens
TSQLFYEGK

SEQ ID NO: 26154 - protein, 9 aa, Homo Sapiens
QRPKLSSPA

SEQ ID NO: 26155 - protein, 9 aa, Homo Sapiens
STQHASASA

SEQ ID NO: 26156 - protein, 9 aa, Homo Sapiens
NVFNSIQSA

SEQ ID NO: 26157 - protein, 9 aa, Homo Sapiens
DKRQQLSEE

SEQ ID NO: 26158 - protein, 9 aa, Homo Sapiens
DYLKYSCHF

SEQ ID NO: 26159 - protein, 9 aa, Homo Sapiens
EPATESRSK

SEQ ID NO: 26160 - protein, 9 aa, Homo Sapiens
GQGLDGAVD

SEQ ID NO: 26161 - protein, 9 aa, Homo Sapiens
NTLDETDAL

SEQ ID NO: 26162 - protein, 9 aa, Homo Sapiens
FQHSRSTQS

SEQ ID NO: 26163 - protein, 9 aa, Homo Sapiens
ALAHASDNA

SEQ ID NO: 26164 - protein, 9 aa, Homo Sapiens
EQWIPRTYQ

SEQ ID NO: 26165 - protein, 9 aa, Homo Sapiens
LEGDQDSHV

SEQ ID NO: 26166 - protein, 9 aa, Homo Sapiens
LPSALPSPG

SEQ ID NO: 26167 - protein, 9 aa, Homo Sapiens
RPGPWPPSP

SEQ ID NO: 26168 - protein, 9 aa, Homo Sapiens
NYRTFLKRT

SEQ ID NO: 26169 - protein, 9 aa, Homo Sapiens
QKELSKFQN

SEQ ID NO: 26170 - protein, 9 aa, Homo Sapiens
FPSKDQKKL

SEQ ID NO: 26171 - protein, 9 aa, Homo Sapiens
GSGLDFQCC

SEQ ID NO: 26172 - protein, 9 aa, Homo Sapiens
MTNGCYHKP

SEQ ID NO: 26173 - protein, 9 aa, Homo Sapiens
MASVQGSKK

SEQ ID NO: 26174 - protein, 9 aa, Homo Sapiens
SERRCLNPL

SEQ ID NO: 26175 - protein, 9 aa, Homo Sapiens
GLYSGEQFH

SEQ ID NO: 26176 - protein, 9 aa, Homo Sapiens
HFSLSQMML

SEQ ID NO: 26177 - protein, 9 aa, Homo Sapiens
LSVRKYWCQ

SEQ ID NO: 26178 - protein, 9 aa, Homo Sapiens
PMEEALAVC

SEQ ID NO: 26179 - protein, 9 aa, Homo Sapiens
LAERPPLFL

SEQ ID NO: 26180 - protein, 9 aa, Homo Sapiens
LQGSGLDFQ

SEQ ID NO: 26181 - protein, 9 aa, Homo Sapiens
EYDDDHVDS

SEQ ID NO: 26182 - protein, 9 aa, Homo Sapiens
VGQYQDVPD

SEQ ID NO: 26183 - protein, 9 aa, Homo Sapiens
KTVQDTQKI

SEQ ID NO: 26184 - protein, 9 aa, Homo Sapiens
SVTLEVEVT

SEQ ID NO: 26185 - protein, 9 aa, Homo Sapiens
FYRVLTCDI

SEQ ID NO: 26186 - protein, 9 aa, Homo Sapiens
LGRNSFKVR

SEQ ID NO: 26187 - protein, 9 aa, Homo Sapiens
WHEKHDNEN

SEQ ID NO: 26188 - protein, 9 aa, Homo Sapiens
AQEKEDPLS

SEQ ID NO: 26189 - protein, 9 aa, Homo Sapiens
QGLFQLLFF

SEQ ID NO: 26190 - protein, 9 aa, Homo Sapiens
QPGQEFYKT

SEQ ID NO: 26191 - protein, 9 aa, Homo Sapiens
QTKTMAKVI

SEQ ID NO: 26192 - protein, 9 aa, Homo Sapiens
SSHVISLFL

SEQ ID NO: 26193 - protein, 9 aa, Homo Sapiens
TTTKDILCM

SEQ ID NO: 26194 - protein, 9 aa, Homo Sapiens
DSSFDLKGE

SEQ ID NO: 26195 - protein, 9 aa, Homo Sapiens
GVATKCIRP

SEQ ID NO: 26196 - protein, 9 aa, Homo Sapiens
LRHQCCHRA

SEQ ID NO: 26197 - protein, 9 aa, Homo Sapiens
FSLLYKSSV

SEQ ID NO: 26198 - protein, 9 aa, Homo Sapiens
QTVEDQHVA

SEQ ID NO: 26199 - protein, 9 aa, Homo Sapiens
NGTGNSDSA

SEQ ID NO: 26200 - protein, 9 aa, Homo Sapiens
LQQQSQQLQ

SEQ ID NO: 26201 - protein, 9 aa, Homo Sapiens
IEHERVHSG

SEQ ID NO: 26202 - protein, 9 aa, Homo Sapiens
IDGVLITMN

SEQ ID NO: 26203 - protein, 9 aa, Homo Sapiens
TKEKQSQIT

SEQ ID NO: 26204 - protein, 9 aa, Homo Sapiens
PNAALAQAP

SEQ ID NO: 26205 - protein, 9 aa, Homo Sapiens
EDKEGETDE

SEQ ID NO: 26206 - protein, 9 aa, Homo Sapiens
TERARDIKC

SEQ ID NO: 26207 - protein, 9 aa, Homo Sapiens
QEAQKMRSI

SEQ ID NO: 26208 - protein, 9 aa, Homo Sapiens
APPCATTFD

SEQ ID NO: 26209 - protein, 9 aa, Homo Sapiens
HLAKVQPQP

SEQ ID NO: 26210 - protein, 9 aa, Homo Sapiens
VEQLRATIA

SEQ ID NO: 26211 - protein, 9 aa, Homo Sapiens
IISWQPPQV

SEQ ID NO: 26212 - protein, 9 aa, Homo Sapiens
QESPDACVP

SEQ ID NO: 26213 - protein, 9 aa, Homo Sapiens
LANSVWGES

SEQ ID NO: 26214 - protein, 9 aa, Homo Sapiens
GRFASQFSG

SEQ ID NO: 26215 - protein, 9 aa, Homo Sapiens
HNALRKHKD

SEQ ID NO: 26216 - protein, 9 aa, Homo Sapiens
EFVLDKIQK

SEQ ID NO: 26217 - protein, 9 aa, Homo Sapiens
ILSVEDNTG

SEQ ID NO: 26218 - protein, 9 aa, Homo Sapiens
GAGIKIHKK

SEQ ID NO: 26219 - protein, 9 aa, Homo Sapiens
AFEQLVVQL

SEQ ID NO: 26220 - protein, 9 aa, Homo Sapiens
TTRGAAVNA

SEQ ID NO: 26221 - protein, 9 aa, Homo Sapiens
KDESEVPSL

SEQ ID NO: 26222 - protein, 9 aa, Homo Sapiens
GYQRLIKEV

SEQ ID NO: 26223 - protein, 9 aa, Homo Sapiens
LWAECSASL

SEQ ID NO: 26224 - protein, 9 aa, Homo Sapiens
MSNGWEIEE

SEQ ID NO: 26225 - protein, 9 aa, Homo Sapiens
VLPAACVRL

SEQ ID NO: 26226 - protein, 9 aa, Homo Sapiens
QQSQQLQEV

SEQ ID NO: 26227 - protein, 9 aa, Homo Sapiens
AVCSGSFPT

SEQ ID NO: 26228 - protein, 9 aa, Homo Sapiens
SAFLLHHRL

SEQ ID NO: 26229 - protein, 9 aa, Homo Sapiens
DGVATKCIR

SEQ ID NO: 26230 - protein, 9 aa, Homo Sapiens
ILRPLTTCD

SEQ ID NO: 26231 - protein, 9 aa, Homo Sapiens
SVASKDLFP

SEQ ID NO: 26232 - protein, 9 aa, Homo Sapiens
DSGHTAVAQ

SEQ ID NO: 26233 - protein, 9 aa, Homo Sapiens
HAKLQNARL

SEQ ID NO: 26234 - protein, 9 aa, Homo Sapiens
QVIVKAISA

SEQ ID NO: 26235 - protein, 9 aa, Homo Sapiens
ASDEEHGQP

SEQ ID NO: 26236 - protein, 9 aa, Homo Sapiens
RPTGGGGPS

SEQ ID NO: 26237 - protein, 9 aa, Homo Sapiens
QWIPRTYQD

SEQ ID NO: 26238 - protein, 9 aa, Homo Sapiens
LSVDFLDDV

SEQ ID NO: 26239 - protein, 9 aa, Homo Sapiens
PAVRFHSCG

SEQ ID NO: 26240 - protein, 9 aa, Homo Sapiens
RRPTAAGLS

SEQ ID NO: 26241 - protein, 9 aa, Homo Sapiens
PLMFTSVIE

SEQ ID NO: 26242 - protein, 9 aa, Homo Sapiens
NYPLALSSS

SEQ ID NO: 26243 - protein, 9 aa, Homo Sapiens
LELFLGQIA

SEQ ID NO: 26244 - protein, 9 aa, Homo Sapiens
QARVFLANQ

SEQ ID NO: 26245 - protein, 9 aa, Homo Sapiens
LIVTEDSFC

SEQ ID NO: 26246 - protein, 9 aa, Homo Sapiens
QGHIEWPDF

SEQ ID NO: 26247 - protein, 9 aa, Homo Sapiens
SKKQNDFAQ

SEQ ID NO: 26248 - protein, 9 aa, Homo Sapiens
FCCKRKMEW

SEQ ID NO: 26249 - protein, 9 aa, Homo Sapiens
EASAARNGP

SEQ ID NO: 26250 - protein, 9 aa, Homo Sapiens
ANIKMTGTT

SEQ ID NO: 26251 - protein, 9 aa, Homo Sapiens
QKLPEHWAN

SEQ ID NO: 26252 - protein, 9 aa, Homo Sapiens
KGEQQKELS

SEQ ID NO: 26253 - protein, 9 aa, Homo Sapiens
SARIDKKGF

SEQ ID NO: 26254 - protein, 9 aa, Homo Sapiens
ASAEGKEPS

SEQ ID NO: 26255 - protein, 9 aa, Homo Sapiens
PQAASAGSC

SEQ ID NO: 26256 - protein, 9 aa, Homo Sapiens
DVTESVKHL

SEQ ID NO: 26257 - protein, 9 aa, Homo Sapiens
LVEQLRATI

SEQ ID NO: 26258 - protein, 9 aa, Homo Sapiens
SSVTRKAPQ

SEQ ID NO: 26259 - protein, 9 aa, Homo Sapiens
LALSSSAGN

SEQ ID NO: 26260 - protein, 9 aa, Homo Sapiens
ANCDSPSRV

SEQ ID NO: 26261 - protein, 9 aa, Homo Sapiens
EDQHVAELT

SEQ ID NO: 26262 - protein, 9 aa, Homo Sapiens
KNPNPIKSL

SEQ ID NO: 26263 - protein, 9 aa, Homo Sapiens
RGRELTTHR

SEQ ID NO: 26264 - protein, 9 aa, Homo Sapiens
GSRQWDILE

SEQ ID NO: 26265 - protein, 9 aa, Homo Sapiens
LCLRELDDM

SEQ ID NO: 26266 - protein, 9 aa, Homo Sapiens
PLDRCLQNL

SEQ ID NO: 26267 - protein, 9 aa, Homo Sapiens
SDACMDKNV

SEQ ID NO: 26268 - protein, 9 aa, Homo Sapiens
FEGSEPRIF

SEQ ID NO: 26269 - protein, 9 aa, Homo Sapiens
NRRPQTPKE

SEQ ID NO: 26270 - protein, 9 aa, Homo Sapiens
LNALLQPGG

SEQ ID NO: 26271 - protein, 9 aa, Homo Sapiens
HWTLATGPL

SEQ ID NO: 26272 - protein, 9 aa, Homo Sapiens
PICIPEPVL

SEQ ID NO: 26273 - protein, 9 aa, Homo Sapiens
LEIFQHCDC

SEQ ID NO: 26274 - protein, 9 aa, Homo Sapiens
VCNLDPGAA

SEQ ID NO: 26275 - protein, 9 aa, Homo Sapiens
AHCNVFVEV

SEQ ID NO: 26276 - protein, 9 aa, Homo Sapiens
CMFSLMNIE

SEQ ID NO: 26277 - protein, 9 aa, Homo Sapiens
DSAGVIFAS

SEQ ID NO: 26278 - protein, 9 aa, Homo Sapiens
SKSNDSGEK

SEQ ID NO: 26279 - protein, 9 aa, Homo Sapiens
PVQQFTSKT

SEQ ID NO: 26280 - protein, 9 aa, Homo Sapiens
LYQNVQCNS

SEQ ID NO: 26281 - protein, 9 aa, Homo Sapiens
ASSHVISLF

SEQ ID NO: 26282 - protein, 9 aa, Homo Sapiens
WHVAKMVKS

SEQ ID NO: 26283 - protein, 9 aa, Homo Sapiens
LTANKIRYQ

SEQ ID NO: 26284 - protein, 9 aa, Homo Sapiens
SLDLVEDSF

SEQ ID NO: 26285 - protein, 9 aa, Homo Sapiens
GTGNSDSAA

SEQ ID NO: 26286 - protein, 9 aa, Homo Sapiens
HKDICPEKL

SEQ ID NO: 26287 - protein, 9 aa, Homo Sapiens
CSGKKGRTF

SEQ ID NO: 26288 - protein, 9 aa, Homo Sapiens
LEDGEIDDV

SEQ ID NO: 26289 - protein, 9 aa, Homo Sapiens
FHPHQLALS

SEQ ID NO: 26290 - protein, 9 aa, Homo Sapiens
QDSHVPNVT

SEQ ID NO: 26291 - protein, 9 aa, Homo Sapiens
DLYHLELFL

SEQ ID NO: 26292 - protein, 9 aa, Homo Sapiens
QCVPQNTGY

SEQ ID NO: 26293 - protein, 9 aa, Homo Sapiens
KCSKSFLML

SEQ ID NO: 26294 - protein, 9 aa, Homo Sapiens
RGSLETHFW

SEQ ID NO: 26295 - protein, 9 aa, Homo Sapiens
RRDLEGDQD

SEQ ID NO: 26296 - protein, 9 aa, Homo Sapiens
RPRSRLRPT

SEQ ID NO: 26297 - protein, 9 aa, Homo Sapiens
LDNCKSIDG

SEQ ID NO: 26298 - protein, 9 aa, Homo Sapiens
QKMRTQTQE

SEQ ID NO: 26299 - protein, 9 aa, Homo Sapiens
RIDGVLITM

SEQ ID NO: 26300 - protein, 9 aa, Homo Sapiens
ALKSGYKGR

SEQ ID NO: 26301 - protein, 9 aa, Homo Sapiens
LEKSQFQRE

SEQ ID NO: 26302 - protein, 9 aa, Homo Sapiens
YEFTVSAEN

SEQ ID NO: 26303 - protein, 9 aa, Homo Sapiens
PGTNPHKDI

SEQ ID NO: 26304 - protein, 9 aa, Homo Sapiens
VHRDLKPKN

SEQ ID NO: 26305 - protein, 9 aa, Homo Sapiens
AAESSYRQV

SEQ ID NO: 26306 - protein, 9 aa, Homo Sapiens
SNNCTDGIR

SEQ ID NO: 26307 - protein, 9 aa, Homo Sapiens
FLFLIVSIW

SEQ ID NO: 26308 - protein, 9 aa, Homo Sapiens
EEIEKQFHV

SEQ ID NO: 26309 - protein, 9 aa, Homo Sapiens
QHVAELTLM

SEQ ID NO: 26310 - protein, 9 aa, Homo Sapiens
KLPEHWANT

SEQ ID NO: 26311 - protein, 9 aa, Homo Sapiens
EEEDIHFFE

SEQ ID NO: 26312 - protein, 9 aa, Homo Sapiens
GAGWIFNRW

SEQ ID NO: 26313 - protein, 9 aa, Homo Sapiens
LGAAAAPPC

SEQ ID NO: 26314 - protein, 9 aa, Homo Sapiens
NGCYHKPRK

SEQ ID NO: 26315 - protein, 9 aa, Homo Sapiens
QMSRGLLAV

SEQ ID NO: 26316 - protein, 9 aa, Homo Sapiens
AEGKEPSPQ

SEQ ID NO: 26317 - protein, 9 aa, Homo Sapiens
LREDKLGSD

SEQ ID NO: 26318 - protein, 9 aa, Homo Sapiens
YSGLIEHER

SEQ ID NO: 26319 - protein, 9 aa, Homo Sapiens
RLSHRLGRN

SEQ ID NO: 26320 - protein, 9 aa, Homo Sapiens
FEYEGKTEK

SEQ ID NO: 26321 - protein, 9 aa, Homo Sapiens
SKNHDSAGV

SEQ ID NO: 26322 - protein, 9 aa, Homo Sapiens
KTHVESRME

SEQ ID NO: 26323 - protein, 9 aa, Homo Sapiens
WKGWELAKE

SEQ ID NO: 26324 - protein, 9 aa, Homo Sapiens
EFNPLMFTS

SEQ ID NO: 26325 - protein, 9 aa, Homo Sapiens
AGASQSQGG

SEQ ID NO: 26326 - protein, 9 aa, Homo Sapiens
ACSSLGPVF

SEQ ID NO: 26327 - protein, 9 aa, Homo Sapiens
EEQKEYEAI

SEQ ID NO: 26328 - protein, 9 aa, Homo Sapiens
TKINFTQKL

SEQ ID NO: 26329 - protein, 9 aa, Homo Sapiens
SQFQREELK

SEQ ID NO: 26330 - protein, 9 aa, Homo Sapiens
PEVTSQGVE

SEQ ID NO: 26331 - protein, 9 aa, Homo Sapiens
TDVTITEYE

SEQ ID NO: 26332 - protein, 9 aa, Homo Sapiens
PCPSPTPEA

SEQ ID NO: 26333 - protein, 9 aa, Homo Sapiens
HEKHDNENT

SEQ ID NO: 26334 - protein, 9 aa, Homo Sapiens
SAGVIFASI

SEQ ID NO: 26335 - protein, 9 aa, Homo Sapiens
LGAGIKIHK

SEQ ID NO: 26336 - protein, 9 aa, Homo Sapiens
EASYTAQPT

SEQ ID NO: 26337 - protein, 9 aa, Homo Sapiens
SIRLGHMQP

SEQ ID NO: 26338 - protein, 9 aa, Homo Sapiens
HLCPSSTQH

SEQ ID NO: 26339 - protein, 9 aa, Homo Sapiens
SLATFSTGE

SEQ ID NO: 26340 - protein, 9 aa, Homo Sapiens
NALQSTVQS

SEQ ID NO: 26341 - protein, 9 aa, Homo Sapiens
SGHTAVAQA

SEQ ID NO: 26342 - protein, 9 aa, Homo Sapiens
VKGQGFRQF

SEQ ID NO: 26343 - protein, 9 aa, Homo Sapiens
LHHRLKGRF

SEQ ID NO: 26344 - protein, 9 aa, Homo Sapiens
FFGGPKNLK

SEQ ID NO: 26345 - protein, 9 aa, Homo Sapiens
RLPALRFIG

SEQ ID NO: 26346 - protein, 9 aa, Homo Sapiens
DDEYDDDHV

SEQ ID NO: 26347 - protein, 9 aa, Homo Sapiens
SMDNSYAEQ

SEQ ID NO: 26348 - protein, 9 aa, Homo Sapiens
KGWELAKET

SEQ ID NO: 26349 - protein, 9 aa, Homo Sapiens
VDFLDDVRR

SEQ ID NO: 26350 - protein, 9 aa, Homo Sapiens
KGRTFSFSL

SEQ ID NO: 26351 - protein, 9 aa, Homo Sapiens
SFKVRVCAC

SEQ ID NO: 26352 - protein, 9 aa, Homo Sapiens
QHSRSTQSV

SEQ ID NO: 26353 - protein, 9 aa, Homo Sapiens
LGRLSHRLG

SEQ ID NO: 26354 - protein, 9 aa, Homo Sapiens
QSPAGQSTC

SEQ ID NO: 26355 - protein, 9 aa, Homo Sapiens
GCLHWLEEA

SEQ ID NO: 26356 - protein, 9 aa, Homo Sapiens
HPDDTTITD

SEQ ID NO: 26357 - protein, 9 aa, Homo Sapiens
YQLLYLANL

SEQ ID NO: 26358 - protein, 9 aa, Homo Sapiens
LLYYYGGGS

SEQ ID NO: 26359 - protein, 9 aa, Homo Sapiens
VYHIKSAEG

SEQ ID NO: 26360 - protein, 9 aa, Homo Sapiens
TCIPNFSYM

SEQ ID NO: 26361 - protein, 9 aa, Homo Sapiens
VHWTLATGP

SEQ ID NO: 26362 - protein, 9 aa, Homo Sapiens
LTKMAQEKE

SEQ ID NO: 26363 - protein, 9 aa, Homo Sapiens
WEVTVTGPL

SEQ ID NO: 26364 - protein, 9 aa, Homo Sapiens
ANLGATGHR

SEQ ID NO: 26365 - protein, 9 aa, Homo Sapiens
EEGCLWAEC

SEQ ID NO: 26366 - protein, 9 aa, Homo Sapiens
QLIRRSQSV

SEQ ID NO: 26367 - protein, 9 aa, Homo Sapiens
HKQVIVKAI

SEQ ID NO: 26368 - protein, 9 aa, Homo Sapiens
DPQSRTFLS

SEQ ID NO: 26369 - protein, 9 aa, Homo Sapiens
KMEELIKNQ

SEQ ID NO: 26370 - protein, 9 aa, Homo Sapiens
VPVPSCGAF

SEQ ID NO: 26371 - protein, 9 aa, Homo Sapiens
QLFYEGKLM

SEQ ID NO: 26372 - protein, 9 aa, Homo Sapiens
PEAIKQLLH

SEQ ID NO: 26373 - protein, 9 aa, Homo Sapiens
PRMLPELHL

SEQ ID NO: 26374 - protein, 9 aa, Homo Sapiens
YLKYSCHFK

SEQ ID NO: 26375 - protein, 9 aa, Homo Sapiens
LSPVCRSYG

SEQ ID NO: 26376 - protein, 9 aa, Homo Sapiens
RNSFKVRVC

SEQ ID NO: 26377 - protein, 9 aa, Homo Sapiens
NHNITHTEE

SEQ ID NO: 26378 - protein, 9 aa, Homo Sapiens
FPEAQLEQS

SEQ ID NO: 26379 - protein, 9 aa, Homo Sapiens
ETVPTVAPK

SEQ ID NO: 26380 - protein, 9 aa, Homo Sapiens
SNGWEIEED

SEQ ID NO: 26381 - protein, 9 aa, Homo Sapiens
LLQKTLSPR

SEQ ID NO: 26382 - protein, 9 aa, Homo Sapiens
LCMKEDIKA

SEQ ID NO: 26383 - protein, 9 aa, Homo Sapiens
TSGASDEEH

SEQ ID NO: 26384 - protein, 9 aa, Homo Sapiens
MEANLGATG

SEQ ID NO: 26385 - protein, 9 aa, Homo Sapiens
SLLRHQCCH

SEQ ID NO: 26386 - protein, 9 aa, Homo Sapiens
HGQCIDTVE

SEQ ID NO: 26387 - protein, 9 aa, Homo Sapiens
SHVISLFLQ

SEQ ID NO: 26388 - protein, 9 aa, Homo Sapiens
DGVLITMND

SEQ ID NO: 26389 - protein, 9 aa, Homo Sapiens
VLELYEEIF

SEQ ID NO: 26390 - protein, 9 aa, Homo Sapiens
NSSTLANHN

SEQ ID NO: 26391 - protein, 9 aa, Homo Sapiens
RSFCCKRKM

SEQ ID NO: 26392 - protein, 9 aa, Homo Sapiens
GSGQQVGGQ

SEQ ID NO: 26393 - protein, 9 aa, Homo Sapiens
LRRLFCHRA

SEQ ID NO: 26394 - protein, 9 aa, Homo Sapiens
YVVPFVKYQ

SEQ ID NO: 26395 - protein, 9 aa, Homo Sapiens
DDPDGSQIQ

SEQ ID NO: 26396 - protein, 9 aa, Homo Sapiens
LSTAQGNTE

SEQ ID NO: 26397 - protein, 9 aa, Homo Sapiens
SGEPATESR

SEQ ID NO: 26398 - protein, 9 aa, Homo Sapiens
AIAYATLQY

SEQ ID NO: 26399 - protein, 9 aa, Homo Sapiens
NGKLGPQTP

SEQ ID NO: 26400 - protein, 9 aa, Homo Sapiens
KLHFGIHPD

SEQ ID NO: 26401 - protein, 9 aa, Homo Sapiens
QGSKKRKLR

SEQ ID NO: 26402 - protein, 9 aa, Homo Sapiens
GSAEAKARD

SEQ ID NO: 26403 - protein, 9 aa, Homo Sapiens
LAAPSAMTA

SEQ ID NO: 26404 - protein, 9 aa, Homo Sapiens
RAQEAQKMR

SEQ ID NO: 26405 - protein, 9 aa, Homo Sapiens
THREGDRES

SEQ ID NO: 26406 - protein, 9 aa, Homo Sapiens
PATHNIEDE

SEQ ID NO: 26407 - protein, 9 aa, Homo Sapiens
VLVAQDGAV

SEQ ID NO: 26408 - protein, 9 aa, Homo Sapiens
VPKGQLPQI

SEQ ID NO: 26409 - protein, 9 aa, Homo Sapiens
SMLQDPRRR

SEQ ID NO: 26410 - protein, 9 aa, Homo Sapiens
TMLPNEILN

SEQ ID NO: 26411 - protein, 9 aa, Homo Sapiens
MQLGRISSR

SEQ ID NO: 26412 - protein, 9 aa, Homo Sapiens
DNTASQFLA

SEQ ID NO: 26413 - protein, 9 aa, Homo Sapiens
LEDKVKLEE

SEQ ID NO: 26414 - protein, 9 aa, Homo Sapiens
RNLQKIKKK

SEQ ID NO: 26415 - protein, 9 aa, Homo Sapiens
EDGEIDDVG

SEQ ID NO: 26416 - protein, 9 aa, Homo Sapiens
LSQVDTPSS

SEQ ID NO: 26417 - protein, 9 aa, Homo Sapiens
TNTSLVSTG

SEQ ID NO: 26418 - protein, 9 aa, Homo Sapiens
TECGKAFSE

SEQ ID NO: 26419 - protein, 9 aa, Homo Sapiens
SSEETLLID

SEQ ID NO: 26420 - protein, 9 aa, Homo Sapiens
TEKTLLEDK

SEQ ID NO: 26421 - protein, 9 aa, Homo Sapiens
HGQPRRAVD

SEQ ID NO: 26422 - protein, 9 aa, Homo Sapiens
IHFFEDIDS

SEQ ID NO: 26423 - protein, 9 aa, Homo Sapiens
AGQSTCGGF

SEQ ID NO: 26424 - protein, 9 aa, Homo Sapiens
PSGPHLPFS

SEQ ID NO: 26425 - protein, 9 aa, Homo Sapiens
TSDNLEQFA

SEQ ID NO: 26426 - protein, 9 aa, Homo Sapiens
TRNRPRPTG

SEQ ID NO: 26427 - protein, 9 aa, Homo Sapiens
SVSARIDKK

SEQ ID NO: 26428 - protein, 9 aa, Homo Sapiens
AAAAGKALR

SEQ ID NO: 26429 - protein, 9 aa, Homo Sapiens
RELKKDNVF

SEQ ID NO: 26430 - protein, 9 aa, Homo Sapiens
VVSHLNPYT

SEQ ID NO: 26431 - protein, 9 aa, Homo Sapiens
GRLSHRLGR

SEQ ID NO: 26432 - protein, 9 aa, Homo Sapiens
SCRAIQYIP

SEQ ID NO: 26433 - protein, 9 aa, Homo Sapiens
LLAVYHIKS

SEQ ID NO: 26434 - protein, 9 aa, Homo Sapiens
MGYGTLVQE

SEQ ID NO: 26435 - protein, 9 aa, Homo Sapiens
RKLLGNVSF

SEQ ID NO: 26436 - protein, 9 aa, Homo Sapiens
QIKGEFYSE

SEQ ID NO: 26437 - protein, 9 aa, Homo Sapiens
LMARLCQSL

SEQ ID NO: 26438 - protein, 9 aa, Homo Sapiens
LVQVSDSAV

SEQ ID NO: 26439 - protein, 9 aa, Homo Sapiens
VAKALLYYP

SEQ ID NO: 26440 - protein, 9 aa, Homo Sapiens
KIHKKRVSD

SEQ ID NO: 26441 - protein, 9 aa, Homo Sapiens
PVPPTGDSK

SEQ ID NO: 26442 - protein, 9 aa, Homo Sapiens
TIGTIVISY

SEQ ID NO: 26443 - protein, 9 aa, Homo Sapiens
ECSKGLPMK

SEQ ID NO: 26444 - protein, 9 aa, Homo Sapiens
GGGSPWSSS

SEQ ID NO: 26445 - protein, 9 aa, Homo Sapiens
LPIKKVPSL

SEQ ID NO: 26446 - protein, 9 aa, Homo Sapiens
TVEDQHVAE

SEQ ID NO: 26447 - protein, 9 aa, Homo Sapiens
VQLVRHDDS

SEQ ID NO: 26448 - protein, 9 aa, Homo Sapiens
WDIQRIREH

SEQ ID NO: 26449 - protein, 9 aa, Homo Sapiens
CSSECIKRK

SEQ ID NO: 26450 - protein, 9 aa, Homo Sapiens
SVLVAQDGA

SEQ ID NO: 26451 - protein, 9 aa, Homo Sapiens
QKKQELSNP

SEQ ID NO: 26452 - protein, 9 aa, Homo Sapiens
ADGYICGKD

SEQ ID NO: 26453 - protein, 9 aa, Homo Sapiens
QQLQEVLGE

SEQ ID NO: 26454 - protein, 9 aa, Homo Sapiens
HQGHIEWPD

SEQ ID NO: 26455 - protein, 9 aa, Homo Sapiens
LSLAPPGDR

SEQ ID NO: 26456 - protein, 9 aa, Homo Sapiens
ILTPEVMLG

SEQ ID NO: 26457 - protein, 9 aa, Homo Sapiens
GEEGGGSPW

SEQ ID NO: 26458 - protein, 9 aa, Homo Sapiens
PKNMQPSKI

SEQ ID NO: 26459 - protein, 9 aa, Homo Sapiens
EYSSGRQLH

SEQ ID NO: 26460 - protein, 9 aa, Homo Sapiens
MGCLHWLEE

SEQ ID NO: 26461 - protein, 9 aa, Homo Sapiens
GDTPGSRQW

SEQ ID NO: 26462 - protein, 9 aa, Homo Sapiens
GYEMCKPDL

SEQ ID NO: 26463 - protein, 9 aa, Homo Sapiens
CFQHSRSTQ

SEQ ID NO: 26464 - protein, 9 aa, Homo Sapiens
SNDSGEKAE

SEQ ID NO: 26465 - protein, 9 aa, Homo Sapiens
PMDPQSRTF

SEQ ID NO: 26466 - protein, 9 aa, Homo Sapiens
SVSGPIEVV

SEQ ID NO: 26467 - protein, 9 aa, Homo Sapiens
FGKDGNIFS

SEQ ID NO: 26468 - protein, 9 aa, Homo Sapiens
RYKKERQLN

SEQ ID NO: 26469 - protein, 9 aa, Homo Sapiens
GLLLRRLFC

SEQ ID NO: 26470 - protein, 9 aa, Homo Sapiens
RGSRSSDAC

SEQ ID NO: 26471 - protein, 9 aa, Homo Sapiens
VLRYKKERQ

SEQ ID NO: 26472 - protein, 9 aa, Homo Sapiens
HGVLELVTP

SEQ ID NO: 26473 - protein, 9 aa, Homo Sapiens
EVFPEAQLE

SEQ ID NO: 26474 - protein, 9 aa, Homo Sapiens
LFGKDGNIF

SEQ ID NO: 26475 - protein, 9 aa, Homo Sapiens
LYHLELFLG

SEQ ID NO: 26476 - protein, 9 aa, Homo Sapiens
ATEETKQDD

SEQ ID NO: 26477 - protein, 9 aa, Homo Sapiens
RTLQQPRAT

SEQ ID NO: 26478 - protein, 9 aa, Homo Sapiens
HSGLPSLLV

SEQ ID NO: 26479 - protein, 9 aa, Homo Sapiens
GDSKAAPVP

SEQ ID NO: 26480 - protein, 9 aa, Homo Sapiens
TEMPTTLEA

SEQ ID NO: 26481 - protein, 9 aa, Homo Sapiens
IKCSKSFLM

SEQ ID NO: 26482 - protein, 9 aa, Homo Sapiens
GGCLCSFQR

SEQ ID NO: 26483 - protein, 9 aa, Homo Sapiens
SQLFYEGKL

SEQ ID NO: 26484 - protein, 9 aa, Homo Sapiens
EGSSVTLEV

SEQ ID NO: 26485 - protein, 9 aa, Homo Sapiens
STVQSLTSE

SEQ ID NO: 26486 - protein, 9 aa, Homo Sapiens
TPPPPGKPQ

SEQ ID NO: 26487 - protein, 9 aa, Homo Sapiens
KEVEFVLDK

SEQ ID NO: 26488 - protein, 9 aa, Homo Sapiens
CSVPPPKGF

SEQ ID NO: 26489 - protein, 9 aa, Homo Sapiens
SKSFLMLSC

SEQ ID NO: 26490 - protein, 9 aa, Homo Sapiens
AGSGHIGPS

SEQ ID NO: 26491 - protein, 9 aa, Homo Sapiens
AKFDYHCPW

SEQ ID NO: 26492 - protein, 9 aa, Homo Sapiens
TTDPKSQLI

SEQ ID NO: 26493 - protein, 9 aa, Homo Sapiens
TKFLQNLSV

SEQ ID NO: 26494 - protein, 9 aa, Homo Sapiens
HYHADNKRC

SEQ ID NO: 26495 - protein, 9 aa, Homo Sapiens
SRSTQSVKS

SEQ ID NO: 26496 - protein, 9 aa, Homo Sapiens
DGIREQYTA

SEQ ID NO: 26497 - protein, 9 aa, Homo Sapiens
LPELHLNCR

SEQ ID NO: 26498 - protein, 9 aa, Homo Sapiens
VAVPVGQYQ

SEQ ID NO: 26499 - protein, 9 aa, Homo Sapiens
YSSGRQLHC

SEQ ID NO: 26500 - protein, 9 aa, Homo Sapiens
QLGRISSRN

SEQ ID NO: 26501 - protein, 9 aa, Homo Sapiens
QYFIRDVKS

SEQ ID NO: 26502 - protein, 9 aa, Homo Sapiens
PPGDRLRLW

SEQ ID NO: 26503 - protein, 9 aa, Homo Sapiens
MDMNSLSPM

SEQ ID NO: 26504 - protein, 9 aa, Homo Sapiens
KNIFHNFRE

SEQ ID NO: 26505 - protein, 9 aa, Homo Sapiens
NNAEQCDAS

SEQ ID NO: 26506 - protein, 9 aa, Homo Sapiens
QLIYNFYYL

SEQ ID NO: 26507 - protein, 9 aa, Homo Sapiens
AASYPPGGF

SEQ ID NO: 26508 - protein, 9 aa, Homo Sapiens
NIDKSGFTY

SEQ ID NO: 26509 - protein, 9 aa, Homo Sapiens
TNDVKSIVR

SEQ ID NO: 26510 - protein, 9 aa, Homo Sapiens
KSGFTYSCP

SEQ ID NO: 26511 - protein, 9 aa, Homo Sapiens
GSSVTLEVE

SEQ ID NO: 26512 - protein, 9 aa, Homo Sapiens
VPQESLASC

SEQ ID NO: 26513 - protein, 9 aa, Homo Sapiens
NIKMTGTTK

SEQ ID NO: 26514 - protein, 9 aa, Homo Sapiens
QGLDGAVDM

SEQ ID NO: 26515 - protein, 9 aa, Homo Sapiens
TYSKNHDSA

SEQ ID NO: 26516 - protein, 9 aa, Homo Sapiens
GSVKGQGFR

SEQ ID NO: 26517 - protein, 9 aa, Homo Sapiens
ETLRQALAG

SEQ ID NO: 26518 - protein, 9 aa, Homo Sapiens
YLVSKTFKN

SEQ ID NO: 26519 - protein, 9 aa, Homo Sapiens
FQHQEWKAA

SEQ ID NO: 26520 - protein, 9 aa, Homo Sapiens
RHQCCHRAE

SEQ ID NO: 26521 - protein, 9 aa, Homo Sapiens
YNFYYLDYL

SEQ ID NO: 26522 - protein, 9 aa, Homo Sapiens
DISTVTQAF

SEQ ID NO: 26523 - protein, 9 aa, Homo Sapiens
DILRPLTTC

SEQ ID NO: 26524 - protein, 9 aa, Homo Sapiens
MLHNYPLAL

SEQ ID NO: 26525 - protein, 9 aa, Homo Sapiens
YYSSYRKPT

SEQ ID NO: 26526 - protein, 9 aa, Homo Sapiens
IIKTIVDDP

SEQ ID NO: 26527 - protein, 9 aa, Homo Sapiens
GASQSQGGG

SEQ ID NO: 26528 - protein, 9 aa, Homo Sapiens
PQESLASCE

SEQ ID NO: 26529 - protein, 9 aa, Homo Sapiens
SYRQVVLNA

SEQ ID NO: 26530 - protein, 9 aa, Homo Sapiens
PLTTCDSRF

SEQ ID NO: 26531 - protein, 9 aa, Homo Sapiens
HRQLMQERA

SEQ ID NO: 26532 - protein, 9 aa, Homo Sapiens
DWLKLDMPL

SEQ ID NO: 26533 - protein, 9 aa, Homo Sapiens
AVDSWWLDS

SEQ ID NO: 26534 - protein, 9 aa, Homo Sapiens
EKKFYIGGV

SEQ ID NO: 26535 - protein, 9 aa, Homo Sapiens
INYTSQLFY

SEQ ID NO: 26536 - protein, 9 aa, Homo Sapiens
GATLVFEVQ

SEQ ID NO: 26537 - protein, 9 aa, Homo Sapiens
EQCDASITI

SEQ ID NO: 26538 - protein, 9 aa, Homo Sapiens
RNRPRPTGR

SEQ ID NO: 26539 - protein, 9 aa, Homo Sapiens
LTGSNRRPQ

SEQ ID NO: 26540 - protein, 9 aa, Homo Sapiens
LRWRDTGVA

SEQ ID NO: 26541 - protein, 9 aa, Homo Sapiens
SGQGLDGAV

SEQ ID NO: 26542 - protein, 9 aa, Homo Sapiens
EFGGDKNGQ

SEQ ID NO: 26543 - protein, 9 aa, Homo Sapiens
GGGPSAHWE

SEQ ID NO: 26544 - protein, 9 aa, Homo Sapiens
SALPSPGYL

SEQ ID NO: 26545 - protein, 9 aa, Homo Sapiens
MGEAMSNGW

SEQ ID NO: 26546 - protein, 9 aa, Homo Sapiens
YPPGGFSLY

SEQ ID NO: 26547 - protein, 9 aa, Homo Sapiens
QLIQLKKEK

SEQ ID NO: 26548 - protein, 9 aa, Homo Sapiens
GQSTCGGFL

SEQ ID NO: 26549 - protein, 9 aa, Homo Sapiens
MRTQTQELH

SEQ ID NO: 26550 - protein, 9 aa, Homo Sapiens
RSSSGEPAT

SEQ ID NO: 26551 - protein, 9 aa, Homo Sapiens
GAAGRLALL

SEQ ID NO: 26552 - protein, 9 aa, Homo Sapiens
PPEFLYCHG

SEQ ID NO: 26553 - protein, 9 aa, Homo Sapiens
LCNLPPLRA

SEQ ID NO: 26554 - protein, 9 aa, Homo Sapiens
AKVKRRPQM

SEQ ID NO: 26555 - protein, 9 aa, Homo Sapiens
LPFEGSEPR

SEQ ID NO: 26556 - protein, 9 aa, Homo Sapiens
ARQYYVQFF

SEQ ID NO: 26557 - protein, 9 aa, Homo Sapiens
GKLGPQTPL

SEQ ID NO: 26558 - protein, 9 aa, Homo Sapiens
AYSLLRHQC

SEQ ID NO: 26559 - protein, 9 aa, Homo Sapiens
SENAHLVQH

SEQ ID NO: 26560 - protein, 9 aa, Homo Sapiens
RQYYVQFFG

SEQ ID NO: 26561 - protein, 9 aa, Homo Sapiens
PRSPRAAAA

SEQ ID NO: 26562 - protein, 9 aa, Homo Sapiens
KDQKKLTLK

SEQ ID NO: 26563 - protein, 9 aa, Homo Sapiens
PIKSLEKES

SEQ ID NO: 26564 - protein, 9 aa, Homo Sapiens
LVSEFNPLM

SEQ ID NO: 26565 - protein, 9 aa, Homo Sapiens
LDLVEDSFL

SEQ ID NO: 26566 - protein, 9 aa, Homo Sapiens
GSRNGGKLS

SEQ ID NO: 26567 - protein, 9 aa, Homo Sapiens
GEPATESRS

SEQ ID NO: 26568 - protein, 9 aa, Homo Sapiens
LIVSIWSPR

SEQ ID NO: 26569 - protein, 9 aa, Homo Sapiens
KLLGNVSFS

SEQ ID NO: 26570 - protein, 9 aa, Homo Sapiens
TNLLLQCFD

SEQ ID NO: 26571 - protein, 9 aa, Homo Sapiens
HSCGIKSCR

SEQ ID NO: 26572 - protein, 9 aa, Homo Sapiens
TTPLTLEGR

SEQ ID NO: 26573 - protein, 9 aa, Homo Sapiens
RNALEIVIK

SEQ ID NO: 26574 - protein, 9 aa, Homo Sapiens
KRKEFRNLS

SEQ ID NO: 26575 - protein, 9 aa, Homo Sapiens
LLLRRLFCH

SEQ ID NO: 26576 - protein, 9 aa, Homo Sapiens
STCGGFLVR

SEQ ID NO: 26577 - protein, 9 aa, Homo Sapiens
LLPEDMALC

SEQ ID NO: 26578 - protein, 9 aa, Homo Sapiens
KYPPMDPQS

SEQ ID NO: 26579 - protein, 9 aa, Homo Sapiens
EETLRQALA

SEQ ID NO: 26580 - protein, 9 aa, Homo Sapiens
NENTASASE

SEQ ID NO: 26581 - protein, 9 aa, Homo Sapiens
KHGYGGWQD

SEQ ID NO: 26582 - protein, 9 aa, Homo Sapiens
HRDLKPKNL

SEQ ID NO: 26583 - protein, 9 aa, Homo Sapiens
SPDQEETKI

SEQ ID NO: 26584 - protein, 9 aa, Homo Sapiens
TIGVDLALK

SEQ ID NO: 26585 - protein, 9 aa, Homo Sapiens
NRPRFAEIN

SEQ ID NO: 26586 - protein, 9 aa, Homo Sapiens
TRKAPQLLS

SEQ ID NO: 26587 - protein, 9 aa, Homo Sapiens
KSIDGKIEG

SEQ ID NO: 26588 - protein, 9 aa, Homo Sapiens
LLKTHVESR

SEQ ID NO: 26589 - protein, 9 aa, Homo Sapiens
GPLPSVASK

SEQ ID NO: 26590 - protein, 9 aa, Homo Sapiens
EDIHFFEDI

SEQ ID NO: 26591 - protein, 9 aa, Homo Sapiens
CHGVPRTLS

SEQ ID NO: 26592 - protein, 9 aa, Homo Sapiens
LGDTPGSRQ

SEQ ID NO: 26593 - protein, 9 aa, Homo Sapiens
AVGFEYEGK

SEQ ID NO: 26594 - protein, 9 aa, Homo Sapiens
LPITEFKGI

SEQ ID NO: 26595 - protein, 9 aa, Homo Sapiens
LSRPRSRLR

SEQ ID NO: 26596 - protein, 9 aa, Homo Sapiens
KHKNAAPAL

SEQ ID NO: 26597 - protein, 9 aa, Homo Sapiens
LPEDMALCN

SEQ ID NO: 26598 - protein, 9 aa, Homo Sapiens
VSIWSPRRL

SEQ ID NO: 26599 - protein, 9 aa, Homo Sapiens
IQSPAGQST

SEQ ID NO: 26600 - protein, 9 aa, Homo Sapiens
DILLNIIEW

SEQ ID NO: 26601 - protein, 9 aa, Homo Sapiens
YATLQYFIR

SEQ ID NO: 26602 - protein, 9 aa, Homo Sapiens
NAEAMEPEL

SEQ ID NO: 26603 - protein, 9 aa, Homo Sapiens
FNICAKTAV

SEQ ID NO: 26604 - protein, 9 aa, Homo Sapiens
RFIGLKCLE

SEQ ID NO: 26605 - protein, 9 aa, Homo Sapiens
TRGMPRSRA

SEQ ID NO: 26606 - protein, 9 aa, Homo Sapiens
EEDIHFFED

SEQ ID NO: 26607 - protein, 9 aa, Homo Sapiens
LPALRFIGL

SEQ ID NO: 26608 - protein, 9 aa, Homo Sapiens
PKSQLIQLK

SEQ ID NO: 26609 - protein, 9 aa, Homo Sapiens
AGLSRPRSR

SEQ ID NO: 26610 - protein, 9 aa, Homo Sapiens
NIEDEILGS

SEQ ID NO: 26611 - protein, 9 aa, Homo Sapiens
QSTCGGFLV

SEQ ID NO: 26612 - protein, 9 aa, Homo Sapiens
SFRQTEENA

SEQ ID NO: 26613 - protein, 9 aa, Homo Sapiens
FNLDISTVT

SEQ ID NO: 26614 - protein, 9 aa, Homo Sapiens
EVCKQELCP

SEQ ID NO: 26615 - protein, 9 aa, Homo Sapiens
PDPLACSVP

SEQ ID NO: 26616 - protein, 9 aa, Homo Sapiens
NGWEIEEDK

SEQ ID NO: 26617 - protein, 9 aa, Homo Sapiens
TLQQPRATL

SEQ ID NO: 26618 - protein, 9 aa, Homo Sapiens
VVQLIVTED

SEQ ID NO: 26619 - protein, 9 aa, Homo Sapiens
TLAKGEYNM

SEQ ID NO: 26620 - protein, 9 aa, Homo Sapiens
KVAASCRAI

SEQ ID NO: 26621 - protein, 9 aa, Homo Sapiens
QRQRSGSES

SEQ ID NO: 26622 - protein, 9 aa, Homo Sapiens
ELAKETTRN

SEQ ID NO: 26623 - protein, 9 aa, Homo Sapiens
QLRATIASA

SEQ ID NO: 26624 - protein, 9 aa, Homo Sapiens
FLIVSIWSP

SEQ ID NO: 26625 - protein, 9 aa, Homo Sapiens
HEEGEPQAA

SEQ ID NO: 26626 - protein, 9 aa, Homo Sapiens
VRYFPSKDQ

SEQ ID NO: 26627 - protein, 9 aa, Homo Sapiens
ELSKAMSEV

SEQ ID NO: 26628 - protein, 9 aa, Homo Sapiens
EMHDVKNYR

SEQ ID NO: 26629 - protein, 9 aa, Homo Sapiens
DDVGFEEIQ

SEQ ID NO: 26630 - protein, 9 aa, Homo Sapiens
AETLDVQIK

SEQ ID NO: 26631 - protein, 9 aa, Homo Sapiens
GQCIDTVES

SEQ ID NO: 26632 - protein, 9 aa, Homo Sapiens
ANSVWGESS

SEQ ID NO: 26633 - protein, 9 aa, Homo Sapiens
PRNGQAPGA

SEQ ID NO: 26634 - protein, 9 aa, Homo Sapiens
PSCNGLAKG

SEQ ID NO: 26635 - protein, 9 aa, Homo Sapiens
MPTTLEAAE

SEQ ID NO: 26636 - protein, 9 aa, Homo Sapiens
VSPISESML

SEQ ID NO: 26637 - protein, 9 aa, Homo Sapiens
DETNSAVHS

SEQ ID NO: 26638 - protein, 9 aa, Homo Sapiens
PPMDPQSRT

SEQ ID NO: 26639 - protein, 9 aa, Homo Sapiens
MDNSYAEQG

SEQ ID NO: 26640 - protein, 9 aa, Homo Sapiens
SHLNPYTLR

SEQ ID NO: 26641 - protein, 9 aa, Homo Sapiens
REHSDCSSE

SEQ ID NO: 26642 - protein, 9 aa, Homo Sapiens
HFVPNSFIG

SEQ ID NO: 26643 - protein, 9 aa, Homo Sapiens
AAEAAIKKQ

SEQ ID NO: 26644 - protein, 9 aa, Homo Sapiens
VESRMEKMM

SEQ ID NO: 26645 - protein, 9 aa, Homo Sapiens
AVPVGQYQD

SEQ ID NO: 26646 - protein, 9 aa, Homo Sapiens
GKYYEMALQ

SEQ ID NO: 26647 - protein, 9 aa, Homo Sapiens
IKSAEGRKK

SEQ ID NO: 26648 - protein, 9 aa, Homo Sapiens
MFSLMNIEP

SEQ ID NO: 26649 - protein, 9 aa, Homo Sapiens
CLGGTPVSA

SEQ ID NO: 26650 - protein, 9 aa, Homo Sapiens
ATDDSCTQN

SEQ ID NO: 26651 - protein, 9 aa, Homo Sapiens
IKRKEFRNL

SEQ ID NO: 26652 - protein, 9 aa, Homo Sapiens
STLANHNIT

SEQ ID NO: 26653 - protein, 9 aa, Homo Sapiens
NYKLQKKQE

SEQ ID NO: 26654 - protein, 9 aa, Homo Sapiens
MALCNLPPL

SEQ ID NO: 26655 - protein, 9 aa, Homo Sapiens
LDETDALLT

SEQ ID NO: 26656 - protein, 9 aa, Homo Sapiens
ATAGASQSQ

SEQ ID NO: 26657 - protein, 9 aa, Homo Sapiens
VRELKKDNV

SEQ ID NO: 26658 - protein, 9 aa, Homo Sapiens
YEAIKLVNM

SEQ ID NO: 26659 - protein, 9 aa, Homo Sapiens
LAAKLCMGC

SEQ ID NO: 26660 - protein, 9 aa, Homo Sapiens
DSVLVAQDG

SEQ ID NO: 26661 - protein, 9 aa, Homo Sapiens
QQDVEECSK

SEQ ID NO: 26662 - protein, 9 aa, Homo Sapiens
VPNSFIGMG

SEQ ID NO: 26663 - protein, 9 aa, Homo Sapiens
RFSMDIDVS

SEQ ID NO: 26664 - protein, 9 aa, Homo Sapiens
SFFFMVLQD

SEQ ID NO: 26665 - protein, 9 aa, Homo Sapiens
ELYDYLKYS

SEQ ID NO: 26666 - protein, 9 aa, Homo Sapiens
VCAAAPAMG

SEQ ID NO: 26667 - protein, 9 aa, Homo Sapiens
TESVKHLLS

SEQ ID NO: 26668 - protein, 9 aa, Homo Sapiens
QLQGSGLDF

SEQ ID NO: 26669 - protein, 9 aa, Homo Sapiens
LGGSSAFLL

SEQ ID NO: 26670 - protein, 9 aa, Homo Sapiens
IEDEILGSE

SEQ ID NO: 26671 - protein, 9 aa, Homo Sapiens
VSFRQTEEN

SEQ ID NO: 26672 - protein, 9 aa, Homo Sapiens
RDGFHPHQL

SEQ ID NO: 26673 - protein, 9 aa, Homo Sapiens
VPPPKGFTA

SEQ ID NO: 26674 - protein, 9 aa, Homo Sapiens
GHIGPSTLH

SEQ ID NO: 26675 - protein, 9 aa, Homo Sapiens
GLSRPRSRL

SEQ ID NO: 26676 - protein, 9 aa, Homo Sapiens
KTITQIQEF

SEQ ID NO: 26677 - protein, 9 aa, Homo Sapiens
QQKELSKFQ

SEQ ID NO: 26678 - protein, 9 aa, Homo Sapiens
GCAKGKAVA

SEQ ID NO: 26679 - protein, 9 aa, Homo Sapiens
TSKTFSFVL

SEQ ID NO: 26680 - protein, 9 aa, Homo Sapiens
MLEYNPAKR

SEQ ID NO: 26681 - protein, 9 aa, Homo Sapiens
AQKMRSIQE

SEQ ID NO: 26682 - protein, 9 aa, Homo Sapiens
AAGLSRPRS

SEQ ID NO: 26683 - protein, 9 aa, Homo Sapiens
RVLLAVYHI

SEQ ID NO: 26684 - protein, 9 aa, Homo Sapiens
GIHPDDTTI

SEQ ID NO: 26685 - protein, 9 aa, Homo Sapiens
SGASDEEHG

SEQ ID NO: 26686 - protein, 9 aa, Homo Sapiens
REALTTEAD

SEQ ID NO: 26687 - protein, 9 aa, Homo Sapiens
LLLLQIIEF

SEQ ID NO: 26688 - protein, 9 aa, Homo Sapiens
KNGKLGPQT

SEQ ID NO: 26689 - protein, 9 aa, Homo Sapiens
PWPAAQPSA

SEQ ID NO: 26690 - protein, 9 aa, Homo Sapiens
ERQLIYNFY

SEQ ID NO: 26691 - protein, 9 aa, Homo Sapiens
SVKHLLSNE

SEQ ID NO: 26692 - protein, 9 aa, Homo Sapiens
PEDTAECQA

SEQ ID NO: 26693 - protein, 9 aa, Homo Sapiens
IDSLDLVED

SEQ ID NO: 26694 - protein, 9 aa, Homo Sapiens
SAMTAAAAM

SEQ ID NO: 26695 - protein, 9 aa, Homo Sapiens
SSVYKSLVS

SEQ ID NO: 26696 - protein, 9 aa, Homo Sapiens
LVCNLDPGA

SEQ ID NO: 26697 - protein, 9 aa, Homo Sapiens
RPGTNPHKD

SEQ ID NO: 26698 - protein, 9 aa, Homo Sapiens
DSTRGMPRS

SEQ ID NO: 26699 - protein, 9 aa, Homo Sapiens
YEMCKPDLR

SEQ ID NO: 26700 - protein, 9 aa, Homo Sapiens
CKSIDGKIE

SEQ ID NO: 26701 - protein, 9 aa, Homo Sapiens
EKAEKEFIF

SEQ ID NO: 26702 - protein, 9 aa, Homo Sapiens
TELNVTSLD

SEQ ID NO: 26703 - protein, 9 aa, Homo Sapiens
KVSAPRVGE

SEQ ID NO: 26704 - protein, 9 aa, Homo Sapiens
GGTPVSASS

SEQ ID NO: 26705 - protein, 9 aa, Homo Sapiens
YYYGGGSAE

SEQ ID NO: 26706 - protein, 9 aa, Homo Sapiens
NYYSSYRKP

SEQ ID NO: 26707 - protein, 9 aa, Homo Sapiens
IHPQEFLRW

SEQ ID NO: 26708 - protein, 9 aa, Homo Sapiens
WTKIIKTIV

SEQ ID NO: 26709 - protein, 9 aa, Homo Sapiens
IATEALDNI

SEQ ID NO: 26710 - protein, 9 aa, Homo Sapiens
GVLAFLAYQ

SEQ ID NO: 26711 - protein, 9 aa, Homo Sapiens
NCSGKKGRT

SEQ ID NO: 26712 - protein, 9 aa, Homo Sapiens
SSAFLLHHR

SEQ ID NO: 26713 - protein, 9 aa, Homo Sapiens
RTLSRDQFN

SEQ ID NO: 26714 - protein, 9 aa, Homo Sapiens
IGVDLALKV

SEQ ID NO: 26715 - protein, 9 aa, Homo Sapiens
SRLRPTRNR

SEQ ID NO: 26716 - protein, 9 aa, Homo Sapiens
KQQDVEECS

SEQ ID NO: 26717 - protein, 9 aa, Homo Sapiens
TLNYYSSYR

SEQ ID NO: 26718 - protein, 9 aa, Homo Sapiens
YSGEQFHET

SEQ ID NO: 26719 - protein, 9 aa, Homo Sapiens
GTTARCPTG

SEQ ID NO: 26720 - protein, 9 aa, Homo Sapiens
PVFEKKFYI

SEQ ID NO: 26721 - protein, 9 aa, Homo Sapiens
DPWHVAKMV

SEQ ID NO: 26722 - protein, 9 aa, Homo Sapiens
CIAKFDYHC

SEQ ID NO: 26723 - protein, 9 aa, Homo Sapiens
SLFGKDGNI

SEQ ID NO: 26724 - protein, 9 aa, Homo Sapiens
GVGWAADGY

SEQ ID NO: 26725 - protein, 9 aa, Homo Sapiens
DAGGTLTSS

SEQ ID NO: 26726 - protein, 9 aa, Homo Sapiens
AHPLPMWTP

SEQ ID NO: 26727 - protein, 9 aa, Homo Sapiens
LACGTNSLS

SEQ ID NO: 26728 - protein, 9 aa, Homo Sapiens
QLQQQSQQL

SEQ ID NO: 26729 - protein, 9 aa, Homo Sapiens
WCQISQQQW

SEQ ID NO: 26730 - protein, 9 aa, Homo Sapiens
LSDDKRQQL

SEQ ID NO: 26731 - protein, 9 aa, Homo Sapiens
PTGDSKAAP

SEQ ID NO: 26732 - protein, 9 aa, Homo Sapiens
TITQIQEFS

SEQ ID NO: 26733 - protein, 9 aa, Homo Sapiens
KSKKQNDFA

SEQ ID NO: 26734 - protein, 9 aa, Homo Sapiens
QSLVCNLDP

SEQ ID NO: 26735 - protein, 9 aa, Homo Sapiens
DKSGFTYSC

SEQ ID NO: 26736 - protein, 9 aa, Homo Sapiens
LDPSLSGQI

SEQ ID NO: 26737 - protein, 9 aa, Homo Sapiens
LITMNDTRL

SEQ ID NO: 26738 - protein, 9 aa, Homo Sapiens
VEDNTGHRI

SEQ ID NO: 26739 - protein, 9 aa, Homo Sapiens
HWVNVVYYS

SEQ ID NO: 26740 - protein, 9 aa, Homo Sapiens
QNVQCNSLR

SEQ ID NO: 26741 - protein, 9 aa, Homo Sapiens
SLDLKTSVE

SEQ ID NO: 26742 - protein, 9 aa, Homo Sapiens
EQKLGETLS

SEQ ID NO: 26743 - protein, 9 aa, Homo Sapiens
KETSICAGY

SEQ ID NO: 26744 - protein, 9 aa, Homo Sapiens
RLPHFSLSQ

SEQ ID NO: 26745 - protein, 9 aa, Homo Sapiens
RLVVSHLNP

SEQ ID NO: 26746 - protein, 9 aa, Homo Sapiens
QNRAKNRYV

SEQ ID NO: 26747 - protein, 9 aa, Homo Sapiens
GDETNSAVH

SEQ ID NO: 26748 - protein, 9 aa, Homo Sapiens
PWSSSEISK

SEQ ID NO: 26749 - protein, 9 aa, Homo Sapiens
QNTGYTYAL

SEQ ID NO: 26750 - protein, 9 aa, Homo Sapiens
TPEVMLGMS

SEQ ID NO: 26751 - protein, 9 aa, Homo Sapiens
ISLFLQHNK

SEQ ID NO: 26752 - protein, 9 aa, Homo Sapiens
AKLCMGCLH

SEQ ID NO: 26753 - protein, 9 aa, Homo Sapiens
SQIQKIKEE

SEQ ID NO: 26754 - protein, 9 aa, Homo Sapiens
YTSQLFYEG

SEQ ID NO: 26755 - protein, 9 aa, Homo Sapiens
ECLAGDWLK

SEQ ID NO: 26756 - protein, 9 aa, Homo Sapiens
KKERQLNEA

SEQ ID NO: 26757 - protein, 9 aa, Homo Sapiens
ETSSPACKQ

SEQ ID NO: 26758 - protein, 9 aa, Homo Sapiens
EQLVVQLVR

SEQ ID NO: 26759 - protein, 9 aa, Homo Sapiens
LKSGYKGRV

SEQ ID NO: 26760 - protein, 9 aa, Homo Sapiens
PSMTNGCYH

SEQ ID NO: 26761 - protein, 9 aa, Homo Sapiens
DSAQRGSCP

SEQ ID NO: 26762 - protein, 9 aa, Homo Sapiens
VTVSFRQTE

SEQ ID NO: 26763 - protein, 9 aa, Homo Sapiens
KTTCEDKEG

SEQ ID NO: 26764 - protein, 9 aa, Homo Sapiens
FGGPKNLKG

SEQ ID NO: 26765 - protein, 9 aa, Homo Sapiens
LQGLPHFGQ

SEQ ID NO: 26766 - protein, 9 aa, Homo Sapiens
QNALLQKTL

SEQ ID NO: 26767 - protein, 9 aa, Homo Sapiens
DQEETKINF

SEQ ID NO: 26768 - protein, 9 aa, Homo Sapiens
CVCGVGWAA

SEQ ID NO: 26769 - protein, 9 aa, Homo Sapiens
VLGKCKCGE

SEQ ID NO: 26770 - protein, 9 aa, Homo Sapiens
WSSSEISKL

SEQ ID NO: 26771 - protein, 9 aa, Homo Sapiens
LLYYPLPFF

SEQ ID NO: 26772 - protein, 9 aa, Homo Sapiens
VLQQHVLEL

SEQ ID NO: 26773 - protein, 9 aa, Homo Sapiens
QMGEAMSNG

SEQ ID NO: 26774 - protein, 9 aa, Homo Sapiens
GLCKTVWYS

SEQ ID NO: 26775 - protein, 9 aa, Homo Sapiens
KRTADRWKT

SEQ ID NO: 26776 - protein, 9 aa, Homo Sapiens
FGGDKNGQR

SEQ ID NO: 26777 - protein, 9 aa, Homo Sapiens
FGLYSGEQF

SEQ ID NO: 26778 - protein, 9 aa, Homo Sapiens
CGELVDCLK

SEQ ID NO: 26779 - protein, 9 aa, Homo Sapiens
RNGQAPGAE

SEQ ID NO: 26780 - protein, 9 aa, Homo Sapiens
GCSSEETLL

SEQ ID NO: 26781 - protein, 9 aa, Homo Sapiens
ANHNITHTE

SEQ ID NO: 26782 - protein, 9 aa, Homo Sapiens
YPQSLVCNL

SEQ ID NO: 26783 - protein, 9 aa, Homo Sapiens
SAEVSNPPK

SEQ ID NO: 26784 - protein, 9 aa, Homo Sapiens
IKVAASCRA

SEQ ID NO: 26785 - protein, 9 aa, Homo Sapiens
RQWDILETE

SEQ ID NO: 26786 - protein, 9 aa, Homo Sapiens
PNSFIGMGV

SEQ ID NO: 26787 - protein, 9 aa, Homo Sapiens
IKKYYYISS

SEQ ID NO: 26788 - protein, 9 aa, Homo Sapiens
IKTIVDDPE

SEQ ID NO: 26789 - protein, 9 aa, Homo Sapiens
FLAYQRYKA

SEQ ID NO: 26790 - protein, 9 aa, Homo Sapiens
AASCRAIQY

SEQ ID NO: 26791 - protein, 9 aa, Homo Sapiens
FHSCGIKSC

SEQ ID NO: 26792 - protein, 9 aa, Homo Sapiens
VSGPIEVVL

SEQ ID NO: 26793 - protein, 9 aa, Homo Sapiens
KTLLEDKVK

SEQ ID NO: 26794 - protein, 9 aa, Homo Sapiens
VNVVYYSPN

SEQ ID NO: 26795 - protein, 9 aa, Homo Sapiens
CIKRKEFRN

SEQ ID NO: 26796 - protein, 9 aa, Homo Sapiens
ICIPEPVLQ

SEQ ID NO: 26797 - protein, 9 aa, Homo Sapiens
MFDNTASQF

SEQ ID NO: 26798 - protein, 9 aa, Homo Sapiens
GVDVNRHKQ

SEQ ID NO: 26799 - protein, 9 aa, Homo Sapiens
TGTITEVST

SEQ ID NO: 26800 - protein, 9 aa, Homo Sapiens
ASESGCKVS

SEQ ID NO: 26801 - protein, 9 aa, Homo Sapiens
AAAPAMGTG

SEQ ID NO: 26802 - protein, 9 aa, Homo Sapiens
LAVRQKTVQ

SEQ ID NO: 26803 - protein, 9 aa, Homo Sapiens
RFQHQEWKA

SEQ ID NO: 26804 - protein, 9 aa, Homo Sapiens
LSRDQFNIC

SEQ ID NO: 26805 - protein, 9 aa, Homo Sapiens
VPASESGCK

SEQ ID NO: 26806 - protein, 9 aa, Homo Sapiens
AHWEAGTTA

SEQ ID NO: 26807 - protein, 9 aa, Homo Sapiens
MAAPWRPWP

SEQ ID NO: 26808 - protein, 9 aa, Homo Sapiens
QVFTIGTIV

SEQ ID NO: 26809 - protein, 9 aa, Homo Sapiens
KLQKKQELS

SEQ ID NO: 26810 - protein, 9 aa, Homo Sapiens
GREQKLGET

SEQ ID NO: 26811 - protein, 9 aa, Homo Sapiens
LLNIIEWLL

SEQ ID NO: 26812 - protein, 9 aa, Homo Sapiens
SLAQLLLLQ

SEQ ID NO: 26813 - protein, 9 aa, Homo Sapiens
EKSQFQREE

SEQ ID NO: 26814 - protein, 9 aa, Homo Sapiens
PARPSGPHL

SEQ ID NO: 26815 - protein, 9 aa, Homo Sapiens
QLRFSMDID

SEQ ID NO: 26816 - protein, 9 aa, Homo Sapiens
YWCQISQQQ

SEQ ID NO: 26817 - protein, 9 aa, Homo Sapiens
VQQFTSKTF

SEQ ID NO: 26818 - protein, 9 aa, Homo Sapiens
ATALQSRFL

SEQ ID NO: 26819 - protein, 9 aa, Homo Sapiens
GLNPTAHCN

SEQ ID NO: 26820 - protein, 9 aa, Homo Sapiens
PSRAVPKGR

SEQ ID NO: 26821 - protein, 9 aa, Homo Sapiens
KTDVTITEY

SEQ ID NO: 26822 - protein, 9 aa, Homo Sapiens
PVFNESRPV

SEQ ID NO: 26823 - protein, 9 aa, Homo Sapiens
PTLESETQA

SEQ ID NO: 26824 - protein, 9 aa, Homo Sapiens
APAMGTGRI

SEQ ID NO: 26825 - protein, 9 aa, Homo Sapiens
VEMHDVKNY

SEQ ID NO: 26826 - protein, 9 aa, Homo Sapiens
AKDPLDRCL

SEQ ID NO: 26827 - protein, 9 aa, Homo Sapiens
GCLWAECSA

SEQ ID NO: 26828 - protein, 9 aa, Homo Sapiens
ASVQGSKKR

SEQ ID NO: 26829 - protein, 9 aa, Homo Sapiens
KKDNVFNSI

SEQ ID NO: 26830 - protein, 9 aa, Homo Sapiens
ADNKRCRKC

SEQ ID NO: 26831 - protein, 9 aa, Homo Sapiens
LDFHYRREL

SEQ ID NO: 26832 - protein, 9 aa, Homo Sapiens
GRLVVSHLN

SEQ ID NO: 26833 - protein, 9 aa, Homo Sapiens
LKKSKKQND

SEQ ID NO: 26834 - protein, 9 aa, Homo Sapiens
AAPPCLPGL

SEQ ID NO: 26835 - protein, 9 aa, Homo Sapiens
ESSYRQVVL

SEQ ID NO: 26836 - protein, 9 aa, Homo Sapiens
VTSQGVETS

SEQ ID NO: 26837 - protein, 9 aa, Homo Sapiens
EMCKPDLRA

SEQ ID NO: 26838 - protein, 9 aa, Homo Sapiens
HNFREIEVE

SEQ ID NO: 26839 - protein, 9 aa, Homo Sapiens
LKDILRPLT

SEQ ID NO: 26840 - protein, 9 aa, Homo Sapiens
HGYGGWQDL

SEQ ID NO: 26841 - protein, 9 aa, Homo Sapiens
PIEVVLVNK

SEQ ID NO: 26842 - protein, 9 aa, Homo Sapiens
IQKIKEEIT

SEQ ID NO: 26843 - protein, 9 aa, Homo Sapiens
MMKEFLSTA

SEQ ID NO: 26844 - protein, 9 aa, Homo Sapiens
HRPHSGVFY

SEQ ID NO: 26845 - protein, 9 aa, Homo Sapiens
DNVFNSIQS

SEQ ID NO: 26846 - protein, 9 aa, Homo Sapiens
ETPTVSIKE

SEQ ID NO: 26847 - protein, 9 aa, Homo Sapiens
DNRDKRTAD

SEQ ID NO: 26848 - protein, 9 aa, Homo Sapiens
SPRDPDANC

SEQ ID NO: 26849 - protein, 9 aa, Homo Sapiens
LNYYSSYRK

SEQ ID NO: 26850 - protein, 9 aa, Homo Sapiens
LPVTNTSLV

SEQ ID NO: 26851 - protein, 9 aa, Homo Sapiens
GSEPRIFRI

SEQ ID NO: 26852 - protein, 9 aa, Homo Sapiens
KENVDVASL

SEQ ID NO: 26853 - protein, 9 aa, Homo Sapiens
KSAVGFEYE

SEQ ID NO: 26854 - protein, 9 aa, Homo Sapiens
KGNKLLAPV

SEQ ID NO: 26855 - protein, 9 aa, Homo Sapiens
DCPKAANSP

SEQ ID NO: 26856 - protein, 9 aa, Homo Sapiens
DVKNYRTFL

SEQ ID NO: 26857 - protein, 9 aa, Homo Sapiens
AKEGKTTEL

SEQ ID NO: 26858 - protein, 9 aa, Homo Sapiens
VSEFNPLMF

SEQ ID NO: 26859 - protein, 9 aa, Homo Sapiens
CRGYCSQKA

SEQ ID NO: 26860 - protein, 9 aa, Homo Sapiens
SQQLQEVLG

SEQ ID NO: 26861 - protein, 9 aa, Homo Sapiens
VRNLQKIKK

SEQ ID NO: 26862 - protein, 9 aa, Homo Sapiens
KLPRNGQAP

SEQ ID NO: 26863 - protein, 9 aa, Homo Sapiens
QQATCIPNF

SEQ ID NO: 26864 - protein, 9 aa, Homo Sapiens
CNGLAKGNK

SEQ ID NO: 26865 - protein, 9 aa, Homo Sapiens
STTGVNSSS

SEQ ID NO: 26866 - protein, 9 aa, Homo Sapiens
LLGTVCGEL

SEQ ID NO: 26867 - protein, 9 aa, Homo Sapiens
FRNLSLRLP

SEQ ID NO: 26868 - protein, 9 aa, Homo Sapiens
PHRSFCCKR

SEQ ID NO: 26869 - protein, 9 aa, Homo Sapiens
SVDFLDDVR

SEQ ID NO: 26870 - protein, 9 aa, Homo Sapiens
RRVPSEQTY

SEQ ID NO: 26871 - protein, 9 aa, Homo Sapiens
RIDKKGFCE

SEQ ID NO: 26872 - protein, 9 aa, Homo Sapiens
THRQLMQER

SEQ ID NO: 26873 - protein, 9 aa, Homo Sapiens
DPEHQGHIE

SEQ ID NO: 26874 - protein, 9 aa, Homo Sapiens
TVEASYTAQ

SEQ ID NO: 26875 - protein, 9 aa, Homo Sapiens
LDDMSLTPD

SEQ ID NO: 26876 - protein, 9 aa, Homo Sapiens
SESMLERLS

SEQ ID NO: 26877 - protein, 9 aa, Homo Sapiens
QSNGTGNSD

SEQ ID NO: 26878 - protein, 9 aa, Homo Sapiens
VNSMDNSYA

SEQ ID NO: 26879 - protein, 9 aa, Homo Sapiens
LSGQITASL

SEQ ID NO: 26880 - protein, 9 aa, Homo Sapiens
IEVVLVNKE

SEQ ID NO: 26881 - protein, 9 aa, Homo Sapiens
KYWCQISQQ

SEQ ID NO: 26882 - protein, 9 aa, Homo Sapiens
FFLFLIVSI

SEQ ID NO: 26883 - protein, 9 aa, Homo Sapiens
SQSQGGGHE

SEQ ID NO: 26884 - protein, 9 aa, Homo Sapiens
GLDFQCCMQ

SEQ ID NO: 26885 - protein, 9 aa, Homo Sapiens
TPTSDNLEQ

SEQ ID NO: 26886 - protein, 9 aa, Homo Sapiens
AVPKGRGGG

SEQ ID NO: 26887 - protein, 9 aa, Homo Sapiens
AFLAYQRYK

SEQ ID NO: 26888 - protein, 9 aa, Homo Sapiens
GENTNLLLQ

SEQ ID NO: 26889 - protein, 9 aa, Homo Sapiens
DRLNALLQP

SEQ ID NO: 26890 - protein, 9 aa, Homo Sapiens
YPVICMTAC

SEQ ID NO: 26891 - protein, 9 aa, Homo Sapiens
TILSPKNMQ

SEQ ID NO: 26892 - protein, 9 aa, Homo Sapiens
QPEETPSIE

SEQ ID NO: 26893 - protein, 9 aa, Homo Sapiens
ASLMDMNSL

SEQ ID NO: 26894 - protein, 9 aa, Homo Sapiens
GCKVSEYSV

SEQ ID NO: 26895 - protein, 9 aa, Homo Sapiens
CAARAQEAQ

SEQ ID NO: 26896 - protein, 9 aa, Homo Sapiens
EIRYPEDLQ

SEQ ID NO: 26897 - protein, 9 aa, Homo Sapiens
IVKYLVQVS

SEQ ID NO: 26898 - protein, 9 aa, Homo Sapiens
FLSRKNTAT

SEQ ID NO: 26899 - protein, 9 aa, Homo Sapiens
PSLSGQITA

SEQ ID NO: 26900 - protein, 9 aa, Homo Sapiens
AARNGPRSP

SEQ ID NO: 26901 - protein, 9 aa, Homo Sapiens
TMNDTRLYH

SEQ ID NO: 26902 - protein, 9 aa, Homo Sapiens
KRRPQMSRG

SEQ ID NO: 26903 - protein, 9 aa, Homo Sapiens
WLKLDMPLT

SEQ ID NO: 26904 - protein, 9 aa, Homo Sapiens
LSKHGYGGW

SEQ ID NO: 26905 - protein, 9 aa, Homo Sapiens
NEPEQWIPR

SEQ ID NO: 26906 - protein, 9 aa, Homo Sapiens
YRTFLKRTK

SEQ ID NO: 26907 - protein, 9 aa, Homo Sapiens
GIREQYTAK

SEQ ID NO: 26908 - protein, 9 aa, Homo Sapiens
GYKGRVPLK

SEQ ID NO: 26909 - protein, 9 aa, Homo Sapiens
VCGELVDCL

SEQ ID NO: 26910 - protein, 9 aa, Homo Sapiens
EAPPAEAAQ

SEQ ID NO: 26911 - protein, 9 aa, Homo Sapiens
KVPSLERNE

SEQ ID NO: 26912 - protein, 9 aa, Homo Sapiens
KMLEYNPAK

SEQ ID NO: 26913 - protein, 9 aa, Homo Sapiens
LSCMFSLMN

SEQ ID NO: 26914 - protein, 9 aa, Homo Sapiens
LNKEIMMQL

SEQ ID NO: 26915 - protein, 9 aa, Homo Sapiens
SASPASSLS

SEQ ID NO: 26916 - protein, 9 aa, Homo Sapiens
VDVNRHKQV

SEQ ID NO: 26917 - protein, 9 aa, Homo Sapiens
YYPLPFFAA

SEQ ID NO: 26918 - protein, 9 aa, Homo Sapiens
TLQYFIRDV

SEQ ID NO: 26919 - protein, 9 aa, Homo Sapiens
KDILCMKED

SEQ ID NO: 26920 - protein, 9 aa, Homo Sapiens
VCSGSFPTD

SEQ ID NO: 26921 - protein, 9 aa, Homo Sapiens
VFYCCTFCS

SEQ ID NO: 26922 - protein, 9 aa, Homo Sapiens
YSLATFSTG

SEQ ID NO: 26923 - protein, 9 aa, Homo Sapiens
QFTSKTFSF

SEQ ID NO: 26924 - protein, 9 aa, Homo Sapiens
APWRPWPTG

SEQ ID NO: 26925 - protein, 9 aa, Homo Sapiens
GRSHLPATW

SEQ ID NO: 26926 - protein, 9 aa, Homo Sapiens
PLALSSSAG

SEQ ID NO: 26927 - protein, 9 aa, Homo Sapiens
KRQQLSEEE

SEQ ID NO: 26928 - protein, 9 aa, Homo Sapiens
TLVFEVQLL

SEQ ID NO: 26929 - protein, 9 aa, Homo Sapiens
QRLRYTCKA

SEQ ID NO: 26930 - protein, 9 aa, Homo Sapiens
QQFTSKTFS

SEQ ID NO: 26931 - protein, 9 aa, Homo Sapiens
TPTVSIKEN

SEQ ID NO: 26932 - protein, 9 aa, Homo Sapiens
SRDQFNICA

SEQ ID NO: 26933 - protein, 9 aa, Homo Sapiens
VGRFASQFS

SEQ ID NO: 26934 - protein, 9 aa, Homo Sapiens
EVSTTGVNS

SEQ ID NO: 26935 - protein, 9 aa, Homo Sapiens
RLRYTCKAR

SEQ ID NO: 26936 - protein, 9 aa, Homo Sapiens
MQKVQYLTR

SEQ ID NO: 26937 - protein, 9 aa, Homo Sapiens
LLAAAKEGK

SEQ ID NO: 26938 - protein, 9 aa, Homo Sapiens
SVLLMARLC

SEQ ID NO: 26939 - protein, 9 aa, Homo Sapiens
EIMMQLGRI

SEQ ID NO: 26940 - protein, 9 aa, Homo Sapiens
NKIRYQLRM

SEQ ID NO: 26941 - protein, 9 aa, Homo Sapiens
QCFDNLQVC

SEQ ID NO: 26942 - protein, 9 aa, Homo Sapiens
STEVTVEAW

SEQ ID NO: 26943 - protein, 9 aa, Homo Sapiens
QYYVQFFGD

SEQ ID NO: 26944 - protein, 9 aa, Homo Sapiens
GFRQFGFQR

SEQ ID NO: 26945 - protein, 9 aa, Homo Sapiens
FPNKWERPV

SEQ ID NO: 26946 - protein, 9 aa, Homo Sapiens
DRCLQNLRD

SEQ ID NO: 26947 - protein, 9 aa, Homo Sapiens
ISNNAEQCD

SEQ ID NO: 26948 - protein, 9 aa, Homo Sapiens
PAGQSTCGG

SEQ ID NO: 26949 - protein, 9 aa, Homo Sapiens
YLSGMLRFQ

SEQ ID NO: 26950 - protein, 9 aa, Homo Sapiens
GRQTKTMAK

SEQ ID NO: 26951 - protein, 9 aa, Homo Sapiens
YPPMDPQSR

SEQ ID NO: 26952 - protein, 9 aa, Homo Sapiens
YWKHKNAAP

SEQ ID NO: 26953 - protein, 9 aa, Homo Sapiens
VRVYHLTQY

SEQ ID NO: 26954 - protein, 9 aa, Homo Sapiens
EDEVFPEAQ

SEQ ID NO: 26955 - protein, 9 aa, Homo Sapiens
VNDARTIGK

SEQ ID NO: 26956 - protein, 9 aa, Homo Sapiens
NDEEEEDIH

SEQ ID NO: 26957 - protein, 9 aa, Homo Sapiens
VNGKYYEMA

SEQ ID NO: 26958 - protein, 9 aa, Homo Sapiens
VFTIGTIVI

SEQ ID NO: 26959 - protein, 9 aa, Homo Sapiens
LAHASDNAR

SEQ ID NO: 26960 - protein, 9 aa, Homo Sapiens
EEDKETKTN

SEQ ID NO: 26961 - protein, 9 aa, Homo Sapiens
LEKEPGPQG

SEQ ID NO: 26962 - protein, 9 aa, Homo Sapiens
ATWELFPCR

SEQ ID NO: 26963 - protein, 9 aa, Homo Sapiens
ETKTNESKE

SEQ ID NO: 26964 - protein, 9 aa, Homo Sapiens
CCHRAELER

SEQ ID NO: 26965 - protein, 9 aa, Homo Sapiens
SRAGENKMD

SEQ ID NO: 26966 - protein, 9 aa, Homo Sapiens
QRGGSEASA

SEQ ID NO: 26967 - protein, 9 aa, Homo Sapiens
RPEREALEK

SEQ ID NO: 26968 - protein, 9 aa, Homo Sapiens
VNKEFGGDK

SEQ ID NO: 26969 - protein, 9 aa, Homo Sapiens
GGAAGRLAL

SEQ ID NO: 26970 - protein, 9 aa, Homo Sapiens
TANKIRYQL

SEQ ID NO: 26971 - protein, 9 aa, Homo Sapiens
PATWPMNAR

SEQ ID NO: 26972 - protein, 9 aa, Homo Sapiens
KNAAPALPE

SEQ ID NO: 26973 - protein, 9 aa, Homo Sapiens
IAYATLQYF

SEQ ID NO: 26974 - protein, 9 aa, Homo Sapiens
LAGLPRETL

SEQ ID NO: 26975 - protein, 9 aa, Homo Sapiens
CVPQNTGYT

SEQ ID NO: 26976 - protein, 9 aa, Homo Sapiens
HGEGQELSI

SEQ ID NO: 26977 - protein, 9 aa, Homo Sapiens
NRWEALRLD

SEQ ID NO: 26978 - protein, 9 aa, Homo Sapiens
IRLGHMQPR

SEQ ID NO: 26979 - protein, 9 aa, Homo Sapiens
PSKDQKKLT

SEQ ID NO: 26980 - protein, 9 aa, Homo Sapiens
IRRSQSVSS

SEQ ID NO: 26981 - protein, 9 aa, Homo Sapiens
FVRYFPSKD

SEQ ID NO: 26982 - protein, 9 aa, Homo Sapiens
AQADLLTIY

SEQ ID NO: 26983 - protein, 9 aa, Homo Sapiens
NHPDLFFGG

SEQ ID NO: 26984 - protein, 9 aa, Homo Sapiens
QWDILETEE

SEQ ID NO: 26985 - protein, 9 aa, Homo Sapiens
ALRKVLGKC

SEQ ID NO: 26986 - protein, 9 aa, Homo Sapiens
ENALHASKE

SEQ ID NO: 26987 - protein, 9 aa, Homo Sapiens
AANSPFSSD

SEQ ID NO: 26988 - protein, 9 aa, Homo Sapiens
MEGSSVTLE

SEQ ID NO: 26989 - protein, 9 aa, Homo Sapiens
INRVTNQNI

SEQ ID NO: 26990 - protein, 9 aa, Homo Sapiens
PPSAQRPKL

SEQ ID NO: 26991 - protein, 9 aa, Homo Sapiens
KDNVFNSIQ

SEQ ID NO: 26992 - protein, 9 aa, Homo Sapiens
DDMSLTPDP

SEQ ID NO: 26993 - protein, 9 aa, Homo Sapiens
ILLNIIEWL

SEQ ID NO: 26994 - protein, 9 aa, Homo Sapiens
MVVCHLFGK

SEQ ID NO: 26995 - protein, 9 aa, Homo Sapiens
AAKLCMGCL

SEQ ID NO: 26996 - protein, 9 aa, Homo Sapiens
SHLPATWPM

SEQ ID NO: 26997 - protein, 9 aa, Homo Sapiens
DLKGEDSWD

SEQ ID NO: 26998 - protein, 9 aa, Homo Sapiens
SIDKSQASA

SEQ ID NO: 26999 - protein, 9 aa, Homo Sapiens
CLCSFQRFQ

SEQ ID NO: 27000 - protein, 9 aa, Homo Sapiens
YHLELFLGQ

SEQ ID NO: 27001 - protein, 9 aa, Homo Sapiens
NEKNPNPIK

SEQ ID NO: 27002 - protein, 9 aa, Homo Sapiens
AAAAAAGKA

SEQ ID NO: 27003 - protein, 9 aa, Homo Sapiens
FAALDPEHQ

SEQ ID NO: 27004 - protein, 9 aa, Homo Sapiens
LWEYSSGRQ

SEQ ID NO: 27005 - protein, 9 aa, Homo Sapiens
WTHEHGVLE

SEQ ID NO: 27006 - protein, 9 aa, Homo Sapiens
RKEFRNLSL

SEQ ID NO: 27007 - protein, 9 aa, Homo Sapiens
DGEIDDVGF

SEQ ID NO: 27008 - protein, 9 aa, Homo Sapiens
GLNKEIMMQ

SEQ ID NO: 27009 - protein, 9 aa, Homo Sapiens
PQLSDDKRQ

SEQ ID NO: 27010 - protein, 9 aa, Homo Sapiens
LVLDNCKSI

SEQ ID NO: 27011 - protein, 9 aa, Homo Sapiens
PTSDNLEQF

SEQ ID NO: 27012 - protein, 9 aa, Homo Sapiens
HPWPAAQPS

SEQ ID NO: 27013 - protein, 9 aa, Homo Sapiens
VKKADVLNI

SEQ ID NO: 27014 - protein, 9 aa, Homo Sapiens
EDPWHVAKM

SEQ ID NO: 27015 - protein, 9 aa, Homo Sapiens
FRQTEENAV

SEQ ID NO: 27016 - protein, 9 aa, Homo Sapiens
AAKEGKTTE

SEQ ID NO: 27017 - protein, 9 aa, Homo Sapiens
KVRVCACPG

SEQ ID NO: 27018 - protein, 9 aa, Homo Sapiens
WICLVAMVY

SEQ ID NO: 27019 - protein, 9 aa, Homo Sapiens
EGKTEKHES

SEQ ID NO: 27020 - protein, 9 aa, Homo Sapiens
VNAEAMEPE

SEQ ID NO: 27021 - protein, 9 aa, Homo Sapiens
AKGEYNMAL

SEQ ID NO: 27022 - protein, 9 aa, Homo Sapiens
EYEGKTEKH

SEQ ID NO: 27023 - protein, 9 aa, Homo Sapiens
SPAGSGHIG

SEQ ID NO: 27024 - protein, 9 aa, Homo Sapiens
PEFLYCHGV

SEQ ID NO: 27025 - protein, 9 aa, Homo Sapiens
IDDVGFEEI

SEQ ID NO: 27026 - protein, 9 aa, Homo Sapiens
QYQDVPDLV

SEQ ID NO: 27027 - protein, 9 aa, Homo Sapiens
SRQWDILET

SEQ ID NO: 27028 - protein, 9 aa, Homo Sapiens
GSGHIGPST

SEQ ID NO: 27029 - protein, 9 aa, Homo Sapiens
PTLPLPTVE

SEQ ID NO: 27030 - protein, 9 aa, Homo Sapiens
DSCTQNKRA

SEQ ID NO: 27031 - protein, 9 aa, Homo Sapiens
RTYKVNKEF

SEQ ID NO: 27032 - protein, 9 aa, Homo Sapiens
IAIAYATLQ

SEQ ID NO: 27033 - protein, 9 aa, Homo Sapiens
NSLSPVCRS

SEQ ID NO: 27034 - protein, 9 aa, Homo Sapiens
CGLSKHGYG

SEQ ID NO: 27035 - protein, 9 aa, Homo Sapiens
ARGSLETHF

SEQ ID NO: 27036 - protein, 9 aa, Homo Sapiens
FTVSAENIV

SEQ ID NO: 27037 - protein, 9 aa, Homo Sapiens
QGVETSSPA

SEQ ID NO: 27038 - protein, 9 aa, Homo Sapiens
TLANHNITH

SEQ ID NO: 27039 - protein, 9 aa, Homo Sapiens
GCLCSFQRF

SEQ ID NO: 27040 - protein, 9 aa, Homo Sapiens
LLQCFDNLQ

SEQ ID NO: 27041 - protein, 9 aa, Homo Sapiens
DEYDDDHVD

SEQ ID NO: 27042 - protein, 9 aa, Homo Sapiens
KNTATEETK

SEQ ID NO: 27043 - protein, 9 aa, Homo Sapiens
LIKEVTEDL

SEQ ID NO: 27044 - protein, 9 aa, Homo Sapiens
MMGRQTKTM

SEQ ID NO: 27045 - protein, 9 aa, Homo Sapiens
DKRTADRWK

SEQ ID NO: 27046 - protein, 9 aa, Homo Sapiens
LAAAKEGKT

SEQ ID NO: 27047 - protein, 9 aa, Homo Sapiens
HRLGRNRDR

SEQ ID NO: 27048 - protein, 9 aa, Homo Sapiens
AMVYLFMCF

SEQ ID NO: 27049 - protein, 9 aa, Homo Sapiens
RSSMLQDPR

SEQ ID NO: 27050 - protein, 9 aa, Homo Sapiens
VSNNCTDGI

SEQ ID NO: 27051 - protein, 9 aa, Homo Sapiens
EVTSQGVET

SEQ ID NO: 27052 - protein, 9 aa, Homo Sapiens
GWIFNRWEA

SEQ ID NO: 27053 - protein, 9 aa, Homo Sapiens
GVNRDSDYN

SEQ ID NO: 27054 - protein, 9 aa, Homo Sapiens
VYHLTQYEH

SEQ ID NO: 27055 - protein, 9 aa, Homo Sapiens
LFACEEYAH

SEQ ID NO: 27056 - protein, 9 aa, Homo Sapiens
EPPEIASPK

SEQ ID NO: 27057 - protein, 9 aa, Homo Sapiens
QKCKTDVNE

SEQ ID NO: 27058 - protein, 9 aa, Homo Sapiens
HYEQRLRYT

SEQ ID NO: 27059 - protein, 9 aa, Homo Sapiens
ERVHSGEKP

SEQ ID NO: 27060 - protein, 9 aa, Homo Sapiens
GHRWAQVKK

SEQ ID NO: 27061 - protein, 9 aa, Homo Sapiens
ETKQAIHNY

SEQ ID NO: 27062 - protein, 9 aa, Homo Sapiens
LDSVLVAQD

SEQ ID NO: 27063 - protein, 9 aa, Homo Sapiens
YAHNALRKH

SEQ ID NO: 27064 - protein, 9 aa, Homo Sapiens
SHPSRDGFH

SEQ ID NO: 27065 - protein, 9 aa, Homo Sapiens
NLTGSNRRP

SEQ ID NO: 27066 - protein, 9 aa, Homo Sapiens
VETSSPACK

SEQ ID NO: 27067 - protein, 9 aa, Homo Sapiens
ESPDACVPP

SEQ ID NO: 27068 - protein, 9 aa, Homo Sapiens
NAALAQAPS

SEQ ID NO: 27069 - protein, 9 aa, Homo Sapiens
AEESKDKVI

SEQ ID NO: 27070 - protein, 9 aa, Homo Sapiens
MDDMDDEYD

SEQ ID NO: 27071 - protein, 9 aa, Homo Sapiens
IINYTSQLF

SEQ ID NO: 27072 - protein, 9 aa, Homo Sapiens
EEDEVFPEA

SEQ ID NO: 27073 - protein, 9 aa, Homo Sapiens
EKPDNDKDE

SEQ ID NO: 27074 - protein, 9 aa, Homo Sapiens
RSYNRNIDK

SEQ ID NO: 27075 - protein, 9 aa, Homo Sapiens
AVRELKKDN

SEQ ID NO: 27076 - protein, 9 aa, Homo Sapiens
CMKEDIKAL

SEQ ID NO: 27077 - protein, 9 aa, Homo Sapiens
QLVRHDDSW

SEQ ID NO: 27078 - protein, 9 aa, Homo Sapiens
VHEEGEPQA

SEQ ID NO: 27079 - protein, 9 aa, Homo Sapiens
EDLQFVYET

SEQ ID NO: 27080 - protein, 9 aa, Homo Sapiens
SSFDLKGED

SEQ ID NO: 27081 - protein, 9 aa, Homo Sapiens
DQRSGEVLQ

SEQ ID NO: 27082 - protein, 9 aa, Homo Sapiens
WAECSASLC

SEQ ID NO: 27083 - protein, 9 aa, Homo Sapiens
FAEINDQDR

SEQ ID NO: 27084 - protein, 9 aa, Homo Sapiens
DEEGCLWAE

SEQ ID NO: 27085 - protein, 9 aa, Homo Sapiens
ALDPEHQGH

SEQ ID NO: 27086 - protein, 9 aa, Homo Sapiens
EIFQHCDCA

SEQ ID NO: 27087 - protein, 9 aa, Homo Sapiens
VGWAADGYI

SEQ ID NO: 27088 - protein, 9 aa, Homo Sapiens
DTPGSRQWD

SEQ ID NO: 27089 - protein, 9 aa, Homo Sapiens
FSENAHLVQ

SEQ ID NO: 27090 - protein, 9 aa, Homo Sapiens
TAGASQSQG

SEQ ID NO: 27091 - protein, 9 aa, Homo Sapiens
YNVNRHSLE

SEQ ID NO: 27092 - protein, 9 aa, Homo Sapiens
TSQGVETSS

SEQ ID NO: 27093 - protein, 9 aa, Homo Sapiens
HPRDVEAIP

SEQ ID NO: 27094 - protein, 9 aa, Homo Sapiens
QHVLELYEE

SEQ ID NO: 27095 - protein, 9 aa, Homo Sapiens
ALVSPISES

SEQ ID NO: 27096 - protein, 9 aa, Homo Sapiens
QEFSDVNEG

SEQ ID NO: 27097 - protein, 9 aa, Homo Sapiens
DPDGSQIQK

SEQ ID NO: 27098 - protein, 9 aa, Homo Sapiens
AQVKKEDQE

SEQ ID NO: 27099 - protein, 9 aa, Homo Sapiens
SGEKAEKEF

SEQ ID NO: 27100 - protein, 9 aa, Homo Sapiens
TRPSLRPTG

SEQ ID NO: 27101 - protein, 9 aa, Homo Sapiens
IDKSQASAD

SEQ ID NO: 27102 - protein, 9 aa, Homo Sapiens
IFNRWEALR

SEQ ID NO: 27103 - protein, 9 aa, Homo Sapiens
NGRLVVSHL

SEQ ID NO: 27104 - protein, 9 aa, Homo Sapiens
KGEYNMALK

SEQ ID NO: 27105 - protein, 9 aa, Homo Sapiens
EQLRATIAS

SEQ ID NO: 27106 - protein, 9 aa, Homo Sapiens
PVYAHIHPR

SEQ ID NO: 27107 - protein, 9 aa, Homo Sapiens
QPDEEGCLW

SEQ ID NO: 27108 - protein, 9 aa, Homo Sapiens
SSTQHASAS

SEQ ID NO: 27109 - protein, 9 aa, Homo Sapiens
QNLSVPHVD

SEQ ID NO: 27110 - protein, 9 aa, Homo Sapiens
GYNFKFDIW

SEQ ID NO: 27111 - protein, 9 aa, Homo Sapiens
QRIREHSDC

SEQ ID NO: 27112 - protein, 9 aa, Homo Sapiens
QTKEKQSQI

SEQ ID NO: 27113 - protein, 9 aa, Homo Sapiens
DPMEEALAV

SEQ ID NO: 27114 - protein, 9 aa, Homo Sapiens
CSKSFLMLS

SEQ ID NO: 27115 - protein, 9 aa, Homo Sapiens
HPLDLLSHL

SEQ ID NO: 27116 - protein, 9 aa, Homo Sapiens
REDKLGSDI

SEQ ID NO: 27117 - protein, 9 aa, Homo Sapiens
SLVSTGHAT

SEQ ID NO: 27118 - protein, 9 aa, Homo Sapiens
QATCIPNFS

SEQ ID NO: 27119 - protein, 9 aa, Homo Sapiens
RSLVLPAAC

SEQ ID NO: 27120 - protein, 9 aa, Homo Sapiens
AQEAQKMRS

SEQ ID NO: 27121 - protein, 9 aa, Homo Sapiens
EALEKEPGP

SEQ ID NO: 27122 - protein, 9 aa, Homo Sapiens
LDPEHQGHI

SEQ ID NO: 27123 - protein, 9 aa, Homo Sapiens
VDIGGHRWA

SEQ ID NO: 27124 - protein, 9 aa, Homo Sapiens
DLFFGGPKN

SEQ ID NO: 27125 - protein, 9 aa, Homo Sapiens
GEQFHETFD

SEQ ID NO: 27126 - protein, 9 aa, Homo Sapiens
RPSLRPTGG

SEQ ID NO: 27127 - protein, 9 aa, Homo Sapiens
TTCDSRFAY

SEQ ID NO: 27128 - protein, 9 aa, Homo Sapiens
GGHRWAQVK

SEQ ID NO: 27129 - protein, 9 aa, Homo Sapiens
PFLEGVNRD

SEQ ID NO: 27130 - protein, 9 aa, Homo Sapiens
NCQYSLATF

SEQ ID NO: 27131 - protein, 9 aa, Homo Sapiens
ALAVCSGSF

SEQ ID NO: 27132 - protein, 9 aa, Homo Sapiens
AVYHIKSAE

SEQ ID NO: 27133 - protein, 9 aa, Homo Sapiens
DKTERARDI

SEQ ID NO: 27134 - protein, 9 aa, Homo Sapiens
KFNLDISTV

SEQ ID NO: 27135 - protein, 9 aa, Homo Sapiens
ALLDLAEPG

SEQ ID NO: 27136 - protein, 9 aa, Homo Sapiens
LANQPIEAP

SEQ ID NO: 27137 - protein, 9 aa, Homo Sapiens
HADNKRCRK

SEQ ID NO: 27138 - protein, 9 aa, Homo Sapiens
DKSQASADT

SEQ ID NO: 27139 - protein, 9 aa, Homo Sapiens
KRRKASFGS

SEQ ID NO: 27140 - protein, 9 aa, Homo Sapiens
RRCLNPLAP

SEQ ID NO: 27141 - protein, 9 aa, Homo Sapiens
HLLKTHVES

SEQ ID NO: 27142 - protein, 9 aa, Homo Sapiens
YTTPLTLEG

SEQ ID NO: 27143 - protein, 9 aa, Homo Sapiens
PNNCSGKKG

SEQ ID NO: 27144 - protein, 9 aa, Homo Sapiens
NEDCPKAAN

SEQ ID NO: 27145 - protein, 9 aa, Homo Sapiens
LTSSCTLTE

SEQ ID NO: 27146 - protein, 9 aa, Homo Sapiens
RQTKTMAKV

SEQ ID NO: 27147 - protein, 9 aa, Homo Sapiens
VKYLVQVSD

SEQ ID NO: 27148 - protein, 9 aa, Homo Sapiens
RNGPRSPRA

SEQ ID NO: 27149 - protein, 9 aa, Homo Sapiens
LYPAAPVSR

SEQ ID NO: 27150 - protein, 9 aa, Homo Sapiens
KSFLMLSCL

SEQ ID NO: 27151 - protein, 9 aa, Homo Sapiens
TWELFPCRG

SEQ ID NO: 27152 - protein, 9 aa, Homo Sapiens
KLHSVLLMA

SEQ ID NO: 27153 - protein, 9 aa, Homo Sapiens
EQQKELSKF

SEQ ID NO: 27154 - protein, 9 aa, Homo Sapiens
FTIGTIVIS

SEQ ID NO: 27155 - protein, 9 aa, Homo Sapiens
PPARPSGPH

SEQ ID NO: 27156 - protein, 9 aa, Homo Sapiens
RMENYKLQK

SEQ ID NO: 27157 - protein, 9 aa, Homo Sapiens
KGAGWIFNR

SEQ ID NO: 27158 - protein, 9 aa, Homo Sapiens
CSSEETLLI

SEQ ID NO: 27159 - protein, 9 aa, Homo Sapiens
SSYRQVVLN

SEQ ID NO: 27160 - protein, 9 aa, Homo Sapiens
RDIKCLMEK

SEQ ID NO: 27161 - protein, 9 aa, Homo Sapiens
SGPIEVVLV

SEQ ID NO: 27162 - protein, 9 aa, Homo Sapiens
MYWKHKNAA

SEQ ID NO: 27163 - protein, 9 aa, Homo Sapiens
LNVTSLDLK

SEQ ID NO: 27164 - protein, 9 aa, Homo Sapiens
RCLQNLRDR

SEQ ID NO: 27165 - protein, 9 aa, Homo Sapiens
NGGHYEQRL

SEQ ID NO: 27166 - protein, 9 aa, Homo Sapiens
SLCLGGTPV

SEQ ID NO: 27167 - protein, 9 aa, Homo Sapiens
SPPHRSFCC

SEQ ID NO: 27168 - protein, 9 aa, Homo Sapiens
YYGGGSAEA

SEQ ID NO: 27169 - protein, 9 aa, Homo Sapiens
SSSSSSAPK

SEQ ID NO: 27170 - protein, 9 aa, Homo Sapiens
MEKFNLDIS

SEQ ID NO: 27171 - protein, 9 aa, Homo Sapiens
LAKETTRNL

SEQ ID NO: 27172 - protein, 9 aa, Homo Sapiens
IHPDDTTIT

SEQ ID NO: 27173 - protein, 9 aa, Homo Sapiens
LHSVLLMAR

SEQ ID NO: 27174 - protein, 9 aa, Homo Sapiens
FCKFSSFEI

SEQ ID NO: 27175 - protein, 9 aa, Homo Sapiens
SSDACMDKN

SEQ ID NO: 27176 - protein, 9 aa, Homo Sapiens
LYLANLNQD

SEQ ID NO: 27177 - protein, 9 aa, Homo Sapiens
HRWAQVKKE

SEQ ID NO: 27178 - protein, 9 aa, Homo Sapiens
TDPKSQLIQ

SEQ ID NO: 27179 - protein, 9 aa, Homo Sapiens
TVSAENIVG

SEQ ID NO: 27180 - protein, 9 aa, Homo Sapiens
ESMPPPEAH

SEQ ID NO: 27181 - protein, 9 aa, Homo Sapiens
SAQRPKLSS

SEQ ID NO: 27182 - protein, 9 aa, Homo Sapiens
REALEKEPG

SEQ ID NO: 27183 - protein, 9 aa, Homo Sapiens
QVIQQYLSG

SEQ ID NO: 27184 - protein, 9 aa, Homo Sapiens
LHNYPLALS

SEQ ID NO: 27185 - protein, 9 aa, Homo Sapiens
LQEDPWHVA

SEQ ID NO: 27186 - protein, 9 aa, Homo Sapiens
LYNVNRHSL

SEQ ID NO: 27187 - protein, 9 aa, Homo Sapiens
WTTCGLSKH

SEQ ID NO: 27188 - protein, 9 aa, Homo Sapiens
EYEFTVSAE

SEQ ID NO: 27189 - protein, 9 aa, Homo Sapiens
CSSLGPVFN

SEQ ID NO: 27190 - protein, 9 aa, Homo Sapiens
EEIHLKLQK

SEQ ID NO: 27191 - protein, 9 aa, Homo Sapiens
VTRKAPQLL

SEQ ID NO: 27192 - protein, 9 aa, Homo Sapiens
ELTTHRQLM

SEQ ID NO: 27193 - protein, 9 aa, Homo Sapiens
QIQKIKEEI

SEQ ID NO: 27194 - protein, 9 aa, Homo Sapiens
GNVSFSLLY

SEQ ID NO: 27195 - protein, 9 aa, Homo Sapiens
KKQNDFAQS

SEQ ID NO: 27196 - protein, 9 aa, Homo Sapiens
QNARLSSEM

SEQ ID NO: 27197 - protein, 9 aa, Homo Sapiens
NRPRPTGRT

SEQ ID NO: 27198 - protein, 9 aa, Homo Sapiens
LAQAPSESK

SEQ ID NO: 27199 - protein, 9 aa, Homo Sapiens
YRRELVFWS

SEQ ID NO: 27200 - protein, 9 aa, Homo Sapiens
GFHPHQLAL

SEQ ID NO: 27201 - protein, 9 aa, Homo Sapiens
IKTDVTITE

SEQ ID NO: 27202 - protein, 9 aa, Homo Sapiens
AKGNKLLAP

SEQ ID NO: 27203 - protein, 9 aa, Homo Sapiens
RDLEGDQDS

SEQ ID NO: 27204 - protein, 9 aa, Homo Sapiens
PHKDICPEK

SEQ ID NO: 27205 - protein, 9 aa, Homo Sapiens
SPRPGPWPP

SEQ ID NO: 27206 - protein, 9 aa, Homo Sapiens
ALVNCQYSL

SEQ ID NO: 27207 - protein, 9 aa, Homo Sapiens
VPFVKYQFI

SEQ ID NO: 27208 - protein, 9 aa, Homo Sapiens
VSVLDRYYR

SEQ ID NO: 27209 - protein, 9 aa, Homo Sapiens
RQHLGWKWV

SEQ ID NO: 27210 - protein, 9 aa, Homo Sapiens
PTVSIKENV

SEQ ID NO: 27211 - protein, 9 aa, Homo Sapiens
DKKGFCEGD

SEQ ID NO: 27212 - protein, 9 aa, Homo Sapiens
NVSFSLLYK

SEQ ID NO: 27213 - protein, 9 aa, Homo Sapiens
GMMSLFGKD

SEQ ID NO: 27214 - protein, 9 aa, Homo Sapiens
MPPPEAHNP

SEQ ID NO: 27215 - protein, 9 aa, Homo Sapiens
LSVPIEPPE

SEQ ID NO: 27216 - protein, 9 aa, Homo Sapiens
PDQEETKIN

SEQ ID NO: 27217 - protein, 9 aa, Homo Sapiens
IGIDSLDLV

SEQ ID NO: 27218 - protein, 9 aa, Homo Sapiens
GAAAAPPCL

SEQ ID NO: 27219 - protein, 9 aa, Homo Sapiens
ALDFHYRRE

SEQ ID NO: 27220 - protein, 9 aa, Homo Sapiens
IKLVNMLDK

SEQ ID NO: 27221 - protein, 9 aa, Homo Sapiens
CDSPSRVPF

SEQ ID NO: 27222 - protein, 9 aa, Homo Sapiens
TCGLSKHGY

SEQ ID NO: 27223 - protein, 9 aa, Homo Sapiens
PIVKYLVQV

SEQ ID NO: 27224 - protein, 9 aa, Homo Sapiens
RRLFCHRAP

SEQ ID NO: 27225 - protein, 9 aa, Homo Sapiens
DNLEQFAKQ

SEQ ID NO: 27226 - protein, 9 aa, Homo Sapiens
PSVASKDLF

SEQ ID NO: 27227 - protein, 9 aa, Homo Sapiens
KRKLRVYLH

SEQ ID NO: 27228 - protein, 9 aa, Homo Sapiens
TIYLVVALA

SEQ ID NO: 27229 - protein, 9 aa, Homo Sapiens
KKGAGWIFN

SEQ ID NO: 27230 - protein, 9 aa, Homo Sapiens
TGSNRRPQT

SEQ ID NO: 27231 - protein, 9 aa, Homo Sapiens
ALCNLPPLR

SEQ ID NO: 27232 - protein, 9 aa, Homo Sapiens
SKKRKLRVY

SEQ ID NO: 27233 - protein, 9 aa, Homo Sapiens
RPLDVHWTL

SEQ ID NO: 27234 - protein, 9 aa, Homo Sapiens
VHSIQQVVV

SEQ ID NO: 27235 - protein, 9 aa, Homo Sapiens
PLPVTNTSL

SEQ ID NO: 27236 - protein, 9 aa, Homo Sapiens
KKSARQYYV

SEQ ID NO: 27237 - protein, 9 aa, Homo Sapiens
CNHPDLFFG

SEQ ID NO: 27238 - protein, 9 aa, Homo Sapiens
HIKSAEGRK

SEQ ID NO: 27239 - protein, 9 aa, Homo Sapiens
DETDALLTE

SEQ ID NO: 27240 - protein, 9 aa, Homo Sapiens
VILSVEDNT

SEQ ID NO: 27241 - protein, 9 aa, Homo Sapiens
AQRGSCPLE

SEQ ID NO: 27242 - protein, 9 aa, Homo Sapiens
RLFCHRAPH

SEQ ID NO: 27243 - protein, 9 aa, Homo Sapiens
EIHLKLQKL

SEQ ID NO: 27244 - protein, 9 aa, Homo Sapiens
VNGSRNGGK

SEQ ID NO: 27245 - protein, 9 aa, Homo Sapiens
HLTQYEHCP

SEQ ID NO: 27246 - protein, 9 aa, Homo Sapiens
LGGTPVSAS

SEQ ID NO: 27247 - protein, 9 aa, Homo Sapiens
MLSVDFLDD

SEQ ID NO: 27248 - protein, 9 aa, Homo Sapiens
QLLLLQIIE

SEQ ID NO: 27249 - protein, 9 aa, Homo Sapiens
YKRILTPEV

SEQ ID NO: 27250 - protein, 9 aa, Homo Sapiens
SYNRNIDKS

SEQ ID NO: 27251 - protein, 9 aa, Homo Sapiens
ALEIVIKSI

SEQ ID NO: 27252 - protein, 9 aa, Homo Sapiens
AFSENAHLV

SEQ ID NO: 27253 - protein, 9 aa, Homo Sapiens
FLYCHGVPR

SEQ ID NO: 27254 - protein, 9 aa, Homo Sapiens
AAPSAMTAA

SEQ ID NO: 27255 - protein, 9 aa, Homo Sapiens
VPVQQFTSK

SEQ ID NO: 27256 - protein, 9 aa, Homo Sapiens
FSMDIDVSY

SEQ ID NO: 27257 - protein, 9 aa, Homo Sapiens
GGFSLYTGS

SEQ ID NO: 27258 - protein, 9 aa, Homo Sapiens
ASMCRKNND

SEQ ID NO: 27259 - protein, 9 aa, Homo Sapiens
MEEALAVCS

SEQ ID NO: 27260 - protein, 9 aa, Homo Sapiens
KTFSFVLTG

SEQ ID NO: 27261 - protein, 9 aa, Homo Sapiens
ADSAQRGSC

SEQ ID NO: 27262 - protein, 9 aa, Homo Sapiens
IHKKRVSDN

SEQ ID NO: 27263 - protein, 9 aa, Homo Sapiens
LTLAKGEYN

SEQ ID NO: 27264 - protein, 9 aa, Homo Sapiens
DMLHNYPLA

SEQ ID NO: 27265 - protein, 9 aa, Homo Sapiens
EETLLIDCR

SEQ ID NO: 27266 - protein, 9 aa, Homo Sapiens
YNPAKRITL

SEQ ID NO: 27267 - protein, 9 aa, Homo Sapiens
KCIRPRYCK

SEQ ID NO: 27268 - protein, 9 aa, Homo Sapiens
MYTTPLTLE

SEQ ID NO: 27269 - protein, 9 aa, Homo Sapiens
PPQVIQQYL

SEQ ID NO: 27270 - protein, 9 aa, Homo Sapiens
SQTKEKQSQ

SEQ ID NO: 27271 - protein, 9 aa, Homo Sapiens
CLHWLEEAE

SEQ ID NO: 27272 - protein, 9 aa, Homo Sapiens
RPQLSDDKR

SEQ ID NO: 27273 - protein, 9 aa, Homo Sapiens
NPATAGASQ

SEQ ID NO: 27274 - protein, 9 aa, Homo Sapiens
LIKVAASCR

SEQ ID NO: 27275 - protein, 9 aa, Homo Sapiens
ITEYEGHAL

SEQ ID NO: 27276 - protein, 9 aa, Homo Sapiens
SVKGQGFRQ

SEQ ID NO: 27277 - protein, 9 aa, Homo Sapiens
AAAKEGKTT

SEQ ID NO: 27278 - protein, 9 aa, Homo Sapiens
YKKRKRSPC

SEQ ID NO: 27279 - protein, 9 aa, Homo Sapiens
EHERVHSGE

SEQ ID NO: 27280 - protein, 9 aa, Homo Sapiens
LPATWPMNA

SEQ ID NO: 27281 - protein, 9 aa, Homo Sapiens
EAGTTARCP

SEQ ID NO: 27282 - protein, 9 aa, Homo Sapiens
ADLLTIYLV

SEQ ID NO: 27283 - protein, 9 aa, Homo Sapiens
RATIGVDLA

SEQ ID NO: 27284 - protein, 9 aa, Homo Sapiens
AMTAAAAMA

SEQ ID NO: 27285 - protein, 9 aa, Homo Sapiens
VQLPICIPE

SEQ ID NO: 27286 - protein, 9 aa, Homo Sapiens
DKETKTNES

SEQ ID NO: 27287 - protein, 9 aa, Homo Sapiens
PLDLLSHLA

SEQ ID NO: 27288 - protein, 9 aa, Homo Sapiens
HRSFCCKRK

SEQ ID NO: 27289 - protein, 9 aa, Homo Sapiens
SHFVPNSFI

SEQ ID NO: 27290 - protein, 9 aa, Homo Sapiens
EKTLLEDKV

SEQ ID NO: 27291 - protein, 9 aa, Homo Sapiens
ERMENYKLQ

SEQ ID NO: 27292 - protein, 9 aa, Homo Sapiens
EGQELSITC

SEQ ID NO: 27293 - protein, 9 aa, Homo Sapiens
PTRNRPRPT

SEQ ID NO: 27294 - protein, 9 aa, Homo Sapiens
QAQADLLTI

SEQ ID NO: 27295 - protein, 9 aa, Homo Sapiens
NVLGETKQA

SEQ ID NO: 27296 - protein, 9 aa, Homo Sapiens
QLHRSKAAD

SEQ ID NO: 27297 - protein, 9 aa, Homo Sapiens
TVEAWEVTV

SEQ ID NO: 27298 - protein, 9 aa, Homo Sapiens
QSDAGGTLT

SEQ ID NO: 27299 - protein, 9 aa, Homo Sapiens
LACSVPPPK

SEQ ID NO: 27300 - protein, 9 aa, Homo Sapiens
LATFSTGER

SEQ ID NO: 27301 - protein, 9 aa, Homo Sapiens
ENYKLQKKQ

SEQ ID NO: 27302 - protein, 9 aa, Homo Sapiens
EFLYCHGVP

SEQ ID NO: 27303 - protein, 9 aa, Homo Sapiens
ELKKDNVFN

SEQ ID NO: 27304 - protein, 9 aa, Homo Sapiens
QLSDDKRQQ

SEQ ID NO: 27305 - protein, 9 aa, Homo Sapiens
TVSVLDRYY

SEQ ID NO: 27306 - protein, 9 aa, Homo Sapiens
RQKTVQDTQ

SEQ ID NO: 27307 - protein, 9 aa, Homo Sapiens
LLVKQLRFS

SEQ ID NO: 27308 - protein, 9 aa, Homo Sapiens
SQASADTWC

SEQ ID NO: 27309 - protein, 9 aa, Homo Sapiens
SATWELFPC

SEQ ID NO: 27310 - protein, 9 aa, Homo Sapiens
IVSIWSPRR

SEQ ID NO: 27311 - protein, 9 aa, Homo Sapiens
AVAAARTGT

SEQ ID NO: 27312 - protein, 9 aa, Homo Sapiens
ARCPTGPLR

SEQ ID NO: 27313 - protein, 9 aa, Homo Sapiens
ETKINFTQK

SEQ ID NO: 27314 - protein, 9 aa, Homo Sapiens
LIEGLCKTV

SEQ ID NO: 27315 - protein, 9 aa, Homo Sapiens
RWAQVKKED

SEQ ID NO: 27316 - protein, 9 aa, Homo Sapiens
FDNTASQFL

SEQ ID NO: 27317 - protein, 9 aa, Homo Sapiens
HYSGLIEHE

SEQ ID NO: 27318 - protein, 9 aa, Homo Sapiens
SLPFEGSEP

SEQ ID NO: 27319 - protein, 9 aa, Homo Sapiens
PPEDTAECQ

SEQ ID NO: 27320 - protein, 9 aa, Homo Sapiens
YVAEESKDK

SEQ ID NO: 27321 - protein, 9 aa, Homo Sapiens
VYDILYPAA

SEQ ID NO: 27322 - protein, 9 aa, Homo Sapiens
SNALQSTVQ

SEQ ID NO: 27323 - protein, 9 aa, Homo Sapiens
KDFFEVANI

SEQ ID NO: 27324 - protein, 9 aa, Homo Sapiens
IYLVVALAS

SEQ ID NO: 27325 - protein, 9 aa, Homo Sapiens
LLEDKVKLE

SEQ ID NO: 27326 - protein, 9 aa, Homo Sapiens
WELFPCRGY

SEQ ID NO: 27327 - protein, 9 aa, Homo Sapiens
HSVLLMARL

SEQ ID NO: 27328 - protein, 9 aa, Homo Sapiens
GQYQDVPDL

SEQ ID NO: 27329 - protein, 9 aa, Homo Sapiens
GLAKGNKLL

SEQ ID NO: 27330 - protein, 9 aa, Homo Sapiens
KYERELIFY

SEQ ID NO: 27331 - protein, 9 aa, Homo Sapiens
IMVVNGSRN

SEQ ID NO: 27332 - protein, 9 aa, Homo Sapiens
EKSRAGENK

SEQ ID NO: 27333 - protein, 9 aa, Homo Sapiens
EDKETKTNE

SEQ ID NO: 27334 - protein, 9 aa, Homo Sapiens
QLVVQLVRH

SEQ ID NO: 27335 - protein, 9 aa, Homo Sapiens
DEVFPEAQL

SEQ ID NO: 27336 - protein, 9 aa, Homo Sapiens
GGSSAFLLH

SEQ ID NO: 27337 - protein, 9 aa, Homo Sapiens
PSLRPTGGG

SEQ ID NO: 27338 - protein, 9 aa, Homo Sapiens
LKRSAEVSN

SEQ ID NO: 27339 - protein, 9 aa, Homo Sapiens
KSGYKGRVP

SEQ ID NO: 27340 - protein, 9 aa, Homo Sapiens
DVKKADVLN

SEQ ID NO: 27341 - protein, 9 aa, Homo Sapiens
VLKRSAEVS

SEQ ID NO: 27342 - protein, 9 aa, Homo Sapiens
KSQFQREEL

SEQ ID NO: 27343 - protein, 9 aa, Homo Sapiens
TQELHYKYT

SEQ ID NO: 27344 - protein, 9 aa, Homo Sapiens
PWHVAKMVK

SEQ ID NO: 27345 - protein, 9 aa, Homo Sapiens
NPRTLRYVA

SEQ ID NO: 27346 - protein, 9 aa, Homo Sapiens
EDNTGHRII

SEQ ID NO: 27347 - protein, 9 aa, Homo Sapiens
SVEDNTGHR

SEQ ID NO: 27348 - protein, 9 aa, Homo Sapiens
TQAAVPKVT

SEQ ID NO: 27349 - protein, 9 aa, Homo Sapiens
PHFGQHSSR

SEQ ID NO: 27350 - protein, 9 aa, Homo Sapiens
YNFKFDIWS

SEQ ID NO: 27351 - protein, 9 aa, Homo Sapiens
NVTSLDLKT

SEQ ID NO: 27352 - protein, 9 aa, Homo Sapiens
QHQEWKAAI

SEQ ID NO: 27353 - protein, 9 aa, Homo Sapiens
SGYPVICMT

SEQ ID NO: 27354 - protein, 9 aa, Homo Sapiens
ALSQHHIDE

SEQ ID NO: 27355 - protein, 9 aa, Homo Sapiens
QGLPHFGQH

SEQ ID NO: 27356 - protein, 9 aa, Homo Sapiens
DTAECQASD

SEQ ID NO: 27357 - protein, 9 aa, Homo Sapiens
LRYKKERQL

SEQ ID NO: 27358 - protein, 9 aa, Homo Sapiens
LIQKMLEYN

SEQ ID NO: 27359 - protein, 9 aa, Homo Sapiens
TLSRDQFNI

SEQ ID NO: 27360 - protein, 9 aa, Homo Sapiens
TSICAGYEV

SEQ ID NO: 27361 - protein, 9 aa, Homo Sapiens
KKYYYISSS

SEQ ID NO: 27362 - protein, 9 aa, Homo Sapiens
PRFAEINDQ

SEQ ID NO: 27363 - protein, 9 aa, Homo Sapiens
NCTDGIREQ

SEQ ID NO: 27364 - protein, 9 aa, Homo Sapiens
LLLAAAKEG

SEQ ID NO: 27365 - protein, 9 aa, Homo Sapiens
EQTYHAKLQ

SEQ ID NO: 27366 - protein, 9 aa, Homo Sapiens
AQAEAQKKQ

SEQ ID NO: 27367 - protein, 9 aa, Homo Sapiens
ALLGGCLCS

SEQ ID NO: 27368 - protein, 9 aa, Homo Sapiens
LQSRFLPYC

SEQ ID NO: 27369 - protein, 9 aa, Homo Sapiens
KTNESKEKY

SEQ ID NO: 27370 - protein, 9 aa, Homo Sapiens
EYEAIKLVN

SEQ ID NO: 27371 - protein, 9 aa, Homo Sapiens
PKTSRTLQQ

SEQ ID NO: 27372 - protein, 9 aa, Homo Sapiens
PSPRPGPWP

SEQ ID NO: 27373 - protein, 9 aa, Homo Sapiens
IQTVEDQHV

SEQ ID NO: 27374 - protein, 9 aa, Homo Sapiens
VANIKMTGT

SEQ ID NO: 27375 - protein, 9 aa, Homo Sapiens
GGEVNDART

SEQ ID NO: 27376 - protein, 9 aa, Homo Sapiens
QKTVQDTQK

SEQ ID NO: 27377 - protein, 9 aa, Homo Sapiens
GPPSAQRPK

SEQ ID NO: 27378 - protein, 9 aa, Homo Sapiens
VEFVLDKIQ

SEQ ID NO: 27379 - protein, 9 aa, Homo Sapiens
RPNGPADPA

SEQ ID NO: 27380 - protein, 9 aa, Homo Sapiens
FEIHERKHR

SEQ ID NO: 27381 - protein, 9 aa, Homo Sapiens
KQSQITSQV

SEQ ID NO: 27382 - protein, 9 aa, Homo Sapiens
IASMCRKNN

SEQ ID NO: 27383 - protein, 9 aa, Homo Sapiens
SVKETSICA

SEQ ID NO: 27384 - protein, 9 aa, Homo Sapiens
CKTDVNECD

SEQ ID NO: 27385 - protein, 9 aa, Homo Sapiens
ILCMKEDIK

SEQ ID NO: 27386 - protein, 9 aa, Homo Sapiens
LKGEDSWDS

SEQ ID NO: 27387 - protein, 9 aa, Homo Sapiens
NQTLSFFFM

SEQ ID NO: 27388 - protein, 9 aa, Homo Sapiens
RAVPKGRGG

SEQ ID NO: 27389 - protein, 9 aa, Homo Sapiens
TMEANLGAT

SEQ ID NO: 27390 - protein, 9 aa, Homo Sapiens
RNLSLRLPH

SEQ ID NO: 27391 - protein, 9 aa, Homo Sapiens
GIKIHKKRV

SEQ ID NO: 27392 - protein, 9 aa, Homo Sapiens
WQNALLQKT

SEQ ID NO: 27393 - protein, 9 aa, Homo Sapiens
KKGFCEGDE

SEQ ID NO: 27394 - protein, 9 aa, Homo Sapiens
LVSTGHATP

SEQ ID NO: 27395 - protein, 9 aa, Homo Sapiens
VQGSKKRKL

SEQ ID NO: 27396 - protein, 9 aa, Homo Sapiens
TLPLPTVEA

SEQ ID NO: 27397 - protein, 9 aa, Homo Sapiens
NDSGEKAEK

SEQ ID NO: 27398 - protein, 9 aa, Homo Sapiens
KALKSGYKG

SEQ ID NO: 27399 - protein, 9 aa, Homo Sapiens
AKALLYYPL

SEQ ID NO: 27400 - protein, 9 aa, Homo Sapiens
RMTELYDYL

SEQ ID NO: 27401 - protein, 9 aa, Homo Sapiens
SFLMLSCLI

SEQ ID NO: 27402 - protein, 9 aa, Homo Sapiens
HYRRELVFW

SEQ ID NO: 27403 - protein, 9 aa, Homo Sapiens
QITASLCKM

SEQ ID NO: 27404 - protein, 9 aa, Homo Sapiens
LLACGTNSL

SEQ ID NO: 27405 - protein, 9 aa, Homo Sapiens
SAPRVGEKR

SEQ ID NO: 27406 - protein, 9 aa, Homo Sapiens
GVETSSPAC

SEQ ID NO: 27407 - protein, 9 aa, Homo Sapiens
IGPSTLHGL

SEQ ID NO: 27408 - protein, 9 aa, Homo Sapiens
QQPRATLAP

SEQ ID NO: 27409 - protein, 9 aa, Homo Sapiens
SGHIGPSTL

SEQ ID NO: 27410 - protein, 9 aa, Homo Sapiens
SFEIHERKH

SEQ ID NO: 27411 - protein, 9 aa, Homo Sapiens
SWRGNEPEQ

SEQ ID NO: 27412 - protein, 9 aa, Homo Sapiens
NNHPPVFEK

SEQ ID NO: 27413 - protein, 9 aa, Homo Sapiens
SRDGFHPHQ

SEQ ID NO: 27414 - protein, 9 aa, Homo Sapiens
KETKTNESK

SEQ ID NO: 27415 - protein, 9 aa, Homo Sapiens
EIDDVGFEE

SEQ ID NO: 27416 - protein, 9 aa, Homo Sapiens
RVLTCDIEK

SEQ ID NO: 27417 - protein, 9 aa, Homo Sapiens
DPAVRFHSC

SEQ ID NO: 27418 - protein, 9 aa, Homo Sapiens
FQCCMQNTK

SEQ ID NO: 27419 - protein, 9 aa, Homo Sapiens
ICAGYEVCQ

SEQ ID NO: 27420 - protein, 9 aa, Homo Sapiens
NALLQPGGV

SEQ ID NO: 27421 - protein, 9 aa, Homo Sapiens
KDGNIFSEG

SEQ ID NO: 27422 - protein, 9 aa, Homo Sapiens
TDALLTEER

SEQ ID NO: 27423 - protein, 9 aa, Homo Sapiens
NVQCNSLRR

SEQ ID NO: 27424 - protein, 9 aa, Homo Sapiens
LLGGCLCSF

SEQ ID NO: 27425 - protein, 9 aa, Homo Sapiens
LLRRLFCHR

SEQ ID NO: 27426 - protein, 9 aa, Homo Sapiens
DPLDRCLQN

SEQ ID NO: 27427 - protein, 9 aa, Homo Sapiens
LDKIQKYTQ

SEQ ID NO: 27428 - protein, 9 aa, Homo Sapiens
PTTRGAAVN

SEQ ID NO: 27429 - protein, 9 aa, Homo Sapiens
SCTLTEILE

SEQ ID NO: 27430 - protein, 9 aa, Homo Sapiens
ELIFYINHS

SEQ ID NO: 27431 - protein, 9 aa, Homo Sapiens
SPISESMLE

SEQ ID NO: 27432 - protein, 9 aa, Homo Sapiens
SPWSSSEIS

SEQ ID NO: 27433 - protein, 9 aa, Homo Sapiens
RQLIYNFYY

SEQ ID NO: 27434 - protein, 9 aa, Homo Sapiens
HSSVTRKAP

SEQ ID NO: 27435 - protein, 9 aa, Homo Sapiens
LELYEEIFS

SEQ ID NO: 27436 - protein, 9 aa, Homo Sapiens
EDTAECQAS

SEQ ID NO: 27437 - protein, 9 aa, Homo Sapiens
LQKTLSPRE

SEQ ID NO: 27438 - protein, 9 aa, Homo Sapiens
GLSKHGYGG

SEQ ID NO: 27439 - protein, 9 aa, Homo Sapiens
FSLSQMMLK

SEQ ID NO: 27440 - protein, 9 aa, Homo Sapiens
KEKQSQITS

SEQ ID NO: 27441 - protein, 9 aa, Homo Sapiens
LAKGNKLLA

SEQ ID NO: 27442 - protein, 9 aa, Homo Sapiens
ALQSTVQSL

SEQ ID NO: 27443 - protein, 9 aa, Homo Sapiens
DKIQKYTQQ

SEQ ID NO: 27444 - protein, 9 aa, Homo Sapiens
YPAAPVSRS

SEQ ID NO: 27445 - protein, 9 aa, Homo Sapiens
LKLDMPLTR

SEQ ID NO: 27446 - protein, 9 aa, Homo Sapiens
PWPPSPAEE

SEQ ID NO: 27447 - protein, 9 aa, Homo Sapiens
PALLGTVCG

SEQ ID NO: 27448 - protein, 9 aa, Homo Sapiens
SHRLGRNRD

SEQ ID NO: 27449 - protein, 9 aa, Homo Sapiens
RYFPSKDQK

SEQ ID NO: 27450 - protein, 9 aa, Homo Sapiens
ADVLNILKD

SEQ ID NO: 27451 - protein, 9 aa, Homo Sapiens
EALAVCSGS

SEQ ID NO: 27452 - protein, 9 aa, Homo Sapiens
LQYFIRDVK

SEQ ID NO: 27453 - protein, 9 aa, Homo Sapiens
EDSGEESGV

SEQ ID NO: 27454 - protein, 9 aa, Homo Sapiens
KSARQYYVQ

SEQ ID NO: 27455 - protein, 9 aa, Homo Sapiens
QPPQVIQQY

SEQ ID NO: 27456 - protein, 9 aa, Homo Sapiens
SGEESGVED

SEQ ID NO: 27457 - protein, 9 aa, Homo Sapiens
EAHPLPMWT

SEQ ID NO: 27458 - protein, 9 aa, Homo Sapiens
VDQRSGEVL

SEQ ID NO: 27459 - protein, 9 aa, Homo Sapiens
TELYDYLKY

SEQ ID NO: 27460 - protein, 9 aa, Homo Sapiens
VISYTIILF

SEQ ID NO: 27461 - protein, 9 aa, Homo Sapiens
TTLEAAEAA

SEQ ID NO: 27462 - protein, 9 aa, Homo Sapiens
LQKKQELSN

SEQ ID NO: 27463 - protein, 9 aa, Homo Sapiens
WFLSRKNTA

SEQ ID NO: 27464 - protein, 9 aa, Homo Sapiens
ERARDIKCL

SEQ ID NO: 27465 - protein, 9 aa, Homo Sapiens
RQALAGLPR

SEQ ID NO: 27466 - protein, 9 aa, Homo Sapiens
IKKVPSLER

SEQ ID NO: 27467 - protein, 9 aa, Homo Sapiens
NFREIEVEV

SEQ ID NO: 27468 - protein, 9 aa, Homo Sapiens
GESSQGRTK

SEQ ID NO: 27469 - protein, 9 aa, Homo Sapiens
QSVKSTVSE

SEQ ID NO: 27470 - protein, 9 aa, Homo Sapiens
DSWWLDSGH

SEQ ID NO: 27471 - protein, 9 aa, Homo Sapiens
EDEILGSEK

SEQ ID NO: 27472 - protein, 9 aa, Homo Sapiens
EGCLWAECS

SEQ ID NO: 27473 - protein, 9 aa, Homo Sapiens
VNLYQNVQC

SEQ ID NO: 27474 - protein, 9 aa, Homo Sapiens
SEPRIFRIK

SEQ ID NO: 27475 - protein, 9 aa, Homo Sapiens
ILSPKNMQP

SEQ ID NO: 27476 - protein, 9 aa, Homo Sapiens
FLRWRDTGV

SEQ ID NO: 27477 - protein, 9 aa, Homo Sapiens
NPLMFTSVI

SEQ ID NO: 27478 - protein, 9 aa, Homo Sapiens
TRGAAVNAE

SEQ ID NO: 27479 - protein, 9 aa, Homo Sapiens
PGMMSLFGK

SEQ ID NO: 27480 - protein, 9 aa, Homo Sapiens
AGVIFASIV

SEQ ID NO: 27481 - protein, 9 aa, Homo Sapiens
GGSEASAAR

SEQ ID NO: 27482 - protein, 9 aa, Homo Sapiens
PVICMTACN

SEQ ID NO: 27483 - protein, 9 aa, Homo Sapiens
EEALAVCSG

SEQ ID NO: 27484 - protein, 9 aa, Homo Sapiens
YSNLYSERR

SEQ ID NO: 27485 - protein, 9 aa, Homo Sapiens
TAETLDVQI

SEQ ID NO: 27486 - protein, 9 aa, Homo Sapiens
RYVNIIAYD

SEQ ID NO: 27487 - protein, 9 aa, Homo Sapiens
HPAAVAAAR

SEQ ID NO: 27488 - protein, 9 aa, Homo Sapiens
GHYEQRLRY

SEQ ID NO: 27489 - protein, 9 aa, Homo Sapiens
KRPGGPTTH

SEQ ID NO: 27490 - protein, 9 aa, Homo Sapiens
ATLQYFIRD

SEQ ID NO: 27491 - protein, 9 aa, Homo Sapiens
LRPHPAAVA

SEQ ID NO: 27492 - protein, 9 aa, Homo Sapiens
EEQLHRSKA

SEQ ID NO: 27493 - protein, 9 aa, Homo Sapiens
KTSRTLQQP

SEQ ID NO: 27494 - protein, 9 aa, Homo Sapiens
NLPPRMLPE

SEQ ID NO: 27495 - protein, 9 aa, Homo Sapiens
PNTLDETDA

SEQ ID NO: 27496 - protein, 9 aa, Homo Sapiens
LFPCRGYCS

SEQ ID NO: 27497 - protein, 9 aa, Homo Sapiens
MCRKNNDDS

SEQ ID NO: 27498 - protein, 9 aa, Homo Sapiens
GKIATEALD

SEQ ID NO: 27499 - protein, 9 aa, Homo Sapiens
HGRDLDEVC

SEQ ID NO: 27500 - protein, 9 aa, Homo Sapiens
EFRNLSLRL

SEQ ID NO: 27501 - protein, 9 aa, Homo Sapiens
GVPAFYTPM

SEQ ID NO: 27502 - protein, 9 aa, Homo Sapiens
CIASMCRKN

SEQ ID NO: 27503 - protein, 9 aa, Homo Sapiens
TALQSRFLP

SEQ ID NO: 27504 - protein, 9 aa, Homo Sapiens
AARAQEAQK

SEQ ID NO: 27505 - protein, 9 aa, Homo Sapiens
LCKTVWYSV

SEQ ID NO: 27506 - protein, 9 aa, Homo Sapiens
TGFTGQKCK

SEQ ID NO: 27507 - protein, 9 aa, Homo Sapiens
SLAPPGDRL

SEQ ID NO: 27508 - protein, 9 aa, Homo Sapiens
TKIIKTIVD

SEQ ID NO: 27509 - protein, 9 aa, Homo Sapiens
HNYPLALSS

SEQ ID NO: 27510 - protein, 9 aa, Homo Sapiens
ENTASASEG

SEQ ID NO: 27511 - protein, 9 aa, Homo Sapiens
QVVLNATYI

SEQ ID NO: 27512 - protein, 9 aa, Homo Sapiens
TLLIDCRGP

SEQ ID NO: 27513 - protein, 9 aa, Homo Sapiens
TVMVNSMDN

SEQ ID NO: 27514 - protein, 9 aa, Homo Sapiens
VKLPRNGQA

SEQ ID NO: 27515 - protein, 9 aa, Homo Sapiens
DMVVCHLFG

SEQ ID NO: 27516 - protein, 9 aa, Homo Sapiens
WRPWPTGLL

SEQ ID NO: 27517 - protein, 9 aa, Homo Sapiens
GLFQLLFFW

SEQ ID NO: 27518 - protein, 9 aa, Homo Sapiens
KQFHVKEDI

SEQ ID NO: 27519 - protein, 9 aa, Homo Sapiens
GLIEHERVH

SEQ ID NO: 27520 - protein, 9 aa, Homo Sapiens
RINRVTNQN

SEQ ID NO: 27521 - protein, 9 aa, Homo Sapiens
QSRFLPYCE

SEQ ID NO: 27522 - protein, 9 aa, Homo Sapiens
AALDPEHQG

SEQ ID NO: 27523 - protein, 9 aa, Homo Sapiens
CLNPLAPPL

SEQ ID NO: 27524 - protein, 9 aa, Homo Sapiens
EREALTTEA

SEQ ID NO: 27525 - protein, 9 aa, Homo Sapiens
IREHSDCSS

SEQ ID NO: 27526 - protein, 9 aa, Homo Sapiens
GNEPEQWIP

SEQ ID NO: 27527 - protein, 9 aa, Homo Sapiens
VFGLYSGEQ

SEQ ID NO: 27528 - protein, 9 aa, Homo Sapiens
LGPQTPLAM

SEQ ID NO: 27529 - protein, 9 aa, Homo Sapiens
PPCATTFDT

SEQ ID NO: 27530 - protein, 9 aa, Homo Sapiens
VGLLLRRLF

SEQ ID NO: 27531 - protein, 9 aa, Homo Sapiens
NLYQNVQCN

SEQ ID NO: 27532 - protein, 9 aa, Homo Sapiens
AKGKAVAAA

SEQ ID NO: 27533 - protein, 9 aa, Homo Sapiens
TYHAKLQNA

SEQ ID NO: 27534 - protein, 9 aa, Homo Sapiens
FDYHCPWVG

SEQ ID NO: 27535 - protein, 9 aa, Homo Sapiens
SIDGKIEGL

SEQ ID NO: 27536 - protein, 9 aa, Homo Sapiens
CKVSEYSVE

SEQ ID NO: 27537 - protein, 9 aa, Homo Sapiens
KEFGGDKNG

SEQ ID NO: 27538 - protein, 9 aa, Homo Sapiens
VVLVNKEAW

SEQ ID NO: 27539 - protein, 9 aa, Homo Sapiens
NPTAHCNVF

SEQ ID NO: 27540 - protein, 9 aa, Homo Sapiens
TFKNCFKSC

SEQ ID NO: 27541 - protein, 9 aa, Homo Sapiens
QTELNVTSL

SEQ ID NO: 27542 - protein, 9 aa, Homo Sapiens
LLWNRPRFA

SEQ ID NO: 27543 - protein, 9 aa, Homo Sapiens
EVSNPPKPL

SEQ ID NO: 27544 - protein, 9 aa, Homo Sapiens
YLNLHWVNV

SEQ ID NO: 27545 - protein, 9 aa, Homo Sapiens
TCDIEKFMP

SEQ ID NO: 27546 - protein, 9 aa, Homo Sapiens
PELHLNCRT

SEQ ID NO: 27547 - protein, 9 aa, Homo Sapiens
HLELFLGQI

SEQ ID NO: 27548 - protein, 9 aa, Homo Sapiens
SFDLKGEDS

SEQ ID NO: 27549 - protein, 9 aa, Homo Sapiens
IKSQTKEKQ

SEQ ID NO: 27550 - protein, 9 aa, Homo Sapiens
SPCPSPTPE

SEQ ID NO: 27551 - protein, 9 aa, Homo Sapiens
KFDIWSLGC

SEQ ID NO: 27552 - protein, 9 aa, Homo Sapiens
TVAPKTLSV

SEQ ID NO: 27553 - protein, 9 aa, Homo Sapiens
VFEVQLLKI

SEQ ID NO: 27554 - protein, 9 aa, Homo Sapiens
PDACVPPTV

SEQ ID NO: 27555 - protein, 9 aa, Homo Sapiens
PEVRVYHLT

SEQ ID NO: 27556 - protein, 9 aa, Homo Sapiens
PQMSRGLLA

SEQ ID NO: 27557 - protein, 9 aa, Homo Sapiens
QKMLEYNPA

SEQ ID NO: 27558 - protein, 9 aa, Homo Sapiens
RTRPSLRPT

SEQ ID NO: 27559 - protein, 9 aa, Homo Sapiens
DLLSHLAKV

SEQ ID NO: 27560 - protein, 9 aa, Homo Sapiens
EVEFVLDKI

SEQ ID NO: 27561 - protein, 9 aa, Homo Sapiens
PVTNTSLVS

SEQ ID NO: 27562 - protein, 9 aa, Homo Sapiens
PPRPNGPAD

SEQ ID NO: 27563 - protein, 9 aa, Homo Sapiens
ELIKNQPEE

SEQ ID NO: 27564 - protein, 9 aa, Homo Sapiens
LPPRMLPEL

SEQ ID NO: 27565 - protein, 9 aa, Homo Sapiens
APSPRPGPW

SEQ ID NO: 27566 - protein, 9 aa, Homo Sapiens
EMPTTLEAA

SEQ ID NO: 27567 - protein, 9 aa, Homo Sapiens
KSNDSGEKA

SEQ ID NO: 27568 - protein, 9 aa, Homo Sapiens
GWELAKETT

SEQ ID NO: 27569 - protein, 9 aa, Homo Sapiens
KLGPQTPLA

SEQ ID NO: 27570 - protein, 9 aa, Homo Sapiens
KALRPHPAA

SEQ ID NO: 27571 - protein, 9 aa, Homo Sapiens
LGAASSHVI

SEQ ID NO: 27572 - protein, 9 aa, Homo Sapiens
YPLALSSSA

SEQ ID NO: 27573 - protein, 9 aa, Homo Sapiens
DANCDSPSR

SEQ ID NO: 27574 - protein, 9 aa, Homo Sapiens
GSNRRPQTP

SEQ ID NO: 27575 - protein, 9 aa, Homo Sapiens
PTVAPKTLS

SEQ ID NO: 27576 - protein, 9 aa, Homo Sapiens
KDPLDRCLQ

SEQ ID NO: 27577 - protein, 9 aa, Homo Sapiens
HVDQRSGEV

SEQ ID NO: 27578 - protein, 9 aa, Homo Sapiens
QALPDMVVC

SEQ ID NO: 27579 - protein, 9 aa, Homo Sapiens
WAQVKKEDQ

SEQ ID NO: 27580 - protein, 9 aa, Homo Sapiens
SIWSPRRLR

SEQ ID NO: 27581 - protein, 9 aa, Homo Sapiens
NIIEWLLQQ

SEQ ID NO: 27582 - protein, 9 aa, Homo Sapiens
CNSLRRDSS

SEQ ID NO: 27583 - protein, 9 aa, Homo Sapiens
GVFYCCTFC

SEQ ID NO: 27584 - protein, 9 aa, Homo Sapiens
YWTHEHGVL

SEQ ID NO: 27585 - protein, 9 aa, Homo Sapiens
EWLLQQLQT

SEQ ID NO: 27586 - protein, 9 aa, Homo Sapiens
TLDETDALL

SEQ ID NO: 27587 - protein, 9 aa, Homo Sapiens
LLTIYLVVA

SEQ ID NO: 27588 - protein, 9 aa, Homo Sapiens
VSASSSSSR

SEQ ID NO: 27589 - protein, 9 aa, Homo Sapiens
QSQQLQEVL

SEQ ID NO: 27590 - protein, 9 aa, Homo Sapiens
PKNLLYYSQ

SEQ ID NO: 27591 - protein, 9 aa, Homo Sapiens
LPNEILNRG

SEQ ID NO: 27592 - protein, 9 aa, Homo Sapiens
CGTNSLSPV

SEQ ID NO: 27593 - protein, 9 aa, Homo Sapiens
RDGVATKCI

SEQ ID NO: 27594 - protein, 9 aa, Homo Sapiens
NGKYYEMAL

SEQ ID NO: 27595 - protein, 9 aa, Homo Sapiens
FLANQPIEA

SEQ ID NO: 27596 - protein, 9 aa, Homo Sapiens
CAKGKAVAA

SEQ ID NO: 27597 - protein, 9 aa, Homo Sapiens
LDISTVTQA

SEQ ID NO: 27598 - protein, 9 aa, Homo Sapiens
IFVYWTHEH

SEQ ID NO: 27599 - protein, 9 aa, Homo Sapiens
CKRKMEWWD

SEQ ID NO: 27600 - protein, 9 aa, Homo Sapiens
PEDLQFVYE

SEQ ID NO: 27601 - protein, 9 aa, Homo Sapiens
ERPQLSDDK

SEQ ID NO: 27602 - protein, 9 aa, Homo Sapiens
QGQFLKFTH

SEQ ID NO: 27603 - protein, 9 aa, Homo Sapiens
KKGRTFSFS

SEQ ID NO: 27604 - protein, 9 aa, Homo Sapiens
LRFQHQEWK

SEQ ID NO: 27605 - protein, 9 aa, Homo Sapiens
TLEAAEAAI

SEQ ID NO: 27606 - protein, 9 aa, Homo Sapiens
PLTLEGRPR

SEQ ID NO: 27607 - protein, 9 aa, Homo Sapiens
KEGKTTELT

SEQ ID NO: 27608 - protein, 9 aa, Homo Sapiens
PQFVQLPIC

SEQ ID NO: 27609 - protein, 9 aa, Homo Sapiens
PPTGDSKAA

SEQ ID NO: 27610 - protein, 9 aa, Homo Sapiens
YEQRLRYTC

SEQ ID NO: 27611 - protein, 9 aa, Homo Sapiens
NVNRHSLEV

SEQ ID NO: 27612 - protein, 9 aa, Homo Sapiens
PRPNGPADP

SEQ ID NO: 27613 - protein, 9 aa, Homo Sapiens
FLEGVNRDS

SEQ ID NO: 27614 - protein, 9 aa, Homo Sapiens
STLPFNVPN

SEQ ID NO: 27615 - protein, 9 aa, Homo Sapiens
ECIKRKEFR

SEQ ID NO: 27616 - protein, 9 aa, Homo Sapiens
SQGVETSSP

SEQ ID NO: 27617 - protein, 9 aa, Homo Sapiens
EVNDARTIG

SEQ ID NO: 27618 - protein, 9 aa, Homo Sapiens
TGNSDSAAP

SEQ ID NO: 27619 - protein, 9 aa, Homo Sapiens
IKEVTEDLK

SEQ ID NO: 27620 - protein, 9 aa, Homo Sapiens
PQRQRSGSE

SEQ ID NO: 27621 - protein, 9 aa, Homo Sapiens
YHLTQYEHC

SEQ ID NO: 27622 - protein, 9 aa, Homo Sapiens
LHSGLPSLL

SEQ ID NO: 27623 - protein, 9 aa, Homo Sapiens
DQHVAELTL

SEQ ID NO: 27624 - protein, 9 aa, Homo Sapiens
KEYEAIKLV

SEQ ID NO: 27625 - protein, 9 aa, Homo Sapiens
QFLKFTHRE

SEQ ID NO: 27626 - protein, 9 aa, Homo Sapiens
LFQLLFFWN

SEQ ID NO: 27627 - protein, 9 aa, Homo Sapiens
HGLEIFQHC

SEQ ID NO: 27628 - protein, 9 aa, Homo Sapiens
NLKRRKASF

SEQ ID NO: 27629 - protein, 9 aa, Homo Sapiens
DTPTSDNLE

SEQ ID NO: 27630 - protein, 9 aa, Homo Sapiens
PPGGFSLYT

SEQ ID NO: 27631 - protein, 9 aa, Homo Sapiens
AQRPKLSSP

SEQ ID NO: 27632 - protein, 9 aa, Homo Sapiens
HQCCHRAEL

SEQ ID NO: 27633 - protein, 9 aa, Homo Sapiens
ERRCLNPLA

SEQ ID NO: 27634 - protein, 9 aa, Homo Sapiens
KKRKLRVYL

SEQ ID NO: 27635 - protein, 9 aa, Homo Sapiens
PLACSVPPP

SEQ ID NO: 27636 - protein, 9 aa, Homo Sapiens
KCKTDVNEC

SEQ ID NO: 27637 - protein, 9 aa, Homo Sapiens
EFLRWRDTG

SEQ ID NO: 27638 - protein, 9 aa, Homo Sapiens
HLKLQKLPE

SEQ ID NO: 27639 - protein, 9 aa, Homo Sapiens
YSLLRHQCC

SEQ ID NO: 27640 - protein, 9 aa, Homo Sapiens
WVNVVYYSP

SEQ ID NO: 27641 - protein, 9 aa, Homo Sapiens
DFHYRRELV

SEQ ID NO: 27642 - protein, 9 aa, Homo Sapiens
VTITEYEGH

SEQ ID NO: 27643 - protein, 9 aa, Homo Sapiens
RPTRNRPRP

SEQ ID NO: 27644 - protein, 9 aa, Homo Sapiens
PHSGVFYCC

SEQ ID NO: 27645 - protein, 9 aa, Homo Sapiens
CLGDSGGTF

SEQ ID NO: 27646 - protein, 9 aa, Homo Sapiens
RDVTNDVKS

SEQ ID NO: 27647 - protein, 9 aa, Homo Sapiens
KGRVPLKSA

SEQ ID NO: 27648 - protein, 9 aa, Homo Sapiens
KVEALSQHH

SEQ ID NO: 27649 - protein, 9 aa, Homo Sapiens
SVPIEPPEI

SEQ ID NO: 27650 - protein, 9 aa, Homo Sapiens
PSRDGFHPH

SEQ ID NO: 27651 - protein, 9 aa, Homo Sapiens
VYKSLVSGS

SEQ ID NO: 27652 - protein, 9 aa, Homo Sapiens
AVKRPLDVH

SEQ ID NO: 27653 - protein, 9 aa, Homo Sapiens
DLLTMLPNE

SEQ ID NO: 27654 - protein, 9 aa, Homo Sapiens
IWICLVAMV

SEQ ID NO: 27655 - protein, 9 aa, Homo Sapiens
YQFICRKCQ

SEQ ID NO: 27656 - protein, 9 aa, Homo Sapiens
LVLPAACVR

SEQ ID NO: 27657 - protein, 9 aa, Homo Sapiens
DTVESFYCL

SEQ ID NO: 27658 - protein, 9 aa, Homo Sapiens
SCGAFASSC

SEQ ID NO: 27659 - protein, 9 aa, Homo Sapiens
LLLQIIEFR

SEQ ID NO: 27660 - protein, 9 aa, Homo Sapiens
SCTQNKRAN

SEQ ID NO: 27661 - protein, 9 aa, Homo Sapiens
NLLGRNSFK

SEQ ID NO: 27662 - protein, 9 aa, Homo Sapiens
VSTTGVNSS

SEQ ID NO: 27663 - protein, 9 aa, Homo Sapiens
VKETSICAG

SEQ ID NO: 27664 - protein, 9 aa, Homo Sapiens
DNSYAEQGT

SEQ ID NO: 27665 - protein, 9 aa, Homo Sapiens
GPSTLHGLA

SEQ ID NO: 27666 - protein, 9 aa, Homo Sapiens
FYRDGVPKG

SEQ ID NO: 27667 - protein, 9 aa, Homo Sapiens
YFINQGLFQ

SEQ ID NO: 27668 - protein, 9 aa, Homo Sapiens
FVYWTHEHG

SEQ ID NO: 27669 - protein, 9 aa, Homo Sapiens
DLDEVCKQE

SEQ ID NO: 27670 - protein, 9 aa, Homo Sapiens
LYYPLPFFA

SEQ ID NO: 27671 - protein, 9 aa, Homo Sapiens
GEYNMALKN

SEQ ID NO: 27672 - protein, 9 aa, Homo Sapiens
CLDSVLVAQ

SEQ ID NO: 27673 - protein, 9 aa, Homo Sapiens
RSAEVSNPP

SEQ ID NO: 27674 - protein, 9 aa, Homo Sapiens
THNIEDEIL

SEQ ID NO: 27675 - protein, 9 aa, Homo Sapiens
NLEQFAKQF

SEQ ID NO: 27676 - protein, 9 aa, Homo Sapiens
SLRLPHFSL

SEQ ID NO: 27677 - protein, 9 aa, Homo Sapiens
TDGIREQYT

SEQ ID NO: 27678 - protein, 9 aa, Homo Sapiens
IQKMLEYNP

SEQ ID NO: 27679 - protein, 9 aa, Homo Sapiens
SSPPCITHS

SEQ ID NO: 27680 - protein, 9 aa, Homo Sapiens
SQESMPPPE

SEQ ID NO: 27681 - protein, 9 aa, Homo Sapiens
TEVTVEAWE

SEQ ID NO: 27682 - protein, 9 aa, Homo Sapiens
ALLYYPLPF

SEQ ID NO: 27683 - protein, 9 aa, Homo Sapiens
HPSIRLGHM

SEQ ID NO: 27684 - protein, 9 aa, Homo Sapiens
TRDVTNDVK

SEQ ID NO: 27685 - protein, 9 aa, Homo Sapiens
ENADSAQRG

SEQ ID NO: 27686 - protein, 9 aa, Homo Sapiens
MGRLRSGQG

SEQ ID NO: 27687 - protein, 9 aa, Homo Sapiens
NTASASEGS

SEQ ID NO: 27688 - protein, 9 aa, Homo Sapiens
CVPPTVPEA

SEQ ID NO: 27689 - protein, 9 aa, Homo Sapiens
ENLTGSNRR

SEQ ID NO: 27690 - protein, 9 aa, Homo Sapiens
FVQLPICIP

SEQ ID NO: 27691 - protein, 9 aa, Homo Sapiens
GGGGGAAGR

SEQ ID NO: 27692 - protein, 9 aa, Homo Sapiens
ALLGTVCGE

SEQ ID NO: 27693 - protein, 9 aa, Homo Sapiens
RQRSGSESS

SEQ ID NO: 27694 - protein, 9 aa, Homo Sapiens
IRYPEDLQF

SEQ ID NO: 27695 - protein, 9 aa, Homo Sapiens
HLNPYTLRF

SEQ ID NO: 27696 - protein, 9 aa, Homo Sapiens
QLLHSGLPS

SEQ ID NO: 27697 - protein, 9 aa, Homo Sapiens
SLVCNLDPG

SEQ ID NO: 27698 - protein, 9 aa, Homo Sapiens
GQELSITCL

SEQ ID NO: 27699 - protein, 9 aa, Homo Sapiens
PISESMLER

SEQ ID NO: 27700 - protein, 9 aa, Homo Sapiens
VQLLKIERR

SEQ ID NO: 27701 - protein, 9 aa, Homo Sapiens
DPLACSVPP

SEQ ID NO: 27702 - protein, 9 aa, Homo Sapiens
PDNDKDESE

SEQ ID NO: 27703 - protein, 9 aa, Homo Sapiens
KPPRPNGPA

SEQ ID NO: 27704 - protein, 9 aa, Homo Sapiens
VLVNKEAWS

SEQ ID NO: 27705 - protein, 9 aa, Homo Sapiens
CPKAANSPF

SEQ ID NO: 27706 - protein, 9 aa, Homo Sapiens
ENAHLVQHQ

SEQ ID NO: 27707 - protein, 9 aa, Homo Sapiens
APPGDRLRL

SEQ ID NO: 27708 - protein, 9 aa, Homo Sapiens
VEDQHVAEL

SEQ ID NO: 27709 - protein, 9 aa, Homo Sapiens
APPCLPGLP

SEQ ID NO: 27710 - protein, 9 aa, Homo Sapiens
TVYDILYPA

SEQ ID NO: 27711 - protein, 9 aa, Homo Sapiens
YTPMGYGTL

SEQ ID NO: 27712 - protein, 9 aa, Homo Sapiens
YDDDHVDSQ

SEQ ID NO: 27713 - protein, 9 aa, Homo Sapiens
GGPSAHWEA

SEQ ID NO: 27714 - protein, 9 aa, Homo Sapiens
YRVLTCDIE

SEQ ID NO: 27715 - protein, 9 aa, Homo Sapiens
ELYEEIFSL

SEQ ID NO: 27716 - protein, 9 aa, Homo Sapiens
QKALEKSQF

SEQ ID NO: 27717 - protein, 9 aa, Homo Sapiens
KNRYVNIIA

SEQ ID NO: 27718 - protein, 9 aa, Homo Sapiens
PQCVPQNTG

SEQ ID NO: 27719 - protein, 9 aa, Homo Sapiens
KFCIASMCR

SEQ ID NO: 27720 - protein, 9 aa, Homo Sapiens
NSLTSCVPY

SEQ ID NO: 27721 - protein, 9 aa, Homo Sapiens
EPEQWIPRT

SEQ ID NO: 27722 - protein, 9 aa, Homo Sapiens
SAEGKEPSP

SEQ ID NO: 27723 - protein, 9 aa, Homo Sapiens
KFSSFEIHE

SEQ ID NO: 27724 - protein, 9 aa, Homo Sapiens
ETSICAGYE

SEQ ID NO: 27725 - protein, 9 aa, Homo Sapiens
PMGYGTLVQ

SEQ ID NO: 27726 - protein, 9 aa, Homo Sapiens
KYYEMALQA

SEQ ID NO: 27727 - protein, 9 aa, Homo Sapiens
GTVCGELVD

SEQ ID NO: 27728 - protein, 9 aa, Homo Sapiens
IVHRDLKPK

SEQ ID NO: 27729 - protein, 9 aa, Homo Sapiens
SMGYEMCKP

SEQ ID NO: 27730 - protein, 9 aa, Homo Sapiens
PALLRQALL

SEQ ID NO: 27731 - protein, 9 aa, Homo Sapiens
RTLRYVAEE

SEQ ID NO: 27732 - protein, 9 aa, Homo Sapiens
EEYAHNALR

SEQ ID NO: 27733 - protein, 9 aa, Homo Sapiens
CRAIQYIPT

SEQ ID NO: 27734 - protein, 9 aa, Homo Sapiens
LGNVSFSLL

SEQ ID NO: 27735 - protein, 9 aa, Homo Sapiens
HGCSSEETL

SEQ ID NO: 27736 - protein, 9 aa, Homo Sapiens
LNLHWVNVV

SEQ ID NO: 27737 - protein, 9 aa, Homo Sapiens
PEAHNPGCI

SEQ ID NO: 27738 - protein, 9 aa, Homo Sapiens
KIIKVKVHK

SEQ ID NO: 27739 - protein, 9 aa, Homo Sapiens
KIMVVNGSR

SEQ ID NO: 27740 - protein, 9 aa, Homo Sapiens
RCLNPLAPP

SEQ ID NO: 27741 - protein, 9 aa, Homo Sapiens
VRKYWCQIS

SEQ ID NO: 27742 - protein, 9 aa, Homo Sapiens
NFYYLDYLM

SEQ ID NO: 27743 - protein, 9 aa, Homo Sapiens
TAGKPPRPN

SEQ ID NO: 27744 - protein, 9 aa, Homo Sapiens
CLTPQRQRS

SEQ ID NO: 27745 - protein, 9 aa, Homo Sapiens
AGTTARCPT

SEQ ID NO: 27746 - protein, 9 aa, Homo Sapiens
NCKSIDGKI

SEQ ID NO: 27747 - protein, 9 aa, Homo Sapiens
ALRPHPAAV

SEQ ID NO: 27748 - protein, 9 aa, Homo Sapiens
AVNAEAMEP

SEQ ID NO: 27749 - protein, 9 aa, Homo Sapiens
RSHLPATWP

SEQ ID NO: 27750 - protein, 9 aa, Homo Sapiens
QAHGEGQEL

SEQ ID NO: 27751 - protein, 9 aa, Homo Sapiens
AAAAPPCLP

SEQ ID NO: 27752 - protein, 9 aa, Homo Sapiens
RYPEDLQFV

SEQ ID NO: 27753 - protein, 9 aa, Homo Sapiens
SKAMSEVEG

SEQ ID NO: 27754 - protein, 9 aa, Homo Sapiens
KKRVSDNLR

SEQ ID NO: 27755 - protein, 9 aa, Homo Sapiens
CTLTEILEA

SEQ ID NO: 27756 - protein, 9 aa, Homo Sapiens
KCLTPQRQR

SEQ ID NO: 27757 - protein, 9 aa, Homo Sapiens
RFHSCGIKS

SEQ ID NO: 27758 - protein, 9 aa, Homo Sapiens
IKENVDVAS

SEQ ID NO: 27759 - protein, 9 aa, Homo Sapiens
HIGPSTLHG

SEQ ID NO: 27760 - protein, 9 aa, Homo Sapiens
TLLEDKVKL

SEQ ID NO: 27761 - protein, 9 aa, Homo Sapiens
KALLYYPLP

SEQ ID NO: 27762 - protein, 9 aa, Homo Sapiens
LTTEADTIS

SEQ ID NO: 27763 - protein, 9 aa, Homo Sapiens
SISNNAEQC

SEQ ID NO: 27764 - protein, 9 aa, Homo Sapiens
ARNGPRSPR

SEQ ID NO: 27765 - protein, 9 aa, Homo Sapiens
LSDSSFDLK

SEQ ID NO: 27766 - protein, 9 aa, Homo Sapiens
VLDKIQKYT

SEQ ID NO: 27767 - protein, 9 aa, Homo Sapiens
KIQKYTQQK

SEQ ID NO: 27768 - protein, 9 aa, Homo Sapiens
GGGGAAGRL

SEQ ID NO: 27769 - protein, 9 aa, Homo Sapiens
DMNSLSPMM

SEQ ID NO: 27770 - protein, 9 aa, Homo Sapiens
HNITHTEEK

SEQ ID NO: 27771 - protein, 9 aa, Homo Sapiens
ISESMLERL

SEQ ID NO: 27772 - protein, 9 aa, Homo Sapiens
YRKPTTTKK

SEQ ID NO: 27773 - protein, 9 aa, Homo Sapiens
TIVISYTII

SEQ ID NO: 27774 - protein, 9 aa, Homo Sapiens
CLWAECSAS

SEQ ID NO: 27775 - protein, 9 aa, Homo Sapiens
GRNALEIVI

SEQ ID NO: 27776 - protein, 9 aa, Homo Sapiens
RCPTGPLRA

SEQ ID NO: 27777 - protein, 9 aa, Homo Sapiens
IEKQFHVKE

SEQ ID NO: 27778 - protein, 9 aa, Homo Sapiens
PKVEALSQH

SEQ ID NO: 27779 - protein, 9 aa, Homo Sapiens
NCDSPSRVP

SEQ ID NO: 27780 - protein, 9 aa, Homo Sapiens
NLDISTVTQ

SEQ ID NO: 27781 - protein, 9 aa, Homo Sapiens
LRLWEYSSG

SEQ ID NO: 27782 - protein, 9 aa, Homo Sapiens
VKRRPQMSR

SEQ ID NO: 27783 - protein, 9 aa, Homo Sapiens
ALLRQALLD

SEQ ID NO: 27784 - protein, 9 aa, Homo Sapiens
KYQFICRKC

SEQ ID NO: 27785 - protein, 9 aa, Homo Sapiens
EANLGATGH

SEQ ID NO: 27786 - protein, 9 aa, Homo Sapiens
MPTLESETQ

SEQ ID NO: 27787 - protein, 9 aa, Homo Sapiens
PSAHWEAGT

SEQ ID NO: 27788 - protein, 9 aa, Homo Sapiens
ANSPFSSDK

SEQ ID NO: 27789 - protein, 9 aa, Homo Sapiens
RLIKEVTED

SEQ ID NO: 27790 - protein, 9 aa, Homo Sapiens
LVDRRFPNK

SEQ ID NO: 27791 - protein, 9 aa, Homo Sapiens
DEDTPTSDN

SEQ ID NO: 27792 - protein, 9 aa, Homo Sapiens
PLVEQLRAT

SEQ ID NO: 27793 - protein, 9 aa, Homo Sapiens
PAMGTGRIG

SEQ ID NO: 27794 - protein, 9 aa, Homo Sapiens
PSAMTAAAA

SEQ ID NO: 27795 - protein, 9 aa, Homo Sapiens
KPKETVPTV

SEQ ID NO: 27796 - protein, 9 aa, Homo Sapiens
EGVEYEFTV

SEQ ID NO: 27797 - protein, 9 aa, Homo Sapiens
SRKNTATEE

SEQ ID NO: 27798 - protein, 9 aa, Homo Sapiens
TAECQASDE

SEQ ID NO: 27799 - protein, 9 aa, Homo Sapiens
FEYMMGRQT

SEQ ID NO: 27800 - protein, 9 aa, Homo Sapiens
NGYNFKFDI

SEQ ID NO: 27801 - protein, 9 aa, Homo Sapiens
FPALLGGCL

SEQ ID NO: 27802 - protein, 9 aa, Homo Sapiens
PMPQEVCRS

SEQ ID NO: 27803 - protein, 9 aa, Homo Sapiens
EELIKNQPE

SEQ ID NO: 27804 - protein, 9 aa, Homo Sapiens
EFYKTSGTV

SEQ ID NO: 27805 - protein, 9 aa, Homo Sapiens
SVQGSKKRK

SEQ ID NO: 27806 - protein, 9 aa, Homo Sapiens
QYSLATFST

SEQ ID NO: 27807 - protein, 9 aa, Homo Sapiens
HASDNARIG

SEQ ID NO: 27808 - protein, 9 aa, Homo Sapiens
YKLQKKQEL

SEQ ID NO: 27809 - protein, 9 aa, Homo Sapiens
PGQEFYKTS

SEQ ID NO: 27810 - protein, 9 aa, Homo Sapiens
NQGLFQLLF

SEQ ID NO: 27811 - protein, 9 aa, Homo Sapiens
DDSCTQNKR

SEQ ID NO: 27812 - protein, 9 aa, Homo Sapiens
SAEAKARDP

SEQ ID NO: 27813 - protein, 9 aa, Homo Sapiens
IEKQQKAQA

SEQ ID NO: 27814 - protein, 9 aa, Homo Sapiens
KGRGGGGRG

SEQ ID NO: 27815 - protein, 9 aa, Homo Sapiens
TNESKEKYQ

SEQ ID NO: 27816 - protein, 9 aa, Homo Sapiens
SVATALQSR

SEQ ID NO: 27817 - protein, 9 aa, Homo Sapiens
LLQIIEFRA

SEQ ID NO: 27818 - protein, 9 aa, Homo Sapiens
GTPVSASSS

SEQ ID NO: 27819 - protein, 9 aa, Homo Sapiens
PWPTGLLAV

SEQ ID NO: 27820 - protein, 9 aa, Homo Sapiens
MTELYDYLK

SEQ ID NO: 27821 - protein, 9 aa, Homo Sapiens
CKFSSFEIH

SEQ ID NO: 27822 - protein, 9 aa, Homo Sapiens
AVRQKTVQD

SEQ ID NO: 27823 - protein, 9 aa, Homo Sapiens
GSRSSDACM

SEQ ID NO: 27824 - protein, 9 aa, Homo Sapiens
AECQASDEL

SEQ ID NO: 27825 - protein, 9 aa, Homo Sapiens
GVEYEFTVS

SEQ ID NO: 27826 - protein, 9 aa, Homo Sapiens
ASFGSIDHL

SEQ ID NO: 27827 - protein, 9 aa, Homo Sapiens
TAAAAMATT

SEQ ID NO: 27828 - protein, 9 aa, Homo Sapiens
ICMTACNPK

SEQ ID NO: 27829 - protein, 9 aa, Homo Sapiens
SLGPVFNES

SEQ ID NO: 27830 - protein, 9 aa, Homo Sapiens
HIHPRDVEA

SEQ ID NO: 27831 - protein, 9 aa, Homo Sapiens
LASCEVKEN

SEQ ID NO: 27832 - protein, 9 aa, Homo Sapiens
EEGVEYEFT

SEQ ID NO: 27833 - protein, 9 aa, Homo Sapiens
RPTGRTRPS

SEQ ID NO: 27834 - protein, 9 aa, Homo Sapiens
PRHPWPAAQ

SEQ ID NO: 27835 - protein, 9 aa, Homo Sapiens
MDDIGIDSL

SEQ ID NO: 27836 - protein, 9 aa, Homo Sapiens
PEREALEKE

SEQ ID NO: 27837 - protein, 9 aa, Homo Sapiens
LDNIRTIVS

SEQ ID NO: 27838 - protein, 9 aa, Homo Sapiens
ISTVTQAFL

SEQ ID NO: 27839 - protein, 9 aa, Homo Sapiens
HEPLVEQLR

SEQ ID NO: 27840 - protein, 9 aa, Homo Sapiens
TSAAQLIRR

SEQ ID NO: 27841 - protein, 9 aa, Homo Sapiens
GQGFRQFGF

SEQ ID NO: 27842 - protein, 9 aa, Homo Sapiens
EFEIALAHA

SEQ ID NO: 27843 - protein, 9 aa, Homo Sapiens
IEWLLQQLQ

SEQ ID NO: 27844 - protein, 9 aa, Homo Sapiens
MAQEKEDPL

SEQ ID NO: 27845 - protein, 9 aa, Homo Sapiens
DPSLSGQIT

SEQ ID NO: 27846 - protein, 9 aa, Homo Sapiens
EAAEAAIKK

SEQ ID NO: 27847 - protein, 9 aa, Homo Sapiens
VLNILKDYD

SEQ ID NO: 27848 - protein, 9 aa, Homo Sapiens
EPGPPSAQR

SEQ ID NO: 27849 - protein, 9 aa, Homo Sapiens
SAHWEAGTT

SEQ ID NO: 27850 - protein, 9 aa, Homo Sapiens
QASADTWCS

SEQ ID NO: 27851 - protein, 9 aa, Homo Sapiens
YRQSIDKSQ

SEQ ID NO: 27852 - protein, 9 aa, Homo Sapiens
PPGHYHADN

SEQ ID NO: 27853 - protein, 9 aa, Homo Sapiens
NPHKDICPE

SEQ ID NO: 27854 - protein, 9 aa, Homo Sapiens
IFSWGVLAF

SEQ ID NO: 27855 - protein, 9 aa, Homo Sapiens
WRGNEPEQW

SEQ ID NO: 27856 - protein, 9 aa, Homo Sapiens
EQTYSLDRF

SEQ ID NO: 27857 - protein, 9 aa, Homo Sapiens
ATKCIRPRY

SEQ ID NO: 27858 - protein, 9 aa, Homo Sapiens
KDILRPLTT

SEQ ID NO: 27859 - protein, 9 aa, Homo Sapiens
VCGVGWAAD

SEQ ID NO: 27860 - protein, 9 aa, Homo Sapiens
QDVEECSKG

SEQ ID NO: 27861 - protein, 9 aa, Homo Sapiens
ELNVTSLDL

SEQ ID NO: 27862 - protein, 9 aa, Homo Sapiens
NADSAQRGS

SEQ ID NO: 27863 - protein, 9 aa, Homo Sapiens
PKAANSPFS

SEQ ID NO: 27864 - protein, 9 aa, Homo Sapiens
SMPPPEAHN

SEQ ID NO: 27865 - protein, 9 aa, Homo Sapiens
LQFVYETVQ

SEQ ID NO: 27866 - protein, 9 aa, Homo Sapiens
HFWAVVCYA

SEQ ID NO: 27867 - protein, 9 aa, Homo Sapiens
HASKEEEGE

SEQ ID NO: 27868 - protein, 9 aa, Homo Sapiens
KVHKKADMV

SEQ ID NO: 27869 - protein, 9 aa, Homo Sapiens
RSGEVLQMW

SEQ ID NO: 27870 - protein, 9 aa, Homo Sapiens
RELTTHRQL

SEQ ID NO: 27871 - protein, 9 aa, Homo Sapiens
FHNFREIEV

SEQ ID NO: 27872 - protein, 9 aa, Homo Sapiens
LDVHWTLAT

SEQ ID NO: 27873 - protein, 9 aa, Homo Sapiens
ARPSGSGQQ

SEQ ID NO: 27874 - protein, 9 aa, Homo Sapiens
MSLFGKDGN

SEQ ID NO: 27875 - protein, 9 aa, Homo Sapiens
LPICIPEPV

SEQ ID NO: 27876 - protein, 9 aa, Homo Sapiens
DARTIGKYC

SEQ ID NO: 27877 - protein, 9 aa, Homo Sapiens
QHALLYNVN

SEQ ID NO: 27878 - protein, 9 aa, Homo Sapiens
LYQLLYLAN

SEQ ID NO: 27879 - protein, 9 aa, Homo Sapiens
KRSPCPSPT

SEQ ID NO: 27880 - protein, 9 aa, Homo Sapiens
EAWEVTVTG

SEQ ID NO: 27881 - protein, 9 aa, Homo Sapiens
GDSTRGMPR

SEQ ID NO: 27882 - protein, 9 aa, Homo Sapiens
ASQSQGGGH

SEQ ID NO: 27883 - protein, 9 aa, Homo Sapiens
GSLETHFWA

SEQ ID NO: 27884 - protein, 9 aa, Homo Sapiens
QFQREELKA

SEQ ID NO: 27885 - protein, 9 aa, Homo Sapiens
KWPGDECRS

SEQ ID NO: 27886 - protein, 9 aa, Homo Sapiens
IGTPDNRDK

SEQ ID NO: 27887 - protein, 9 aa, Homo Sapiens
PLVDRRFPN

SEQ ID NO: 27888 - protein, 9 aa, Homo Sapiens
GGSPWSSSE

SEQ ID NO: 27889 - protein, 9 aa, Homo Sapiens
FIGLKCLEH

SEQ ID NO: 27890 - protein, 9 aa, Homo Sapiens
NLQKIKKKL

SEQ ID NO: 27891 - protein, 9 aa, Homo Sapiens
HDLLTMLPN

SEQ ID NO: 27892 - protein, 9 aa, Homo Sapiens
DGSQIQKIK

SEQ ID NO: 27893 - protein, 9 aa, Homo Sapiens
TSLVSTGHA

SEQ ID NO: 27894 - protein, 9 aa, Homo Sapiens
SCEVKENLR

SEQ ID NO: 27895 - protein, 9 aa, Homo Sapiens
MTACNPKYS

SEQ ID NO: 27896 - protein, 9 aa, Homo Sapiens
REEDEVFPE

SEQ ID NO: 27897 - protein, 9 aa, Homo Sapiens
ELSITCLVD

SEQ ID NO: 27898 - protein, 9 aa, Homo Sapiens
EFTVSAENI

SEQ ID NO: 27899 - protein, 9 aa, Homo Sapiens
VLLAVYHIK

SEQ ID NO: 27900 - protein, 9 aa, Homo Sapiens
LQKIKKKLE

SEQ ID NO: 27901 - protein, 9 aa, Homo Sapiens
YLVQVSDSA

SEQ ID NO: 27902 - protein, 9 aa, Homo Sapiens
EREALEKEP

SEQ ID NO: 27903 - protein, 9 aa, Homo Sapiens
KNSPIVKYL

SEQ ID NO: 27904 - protein, 9 aa, Homo Sapiens
AIINYTSQL

SEQ ID NO: 27905 - protein, 9 aa, Homo Sapiens
VYWTHEHGV

SEQ ID NO: 27906 - protein, 9 aa, Homo Sapiens
TNSAVHSIQ

SEQ ID NO: 27907 - protein, 9 aa, Homo Sapiens
AKETTRNLV

SEQ ID NO: 27908 - protein, 9 aa, Homo Sapiens
TDPAVRFHS

SEQ ID NO: 27909 - protein, 9 aa, Homo Sapiens
GAASYPPGG

SEQ ID NO: 27910 - protein, 9 aa, Homo Sapiens
CMTACNPKY

SEQ ID NO: 27911 - protein, 9 aa, Homo Sapiens
TLSFFFMVL

SEQ ID NO: 27912 - protein, 9 aa, Homo Sapiens
YNMALKNLE

SEQ ID NO: 27913 - protein, 9 aa, Homo Sapiens
MTAAAAMAT

SEQ ID NO: 27914 - protein, 9 aa, Homo Sapiens
GEVLQMWSV

SEQ ID NO: 27915 - protein, 9 aa, Homo Sapiens
THEHGVLEL

SEQ ID NO: 27916 - protein, 9 aa, Homo Sapiens
RRKASFGSI

SEQ ID NO: 27917 - protein, 9 aa, Homo Sapiens
MPQEVCRSF

SEQ ID NO: 27918 - protein, 9 aa, Homo Sapiens
TEFKGIFSK

SEQ ID NO: 27919 - protein, 9 aa, Homo Sapiens
YQQATCIPN

SEQ ID NO: 27920 - protein, 9 aa, Homo Sapiens
LVSKTFKNC

SEQ ID NO: 27921 - protein, 9 aa, Homo Sapiens
LLHPSIRLG

SEQ ID NO: 27922 - protein, 9 aa, Homo Sapiens
LSLRLPHFS

SEQ ID NO: 27923 - protein, 9 aa, Homo Sapiens
PLYIDFRQH

SEQ ID NO: 27924 - protein, 9 aa, Homo Sapiens
LAPPGDRLR

SEQ ID NO: 27925 - protein, 9 aa, Homo Sapiens
TEAHPLPMW

SEQ ID NO: 27926 - protein, 9 aa, Homo Sapiens
GTLRLWEYS

SEQ ID NO: 27927 - protein, 9 aa, Homo Sapiens
GKKGRTFSF

SEQ ID NO: 27928 - protein, 9 aa, Homo Sapiens
IKSLEKESA

SEQ ID NO: 27929 - protein, 9 aa, Homo Sapiens
DVTITEYEG

SEQ ID NO: 27930 - protein, 9 aa, Homo Sapiens
GTASAEGKE

SEQ ID NO: 27931 - protein, 9 aa, Homo Sapiens
PALLGGCLC

SEQ ID NO: 27932 - protein, 9 aa, Homo Sapiens
QEEIEKQFH

SEQ ID NO: 27933 - protein, 9 aa, Homo Sapiens
SWQPPQVIQ

SEQ ID NO: 27934 - protein, 9 aa, Homo Sapiens
LAKVQPQPW

SEQ ID NO: 27935 - protein, 9 aa, Homo Sapiens
EVVLVNKEA

SEQ ID NO: 27936 - protein, 9 aa, Homo Sapiens
DSGGTFVIF

SEQ ID NO: 27937 - protein, 9 aa, Homo Sapiens
EHGVLELVT

SEQ ID NO: 27938 - protein, 9 aa, Homo Sapiens
ETVYDILYP

SEQ ID NO: 27939 - protein, 9 aa, Homo Sapiens
LEYNPAKRI

SEQ ID NO: 27940 - protein, 9 aa, Homo Sapiens
HVTAPPCAT

SEQ ID NO: 27941 - protein, 9 aa, Homo Sapiens
LDRCLQNLR

SEQ ID NO: 27942 - protein, 9 aa, Homo Sapiens
VICMTACNP

SEQ ID NO: 27943 - protein, 9 aa, Homo Sapiens
SPPCITHSP

SEQ ID NO: 27944 - protein, 9 aa, Homo Sapiens
EHGQPRRAV

SEQ ID NO: 27945 - protein, 9 aa, Homo Sapiens
PLDVHWTLA

SEQ ID NO: 27946 - protein, 9 aa, Homo Sapiens
AETVYDILY

SEQ ID NO: 27947 - protein, 9 aa, Homo Sapiens
DRRFPNKWE

SEQ ID NO: 27948 - protein, 9 aa, Homo Sapiens
WGESSQGRT

SEQ ID NO: 27949 - protein, 9 aa, Homo Sapiens
HFGQHSSRV

SEQ ID NO: 27950 - protein, 9 aa, Homo Sapiens
RPRFAEIND

SEQ ID NO: 27951 - protein, 9 aa, Homo Sapiens
DSMGYEMCK

SEQ ID NO: 27952 - protein, 9 aa, Homo Sapiens
QQQSQQLQE

SEQ ID NO: 27953 - protein, 9 aa, Homo Sapiens
AHIHPRDVE

SEQ ID NO: 27954 - protein, 9 aa, Homo Sapiens
ITQIQEFSD

SEQ ID NO: 27955 - protein, 9 aa, Homo Sapiens
LQKLPEHWA

SEQ ID NO: 27956 - protein, 9 aa, Homo Sapiens
SARQYYVQF

SEQ ID NO: 27957 - protein, 9 aa, Homo Sapiens
QKVQYLTRS

SEQ ID NO: 27958 - protein, 9 aa, Homo Sapiens
NGPADPAKQ

SEQ ID NO: 27959 - protein, 9 aa, Homo Sapiens
QHCDCAKGL

SEQ ID NO: 27960 - protein, 9 aa, Homo Sapiens
QVIHPQEFL

SEQ ID NO: 27961 - protein, 9 aa, Homo Sapiens
YHAKLQNAR

SEQ ID NO: 27962 - protein, 9 aa, Homo Sapiens
SKHGYGGWQ

SEQ ID NO: 27963 - protein, 9 aa, Homo Sapiens
QKYERELIF

SEQ ID NO: 27964 - protein, 9 aa, Homo Sapiens
TVESFYCLC

SEQ ID NO: 27965 - protein, 9 aa, Homo Sapiens
GLALSLAPP

SEQ ID NO: 27966 - protein, 9 aa, Homo Sapiens
KTQVGRFAS

SEQ ID NO: 27967 - protein, 9 aa, Homo Sapiens
INPTSSVYK

SEQ ID NO: 27968 - protein, 9 aa, Homo Sapiens
SYGGDSTRG

SEQ ID NO: 27969 - protein, 9 aa, Homo Sapiens
EQLHRSKAA

SEQ ID NO: 27970 - protein, 9 aa, Homo Sapiens
LVVSHLNPY

SEQ ID NO: 27971 - protein, 9 aa, Homo Sapiens
TLENADSAQ

SEQ ID NO: 27972 - protein, 9 aa, Homo Sapiens
IKINPTSSV

SEQ ID NO: 27973 - protein, 9 aa, Homo Sapiens
AGKPPRPNG

SEQ ID NO: 27974 - protein, 9 aa, Homo Sapiens
FFEVANIKM

SEQ ID NO: 27975 - protein, 9 aa, Homo Sapiens
VFEKKFYIG

SEQ ID NO: 27976 - protein, 9 aa, Homo Sapiens
SLETHFWAV

SEQ ID NO: 27977 - protein, 9 aa, Homo Sapiens
SVTRKAPQL

SEQ ID NO: 27978 - protein, 9 aa, Homo Sapiens
GEIDDVGFE

SEQ ID NO: 27979 - protein, 9 aa, Homo Sapiens
HRSKAADEE

SEQ ID NO: 27980 - protein, 9 aa, Homo Sapiens
PTSSVYKSL

SEQ ID NO: 27981 - protein, 9 aa, Homo Sapiens
RTQTQELHY

SEQ ID NO: 27982 - protein, 9 aa, Homo Sapiens
SIKENVDVA

SEQ ID NO: 27983 - protein, 9 aa, Homo Sapiens
MGCAKGKAV

SEQ ID NO: 27984 - protein, 9 aa, Homo Sapiens
DKEGETDEL

SEQ ID NO: 27985 - protein, 9 aa, Homo Sapiens
LENADSAQR

SEQ ID NO: 27986 - protein, 9 aa, Homo Sapiens
LSGMLRFQH

SEQ ID NO: 27987 - protein, 9 aa, Homo Sapiens
RIKGEQQKE

SEQ ID NO: 27988 - protein, 9 aa, Homo Sapiens
YMMGRQTKT

SEQ ID NO: 27989 - protein, 9 aa, Homo Sapiens
TNQNITLSL

SEQ ID NO: 27990 - protein, 9 aa, Homo Sapiens
MVNSMDNSY

SEQ ID NO: 27991 - protein, 9 aa, Homo Sapiens
QAAVPKVTL

SEQ ID NO: 27992 - protein, 9 aa, Homo Sapiens
YYISSSAEK

SEQ ID NO: 27993 - protein, 9 aa, Homo Sapiens
KDICPEKLS

SEQ ID NO: 27994 - protein, 9 aa, Homo Sapiens
NRVTNQNIT

SEQ ID NO: 27995 - protein, 9 aa, Homo Sapiens
QQKMRTQTQ

SEQ ID NO: 27996 - protein, 9 aa, Homo Sapiens
GRTRPSLRP

SEQ ID NO: 27997 - protein, 9 aa, Homo Sapiens
KSQASADTW

SEQ ID NO: 27998 - protein, 9 aa, Homo Sapiens
KQLLHSGLP

SEQ ID NO: 27999 - protein, 9 aa, Homo Sapiens
WEYSSGRQL

SEQ ID NO: 28000 - protein, 9 aa, Homo Sapiens
LRYVAEESK

SEQ ID NO: 28001 - protein, 9 aa, Homo Sapiens
ESVKHLLSN

SEQ ID NO: 28002 - protein, 9 aa, Homo Sapiens
KYYYISSSA

SEQ ID NO: 28003 - protein, 9 aa, Homo Sapiens
ATLVFEVQL

SEQ ID NO: 28004 - protein, 9 aa, Homo Sapiens
VQDTQKIIA

SEQ ID NO: 28005 - protein, 9 aa, Homo Sapiens
MALQAALTV

SEQ ID NO: 28006 - protein, 9 aa, Homo Sapiens
WPAAQPSAR

SEQ ID NO: 28007 - protein, 9 aa, Homo Sapiens
ENKMDAEDA

SEQ ID NO: 28008 - protein, 9 aa, Homo Sapiens
EMFDNTASQ

SEQ ID NO: 28009 - protein, 9 aa, Homo Sapiens
RDQFNICAK

SEQ ID NO: 28010 - protein, 9 aa, Homo Sapiens
IDGKIEGLT

SEQ ID NO: 28011 - protein, 9 aa, Homo Sapiens
PEDMALCNL

SEQ ID NO: 28012 - protein, 9 aa, Homo Sapiens
ELANSVWGE

SEQ ID NO: 28013 - protein, 9 aa, Homo Sapiens
DDMDDEYDD

SEQ ID NO: 28014 - protein, 9 aa, Homo Sapiens
PNKWERPVA

SEQ ID NO: 28015 - protein, 9 aa, Homo Sapiens
RVNGKYYEM

SEQ ID NO: 28016 - protein, 9 aa, Homo Sapiens
KEPGPQGTL

SEQ ID NO: 28017 - protein, 9 aa, Homo Sapiens
ALHASKEEE

SEQ ID NO: 28018 - protein, 9 aa, Homo Sapiens
LTPQRQRSG

SEQ ID NO: 28019 - protein, 9 aa, Homo Sapiens
NGLAKGNKL

SEQ ID NO: 28020 - protein, 9 aa, Homo Sapiens
QQHVLELYE

SEQ ID NO: 28021 - protein, 9 aa, Homo Sapiens
HWEAGTTAR

SEQ ID NO: 28022 - protein, 9 aa, Homo Sapiens
SSLSQVDTP

SEQ ID NO: 28023 - protein, 9 aa, Homo Sapiens
DACVPPTVP

SEQ ID NO: 28024 - protein, 9 aa, Homo Sapiens
APKRPGGPT

SEQ ID NO: 28025 - protein, 9 aa, Homo Sapiens
MMQLGRISS

SEQ ID NO: 28026 - protein, 9 aa, Homo Sapiens
TKWPGDECR

SEQ ID NO: 28027 - protein, 9 aa, Homo Sapiens
PRPTGRTRP

SEQ ID NO: 28028 - protein, 9 aa, Homo Sapiens
RQFGFQRLD

SEQ ID NO: 28029 - protein, 9 aa, Homo Sapiens
QLLKIERRT

SEQ ID NO: 28030 - protein, 9 aa, Homo Sapiens
GQEFYKTSG

SEQ ID NO: 28031 - protein, 9 aa, Homo Sapiens
ANQPIEAPE

SEQ ID NO: 28032 - protein, 9 aa, Homo Sapiens
TTSAAQLIR

SEQ ID NO: 28033 - protein, 9 aa, Homo Sapiens
HDNENTASA

SEQ ID NO: 28034 - protein, 9 aa, Homo Sapiens
TTMEANLGA

SEQ ID NO: 28035 - protein, 9 aa, Homo Sapiens
CLRELDDMS

SEQ ID NO: 28036 - protein, 9 aa, Homo Sapiens
PSGSGQQVG

SEQ ID NO: 28037 - protein, 9 aa, Homo Sapiens
LQSTVQSLT

SEQ ID NO: 28038 - protein, 9 aa, Homo Sapiens
VDRRFPNKW

SEQ ID NO: 28039 - protein, 9 aa, Homo Sapiens
SDAGGTLTS

SEQ ID NO: 28040 - protein, 9 aa, Homo Sapiens
GQKCKTDVN

SEQ ID NO: 28041 - protein, 9 aa, Homo Sapiens
QESLASCEV

SEQ ID NO: 28042 - protein, 9 aa, Homo Sapiens
KVNKEFGGD

SEQ ID NO: 28043 - protein, 9 aa, Homo Sapiens
NMQPSKISG

SEQ ID NO: 28044 - protein, 9 aa, Homo Sapiens
ITPDNQSDA

SEQ ID NO: 28045 - protein, 9 aa, Homo Sapiens
PRTVSVLDR

SEQ ID NO: 28046 - protein, 9 aa, Homo Sapiens
ATHNIEDEI

SEQ ID NO: 28047 - protein, 9 aa, Homo Sapiens
VLAFLAYQR

SEQ ID NO: 28048 - protein, 9 aa, Homo Sapiens
DLSDSSFDL

SEQ ID NO: 28049 - protein, 9 aa, Homo Sapiens
QRSGSESSV

SEQ ID NO: 28050 - protein, 9 aa, Homo Sapiens
SSCTLTEIL

SEQ ID NO: 28051 - protein, 9 aa, Homo Sapiens
DKDESEVPS

SEQ ID NO: 28052 - protein, 9 aa, Homo Sapiens
LEAAEAAIK

SEQ ID NO: 28053 - protein, 9 aa, Homo Sapiens
VDSWWLDSG

SEQ ID NO: 28054 - protein, 9 aa, Homo Sapiens
CQASDELEC

SEQ ID NO: 28055 - protein, 9 aa, Homo Sapiens
EAIINYTSQ

SEQ ID NO: 28056 - protein, 9 aa, Homo Sapiens
SNNAEQCDA

SEQ ID NO: 28057 - protein, 9 aa, Homo Sapiens
PGSRQWDIL

SEQ ID NO: 28058 - protein, 9 aa, Homo Sapiens
EPQAASAGS

SEQ ID NO: 28059 - protein, 9 aa, Homo Sapiens
NSPFSSDKH

SEQ ID NO: 28060 - protein, 9 aa, Homo Sapiens
CKQELCPRR

SEQ ID NO: 28061 - protein, 9 aa, Homo Sapiens
QHLGWKWVH

SEQ ID NO: 28062 - protein, 9 aa, Homo Sapiens
SDPSRAVPK

SEQ ID NO: 28063 - protein, 9 aa, Homo Sapiens
AGAASYPPG

SEQ ID NO: 28064 - protein, 9 aa, Homo Sapiens
KSYGGDSTR

SEQ ID NO: 28065 - protein, 9 aa, Homo Sapiens
LYCHGVPRT

SEQ ID NO: 28066 - protein, 9 aa, Homo Sapiens
REELSKAMS

SEQ ID NO: 28067 - protein, 9 aa, Homo Sapiens
AVHSIQQVV

SEQ ID NO: 28068 - protein, 9 aa, Homo Sapiens
VSHLNPYTL

SEQ ID NO: 28069 - protein, 9 aa, Homo Sapiens
HLPNAALAQ

SEQ ID NO: 28070 - protein, 9 aa, Homo Sapiens
FKFDIWSLG

SEQ ID NO: 28071 - protein, 9 aa, Homo Sapiens
EEGEPQAAS

SEQ ID NO: 28072 - protein, 9 aa, Homo Sapiens
SGCKVSEYS

SEQ ID NO: 28073 - protein, 9 aa, Homo Sapiens
ALLQKTLSP

SEQ ID NO: 28074 - protein, 9 aa, Homo Sapiens
DNKRCRKCA

SEQ ID NO: 28075 - protein, 9 aa, Homo Sapiens
TWPMNARPG

SEQ ID NO: 28076 - protein, 9 aa, Homo Sapiens
GQFLKFTHR

SEQ ID NO: 28077 - protein, 9 aa, Homo Sapiens
FEKKFYIGG

SEQ ID NO: 28078 - protein, 9 aa, Homo Sapiens
GTFVIFDDL

SEQ ID NO: 28079 - protein, 9 aa, Homo Sapiens
LVKQLRFSM

SEQ ID NO: 28080 - protein, 9 aa, Homo Sapiens
PLAAPSAMT

SEQ ID NO: 28081 - protein, 9 aa, Homo Sapiens
NICAKTAVV

SEQ ID NO: 28082 - protein, 9 aa, Homo Sapiens
DNTGHRIII

SEQ ID NO: 28083 - protein, 9 aa, Homo Sapiens
KQAIHNYLL

SEQ ID NO: 28084 - protein, 9 aa, Homo Sapiens
SLMDMNSLS

SEQ ID NO: 28085 - protein, 9 aa, Homo Sapiens
LESETQAAV

SEQ ID NO: 28086 - protein, 9 aa, Homo Sapiens
GRNSFKVRV

SEQ ID NO: 28087 - protein, 9 aa, Homo Sapiens
PDGSQIQKI

SEQ ID NO: 28088 - protein, 9 aa, Homo Sapiens
LNGLPIKKV

SEQ ID NO: 28089 - protein, 9 aa, Homo Sapiens
LTKQGVLFR

SEQ ID NO: 28090 - protein, 9 aa, Homo Sapiens
KINFTQKLI

SEQ ID NO: 28091 - protein, 9 aa, Homo Sapiens
ALLYNVNRH

SEQ ID NO: 28092 - protein, 9 aa, Homo Sapiens
FNESRPVVC

SEQ ID NO: 28093 - protein, 9 aa, Homo Sapiens
LQSVLRYKK

SEQ ID NO: 28094 - protein, 9 aa, Homo Sapiens
PTAHCNVFV

SEQ ID NO: 28095 - protein, 9 aa, Homo Sapiens
RPHPAAVAA

SEQ ID NO: 28096 - protein, 9 aa, Homo Sapiens
LLQPGGVLT

SEQ ID NO: 28097 - protein, 9 aa, Homo Sapiens
RRFPNKWER

SEQ ID NO: 28098 - protein, 9 aa, Homo Sapiens
HRAHPRHPW

SEQ ID NO: 28099 - protein, 9 aa, Homo Sapiens
PGQTGESLG

SEQ ID NO: 28100 - protein, 9 aa, Homo Sapiens
FEVQLLKIE

SEQ ID NO: 28101 - protein, 9 aa, Homo Sapiens
VEYEFTVSA

SEQ ID NO: 28102 - protein, 9 aa, Homo Sapiens
YPEDLQFVY

SEQ ID NO: 28103 - protein, 9 aa, Homo Sapiens
SDDKRQQLS

SEQ ID NO: 28104 - protein, 9 aa, Homo Sapiens
CIKCSKSFL

SEQ ID NO: 28105 - protein, 9 aa, Homo Sapiens
LLDEMFDNT

SEQ ID NO: 28106 - protein, 9 aa, Homo Sapiens
VSVSARIDK

SEQ ID NO: 28107 - protein, 9 aa, Homo Sapiens
SHLLKTHVE

SEQ ID NO: 28108 - protein, 9 aa, Homo Sapiens
SGKKGRTFS

SEQ ID NO: 28109 - protein, 9 aa, Homo Sapiens
NGSRNGGKL

SEQ ID NO: 28110 - protein, 9 aa, Homo Sapiens
CVNVLGETK

SEQ ID NO: 28111 - protein, 9 aa, Homo Sapiens
NQSDAGGTL

SEQ ID NO: 28112 - protein, 9 aa, Homo Sapiens
GENKMDAED

SEQ ID NO: 28113 - protein, 9 aa, Homo Sapiens
LKFCIASMC

SEQ ID NO: 28114 - protein, 9 aa, Homo Sapiens
MGTGRIGGL

SEQ ID NO: 28115 - protein, 9 aa, Homo Sapiens
RCIAKFDYH

SEQ ID NO: 28116 - protein, 9 aa, Homo Sapiens
PTGGGGPSA

SEQ ID NO: 28117 - protein, 9 aa, Homo Sapiens
VQIKGEFYS

SEQ ID NO: 28118 - protein, 9 aa, Homo Sapiens
VCHLFGKEE

SEQ ID NO: 28119 - protein, 9 aa, Homo Sapiens
RTERQLIYN

SEQ ID NO: 28120 - protein, 9 aa, Homo Sapiens
KRILTPEVM

SEQ ID NO: 28121 - protein, 9 aa, Homo Sapiens
PEAQLEQSK

SEQ ID NO: 28122 - protein, 9 aa, Homo Sapiens
QCIDTVESF

SEQ ID NO: 28123 - protein, 9 aa, Homo Sapiens
NWTKIIKTI

SEQ ID NO: 28124 - protein, 9 aa, Homo Sapiens
HVLELYEEI

SEQ ID NO: 28125 - protein, 9 aa, Homo Sapiens
YCCTFCSSG

SEQ ID NO: 28126 - protein, 9 aa, Homo Sapiens
CHLFGKEEM

SEQ ID NO: 28127 - protein, 9 aa, Homo Sapiens
QLIVTEDSF

SEQ ID NO: 28128 - protein, 9 aa, Homo Sapiens
QVGGQTAVK

SEQ ID NO: 28129 - protein, 9 aa, Homo Sapiens
PGPPSAQRP

SEQ ID NO: 28130 - protein, 9 aa, Homo Sapiens
QAPSESKPA

SEQ ID NO: 28131 - protein, 9 aa, Homo Sapiens
PCLPGLPGG

SEQ ID NO: 28132 - protein, 9 aa, Homo Sapiens
TNQTLSFFF

SEQ ID NO: 28133 - protein, 9 aa, Homo Sapiens
EEEEDIHFF

SEQ ID NO: 28134 - protein, 9 aa, Homo Sapiens
ALAQAPSES

SEQ ID NO: 28135 - protein, 9 aa, Homo Sapiens
RPSGSGQQV

SEQ ID NO: 28136 - protein, 9 aa, Homo Sapiens
SFSLLYKSS

SEQ ID NO: 28137 - protein, 9 aa, Homo Sapiens
ARPSGPHLP

SEQ ID NO: 28138 - protein, 9 aa, Homo Sapiens
DIGIDSLDL

SEQ ID NO: 28139 - protein, 9 aa, Homo Sapiens
YEMALQAAL

SEQ ID NO: 28140 - protein, 9 aa, Homo Sapiens
NVTVMEGSS

SEQ ID NO: 28141 - protein, 9 aa, Homo Sapiens
KSQLIQLKK

SEQ ID NO: 28142 - protein, 9 aa, Homo Sapiens
SSFEIHERK

SEQ ID NO: 28143 - protein, 9 aa, Homo Sapiens
LKALKSGYK

SEQ ID NO: 28144 - protein, 9 aa, Homo Sapiens
NLNGLPIKK

SEQ ID NO: 28145 - protein, 9 aa, Homo Sapiens
MLPELHLNC

SEQ ID NO: 28146 - protein, 9 aa, Homo Sapiens
GIKTDVTIT

SEQ ID NO: 28147 - protein, 9 aa, Homo Sapiens
PLSCMFSLM

SEQ ID NO: 28148 - protein, 9 aa, Homo Sapiens
RKYWCQISQ

SEQ ID NO: 28149 - protein, 9 aa, Homo Sapiens
PAFYTPMGY

SEQ ID NO: 28150 - protein, 9 aa, Homo Sapiens
NQPIEAPEE

SEQ ID NO: 28151 - protein, 9 aa, Homo Sapiens
EGKEPSPQC

SEQ ID NO: 28152 - protein, 9 aa, Homo Sapiens
QGSGLDFQC

SEQ ID NO: 28153 - protein, 9 aa, Homo Sapiens
LQPGQEFYK

SEQ ID NO: 28154 - protein, 9 aa, Homo Sapiens
TGDSKAAPV

SEQ ID NO: 28155 - protein, 9 aa, Homo Sapiens
KQVIVKAIS

SEQ ID NO: 28156 - protein, 9 aa, Homo Sapiens
PRPGPWPPS

SEQ ID NO: 28157 - protein, 9 aa, Homo Sapiens
KCMMKEFLS

SEQ ID NO: 28158 - protein, 9 aa, Homo Sapiens
DFLLHPSIR

SEQ ID NO: 28159 - protein, 9 aa, Homo Sapiens
RQTEENAVW

SEQ ID NO: 28160 - protein, 9 aa, Homo Sapiens
GGGSAEAKA

SEQ ID NO: 28161 - protein, 9 aa, Homo Sapiens
YDSMGYEMC

SEQ ID NO: 28162 - protein, 9 aa, Homo Sapiens
GPQTPLAMD

SEQ ID NO: 28163 - protein, 9 aa, Homo Sapiens
KAEKEFIFV

SEQ ID NO: 28164 - protein, 9 aa, Homo Sapiens
VPKGRGGGG

SEQ ID NO: 28165 - protein, 9 aa, Homo Sapiens
YGGGSAEAK

SEQ ID NO: 28166 - protein, 9 aa, Homo Sapiens
VLITMNDTR

SEQ ID NO: 28167 - protein, 9 aa, Homo Sapiens
CAAAPAMGT

SEQ ID NO: 28168 - protein, 9 aa, Homo Sapiens
SGMLRFQHQ

SEQ ID NO: 28169 - protein, 9 aa, Homo Sapiens
ESHPSRDGF

SEQ ID NO: 28170 - protein, 9 aa, Homo Sapiens
RSPCPSPTP

SEQ ID NO: 28171 - protein, 9 aa, Homo Sapiens
VAASCRAIQ

SEQ ID NO: 28172 - protein, 9 aa, Homo Sapiens
TYLNLHWVN

SEQ ID NO: 28173 - protein, 9 aa, Homo Sapiens
HVKEDIPGR

SEQ ID NO: 28174 - protein, 9 aa, Homo Sapiens
LVFEVQLLK

SEQ ID NO: 28175 - protein, 9 aa, Homo Sapiens
FFPALLGGC

SEQ ID NO: 28176 - protein, 9 aa, Homo Sapiens
LRPTRNRPR

SEQ ID NO: 28177 - protein, 9 aa, Homo Sapiens
LDLKTSVEN

SEQ ID NO: 28178 - protein, 9 aa, Homo Sapiens
LAVCSGSFP

SEQ ID NO: 28179 - protein, 9 aa, Homo Sapiens
HDVKNYRTF

SEQ ID NO: 28180 - protein, 9 aa, Homo Sapiens
LRLPHFSLS

SEQ ID NO: 28181 - protein, 9 aa, Homo Sapiens
LNILKDYDR

SEQ ID NO: 28182 - protein, 9 aa, Homo Sapiens
AAVAAARTG

SEQ ID NO: 28183 - protein, 9 aa, Homo Sapiens
QISQQQWLE

SEQ ID NO: 28184 - protein, 9 aa, Homo Sapiens
ETNSAVHSI

SEQ ID NO: 28185 - protein, 9 aa, Homo Sapiens
NALLQKTLS

SEQ ID NO: 28186 - protein, 9 aa, Homo Sapiens
YSPPQCVPQ

SEQ ID NO: 28187 - protein, 9 aa, Homo Sapiens
QSTVQSLTS

SEQ ID NO: 28188 - protein, 9 aa, Homo Sapiens
TCGGFLVRE

SEQ ID NO: 28189 - protein, 9 aa, Homo Sapiens
LPVYAHIHP

SEQ ID NO: 28190 - protein, 9 aa, Homo Sapiens
TCEDKEGET

SEQ ID NO: 28191 - protein, 9 aa, Homo Sapiens
ENGYNFKFD

SEQ ID NO: 28192 - protein, 9 aa, Homo Sapiens
DFFEVANIK

SEQ ID NO: 28193 - protein, 9 aa, Homo Sapiens
TFSFSLPIT

SEQ ID NO: 28194 - protein, 9 aa, Homo Sapiens
NQPEETPSI

SEQ ID NO: 28195 - protein, 9 aa, Homo Sapiens
SEASAARNG

SEQ ID NO: 28196 - protein, 9 aa, Homo Sapiens
DYKTRDVTN

SEQ ID NO: 28197 - protein, 9 aa, Homo Sapiens
EELLLAAAK

SEQ ID NO: 28198 - protein, 9 aa, Homo Sapiens
AEINDQDRT

SEQ ID NO: 28199 - protein, 9 aa, Homo Sapiens
TERQLIYNF

SEQ ID NO: 28200 - protein, 9 aa, Homo Sapiens
RLWEYSSGR

SEQ ID NO: 28201 - protein, 9 aa, Homo Sapiens
NTGHRIIIE

SEQ ID NO: 28202 - protein, 9 aa, Homo Sapiens
QPPEFLYCH

SEQ ID NO: 28203 - protein, 9 aa, Homo Sapiens
VWGESSQGR

SEQ ID NO: 28204 - protein, 9 aa, Homo Sapiens
LRELDDMSL

SEQ ID NO: 28205 - protein, 9 aa, Homo Sapiens
GGSAEAKAR

SEQ ID NO: 28206 - protein, 9 aa, Homo Sapiens
SAKLHSVLL

SEQ ID NO: 28207 - protein, 9 aa, Homo Sapiens
LYIDFRQHL

SEQ ID NO: 28208 - protein, 9 aa, Homo Sapiens
TTEADTISG

SEQ ID NO: 28209 - protein, 9 aa, Homo Sapiens
LDLLSHLAK

SEQ ID NO: 28210 - protein, 9 aa, Homo Sapiens
LQPGGVLTI

SEQ ID NO: 28211 - protein, 9 aa, Homo Sapiens
ACGTNSLSP

SEQ ID NO: 28212 - protein, 9 aa, Homo Sapiens
YRQVVLNAT

SEQ ID NO: 28213 - protein, 9 aa, Homo Sapiens
LRLEFEPLR

SEQ ID NO: 28214 - protein, 9 aa, Homo Sapiens
QLTPMPQEV

SEQ ID NO: 28215 - protein, 9 aa, Homo Sapiens
SVLDRYYRP

SEQ ID NO: 28216 - protein, 9 aa, Homo Sapiens
RTGTRRPTA

SEQ ID NO: 28217 - protein, 9 aa, Homo Sapiens
SGPHLPFSR

SEQ ID NO: 28218 - protein, 9 aa, Homo Sapiens
PTAAGLSRP

SEQ ID NO: 28219 - protein, 9 aa, Homo Sapiens
KKRKRSPCP

SEQ ID NO: 28220 - protein, 9 aa, Homo Sapiens
PKRPGGPTT

SEQ ID NO: 28221 - protein, 9 aa, Homo Sapiens
KPKNLLYYS

SEQ ID NO: 28222 - protein, 9 aa, Homo Sapiens
GFTGQKCKT

SEQ ID NO: 28223 - protein, 9 aa, Homo Sapiens
INQGLFQLL

SEQ ID NO: 28224 - protein, 9 aa, Homo Sapiens
ESSPPCITH

SEQ ID NO: 28225 - protein, 9 aa, Homo Sapiens
HALLYNVNR

SEQ ID NO: 28226 - protein, 9 aa, Homo Sapiens
LQCFDNLQV

SEQ ID NO: 28227 - protein, 9 aa, Homo Sapiens
ILYPAAPVS

SEQ ID NO: 28228 - protein, 9 aa, Homo Sapiens
TPVSASSSS

SEQ ID NO: 28229 - protein, 9 aa, Homo Sapiens
EYNPAKRIT

SEQ ID NO: 28230 - protein, 9 aa, Homo Sapiens
VIHPQEFLR

SEQ ID NO: 28231 - protein, 9 aa, Homo Sapiens
LIDLTKQGV

SEQ ID NO: 28232 - protein, 9 aa, Homo Sapiens
SQRTLPSAL

SEQ ID NO: 28233 - protein, 9 aa, Homo Sapiens
DFEMKMPTL

SEQ ID NO: 28234 - protein, 9 aa, Homo Sapiens
FHYRRELVF

SEQ ID NO: 28235 - protein, 9 aa, Homo Sapiens
RFMYTTPLT

SEQ ID NO: 28236 - protein, 9 aa, Homo Sapiens
QLPICIPEP

SEQ ID NO: 28237 - protein, 9 aa, Homo Sapiens
SAVGFEYEG

SEQ ID NO: 28238 - protein, 9 aa, Homo Sapiens
LPNAALAQA

SEQ ID NO: 28239 - protein, 9 aa, Homo Sapiens
LVHEEGEPQ

SEQ ID NO: 28240 - protein, 9 aa, Homo Sapiens
LVAVPVGQY

SEQ ID NO: 28241 - protein, 9 aa, Homo Sapiens
LIRRSQSVS

SEQ ID NO: 28242 - protein, 9 aa, Homo Sapiens
LLLQCFDNL

SEQ ID NO: 28243 - protein, 9 aa, Homo Sapiens
QFVYETVQN

SEQ ID NO: 28244 - protein, 9 aa, Homo Sapiens
LHASKEEEG

SEQ ID NO: 28245 - protein, 9 aa, Homo Sapiens
EYMMGRQTK

SEQ ID NO: 28246 - protein, 9 aa, Homo Sapiens
LAGDWLKLD

SEQ ID NO: 28247 - protein, 9 aa, Homo Sapiens
NKWERPVAE

SEQ ID NO: 28248 - protein, 9 aa, Homo Sapiens
TCLGDSGGT

SEQ ID NO: 28249 - protein, 9 aa, Homo Sapiens
TPMPQEVCR

SEQ ID NO: 28250 - protein, 9 aa, Homo Sapiens
AKLHSVLLM

SEQ ID NO: 28251 - protein, 9 aa, Homo Sapiens
EVANIKMTG

SEQ ID NO: 28252 - protein, 9 aa, Homo Sapiens
ESLASCEVK

SEQ ID NO: 28253 - protein, 9 aa, Homo Sapiens
SSECIKRKE

SEQ ID NO: 28254 - protein, 9 aa, Homo Sapiens
AQDGAVLFQ

SEQ ID NO: 28255 - protein, 9 aa, Homo Sapiens
QAEAQKKQL

SEQ ID NO: 28256 - protein, 9 aa, Homo Sapiens
PITEFKGIF

SEQ ID NO: 28257 - protein, 9 aa, Homo Sapiens
PAKDPLDRC

SEQ ID NO: 28258 - protein, 9 aa, Homo Sapiens
GDSGGTFVI

SEQ ID NO: 28259 - protein, 9 aa, Homo Sapiens
ALEKEPGPQ

SEQ ID NO: 28260 - protein, 9 aa, Homo Sapiens
VKNYRTFLK

SEQ ID NO: 28261 - protein, 9 aa, Homo Sapiens
QTPLAMDRF

SEQ ID NO: 28262 - protein, 9 aa, Homo Sapiens
GLEIFQHCD

SEQ ID NO: 28263 - protein, 9 aa, Homo Sapiens
NKEFGGDKN

SEQ ID NO: 28264 - protein, 9 aa, Homo Sapiens
YFTYSNLYS

SEQ ID NO: 28265 - protein, 9 aa, Homo Sapiens
QVCAAAPAM

SEQ ID NO: 28266 - protein, 9 aa, Homo Sapiens
IKGEQQKEL

SEQ ID NO: 28267 - protein, 9 aa, Homo Sapiens
AAARTGTRR

SEQ ID NO: 28268 - protein, 9 aa, Homo Sapiens
VTVEAWEVT

SEQ ID NO: 28269 - protein, 9 aa, Homo Sapiens
PLPSVASKD

SEQ ID NO: 28270 - protein, 9 aa, Homo Sapiens
SGQITASLC

SEQ ID NO: 28271 - protein, 9 aa, Homo Sapiens
SDNLEQFAK

SEQ ID NO: 28272 - protein, 9 aa, Homo Sapiens
PLPTVEASY

SEQ ID NO: 28273 - protein, 9 aa, Homo Sapiens
WEEQLHRSK

SEQ ID NO: 28274 - protein, 9 aa, Homo Sapiens
HPSRDGFHP

SEQ ID NO: 28275 - protein, 9 aa, Homo Sapiens
QTNAMYLKN

SEQ ID NO: 28276 - protein, 8 aa, Homo Sapiens
RPGLPGPT

SEQ ID NO: 28277 - protein, 9 aa, Homo Sapiens
RVPSEQTYS

SEQ ID NO: 28278 - protein, 9 aa, Homo Sapiens
LYLVSKTFK

SEQ ID NO: 28279 - protein, 9 aa, Homo Sapiens
FLKFTHREG

SEQ ID NO: 28280 - protein, 9 aa, Homo Sapiens
LKNIFHNFR

SEQ ID NO: 28281 - protein, 9 aa, Homo Sapiens
DILYPAAPV

SEQ ID NO: 28282 - protein, 9 aa, Homo Sapiens
ECQASDELE

SEQ ID NO: 28283 - protein, 9 aa, Homo Sapiens
IDKKGFCEG

SEQ ID NO: 28284 - protein, 9 aa, Homo Sapiens
KEIMMQLGR

SEQ ID NO: 28285 - protein, 9 aa, Homo Sapiens
SGEQFHETF

SEQ ID NO: 28286 - protein, 9 aa, Homo Sapiens
LKRRKASFG

SEQ ID NO: 28287 - protein, 9 aa, Homo Sapiens
NDKDESEVP

SEQ ID NO: 28288 - protein, 9 aa, Homo Sapiens
AKQQDVEEC

SEQ ID NO: 28289 - protein, 9 aa, Homo Sapiens
SPRAAAAAA

SEQ ID NO: 28290 - protein, 9 aa, Homo Sapiens
QEFYKTSGT

SEQ ID NO: 28291 - protein, 9 aa, Homo Sapiens
LKYSCHFKK

SEQ ID NO: 28292 - protein, 9 aa, Homo Sapiens
APSAMTAAA

SEQ ID NO: 28293 - protein, 9 aa, Homo Sapiens
EQKEYEAIK

SEQ ID NO: 28294 - protein, 9 aa, Homo Sapiens
PSEQTYSLD

SEQ ID NO: 28295 - protein, 9 aa, Homo Sapiens
RRSQSVSSP

SEQ ID NO: 28296 - protein, 9 aa, Homo Sapiens
ETLLIDCRG

SEQ ID NO: 28297 - protein, 9 aa, Homo Sapiens
PQEVCRSFV

SEQ ID NO: 28298 - protein, 9 aa, Homo Sapiens
RELIFYINH

SEQ ID NO: 28299 - protein, 9 aa, Homo Sapiens
RQSIDKSQA

SEQ ID NO: 28300 - protein, 9 aa, Homo Sapiens
AVWWPGQTG

SEQ ID NO: 28301 - protein, 9 aa, Homo Sapiens
LRSGQGLDG

SEQ ID NO: 28302 - protein, 9 aa, Homo Sapiens
PHFSLSQMM

SEQ ID NO: 28303 - protein, 9 aa, Homo Sapiens
TRRPTAAGL

SEQ ID NO: 28304 - protein, 9 aa, Homo Sapiens
VVPFVKYQF

SEQ ID NO: 28305 - protein, 9 aa, Homo Sapiens
VEPGPPSAQ

SEQ ID NO: 28306 - protein, 9 aa, Homo Sapiens
NSMDNSYAE

SEQ ID NO: 28307 - protein, 9 aa, Homo Sapiens
QEDPWHVAK

SEQ ID NO: 28308 - protein, 9 aa, Homo Sapiens
TKDILCMKE

SEQ ID NO: 28309 - protein, 9 aa, Homo Sapiens
RPATDDSCT

SEQ ID NO: 28310 - protein, 9 aa, Homo Sapiens
PCITHSPQN

SEQ ID NO: 28311 - protein, 9 aa, Homo Sapiens
PPPEAHNPG

SEQ ID NO: 28312 - protein, 9 aa, Homo Sapiens
EKHDNENTA

SEQ ID NO: 28313 - protein, 9 aa, Homo Sapiens
QTYSLDRFA

SEQ ID NO: 28314 - protein, 9 aa, Homo Sapiens
QGVLFRGQI

SEQ ID NO: 28315 - protein, 9 aa, Homo Sapiens
RFPNKWERP

SEQ ID NO: 28316 - protein, 9 aa, Homo Sapiens
LLTKWPGDE

SEQ ID NO: 28317 - protein, 9 aa, Homo Sapiens
GIKSQTKEK

SEQ ID NO: 28318 - protein, 9 aa, Homo Sapiens
QCNSLRRDS

SEQ ID NO: 28319 - protein, 9 aa, Homo Sapiens
KHLLSNEDA

SEQ ID NO: 28320 - protein, 9 aa, Homo Sapiens
DCSSECIKR

SEQ ID NO: 28321 - protein, 9 aa, Homo Sapiens
LAQLLLLQI

SEQ ID NO: 28322 - protein, 9 aa, Homo Sapiens
RKASFGSID

SEQ ID NO: 28323 - protein, 9 aa, Homo Sapiens
IMMQLGRIS

SEQ ID NO: 28324 - protein, 9 aa, Homo Sapiens
QKNGKLGPQ

SEQ ID NO: 28325 - protein, 9 aa, Homo Sapiens
LTCDIEKFM

SEQ ID NO: 28326 - protein, 9 aa, Homo Sapiens
ARVFLANQP

SEQ ID NO: 28327 - protein, 9 aa, Homo Sapiens
QGFRQFGFQ

SEQ ID NO: 28328 - protein, 9 aa, Homo Sapiens
YFPSKDQKK

SEQ ID NO: 28329 - protein, 9 aa, Homo Sapiens
PASESGCKV

SEQ ID NO: 28330 - protein, 9 aa, Homo Sapiens
SLSGQITAS

SEQ ID NO: 28331 - protein, 9 aa, Homo Sapiens
SHSSVTRKA

SEQ ID NO: 28332 - protein, 9 aa, Homo Sapiens
LDRYYRPRD

SEQ ID NO: 28333 - protein, 9 aa, Homo Sapiens
VLTCDIEKF

SEQ ID NO: 28334 - protein, 9 aa, Homo Sapiens
HSRSTQSVK

SEQ ID NO: 28335 - protein, 9 aa, Homo Sapiens
AQAPSESKP

SEQ ID NO: 28336 - protein, 9 aa, Homo Sapiens
QELHYKYTV

SEQ ID NO: 28337 - protein, 9 aa, Homo Sapiens
NTASQFLAV

SEQ ID NO: 28338 - protein, 9 aa, Homo Sapiens
NVPRDFEMK

SEQ ID NO: 28339 - protein, 9 aa, Homo Sapiens
LLHSGLPSL

SEQ ID NO: 28340 - protein, 9 aa, Homo Sapiens
EDTPTSDNL

SEQ ID NO: 28341 - protein, 9 aa, Homo Sapiens
CQISQQQWL

SEQ ID NO: 28342 - protein, 9 aa, Homo Sapiens
SSYRKPTTT

SEQ ID NO: 28343 - protein, 9 aa, Homo Sapiens
LLDLAEPGG

SEQ ID NO: 28344 - protein, 9 aa, Homo Sapiens
KINPTSSVY

SEQ ID NO: 28345 - protein, 9 aa, Homo Sapiens
QKKSARQYY

SEQ ID NO: 28346 - protein, 9 aa, Homo Sapiens
DPDANCDSP

SEQ ID NO: 28347 - protein, 9 aa, Homo Sapiens
TNAMYLKNV

SEQ ID NO: 28348 - protein, 9 aa, Homo Sapiens
DRYYRPRDG

SEQ ID NO: 28349 - protein, 9 aa, Homo Sapiens
KQQKAQAEA

SEQ ID NO: 28350 - protein, 9 aa, Homo Sapiens
NIKKYYYIS

SEQ ID NO: 28351 - protein, 9 aa, Homo Sapiens
QTLSFFFMV

SEQ ID NO: 28352 - protein, 9 aa, Homo Sapiens
LSFFFMVLQ

SEQ ID NO: 28353 - protein, 9 aa, Homo Sapiens
DFQCCMQNT

SEQ ID NO: 28354 - protein, 9 aa, Homo Sapiens
FYCCTFCSS

SEQ ID NO: 28355 - protein, 9 aa, Homo Sapiens
AFASSCQPS

SEQ ID NO: 28356 - protein, 9 aa, Homo Sapiens
FINQGLFQL

SEQ ID NO: 28357 - protein, 9 aa, Homo Sapiens
GSASPASSL

SEQ ID NO: 28358 - protein, 9 aa, Homo Sapiens
RLEFEPLRK

SEQ ID NO: 28359 - protein, 9 aa, Homo Sapiens
SLSPVCRSY

SEQ ID NO: 28360 - protein, 9 aa, Homo Sapiens
TYSNLYSER

SEQ ID NO: 28361 - protein, 9 aa, Homo Sapiens
KNYRTFLKR

SEQ ID NO: 28362 - protein, 9 aa, Homo Sapiens
MHDVKNYRT

SEQ ID NO: 28363 - protein, 9 aa, Homo Sapiens
EDKVKLEEQ

SEQ ID NO: 28364 - protein, 9 aa, Homo Sapiens
EQRLRYTCK

SEQ ID NO: 28365 - protein, 9 aa, Homo Sapiens
TSLDLKTSV

SEQ ID NO: 28366 - protein, 9 aa, Homo Sapiens
QKLGETLSG

SEQ ID NO: 28367 - protein, 9 aa, Homo Sapiens
QSLTSERKE

SEQ ID NO: 28368 - protein, 9 aa, Homo Sapiens
PSALPSPGY

SEQ ID NO: 28369 - protein, 9 aa, Homo Sapiens
NQNITLSLV

SEQ ID NO: 28370 - protein, 9 aa, Homo Sapiens
KRPATDDSC

SEQ ID NO: 28371 - protein, 9 aa, Homo Sapiens
MEELIKNQP

SEQ ID NO: 28372 - protein, 9 aa, Homo Sapiens
DSGEKAEKE

SEQ ID NO: 28373 - protein, 9 aa, Homo Sapiens
DQESPDACV

SEQ ID NO: 28374 - protein, 9 aa, Homo Sapiens
FEIALAHAS

SEQ ID NO: 28375 - protein, 9 aa, Homo Sapiens
FSWGVLAFL

SEQ ID NO: 28376 - protein, 9 aa, Homo Sapiens
PALRFIGLK

SEQ ID NO: 28377 - protein, 9 aa, Homo Sapiens
VSVKETSIC

SEQ ID NO: 28378 - protein, 9 aa, Homo Sapiens
QVGRFASQF

SEQ ID NO: 28379 - protein, 9 aa, Homo Sapiens
GKDGNIFSE

SEQ ID NO: 28380 - protein, 9 aa, Homo Sapiens
DIKCLMEKL

SEQ ID NO: 28381 - protein, 9 aa, Homo Sapiens
LMFTSVIEC

SEQ ID NO: 28382 - protein, 9 aa, Homo Sapiens
FQLLFFWNT

SEQ ID NO: 28383 - protein, 9 aa, Homo Sapiens
IYQQATCIP

SEQ ID NO: 28384 - protein, 9 aa, Homo Sapiens
ASCEVKENL

SEQ ID NO: 28385 - protein, 9 aa, Homo Sapiens
RKRSPCPSP

SEQ ID NO: 28386 - protein, 9 aa, Homo Sapiens
KAFSENAHL

SEQ ID NO: 28387 - protein, 9 aa, Homo Sapiens
KLGSDISAL

SEQ ID NO: 28388 - protein, 9 aa, Homo Sapiens
ASKEEEGEG

SEQ ID NO: 28389 - protein, 9 aa, Homo Sapiens
GEGQELSIT

SEQ ID NO: 28390 - protein, 9 aa, Homo Sapiens
NHDSAGVIF

SEQ ID NO: 28391 - protein, 9 aa, Homo Sapiens
LAKGEYNMA

SEQ ID NO: 28392 - protein, 9 aa, Homo Sapiens
GVDLALKVL

SEQ ID NO: 28393 - protein, 9 aa, Homo Sapiens
MSLTPDPEP

SEQ ID NO: 28394 - protein, 9 aa, Homo Sapiens
ATEALDNIR

SEQ ID NO: 28395 - protein, 9 aa, Homo Sapiens
PTKFLQNLS

SEQ ID NO: 28396 - protein, 9 aa, Homo Sapiens
GRLRSGQGL

SEQ ID NO: 28397 - protein, 9 aa, Homo Sapiens
PATESRSKT

SEQ ID NO: 28398 - protein, 9 aa, Homo Sapiens
AACVRLLPG

SEQ ID NO: 28399 - protein, 9 aa, Homo Sapiens
VTNQTLSFF

SEQ ID NO: 28400 - protein, 9 aa, Homo Sapiens
PFEGSEPRI

SEQ ID NO: 28401 - protein, 9 aa, Homo Sapiens
LPLPTVEAS

SEQ ID NO: 28402 - protein, 9 aa, Homo Sapiens
VYAHIHPRD

SEQ ID NO: 28403 - protein, 9 aa, Homo Sapiens
DGTASAEGK

SEQ ID NO: 28404 - protein, 9 aa, Homo Sapiens
TNSLSPVCR

SEQ ID NO: 28405 - protein, 9 aa, Homo Sapiens
HPDLFFGGP

SEQ ID NO: 28406 - protein, 9 aa, Homo Sapiens
LVNCQYSLA

SEQ ID NO: 28407 - protein, 9 aa, Homo Sapiens
SGYQRLIKE

SEQ ID NO: 28408 - protein, 9 aa, Homo Sapiens
CAGYEVCQH

SEQ ID NO: 28409 - protein, 9 aa, Homo Sapiens
MDDEYDDDH

SEQ ID NO: 28410 - protein, 9 aa, Homo Sapiens
FQSRGSRSS

SEQ ID NO: 28411 - protein, 9 aa, Homo Sapiens
RHKQVIVKA

SEQ ID NO: 28412 - protein, 9 aa, Homo Sapiens
VPQNTGYTY

SEQ ID NO: 28413 - protein, 9 aa, Homo Sapiens
ATEKTLLED

SEQ ID NO: 28414 - protein, 9 aa, Homo Sapiens
VASKDLFPF

SEQ ID NO: 28415 - protein, 9 aa, Homo Sapiens
CGKAFSENA

SEQ ID NO: 28416 - protein, 9 aa, Homo Sapiens
GRDLDEVCK

SEQ ID NO: 28417 - protein, 9 aa, Homo Sapiens
QESMPPPEA

SEQ ID NO: 28418 - protein, 9 aa, Homo Sapiens
RARDIKCLM

SEQ ID NO: 28419 - protein, 9 aa, Homo Sapiens
AADGYICGK

SEQ ID NO: 28420 - protein, 9 aa, Homo Sapiens
DNCKSIDGK

SEQ ID NO: 28421 - protein, 9 aa, Homo Sapiens
KKSKKQNDF

SEQ ID NO: 28422 - protein, 9 aa, Homo Sapiens
SGVFYCCTF

SEQ ID NO: 28423 - protein, 9 aa, Homo Sapiens
RKNTATEET

SEQ ID NO: 28424 - protein, 9 aa, Homo Sapiens
RFLPYCEPV

SEQ ID NO: 28425 - protein, 9 aa, Homo Sapiens
NELANSVWG

SEQ ID NO: 28426 - protein, 9 aa, Homo Sapiens
HREGDRESW

SEQ ID NO: 28427 - protein, 9 aa, Homo Sapiens
SSSSSAPKR

SEQ ID NO: 28428 - protein, 9 aa, Homo Sapiens
FQHCDCAKG

SEQ ID NO: 28429 - protein, 9 aa, Homo Sapiens
GPSAHWEAG

SEQ ID NO: 28430 - protein, 9 aa, Homo Sapiens
YHADNKRCR

SEQ ID NO: 28431 - protein, 9 aa, Homo Sapiens
KAPQLLSQR

SEQ ID NO: 28432 - protein, 9 aa, Homo Sapiens
EHQGHIEWP

SEQ ID NO: 28433 - protein, 9 aa, Homo Sapiens
EECSKGLPM

SEQ ID NO: 28434 - protein, 9 aa, Homo Sapiens
AKNRYVNII

SEQ ID NO: 28435 - protein, 9 aa, Homo Sapiens
PEHQGHIEW

SEQ ID NO: 28436 - protein, 9 aa, Homo Sapiens
CITHSPQNE

SEQ ID NO: 28437 - protein, 9 aa, Homo Sapiens
PLAPPLVTS

SEQ ID NO: 28438 - protein, 9 aa, Homo Sapiens
RDLKPKNLL

SEQ ID NO: 28439 - protein, 9 aa, Homo Sapiens
KGQLPQILH

SEQ ID NO: 28440 - protein, 9 aa, Homo Sapiens
VHKKADMVN

SEQ ID NO: 28441 - protein, 9 aa, Homo Sapiens
EKNPNPIKS

SEQ ID NO: 28442 - protein, 9 aa, Homo Sapiens
KSLKNIFHN

SEQ ID NO: 28443 - protein, 9 aa, Homo Sapiens
LHFGIHPDD

SEQ ID NO: 28444 - protein, 9 aa, Homo Sapiens
ASPASSLSQ

SEQ ID NO: 28445 - protein, 9 aa, Homo Sapiens
KTERARDIK

SEQ ID NO: 28446 - protein, 9 aa, Homo Sapiens
PGDRLRLWG

SEQ ID NO: 28447 - protein, 9 aa, Homo Sapiens
RMGRLRSGQ

SEQ ID NO: 28448 - protein, 9 aa, Homo Sapiens
KSQTKEKQS

SEQ ID NO: 28449 - protein, 9 aa, Homo Sapiens
LSQHHIDEL

SEQ ID NO: 28450 - protein, 9 aa, Homo Sapiens
QNDFAQSGQ

SEQ ID NO: 28451 - protein, 9 aa, Homo Sapiens
YRATIGVDL

SEQ ID NO: 28452 - protein, 9 aa, Homo Sapiens
KWIPTKFLQ

SEQ ID NO: 28453 - protein, 9 aa, Homo Sapiens
PPEIASPKM

SEQ ID NO: 28454 - protein, 9 aa, Homo Sapiens
ERGRELTTH

SEQ ID NO: 28455 - protein, 9 aa, Homo Sapiens
GASDEEHGQ

SEQ ID NO: 28456 - protein, 9 aa, Homo Sapiens
AAGRLALLW

SEQ ID NO: 28457 - protein, 9 aa, Homo Sapiens
SAVHSIQQV

SEQ ID NO: 28458 - protein, 9 aa, Homo Sapiens
QIIEFRAAG

SEQ ID NO: 28459 - protein, 9 aa, Homo Sapiens
RPRPTGRTR

SEQ ID NO: 28460 - protein, 9 aa, Homo Sapiens
EIASPKMHR

SEQ ID NO: 28461 - protein, 9 aa, Homo Sapiens
AGRLALLWI

SEQ ID NO: 28462 - protein, 9 aa, Homo Sapiens
RSGQGLDGA

SEQ ID NO: 28463 - protein, 9 aa, Homo Sapiens
LFEYMMGRQ

SEQ ID NO: 28464 - protein, 9 aa, Homo Sapiens
SFSLPITEF

SEQ ID NO: 28465 - protein, 9 aa, Homo Sapiens
EAHNPGCIV

SEQ ID NO: 28466 - protein, 9 aa, Homo Sapiens
DLPNTLDET

SEQ ID NO: 28467 - protein, 9 aa, Homo Sapiens
FSFSLPITE

SEQ ID NO: 28468 - protein, 9 aa, Homo Sapiens
MFTSVIECE

SEQ ID NO: 28469 - protein, 9 aa, Homo Sapiens
SCNGLAKGN

SEQ ID NO: 28470 - protein, 9 aa, Homo Sapiens
GGGGPSAHW

SEQ ID NO: 28471 - protein, 9 aa, Homo Sapiens
VGREQKLGE

SEQ ID NO: 28472 - protein, 9 aa, Homo Sapiens
PTVEASYTA

SEQ ID NO: 28473 - protein, 9 aa, Homo Sapiens
WNRPRFAEI

SEQ ID NO: 28474 - protein, 9 aa, Homo Sapiens
VAEESKDKV

SEQ ID NO: 28475 - protein, 9 aa, Homo Sapiens
VNIIAYDHS

SEQ ID NO: 28476 - protein, 9 aa, Homo Sapiens
PQSLVCNLD

SEQ ID NO: 28477 - protein, 9 aa, Homo Sapiens
KDLFPFPIH

SEQ ID NO: 28478 - protein, 9 aa, Homo Sapiens
PLRKPSRRA

SEQ ID NO: 28479 - protein, 9 aa, Homo Sapiens
FCHRAPHDQ

SEQ ID NO: 28480 - protein, 9 aa, Homo Sapiens
LSVEDNTGH

SEQ ID NO: 28481 - protein, 9 aa, Homo Sapiens
AGIKIHKKR

SEQ ID NO: 28482 - protein, 9 aa, Homo Sapiens
KQGVLFRGQ

SEQ ID NO: 28483 - protein, 9 aa, Homo Sapiens
LLQEDPWHV

SEQ ID NO: 28484 - protein, 9 aa, Homo Sapiens
AESSYRQVV

SEQ ID NO: 28485 - protein, 9 aa, Homo Sapiens
PIEPPEIAS

SEQ ID NO: 28486 - protein, 9 aa, Homo Sapiens
PDFLLHPSI

SEQ ID NO: 28487 - protein, 9 aa, Homo Sapiens
EALSQHHID

SEQ ID NO: 28488 - protein, 9 aa, Homo Sapiens
VFPEAQLEQ

SEQ ID NO: 28489 - protein, 9 aa, Homo Sapiens
FLLHHRLKG

SEQ ID NO: 28490 - protein, 9 aa, Homo Sapiens
TSSVYKSLV

SEQ ID NO: 28491 - protein, 9 aa, Homo Sapiens
WPGDECRSP

SEQ ID NO: 28492 - protein, 9 aa, Homo Sapiens
CYHKPRKAR

SEQ ID NO: 28493 - protein, 9 aa, Homo Sapiens
NILKDYDRE

SEQ ID NO: 28494 - protein, 9 aa, Homo Sapiens
CEVKENLRI

SEQ ID NO: 28495 - protein, 9 aa, Homo Sapiens
CNLKRRKAS

SEQ ID NO: 28496 - protein, 9 aa, Homo Sapiens
WKHKNAAPA

SEQ ID NO: 28497 - protein, 9 aa, Homo Sapiens
PVPSCGAFA

SEQ ID NO: 28498 - protein, 9 aa, Homo Sapiens
FRQFGFQRL

SEQ ID NO: 28499 - protein, 9 aa, Homo Sapiens
ITEFKGIFS

SEQ ID NO: 28500 - protein, 9 aa, Homo Sapiens
CLPGLPGGG

SEQ ID NO: 28501 - protein, 9 aa, Homo Sapiens
HERVHSGEK

SEQ ID NO: 28502 - protein, 9 aa, Homo Sapiens
KKADVLNIL

SEQ ID NO: 28503 - protein, 9 aa, Homo Sapiens
ESNSLTSCV

SEQ ID NO: 28504 - protein, 9 aa, Homo Sapiens
NLRLEFEPL

SEQ ID NO: 28505 - protein, 9 aa, Homo Sapiens
NRYVNIIAY

SEQ ID NO: 28506 - protein, 9 aa, Homo Sapiens
AVVVQLIVT

SEQ ID NO: 28507 - protein, 9 aa, Homo Sapiens
SSSSAPKRP

SEQ ID NO: 28508 - protein, 9 aa, Homo Sapiens
VCKQELCPR

SEQ ID NO: 28509 - protein, 9 aa, Homo Sapiens
TGTRRPTAA

SEQ ID NO: 28510 - protein, 9 aa, Homo Sapiens
NSPIVKYLV

SEQ ID NO: 28511 - protein, 9 aa, Homo Sapiens
LCMGCLHWL

SEQ ID NO: 28512 - protein, 9 aa, Homo Sapiens
DEVCKQELC

SEQ ID NO: 28513 - protein, 9 aa, Homo Sapiens
ARDGVATKC

SEQ ID NO: 28514 - protein, 9 aa, Homo Sapiens
YYVQFFGDA

SEQ ID NO: 28515 - protein, 9 aa, Homo Sapiens
QRLREELSK

SEQ ID NO: 28516 - protein, 9 aa, Homo Sapiens
WAADGYICG

SEQ ID NO: 28517 - protein, 9 aa, Homo Sapiens
ESGCKVSEY

SEQ ID NO: 28518 - protein, 9 aa, Homo Sapiens
LDVQIKGEF

SEQ ID NO: 28519 - protein, 9 aa, Homo Sapiens
TPDNQSDAG

SEQ ID NO: 28520 - protein, 9 aa, Homo Sapiens
IDTVESFYC

SEQ ID NO: 28521 - protein, 9 aa, Homo Sapiens
SMTNGCYHK

SEQ ID NO: 28522 - protein, 9 aa, Homo Sapiens
STRGMPRSR

SEQ ID NO: 28523 - protein, 9 aa, Homo Sapiens
SLKKSKKQN

SEQ ID NO: 28524 - protein, 9 aa, Homo Sapiens
RDPDANCDS

SEQ ID NO: 28525 - protein, 9 aa, Homo Sapiens
QALAGLPRE

SEQ ID NO: 28526 - protein, 9 aa, Homo Sapiens
EHSDCSSEC

SEQ ID NO: 28527 - protein, 9 aa, Homo Sapiens
GGGAAGRLA

SEQ ID NO: 28528 - protein, 9 aa, Homo Sapiens
PQSRTFLSN

SEQ ID NO: 28529 - protein, 9 aa, Homo Sapiens
PRSRLRPTR

SEQ ID NO: 28530 - protein, 9 aa, Homo Sapiens
TDDSCTQNK

SEQ ID NO: 28531 - protein, 9 aa, Homo Sapiens
LVAKALLYY

SEQ ID NO: 28532 - protein, 9 aa, Homo Sapiens
PGPWPPSPA

SEQ ID NO: 28533 - protein, 9 aa, Homo Sapiens
APATHNIED

SEQ ID NO: 28534 - protein, 9 aa, Homo Sapiens
IFYRDGVPK

SEQ ID NO: 28535 - protein, 9 aa, Homo Sapiens
AGENKMDAE

SEQ ID NO: 28536 - protein, 9 aa, Homo Sapiens
PKETVPTVA

SEQ ID NO: 28537 - protein, 9 aa, Homo Sapiens
PGRSHLPAT

SEQ ID NO: 28538 - protein, 9 aa, Homo Sapiens
IGGHRWAQV

SEQ ID NO: 28539 - protein, 9 aa, Homo Sapiens
HLPATWPMN

SEQ ID NO: 28540 - protein, 9 aa, Homo Sapiens
ACNLKRRKA

SEQ ID NO: 28541 - protein, 9 aa, Homo Sapiens
QKAQAEAQK

SEQ ID NO: 28542 - protein, 9 aa, Homo Sapiens
EEHGQPRRA

SEQ ID NO: 28543 - protein, 9 aa, Homo Sapiens
ALEKSQFQR

SEQ ID NO: 28544 - protein, 9 aa, Homo Sapiens
KEREALTTE

SEQ ID NO: 28545 - protein, 9 aa, Homo Sapiens
GTIVISYTI

SEQ ID NO: 28546 - protein, 9 aa, Homo Sapiens
HVAKMVKSY

SEQ ID NO: 28547 - protein, 9 aa, Homo Sapiens
GLPVYAHIH

SEQ ID NO: 28548 - protein, 9 aa, Homo Sapiens
VQSLTSERK

SEQ ID NO: 28549 - protein, 9 aa, Homo Sapiens
RKVLGKCKC

SEQ ID NO: 28550 - protein, 9 aa, Homo Sapiens
MSGYPVICM

SEQ ID NO: 28551 - protein, 9 aa, Homo Sapiens
KKTTCEDKE

SEQ ID NO: 28552 - protein, 9 aa, Homo Sapiens
ELDPSLSGQ

SEQ ID NO: 28553 - protein, 9 aa, Homo Sapiens
TEVSTTGVN

SEQ ID NO: 28554 - protein, 9 aa, Homo Sapiens
YKGRVPLKS

SEQ ID NO: 28555 - protein, 9 aa, Homo Sapiens
FCIASMCRK

SEQ ID NO: 28556 - protein, 9 aa, Homo Sapiens
CTQNKRANR

SEQ ID NO: 28557 - protein, 9 aa, Homo Sapiens
KTSGTVNFM

SEQ ID NO: 28558 - protein, 9 aa, Homo Sapiens
IVISYTIIL

SEQ ID NO: 28559 - protein, 9 aa, Homo Sapiens
LLSHLAKVQ

SEQ ID NO: 28560 - protein, 9 aa, Homo Sapiens
PATAGASQS

SEQ ID NO: 28561 - protein, 9 aa, Homo Sapiens
IGMYFTYSN

SEQ ID NO: 28562 - protein, 9 aa, Homo Sapiens
NDARTIGKY

SEQ ID NO: 28563 - protein, 9 aa, Homo Sapiens
RYVAEESKD

SEQ ID NO: 28564 - protein, 9 aa, Homo Sapiens
ATIGVDLAL

SEQ ID NO: 28565 - protein, 9 aa, Homo Sapiens
GQLTPMPQE

SEQ ID NO: 28566 - protein, 9 aa, Homo Sapiens
CLAGDWLKL

SEQ ID NO: 28567 - protein, 9 aa, Homo Sapiens
MDPQSRTFL

SEQ ID NO: 28568 - protein, 9 aa, Homo Sapiens
SKDLFPFPI

SEQ ID NO: 28569 - protein, 9 aa, Homo Sapiens
NKCLTPQRQ

SEQ ID NO: 28570 - protein, 9 aa, Homo Sapiens
IREQYTAKP

SEQ ID NO: 28571 - protein, 9 aa, Homo Sapiens
TTKDILCMK

SEQ ID NO: 28572 - protein, 9 aa, Homo Sapiens
KKLEIALEK

SEQ ID NO: 28573 - protein, 9 aa, Homo Sapiens
DVQIKGEFY

SEQ ID NO: 28574 - protein, 9 aa, Homo Sapiens
KVSEYSVEM

SEQ ID NO: 28575 - protein, 9 aa, Homo Sapiens
AIALDFHYR

SEQ ID NO: 28576 - protein, 9 aa, Homo Sapiens
SGLDFQCCM

SEQ ID NO: 28577 - protein, 9 aa, Homo Sapiens
QNITLSLVA

SEQ ID NO: 28578 - protein, 9 aa, Homo Sapiens
SKTFSFVLT

SEQ ID NO: 28579 - protein, 9 aa, Homo Sapiens
CNLPPLRAA

SEQ ID NO: 28580 - protein, 9 aa, Homo Sapiens
NLNQLREDK

SEQ ID NO: 28581 - protein, 9 aa, Homo Sapiens
KRIKGEQQK

SEQ ID NO: 28582 - protein, 9 aa, Homo Sapiens
QKIKKKLEI

SEQ ID NO: 28583 - protein, 9 aa, Homo Sapiens
EIHERKHRG

SEQ ID NO: 28584 - protein, 9 aa, Homo Sapiens
EFKGIFSKS

SEQ ID NO: 28585 - protein, 9 aa, Homo Sapiens
DIGGHRWAQ

SEQ ID NO: 28586 - protein, 9 aa, Homo Sapiens
VYLFMCFGG

SEQ ID NO: 28587 - protein, 9 aa, Homo Sapiens
LQQPRATLA

SEQ ID NO: 28588 - protein, 9 aa, Homo Sapiens
NPAKRITLR

SEQ ID NO: 28589 - protein, 9 aa, Homo Sapiens
LFYRVLTCD

SEQ ID NO: 28590 - protein, 9 aa, Homo Sapiens
VPVGQYQDV

SEQ ID NO: 28591 - protein, 9 aa, Homo Sapiens
PHLPFSRSR

SEQ ID NO: 28592 - protein, 9 aa, Homo Sapiens
HKNAAPALP

SEQ ID NO: 28593 - protein, 9 aa, Homo Sapiens
SAFEQLVVQ

SEQ ID NO: 28594 - protein, 9 aa, Homo Sapiens
DLLTIYLVV

SEQ ID NO: 28595 - protein, 9 aa, Homo Sapiens
ETQAAVPKV

SEQ ID NO: 28596 - protein, 9 aa, Homo Sapiens
PRDPDANCD

SEQ ID NO: 28597 - protein, 9 aa, Homo Sapiens
ARTGTRRPT

SEQ ID NO: 28598 - protein, 9 aa, Homo Sapiens
KKIHTGDRP

SEQ ID NO: 28599 - protein, 9 aa, Homo Sapiens
LEGVNRDSD

SEQ ID NO: 28600 - protein, 9 aa, Homo Sapiens
PGDECRSPR

SEQ ID NO: 28601 - protein, 9 aa, Homo Sapiens
RPSGPHLPF

SEQ ID NO: 28602 - protein, 9 aa, Homo Sapiens
VNRHKQVIV

SEQ ID NO: 28603 - protein, 9 aa, Homo Sapiens
YYYISSSAE

SEQ ID NO: 28604 - protein, 9 aa, Homo Sapiens
AEVSNPPKP

SEQ ID NO: 28605 - protein, 9 aa, Homo Sapiens
LSITCLVDE

SEQ ID NO: 28606 - protein, 9 aa, Homo Sapiens
VLFRGQISE

SEQ ID NO: 28607 - protein, 9 aa, Homo Sapiens
WPGQTGESL

SEQ ID NO: 28608 - protein, 9 aa, Homo Sapiens
NTATEETKQ

SEQ ID NO: 28609 - protein, 9 aa, Homo Sapiens
LPNTLDETD

SEQ ID NO: 28610 - protein, 9 aa, Homo Sapiens
KAMSEVEGL

SEQ ID NO: 28611 - protein, 9 aa, Homo Sapiens
GGHYEQRLR

SEQ ID NO: 28612 - protein, 9 aa, Homo Sapiens
GPRSPRAAA

SEQ ID NO: 28613 - protein, 9 aa, Homo Sapiens
SAQRGSCPL

SEQ ID NO: 28614 - protein, 9 aa, Homo Sapiens
VAMVYLFMC

SEQ ID NO: 28615 - protein, 9 aa, Homo Sapiens
MENYKLQKK

SEQ ID NO: 28616 - protein, 9 aa, Homo Sapiens
YHCPWVGNC

SEQ ID NO: 28617 - protein, 9 aa, Homo Sapiens
EARGSLETH

SEQ ID NO: 28618 - protein, 9 aa, Homo Sapiens
TEALDNIRT

SEQ ID NO: 28619 - protein, 9 aa, Homo Sapiens
QKEYEAIKL

SEQ ID NO: 28620 - protein, 9 aa, Homo Sapiens
EEFEIALAH

SEQ ID NO: 28621 - protein, 9 aa, Homo Sapiens
LEIVIKSIV

SEQ ID NO: 28622 - protein, 9 aa, Homo Sapiens
NRDKRTADR

SEQ ID NO: 28623 - protein, 9 aa, Homo Sapiens
ARIDKKGFC

SEQ ID NO: 28624 - protein, 9 aa, Homo Sapiens
GQHSSRVVQ

SEQ ID NO: 28625 - protein, 9 aa, Homo Sapiens
ALQSRFLPY

SEQ ID NO: 28626 - protein, 9 aa, Homo Sapiens
HDSAGVIFA

SEQ ID NO: 28627 - protein, 9 aa, Homo Sapiens
SQFSGYQQQ

SEQ ID NO: 28628 - protein, 9 aa, Homo Sapiens
GPVFNESRP

SEQ ID NO: 28629 - protein, 9 aa, Homo Sapiens
TPGSRQWDI

SEQ ID NO: 28630 - protein, 9 aa, Homo Sapiens
CRKNNDDSG

SEQ ID NO: 28631 - protein, 9 aa, Homo Sapiens
QSLNWTKII

SEQ ID NO: 28632 - protein, 9 aa, Homo Sapiens
QTGESLGHP

SEQ ID NO: 28633 - protein, 9 aa, Homo Sapiens
KTDVNECDI

SEQ ID NO: 28634 - protein, 9 aa, Homo Sapiens
VMVNSMDNS

SEQ ID NO: 28635 - protein, 9 aa, Homo Sapiens
HWKGWELAK

SEQ ID NO: 28636 - protein, 9 aa, Homo Sapiens
EKQSQITSQ

SEQ ID NO: 28637 - protein, 9 aa, Homo Sapiens
LGPVFNESR

SEQ ID NO: 28638 - protein, 9 aa, Homo Sapiens
IKQLLHSGL

SEQ ID NO: 28639 - protein, 9 aa, Homo Sapiens
DILCMKEDI

SEQ ID NO: 28640 - protein, 9 aa, Homo Sapiens
QAASAGSCK

SEQ ID NO: 28641 - protein, 9 aa, Homo Sapiens
RDLDEVCKQ

SEQ ID NO: 28642 - protein, 9 aa, Homo Sapiens
KVKVHKKAD

SEQ ID NO: 28643 - protein, 9 aa, Homo Sapiens
AALAQAPSE

SEQ ID NO: 28644 - protein, 9 aa, Homo Sapiens
SPKNMQPSK

SEQ ID NO: 28645 - protein, 9 aa, Homo Sapiens
SYPPGGFSL

SEQ ID NO: 28646 - protein, 9 aa, Homo Sapiens
SKEEEGEGG

SEQ ID NO: 28647 - protein, 9 aa, Homo Sapiens
AYATLQYFI

SEQ ID NO: 28648 - protein, 9 aa, Homo Sapiens
PQEFLRWRD

SEQ ID NO: 28649 - protein, 9 aa, Homo Sapiens
NGPRSPRAA

SEQ ID NO: 28650 - protein, 9 aa, Homo Sapiens
TTARCPTGP

SEQ ID NO: 28651 - protein, 9 aa, Homo Sapiens
LEFEPLRKP

SEQ ID NO: 28652 - protein, 9 aa, Homo Sapiens
VLQSVLRYK

SEQ ID NO: 28653 - protein, 9 aa, Homo Sapiens
PWRPWPTGL

SEQ ID NO: 28654 - protein, 9 aa, Homo Sapiens
PGGFSLYTG

SEQ ID NO: 28655 - protein, 9 aa, Homo Sapiens
SGYKGRVPL

SEQ ID NO: 28656 - protein, 9 aa, Homo Sapiens
HKKIHTGDR

SEQ ID NO: 28657 - protein, 9 aa, Homo Sapiens
DVEECSKGL

SEQ ID NO: 28658 - protein, 9 aa, Homo Sapiens
FYTPMGYGT

SEQ ID NO: 28659 - protein, 9 aa, Homo Sapiens
KADVLNILK

SEQ ID NO: 28660 - protein, 9 aa, Homo Sapiens
KFLQNLSVP

SEQ ID NO: 28661 - protein, 9 aa, Homo Sapiens
RGNEPEQWI

SEQ ID NO: 28662 - protein, 9 aa, Homo Sapiens
EKTITQIQE

SEQ ID NO: 28663 - protein, 9 aa, Homo Sapiens
QSQGGGHED

SEQ ID NO: 28664 - protein, 9 aa, Homo Sapiens
LLGRLSHRL

SEQ ID NO: 28665 - protein, 9 aa, Homo Sapiens
WWLDSGHTA

SEQ ID NO: 28666 - protein, 9 aa, Homo Sapiens
EETKINFTQ

SEQ ID NO: 28667 - protein, 9 aa, Homo Sapiens
ALSLAPPGD

SEQ ID NO: 28668 - protein, 9 aa, Homo Sapiens
QFICRKCQM

SEQ ID NO: 28669 - protein, 9 aa, Homo Sapiens
TVSFRQTEE

SEQ ID NO: 28670 - protein, 9 aa, Homo Sapiens
TVQSLTSER

SEQ ID NO: 28671 - protein, 9 aa, Homo Sapiens
KSLEKESAF

SEQ ID NO: 28672 - protein, 9 aa, Homo Sapiens
VESSPPCIT

SEQ ID NO: 28673 - protein, 9 aa, Homo Sapiens
YIDFRQHLG

SEQ ID NO: 28674 - protein, 9 aa, Homo Sapiens
KLDMPLTRS

SEQ ID NO: 28675 - protein, 9 aa, Homo Sapiens
AAVNAEAME

SEQ ID NO: 28676 - protein, 9 aa, Homo Sapiens
FSLPITEFK

SEQ ID NO: 28677 - protein, 9 aa, Homo Sapiens
GQQVGGQTA

SEQ ID NO: 28678 - protein, 9 aa, Homo Sapiens
KQNDFAQSG

SEQ ID NO: 28679 - protein, 9 aa, Homo Sapiens
LVKLPRNGQ

SEQ ID NO: 28680 - protein, 9 aa, Homo Sapiens
TNGCYHKPR

SEQ ID NO: 28681 - protein, 9 aa, Homo Sapiens
LDSGHTAVA

SEQ ID NO: 28682 - protein, 9 aa, Homo Sapiens
REKTITQIQ

SEQ ID NO: 28683 - protein, 9 aa, Homo Sapiens
LSKAMSEVE

SEQ ID NO: 28684 - protein, 9 aa, Homo Sapiens
NRDSDYNGS

SEQ ID NO: 28685 - protein, 9 aa, Homo Sapiens
NPNPIKSLE

SEQ ID NO: 28686 - protein, 9 aa, Homo Sapiens
EKEREALTT

SEQ ID NO: 28687 - protein, 9 aa, Homo Sapiens
KFDYHCPWV

SEQ ID NO: 28688 - protein, 9 aa, Homo Sapiens
NSVWGESSQ

SEQ ID NO: 28689 - protein, 9 aa, Homo Sapiens
PDNRDKRTA

SEQ ID NO: 28690 - protein, 9 aa, Homo Sapiens
SDSSFDLKG

SEQ ID NO: 28691 - protein, 9 aa, Homo Sapiens
AAPWRPWPT

SEQ ID NO: 28692 - protein, 9 aa, Homo Sapiens
VPAFYTPMG

SEQ ID NO: 28693 - protein, 9 aa, Homo Sapiens
LTTCDSRFA

SEQ ID NO: 28694 - protein, 9 aa, Homo Sapiens
RSLPKVEAL

SEQ ID NO: 28695 - protein, 9 aa, Homo Sapiens
ARAQEAQKM

SEQ ID NO: 28696 - protein, 9 aa, Homo Sapiens
WQPPQVIQQ

SEQ ID NO: 28697 - protein, 9 aa, Homo Sapiens
ALPSPGYLG

SEQ ID NO: 28698 - protein, 9 aa, Homo Sapiens
LRPTGGGGP

SEQ ID NO: 28699 - protein, 9 aa, Homo Sapiens
YVQFFGDAP

SEQ ID NO: 28700 - protein, 9 aa, Homo Sapiens
NNGRLVVSH

SEQ ID NO: 28701 - protein, 9 aa, Homo Sapiens
RSPRAAAAA

SEQ ID NO: 28702 - protein, 9 aa, Homo Sapiens
LKLQKLPEH

SEQ ID NO: 28703 - protein, 9 aa, Homo Sapiens
RTVSVLDRY

SEQ ID NO: 28704 - protein, 9 aa, Homo Sapiens
GMYFTYSNL

SEQ ID NO: 28705 - protein, 9 aa, Homo Sapiens
QRGSCPLEK

SEQ ID NO: 28706 - protein, 9 aa, Homo Sapiens
VTNQNITLS

SEQ ID NO: 28707 - protein, 9 aa, Homo Sapiens
ATLNYYSSY

SEQ ID NO: 28708 - protein, 9 aa, Homo Sapiens
MVYLFMCFG

SEQ ID NO: 28709 - protein, 9 aa, Homo Sapiens
HSDCSSECI

SEQ ID NO: 28710 - protein, 9 aa, Homo Sapiens
PDLFFGGPK

SEQ ID NO: 28711 - protein, 9 aa, Homo Sapiens
SEFNPLMFT

SEQ ID NO: 28712 - protein, 9 aa, Homo Sapiens
DMSLTPDPE

SEQ ID NO: 28713 - protein, 9 aa, Homo Sapiens
ESFYCLCHT

SEQ ID NO: 28714 - protein, 9 aa, Homo Sapiens
GPWPPSPAE

SEQ ID NO: 28715 - protein, 9 aa, Homo Sapiens
KYLVQVSDS

SEQ ID NO: 28716 - protein, 9 aa, Homo Sapiens
FEPLRKPSR

SEQ ID NO: 28717 - protein, 9 aa, Homo Sapiens
ACVPPTVPE

SEQ ID NO: 28718 - protein, 9 aa, Homo Sapiens
NALEIVIKS

SEQ ID NO: 28719 - protein, 9 aa, Homo Sapiens
PIKKVPSLE

SEQ ID NO: 28720 - protein, 9 aa, Homo Sapiens
CIRPRYCKI

SEQ ID NO: 28721 - protein, 9 aa, Homo Sapiens
PDMVVCHLF

SEQ ID NO: 28722 - protein, 9 aa, Homo Sapiens
AKRIKGEQQ

SEQ ID NO: 28723 - protein, 9 aa, Homo Sapiens
QPSKISGLI

SEQ ID NO: 28724 - protein, 9 aa, Homo Sapiens
KAANSPFSS

SEQ ID NO: 28725 - protein, 9 aa, Homo Sapiens
TQIQEFSDV

SEQ ID NO: 28726 - protein, 9 aa, Homo Sapiens
RLREELSKA

SEQ ID NO: 28727 - protein, 9 aa, Homo Sapiens
RLLDEMFDN

SEQ ID NO: 28728 - protein, 9 aa, Homo Sapiens
ISWQPPQVI

SEQ ID NO: 28729 - protein, 9 aa, Homo Sapiens
GAASSHVIS

SEQ ID NO: 28730 - protein, 9 aa, Homo Sapiens
ISAVVVQLI

SEQ ID NO: 28731 - protein, 9 aa, Homo Sapiens
LRYTCKARL

SEQ ID NO: 28732 - protein, 9 aa, Homo Sapiens
VVVQLIVTE

SEQ ID NO: 28733 - protein, 9 aa, Homo Sapiens
TITEVSTTG

SEQ ID NO: 28734 - protein, 9 aa, Homo Sapiens
HSIQQVVVT

SEQ ID NO: 28735 - protein, 9 aa, Homo Sapiens
PEIASPKMH

SEQ ID NO: 28736 - protein, 9 aa, Homo Sapiens
KSRAGENKM

SEQ ID NO: 28737 - protein, 9 aa, Homo Sapiens
FKGIFSKSR

SEQ ID NO: 28738 - protein, 9 aa, Homo Sapiens
QNVPRDFEM

SEQ ID NO: 28739 - protein, 9 aa, Homo Sapiens
GSEASAARN

SEQ ID NO: 28740 - protein, 9 aa, Homo Sapiens
SFCCKRKME

SEQ ID NO: 28741 - protein, 9 aa, Homo Sapiens
THKKIHTGD

SEQ ID NO: 28742 - protein, 9 aa, Homo Sapiens
PDNQSDAGG

SEQ ID NO: 28743 - protein, 9 aa, Homo Sapiens
RIREHSDCS

SEQ ID NO: 28744 - protein, 9 aa, Homo Sapiens
AGKALRPHP

SEQ ID NO: 28745 - protein, 9 aa, Homo Sapiens
FTYSNLYSE

SEQ ID NO: 28746 - protein, 9 aa, Homo Sapiens
WLLQQLQTL

SEQ ID NO: 28747 - protein, 9 aa, Homo Sapiens
PCATTFDTA

SEQ ID NO: 28748 - protein, 9 aa, Homo Sapiens
VMEGSSVTL

SEQ ID NO: 28749 - protein, 9 aa, Homo Sapiens
DPSRAVPKG

SEQ ID NO: 28750 - protein, 9 aa, Homo Sapiens
NPTSSVYKS

SEQ ID NO: 28751 - protein, 9 aa, Homo Sapiens
RSLKKSKKQ

SEQ ID NO: 28752 - protein, 9 aa, Homo Sapiens
TFVIFDDLS

SEQ ID NO: 28753 - protein, 9 aa, Homo Sapiens
SAARNGPRS

SEQ ID NO: 28754 - protein, 9 aa, Homo Sapiens
RFASQFSGY

SEQ ID NO: 28755 - protein, 9 aa, Homo Sapiens
RPHSGVFYC

SEQ ID NO: 28756 - protein, 9 aa, Homo Sapiens
CQYSLATFS

SEQ ID NO: 28757 - protein, 9 aa, Homo Sapiens
SKDQKKLTL

SEQ ID NO: 28758 - protein, 9 aa, Homo Sapiens
RKYPPMDPQ

SEQ ID NO: 28759 - protein, 9 aa, Homo Sapiens
PEVMLGMSM

SEQ ID NO: 28760 - protein, 9 aa, Homo Sapiens
RPWPTGLLA

SEQ ID NO: 28761 - protein, 9 aa, Homo Sapiens
LIYNFYYLD

SEQ ID NO: 28762 - protein, 9 aa, Homo Sapiens
FNRWEALRL

SEQ ID NO: 28763 - protein, 9 aa, Homo Sapiens
DSLDLVEDS

SEQ ID NO: 28764 - protein, 9 aa, Homo Sapiens
DLIEGLCKT

SEQ ID NO: 28765 - protein, 9 aa, Homo Sapiens
VIKSIVNLD

SEQ ID NO: 28766 - protein, 9 aa, Homo Sapiens
TVMEGSSVT

SEQ ID NO: 28767 - protein, 9 aa, Homo Sapiens
LVAMVYLFM

SEQ ID NO: 28768 - protein, 9 aa, Homo Sapiens
RTIGKYCGD

SEQ ID NO: 28769 - protein, 9 aa, Homo Sapiens
ERINRVTNQ

SEQ ID NO: 28770 - protein, 9 aa, Homo Sapiens
IKNQPEETP

SEQ ID NO: 28771 - protein, 9 aa, Homo Sapiens
FVPNSFIGM

SEQ ID NO: 28772 - protein, 9 aa, Homo Sapiens
PPHRSFCCK

SEQ ID NO: 28773 - protein, 9 aa, Homo Sapiens
PSIRLGHMQ

SEQ ID NO: 28774 - protein, 9 aa, Homo Sapiens
LYDYLKYSC

SEQ ID NO: 28775 - protein, 9 aa, Homo Sapiens
FSSFEIHER

SEQ ID NO: 28776 - protein, 9 aa, Homo Sapiens
LLIDCRGPM

SEQ ID NO: 28777 - protein, 9 aa, Homo Sapiens
SPQLTANKI

SEQ ID NO: 28778 - protein, 9 aa, Homo Sapiens
RQVVLNATY

SEQ ID NO: 28779 - protein, 9 aa, Homo Sapiens
LQNLSVPHV

SEQ ID NO: 28780 - protein, 9 aa, Homo Sapiens
VPRDFEMKM

SEQ ID NO: 28781 - protein, 9 aa, Homo Sapiens
PKGRGGGGR

SEQ ID NO: 28782 - protein, 9 aa, Homo Sapiens
LPDMVVCHL

SEQ ID NO: 28783 - protein, 9 aa, Homo Sapiens
PCRGYCSQK

SEQ ID NO: 28784 - protein, 9 aa, Homo Sapiens
EQMGEAMSN

SEQ ID NO: 28785 - protein, 9 aa, Homo Sapiens
SRFLPYCEP

SEQ ID NO: 28786 - protein, 9 aa, Homo Sapiens
SKIIKVKVH

SEQ ID NO: 28787 - protein, 9 aa, Homo Sapiens
DVLNILKDY

SEQ ID NO: 28788 - protein, 9 aa, Homo Sapiens
QELSITCLV

SEQ ID NO: 28789 - protein, 9 aa, Homo Sapiens
DLALKVLHW

SEQ ID NO: 28790 - protein, 9 aa, Homo Sapiens
GDECRSPRG

SEQ ID NO: 28791 - protein, 9 aa, Homo Sapiens
MYFTYSNLY

SEQ ID NO: 28792 - protein, 9 aa, Homo Sapiens
YNRNIDKSG

SEQ ID NO: 28793 - protein, 9 aa, Homo Sapiens
FVKYQFICR

SEQ ID NO: 28794 - protein, 9 aa, Homo Sapiens
CSKGLPMKD

SEQ ID NO: 28795 - protein, 9 aa, Homo Sapiens
GKAFSENAH

SEQ ID NO: 28796 - protein, 9 aa, Homo Sapiens
LHVTAPPCA

SEQ ID NO: 28797 - protein, 9 aa, Homo Sapiens
MGRQTKTMA

SEQ ID NO: 28798 - protein, 9 aa, Homo Sapiens
KGKAVAAAA

SEQ ID NO: 28799 - protein, 9 aa, Homo Sapiens
EFEPLRKPS

SEQ ID NO: 28800 - protein, 9 aa, Homo Sapiens
YERELIFYI

SEQ ID NO: 28801 - protein, 9 aa, Homo Sapiens
SGEVLQMWS

SEQ ID NO: 28802 - protein, 9 aa, Homo Sapiens
KVLGKCKCG

SEQ ID NO: 28803 - protein, 9 aa, Homo Sapiens
DKVKLEEQL

SEQ ID NO: 28804 - protein, 9 aa, Homo Sapiens
PRDFEMKMP

SEQ ID NO: 28805 - protein, 9 aa, Homo Sapiens
VTVMEGSSV

SEQ ID NO: 28806 - protein, 9 aa, Homo Sapiens
WEAGTTARC

SEQ ID NO: 28807 - protein, 9 aa, Homo Sapiens
YHIKSAEGR

SEQ ID NO: 28808 - protein, 9 aa, Homo Sapiens
TPQRQRSGS

SEQ ID NO: 28809 - protein, 9 aa, Homo Sapiens
GRELTTHRQ

SEQ ID NO: 28810 - protein, 9 aa, Homo Sapiens
CGAFASSCQ

SEQ ID NO: 28811 - protein, 9 aa, Homo Sapiens
GMSGYQRLI

SEQ ID NO: 28812 - protein, 9 aa, Homo Sapiens
LHRRVPSEQ

SEQ ID NO: 28813 - protein, 9 aa, Homo Sapiens
VPPTVPEAP

SEQ ID NO: 28814 - protein, 9 aa, Homo Sapiens
TSRTLQQPR

SEQ ID NO: 28815 - protein, 9 aa, Homo Sapiens
LMDMNSLSP

SEQ ID NO: 28816 - protein, 9 aa, Homo Sapiens
QLREDKLGS

SEQ ID NO: 28817 - protein, 9 aa, Homo Sapiens
TLLQEDPWH

SEQ ID NO: 28818 - protein, 9 aa, Homo Sapiens
CPSCNGLAK

SEQ ID NO: 28819 - protein, 9 aa, Homo Sapiens
RAGENKMDA

SEQ ID NO: 28820 - protein, 9 aa, Homo Sapiens
LGDSGGTFV

SEQ ID NO: 28821 - protein, 9 aa, Homo Sapiens
LRIDGVLIT

SEQ ID NO: 28822 - protein, 9 aa, Homo Sapiens
CATTFDTAF

SEQ ID NO: 28823 - protein, 9 aa, Homo Sapiens
LFCHRAPHD

SEQ ID NO: 28824 - protein, 9 aa, Homo Sapiens
NSYAEQGTN

SEQ ID NO: 28825 - protein, 9 aa, Homo Sapiens
NKMDAEDAH

SEQ ID NO: 28826 - protein, 9 aa, Homo Sapiens
GNSDSAAPT

SEQ ID NO: 28827 - protein, 9 aa, Homo Sapiens
RPTAAGLSR

SEQ ID NO: 28828 - protein, 9 aa, Homo Sapiens
DPKSQLIQL

SEQ ID NO: 28829 - protein, 9 aa, Homo Sapiens
SGSGQQVGG

SEQ ID NO: 28830 - protein, 9 aa, Homo Sapiens
LAFLAYQRY

SEQ ID NO: 28831 - protein, 9 aa, Homo Sapiens
IQEFSDVNE

SEQ ID NO: 28832 - protein, 9 aa, Homo Sapiens
QAPGAEPAP

SEQ ID NO: 28833 - protein, 9 aa, Homo Sapiens
YKTSGTVNF

SEQ ID NO: 28834 - protein, 9 aa, Homo Sapiens
RAHPRHPWP

SEQ ID NO: 28835 - protein, 9 aa, Homo Sapiens
LGTVCGELV

SEQ ID NO: 28836 - protein, 9 aa, Homo Sapiens
QSRTFLSNY

SEQ ID NO: 28837 - protein, 9 aa, Homo Sapiens
PSSTQHASA

SEQ ID NO: 28838 - protein, 9 aa, Homo Sapiens
TLRLWEYSS

SEQ ID NO: 28839 - protein, 9 aa, Homo Sapiens
TKMAQEKED

SEQ ID NO: 28840 - protein, 9 aa, Homo Sapiens
LDFQCCMQN

SEQ ID NO: 28841 - protein, 9 aa, Homo Sapiens
HKKADMVNE

SEQ ID NO: 28842 - protein, 9 aa, Homo Sapiens
GEVNDARTI

SEQ ID NO: 28843 - protein, 9 aa, Homo Sapiens
EVRVYHLTQ

SEQ ID NO: 28844 - protein, 9 aa, Homo Sapiens
GSSAFLLHH

SEQ ID NO: 28845 - protein, 9 aa, Homo Sapiens
QEETLRQAL

SEQ ID NO: 28846 - protein, 9 aa, Homo Sapiens
LFLIVSIWS

SEQ ID NO: 28847 - protein, 9 aa, Homo Sapiens
DTTMEANLG

SEQ ID NO: 28848 - protein, 9 aa, Homo Sapiens
EGDQDSHVP

SEQ ID NO: 28849 - protein, 9 aa, Homo Sapiens
DQARVFLAN

SEQ ID NO: 28850 - protein, 9 aa, Homo Sapiens
GLQKYEREL

SEQ ID NO: 28851 - protein, 9 aa, Homo Sapiens
RAKNRYVNI

SEQ ID NO: 28852 - protein, 9 aa, Homo Sapiens
IFQHCDCAK

SEQ ID NO: 28853 - protein, 9 aa, Homo Sapiens
KMRTQTQEL

SEQ ID NO: 28854 - protein, 9 aa, Homo Sapiens
IYNFYYLDY

SEQ ID NO: 28855 - protein, 9 aa, Homo Sapiens
ASAARNGPR

SEQ ID NO: 28856 - protein, 9 aa, Homo Sapiens
HSDLIEGLC

SEQ ID NO: 28857 - protein, 9 aa, Homo Sapiens
PGHYHADNK

SEQ ID NO: 28858 - protein, 9 aa, Homo Sapiens
IWSPRRLRN

SEQ ID NO: 28859 - protein, 9 aa, Homo Sapiens
SLRPTGGGG

SEQ ID NO: 28860 - protein, 9 aa, Homo Sapiens
ESRMEKMMD

SEQ ID NO: 28861 - protein, 9 aa, Homo Sapiens
RDKRTADRW

SEQ ID NO: 28862 - protein, 9 aa, Homo Sapiens
GKEPSPQCG

SEQ ID NO: 28863 - protein, 9 aa, Homo Sapiens
YQNVQCNSL

SEQ ID NO: 28864 - protein, 9 aa, Homo Sapiens
CNVFVEVVL

SEQ ID NO: 28865 - protein, 9 aa, Homo Sapiens
SVPPPKGFT

SEQ ID NO: 28866 - protein, 9 aa, Homo Sapiens
GETKQAIHN

SEQ ID NO: 28867 - protein, 9 aa, Homo Sapiens
VISLFLQHN

SEQ ID NO: 28868 - protein, 9 aa, Homo Sapiens
PPCLPGLPG

SEQ ID NO: 28869 - protein, 9 aa, Homo Sapiens
RHPWPAAQP

SEQ ID NO: 28870 - protein, 9 aa, Homo Sapiens
LALSLAPPG

SEQ ID NO: 28871 - protein, 9 aa, Homo Sapiens
FEVANIKMT

SEQ ID NO: 28872 - protein, 9 aa, Homo Sapiens
GKLHFGIHP

SEQ ID NO: 28873 - protein, 9 aa, Homo Sapiens
WIFNRWEAL

SEQ ID NO: 28874 - protein, 9 aa, Homo Sapiens
SRPRSRLRP

SEQ ID NO: 28875 - protein, 9 aa, Homo Sapiens
CPSSTQHAS

SEQ ID NO: 28876 - protein, 9 aa, Homo Sapiens
SRSSDACMD

SEQ ID NO: 28877 - protein, 9 aa, Homo Sapiens
SLASCEVKE

SEQ ID NO: 28878 - protein, 9 aa, Homo Sapiens
EMALQAALT

SEQ ID NO: 28879 - protein, 9 aa, Homo Sapiens
GQTGESLGH

SEQ ID NO: 28880 - protein, 9 aa, Homo Sapiens
LRQALLDLA

SEQ ID NO: 28881 - protein, 9 aa, Homo Sapiens
KRPLDVHWT

SEQ ID NO: 28882 - protein, 9 aa, Homo Sapiens
LNIIEWLLQ

SEQ ID NO: 28883 - protein, 9 aa, Homo Sapiens
LQPPEFLYC

SEQ ID NO: 28884 - protein, 9 aa, Homo Sapiens
QLTANKIRY

SEQ ID NO: 28885 - protein, 9 aa, Homo Sapiens
GHYHADNKR

SEQ ID NO: 28886 - protein, 9 aa, Homo Sapiens
GMLRFQHQE

SEQ ID NO: 28887 - protein, 9 aa, Homo Sapiens
LDEVCKQEL

SEQ ID NO: 28888 - protein, 9 aa, Homo Sapiens
DDKRQQLSE

SEQ ID NO: 28889 - protein, 9 aa, Homo Sapiens
CMMKEFLST

SEQ ID NO: 28890 - protein, 9 aa, Homo Sapiens
SAPKRPGGP

SEQ ID NO: 28891 - protein, 9 aa, Homo Sapiens
SLSPMMPTS

SEQ ID NO: 28892 - protein, 9 aa, Homo Sapiens
PSCGAFASS

SEQ ID NO: 28893 - protein, 9 aa, Homo Sapiens
SLSQVDTPS

SEQ ID NO: 28894 - protein, 9 aa, Homo Sapiens
QDGAVLFQP

SEQ ID NO: 28895 - protein, 9 aa, Homo Sapiens
AVRFHSCGI

SEQ ID NO: 28896 - protein, 9 aa, Homo Sapiens
VWWPGQTGE

SEQ ID NO: 28897 - protein, 9 aa, Homo Sapiens
KMAQEKEDP

SEQ ID NO: 28898 - protein, 9 aa, Homo Sapiens
SSTLANHNI

SEQ ID NO: 28899 - protein, 9 aa, Homo Sapiens
AASSHVISL

SEQ ID NO: 28900 - protein, 9 aa, Homo Sapiens
KNVTVSFRQ

SEQ ID NO: 28901 - protein, 9 aa, Homo Sapiens
NHPPVFEKK

SEQ ID NO: 28902 - protein, 9 aa, Homo Sapiens
ENNHPPVFE

SEQ ID NO: 28903 - protein, 9 aa, Homo Sapiens
LHWVNVVYY

SEQ ID NO: 28904 - protein, 9 aa, Homo Sapiens
LTKWPGDEC

SEQ ID NO: 28905 - protein, 9 aa, Homo Sapiens
LRLPALRFI

SEQ ID NO: 28906 - protein, 9 aa, Homo Sapiens
NKRCRKCAP

SEQ ID NO: 28907 - protein, 9 aa, Homo Sapiens
ACSVPPPKG

SEQ ID NO: 28908 - protein, 9 aa, Homo Sapiens
TQSVKSTVS

SEQ ID NO: 28909 - protein, 9 aa, Homo Sapiens
DQFNICAKT

SEQ ID NO: 28910 - protein, 9 aa, Homo Sapiens
QALLDLAEP

SEQ ID NO: 28911 - protein, 9 aa, Homo Sapiens
VKQLRFSMD

SEQ ID NO: 28912 - protein, 9 aa, Homo Sapiens
FDLKGEDSW

SEQ ID NO: 28913 - protein, 9 aa, Homo Sapiens
FLVAKALLY

SEQ ID NO: 28914 - protein, 9 aa, Homo Sapiens
YKVNKEFGG

SEQ ID NO: 28915 - protein, 9 aa, Homo Sapiens
ETLDVQIKG

SEQ ID NO: 28916 - protein, 9 aa, Homo Sapiens
KKVPSLERN

SEQ ID NO: 28917 - protein, 9 aa, Homo Sapiens
GSPQLTANK

SEQ ID NO: 28918 - protein, 9 aa, Homo Sapiens
RPLTTCDSR

SEQ ID NO: 28919 - protein, 9 aa, Homo Sapiens
DSGEESGVE

SEQ ID NO: 28920 - protein, 9 aa, Homo Sapiens
NALHASKEE

SEQ ID NO: 28921 - protein, 9 aa, Homo Sapiens
FIGMGVLSC

SEQ ID NO: 28922 - protein, 9 aa, Homo Sapiens
LLRLPALRF

SEQ ID NO: 28923 - protein, 9 aa, Homo Sapiens
HENGYNFKF

SEQ ID NO: 28924 - protein, 9 aa, Homo Sapiens
EVQLLKIER

SEQ ID NO: 28925 - protein, 9 aa, Homo Sapiens
KNQPEETPS

SEQ ID NO: 28926 - protein, 9 aa, Homo Sapiens
QQVGGQTAV

SEQ ID NO: 28927 - protein, 9 aa, Homo Sapiens
VRFHSCGIK

SEQ ID NO: 28928 - protein, 9 aa, Homo Sapiens
EKEPGPQGT

SEQ ID NO: 28929 - protein, 9 aa, Homo Sapiens
VKVHKKADM

SEQ ID NO: 28930 - protein, 9 aa, Homo Sapiens
TLESETQAA

SEQ ID NO: 28931 - protein, 9 aa, Homo Sapiens
THVESRMEK

SEQ ID NO: 28932 - protein, 9 aa, Homo Sapiens
QLLYLANLN

SEQ ID NO: 28933 - protein, 9 aa, Homo Sapiens
LIKNQPEET

SEQ ID NO: 28934 - protein, 9 aa, Homo Sapiens
HLGWKWVHE

SEQ ID NO: 28935 - protein, 9 aa, Homo Sapiens
QCFLTKMAQ

SEQ ID NO: 28936 - protein, 9 aa, Homo Sapiens
ALYLVSKTF

SEQ ID NO: 28937 - protein, 9 aa, Homo Sapiens
AGDWLKLDM

SEQ ID NO: 28938 - protein, 9 aa, Homo Sapiens
QRTLPSALP

SEQ ID NO: 28939 - protein, 9 aa, Homo Sapiens
PATDDSCTQ

SEQ ID NO: 28940 - protein, 9 aa, Homo Sapiens
ALRFIGLKC

SEQ ID NO: 28941 - protein, 9 aa, Homo Sapiens
TTCGLSKHG

SEQ ID NO: 28942 - protein, 9 aa, Homo Sapiens
VSKTFKNCF

SEQ ID NO: 28943 - protein, 9 aa, Homo Sapiens
VEALSQHHI

SEQ ID NO: 28944 - protein, 9 aa, Homo Sapiens
PNGPADPAK

SEQ ID NO: 28945 - protein, 9 aa, Homo Sapiens
QSIDKSQAS

SEQ ID NO: 28946 - protein, 9 aa, Homo Sapiens
PPQCVPQNT

SEQ ID NO: 28947 - protein, 9 aa, Homo Sapiens
CLVAMVYLF

SEQ ID NO: 28948 - protein, 9 aa, Homo Sapiens
HKKRVSDNL

SEQ ID NO: 28949 - protein, 9 aa, Homo Sapiens
LRQALAGLP

SEQ ID NO: 28950 - protein, 9 aa, Homo Sapiens
TTCEDKEGE

SEQ ID NO: 28951 - protein, 9 aa, Homo Sapiens
LPKVEALSQ

SEQ ID NO: 28952 - protein, 9 aa, Homo Sapiens
SGGTFVIFD

SEQ ID NO: 28953 - protein, 9 aa, Homo Sapiens
RSLPFEGSE

SEQ ID NO: 28954 - protein, 9 aa, Homo Sapiens
LSPKNMQPS

SEQ ID NO: 28955 - protein, 9 aa, Homo Sapiens
RYYRPRDGA

SEQ ID NO: 28956 - protein, 9 aa, Homo Sapiens
SKCMMKEFL

SEQ ID NO: 28957 - protein, 9 aa, Homo Sapiens
TTHRQLMQE

SEQ ID NO: 28958 - protein, 9 aa, Homo Sapiens
TPDNRDKRT

SEQ ID NO: 28959 - protein, 9 aa, Homo Sapiens
LTPMPQEVC

SEQ ID NO: 28960 - protein, 9 aa, Homo Sapiens
KLQNARLSS

SEQ ID NO: 28961 - protein, 9 aa, Homo Sapiens
HYKRILTPE

SEQ ID NO: 28962 - protein, 9 aa, Homo Sapiens
SLKNIFHNF

SEQ ID NO: 28963 - protein, 9 aa, Homo Sapiens
PAACVRLLP

SEQ ID NO: 28964 - protein, 9 aa, Homo Sapiens
LPSVASKDL

SEQ ID NO: 28965 - protein, 9 aa, Homo Sapiens
QFVQLPICI

SEQ ID NO: 28966 - protein, 9 aa, Homo Sapiens
GAAVNAEAM

SEQ ID NO: 28967 - protein, 9 aa, Homo Sapiens
KEPSPQCGG

SEQ ID NO: 28968 - protein, 9 aa, Homo Sapiens
GTRRPTAAG

SEQ ID NO: 28969 - protein, 9 aa, Homo Sapiens
FYPQSLVCN

SEQ ID NO: 28970 - protein, 9 aa, Homo Sapiens
LHWKGWELA

SEQ ID NO: 28971 - protein, 9 aa, Homo Sapiens
NSFIGMGVL

SEQ ID NO: 28972 - protein, 9 aa, Homo Sapiens
DVTNDVKSI

SEQ ID NO: 28973 - protein, 9 aa, Homo Sapiens
AWEVTVTGP

SEQ ID NO: 28974 - protein, 9 aa, Homo Sapiens
EAIKQLLHS

SEQ ID NO: 28975 - protein, 9 aa, Homo Sapiens
VDLALKVLH

SEQ ID NO: 28976 - protein, 9 aa, Homo Sapiens
MNSLSPMMP

SEQ ID NO: 28977 - protein, 9 aa, Homo Sapiens
KAKVKRRPQ

SEQ ID NO: 28978 - protein, 9 aa, Homo Sapiens
LTSCVPYPT

SEQ ID NO: 28979 - protein, 9 aa, Homo Sapiens
RKKTTCEDK

SEQ ID NO: 28980 - protein, 9 aa, Homo Sapiens
TKCIRPRYC

SEQ ID NO: 28981 - protein, 9 aa, Homo Sapiens
NSAVHSIQQ

SEQ ID NO: 28982 - protein, 9 aa, Homo Sapiens
VPFLEGVNR

SEQ ID NO: 28983 - protein, 9 aa, Homo Sapiens
EMKMPTLVG

SEQ ID NO: 28984 - protein, 9 aa, Homo Sapiens
LRPLTTCDS

SEQ ID NO: 28985 - protein, 9 aa, Homo Sapiens
IAKFDYHCP

SEQ ID NO: 28986 - protein, 9 aa, Homo Sapiens
HDMLHNYPL

SEQ ID NO: 28987 - protein, 9 aa, Homo Sapiens
DIQRIREHS

SEQ ID NO: 28988 - protein, 9 aa, Homo Sapiens
TLDVQIKGE

SEQ ID NO: 28989 - protein, 9 aa, Homo Sapiens
SICAGYEVC

SEQ ID NO: 28990 - protein, 9 aa, Homo Sapiens
EDKLGSDIS

SEQ ID NO: 28991 - protein, 9 aa, Homo Sapiens
NIISWQPPQ

SEQ ID NO: 28992 - protein, 9 aa, Homo Sapiens
ICNHPDLFF

SEQ ID NO: 28993 - protein, 9 aa, Homo Sapiens
GQITASLCK

SEQ ID NO: 28994 - protein, 9 aa, Homo Sapiens
YDYLKYSCH

SEQ ID NO: 28995 - protein, 9 aa, Homo Sapiens
DFRQHLGWK

SEQ ID NO: 28996 - protein, 9 aa, Homo Sapiens
WELAKETTR

SEQ ID NO: 28997 - protein, 9 aa, Homo Sapiens
MKMPTLVGE

SEQ ID NO: 28998 - protein, 9 aa, Homo Sapiens
RGAAVNAEA

SEQ ID NO: 28999 - protein, 9 aa, Homo Sapiens
QHSSRVVQE

SEQ ID NO: 29000 - protein, 9 aa, Homo Sapiens
NGLPIKKVP

SEQ ID NO: 29001 - protein, 9 aa, Homo Sapiens
FASSCQPSC

SEQ ID NO: 29002 - protein, 9 aa, Homo Sapiens
NEILNRGPG

SEQ ID NO: 29003 - protein, 9 aa, Homo Sapiens
RLWQNALLQ

SEQ ID NO: 29004 - protein, 9 aa, Homo Sapiens
IALAHASDN

SEQ ID NO: 29005 - protein, 9 aa, Homo Sapiens
SSSAPKRPG

SEQ ID NO: 29006 - protein, 9 aa, Homo Sapiens
TPLTLEGRP

SEQ ID NO: 29007 - protein, 9 aa, Homo Sapiens
TVSIKENVD

SEQ ID NO: 29008 - protein, 9 aa, Homo Sapiens
WGVLAFLAY

SEQ ID NO: 29009 - protein, 9 aa, Homo Sapiens
YEGKTEKHE

SEQ ID NO: 29010 - protein, 9 aa, Homo Sapiens
GAFASSCQP

SEQ ID NO: 29011 - protein, 9 aa, Homo Sapiens
RFAEINDQD

SEQ ID NO: 29012 - protein, 9 aa, Homo Sapiens
FEQLVVQLV

SEQ ID NO: 29013 - protein, 9 aa, Homo Sapiens
GLPIKKVPS

SEQ ID NO: 29014 - protein, 9 aa, Homo Sapiens
GWAADGYIC

SEQ ID NO: 29015 - protein, 9 aa, Homo Sapiens
WIPTKFLQN

SEQ ID NO: 29016 - protein, 9 aa, Homo Sapiens
CGVGWAADG

SEQ ID NO: 29017 - protein, 9 aa, Homo Sapiens
ASQFSGYQQ

SEQ ID NO: 29018 - protein, 9 aa, Homo Sapiens
LRSLVLPAA

SEQ ID NO: 29019 - protein, 9 aa, Homo Sapiens
SSLTSSCTL

SEQ ID NO: 29020 - protein, 9 aa, Homo Sapiens
PLHVTAPPC

SEQ ID NO: 29021 - protein, 9 aa, Homo Sapiens
LLRQALLDL

SEQ ID NO: 29022 - protein, 9 aa, Homo Sapiens
DMDDEYDDD

SEQ ID NO: 29023 - protein, 9 aa, Homo Sapiens
FHVKEDIPG

SEQ ID NO: 29024 - protein, 9 aa, Homo Sapiens
CIDTVESFY

SEQ ID NO: 29025 - protein, 9 aa, Homo Sapiens
KALEKSQFQ

SEQ ID NO: 29026 - protein, 9 aa, Homo Sapiens
AEEDKETKT

SEQ ID NO: 29027 - protein, 9 aa, Homo Sapiens
ERELIFYIN

SEQ ID NO: 29028 - protein, 9 aa, Homo Sapiens
FFMVLQDIP

SEQ ID NO: 29029 - protein, 9 aa, Homo Sapiens
AAPAMGTGR

SEQ ID NO: 29030 - protein, 9 aa, Homo Sapiens
WLDSGHTAV

SEQ ID NO: 29031 - protein, 9 aa, Homo Sapiens
VVNGSRNGG

SEQ ID NO: 29032 - protein, 9 aa, Homo Sapiens
TLRYVAEES

SEQ ID NO: 29033 - protein, 9 aa, Homo Sapiens
SKAAPVPPT

SEQ ID NO: 29034 - protein, 9 aa, Homo Sapiens
HPLPMWTPA

SEQ ID NO: 29035 - protein, 9 aa, Homo Sapiens
NLHWVNVVY

SEQ ID NO: 29036 - protein, 9 aa, Homo Sapiens
ASCRAIQYI

SEQ ID NO: 29037 - protein, 9 aa, Homo Sapiens
AAAPPCLPG

SEQ ID NO: 29038 - protein, 9 aa, Homo Sapiens
ALTTEADTI

SEQ ID NO: 29039 - protein, 9 aa, Homo Sapiens
SGQQVGGQT

SEQ ID NO: 29040 - protein, 9 aa, Homo Sapiens
ALLQPGGVL

SEQ ID NO: 29041 - protein, 9 aa, Homo Sapiens
QLQEVLGET

SEQ ID NO: 29042 - protein, 9 aa, Homo Sapiens
TARCPTGPL

SEQ ID NO: 29043 - protein, 9 aa, Homo Sapiens
LALKVLHWD

SEQ ID NO: 29044 - protein, 9 aa, Homo Sapiens
HSGVFYCCT

SEQ ID NO: 29045 - protein, 9 aa, Homo Sapiens
RDGVPKGQL

SEQ ID NO: 29046 - protein, 9 aa, Homo Sapiens
VNRDSDYNG

SEQ ID NO: 29047 - protein, 9 aa, Homo Sapiens
AKLQNARLS

SEQ ID NO: 29048 - protein, 9 aa, Homo Sapiens
VKYQFICRK

SEQ ID NO: 29049 - protein, 9 aa, Homo Sapiens
QTYHAKLQN

SEQ ID NO: 29050 - protein, 9 aa, Homo Sapiens
TAHCNVFVE

SEQ ID NO: 29051 - protein, 9 aa, Homo Sapiens
LRKPSRRAA

SEQ ID NO: 29052 - protein, 9 aa, Homo Sapiens
SLLVKQLRF

SEQ ID NO: 29053 - protein, 9 aa, Homo Sapiens
LQKALEKSQ

SEQ ID NO: 29054 - protein, 9 aa, Homo Sapiens
VSIKENVDV

SEQ ID NO: 29055 - protein, 9 aa, Homo Sapiens
IKGEFYSEN

SEQ ID NO: 29056 - protein, 9 aa, Homo Sapiens
HLLSNEDAA

SEQ ID NO: 29057 - protein, 9 aa, Homo Sapiens
TSSCTLTEI

SEQ ID NO: 29058 - protein, 9 aa, Homo Sapiens
ESMLERLSK

SEQ ID NO: 29059 - protein, 9 aa, Homo Sapiens
NLGATGHRP

SEQ ID NO: 29060 - protein, 9 aa, Homo Sapiens
IHLKLQKLP

SEQ ID NO: 29061 - protein, 9 aa, Homo Sapiens
SAAQLIRRS

SEQ ID NO: 29062 - protein, 9 aa, Homo Sapiens
GFEYEGKTE

SEQ ID NO: 29063 - protein, 9 aa, Homo Sapiens
FPCRGYCSQ

SEQ ID NO: 29064 - protein, 9 aa, Homo Sapiens
WRKKTTCED

SEQ ID NO: 29065 - protein, 9 aa, Homo Sapiens
LNQLREDKL

SEQ ID NO: 29066 - protein, 9 aa, Homo Sapiens
LLGNVSFSL

SEQ ID NO: 29067 - protein, 9 aa, Homo Sapiens
RPQMSRGLL

SEQ ID NO: 29068 - protein, 9 aa, Homo Sapiens
PPRMLPELH

SEQ ID NO: 29069 - protein, 9 aa, Homo Sapiens
DSKAAPVPP

SEQ ID NO: 29070 - protein, 9 aa, Homo Sapiens
REWEEQLHR

SEQ ID NO: 29071 - protein, 9 aa, Homo Sapiens
LRFSMDIDV

SEQ ID NO: 29072 - protein, 9 aa, Homo Sapiens
KNLLYYSQD

SEQ ID NO: 29073 - protein, 9 aa, Homo Sapiens
DVGFEEIQE

SEQ ID NO: 29074 - protein, 9 aa, Homo Sapiens
MSHSSVTRK

SEQ ID NO: 29075 - protein, 9 aa, Homo Sapiens
ELDDMSLTP

SEQ ID NO: 29076 - protein, 9 aa, Homo Sapiens
IKSIVNLDS

SEQ ID NO: 29077 - protein, 9 aa, Homo Sapiens
EDMALCNLP

SEQ ID NO: 29078 - protein, 9 aa, Homo Sapiens
VFNESRPVV

SEQ ID NO: 29079 - protein, 9 aa, Homo Sapiens
RSSDACMDK

SEQ ID NO: 29080 - protein, 9 aa, Homo Sapiens
SHLAKVQPQ

SEQ ID NO: 29081 - protein, 9 aa, Homo Sapiens
EAQKMRSIQ

SEQ ID NO: 29082 - protein, 9 aa, Homo Sapiens
NSFKVRVCA

SEQ ID NO: 29083 - protein, 9 aa, Homo Sapiens
EYNMALKNL

SEQ ID NO: 29084 - protein, 9 aa, Homo Sapiens
IDKSGFTYS

SEQ ID NO: 29085 - protein, 9 aa, Homo Sapiens
LSRKNTATE

SEQ ID NO: 29086 - protein, 9 aa, Homo Sapiens
MSGYQRLIK

SEQ ID NO: 29087 - protein, 9 aa, Homo Sapiens
TGESLGHPL

SEQ ID NO: 29088 - protein, 9 aa, Homo Sapiens
SLSQMMLKV

SEQ ID NO: 29089 - protein, 9 aa, Homo Sapiens
GRTFSFSLP

SEQ ID NO: 29090 - protein, 9 aa, Homo Sapiens
VKHLLSNED

SEQ ID NO: 29091 - protein, 9 aa, Homo Sapiens
VLDNCKSID

SEQ ID NO: 29092 - protein, 9 aa, Homo Sapiens
LVVQLVRHD

SEQ ID NO: 29093 - protein, 9 aa, Homo Sapiens
ICLVAMVYL

SEQ ID NO: 29094 - protein, 9 aa, Homo Sapiens
SEETLLIDC

SEQ ID NO: 29095 - protein, 9 aa, Homo Sapiens
FNPLMFTSV

SEQ ID NO: 29096 - protein, 9 aa, Homo Sapiens
QRLIKEVTE

SEQ ID NO: 29097 - protein, 9 aa, Homo Sapiens
TGGGGPSAH

SEQ ID NO: 29098 - protein, 9 aa, Homo Sapiens
IPTKFLQNL

SEQ ID NO: 29099 - protein, 9 aa, Homo Sapiens
IEPPEIASP

SEQ ID NO: 29100 - protein, 9 aa, Homo Sapiens
LPHFGQHSS

SEQ ID NO: 29101 - protein, 9 aa, Homo Sapiens
SETQAAVPK

SEQ ID NO: 29102 - protein, 9 aa, Homo Sapiens
RNIDKSGFT

SEQ ID NO: 29103 - protein, 9 aa, Homo Sapiens
RLRSGQGLD

SEQ ID NO: 29104 - protein, 9 aa, Homo Sapiens
PAAVAAART

SEQ ID NO: 29105 - protein, 9 aa, Homo Sapiens
ATWPMNARP

SEQ ID NO: 29106 - protein, 9 aa, Homo Sapiens
SFIGMGVLS

SEQ ID NO: 29107 - protein, 9 aa, Homo Sapiens
SENALHASK

SEQ ID NO: 29108 - protein, 9 aa, Homo Sapiens
IEGLCKTVW

SEQ ID NO: 29109 - protein, 9 aa, Homo Sapiens
QCDASITID

SEQ ID NO: 29110 - protein, 9 aa, Homo Sapiens
KRSAEVSNP

SEQ ID NO: 29111 - protein, 9 aa, Homo Sapiens
NRNIDKSGF

SEQ ID NO: 29112 - protein, 9 aa, Homo Sapiens
GDQDSHVPN

SEQ ID NO: 29113 - protein, 9 aa, Homo Sapiens
IGTIVISYT

SEQ ID NO: 29114 - protein, 9 aa, Homo Sapiens
RGGSEASAA

SEQ ID NO: 29115 - protein, 9 aa, Homo Sapiens
GGTFVIFDD

SEQ ID NO: 29116 - protein, 9 aa, Homo Sapiens
GPIEVVLVN

SEQ ID NO: 29117 - protein, 9 aa, Homo Sapiens
SKIMVVNGS

SEQ ID NO: 29118 - protein, 9 aa, Homo Sapiens
VNVLGETKQ

SEQ ID NO: 29119 - protein, 9 aa, Homo Sapiens
RVFLANQPI

SEQ ID NO: 29120 - protein, 9 aa, Homo Sapiens
AFYTPMGYG

SEQ ID NO: 29121 - protein, 9 aa, Homo Sapiens
KMDAEDAHH

SEQ ID NO: 29122 - protein, 9 aa, Homo Sapiens
DQDSHVPNV

SEQ ID NO: 29123 - protein, 9 aa, Homo Sapiens
EAIKLVNML

SEQ ID NO: 29124 - protein, 9 aa, Homo Sapiens
GTPDNRDKR

SEQ ID NO: 29125 - protein, 9 aa, Homo Sapiens
CFLTKMAQE

SEQ ID NO: 29126 - protein, 9 aa, Homo Sapiens
VTNDVKSIV

SEQ ID NO: 29127 - protein, 9 aa, Homo Sapiens
LLTMLPNEI

SEQ ID NO: 29128 - protein, 9 aa, Homo Sapiens
GTITEVSTT

SEQ ID NO: 29129 - protein, 9 aa, Homo Sapiens
KGQGFRQFG

SEQ ID NO: 29130 - protein, 9 aa, Homo Sapiens
FTSKTFSFV

SEQ ID NO: 29131 - protein, 9 aa, Homo Sapiens
VAPKTLSVA

SEQ ID NO: 29132 - protein, 9 aa, Homo Sapiens
VEKPDNDKD

SEQ ID NO: 29133 - protein, 9 aa, Homo Sapiens
LAPPLVTSS

SEQ ID NO: 29134 - protein, 9 aa, Homo Sapiens
LIEHERVHS

SEQ ID NO: 29135 - protein, 9 aa, Homo Sapiens
GSPWSSSEI

SEQ ID NO: 29136 - protein, 9 aa, Homo Sapiens
QEVCRSFVK

SEQ ID NO: 29137 - protein, 9 aa, Homo Sapiens
CEDKEGETD

SEQ ID NO: 29138 - protein, 9 aa, Homo Sapiens
YAHIHPRDV

SEQ ID NO: 29139 - protein, 9 aa, Homo Sapiens
SESGCKVSE

SEQ ID NO: 29140 - protein, 9 aa, Homo Sapiens
EIALAHASD

SEQ ID NO: 29141 - protein, 9 aa, Homo Sapiens
CKTVWYSVP

SEQ ID NO: 29142 - protein, 9 aa, Homo Sapiens
NRHSLEVRV

SEQ ID NO: 29143 - protein, 9 aa, Homo Sapiens
LHRSKAADE

SEQ ID NO: 29144 - protein, 9 aa, Homo Sapiens
VATALQSRF

SEQ ID NO: 29145 - protein, 9 aa, Homo Sapiens
SPIVKYLVQ

SEQ ID NO: 29146 - protein, 9 aa, Homo Sapiens
MMSLFGKDG

SEQ ID NO: 29147 - protein, 9 aa, Homo Sapiens
FYKTSGTVN

SEQ ID NO: 29148 - protein, 9 aa, Homo Sapiens
TTGVNSSSK

SEQ ID NO: 29149 - protein, 9 aa, Homo Sapiens
TPDPLACSV

SEQ ID NO: 29150 - protein, 9 aa, Homo Sapiens
HVISLFLQH

SEQ ID NO: 29151 - protein, 9 aa, Homo Sapiens
LQIIEFRAA

SEQ ID NO: 29152 - protein, 9 aa, Homo Sapiens
ITEVSTTGV

SEQ ID NO: 29153 - protein, 9 aa, Homo Sapiens
NMALKNLEM

SEQ ID NO: 29154 - protein, 9 aa, Homo Sapiens
LPHFSLSQM

SEQ ID NO: 29155 - protein, 9 aa, Homo Sapiens
DLQFVYETV

SEQ ID NO: 29156 - protein, 9 aa, Homo Sapiens
NTSLVSTGH

SEQ ID NO: 29157 - protein, 9 aa, Homo Sapiens
MLRFQHQEW

SEQ ID NO: 29158 - protein, 9 aa, Homo Sapiens
ARDIKCLME

SEQ ID NO: 29159 - protein, 9 aa, Homo Sapiens
LTPEVMLGM

SEQ ID NO: 29160 - protein, 9 aa, Homo Sapiens
VTESVKHLL

SEQ ID NO: 29161 - protein, 9 aa, Homo Sapiens
TAPPCATTF

SEQ ID NO: 29162 - protein, 9 aa, Homo Sapiens
SAVVVQLIV

SEQ ID NO: 29163 - protein, 9 aa, Homo Sapiens
FFVRYFPSK

SEQ ID NO: 29164 - protein, 9 aa, Homo Sapiens
LSHRLGRNR

SEQ ID NO: 29165 - protein, 9 aa, Homo Sapiens
PVGQYQDVP

SEQ ID NO: 29166 - protein, 9 aa, Homo Sapiens
DNENTASAS

SEQ ID NO: 29167 - protein, 9 aa, Homo Sapiens
DSVESSPPC

SEQ ID NO: 29168 - protein, 9 aa, Homo Sapiens
ARTIGKYCG

SEQ ID NO: 29169 - protein, 9 aa, Homo Sapiens
ALAGLPRET

SEQ ID NO: 29170 - protein, 9 aa, Homo Sapiens
SWGVLAFLA

SEQ ID NO: 29171 - protein, 9 aa, Homo Sapiens
VLDRYYRPR

SEQ ID NO: 29172 - protein, 9 aa, Homo Sapiens
LPTVEASYT

SEQ ID NO: 29173 - protein, 9 aa, Homo Sapiens
EGQLTPMPQ

SEQ ID NO: 29174 - protein, 9 aa, Homo Sapiens
FDIWSLGCL

SEQ ID NO: 29175 - protein, 9 aa, Homo Sapiens
GEAMSNGWE

SEQ ID NO: 29176 - protein, 9 aa, Homo Sapiens
CNLDPGAAL

SEQ ID NO: 29177 - protein, 9 aa, Homo Sapiens
RELDDMSLT

SEQ ID NO: 29178 - protein, 9 aa, Homo Sapiens
IIEWLLQQL

SEQ ID NO: 29179 - protein, 9 aa, Homo Sapiens
YKKERQLNE

SEQ ID NO: 29180 - protein, 9 aa, Homo Sapiens
YVNIIAYDH

SEQ ID NO: 29181 - protein, 9 aa, Homo Sapiens
AQLLLLQII

SEQ ID NO: 29182 - protein, 9 aa, Homo Sapiens
LGETKQAIH

SEQ ID NO: 29183 - protein, 9 aa, Homo Sapiens
SNRRPQTPK

SEQ ID NO: 29184 - protein, 9 aa, Homo Sapiens
RDSDYNGSG

SEQ ID NO: 29185 - protein, 9 aa, Homo Sapiens
SVWGESSQG

SEQ ID NO: 29186 - protein, 9 aa, Homo Sapiens
FLMLSCLIR

SEQ ID NO: 29187 - protein, 9 aa, Homo Sapiens
NDVKSIVRF

SEQ ID NO: 29188 - protein, 9 aa, Homo Sapiens
KTTDPKSQL

SEQ ID NO: 29189 - protein, 9 aa, Homo Sapiens
PDEEGCLWA

SEQ ID NO: 29190 - protein, 9 aa, Homo Sapiens
QPPEDTAEC

SEQ ID NO: 29191 - protein, 9 aa, Homo Sapiens
VGFEEIQEK

SEQ ID NO: 29192 - protein, 9 aa, Homo Sapiens
FGIHPDDTT

SEQ ID NO: 29193 - protein, 9 aa, Homo Sapiens
GVLFRGQIS

SEQ ID NO: 29194 - protein, 9 aa, Homo Sapiens
IDLTKQGVL

SEQ ID NO: 29195 - protein, 9 aa, Homo Sapiens
LKTHVESRM

SEQ ID NO: 29196 - protein, 9 aa, Homo Sapiens
AAQLIRRSQ

SEQ ID NO: 29197 - protein, 9 aa, Homo Sapiens
CHLCPSSTQ

SEQ ID NO: 29198 - protein, 9 aa, Homo Sapiens
ETDALLTEE

SEQ ID NO: 29199 - protein, 9 aa, Homo Sapiens
PKGQLPQIL

SEQ ID NO: 29200 - protein, 9 aa, Homo Sapiens
LVAQDGAVL

SEQ ID NO: 29201 - protein, 9 aa, Homo Sapiens
TASAEGKEP

SEQ ID NO: 29202 - protein, 9 aa, Homo Sapiens
PDANCDSPS

SEQ ID NO: 29203 - protein, 9 aa, Homo Sapiens
VSFSLLYKS

SEQ ID NO: 29204 - protein, 9 aa, Homo Sapiens
VLGETKQAI

SEQ ID NO: 29205 - protein, 9 aa, Homo Sapiens
ASKDLFPFP

SEQ ID NO: 29206 - protein, 9 aa, Homo Sapiens
DGLQKYERE

SEQ ID NO: 29207 - protein, 9 aa, Homo Sapiens
KLCMGCLHW

SEQ ID NO: 29208 - protein, 9 aa, Homo Sapiens
AIKQLLHSG

SEQ ID NO: 29209 - protein, 9 aa, Homo Sapiens
RRPQMSRGL

SEQ ID NO: 29210 - protein, 9 aa, Homo Sapiens
NYTSQLFYE

SEQ ID NO: 29211 - protein, 9 aa, Homo Sapiens
GVLITMNDT

SEQ ID NO: 29212 - protein, 9 aa, Homo Sapiens
LAVYHIKSA

SEQ ID NO: 29213 - protein, 9 aa, Homo Sapiens
KETVPTVAP

SEQ ID NO: 29214 - protein, 9 aa, Homo Sapiens
RQALLDLAE

SEQ ID NO: 29215 - protein, 9 aa, Homo Sapiens
GSKKRKLRV

SEQ ID NO: 29216 - protein, 9 aa, Homo Sapiens
VEASYTAQP

SEQ ID NO: 29217 - protein, 9 aa, Homo Sapiens
PFVKYQFIC

SEQ ID NO: 29218 - protein, 9 aa, Homo Sapiens
GTNSLSPVC

SEQ ID NO: 29219 - protein, 9 aa, Homo Sapiens
WPPSPAEEP

SEQ ID NO: 29220 - protein, 9 aa, Homo Sapiens
LYYYGGGSA

SEQ ID NO: 29221 - protein, 9 aa, Homo Sapiens
SRNGGKLSN

SEQ ID NO: 29222 - protein, 9 aa, Homo Sapiens
NIFHNFREI

SEQ ID NO: 29223 - protein, 9 aa, Homo Sapiens
FFFMVLQDI

SEQ ID NO: 29224 - protein, 9 aa, Homo Sapiens
GAAESSYRQ

SEQ ID NO: 29225 - protein, 9 aa, Homo Sapiens
HMDDMDDEY

SEQ ID NO: 29226 - protein, 9 aa, Homo Sapiens
SPALLGTVC

SEQ ID NO: 29227 - protein, 9 aa, Homo Sapiens
TQTQELHYK

SEQ ID NO: 29228 - protein, 9 aa, Homo Sapiens
PPVFEKKFY

SEQ ID NO: 29229 - protein, 9 aa, Homo Sapiens
FMYTTPLTL

SEQ ID NO: 29230 - protein, 9 aa, Homo Sapiens
LPAACVRLL

SEQ ID NO: 29231 - protein, 9 aa, Homo Sapiens
SECIKRKEF

SEQ ID NO: 29232 - protein, 9 aa, Homo Sapiens
KVKRRPQMS

SEQ ID NO: 29233 - protein, 9 aa, Homo Sapiens
SRGSRSSDA

SEQ ID NO: 29234 - protein, 9 aa, Homo Sapiens
ETHFWAVVC

SEQ ID NO: 29235 - protein, 9 aa, Homo Sapiens
SEQTYSLDR

SEQ ID NO: 29236 - protein, 9 aa, Homo Sapiens
IIKVKVHKK

SEQ ID NO: 29237 - protein, 9 aa, Homo Sapiens
DEEHGQPRR

SEQ ID NO: 29238 - protein, 9 aa, Homo Sapiens
IQRIREHSD

SEQ ID NO: 29239 - protein, 9 aa, Homo Sapiens
SSMLQDPRR

SEQ ID NO: 29240 - protein, 9 aa, Homo Sapiens
GTNPHKDIC

SEQ ID NO: 29241 - protein, 9 aa, Homo Sapiens
SMCRKNNDD

SEQ ID NO: 29242 - protein, 9 aa, Homo Sapiens
LDRLNALLQ

SEQ ID NO: 29243 - protein, 9 aa, Homo Sapiens
SSSGEPATE

SEQ ID NO: 29244 - protein, 9 aa, Homo Sapiens
VQLIVTEDS

SEQ ID NO: 29245 - protein, 9 aa, Homo Sapiens
VVQLVRHDD

SEQ ID NO: 29246 - protein, 9 aa, Homo Sapiens
TGQKCKTDV

SEQ ID NO: 29247 - protein, 9 aa, Homo Sapiens
RSRLRPTRN

SEQ ID NO: 29248 - protein, 9 aa, Homo Sapiens
QEKEDPLSH

SEQ ID NO: 29249 - protein, 9 aa, Homo Sapiens
ASSLSQVDT

SEQ ID NO: 29250 - protein, 9 aa, Homo Sapiens
NNCSGKKGR

SEQ ID NO: 29251 - protein, 9 aa, Homo Sapiens
CKPDLRAEL

SEQ ID NO: 29252 - protein, 9 aa, Homo Sapiens
TVQDTQKII

SEQ ID NO: 29253 - protein, 9 aa, Homo Sapiens
EALDNIRTI

SEQ ID NO: 29254 - protein, 9 aa, Homo Sapiens
AARTGTRRP

SEQ ID NO: 29255 - protein, 9 aa, Homo Sapiens
VVCHLFGKE

SEQ ID NO: 29256 - protein, 9 aa, Homo Sapiens
LVSPISESM

SEQ ID NO: 29257 - protein, 9 aa, Homo Sapiens
NQLREDKLG

SEQ ID NO: 29258 - protein, 9 aa, Homo Sapiens
GVPKGQLPQ

SEQ ID NO: 29259 - protein, 9 aa, Homo Sapiens
GGDSTRGMP

SEQ ID NO: 29260 - protein, 9 aa, Homo Sapiens
LQQHVLELY

SEQ ID NO: 29261 - protein, 9 aa, Homo Sapiens
ALDNIRTIV

SEQ ID NO: 29262 - protein, 9 aa, Homo Sapiens
SYRKPTTTK

SEQ ID NO: 29263 - protein, 9 aa, Homo Sapiens
VQCNSLRRD

SEQ ID NO: 29264 - protein, 9 aa, Homo Sapiens
VLLMARLCQ

SEQ ID NO: 29265 - protein, 9 aa, Homo Sapiens
QRSGEVLQM

SEQ ID NO: 29266 - protein, 9 aa, Homo Sapiens
EIVIKSIVN

SEQ ID NO: 29267 - protein, 9 aa, Homo Sapiens
PRTLRYVAE

SEQ ID NO: 29268 - protein, 9 aa, Homo Sapiens
MQPSKISGL

SEQ ID NO: 29269 - protein, 9 aa, Homo Sapiens
LYSGEQFHE

SEQ ID NO: 29270 - protein, 9 aa, Homo Sapiens
EAQLEQSKA

SEQ ID NO: 29271 - protein, 9 aa, Homo Sapiens
YFYPQSLVC

SEQ ID NO: 29272 - protein, 9 aa, Homo Sapiens
EVMLGMSMA

SEQ ID NO: 29273 - protein, 9 aa, Homo Sapiens
ALLGRLSHR

SEQ ID NO: 29274 - protein, 9 aa, Homo Sapiens
KHDNENTAS

SEQ ID NO: 29275 - protein, 9 aa, Homo Sapiens
GEPQAASAG

SEQ ID NO: 29276 - protein, 9 aa, Homo Sapiens
SSGEPATES

SEQ ID NO: 29277 - protein, 9 aa, Homo Sapiens
TKQGVLFRG

SEQ ID NO: 29278 - protein, 9 aa, Homo Sapiens
CIPNFSYMG

SEQ ID NO: 29279 - protein, 9 aa, Homo Sapiens
QDLYHLELF

SEQ ID NO: 29280 - protein, 9 aa, Homo Sapiens
VTAPPCATT

SEQ ID NO: 29281 - protein, 9 aa, Homo Sapiens
SVLRYKKER

SEQ ID NO: 29282 - protein, 9 aa, Homo Sapiens
SCVPYPTAS

SEQ ID NO: 29283 - protein, 9 aa, Homo Sapiens
DYHCPWVGN

SEQ ID NO: 29284 - protein, 9 aa, Homo Sapiens
CLQNLRDRE

SEQ ID NO: 29285 - protein, 9 aa, Homo Sapiens
LHEPLVEQL

SEQ ID NO: 29286 - protein, 9 aa, Homo Sapiens
FASQFSGYQ

SEQ ID NO: 29287 - protein, 9 aa, Homo Sapiens
LLGRNSFKV

SEQ ID NO: 29288 - protein, 9 aa, Homo Sapiens
SRTLQQPRA

SEQ ID NO: 29289 - protein, 9 aa, Homo Sapiens
EELSKAMSE

SEQ ID NO: 29290 - protein, 9 aa, Homo Sapiens
FLTKMAQEK

SEQ ID NO: 29291 - protein, 9 aa, Homo Sapiens
EKQFHVKED

SEQ ID NO: 29292 - protein, 9 aa, Homo Sapiens
SSLGPVFNE

SEQ ID NO: 29293 - protein, 9 aa, Homo Sapiens
QIQEFSDVN

SEQ ID NO: 29294 - protein, 9 aa, Homo Sapiens
LNQSNGTGN

SEQ ID NO: 29295 - protein, 9 aa, Homo Sapiens
LETHFWAVV

SEQ ID NO: 29296 - protein, 9 aa, Homo Sapiens
GLHEPLVEQ

SEQ ID NO: 29297 - protein, 9 aa, Homo Sapiens
LQKYERELI

SEQ ID NO: 29298 - protein, 9 aa, Homo Sapiens
SPALLRQAL

SEQ ID NO: 29299 - protein, 9 aa, Homo Sapiens
IKCLMEKLF

SEQ ID NO: 29300 - protein, 9 aa, Homo Sapiens
FTHREGDRE

SEQ ID NO: 29301 - protein, 9 aa, Homo Sapiens
TYKVNKEFG

SEQ ID NO: 29302 - protein, 9 aa, Homo Sapiens
ECGKAFSEN

SEQ ID NO: 29303 - protein, 9 aa, Homo Sapiens
PGSPQLTAN

SEQ ID NO: 29304 - protein, 9 aa, Homo Sapiens
YKTRDVTND

SEQ ID NO: 29305 - protein, 9 aa, Homo Sapiens
TPMGYGTLV

SEQ ID NO: 29306 - protein, 9 aa, Homo Sapiens
NVTVSFRQT

SEQ ID NO: 29307 - protein, 9 aa, Homo Sapiens
DVHWTLATG

SEQ ID NO: 29308 - protein, 9 aa, Homo Sapiens
SNGTGNSDS

SEQ ID NO: 29309 - protein, 9 aa, Homo Sapiens
TSCVPYPTA

SEQ ID NO: 29310 - protein, 9 aa, Homo Sapiens
SVRKYWCQI

SEQ ID NO: 29311 - protein, 9 aa, Homo Sapiens
RVTNQNITL

SEQ ID NO: 29312 - protein, 9 aa, Homo Sapiens
YCHGVPRTL

SEQ ID NO: 29313 - protein, 9 aa, Homo Sapiens
VEECSKGLP

SEQ ID NO: 29314 - protein, 9 aa, Homo Sapiens
YKTTDPKSQ

SEQ ID NO: 29315 - protein, 9 aa, Homo Sapiens
ELHLNCRTR

SEQ ID NO: 29316 - protein, 9 aa, Homo Sapiens
NLSLRLPHF

SEQ ID NO: 29317 - protein, 9 aa, Homo Sapiens
DECRSPRGQ

SEQ ID NO: 29318 - protein, 9 aa, Homo Sapiens
ALPDMVVCH

SEQ ID NO: 29319 - protein, 9 aa, Homo Sapiens
TVCGELVDC

SEQ ID NO: 29320 - protein, 9 aa, Homo Sapiens
ELLLAAAKE

SEQ ID NO: 29321 - protein, 9 aa, Homo Sapiens
SDEEHGQPR

SEQ ID NO: 29322 - protein, 9 aa, Homo Sapiens
SHGLEIFQH

SEQ ID NO: 29323 - protein, 9 aa, Homo Sapiens
PTGRTRPSL

SEQ ID NO: 29324 - protein, 9 aa, Homo Sapiens
CCKRKMEWW

SEQ ID NO: 29325 - protein, 9 aa, Homo Sapiens
VAHVDQRSG

SEQ ID NO: 29326 - protein, 9 aa, Homo Sapiens
NSLSPMMPT

SEQ ID NO: 29327 - protein, 9 aa, Homo Sapiens
LKPKNLLYY

SEQ ID NO: 29328 - protein, 9 aa, Homo Sapiens
LTMLPNEIL

SEQ ID NO: 29329 - protein, 9 aa, Homo Sapiens
QEETKINFT

SEQ ID NO: 29330 - protein, 9 aa, Homo Sapiens
MLQDPRRRD

SEQ ID NO: 29331 - protein, 9 aa, Homo Sapiens
LLVAVPVGQ

SEQ ID NO: 29332 - protein, 9 aa, Homo Sapiens
EAMSNGWEI

SEQ ID NO: 29333 - protein, 9 aa, Homo Sapiens
DKLGSDISA

SEQ ID NO: 29334 - protein, 9 aa, Homo Sapiens
ELFPCRGYC

SEQ ID NO: 29335 - protein, 9 aa, Homo Sapiens
AVILSVEDN

SEQ ID NO: 29336 - protein, 9 aa, Homo Sapiens
AHGEGQELS

SEQ ID NO: 29337 - protein, 9 aa, Homo Sapiens
VPTVAPKTL

SEQ ID NO: 29338 - protein, 9 aa, Homo Sapiens
VEAWEVTVT

SEQ ID NO: 29339 - protein, 9 aa, Homo Sapiens
MCKPDLRAE

SEQ ID NO: 29340 - protein, 9 aa, Homo Sapiens
RLRPTRNRP

SEQ ID NO: 29341 - protein, 9 aa, Homo Sapiens
AALVSPISE

SEQ ID NO: 29342 - protein, 9 aa, Homo Sapiens
EEGGGSPWS

SEQ ID NO: 29343 - protein, 9 aa, Homo Sapiens
KEEEGEGGK

SEQ ID NO: 29344 - protein, 9 aa, Homo Sapiens
LKKDNVFNS

SEQ ID NO: 29345 - protein, 9 aa, Homo Sapiens
ATESRSKTE

SEQ ID NO: 29346 - protein, 9 aa, Homo Sapiens
EGGGSPWSS

SEQ ID NO: 29347 - protein, 9 aa, Homo Sapiens
CTDGIREQY

SEQ ID NO: 29348 - protein, 9 aa, Homo Sapiens
LMEKFNLDI

SEQ ID NO: 29349 - protein, 9 aa, Homo Sapiens
GPHLPFSRS

SEQ ID NO: 29350 - protein, 9 aa, Homo Sapiens
YYEMALQAA

SEQ ID NO: 29351 - protein, 9 aa, Homo Sapiens
KPDNDKDES

SEQ ID NO: 29352 - protein, 9 aa, Homo Sapiens
KIEKQQKAQ

SEQ ID NO: 29353 - protein, 9 aa, Homo Sapiens
YISSSAEKK

SEQ ID NO: 29354 - protein, 9 aa, Homo Sapiens
GEQQKELSK

SEQ ID NO: 29355 - protein, 9 aa, Homo Sapiens
NRHKQVIVK

SEQ ID NO: 29356 - protein, 9 aa, Homo Sapiens
RLRSLVLPA

SEQ ID NO: 29357 - protein, 9 aa, Homo Sapiens
LSPMMPTSP

SEQ ID NO: 29358 - protein, 9 aa, Homo Sapiens
LGGCLCSFQ

SEQ ID NO: 29359 - protein, 9 aa, Homo Sapiens
DNSLYQLLY

SEQ ID NO: 29360 - protein, 9 aa, Homo Sapiens
LLYNVNRHS

SEQ ID NO: 29361 - protein, 9 aa, Homo Sapiens
TGRTRPSLR

SEQ ID NO: 29362 - protein, 9 aa, Homo Sapiens
MLLTKWPGD

SEQ ID NO: 29363 - protein, 9 aa, Homo Sapiens
SQLIQLKKE

SEQ ID NO: 29364 - protein, 9 aa, Homo Sapiens
KAQAEAQKK

SEQ ID NO: 29365 - protein, 9 aa, Homo Sapiens
EGVNRDSDY

SEQ ID NO: 29366 - protein, 9 aa, Homo Sapiens
SLTSSCTLT

SEQ ID NO: 29367 - protein, 9 aa, Homo Sapiens
VFLANQPIE

SEQ ID NO: 29368 - protein, 9 aa, Homo Sapiens
YQRLIKEVT

SEQ ID NO: 29369 - protein, 9 aa, Homo Sapiens
GSQIQKIKE

SEQ ID NO: 29370 - protein, 9 aa, Homo Sapiens
PASSLSQVD

SEQ ID NO: 29371 - protein, 9 aa, Homo Sapiens
GIDSLDLVE

SEQ ID NO: 29372 - protein, 9 aa, Homo Sapiens
EDNSLYQLL

SEQ ID NO: 29373 - protein, 9 aa, Homo Sapiens
KASFGSIDH

SEQ ID NO: 29374 - protein, 9 aa, Homo Sapiens
KIATEALDN

SEQ ID NO: 29375 - protein, 9 aa, Homo Sapiens
EALTTEADT

SEQ ID NO: 29376 - protein, 9 aa, Homo Sapiens
GIQTVEDQH

SEQ ID NO: 29377 - protein, 9 aa, Homo Sapiens
FKVRVCACP

SEQ ID NO: 29378 - protein, 9 aa, Homo Sapiens
RAIQYIPTE

SEQ ID NO: 29379 - protein, 9 aa, Homo Sapiens
VPSEQTYSL

SEQ ID NO: 29380 - protein, 9 aa, Homo Sapiens
KAAPVPPTD

SEQ ID NO: 29381 - protein, 9 aa, Homo Sapiens
VPPTGDSKA

SEQ ID NO: 29382 - protein, 9 aa, Homo Sapiens
EIEKQFHVK

SEQ ID NO: 29383 - protein, 9 aa, Homo Sapiens
RVLKRSAEV

SEQ ID NO: 29384 - protein, 9 aa, Homo Sapiens
AAAAAGKAL

SEQ ID NO: 29385 - protein, 9 aa, Homo Sapiens
LCLGGTPVS

SEQ ID NO: 29386 - protein, 9 aa, Homo Sapiens
RRFMYTTPL

SEQ ID NO: 29387 - protein, 9 aa, Homo Sapiens
ACEEYAHNA

SEQ ID NO: 29388 - protein, 9 aa, Homo Sapiens
TVPTVAPKT

SEQ ID NO: 29389 - protein, 9 aa, Homo Sapiens
IALYLVSKT

SEQ ID NO: 29390 - protein, 9 aa, Homo Sapiens
ELIYQQATC

SEQ ID NO: 29391 - protein, 9 aa, Homo Sapiens
TQVGRFASQ

SEQ ID NO: 29392 - protein, 9 aa, Homo Sapiens
SSVTLEVEV

SEQ ID NO: 29393 - protein, 9 aa, Homo Sapiens
LNWTKIIKT

SEQ ID NO: 29394 - protein, 9 aa, Homo Sapiens
VAAARTGTR

SEQ ID NO: 29395 - protein, 9 aa, Homo Sapiens
LRFIGLKCL

SEQ ID NO: 29396 - protein, 9 aa, Homo Sapiens
QSRGSRSSD

SEQ ID NO: 29397 - protein, 9 aa, Homo Sapiens
SNLYSERRD

SEQ ID NO: 29398 - protein, 9 aa, Homo Sapiens
NITHTEEKP

SEQ ID NO: 29399 - protein, 9 aa, Homo Sapiens
QSVLRYKKE

SEQ ID NO: 29400 - protein, 9 aa, Homo Sapiens
IALDFHYRR

SEQ ID NO: 29401 - protein, 9 aa, Homo Sapiens
SSAPKRPGG

SEQ ID NO: 29402 - protein, 9 aa, Homo Sapiens
YSKNHDSAG

SEQ ID NO: 29403 - protein, 9 aa, Homo Sapiens
NQSNGTGNS

SEQ ID NO: 29404 - protein, 9 aa, Homo Sapiens
APSMTNGCY

SEQ ID NO: 29405 - protein, 9 aa, Homo Sapiens
TAAGLSRPR

SEQ ID NO: 29406 - protein, 9 aa, Homo Sapiens
NTEAHPLPM

SEQ ID NO: 29407 - protein, 9 aa, Homo Sapiens
SLPKVEALS

SEQ ID NO: 29408 - protein, 9 aa, Homo Sapiens
HPRHPWPAA

SEQ ID NO: 29409 - protein, 9 aa, Homo Sapiens
PQNTGYTYA

SEQ ID NO: 29410 - protein, 9 aa, Homo Sapiens
ENTNLLLQC

SEQ ID NO: 29411 - protein, 9 aa, Homo Sapiens
SLVLPAACV

SEQ ID NO: 29412 - protein, 9 aa, Homo Sapiens
LLAVRQKTV

SEQ ID NO: 29413 - protein, 9 aa, Homo Sapiens
TRRDLEGDQ

SEQ ID NO: 29414 - protein, 9 aa, Homo Sapiens
AAGKALRPH

SEQ ID NO: 29415 - protein, 9 aa, Homo Sapiens
HPQEFLRWR

SEQ ID NO: 29416 - protein, 9 aa, Homo Sapiens
CEEYAHNAL

SEQ ID NO: 29417 - protein, 9 aa, Homo Sapiens
KLFYRVLTC

SEQ ID NO: 29418 - protein, 9 aa, Homo Sapiens
ESETQAAVP

SEQ ID NO: 29419 - protein, 9 aa, Homo Sapiens
TKQAIHNYL

SEQ ID NO: 29420 - protein, 9 aa, Homo Sapiens
QQKAQAEAQ

SEQ ID NO: 29421 - protein, 9 aa, Homo Sapiens
LDEMFDNTA

SEQ ID NO: 29422 - protein, 9 aa, Homo Sapiens
SSPDQEETK

SEQ ID NO: 29423 - protein, 9 aa, Homo Sapiens
VKRPLDVHW

SEQ ID NO: 29424 - protein, 9 aa, Homo Sapiens
HCNVFVEVV

SEQ ID NO: 29425 - protein, 9 aa, Homo Sapiens
PAGSGHIGP

SEQ ID NO: 29426 - protein, 9 aa, Homo Sapiens
DGVPKGQLP

SEQ ID NO: 29427 - protein, 9 aa, Homo Sapiens
EREWEEQLH

SEQ ID NO: 29428 - protein, 9 aa, Homo Sapiens
IKVKVHKKA

SEQ ID NO: 29429 - protein, 9 aa, Homo Sapiens
IDFRQHLGW

SEQ ID NO: 29430 - protein, 9 aa, Homo Sapiens
EYAHNALRK

SEQ ID NO: 29431 - protein, 9 aa, Homo Sapiens
EWEEQLHRS

SEQ ID NO: 29432 - protein, 9 aa, Homo Sapiens
SLYQLLYLA

SEQ ID NO: 29433 - protein, 9 aa, Homo Sapiens
LWNRPRFAE

SEQ ID NO: 29434 - protein, 9 aa, Homo Sapiens
SNSLTSCVP

SEQ ID NO: 29435 - protein, 9 aa, Homo Sapiens
AHNALRKHK

SEQ ID NO: 29436 - protein, 9 aa, Homo Sapiens
SRAVPKGRG

SEQ ID NO: 29437 - protein, 9 aa, Homo Sapiens
ITMNDTRLY

SEQ ID NO: 29438 - protein, 9 aa, Homo Sapiens
VPIEPPEIA

SEQ ID NO: 29439 - protein, 9 aa, Homo Sapiens
TLRQALAGL

SEQ ID NO: 29440 - protein, 9 aa, Homo Sapiens
KRKRSPCPS

SEQ ID NO: 29441 - protein, 9 aa, Homo Sapiens
AAAGKALRP

SEQ ID NO: 29442 - protein, 9 aa, Homo Sapiens
ESHFVPNSF

SEQ ID NO: 29443 - protein, 9 aa, Homo Sapiens
SLPITEFKG

SEQ ID NO: 29444 - protein, 9 aa, Homo Sapiens
DLEGDQDSH

SEQ ID NO: 29445 - protein, 9 aa, Homo Sapiens
VAQDGAVLF

SEQ ID NO: 29446 - protein, 9 aa, Homo Sapiens
SWWLDSGHT

SEQ ID NO: 29447 - protein, 9 aa, Homo Sapiens
QKMRSIQET

SEQ ID NO: 29448 - protein, 9 aa, Homo Sapiens
STQSVKSTV

SEQ ID NO: 29449 - protein, 9 aa, Homo Sapiens
YSSYRKPTT

SEQ ID NO: 29450 - protein, 9 aa, Homo Sapiens
NNCTDGIRE

SEQ ID NO: 29451 - protein, 9 aa, Homo Sapiens
EGEPQAASA

SEQ ID NO: 29452 - protein, 9 aa, Homo Sapiens
PSAQRPKLS

SEQ ID NO: 29453 - protein, 9 aa, Homo Sapiens
NRCIAKFDY

SEQ ID NO: 29454 - protein, 9 aa, Homo Sapiens
PQLTANKIR

SEQ ID NO: 29455 - protein, 9 aa, Homo Sapiens
SPPQCVPQN

SEQ ID NO: 29456 - protein, 9 aa, Homo Sapiens
CDIEKFMPI

SEQ ID NO: 29457 - protein, 9 aa, Homo Sapiens
LTLEGRPRG

SEQ ID NO: 29458 - protein, 9 aa, Homo Sapiens
CIPEPVLQD

SEQ ID NO: 29459 - protein, 9 aa, Homo Sapiens
GTAQLLPRL

SEQ ID NO: 29460 - protein, 9 aa, Homo Sapiens
PDLQETSLA

SEQ ID NO: 29461 - protein, 9 aa, Homo Sapiens
TLFLGVQKH

SEQ ID NO: 29462 - protein, 9 aa, Homo Sapiens
TSNGWCFIT

SEQ ID NO: 29463 - protein, 9 aa, Homo Sapiens
FELSVLGFI

SEQ ID NO: 29464 - protein, 9 aa, Homo Sapiens
ELLSREAVH

SEQ ID NO: 29465 - protein, 9 aa, Homo Sapiens
KMANRNHLK

SEQ ID NO: 29466 - protein, 9 aa, Homo Sapiens
TDENPCGVD

SEQ ID NO: 29467 - protein, 9 aa, Homo Sapiens
PPTLSKGLR

SEQ ID NO: 29468 - protein, 9 aa, Homo Sapiens
PCDRVVCSS

SEQ ID NO: 29469 - protein, 9 aa, Homo Sapiens
LKSMDYFDD

SEQ ID NO: 29470 - protein, 9 aa, Homo Sapiens
IARAPGFIP

SEQ ID NO: 29471 - protein, 9 aa, Homo Sapiens
GGGSLLEFF

SEQ ID NO: 29472 - protein, 9 aa, Homo Sapiens
TVMYSQINA

SEQ ID NO: 29473 - protein, 9 aa, Homo Sapiens
ARLCTPPTC

SEQ ID NO: 29474 - protein, 9 aa, Homo Sapiens
QDSFPAGFG

SEQ ID NO: 29475 - protein, 9 aa, Homo Sapiens
VTDYFSQTP

SEQ ID NO: 29476 - protein, 9 aa, Homo Sapiens
YLNQMINSI

SEQ ID NO: 29477 - protein, 9 aa, Homo Sapiens
IVDAVKLDA

SEQ ID NO: 29478 - protein, 9 aa, Homo Sapiens
TQINNKAAI

SEQ ID NO: 29479 - protein, 9 aa, Homo Sapiens
DPEHRGHVE

SEQ ID NO: 29480 - protein, 9 aa, Homo Sapiens
LMAAQGRVL

SEQ ID NO: 29481 - protein, 9 aa, Homo Sapiens
MKSIVGEVV

SEQ ID NO: 29482 - protein, 9 aa, Homo Sapiens
GHLPALSRR

SEQ ID NO: 29483 - protein, 9 aa, Homo Sapiens
SDHLMQQGI

SEQ ID NO: 29484 - protein, 9 aa, Homo Sapiens
YRKPLKNSQ

SEQ ID NO: 29485 - protein, 9 aa, Homo Sapiens
SSSALTDHD

SEQ ID NO: 29486 - protein, 9 aa, Homo Sapiens
HSSSTISKK

SEQ ID NO: 29487 - protein, 9 aa, Homo Sapiens
LYEKGPDSV

SEQ ID NO: 29488 - protein, 9 aa, Homo Sapiens
KLSKLNEMN

SEQ ID NO: 29489 - protein, 9 aa, Homo Sapiens
GRHVAPHTG

SEQ ID NO: 29490 - protein, 9 aa, Homo Sapiens
ATVDPVMLQ

SEQ ID NO: 29491 - protein, 9 aa, Homo Sapiens
NRIQCAMKS

SEQ ID NO: 29492 - protein, 9 aa, Homo Sapiens
SQEVGAVAE

SEQ ID NO: 29493 - protein, 9 aa, Homo Sapiens
LLWDELYVG

SEQ ID NO: 29494 - protein, 9 aa, Homo Sapiens
VGFQTRLQR

SEQ ID NO: 29495 - protein, 9 aa, Homo Sapiens
ILGHNGIKQ

SEQ ID NO: 29496 - protein, 9 aa, Homo Sapiens
TASQTPSVV

SEQ ID NO: 29497 - protein, 9 aa, Homo Sapiens
MAYRKPLKN

SEQ ID NO: 29498 - protein, 9 aa, Homo Sapiens
ELLAGLPAH

SEQ ID NO: 29499 - protein, 9 aa, Homo Sapiens
NTIMAHCRH

SEQ ID NO: 29500 - protein, 9 aa, Homo Sapiens
VLLCRQHSL

SEQ ID NO: 29501 - protein, 9 aa, Homo Sapiens
GPRGPPPHP

SEQ ID NO: 29502 - protein, 9 aa, Homo Sapiens
LSEGVQGVN

SEQ ID NO: 29503 - protein, 9 aa, Homo Sapiens
AGVDGQHRA

SEQ ID NO: 29504 - protein, 9 aa, Homo Sapiens
FLRSQGFKD

SEQ ID NO: 29505 - protein, 9 aa, Homo Sapiens
APISPSRTA

SEQ ID NO: 29506 - protein, 9 aa, Homo Sapiens
DRALEILLY

SEQ ID NO: 29507 - protein, 9 aa, Homo Sapiens
CGHLKRWPY

SEQ ID NO: 29508 - protein, 9 aa, Homo Sapiens
FLHLEKETP

SEQ ID NO: 29509 - protein, 9 aa, Homo Sapiens
APRNTCRRW

SEQ ID NO: 29510 - protein, 9 aa, Homo Sapiens
LRLKQQARA

SEQ ID NO: 29511 - protein, 9 aa, Homo Sapiens
AYRKPLKNS

SEQ ID NO: 29512 - protein, 9 aa, Homo Sapiens
TTCCRPNCC

SEQ ID NO: 29513 - protein, 9 aa, Homo Sapiens
MEGVFPCQH

SEQ ID NO: 29514 - protein, 9 aa, Homo Sapiens
AKSGASARR

SEQ ID NO: 29515 - protein, 9 aa, Homo Sapiens
PISPSRTAS

SEQ ID NO: 29516 - protein, 9 aa, Homo Sapiens
LAIALAALG

SEQ ID NO: 29517 - protein, 9 aa, Homo Sapiens
VNSYGDIQR

SEQ ID NO: 29518 - protein, 9 aa, Homo Sapiens
AAHGAPVGP

SEQ ID NO: 29519 - protein, 9 aa, Homo Sapiens
AVAQRNMPL

SEQ ID NO: 29520 - protein, 9 aa, Homo Sapiens
AEGKKAFAT

SEQ ID NO: 29521 - protein, 9 aa, Homo Sapiens
AYSPLDEKS

SEQ ID NO: 29522 - protein, 9 aa, Homo Sapiens
TFNKSHPKR

SEQ ID NO: 29523 - protein, 9 aa, Homo Sapiens
QGLLDNSLT

SEQ ID NO: 29524 - protein, 9 aa, Homo Sapiens
AAVAQRNMP

SEQ ID NO: 29525 - protein, 9 aa, Homo Sapiens
NVYRVRSKY

SEQ ID NO: 29526 - protein, 9 aa, Homo Sapiens
LYVGFQTRL

SEQ ID NO: 29527 - protein, 9 aa, Homo Sapiens
CGAIVKQKN

SEQ ID NO: 29528 - protein, 9 aa, Homo Sapiens
VFSHKFDYE

SEQ ID NO: 29529 - protein, 9 aa, Homo Sapiens
LLCLLLLGN

SEQ ID NO: 29530 - protein, 9 aa, Homo Sapiens
ESSYCSPQK

SEQ ID NO: 29531 - protein, 9 aa, Homo Sapiens
CDWDNHRSA

SEQ ID NO: 29532 - protein, 9 aa, Homo Sapiens
GGAPPEALP

SEQ ID NO: 29533 - protein, 9 aa, Homo Sapiens
VLCPYNRKG

SEQ ID NO: 29534 - protein, 9 aa, Homo Sapiens
QTDIQTDID

SEQ ID NO: 29535 - protein, 9 aa, Homo Sapiens
ANQVTVRKR

SEQ ID NO: 29536 - protein, 9 aa, Homo Sapiens
RKRLCENTA

SEQ ID NO: 29537 - protein, 9 aa, Homo Sapiens
VKENLYQLK

SEQ ID NO: 29538 - protein, 9 aa, Homo Sapiens
ALPADATDV

SEQ ID NO: 29539 - protein, 9 aa, Homo Sapiens
EPWIMEGVF

SEQ ID NO: 29540 - protein, 9 aa, Homo Sapiens
TVDPVMLQK

SEQ ID NO: 29541 - protein, 9 aa, Homo Sapiens
GALGEGLSA

SEQ ID NO: 29542 - protein, 9 aa, Homo Sapiens
EFCFSRENF

SEQ ID NO: 29543 - protein, 9 aa, Homo Sapiens
SPTRNDLEP

SEQ ID NO: 29544 - protein, 9 aa, Homo Sapiens
CAMKSLSRI

SEQ ID NO: 29545 - protein, 9 aa, Homo Sapiens
KREKDHTTH

SEQ ID NO: 29546 - protein, 9 aa, Homo Sapiens
QDIVHIRRE

SEQ ID NO: 29547 - protein, 9 aa, Homo Sapiens
GLAAVGAAV

SEQ ID NO: 29548 - protein, 9 aa, Homo Sapiens
AAGMGDKGR

SEQ ID NO: 29549 - protein, 9 aa, Homo Sapiens
QTGRMRRWL

SEQ ID NO: 29550 - protein, 9 aa, Homo Sapiens
LAAIVDAVK

SEQ ID NO: 29551 - protein, 9 aa, Homo Sapiens
EGGGGSLLE

SEQ ID NO: 29552 - protein, 9 aa, Homo Sapiens
PAHLRQAFS

SEQ ID NO: 29553 - protein, 9 aa, Homo Sapiens
YFLNVFGLP

SEQ ID NO: 29554 - protein, 9 aa, Homo Sapiens
GELKLARND

SEQ ID NO: 29555 - protein, 9 aa, Homo Sapiens
LVFDEVRAL

SEQ ID NO: 29556 - protein, 9 aa, Homo Sapiens
PEPSGKMAN

SEQ ID NO: 29557 - protein, 9 aa, Homo Sapiens
NCSMFSAVR

SEQ ID NO: 29558 - protein, 9 aa, Homo Sapiens
FGLPSIYSL

SEQ ID NO: 29559 - protein, 9 aa, Homo Sapiens
GQVPCGLLP

SEQ ID NO: 29560 - protein, 9 aa, Homo Sapiens
MQVESSYCS

SEQ ID NO: 29561 - protein, 9 aa, Homo Sapiens
GLSAVIALV

SEQ ID NO: 29562 - protein, 9 aa, Homo Sapiens
WPHGVWSTD

SEQ ID NO: 29563 - protein, 9 aa, Homo Sapiens
WARLCTPPT

SEQ ID NO: 29564 - protein, 9 aa, Homo Sapiens
NECESSPCI

SEQ ID NO: 29565 - protein, 9 aa, Homo Sapiens
KLRHPGYLS

SEQ ID NO: 29566 - protein, 9 aa, Homo Sapiens
PGEKLNDFR

SEQ ID NO: 29567 - protein, 9 aa, Homo Sapiens
VLPRRSEEG

SEQ ID NO: 29568 - protein, 9 aa, Homo Sapiens
ATALLLQGQ

SEQ ID NO: 29569 - protein, 9 aa, Homo Sapiens
QQHIERFTQ

SEQ ID NO: 29570 - protein, 9 aa, Homo Sapiens
DSRATGAHW

SEQ ID NO: 29571 - protein, 9 aa, Homo Sapiens
CAIAGVLTF

SEQ ID NO: 29572 - protein, 9 aa, Homo Sapiens
VDGQHRALA

SEQ ID NO: 29573 - protein, 9 aa, Homo Sapiens
AAVGAAWQV

SEQ ID NO: 29574 - protein, 9 aa, Homo Sapiens
PHGVWSTDK

SEQ ID NO: 29575 - protein, 9 aa, Homo Sapiens
KCHEVQLLA

SEQ ID NO: 29576 - protein, 9 aa, Homo Sapiens
GHNVFDNDS

SEQ ID NO: 29577 - protein, 9 aa, Homo Sapiens
AHHKFQSQA

SEQ ID NO: 29578 - protein, 9 aa, Homo Sapiens
LPCTLGLRM

SEQ ID NO: 29579 - protein, 9 aa, Homo Sapiens
KANAPMKQL

SEQ ID NO: 29580 - protein, 9 aa, Homo Sapiens
RKGSKSIKY

SEQ ID NO: 29581 - protein, 9 aa, Homo Sapiens
AVGAAVGAA

SEQ ID NO: 29582 - protein, 9 aa, Homo Sapiens
GKKIEAPPD

SEQ ID NO: 29583 - protein, 9 aa, Homo Sapiens
FQEFQEERQ

SEQ ID NO: 29584 - protein, 9 aa, Homo Sapiens
KPGDPSRQP

SEQ ID NO: 29585 - protein, 9 aa, Homo Sapiens
SSAALCGAG

SEQ ID NO: 29586 - protein, 9 aa, Homo Sapiens
YVNVRLRDL

SEQ ID NO: 29587 - protein, 9 aa, Homo Sapiens
VESSYCSPQ

SEQ ID NO: 29588 - protein, 9 aa, Homo Sapiens
LEGLLPGVA

SEQ ID NO: 29589 - protein, 9 aa, Homo Sapiens
RKPLKNSQD

SEQ ID NO: 29590 - protein, 9 aa, Homo Sapiens
IDTFNKSHP

SEQ ID NO: 29591 - protein, 9 aa, Homo Sapiens
YGLYNSPFD

SEQ ID NO: 29592 - protein, 9 aa, Homo Sapiens
SKLKFSGFT

SEQ ID NO: 29593 - protein, 9 aa, Homo Sapiens
NQVTVRKRE

SEQ ID NO: 29594 - protein, 9 aa, Homo Sapiens
SCETQGILK

SEQ ID NO: 29595 - protein, 9 aa, Homo Sapiens
YFDIVKIPM

SEQ ID NO: 29596 - protein, 9 aa, Homo Sapiens
VGEVVREIG

SEQ ID NO: 29597 - protein, 9 aa, Homo Sapiens
PADPDCIAF

SEQ ID NO: 29598 - protein, 9 aa, Homo Sapiens
ETDKVVRAI

SEQ ID NO: 29599 - protein, 9 aa, Homo Sapiens
EQNLDACQN

SEQ ID NO: 29600 - protein, 9 aa, Homo Sapiens
LLSREAVHR

SEQ ID NO: 29601 - protein, 9 aa, Homo Sapiens
QAVPASSFR

SEQ ID NO: 29602 - protein, 9 aa, Homo Sapiens
EDAIVILEK

SEQ ID NO: 29603 - protein, 9 aa, Homo Sapiens
GGGGSSLSS

SEQ ID NO: 29604 - protein, 9 aa, Homo Sapiens
NIKYDTALN

SEQ ID NO: 29605 - protein, 9 aa, Homo Sapiens
NIFLVFRAA

SEQ ID NO: 29606 - protein, 9 aa, Homo Sapiens
QRQWALAIM

SEQ ID NO: 29607 - protein, 9 aa, Homo Sapiens
SNGWCFITL

SEQ ID NO: 29608 - protein, 9 aa, Homo Sapiens
TIYEVTGKS

SEQ ID NO: 29609 - protein, 9 aa, Homo Sapiens
QLVRKKHKA

SEQ ID NO: 29610 - protein, 9 aa, Homo Sapiens
QREPRARFY

SEQ ID NO: 29611 - protein, 9 aa, Homo Sapiens
LNLQKSFKP

SEQ ID NO: 29612 - protein, 9 aa, Homo Sapiens
SDDIDLRKA

SEQ ID NO: 29613 - protein, 9 aa, Homo Sapiens
LLLLVTSSH

SEQ ID NO: 29614 - protein, 9 aa, Homo Sapiens
DSFPAGFGG

SEQ ID NO: 29615 - protein, 9 aa, Homo Sapiens
APRFIARAL

SEQ ID NO: 29616 - protein, 9 aa, Homo Sapiens
IFLVFRAAT

SEQ ID NO: 29617 - protein, 9 aa, Homo Sapiens
IEAPPDNKK

SEQ ID NO: 29618 - protein, 9 aa, Homo Sapiens
KKLNESLKV

SEQ ID NO: 29619 - protein, 9 aa, Homo Sapiens
SRRLDLQEQ

SEQ ID NO: 29620 - protein, 9 aa, Homo Sapiens
FPAGFGGVH

SEQ ID NO: 29621 - protein, 9 aa, Homo Sapiens
HAAHHKFQS

SEQ ID NO: 29622 - protein, 9 aa, Homo Sapiens
TFVGPLASV

SEQ ID NO: 29623 - protein, 9 aa, Homo Sapiens
VAEAVVGAA

SEQ ID NO: 29624 - protein, 9 aa, Homo Sapiens
HKAQHRCMR

SEQ ID NO: 29625 - protein, 9 aa, Homo Sapiens
ALQFQTRET

SEQ ID NO: 29626 - protein, 9 aa, Homo Sapiens
HLMQQGILK

SEQ ID NO: 29627 - protein, 9 aa, Homo Sapiens
MLQGVAQLS

SEQ ID NO: 29628 - protein, 9 aa, Homo Sapiens
VKKRNQKTT

SEQ ID NO: 29629 - protein, 9 aa, Homo Sapiens
AIVDAVKLD

SEQ ID NO: 29630 - protein, 9 aa, Homo Sapiens
DEVGALGEG

SEQ ID NO: 29631 - protein, 9 aa, Homo Sapiens
KLARNDIDL

SEQ ID NO: 29632 - protein, 9 aa, Homo Sapiens
GGGGGSSLS

SEQ ID NO: 29633 - protein, 9 aa, Homo Sapiens
AIVILEKTP

SEQ ID NO: 29634 - protein, 9 aa, Homo Sapiens
WIMEGVFPC

SEQ ID NO: 29635 - protein, 9 aa, Homo Sapiens
RQAFLEGKV

SEQ ID NO: 29636 - protein, 9 aa, Homo Sapiens
EGVQGVNSY

SEQ ID NO: 29637 - protein, 9 aa, Homo Sapiens
YYYKCHEVQ

SEQ ID NO: 29638 - protein, 9 aa, Homo Sapiens
DSIHCERKL

SEQ ID NO: 29639 - protein, 9 aa, Homo Sapiens
QHSCPHCSK

SEQ ID NO: 29640 - protein, 9 aa, Homo Sapiens
FYHLQREPR

SEQ ID NO: 29641 - protein, 9 aa, Homo Sapiens
QVTIHVPPT

SEQ ID NO: 29642 - protein, 9 aa, Homo Sapiens
DNSLTASLT

SEQ ID NO: 29643 - protein, 9 aa, Homo Sapiens
VMLQKRGGA

SEQ ID NO: 29644 - protein, 9 aa, Homo Sapiens
KQKNEKGFT

SEQ ID NO: 29645 - protein, 9 aa, Homo Sapiens
QQGPCGHLK

SEQ ID NO: 29646 - protein, 9 aa, Homo Sapiens
MGDLFSTTD

SEQ ID NO: 29647 - protein, 9 aa, Homo Sapiens
PERHPLYHY

SEQ ID NO: 29648 - protein, 9 aa, Homo Sapiens
RALRFIARA

SEQ ID NO: 29649 - protein, 9 aa, Homo Sapiens
SMAAVAQRN

SEQ ID NO: 29650 - protein, 9 aa, Homo Sapiens
IVILEKTPF

SEQ ID NO: 29651 - protein, 9 aa, Homo Sapiens
VRALGEGLA

SEQ ID NO: 29652 - protein, 9 aa, Homo Sapiens
FLSGFVAEA

SEQ ID NO: 29653 - protein, 9 aa, Homo Sapiens
PPEALPADA

SEQ ID NO: 29654 - protein, 9 aa, Homo Sapiens
CRRWTPPSN

SEQ ID NO: 29655 - protein, 9 aa, Homo Sapiens
SPREQNLDA

SEQ ID NO: 29656 - protein, 9 aa, Homo Sapiens
NIPFGITKE

SEQ ID NO: 29657 - protein, 9 aa, Homo Sapiens
MEKANAPMK

SEQ ID NO: 29658 - protein, 9 aa, Homo Sapiens
CETQGILKH

SEQ ID NO: 29659 - protein, 9 aa, Homo Sapiens
GTFVGPLAS

SEQ ID NO: 29660 - protein, 9 aa, Homo Sapiens
CRGSCTLGR

SEQ ID NO: 29661 - protein, 9 aa, Homo Sapiens
SCRCWQLSP

SEQ ID NO: 29662 - protein, 9 aa, Homo Sapiens
KPLSEGVQG

SEQ ID NO: 29663 - protein, 9 aa, Homo Sapiens
SRATGAHWM

SEQ ID NO: 29664 - protein, 9 aa, Homo Sapiens
DYSDDIDLR

SEQ ID NO: 29665 - protein, 9 aa, Homo Sapiens
ETGTGLLCM

SEQ ID NO: 29666 - protein, 9 aa, Homo Sapiens
YNSPFDPVL

SEQ ID NO: 29667 - protein, 9 aa, Homo Sapiens
SAATGTSAS

SEQ ID NO: 29668 - protein, 9 aa, Homo Sapiens
LLYVTYTPL

SEQ ID NO: 29669 - protein, 9 aa, Homo Sapiens
LYSLDSDHK

SEQ ID NO: 29670 - protein, 9 aa, Homo Sapiens
CHEVQLLAA

SEQ ID NO: 29671 - protein, 9 aa, Homo Sapiens
TSKGSCETQ

SEQ ID NO: 29672 - protein, 9 aa, Homo Sapiens
CKEIGITPL

SEQ ID NO: 29673 - protein, 9 aa, Homo Sapiens
GNIPFGITK

SEQ ID NO: 29674 - protein, 9 aa, Homo Sapiens
KDKTRAGKM

SEQ ID NO: 29675 - protein, 9 aa, Homo Sapiens
LLLEAQKEP

SEQ ID NO: 29676 - protein, 9 aa, Homo Sapiens
TFALPVPVI

SEQ ID NO: 29677 - protein, 9 aa, Homo Sapiens
GLQDSFPAG

SEQ ID NO: 29678 - protein, 9 aa, Homo Sapiens
FHYGNLSHA

SEQ ID NO: 29679 - protein, 9 aa, Homo Sapiens
LAAVGAAVG

SEQ ID NO: 29680 - protein, 9 aa, Homo Sapiens
ALAPAESSP

SEQ ID NO: 29681 - protein, 9 aa, Homo Sapiens
LCPYNRKGS

SEQ ID NO: 29682 - protein, 9 aa, Homo Sapiens
PLASVGALV

SEQ ID NO: 29683 - protein, 9 aa, Homo Sapiens
TRYGLYNSP

SEQ ID NO: 29684 - protein, 9 aa, Homo Sapiens
VGRHVAPHT

SEQ ID NO: 29685 - protein, 9 aa, Homo Sapiens
KRLCENTAG

SEQ ID NO: 29686 - protein, 9 aa, Homo Sapiens
VYRVRSKYN

SEQ ID NO: 29687 - protein, 9 aa, Homo Sapiens
LGALKKNAT

SEQ ID NO: 29688 - protein, 9 aa, Homo Sapiens
VSELNKNSS

SEQ ID NO: 29689 - protein, 9 aa, Homo Sapiens
PNSDALQFQ

SEQ ID NO: 29690 - protein, 9 aa, Homo Sapiens
YCPRGNRYC

SEQ ID NO: 29691 - protein, 9 aa, Homo Sapiens
DWDNHRSAE

SEQ ID NO: 29692 - protein, 9 aa, Homo Sapiens
RSYGSDSEN

SEQ ID NO: 29693 - protein, 9 aa, Homo Sapiens
ADPDCIAFI

SEQ ID NO: 29694 - protein, 9 aa, Homo Sapiens
GVDSECINR

SEQ ID NO: 29695 - protein, 9 aa, Homo Sapiens
PGTGLAFPP

SEQ ID NO: 29696 - protein, 9 aa, Homo Sapiens
ISPSRTASQ

SEQ ID NO: 29697 - protein, 9 aa, Homo Sapiens
TDIQTDIDL

SEQ ID NO: 29698 - protein, 9 aa, Homo Sapiens
CCIYCPRGN

SEQ ID NO: 29699 - protein, 9 aa, Homo Sapiens
DVRPRALPT

SEQ ID NO: 29700 - protein, 9 aa, Homo Sapiens
ALLLQGQLG

SEQ ID NO: 29701 - protein, 9 aa, Homo Sapiens
DCILYYGFE

SEQ ID NO: 29702 - protein, 9 aa, Homo Sapiens
VHVEFASHG

SEQ ID NO: 29703 - protein, 9 aa, Homo Sapiens
FALPVPVIV

SEQ ID NO: 29704 - protein, 9 aa, Homo Sapiens
DLGVRHLKL

SEQ ID NO: 29705 - protein, 9 aa, Homo Sapiens
FLRQGLLDN

SEQ ID NO: 29706 - protein, 9 aa, Homo Sapiens
KRYAPDLPC

SEQ ID NO: 29707 - protein, 9 aa, Homo Sapiens
LRSVVYLPY

SEQ ID NO: 29708 - protein, 9 aa, Homo Sapiens
FGITKEAMM

SEQ ID NO: 29709 - protein, 9 aa, Homo Sapiens
FTYYKQLRE

SEQ ID NO: 29710 - protein, 9 aa, Homo Sapiens
RVSEGLRDW

SEQ ID NO: 29711 - protein, 9 aa, Homo Sapiens
LEEGLVNIK

SEQ ID NO: 29712 - protein, 9 aa, Homo Sapiens
PQSTGELTV

SEQ ID NO: 29713 - protein, 9 aa, Homo Sapiens
AEAVVGAAG

SEQ ID NO: 29714 - protein, 9 aa, Homo Sapiens
RALGFKLRA

SEQ ID NO: 29715 - protein, 9 aa, Homo Sapiens
AICSPLHYK

SEQ ID NO: 29716 - protein, 9 aa, Homo Sapiens
ADLGVRHLK

SEQ ID NO: 29717 - protein, 9 aa, Homo Sapiens
HSLHLRQAS

SEQ ID NO: 29718 - protein, 9 aa, Homo Sapiens
VHPDSRATG

SEQ ID NO: 29719 - protein, 9 aa, Homo Sapiens
IQCAMKSLS

SEQ ID NO: 29720 - protein, 9 aa, Homo Sapiens
LQTDIQTDI

SEQ ID NO: 29721 - protein, 9 aa, Homo Sapiens
AILLVNCDW

SEQ ID NO: 29722 - protein, 9 aa, Homo Sapiens
DIQTDIDLT

SEQ ID NO: 29723 - protein, 9 aa, Homo Sapiens
KLYSLDSDH

SEQ ID NO: 29724 - protein, 9 aa, Homo Sapiens
CYRRLEKLG

SEQ ID NO: 29725 - protein, 9 aa, Homo Sapiens
NYEELARQC

SEQ ID NO: 29726 - protein, 9 aa, Homo Sapiens
ILFVNPAIW

SEQ ID NO: 29727 - protein, 9 aa, Homo Sapiens
ALVKKRNQK

SEQ ID NO: 29728 - protein, 9 aa, Homo Sapiens
VVVFDEAHS

SEQ ID NO: 29729 - protein, 9 aa, Homo Sapiens
SLGHNVFDN

SEQ ID NO: 29730 - protein, 9 aa, Homo Sapiens
PTLSKGLRS

SEQ ID NO: 29731 - protein, 9 aa, Homo Sapiens
GITKEAMMD

SEQ ID NO: 29732 - protein, 9 aa, Homo Sapiens
QEEVRLFFL

SEQ ID NO: 29733 - protein, 9 aa, Homo Sapiens
CYLKCKKCT

SEQ ID NO: 29734 - protein, 9 aa, Homo Sapiens
HYGNLSHAP

SEQ ID NO: 29735 - protein, 9 aa, Homo Sapiens
STSRFMAYR

SEQ ID NO: 29736 - protein, 9 aa, Homo Sapiens
KRWPYGQVP

SEQ ID NO: 29737 - protein, 9 aa, Homo Sapiens
FCSKPTSAS

SEQ ID NO: 29738 - protein, 9 aa, Homo Sapiens
FEDIFRISS

SEQ ID NO: 29739 - protein, 9 aa, Homo Sapiens
MFQEFQEER

SEQ ID NO: 29740 - protein, 9 aa, Homo Sapiens
KPHYIPRRW

SEQ ID NO: 29741 - protein, 9 aa, Homo Sapiens
RKFFPCFDE

SEQ ID NO: 29742 - protein, 9 aa, Homo Sapiens
IGEEVPRTI

SEQ ID NO: 29743 - protein, 9 aa, Homo Sapiens
TAGHLKDAQ

SEQ ID NO: 29744 - protein, 9 aa, Homo Sapiens
LAADLTFVG

SEQ ID NO: 29745 - protein, 9 aa, Homo Sapiens
LLPKPLSEG

SEQ ID NO: 29746 - protein, 9 aa, Homo Sapiens
GHVEWPDFL

SEQ ID NO: 29747 - protein, 9 aa, Homo Sapiens
VAQRNMPLQ

SEQ ID NO: 29748 - protein, 9 aa, Homo Sapiens
VHPLMAAQG

SEQ ID NO: 29749 - protein, 9 aa, Homo Sapiens
DCIAFIHSN

SEQ ID NO: 29750 - protein, 9 aa, Homo Sapiens
IHVVDWPFD

SEQ ID NO: 29751 - protein, 9 aa, Homo Sapiens
VARFQRTKE

SEQ ID NO: 29752 - protein, 9 aa, Homo Sapiens
IALVRPLAT

SEQ ID NO: 29753 - protein, 9 aa, Homo Sapiens
SIDTFNKSH

SEQ ID NO: 29754 - protein, 9 aa, Homo Sapiens
QVGQAYVGW

SEQ ID NO: 29755 - protein, 9 aa, Homo Sapiens
LLPGVAAGM

SEQ ID NO: 29756 - protein, 9 aa, Homo Sapiens
FITVGCRGS

SEQ ID NO: 29757 - protein, 9 aa, Homo Sapiens
QHSLHLRQA

SEQ ID NO: 29758 - protein, 9 aa, Homo Sapiens
AAVGAAVGA

SEQ ID NO: 29759 - protein, 9 aa, Homo Sapiens
GLYNSPFDP

SEQ ID NO: 29760 - protein, 9 aa, Homo Sapiens
PRNTCRRWT

SEQ ID NO: 29761 - protein, 9 aa, Homo Sapiens
CCRPNCCVS

SEQ ID NO: 29762 - protein, 9 aa, Homo Sapiens
SDALQFQTR

SEQ ID NO: 29763 - protein, 9 aa, Homo Sapiens
KALAALRAL

SEQ ID NO: 29764 - protein, 9 aa, Homo Sapiens
LGVQKHLRT

SEQ ID NO: 29765 - protein, 9 aa, Homo Sapiens
TDSTKSGVP

SEQ ID NO: 29766 - protein, 9 aa, Homo Sapiens
VREIAQDCK

SEQ ID NO: 29767 - protein, 9 aa, Homo Sapiens
LAPAESSPL

SEQ ID NO: 29768 - protein, 9 aa, Homo Sapiens
MKSLSRITE

SEQ ID NO: 29769 - protein, 9 aa, Homo Sapiens
AQGRVSQRL

SEQ ID NO: 29770 - protein, 9 aa, Homo Sapiens
TDYLIKILT

SEQ ID NO: 29771 - protein, 9 aa, Homo Sapiens
AKALAALRA

SEQ ID NO: 29772 - protein, 9 aa, Homo Sapiens
LRCRQQGPC

SEQ ID NO: 29773 - protein, 9 aa, Homo Sapiens
RQYMHTGTM

SEQ ID NO: 29774 - protein, 9 aa, Homo Sapiens
TLSKGLRSQ

SEQ ID NO: 29775 - protein, 9 aa, Homo Sapiens
LLRWKAYLL

SEQ ID NO: 29776 - protein, 9 aa, Homo Sapiens
MLAYSPLDE

SEQ ID NO: 29777 - protein, 9 aa, Homo Sapiens
PADATDVRP

SEQ ID NO: 29778 - protein, 9 aa, Homo Sapiens
YQSSSALTD

SEQ ID NO: 29779 - protein, 9 aa, Homo Sapiens
PRALGFKLR

SEQ ID NO: 29780 - protein, 9 aa, Homo Sapiens
EQDIVHIRR

SEQ ID NO: 29781 - protein, 9 aa, Homo Sapiens
GPLASVGAL

SEQ ID NO: 29782 - protein, 9 aa, Homo Sapiens
RRAKAGVQL

SEQ ID NO: 29783 - protein, 9 aa, Homo Sapiens
LALRAGQVI

SEQ ID NO: 29784 - protein, 9 aa, Homo Sapiens
RKREKDHTT

SEQ ID NO: 29785 - protein, 9 aa, Homo Sapiens
AWLCGLLPF

SEQ ID NO: 29786 - protein, 9 aa, Homo Sapiens
LVREIAQDC

SEQ ID NO: 29787 - protein, 9 aa, Homo Sapiens
GPLVAVGAL

SEQ ID NO: 29788 - protein, 9 aa, Homo Sapiens
YELQDVSSV

SEQ ID NO: 29789 - protein, 9 aa, Homo Sapiens
SWARLCTPP

SEQ ID NO: 29790 - protein, 9 aa, Homo Sapiens
AGFGGVHFV

SEQ ID NO: 29791 - protein, 9 aa, Homo Sapiens
DADIQYEYF

SEQ ID NO: 29792 - protein, 9 aa, Homo Sapiens
AHSIDNVCI

SEQ ID NO: 29793 - protein, 9 aa, Homo Sapiens
VMTNNCSYP

SEQ ID NO: 29794 - protein, 9 aa, Homo Sapiens
KHLRTFLEF

SEQ ID NO: 29795 - protein, 9 aa, Homo Sapiens
RNTCRRWTP

SEQ ID NO: 29796 - protein, 9 aa, Homo Sapiens
RAIAIALRN

SEQ ID NO: 29797 - protein, 9 aa, Homo Sapiens
MVMTNNCSY

SEQ ID NO: 29798 - protein, 9 aa, Homo Sapiens
LVADEVGAL

SEQ ID NO: 29799 - protein, 9 aa, Homo Sapiens
KFHWCCYLK

SEQ ID NO: 29800 - protein, 9 aa, Homo Sapiens
RSKSFHYGN

SEQ ID NO: 29801 - protein, 9 aa, Homo Sapiens
VCVTTYAIN

SEQ ID NO: 29802 - protein, 9 aa, Homo Sapiens
IKDEQDIVH

SEQ ID NO: 29803 - protein, 9 aa, Homo Sapiens
PREQNLDAC

SEQ ID NO: 29804 - protein, 9 aa, Homo Sapiens
NDSIHCERK

SEQ ID NO: 29805 - protein, 9 aa, Homo Sapiens
LDQGGAPPE

SEQ ID NO: 29806 - protein, 9 aa, Homo Sapiens
PGFLISSGL

SEQ ID NO: 29807 - protein, 9 aa, Homo Sapiens
RWPHGVWST

SEQ ID NO: 29808 - protein, 9 aa, Homo Sapiens
VAAGMGDKG

SEQ ID NO: 29809 - protein, 9 aa, Homo Sapiens
KALQYVNVR

SEQ ID NO: 29810 - protein, 9 aa, Homo Sapiens
KFWALGFEL

SEQ ID NO: 29811 - protein, 9 aa, Homo Sapiens
APHTGAHPA

SEQ ID NO: 29812 - protein, 9 aa, Homo Sapiens
LPNSDALQF

SEQ ID NO: 29813 - protein, 9 aa, Homo Sapiens
APPEALPAD

SEQ ID NO: 29814 - protein, 9 aa, Homo Sapiens
GLLDNSLTA

SEQ ID NO: 29815 - protein, 9 aa, Homo Sapiens
LTDYLIKIL

SEQ ID NO: 29816 - protein, 9 aa, Homo Sapiens
ALRALEGLL

SEQ ID NO: 29817 - protein, 9 aa, Homo Sapiens
PDLPCDVYT

SEQ ID NO: 29818 - protein, 9 aa, Homo Sapiens
CSPLHYKVI

SEQ ID NO: 29819 - protein, 9 aa, Homo Sapiens
FVNPAIWIH

SEQ ID NO: 29820 - protein, 9 aa, Homo Sapiens
IKTDKSVVD

SEQ ID NO: 29821 - protein, 9 aa, Homo Sapiens
KAAIGEEVP

SEQ ID NO: 29822 - protein, 9 aa, Homo Sapiens
TLKTFTPPV

SEQ ID NO: 29823 - protein, 9 aa, Homo Sapiens
NNCSYPPCT

SEQ ID NO: 29824 - protein, 9 aa, Homo Sapiens
VQNEKSIAQ

SEQ ID NO: 29825 - protein, 9 aa, Homo Sapiens
GNLASGLGA

SEQ ID NO: 29826 - protein, 9 aa, Homo Sapiens
DWLPPLGSL

SEQ ID NO: 29827 - protein, 9 aa, Homo Sapiens
AEGPLTGVH

SEQ ID NO: 29828 - protein, 9 aa, Homo Sapiens
QGRVSQRLS

SEQ ID NO: 29829 - protein, 9 aa, Homo Sapiens
RLCTPPTCA

SEQ ID NO: 29830 - protein, 9 aa, Homo Sapiens
GPLVADEVG

SEQ ID NO: 29831 - protein, 9 aa, Homo Sapiens
KGTVLPDLQ

SEQ ID NO: 29832 - protein, 9 aa, Homo Sapiens
LLDNSLTAS

SEQ ID NO: 29833 - protein, 9 aa, Homo Sapiens
GASARRFHF

SEQ ID NO: 29834 - protein, 9 aa, Homo Sapiens
ADEVGALGE

SEQ ID NO: 29835 - protein, 9 aa, Homo Sapiens
GEKLNDFRD

SEQ ID NO: 29836 - protein, 9 aa, Homo Sapiens
LPSIYSLIL

SEQ ID NO: 29837 - protein, 9 aa, Homo Sapiens
AALCGAGPT

SEQ ID NO: 29838 - protein, 9 aa, Homo Sapiens
NQRFHAAHH

SEQ ID NO: 29839 - protein, 9 aa, Homo Sapiens
KFDYELQDV

SEQ ID NO: 29840 - protein, 9 aa, Homo Sapiens
YVDLAPTPG

SEQ ID NO: 29841 - protein, 9 aa, Homo Sapiens
DNDSFLQRV

SEQ ID NO: 29842 - protein, 9 aa, Homo Sapiens
IAIALRNLS

SEQ ID NO: 29843 - protein, 9 aa, Homo Sapiens
RQEKPQSLQ

SEQ ID NO: 29844 - protein, 9 aa, Homo Sapiens
ADLTFVGLL

SEQ ID NO: 29845 - protein, 9 aa, Homo Sapiens
DIQRTLFLG

SEQ ID NO: 29846 - protein, 9 aa, Homo Sapiens
RQWALAIMC

SEQ ID NO: 29847 - protein, 9 aa, Homo Sapiens
LHNKLSVIF

SEQ ID NO: 29848 - protein, 9 aa, Homo Sapiens
KVVRAIAIA

SEQ ID NO: 29849 - protein, 9 aa, Homo Sapiens
QGGAPPEAL

SEQ ID NO: 29850 - protein, 9 aa, Homo Sapiens
RPLGEALAA

SEQ ID NO: 29851 - protein, 9 aa, Homo Sapiens
AVARWRGPT

SEQ ID NO: 29852 - protein, 9 aa, Homo Sapiens
QRLSPRKVS

SEQ ID NO: 29853 - protein, 9 aa, Homo Sapiens
SSTISKKPE

SEQ ID NO: 29854 - protein, 9 aa, Homo Sapiens
TGMSRSWAR

SEQ ID NO: 29855 - protein, 9 aa, Homo Sapiens
RIQCAMKSL

SEQ ID NO: 29856 - protein, 9 aa, Homo Sapiens
WDNHRSAEP

SEQ ID NO: 29857 - protein, 9 aa, Homo Sapiens
VGAAWQVGA

SEQ ID NO: 29858 - protein, 9 aa, Homo Sapiens
QVIRKALTE

SEQ ID NO: 29859 - protein, 9 aa, Homo Sapiens
ATGKPPTLS

SEQ ID NO: 29860 - protein, 9 aa, Homo Sapiens
LSKLKFSGF

SEQ ID NO: 29861 - protein, 9 aa, Homo Sapiens
VARWRGPTG

SEQ ID NO: 29862 - protein, 9 aa, Homo Sapiens
EGLLPGVAA

SEQ ID NO: 29863 - protein, 9 aa, Homo Sapiens
LKILGKKIE

SEQ ID NO: 29864 - protein, 9 aa, Homo Sapiens
PQAVPASSF

SEQ ID NO: 29865 - protein, 9 aa, Homo Sapiens
FSRENFSKD

SEQ ID NO: 29866 - protein, 9 aa, Homo Sapiens
VGEGLAATG

SEQ ID NO: 29867 - protein, 9 aa, Homo Sapiens
RRLEKLGCE

SEQ ID NO: 29868 - protein, 9 aa, Homo Sapiens
NQTYHFQAE

SEQ ID NO: 29869 - protein, 9 aa, Homo Sapiens
KSIVGEVVR

SEQ ID NO: 29870 - protein, 9 aa, Homo Sapiens
LRPVHVEFA

SEQ ID NO: 29871 - protein, 9 aa, Homo Sapiens
FCFSRENFS

SEQ ID NO: 29872 - protein, 9 aa, Homo Sapiens
SARRFHFVY

SEQ ID NO: 29873 - protein, 9 aa, Homo Sapiens
YTQLVRKKH

SEQ ID NO: 29874 - protein, 9 aa, Homo Sapiens
LPADATDVR

SEQ ID NO: 29875 - protein, 9 aa, Homo Sapiens
DYFDIVKIP

SEQ ID NO: 29876 - protein, 9 aa, Homo Sapiens
WASTQTGRM

SEQ ID NO: 29877 - protein, 9 aa, Homo Sapiens
IHVPPTIAD

SEQ ID NO: 29878 - protein, 9 aa, Homo Sapiens
KHEFDADIQ

SEQ ID NO: 29879 - protein, 9 aa, Homo Sapiens
CDHILFVNP

SEQ ID NO: 29880 - protein, 9 aa, Homo Sapiens
GAVAEGLAT

SEQ ID NO: 29881 - protein, 9 aa, Homo Sapiens
VGAGVDGQH

SEQ ID NO: 29882 - protein, 9 aa, Homo Sapiens
KCTIFVVDE

SEQ ID NO: 29883 - protein, 9 aa, Homo Sapiens
GAAEALAAH

SEQ ID NO: 29884 - protein, 9 aa, Homo Sapiens
ELSVLGFIS

SEQ ID NO: 29885 - protein, 9 aa, Homo Sapiens
GDHLSTMYD

SEQ ID NO: 29886 - protein, 9 aa, Homo Sapiens
EEQTQINLN

SEQ ID NO: 29887 - protein, 9 aa, Homo Sapiens
RKNWNSSDC

SEQ ID NO: 29888 - protein, 9 aa, Homo Sapiens
TDAAVTINQ

SEQ ID NO: 29889 - protein, 9 aa, Homo Sapiens
LAGPSAGQL

SEQ ID NO: 29890 - protein, 9 aa, Homo Sapiens
HRLYQVTIH

SEQ ID NO: 29891 - protein, 9 aa, Homo Sapiens
CGAGPTRRN

SEQ ID NO: 29892 - protein, 9 aa, Homo Sapiens
GGLSLCSVF

SEQ ID NO: 29893 - protein, 9 aa, Homo Sapiens
STDLEETLE

SEQ ID NO: 29894 - protein, 9 aa, Homo Sapiens
TAQLLPRLE

SEQ ID NO: 29895 - protein, 9 aa, Homo Sapiens
TGKPPTLSK

SEQ ID NO: 29896 - protein, 9 aa, Homo Sapiens
KLYQSARAW

SEQ ID NO: 29897 - protein, 9 aa, Homo Sapiens
SSFRQRPSS

SEQ ID NO: 29898 - protein, 9 aa, Homo Sapiens
DSDHKDQLI

SEQ ID NO: 29899 - protein, 9 aa, Homo Sapiens
EHRGHVEWP

SEQ ID NO: 29900 - protein, 9 aa, Homo Sapiens
FSTTDCKAQ

SEQ ID NO: 29901 - protein, 9 aa, Homo Sapiens
HLKRWPYGQ

SEQ ID NO: 29902 - protein, 9 aa, Homo Sapiens
AAQRQWALA

SEQ ID NO: 29903 - protein, 9 aa, Homo Sapiens
EVGAVAEGL

SEQ ID NO: 29904 - protein, 9 aa, Homo Sapiens
LAGLPAHLR

SEQ ID NO: 29905 - protein, 9 aa, Homo Sapiens
LAAHGAPVG

SEQ ID NO: 29906 - protein, 9 aa, Homo Sapiens
VPSKVIGDH

SEQ ID NO: 29907 - protein, 9 aa, Homo Sapiens
SRFMAYRKP

SEQ ID NO: 29908 - protein, 9 aa, Homo Sapiens
QPGASPSRE

SEQ ID NO: 29909 - protein, 9 aa, Homo Sapiens
GVFPCQHSP

SEQ ID NO: 29910 - protein, 9 aa, Homo Sapiens
CTPPTCAPR

SEQ ID NO: 29911 - protein, 9 aa, Homo Sapiens
NVFDNDSFL

SEQ ID NO: 29912 - protein, 9 aa, Homo Sapiens
ASTQTGRMR

SEQ ID NO: 29913 - protein, 9 aa, Homo Sapiens
CGLLPFFST

SEQ ID NO: 29914 - protein, 9 aa, Homo Sapiens
NDSDRYSHN

SEQ ID NO: 29915 - protein, 9 aa, Homo Sapiens
SEGLRDWLP

SEQ ID NO: 29916 - protein, 9 aa, Homo Sapiens
CSPQKVKSK

SEQ ID NO: 29917 - protein, 9 aa, Homo Sapiens
KGRPLGEAL

SEQ ID NO: 29918 - protein, 9 aa, Homo Sapiens
KHKAQHRCM

SEQ ID NO: 29919 - protein, 9 aa, Homo Sapiens
CKISLSSLC

SEQ ID NO: 29920 - protein, 9 aa, Homo Sapiens
MAAQRQWAL

SEQ ID NO: 29921 - protein, 9 aa, Homo Sapiens
ATAEGPLTG

SEQ ID NO: 29922 - protein, 9 aa, Homo Sapiens
SRENFSKDL

SEQ ID NO: 29923 - protein, 9 aa, Homo Sapiens
LVAVGALVS

SEQ ID NO: 29924 - protein, 9 aa, Homo Sapiens
EVGALGEGL

SEQ ID NO: 29925 - protein, 9 aa, Homo Sapiens
GGGSSLSSS

SEQ ID NO: 29926 - protein, 9 aa, Homo Sapiens
STIYEVTGK

SEQ ID NO: 29927 - protein, 9 aa, Homo Sapiens
VKALQYVNV

SEQ ID NO: 29928 - protein, 9 aa, Homo Sapiens
QGFKDKTRA

SEQ ID NO: 29929 - protein, 9 aa, Homo Sapiens
NYIQAADKR

SEQ ID NO: 29930 - protein, 9 aa, Homo Sapiens
AIALAALGA

SEQ ID NO: 29931 - protein, 9 aa, Homo Sapiens
SDSENDRSY

SEQ ID NO: 29932 - protein, 9 aa, Homo Sapiens
GMSRSWARL

SEQ ID NO: 29933 - protein, 9 aa, Homo Sapiens
LIPCDRVVC

SEQ ID NO: 29934 - protein, 9 aa, Homo Sapiens
AGSPAFSST

SEQ ID NO: 29935 - protein, 9 aa, Homo Sapiens
AIGEEVPRT

SEQ ID NO: 29936 - protein, 9 aa, Homo Sapiens
EEVRLFFLL

SEQ ID NO: 29937 - protein, 9 aa, Homo Sapiens
YLPYDYVCK

SEQ ID NO: 29938 - protein, 9 aa, Homo Sapiens
TPPTCAPRN

SEQ ID NO: 29939 - protein, 9 aa, Homo Sapiens
SGLSSHKQG

SEQ ID NO: 29940 - protein, 9 aa, Homo Sapiens
MINSIAEDG

SEQ ID NO: 29941 - protein, 9 aa, Homo Sapiens
VQKHLRTFL

SEQ ID NO: 29942 - protein, 9 aa, Homo Sapiens
SMAAQRQWA

SEQ ID NO: 29943 - protein, 9 aa, Homo Sapiens
RYAPDLPCD

SEQ ID NO: 29944 - protein, 9 aa, Homo Sapiens
DLYEKGPDS

SEQ ID NO: 29945 - protein, 9 aa, Homo Sapiens
HLRTFLEFG

SEQ ID NO: 29946 - protein, 9 aa, Homo Sapiens
HVVDWPFDD

SEQ ID NO: 29947 - protein, 9 aa, Homo Sapiens
PSRQPCLIS

SEQ ID NO: 29948 - protein, 9 aa, Homo Sapiens
TGLLCMEEL

SEQ ID NO: 29949 - protein, 9 aa, Homo Sapiens
PLVAVGALV

SEQ ID NO: 29950 - protein, 9 aa, Homo Sapiens
SNRSTAYVG

SEQ ID NO: 29951 - protein, 9 aa, Homo Sapiens
NSYGDIQRT

SEQ ID NO: 29952 - protein, 9 aa, Homo Sapiens
RFIARAPGF

SEQ ID NO: 29953 - protein, 9 aa, Homo Sapiens
EPNSTDLEE

SEQ ID NO: 29954 - protein, 9 aa, Homo Sapiens
ARVSALVAK

SEQ ID NO: 29955 - protein, 9 aa, Homo Sapiens
EAQKEPVSL

SEQ ID NO: 29956 - protein, 9 aa, Homo Sapiens
ALPCTLGLR

SEQ ID NO: 29957 - protein, 9 aa, Homo Sapiens
GRGGSGPAL

SEQ ID NO: 29958 - protein, 9 aa, Homo Sapiens
LRALEGLLP

SEQ ID NO: 29959 - protein, 9 aa, Homo Sapiens
GVTSPSNDE

SEQ ID NO: 29960 - protein, 9 aa, Homo Sapiens
LIVEHNWFD

SEQ ID NO: 29961 - protein, 9 aa, Homo Sapiens
ARWRGPTGP

SEQ ID NO: 29962 - protein, 9 aa, Homo Sapiens
GAGVDGQHR

SEQ ID NO: 29963 - protein, 9 aa, Homo Sapiens
ALAAHGAPV

SEQ ID NO: 29964 - protein, 9 aa, Homo Sapiens
QTQINLNCT

SEQ ID NO: 29965 - protein, 9 aa, Homo Sapiens
PNGPDCGHG

SEQ ID NO: 29966 - protein, 9 aa, Homo Sapiens
LASEIMPLP

SEQ ID NO: 29967 - protein, 9 aa, Homo Sapiens
GLEFLSVPF

SEQ ID NO: 29968 - protein, 9 aa, Homo Sapiens
EIMPLPQWI

SEQ ID NO: 29969 - protein, 9 aa, Homo Sapiens
PHYIPRRWG

SEQ ID NO: 29970 - protein, 9 aa, Homo Sapiens
NLYQLKNQI

SEQ ID NO: 29971 - protein, 9 aa, Homo Sapiens
EDGWVTDYF

SEQ ID NO: 29972 - protein, 9 aa, Homo Sapiens
PFHVASPER

SEQ ID NO: 29973 - protein, 9 aa, Homo Sapiens
QPGGLSLCS

SEQ ID NO: 29974 - protein, 9 aa, Homo Sapiens
AVGPLVAVG

SEQ ID NO: 29975 - protein, 9 aa, Homo Sapiens
KKLIKTDKS

SEQ ID NO: 29976 - protein, 9 aa, Homo Sapiens
LSLASEIMP

SEQ ID NO: 29977 - protein, 9 aa, Homo Sapiens
IQAADKRKA

SEQ ID NO: 29978 - protein, 9 aa, Homo Sapiens
PTEEKPGSP

SEQ ID NO: 29979 - protein, 9 aa, Homo Sapiens
GGPPGTGLA

SEQ ID NO: 29980 - protein, 9 aa, Homo Sapiens
PRALPTPGP

SEQ ID NO: 29981 - protein, 9 aa, Homo Sapiens
RIGAMLAYS

SEQ ID NO: 29982 - protein, 9 aa, Homo Sapiens
NSNRSTAYV

SEQ ID NO: 29983 - protein, 9 aa, Homo Sapiens
LAALGAAVG

SEQ ID NO: 29984 - protein, 9 aa, Homo Sapiens
TGLAFPPPA

SEQ ID NO: 29985 - protein, 9 aa, Homo Sapiens
APDLPCDVY

SEQ ID NO: 29986 - protein, 9 aa, Homo Sapiens
LWQRASTTA

SEQ ID NO: 29987 - protein, 9 aa, Homo Sapiens
YGQVPCGLL

SEQ ID NO: 29988 - protein, 9 aa, Homo Sapiens
VIRKALTEE

SEQ ID NO: 29989 - protein, 9 aa, Homo Sapiens
VSQEVGAVA

SEQ ID NO: 29990 - protein, 9 aa, Homo Sapiens
RHVAPHTGA

SEQ ID NO: 29991 - protein, 9 aa, Homo Sapiens
VNPAIWIHT

SEQ ID NO: 29992 - protein, 9 aa, Homo Sapiens
LQGQLGSLG

SEQ ID NO: 29993 - protein, 9 aa, Homo Sapiens
GLRLKQQAR

SEQ ID NO: 29994 - protein, 9 aa, Homo Sapiens
KEPLEVSEL

SEQ ID NO: 29995 - protein, 9 aa, Homo Sapiens
SLSSSSSQQ

SEQ ID NO: 29996 - protein, 9 aa, Homo Sapiens
WALGFELSV

SEQ ID NO: 29997 - protein, 9 aa, Homo Sapiens
TDKSVVDRA

SEQ ID NO: 29998 - protein, 9 aa, Homo Sapiens
PPLSSAALC

SEQ ID NO: 29999 - protein, 9 aa, Homo Sapiens
APDLLLAEA

SEQ ID NO: 30000 - protein, 9 aa, Homo Sapiens
QPCLISPYH

SEQ ID NO: 30001 - protein, 9 aa, Homo Sapiens
EKPGSPWSG

SEQ ID NO: 30002 - protein, 9 aa, Homo Sapiens
IPMDLSTIK

SEQ ID NO: 30003 - protein, 9 aa, Homo Sapiens
MWALVGLLA

SEQ ID NO: 30004 - protein, 9 aa, Homo Sapiens
QRASTTAAW

SEQ ID NO: 30005 - protein, 9 aa, Homo Sapiens
GFLSFLLLS

SEQ ID NO: 30006 - protein, 9 aa, Homo Sapiens
GDKGRPLGE

SEQ ID NO: 30007 - protein, 9 aa, Homo Sapiens
SKNATGNLA

SEQ ID NO: 30008 - protein, 9 aa, Homo Sapiens
RQHSLHLRQ

SEQ ID NO: 30009 - protein, 9 aa, Homo Sapiens
ESLKVQNEK

SEQ ID NO: 30010 - protein, 9 aa, Homo Sapiens
LVGLLARVS

SEQ ID NO: 30011 - protein, 9 aa, Homo Sapiens
SPLHYKVIM

SEQ ID NO: 30012 - protein, 9 aa, Homo Sapiens
PGGLSLCSV

SEQ ID NO: 30013 - protein, 9 aa, Homo Sapiens
LGKKIEAPP

SEQ ID NO: 30014 - protein, 9 aa, Homo Sapiens
PGTSAKTPS

SEQ ID NO: 30015 - protein, 9 aa, Homo Sapiens
VFDEAHSID

SEQ ID NO: 30016 - protein, 9 aa, Homo Sapiens
APTPGTSAK

SEQ ID NO: 30017 - protein, 9 aa, Homo Sapiens
LVNIKYDTA

SEQ ID NO: 30018 - protein, 9 aa, Homo Sapiens
CTGMSRSWA

SEQ ID NO: 30019 - protein, 9 aa, Homo Sapiens
TGVHPLMAA

SEQ ID NO: 30020 - protein, 9 aa, Homo Sapiens
FTKGTVLPD

SEQ ID NO: 30021 - protein, 9 aa, Homo Sapiens
VAEGLATMW

SEQ ID NO: 30022 - protein, 9 aa, Homo Sapiens
AASRALDDV

SEQ ID NO: 30023 - protein, 9 aa, Homo Sapiens
MEELSKKDK

SEQ ID NO: 30024 - protein, 9 aa, Homo Sapiens
AVPASSFRQ

SEQ ID NO: 30025 - protein, 9 aa, Homo Sapiens
PLHYKVIMS

SEQ ID NO: 30026 - protein, 9 aa, Homo Sapiens
RAVGEGLAA

SEQ ID NO: 30027 - protein, 9 aa, Homo Sapiens
DKVVRAIAI

SEQ ID NO: 30028 - protein, 9 aa, Homo Sapiens
TVKENLYQL

SEQ ID NO: 30029 - protein, 9 aa, Homo Sapiens
VTHNQTYHF

SEQ ID NO: 30030 - protein, 9 aa, Homo Sapiens
VRAVGEGLA

SEQ ID NO: 30031 - protein, 9 aa, Homo Sapiens
FDNDSFLQR

SEQ ID NO: 30032 - protein, 9 aa, Homo Sapiens
RRWGKPYNY

SEQ ID NO: 30033 - protein, 9 aa, Homo Sapiens
EEESFSLCS

SEQ ID NO: 30034 - protein, 9 aa, Homo Sapiens
RQVPSKVIG

SEQ ID NO: 30035 - protein, 9 aa, Homo Sapiens
LWDELYVGF

SEQ ID NO: 30036 - protein, 9 aa, Homo Sapiens
FTLTDSTKS

SEQ ID NO: 30037 - protein, 9 aa, Homo Sapiens
DEEPNSTDL

SEQ ID NO: 30038 - protein, 9 aa, Homo Sapiens
PDYFDIVKI

SEQ ID NO: 30039 - protein, 9 aa, Homo Sapiens
PFGITKEAM

SEQ ID NO: 30040 - protein, 9 aa, Homo Sapiens
THISRCKIS

SEQ ID NO: 30041 - protein, 9 aa, Homo Sapiens
LQKRGGAAE

SEQ ID NO: 30042 - protein, 9 aa, Homo Sapiens
DLEPGLGHF

SEQ ID NO: 30043 - protein, 9 aa, Homo Sapiens
VDQPGGLSL

SEQ ID NO: 30044 - protein, 9 aa, Homo Sapiens
PVPILIPCD

SEQ ID NO: 30045 - protein, 9 aa, Homo Sapiens
AWQVGAGVD

SEQ ID NO: 30046 - protein, 9 aa, Homo Sapiens
ESGGAIEGL

SEQ ID NO: 30047 - protein, 9 aa, Homo Sapiens
CAPRNTCRR

SEQ ID NO: 30048 - protein, 9 aa, Homo Sapiens
LCRLRQEKP

SEQ ID NO: 30049 - protein, 9 aa, Homo Sapiens
KHLKLRCRQ

SEQ ID NO: 30050 - protein, 9 aa, Homo Sapiens
SAALCGAGP

SEQ ID NO: 30051 - protein, 9 aa, Homo Sapiens
QAYVGWPCL

SEQ ID NO: 30052 - protein, 9 aa, Homo Sapiens
VRSKYNSDW

SEQ ID NO: 30053 - protein, 9 aa, Homo Sapiens
RYGLYNSPF

SEQ ID NO: 30054 - protein, 9 aa, Homo Sapiens
LRQGLLDNS

SEQ ID NO: 30055 - protein, 9 aa, Homo Sapiens
AAVTINQTV

SEQ ID NO: 30056 - protein, 9 aa, Homo Sapiens
DPSRQPCLI

SEQ ID NO: 30057 - protein, 9 aa, Homo Sapiens
SQINAASRA

SEQ ID NO: 30058 - protein, 9 aa, Homo Sapiens
GLLWDELYV

SEQ ID NO: 30059 - protein, 9 aa, Homo Sapiens
KPPTLSKGL

SEQ ID NO: 30060 - protein, 9 aa, Homo Sapiens
HILFVNPAI

SEQ ID NO: 30061 - protein, 9 aa, Homo Sapiens
RSWARLCTP

SEQ ID NO: 30062 - protein, 9 aa, Homo Sapiens
QGFLSFLLL

SEQ ID NO: 30063 - protein, 9 aa, Homo Sapiens
KQHSCPHCS

SEQ ID NO: 30064 - protein, 9 aa, Homo Sapiens
VTYTPLLGS

SEQ ID NO: 30065 - protein, 9 aa, Homo Sapiens
GVQGVNSYG

SEQ ID NO: 30066 - protein, 9 aa, Homo Sapiens
IQQHIERFT

SEQ ID NO: 30067 - protein, 9 aa, Homo Sapiens
MLQKRGGAA

SEQ ID NO: 30068 - protein, 9 aa, Homo Sapiens
KEPVSLQEA

SEQ ID NO: 30069 - protein, 9 aa, Homo Sapiens
NWNSSDCLH

SEQ ID NO: 30070 - protein, 9 aa, Homo Sapiens
SVPQSTGEL

SEQ ID NO: 30071 - protein, 9 aa, Homo Sapiens
EIGITPLIL

SEQ ID NO: 30072 - protein, 9 aa, Homo Sapiens
GQAYVGWPC

SEQ ID NO: 30073 - protein, 9 aa, Homo Sapiens
LPGVAAGMG

SEQ ID NO: 30074 - protein, 9 aa, Homo Sapiens
STQTGRMRR

SEQ ID NO: 30075 - protein, 9 aa, Homo Sapiens
HLKLRCRQQ

SEQ ID NO: 30076 - protein, 9 aa, Homo Sapiens
SLASEIMPL

SEQ ID NO: 30077 - protein, 9 aa, Homo Sapiens
TQLVRKKHK

SEQ ID NO: 30078 - protein, 9 aa, Homo Sapiens
FLEFGTLSF

SEQ ID NO: 30079 - protein, 9 aa, Homo Sapiens
KISLSSLCC

SEQ ID NO: 30080 - protein, 9 aa, Homo Sapiens
CTLGLRMLL

SEQ ID NO: 30081 - protein, 9 aa, Homo Sapiens
SLDSDHKDQ

SEQ ID NO: 30082 - protein, 9 aa, Homo Sapiens
PTRNDLEPG

SEQ ID NO: 30083 - protein, 9 aa, Homo Sapiens
TSPINPQYM

SEQ ID NO: 30084 - protein, 9 aa, Homo Sapiens
IMEGVFPCQ

SEQ ID NO: 30085 - protein, 9 aa, Homo Sapiens
PLVADEVGA

SEQ ID NO: 30086 - protein, 9 aa, Homo Sapiens
DHKDQLIEV

SEQ ID NO: 30087 - protein, 9 aa, Homo Sapiens
EGPLTGVHP

SEQ ID NO: 30088 - protein, 9 aa, Homo Sapiens
GFKDKTRAG

SEQ ID NO: 30089 - protein, 9 aa, Homo Sapiens
MGDKGRPLG

SEQ ID NO: 30090 - protein, 9 aa, Homo Sapiens
LSRRLDLQE

SEQ ID NO: 30091 - protein, 9 aa, Homo Sapiens
VGAVAEGLA

SEQ ID NO: 30092 - protein, 9 aa, Homo Sapiens
LVKKRNQKT

SEQ ID NO: 30093 - protein, 9 aa, Homo Sapiens
SVPEHFTLT

SEQ ID NO: 30094 - protein, 9 aa, Homo Sapiens
PLPRPDPQR

SEQ ID NO: 30095 - protein, 9 aa, Homo Sapiens
GRDLTDYLI

SEQ ID NO: 30096 - protein, 9 aa, Homo Sapiens
TSRFMAYRK

SEQ ID NO: 30097 - protein, 9 aa, Homo Sapiens
FLNVFGLPS

SEQ ID NO: 30098 - protein, 9 aa, Homo Sapiens
LMDEFPKAE

SEQ ID NO: 30099 - protein, 9 aa, Homo Sapiens
LFYHLQREP

SEQ ID NO: 30100 - protein, 9 aa, Homo Sapiens
DLTFVGLLT

SEQ ID NO: 30101 - protein, 9 aa, Homo Sapiens
QNIFLVFRA

SEQ ID NO: 30102 - protein, 9 aa, Homo Sapiens
RRWLCTGMS

SEQ ID NO: 30103 - protein, 9 aa, Homo Sapiens
EPERQYMHT

SEQ ID NO: 30104 - protein, 9 aa, Homo Sapiens
TAEGPLTGV

SEQ ID NO: 30105 - protein, 9 aa, Homo Sapiens
HEVQLLAAW

SEQ ID NO: 30106 - protein, 9 aa, Homo Sapiens
ATGNLASGL

SEQ ID NO: 30107 - protein, 9 aa, Homo Sapiens
SALVAKQVR

SEQ ID NO: 30108 - protein, 9 aa, Homo Sapiens
YMLQGVAQL

SEQ ID NO: 30109 - protein, 9 aa, Homo Sapiens
TCAPRNTCR

SEQ ID NO: 30110 - protein, 9 aa, Homo Sapiens
LTGVHPLMA

SEQ ID NO: 30111 - protein, 9 aa, Homo Sapiens
TNNCSYPPC

SEQ ID NO: 30112 - protein, 9 aa, Homo Sapiens
RSVVYLPYD

SEQ ID NO: 30113 - protein, 9 aa, Homo Sapiens
PEPRPTEEK

SEQ ID NO: 30114 - protein, 9 aa, Homo Sapiens
LRQEKPQSL

SEQ ID NO: 30115 - protein, 9 aa, Homo Sapiens
WGSDLSDIM

SEQ ID NO: 30116 - protein, 9 aa, Homo Sapiens
STSNGWCFI

SEQ ID NO: 30117 - protein, 9 aa, Homo Sapiens
SSSSMFQEF

SEQ ID NO: 30118 - protein, 9 aa, Homo Sapiens
DPDCIAFIH

SEQ ID NO: 30119 - protein, 9 aa, Homo Sapiens
SPLAGPSAG

SEQ ID NO: 30120 - protein, 9 aa, Homo Sapiens
NLDACQNGM

SEQ ID NO: 30121 - protein, 9 aa, Homo Sapiens
LPFFSTSNG

SEQ ID NO: 30122 - protein, 9 aa, Homo Sapiens
LQTRYGLYN

SEQ ID NO: 30123 - protein, 9 aa, Homo Sapiens
FFSTSNGWC

SEQ ID NO: 30124 - protein, 9 aa, Homo Sapiens
FDTFIIFMI

SEQ ID NO: 30125 - protein, 9 aa, Homo Sapiens
LKRWPYGQV

SEQ ID NO: 30126 - protein, 9 aa, Homo Sapiens
PPARREVAR

SEQ ID NO: 30127 - protein, 9 aa, Homo Sapiens
DENPCGVDS

SEQ ID NO: 30128 - protein, 9 aa, Homo Sapiens
DPQRGSPGL

SEQ ID NO: 30129 - protein, 9 aa, Homo Sapiens
DCGHGSFHQ

SEQ ID NO: 30130 - protein, 9 aa, Homo Sapiens
FLPGEKLND

SEQ ID NO: 30131 - protein, 9 aa, Homo Sapiens
IAQDCKTDL

SEQ ID NO: 30132 - protein, 9 aa, Homo Sapiens
LGHNVFDND

SEQ ID NO: 30133 - protein, 9 aa, Homo Sapiens
VEFASHGDR

SEQ ID NO: 30134 - protein, 9 aa, Homo Sapiens
EVRLFFLLH

SEQ ID NO: 30135 - protein, 9 aa, Homo Sapiens
AQNRIQCAM

SEQ ID NO: 30136 - protein, 9 aa, Homo Sapiens
RRSEEGSFS

SEQ ID NO: 30137 - protein, 9 aa, Homo Sapiens
LNQMINSIA

SEQ ID NO: 30138 - protein, 9 aa, Homo Sapiens
IQTDIDLTK

SEQ ID NO: 30139 - protein, 9 aa, Homo Sapiens
RALGEGLAA

SEQ ID NO: 30140 - protein, 9 aa, Homo Sapiens
KLCPADPDC

SEQ ID NO: 30141 - protein, 9 aa, Homo Sapiens
LLVNCDWDN

SEQ ID NO: 30142 - protein, 9 aa, Homo Sapiens
LCSDQTSYL

SEQ ID NO: 30143 - protein, 9 aa, Homo Sapiens
IPCDRVVCS

SEQ ID NO: 30144 - protein, 9 aa, Homo Sapiens
SVIFPLWKL

SEQ ID NO: 30145 - protein, 9 aa, Homo Sapiens
GAIEGLAAV

SEQ ID NO: 30146 - protein, 9 aa, Homo Sapiens
KNDLYEKGP

SEQ ID NO: 30147 - protein, 9 aa, Homo Sapiens
LYQVTIHVP

SEQ ID NO: 30148 - protein, 9 aa, Homo Sapiens
YFDDIGPSV

SEQ ID NO: 30149 - protein, 9 aa, Homo Sapiens
LTDSTKSGV

SEQ ID NO: 30150 - protein, 9 aa, Homo Sapiens
EGIHVVDWP

SEQ ID NO: 30151 - protein, 9 aa, Homo Sapiens
GGTAQLLPR

SEQ ID NO: 30152 - protein, 9 aa, Homo Sapiens
TTAAWASTQ

SEQ ID NO: 30153 - protein, 9 aa, Homo Sapiens
KDEQDIVHI

SEQ ID NO: 30154 - protein, 9 aa, Homo Sapiens
TGNEEQTQI

SEQ ID NO: 30155 - protein, 9 aa, Homo Sapiens
PPPHPAADS

SEQ ID NO: 30156 - protein, 9 aa, Homo Sapiens
LMALVKKRN

SEQ ID NO: 30157 - protein, 9 aa, Homo Sapiens
PSRTASQTP

SEQ ID NO: 30158 - protein, 9 aa, Homo Sapiens
TGAHPATAP

SEQ ID NO: 30159 - protein, 9 aa, Homo Sapiens
SDVLWQRAS

SEQ ID NO: 30160 - protein, 9 aa, Homo Sapiens
DAAVTINQT

SEQ ID NO: 30161 - protein, 9 aa, Homo Sapiens
GLPSIYSLI

SEQ ID NO: 30162 - protein, 9 aa, Homo Sapiens
LSAQGFLSF

SEQ ID NO: 30163 - protein, 9 aa, Homo Sapiens
YGRGWDLMQ

SEQ ID NO: 30164 - protein, 9 aa, Homo Sapiens
GWVTDYFSQ

SEQ ID NO: 30165 - protein, 9 aa, Homo Sapiens
LSMEEGSGQ

SEQ ID NO: 30166 - protein, 9 aa, Homo Sapiens
FNSTIYEVT

SEQ ID NO: 30167 - protein, 9 aa, Homo Sapiens
LSSHKQGHT

SEQ ID NO: 30168 - protein, 9 aa, Homo Sapiens
DQPGGLSLC

SEQ ID NO: 30169 - protein, 9 aa, Homo Sapiens
DATDVRPRA

SEQ ID NO: 30170 - protein, 9 aa, Homo Sapiens
RRLDLQEQM

SEQ ID NO: 30171 - protein, 9 aa, Homo Sapiens
AETIYLDTC

SEQ ID NO: 30172 - protein, 9 aa, Homo Sapiens
GDPSRQPCL

SEQ ID NO: 30173 - protein, 9 aa, Homo Sapiens
WDELYVGFQ

SEQ ID NO: 30174 - protein, 9 aa, Homo Sapiens
GTSCRCWQL

SEQ ID NO: 30175 - protein, 9 aa, Homo Sapiens
PTPGTSAKT

SEQ ID NO: 30176 - protein, 9 aa, Homo Sapiens
EVRALGEGL

SEQ ID NO: 30177 - protein, 9 aa, Homo Sapiens
TCGSNGSLY

SEQ ID NO: 30178 - protein, 9 aa, Homo Sapiens
PRPTEEKPG

SEQ ID NO: 30179 - protein, 9 aa, Homo Sapiens
ENNYIQAAD

SEQ ID NO: 30180 - protein, 9 aa, Homo Sapiens
KGQGGPPGT

SEQ ID NO: 30181 - protein, 9 aa, Homo Sapiens
SPLDEKSLA

SEQ ID NO: 30182 - protein, 9 aa, Homo Sapiens
NRGFARRIY

SEQ ID NO: 30183 - protein, 9 aa, Homo Sapiens
SMFSAVRED

SEQ ID NO: 30184 - protein, 9 aa, Homo Sapiens
STAVLSAQG

SEQ ID NO: 30185 - protein, 9 aa, Homo Sapiens
KLEEGLVNI

SEQ ID NO: 30186 - protein, 9 aa, Homo Sapiens
YEVTGKSQP

SEQ ID NO: 30187 - protein, 9 aa, Homo Sapiens
TALLLQGQL

SEQ ID NO: 30188 - protein, 9 aa, Homo Sapiens
WALAIMCRV

SEQ ID NO: 30189 - protein, 9 aa, Homo Sapiens
LHLVLPRRS

SEQ ID NO: 30190 - protein, 9 aa, Homo Sapiens
THPYGRGWD

SEQ ID NO: 30191 - protein, 9 aa, Homo Sapiens
QTPPFLLLL

SEQ ID NO: 30192 - protein, 9 aa, Homo Sapiens
PPNGPDCGH

SEQ ID NO: 30193 - protein, 9 aa, Homo Sapiens
SAEGKKAFA

SEQ ID NO: 30194 - protein, 9 aa, Homo Sapiens
FSLCSDQTS

SEQ ID NO: 30195 - protein, 9 aa, Homo Sapiens
GFISRALRF

SEQ ID NO: 30196 - protein, 9 aa, Homo Sapiens
GPLTGVHPL

SEQ ID NO: 30197 - protein, 9 aa, Homo Sapiens
HNVFDNDSF

SEQ ID NO: 30198 - protein, 9 aa, Homo Sapiens
TDKVVRAIA

SEQ ID NO: 30199 - protein, 9 aa, Homo Sapiens
PRRSEEGSF

SEQ ID NO: 30200 - protein, 9 aa, Homo Sapiens
CSDQTSYLS

SEQ ID NO: 30201 - protein, 9 aa, Homo Sapiens
TGRMRRWLC

SEQ ID NO: 30202 - protein, 9 aa, Homo Sapiens
SEIMPLPQW

SEQ ID NO: 30203 - protein, 9 aa, Homo Sapiens
QVPVLQHNT

SEQ ID NO: 30204 - protein, 9 aa, Homo Sapiens
PGFIPGAPR

SEQ ID NO: 30205 - protein, 9 aa, Homo Sapiens
AGLPAHLRQ

SEQ ID NO: 30206 - protein, 9 aa, Homo Sapiens
TGELTVRAK

SEQ ID NO: 30207 - protein, 9 aa, Homo Sapiens
MTNNCSYPP

SEQ ID NO: 30208 - protein, 9 aa, Homo Sapiens
CHAHDCCYR

SEQ ID NO: 30209 - protein, 9 aa, Homo Sapiens
EFGTLSFKF

SEQ ID NO: 30210 - protein, 9 aa, Homo Sapiens
RHPGYLSGK

SEQ ID NO: 30211 - protein, 9 aa, Homo Sapiens
QVPCGLLPK

SEQ ID NO: 30212 - protein, 9 aa, Homo Sapiens
GWLLESGCP

SEQ ID NO: 30213 - protein, 9 aa, Homo Sapiens
YVHPDSRAT

SEQ ID NO: 30214 - protein, 9 aa, Homo Sapiens
GGSSLSSSS

SEQ ID NO: 30215 - protein, 9 aa, Homo Sapiens
SSALTDHDP

SEQ ID NO: 30216 - protein, 9 aa, Homo Sapiens
HPLMAAQGR

SEQ ID NO: 30217 - protein, 9 aa, Homo Sapiens
GLAADLTFV

SEQ ID NO: 30218 - protein, 9 aa, Homo Sapiens
CIYCPRGNR

SEQ ID NO: 30219 - protein, 9 aa, Homo Sapiens
KAETIYLDT

SEQ ID NO: 30220 - protein, 9 aa, Homo Sapiens
QRFHAAHHK

SEQ ID NO: 30221 - protein, 9 aa, Homo Sapiens
GLATMWALV

SEQ ID NO: 30222 - protein, 9 aa, Homo Sapiens
SEMLVVPEQ

SEQ ID NO: 30223 - protein, 9 aa, Homo Sapiens
ICSPLHYKV

SEQ ID NO: 30224 - protein, 9 aa, Homo Sapiens
NKLSVIFPL

SEQ ID NO: 30225 - protein, 9 aa, Homo Sapiens
ESSWGSDLS

SEQ ID NO: 30226 - protein, 9 aa, Homo Sapiens
RVLAIALAA

SEQ ID NO: 30227 - protein, 9 aa, Homo Sapiens
VEFRNNYEE

SEQ ID NO: 30228 - protein, 9 aa, Homo Sapiens
IGAMLAYSP

SEQ ID NO: 30229 - protein, 9 aa, Homo Sapiens
CLHLNPDNF

SEQ ID NO: 30230 - protein, 9 aa, Homo Sapiens
VFTKGTVLP

SEQ ID NO: 30231 - protein, 9 aa, Homo Sapiens
DCLHLNPDN

SEQ ID NO: 30232 - protein, 9 aa, Homo Sapiens
IARALGFIP

SEQ ID NO: 30233 - protein, 9 aa, Homo Sapiens
WALVNFLLP

SEQ ID NO: 30234 - protein, 9 aa, Homo Sapiens
LLLYVTYTP

SEQ ID NO: 30235 - protein, 9 aa, Homo Sapiens
LLLAEADLP

SEQ ID NO: 30236 - protein, 9 aa, Homo Sapiens
QSTGELTVR

SEQ ID NO: 30237 - protein, 9 aa, Homo Sapiens
LPDLQETSL

SEQ ID NO: 30238 - protein, 9 aa, Homo Sapiens
DIQYEYFNA

SEQ ID NO: 30239 - protein, 9 aa, Homo Sapiens
KAYLLHTTC

SEQ ID NO: 30240 - protein, 9 aa, Homo Sapiens
ELWALVNFL

SEQ ID NO: 30241 - protein, 9 aa, Homo Sapiens
WNSSDCLHL

SEQ ID NO: 30242 - protein, 9 aa, Homo Sapiens
QYVNVRLRD

SEQ ID NO: 30243 - protein, 9 aa, Homo Sapiens
NSDALQFQT

SEQ ID NO: 30244 - protein, 9 aa, Homo Sapiens
RHLKLNTEV

SEQ ID NO: 30245 - protein, 9 aa, Homo Sapiens
VGCRGSCTL

SEQ ID NO: 30246 - protein, 9 aa, Homo Sapiens
KAGVQLGTN

SEQ ID NO: 30247 - protein, 9 aa, Homo Sapiens
CMGDLFSTT

SEQ ID NO: 30248 - protein, 9 aa, Homo Sapiens
DARKFFPCF

SEQ ID NO: 30249 - protein, 9 aa, Homo Sapiens
ENPCGVDSE

SEQ ID NO: 30250 - protein, 9 aa, Homo Sapiens
PTPGPATPP

SEQ ID NO: 30251 - protein, 9 aa, Homo Sapiens
LCGLLPFFS

SEQ ID NO: 30252 - protein, 9 aa, Homo Sapiens
HPYGRGWDL

SEQ ID NO: 30253 - protein, 9 aa, Homo Sapiens
SVPFTYYKQ

SEQ ID NO: 30254 - protein, 9 aa, Homo Sapiens
EGLATMWAL

SEQ ID NO: 30255 - protein, 9 aa, Homo Sapiens
LAYYYKCHE

SEQ ID NO: 30256 - protein, 9 aa, Homo Sapiens
QMEKANAPM

SEQ ID NO: 30257 - protein, 9 aa, Homo Sapiens
NSIAEDGSN

SEQ ID NO: 30258 - protein, 9 aa, Homo Sapiens
ASTTAAWAS

SEQ ID NO: 30259 - protein, 9 aa, Homo Sapiens
QVGAGVDGQ

SEQ ID NO: 30260 - protein, 9 aa, Homo Sapiens
EDIFRISSM

SEQ ID NO: 30261 - protein, 9 aa, Homo Sapiens
ADATDVRPR

SEQ ID NO: 30262 - protein, 9 aa, Homo Sapiens
FLGVQKHLR

SEQ ID NO: 30263 - protein, 9 aa, Homo Sapiens
YQVTIHVPP

SEQ ID NO: 30264 - protein, 9 aa, Homo Sapiens
SAVIALVRP

SEQ ID NO: 30265 - protein, 9 aa, Homo Sapiens
LLQGQLGSL

SEQ ID NO: 30266 - protein, 9 aa, Homo Sapiens
SHISAATGT

SEQ ID NO: 30267 - protein, 9 aa, Homo Sapiens
SYIDKNLEL

SEQ ID NO: 30268 - protein, 9 aa, Homo Sapiens
SGHLPALSR

SEQ ID NO: 30269 - protein, 9 aa, Homo Sapiens
VNCDWDNHR

SEQ ID NO: 30270 - protein, 9 aa, Homo Sapiens
AQRQWALAI

SEQ ID NO: 30271 - protein, 9 aa, Homo Sapiens
RMLLALPGA

SEQ ID NO: 30272 - protein, 9 aa, Homo Sapiens
SFHYGNLSH

SEQ ID NO: 30273 - protein, 9 aa, Homo Sapiens
RLRQEKPQS

SEQ ID NO: 30274 - protein, 9 aa, Homo Sapiens
ESLYFEVED

SEQ ID NO: 30275 - protein, 9 aa, Homo Sapiens
PPGTGLAFP

SEQ ID NO: 30276 - protein, 9 aa, Homo Sapiens
VVREIGQKC

SEQ ID NO: 30277 - protein, 9 aa, Homo Sapiens
LKHEFDADI

SEQ ID NO: 30278 - protein, 9 aa, Homo Sapiens
SNTIMAHCR

SEQ ID NO: 30279 - protein, 9 aa, Homo Sapiens
VAPHTGAHP

SEQ ID NO: 30280 - protein, 9 aa, Homo Sapiens
PYGRGWDLM

SEQ ID NO: 30281 - protein, 9 aa, Homo Sapiens
HTGAHPATA

SEQ ID NO: 30282 - protein, 9 aa, Homo Sapiens
HNEEGKKKE

SEQ ID NO: 30283 - protein, 9 aa, Homo Sapiens
SLKVQNEKS

SEQ ID NO: 30284 - protein, 9 aa, Homo Sapiens
EHFTLTDST

SEQ ID NO: 30285 - protein, 9 aa, Homo Sapiens
AIAGVLTFA

SEQ ID NO: 30286 - protein, 9 aa, Homo Sapiens
RQGLLDNSL

SEQ ID NO: 30287 - protein, 9 aa, Homo Sapiens
NLASGLGAG

SEQ ID NO: 30288 - protein, 9 aa, Homo Sapiens
GAIVKQKNE

SEQ ID NO: 30289 - protein, 9 aa, Homo Sapiens
VFPCQHSPG

SEQ ID NO: 30290 - protein, 9 aa, Homo Sapiens
AQLSMEEGS

SEQ ID NO: 30291 - protein, 9 aa, Homo Sapiens
VFPCQHSPA

SEQ ID NO: 30292 - protein, 9 aa, Homo Sapiens
LKVQNEKSI

SEQ ID NO: 30293 - protein, 9 aa, Homo Sapiens
FVVNINSNR

SEQ ID NO: 30294 - protein, 9 aa, Homo Sapiens
SSGLSSHKQ

SEQ ID NO: 30295 - protein, 9 aa, Homo Sapiens
HRHRWPHGV

SEQ ID NO: 30296 - protein, 9 aa, Homo Sapiens
GVDALVLDQ

SEQ ID NO: 30297 - protein, 9 aa, Homo Sapiens
NQQNIFLVF

SEQ ID NO: 30298 - protein, 9 aa, Homo Sapiens
IDCGAIVKQ

SEQ ID NO: 30299 - protein, 9 aa, Homo Sapiens
GLRDWLPPL

SEQ ID NO: 30300 - protein, 9 aa, Homo Sapiens
HEFDADIQY

SEQ ID NO: 30301 - protein, 9 aa, Homo Sapiens
WKLSKLNEM

SEQ ID NO: 30302 - protein, 9 aa, Homo Sapiens
AGIRQAFLE

SEQ ID NO: 30303 - protein, 9 aa, Homo Sapiens
SELLLLLRL

SEQ ID NO: 30304 - protein, 9 aa, Homo Sapiens
ECSNTIMAH

SEQ ID NO: 30305 - protein, 9 aa, Homo Sapiens
VSQRLSPRK

SEQ ID NO: 30306 - protein, 9 aa, Homo Sapiens
LKLARNDID

SEQ ID NO: 30307 - protein, 9 aa, Homo Sapiens
AAIVDAVKL

SEQ ID NO: 30308 - protein, 9 aa, Homo Sapiens
GEGLSAVIA

SEQ ID NO: 30309 - protein, 9 aa, Homo Sapiens
LKFSGFTFK

SEQ ID NO: 30310 - protein, 9 aa, Homo Sapiens
QKSFKPAIQ

SEQ ID NO: 30311 - protein, 9 aa, Homo Sapiens
QRKRLCENT

SEQ ID NO: 30312 - protein, 9 aa, Homo Sapiens
RQPCLISPY

SEQ ID NO: 30313 - protein, 9 aa, Homo Sapiens
MAAALGALK

SEQ ID NO: 30314 - protein, 9 aa, Homo Sapiens
TPPTWTSKG

SEQ ID NO: 30315 - protein, 9 aa, Homo Sapiens
GLLPGVAAG

SEQ ID NO: 30316 - protein, 9 aa, Homo Sapiens
LRAGQVIRK

SEQ ID NO: 30317 - protein, 9 aa, Homo Sapiens
ALAALRALE

SEQ ID NO: 30318 - protein, 9 aa, Homo Sapiens
GQHRALAKA

SEQ ID NO: 30319 - protein, 9 aa, Homo Sapiens
VADEVGALG

SEQ ID NO: 30320 - protein, 9 aa, Homo Sapiens
VEKEGIHVV

SEQ ID NO: 30321 - protein, 9 aa, Homo Sapiens
VGWPCLHPD

SEQ ID NO: 30322 - protein, 9 aa, Homo Sapiens
ITKEAMMDF

SEQ ID NO: 30323 - protein, 9 aa, Homo Sapiens
IEGLAAVGA

SEQ ID NO: 30324 - protein, 9 aa, Homo Sapiens
SNGSLYVGD

SEQ ID NO: 30325 - protein, 9 aa, Homo Sapiens
LLILMALVK

SEQ ID NO: 30326 - protein, 9 aa, Homo Sapiens
AGVLTFALP

SEQ ID NO: 30327 - protein, 9 aa, Homo Sapiens
TPGTSAKTP

SEQ ID NO: 30328 - protein, 9 aa, Homo Sapiens
HKFDYELQD

SEQ ID NO: 30329 - protein, 9 aa, Homo Sapiens
KVIGDHLST

SEQ ID NO: 30330 - protein, 9 aa, Homo Sapiens
KLSLSKLKF

SEQ ID NO: 30331 - protein, 9 aa, Homo Sapiens
NVLSHLPSH

SEQ ID NO: 30332 - protein, 9 aa, Homo Sapiens
LSAVIALVR

SEQ ID NO: 30333 - protein, 9 aa, Homo Sapiens
AKAGVQLGT

SEQ ID NO: 30334 - protein, 9 aa, Homo Sapiens
LDNSLTASL

SEQ ID NO: 30335 - protein, 9 aa, Homo Sapiens
QRGSPGLRP

SEQ ID NO: 30336 - protein, 9 aa, Homo Sapiens
NPVKRYAPD

SEQ ID NO: 30337 - protein, 9 aa, Homo Sapiens
KRGGAAEAL

SEQ ID NO: 30338 - protein, 9 aa, Homo Sapiens
DEMAAALGA

SEQ ID NO: 30339 - protein, 9 aa, Homo Sapiens
GSNGSLYVG

SEQ ID NO: 30340 - protein, 9 aa, Homo Sapiens
CCKEIGITP

SEQ ID NO: 30341 - protein, 9 aa, Homo Sapiens
RDLTDYLIK

SEQ ID NO: 30342 - protein, 9 aa, Homo Sapiens
DELYVGFQT

SEQ ID NO: 30343 - protein, 9 aa, Homo Sapiens
GLAATGTFV

SEQ ID NO: 30344 - protein, 9 aa, Homo Sapiens
RNMPLQTGT

SEQ ID NO: 30345 - protein, 9 aa, Homo Sapiens
ALAKALAAL

SEQ ID NO: 30346 - protein, 9 aa, Homo Sapiens
MEMVMTNNC

SEQ ID NO: 30347 - protein, 9 aa, Homo Sapiens
ALVGLLARV

SEQ ID NO: 30348 - protein, 9 aa, Homo Sapiens
LQKSFKPAI

SEQ ID NO: 30349 - protein, 9 aa, Homo Sapiens
LEKETPVHS

SEQ ID NO: 30350 - protein, 9 aa, Homo Sapiens
ENLYQLKNQ

SEQ ID NO: 30351 - protein, 9 aa, Homo Sapiens
AFLEGKVAS

SEQ ID NO: 30352 - protein, 9 aa, Homo Sapiens
SSMFQEFQE

SEQ ID NO: 30353 - protein, 9 aa, Homo Sapiens
PVALTCGSN

SEQ ID NO: 30354 - protein, 9 aa, Homo Sapiens
ALVLDESGG

SEQ ID NO: 30355 - protein, 9 aa, Homo Sapiens
LFSTTDCKA

SEQ ID NO: 30356 - protein, 9 aa, Homo Sapiens
NTCRRWTPP

SEQ ID NO: 30357 - protein, 9 aa, Homo Sapiens
SFKPAIQEL

SEQ ID NO: 30358 - protein, 9 aa, Homo Sapiens
ELLLLLRLL

SEQ ID NO: 30359 - protein, 9 aa, Homo Sapiens
SLTDAAVTI

SEQ ID NO: 30360 - protein, 9 aa, Homo Sapiens
CFGTFLPGE

SEQ ID NO: 30361 - protein, 9 aa, Homo Sapiens
HLPALSRRL

SEQ ID NO: 30362 - protein, 9 aa, Homo Sapiens
WVTDYFSQT

SEQ ID NO: 30363 - protein, 9 aa, Homo Sapiens
SKKPELLAR

SEQ ID NO: 30364 - protein, 9 aa, Homo Sapiens
LESGCPKEM

SEQ ID NO: 30365 - protein, 9 aa, Homo Sapiens
VPVLQHNTS

SEQ ID NO: 30366 - protein, 9 aa, Homo Sapiens
DVLWQRAST

SEQ ID NO: 30367 - protein, 9 aa, Homo Sapiens
ALLRWKAYL

SEQ ID NO: 30368 - protein, 9 aa, Homo Sapiens
GTVARLPEA

SEQ ID NO: 30369 - protein, 9 aa, Homo Sapiens
EMAAALGAL

SEQ ID NO: 30370 - protein, 9 aa, Homo Sapiens
EVSELNKNS

SEQ ID NO: 30371 - protein, 9 aa, Homo Sapiens
LTDAAVTIN

SEQ ID NO: 30372 - protein, 9 aa, Homo Sapiens
RVGALVLDE

SEQ ID NO: 30373 - protein, 9 aa, Homo Sapiens
AHLRQAFSL

SEQ ID NO: 30374 - protein, 9 aa, Homo Sapiens
PCGLLPKPL

SEQ ID NO: 30375 - protein, 9 aa, Homo Sapiens
CPYNRKGSK

SEQ ID NO: 30376 - protein, 9 aa, Homo Sapiens
VGPLASVGA

SEQ ID NO: 30377 - protein, 9 aa, Homo Sapiens
QTDIDLTKE

SEQ ID NO: 30378 - protein, 9 aa, Homo Sapiens
PGVTSPSND

SEQ ID NO: 30379 - protein, 9 aa, Homo Sapiens
KNWNSSDCL

SEQ ID NO: 30380 - protein, 9 aa, Homo Sapiens
DGEDAIVIL

SEQ ID NO: 30381 - protein, 9 aa, Homo Sapiens
FTQHDQVGF

SEQ ID NO: 30382 - protein, 9 aa, Homo Sapiens
AHGAPVGPL

SEQ ID NO: 30383 - protein, 9 aa, Homo Sapiens
EKPQSLQAA

SEQ ID NO: 30384 - protein, 9 aa, Homo Sapiens
RGGSGPALA

SEQ ID NO: 30385 - protein, 9 aa, Homo Sapiens
CRPNCCVSS

SEQ ID NO: 30386 - protein, 9 aa, Homo Sapiens
GHNGIKQHS

SEQ ID NO: 30387 - protein, 9 aa, Homo Sapiens
LARVGALVL

SEQ ID NO: 30388 - protein, 9 aa, Homo Sapiens
VTSPSNDEP

SEQ ID NO: 30389 - protein, 9 aa, Homo Sapiens
LGEALAADA

SEQ ID NO: 30390 - protein, 9 aa, Homo Sapiens
PFTYYKQLR

SEQ ID NO: 30391 - protein, 9 aa, Homo Sapiens
EKEGIHVVD

SEQ ID NO: 30392 - protein, 9 aa, Homo Sapiens
PARREVARF

SEQ ID NO: 30393 - protein, 9 aa, Homo Sapiens
EKETPVHSR

SEQ ID NO: 30394 - protein, 9 aa, Homo Sapiens
CKPGDPSRQ

SEQ ID NO: 30395 - protein, 9 aa, Homo Sapiens
AADARKFFP

SEQ ID NO: 30396 - protein, 9 aa, Homo Sapiens
TGTGLLCME

SEQ ID NO: 30397 - protein, 9 aa, Homo Sapiens
VGPLVAVGA

SEQ ID NO: 30398 - protein, 9 aa, Homo Sapiens
RGVDQPGGL

SEQ ID NO: 30399 - protein, 9 aa, Homo Sapiens
YGSDSENDR

SEQ ID NO: 30400 - protein, 9 aa, Homo Sapiens
SKSFHYGNL

SEQ ID NO: 30401 - protein, 9 aa, Homo Sapiens
QELHNKLSV

SEQ ID NO: 30402 - protein, 9 aa, Homo Sapiens
LVRPLATVD

SEQ ID NO: 30403 - protein, 9 aa, Homo Sapiens
VYLPYDYVC

SEQ ID NO: 30404 - protein, 9 aa, Homo Sapiens
VFDEVRALG

SEQ ID NO: 30405 - protein, 9 aa, Homo Sapiens
MAHCRHELL

SEQ ID NO: 30406 - protein, 9 aa, Homo Sapiens
ALSRRLDLQ

SEQ ID NO: 30407 - protein, 9 aa, Homo Sapiens
WLPPLGSLT

SEQ ID NO: 30408 - protein, 9 aa, Homo Sapiens
LCRQHSLHL

SEQ ID NO: 30409 - protein, 9 aa, Homo Sapiens
FIPRALGFK

SEQ ID NO: 30410 - protein, 9 aa, Homo Sapiens
FRQRPSSTG

SEQ ID NO: 30411 - protein, 9 aa, Homo Sapiens
EGGTAQLLP

SEQ ID NO: 30412 - protein, 9 aa, Homo Sapiens
YVGFQTRLQ

SEQ ID NO: 30413 - protein, 9 aa, Homo Sapiens
CRQTPPFLL

SEQ ID NO: 30414 - protein, 9 aa, Homo Sapiens
PSYIDKNLE

SEQ ID NO: 30415 - protein, 9 aa, Homo Sapiens
TIHVPPTIA

SEQ ID NO: 30416 - protein, 9 aa, Homo Sapiens
RLCENTAGH

SEQ ID NO: 30417 - protein, 9 aa, Homo Sapiens
ILMALVKKR

SEQ ID NO: 30418 - protein, 9 aa, Homo Sapiens
APVGPLARV

SEQ ID NO: 30419 - protein, 9 aa, Homo Sapiens
TGADLGVRH

SEQ ID NO: 30420 - protein, 9 aa, Homo Sapiens
ERKLYQSAR

SEQ ID NO: 30421 - protein, 9 aa, Homo Sapiens
NDRSYSHHR

SEQ ID NO: 30422 - protein, 9 aa, Homo Sapiens
SNQQNIFLV

SEQ ID NO: 30423 - protein, 9 aa, Homo Sapiens
HKDQLIEVI

SEQ ID NO: 30424 - protein, 9 aa, Homo Sapiens
AWPPARREV

SEQ ID NO: 30425 - protein, 9 aa, Homo Sapiens
IPFGITKEA

SEQ ID NO: 30426 - protein, 9 aa, Homo Sapiens
NPCGVDSEC

SEQ ID NO: 30427 - protein, 9 aa, Homo Sapiens
PIQGSKLRH

SEQ ID NO: 30428 - protein, 9 aa, Homo Sapiens
GPTGPEGTE

SEQ ID NO: 30429 - protein, 9 aa, Homo Sapiens
NATGNLASG

SEQ ID NO: 30430 - protein, 9 aa, Homo Sapiens
AALGAAVGP

SEQ ID NO: 30431 - protein, 9 aa, Homo Sapiens
NINSNRSTA

SEQ ID NO: 30432 - protein, 9 aa, Homo Sapiens
LAALRALEG

SEQ ID NO: 30433 - protein, 9 aa, Homo Sapiens
PSKVIGDHL

SEQ ID NO: 30434 - protein, 9 aa, Homo Sapiens
GTGLAFPPP

SEQ ID NO: 30435 - protein, 9 aa, Homo Sapiens
ALEGLLPGV

SEQ ID NO: 30436 - protein, 9 aa, Homo Sapiens
EPRPTEEKP

SEQ ID NO: 30437 - protein, 9 aa, Homo Sapiens
SRSWARLCT

SEQ ID NO: 30438 - protein, 9 aa, Homo Sapiens
EEKPGSPWS

SEQ ID NO: 30439 - protein, 9 aa, Homo Sapiens
PEHRGHVEW

SEQ ID NO: 30440 - protein, 9 aa, Homo Sapiens
GPLARVGAL

SEQ ID NO: 30441 - protein, 9 aa, Homo Sapiens
TGNLASGLG

SEQ ID NO: 30442 - protein, 9 aa, Homo Sapiens
ALQYVNVRL

SEQ ID NO: 30443 - protein, 9 aa, Homo Sapiens
DYLIKILTE

SEQ ID NO: 30444 - protein, 9 aa, Homo Sapiens
IKQHSCPHC

SEQ ID NO: 30445 - protein, 9 aa, Homo Sapiens
PGDPSRQPC

SEQ ID NO: 30446 - protein, 9 aa, Homo Sapiens
VKLDAIEPY

SEQ ID NO: 30447 - protein, 9 aa, Homo Sapiens
ADARKFFPC

SEQ ID NO: 30448 - protein, 9 aa, Homo Sapiens
PPHPAADSS

SEQ ID NO: 30449 - protein, 9 aa, Homo Sapiens
LHLEKETPV

SEQ ID NO: 30450 - protein, 9 aa, Homo Sapiens
IYEVTGKSQ

SEQ ID NO: 30451 - protein, 9 aa, Homo Sapiens
RCKISLSSL

SEQ ID NO: 30452 - protein, 9 aa, Homo Sapiens
YYKCHEVQL

SEQ ID NO: 30453 - protein, 9 aa, Homo Sapiens
EGLAAVGAA

SEQ ID NO: 30454 - protein, 9 aa, Homo Sapiens
GSPAFSSTL

SEQ ID NO: 30455 - protein, 9 aa, Homo Sapiens
PLAGPSAGQ

SEQ ID NO: 30456 - protein, 9 aa, Homo Sapiens
AHDCCYRRL

SEQ ID NO: 30457 - protein, 9 aa, Homo Sapiens
DLKTCEDIN

SEQ ID NO: 30458 - protein, 9 aa, Homo Sapiens
PCGVDSECI

SEQ ID NO: 30459 - protein, 9 aa, Homo Sapiens
RYSHNEEGK

SEQ ID NO: 30460 - protein, 9 aa, Homo Sapiens
TDVRPRALP

SEQ ID NO: 30461 - protein, 9 aa, Homo Sapiens
FGTFLPGEK

SEQ ID NO: 30462 - protein, 9 aa, Homo Sapiens
HGAPVGPLA

SEQ ID NO: 30463 - protein, 9 aa, Homo Sapiens
RREVARFQR

SEQ ID NO: 30464 - protein, 9 aa, Homo Sapiens
LLLQGQLGS

SEQ ID NO: 30465 - protein, 9 aa, Homo Sapiens
QVESSYCSP

SEQ ID NO: 30466 - protein, 9 aa, Homo Sapiens
YHLQREPRA

SEQ ID NO: 30467 - protein, 9 aa, Homo Sapiens
TDLEETLER

SEQ ID NO: 30468 - protein, 9 aa, Homo Sapiens
AAEALAAHG

SEQ ID NO: 30469 - protein, 9 aa, Homo Sapiens
EPVSLQEAI

SEQ ID NO: 30470 - protein, 9 aa, Homo Sapiens
ERFTQHDQV

SEQ ID NO: 30471 - protein, 9 aa, Homo Sapiens
SAQGFLSFL

SEQ ID NO: 30472 - protein, 9 aa, Homo Sapiens
SHNEEGKKK

SEQ ID NO: 30473 - protein, 9 aa, Homo Sapiens
TGTMVEFAF

SEQ ID NO: 30474 - protein, 9 aa, Homo Sapiens
AAWASTQTG

SEQ ID NO: 30475 - protein, 9 aa, Homo Sapiens
QVRAVGEGL

SEQ ID NO: 30476 - protein, 9 aa, Homo Sapiens
EFRNNYEEL

SEQ ID NO: 30477 - protein, 9 aa, Homo Sapiens
VRAIAIALR

SEQ ID NO: 30478 - protein, 9 aa, Homo Sapiens
EDSVPQSTG

SEQ ID NO: 30479 - protein, 9 aa, Homo Sapiens
PAGFGGVHF

SEQ ID NO: 30480 - protein, 9 aa, Homo Sapiens
EMQVESSYC

SEQ ID NO: 30481 - protein, 9 aa, Homo Sapiens
LYLRPVHVE

SEQ ID NO: 30482 - protein, 9 aa, Homo Sapiens
KLPELWALV

SEQ ID NO: 30483 - protein, 9 aa, Homo Sapiens
FVGLLTGVD

SEQ ID NO: 30484 - protein, 9 aa, Homo Sapiens
SSDCLHLNP

SEQ ID NO: 30485 - protein, 9 aa, Homo Sapiens
VLTFALPVP

SEQ ID NO: 30486 - protein, 9 aa, Homo Sapiens
VRLFFLLHL

SEQ ID NO: 30487 - protein, 9 aa, Homo Sapiens
PTGPEGTED

SEQ ID NO: 30488 - protein, 9 aa, Homo Sapiens
CERKLYQSA

SEQ ID NO: 30489 - protein, 9 aa, Homo Sapiens
RVSALVAKQ

SEQ ID NO: 30490 - protein, 9 aa, Homo Sapiens
PNCCVSSCC

SEQ ID NO: 30491 - protein, 9 aa, Homo Sapiens
VSLGHNVFD

SEQ ID NO: 30492 - protein, 9 aa, Homo Sapiens
HLKLNTEVR

SEQ ID NO: 30493 - protein, 9 aa, Homo Sapiens
EYHTESSWG

SEQ ID NO: 30494 - protein, 9 aa, Homo Sapiens
YCCIYCPRG

SEQ ID NO: 30495 - protein, 9 aa, Homo Sapiens
AHRLYQVTI

SEQ ID NO: 30496 - protein, 9 aa, Homo Sapiens
YSQINAASR

SEQ ID NO: 30497 - protein, 9 aa, Homo Sapiens
FISRALRFI

SEQ ID NO: 30498 - protein, 9 aa, Homo Sapiens
VGPLARVGA

SEQ ID NO: 30499 - protein, 9 aa, Homo Sapiens
LGTNALLVV

SEQ ID NO: 30500 - protein, 9 aa, Homo Sapiens
FEVEDGFQE

SEQ ID NO: 30501 - protein, 9 aa, Homo Sapiens
YRRLEKLGC

SEQ ID NO: 30502 - protein, 9 aa, Homo Sapiens
ANQVPVLQH

SEQ ID NO: 30503 - protein, 9 aa, Homo Sapiens
GLSSHKQGH

SEQ ID NO: 30504 - protein, 9 aa, Homo Sapiens
QQARACCPI

SEQ ID NO: 30505 - protein, 9 aa, Homo Sapiens
SLCSDQTSY

SEQ ID NO: 30506 - protein, 9 aa, Homo Sapiens
LECSNTIMA

SEQ ID NO: 30507 - protein, 9 aa, Homo Sapiens
ASELLLLLR

SEQ ID NO: 30508 - protein, 9 aa, Homo Sapiens
HYKVIMSKR

SEQ ID NO: 30509 - protein, 9 aa, Homo Sapiens
ILASNQQNI

SEQ ID NO: 30510 - protein, 9 aa, Homo Sapiens
HTGTMVEFA

SEQ ID NO: 30511 - protein, 9 aa, Homo Sapiens
QHIERFTQH

SEQ ID NO: 30512 - protein, 9 aa, Homo Sapiens
GKPPTLSKG

SEQ ID NO: 30513 - protein, 9 aa, Homo Sapiens
VLDQGGAPP

SEQ ID NO: 30514 - protein, 9 aa, Homo Sapiens
ASSFRQRPS

SEQ ID NO: 30515 - protein, 9 aa, Homo Sapiens
ATDVRPRAL

SEQ ID NO: 30516 - protein, 9 aa, Homo Sapiens
NVFGLPSIY

SEQ ID NO: 30517 - protein, 9 aa, Homo Sapiens
GVQLGTNAL

SEQ ID NO: 30518 - protein, 9 aa, Homo Sapiens
EQTQINLNC

SEQ ID NO: 30519 - protein, 9 aa, Homo Sapiens
PLRMSEMLV

SEQ ID NO: 30520 - protein, 9 aa, Homo Sapiens
DKIKDEQDI

SEQ ID NO: 30521 - protein, 9 aa, Homo Sapiens
VGAAVGAAW

SEQ ID NO: 30522 - protein, 9 aa, Homo Sapiens
HPAADSSSE

SEQ ID NO: 30523 - protein, 9 aa, Homo Sapiens
ILGKKIEAP

SEQ ID NO: 30524 - protein, 9 aa, Homo Sapiens
LYNSPFDPV

SEQ ID NO: 30525 - protein, 9 aa, Homo Sapiens
QTYHFQAED

SEQ ID NO: 30526 - protein, 9 aa, Homo Sapiens
NSLTASLTN

SEQ ID NO: 30527 - protein, 9 aa, Homo Sapiens
CQFCRLEKC

SEQ ID NO: 30528 - protein, 9 aa, Homo Sapiens
LTFALPVPV

SEQ ID NO: 30529 - protein, 9 aa, Homo Sapiens
ENRGFARRI

SEQ ID NO: 30530 - protein, 9 aa, Homo Sapiens
MRRWLCTGM

SEQ ID NO: 30531 - protein, 9 aa, Homo Sapiens
EKANAPMKQ

SEQ ID NO: 30532 - protein, 9 aa, Homo Sapiens
CRLRQEKPQ

SEQ ID NO: 30533 - protein, 9 aa, Homo Sapiens
APGFIPGAP

SEQ ID NO: 30534 - protein, 9 aa, Homo Sapiens
TNWKLSKLN

SEQ ID NO: 30535 - protein, 9 aa, Homo Sapiens
VPEHFTLTD

SEQ ID NO: 30536 - protein, 9 aa, Homo Sapiens
IQGSKLRHP

SEQ ID NO: 30537 - protein, 9 aa, Homo Sapiens
NKSHPKRGL

SEQ ID NO: 30538 - protein, 9 aa, Homo Sapiens
QYMTMLNQL

SEQ ID NO: 30539 - protein, 9 aa, Homo Sapiens
SIDNVCIDS

SEQ ID NO: 30540 - protein, 9 aa, Homo Sapiens
STTDCKAQD

SEQ ID NO: 30541 - protein, 9 aa, Homo Sapiens
RLEKCLEMG

SEQ ID NO: 30542 - protein, 9 aa, Homo Sapiens
VGALVFDEV

SEQ ID NO: 30543 - protein, 9 aa, Homo Sapiens
LWALVNFLL

SEQ ID NO: 30544 - protein, 9 aa, Homo Sapiens
SVGALVFDE

SEQ ID NO: 30545 - protein, 9 aa, Homo Sapiens
IGDHLSTMY

SEQ ID NO: 30546 - protein, 9 aa, Homo Sapiens
AADATAEGP

SEQ ID NO: 30547 - protein, 9 aa, Homo Sapiens
QVTVRKREK

SEQ ID NO: 30548 - protein, 9 aa, Homo Sapiens
LLKILGKKI

SEQ ID NO: 30549 - protein, 9 aa, Homo Sapiens
ALTCGSNGS

SEQ ID NO: 30550 - protein, 9 aa, Homo Sapiens
QGILKFLQD

SEQ ID NO: 30551 - protein, 9 aa, Homo Sapiens
GPPGTGLAF

SEQ ID NO: 30552 - protein, 9 aa, Homo Sapiens
AYYYKCHEV

SEQ ID NO: 30553 - protein, 9 aa, Homo Sapiens
SGGGGGSSL

SEQ ID NO: 30554 - protein, 9 aa, Homo Sapiens
KLNESLKVQ

SEQ ID NO: 30555 - protein, 9 aa, Homo Sapiens
RTGNEEQTQ

SEQ ID NO: 30556 - protein, 9 aa, Homo Sapiens
VTGKSQPKA

SEQ ID NO: 30557 - protein, 9 aa, Homo Sapiens
VNFLLPTIF

SEQ ID NO: 30558 - protein, 9 aa, Homo Sapiens
PLSEGVQGV

SEQ ID NO: 30559 - protein, 9 aa, Homo Sapiens
NPQYMTMLN

SEQ ID NO: 30560 - protein, 9 aa, Homo Sapiens
AVGAAWQVG

SEQ ID NO: 30561 - protein, 9 aa, Homo Sapiens
GTVLPDLQE

SEQ ID NO: 30562 - protein, 9 aa, Homo Sapiens
DDIDLRKAI

SEQ ID NO: 30563 - protein, 9 aa, Homo Sapiens
AWASTQTGR

SEQ ID NO: 30564 - protein, 9 aa, Homo Sapiens
ISRALRFIA

SEQ ID NO: 30565 - protein, 9 aa, Homo Sapiens
LMQQGILKF

SEQ ID NO: 30566 - protein, 9 aa, Homo Sapiens
DSKNATGNL

SEQ ID NO: 30567 - protein, 9 aa, Homo Sapiens
GAPVGPLAR

SEQ ID NO: 30568 - protein, 9 aa, Homo Sapiens
VRLRDLYPD

SEQ ID NO: 30569 - protein, 9 aa, Homo Sapiens
TISKKPELL

SEQ ID NO: 30570 - protein, 9 aa, Homo Sapiens
FVKNDLYEK

SEQ ID NO: 30571 - protein, 9 aa, Homo Sapiens
MALENRGFA

SEQ ID NO: 30572 - protein, 9 aa, Homo Sapiens
FITLKTFTP

SEQ ID NO: 30573 - protein, 9 aa, Homo Sapiens
PLGEALAAD

SEQ ID NO: 30574 - protein, 9 aa, Homo Sapiens
CRQQGPCGH

SEQ ID NO: 30575 - protein, 9 aa, Homo Sapiens
GLLTGVDAL

SEQ ID NO: 30576 - protein, 9 aa, Homo Sapiens
LGFELSVLG

SEQ ID NO: 30577 - protein, 9 aa, Homo Sapiens
ALGALKKNA

SEQ ID NO: 30578 - protein, 9 aa, Homo Sapiens
LPGEKLNDF

SEQ ID NO: 30579 - protein, 9 aa, Homo Sapiens
VGALGEGLS

SEQ ID NO: 30580 - protein, 9 aa, Homo Sapiens
NAPMKQLKR

SEQ ID NO: 30581 - protein, 9 aa, Homo Sapiens
YAWLCGLLP

SEQ ID NO: 30582 - protein, 9 aa, Homo Sapiens
VKIPMDLST

SEQ ID NO: 30583 - protein, 9 aa, Homo Sapiens
PGPRGPPPH

SEQ ID NO: 30584 - protein, 9 aa, Homo Sapiens
GRVLAIALA

SEQ ID NO: 30585 - protein, 9 aa, Homo Sapiens
VLPDLQETS

SEQ ID NO: 30586 - protein, 9 aa, Homo Sapiens
PELWALVNF

SEQ ID NO: 30587 - protein, 9 aa, Homo Sapiens
IKYDTALNL

SEQ ID NO: 30588 - protein, 9 aa, Homo Sapiens
QRGVDQPGG

SEQ ID NO: 30589 - protein, 9 aa, Homo Sapiens
SALTDHDPL

SEQ ID NO: 30590 - protein, 9 aa, Homo Sapiens
LFVNPAIWI

SEQ ID NO: 30591 - protein, 9 aa, Homo Sapiens
LSSAALCGA

SEQ ID NO: 30592 - protein, 9 aa, Homo Sapiens
SPINPQYMT

SEQ ID NO: 30593 - protein, 9 aa, Homo Sapiens
HNWFDTFII

SEQ ID NO: 30594 - protein, 9 aa, Homo Sapiens
SPSRTASQT

SEQ ID NO: 30595 - protein, 9 aa, Homo Sapiens
HVEFASHGD

SEQ ID NO: 30596 - protein, 9 aa, Homo Sapiens
PPTWTSKGS

SEQ ID NO: 30597 - protein, 9 aa, Homo Sapiens
PDSRATGAH

SEQ ID NO: 30598 - protein, 9 aa, Homo Sapiens
GLSLCSVFP

SEQ ID NO: 30599 - protein, 9 aa, Homo Sapiens
KLFLHLEKE

SEQ ID NO: 30600 - protein, 9 aa, Homo Sapiens
NGPDCGHGS

SEQ ID NO: 30601 - protein, 9 aa, Homo Sapiens
RLPEAVSME

SEQ ID NO: 30602 - protein, 9 aa, Homo Sapiens
EAVVGAAGA

SEQ ID NO: 30603 - protein, 9 aa, Homo Sapiens
TDYFSQTPL

SEQ ID NO: 30604 - protein, 9 aa, Homo Sapiens
GTFLPGEKL

SEQ ID NO: 30605 - protein, 9 aa, Homo Sapiens
LVTHNQTYH

SEQ ID NO: 30606 - protein, 9 aa, Homo Sapiens
FDEVRALGE

SEQ ID NO: 30607 - protein, 9 aa, Homo Sapiens
RFHFVYQAV

SEQ ID NO: 30608 - protein, 9 aa, Homo Sapiens
SESLYFEVE

SEQ ID NO: 30609 - protein, 9 aa, Homo Sapiens
GADLGVRHL

SEQ ID NO: 30610 - protein, 9 aa, Homo Sapiens
KPGSPWSGP

SEQ ID NO: 30611 - protein, 9 aa, Homo Sapiens
SGKMANRNH

SEQ ID NO: 30612 - protein, 9 aa, Homo Sapiens
DFCIVCVTT

SEQ ID NO: 30613 - protein, 9 aa, Homo Sapiens
VVDEDCSDS

SEQ ID NO: 30614 - protein, 9 aa, Homo Sapiens
DESGGAIEG

SEQ ID NO: 30615 - protein, 9 aa, Homo Sapiens
VTVRKREKD

SEQ ID NO: 30616 - protein, 9 aa, Homo Sapiens
YGDIQRTLF

SEQ ID NO: 30617 - protein, 9 aa, Homo Sapiens
TFLPGEKLN

SEQ ID NO: 30618 - protein, 9 aa, Homo Sapiens
TWTSKGSCE

SEQ ID NO: 30619 - protein, 9 aa, Homo Sapiens
YLRPVHVEF

SEQ ID NO: 30620 - protein, 9 aa, Homo Sapiens
AQGFLSFLL

SEQ ID NO: 30621 - protein, 9 aa, Homo Sapiens
IRQAFLEGK

SEQ ID NO: 30622 - protein, 9 aa, Homo Sapiens
LTHPYGRGW

SEQ ID NO: 30623 - protein, 9 aa, Homo Sapiens
QKEPVSLQE

SEQ ID NO: 30624 - protein, 9 aa, Homo Sapiens
CRTTCCRPN

SEQ ID NO: 30625 - protein, 9 aa, Homo Sapiens
TFVGLLTGV

SEQ ID NO: 30626 - protein, 9 aa, Homo Sapiens
QVQKCTIFV

SEQ ID NO: 30627 - protein, 9 aa, Homo Sapiens
PRLEGYFSN

SEQ ID NO: 30628 - protein, 9 aa, Homo Sapiens
PEVRSKSFH

SEQ ID NO: 30629 - protein, 9 aa, Homo Sapiens
DRYSHNEEG

SEQ ID NO: 30630 - protein, 9 aa, Homo Sapiens
AVIALVRPL

SEQ ID NO: 30631 - protein, 9 aa, Homo Sapiens
NSESLYFEV

SEQ ID NO: 30632 - protein, 9 aa, Homo Sapiens
ADKRKALEE

SEQ ID NO: 30633 - protein, 9 aa, Homo Sapiens
LRMSEMLVV

SEQ ID NO: 30634 - protein, 9 aa, Homo Sapiens
EVEDGFQEL

SEQ ID NO: 30635 - protein, 9 aa, Homo Sapiens
LENRGFARR

SEQ ID NO: 30636 - protein, 9 aa, Homo Sapiens
REPRARFYA

SEQ ID NO: 30637 - protein, 9 aa, Homo Sapiens
REEESFSLC

SEQ ID NO: 30638 - protein, 9 aa, Homo Sapiens
YPSEPHQPH

SEQ ID NO: 30639 - protein, 9 aa, Homo Sapiens
CWQLSPGHG

SEQ ID NO: 30640 - protein, 9 aa, Homo Sapiens
DHILFVNPA

SEQ ID NO: 30641 - protein, 9 aa, Homo Sapiens
SMFQEFQEE

SEQ ID NO: 30642 - protein, 9 aa, Homo Sapiens
MAYEWKPDE

SEQ ID NO: 30643 - protein, 9 aa, Homo Sapiens
LLESGCPKE

SEQ ID NO: 30644 - protein, 9 aa, Homo Sapiens
IPCPLRMSE

SEQ ID NO: 30645 - protein, 9 aa, Homo Sapiens
GVDGQHRAL

SEQ ID NO: 30646 - protein, 9 aa, Homo Sapiens
VNVRLRDLY

SEQ ID NO: 30647 - protein, 9 aa, Homo Sapiens
LPALSRRLD

SEQ ID NO: 30648 - protein, 9 aa, Homo Sapiens
AGMGDKGRP

SEQ ID NO: 30649 - protein, 9 aa, Homo Sapiens
VVNAVNCSM

SEQ ID NO: 30650 - protein, 9 aa, Homo Sapiens
LELLSREAV

SEQ ID NO: 30651 - protein, 9 aa, Homo Sapiens
DKSVVDRAK

SEQ ID NO: 30652 - protein, 9 aa, Homo Sapiens
KWGFITVGC

SEQ ID NO: 30653 - protein, 9 aa, Homo Sapiens
HSCGLRLKQ

SEQ ID NO: 30654 - protein, 9 aa, Homo Sapiens
PSNDEPPME

SEQ ID NO: 30655 - protein, 9 aa, Homo Sapiens
KTFTPPVSR

SEQ ID NO: 30656 - protein, 9 aa, Homo Sapiens
GTGLLCMEE

SEQ ID NO: 30657 - protein, 9 aa, Homo Sapiens
NRKGSKSIK

SEQ ID NO: 30658 - protein, 9 aa, Homo Sapiens
EVTGKSQPK

SEQ ID NO: 30659 - protein, 9 aa, Homo Sapiens
LKQQARACC

SEQ ID NO: 30660 - protein, 9 aa, Homo Sapiens
FVAEAVVGA

SEQ ID NO: 30661 - protein, 9 aa, Homo Sapiens
VVNINSNRS

SEQ ID NO: 30662 - protein, 9 aa, Homo Sapiens
PSAGQLLAR

SEQ ID NO: 30663 - protein, 9 aa, Homo Sapiens
EAINVLSHL

SEQ ID NO: 30664 - protein, 9 aa, Homo Sapiens
SELNKNSSK

SEQ ID NO: 30665 - protein, 9 aa, Homo Sapiens
WGFITVGCR

SEQ ID NO: 30666 - protein, 9 aa, Homo Sapiens
PLTGVHPLM

SEQ ID NO: 30667 - protein, 9 aa, Homo Sapiens
AVTINQTVD

SEQ ID NO: 30668 - protein, 9 aa, Homo Sapiens
LGFISRALR

SEQ ID NO: 30669 - protein, 9 aa, Homo Sapiens
LEKCLEMGM

SEQ ID NO: 30670 - protein, 9 aa, Homo Sapiens
HNGIKQHSC

SEQ ID NO: 30671 - protein, 9 aa, Homo Sapiens
SGPALAPAE

SEQ ID NO: 30672 - protein, 9 aa, Homo Sapiens
ILLYPSEPH

SEQ ID NO: 30673 - protein, 9 aa, Homo Sapiens
LATMWALVG

SEQ ID NO: 30674 - protein, 9 aa, Homo Sapiens
QVPSKVIGD

SEQ ID NO: 30675 - protein, 9 aa, Homo Sapiens
FIPGAPRFI

SEQ ID NO: 30676 - protein, 9 aa, Homo Sapiens
CCYLKCKKC

SEQ ID NO: 30677 - protein, 9 aa, Homo Sapiens
VRHLKLNTE

SEQ ID NO: 30678 - protein, 9 aa, Homo Sapiens
LCPADPDCI

SEQ ID NO: 30679 - protein, 9 aa, Homo Sapiens
YEDSVPQST

SEQ ID NO: 30680 - protein, 9 aa, Homo Sapiens
FPKAETIYL

SEQ ID NO: 30681 - protein, 9 aa, Homo Sapiens
YGFEDIFRI

SEQ ID NO: 30682 - protein, 9 aa, Homo Sapiens
TLTDSTKSG

SEQ ID NO: 30683 - protein, 9 aa, Homo Sapiens
MSRSCAAPG

SEQ ID NO: 30684 - protein, 9 aa, Homo Sapiens
ITVGCRGSC

SEQ ID NO: 30685 - protein, 9 aa, Homo Sapiens
QNRIQCAMK

SEQ ID NO: 30686 - protein, 9 aa, Homo Sapiens
PDPQRGSPG

SEQ ID NO: 30687 - protein, 9 aa, Homo Sapiens
LKTCEDINE

SEQ ID NO: 30688 - protein, 9 aa, Homo Sapiens
ASNQQNIFL

SEQ ID NO: 30689 - protein, 9 aa, Homo Sapiens
EFLSVPFTY

SEQ ID NO: 30690 - protein, 9 aa, Homo Sapiens
ISNLKSMDY

SEQ ID NO: 30691 - protein, 9 aa, Homo Sapiens
SIVGEVVRE

SEQ ID NO: 30692 - protein, 9 aa, Homo Sapiens
SQGFKDKTR

SEQ ID NO: 30693 - protein, 9 aa, Homo Sapiens
DSDRYSHNE

SEQ ID NO: 30694 - protein, 9 aa, Homo Sapiens
LIKTDKSVV

SEQ ID NO: 30695 - protein, 9 aa, Homo Sapiens
HYIPRRWGK

SEQ ID NO: 30696 - protein, 9 aa, Homo Sapiens
VLALLRWKA

SEQ ID NO: 30697 - protein, 9 aa, Homo Sapiens
FHAAHHKFQ

SEQ ID NO: 30698 - protein, 9 aa, Homo Sapiens
PCTLGLRML

SEQ ID NO: 30699 - protein, 9 aa, Homo Sapiens
LPEAVSMET

SEQ ID NO: 30700 - protein, 9 aa, Homo Sapiens
LVNCDWDNH

SEQ ID NO: 30701 - protein, 9 aa, Homo Sapiens
SNDEPPMEA

SEQ ID NO: 30702 - protein, 9 aa, Homo Sapiens
RALPTPGPA

SEQ ID NO: 30703 - protein, 9 aa, Homo Sapiens
IKILTERGY

SEQ ID NO: 30704 - protein, 9 aa, Homo Sapiens
PDLLLAEAD

SEQ ID NO: 30705 - protein, 9 aa, Homo Sapiens
EEPWIMEGV

SEQ ID NO: 30706 - protein, 9 aa, Homo Sapiens
AEALAAHGA

SEQ ID NO: 30707 - protein, 9 aa, Homo Sapiens
ISKKPELLA

SEQ ID NO: 30708 - protein, 9 aa, Homo Sapiens
GSKSIKYWC

SEQ ID NO: 30709 - protein, 9 aa, Homo Sapiens
YVGWPCLHP

SEQ ID NO: 30710 - protein, 9 aa, Homo Sapiens
LSLSKLKFS

SEQ ID NO: 30711 - protein, 9 aa, Homo Sapiens
DHLMQQGIL

SEQ ID NO: 30712 - protein, 9 aa, Homo Sapiens
LKCKKCTEI

SEQ ID NO: 30713 - protein, 9 aa, Homo Sapiens
FLYQSSSAL

SEQ ID NO: 30714 - protein, 9 aa, Homo Sapiens
NISHISAAT

SEQ ID NO: 30715 - protein, 9 aa, Homo Sapiens
TSCRCWQLS

SEQ ID NO: 30716 - protein, 9 aa, Homo Sapiens
SWGSDLSDI

SEQ ID NO: 30717 - protein, 9 aa, Homo Sapiens
MTNWKLSKL

SEQ ID NO: 30718 - protein, 9 aa, Homo Sapiens
LGFKLRALR

SEQ ID NO: 30719 - protein, 9 aa, Homo Sapiens
RGSPGLRPP

SEQ ID NO: 30720 - protein, 9 aa, Homo Sapiens
GPCGHLKRW

SEQ ID NO: 30721 - protein, 9 aa, Homo Sapiens
QLSMEEGSG

SEQ ID NO: 30722 - protein, 9 aa, Homo Sapiens
YIPRRWGKP

SEQ ID NO: 30723 - protein, 9 aa, Homo Sapiens
ASVGALVFD

SEQ ID NO: 30724 - protein, 9 aa, Homo Sapiens
MPLPQWIHY

SEQ ID NO: 30725 - protein, 9 aa, Homo Sapiens
QFCRLEKCL

SEQ ID NO: 30726 - protein, 9 aa, Homo Sapiens
RGYCCIYCP

SEQ ID NO: 30727 - protein, 9 aa, Homo Sapiens
AAPISPSRT

SEQ ID NO: 30728 - protein, 9 aa, Homo Sapiens
GVQKHLRTF

SEQ ID NO: 30729 - protein, 9 aa, Homo Sapiens
TQINLNCTQ

SEQ ID NO: 30730 - protein, 9 aa, Homo Sapiens
FKFWALGFE

SEQ ID NO: 30731 - protein, 9 aa, Homo Sapiens
SHPKRGLVV

SEQ ID NO: 30732 - protein, 9 aa, Homo Sapiens
IVGEVVREI

SEQ ID NO: 30733 - protein, 9 aa, Homo Sapiens
LDESGGAIE

SEQ ID NO: 30734 - protein, 9 aa, Homo Sapiens
GGWLLESGC

SEQ ID NO: 30735 - protein, 9 aa, Homo Sapiens
RPLATVDPV

SEQ ID NO: 30736 - protein, 9 aa, Homo Sapiens
AVNCSMFSA

SEQ ID NO: 30737 - protein, 9 aa, Homo Sapiens
AQDCKTDLR

SEQ ID NO: 30738 - protein, 9 aa, Homo Sapiens
ASARRFHFV

SEQ ID NO: 30739 - protein, 9 aa, Homo Sapiens
GEGLAADLT

SEQ ID NO: 30740 - protein, 9 aa, Homo Sapiens
CGSNGSLYV

SEQ ID NO: 30741 - protein, 9 aa, Homo Sapiens
IFVVDEDCS

SEQ ID NO: 30742 - protein, 9 aa, Homo Sapiens
RPVHVEFAS

SEQ ID NO: 30743 - protein, 9 aa, Homo Sapiens
EFPKAETIY

SEQ ID NO: 30744 - protein, 9 aa, Homo Sapiens
EDINECESS

SEQ ID NO: 30745 - protein, 9 aa, Homo Sapiens
YFPSYIDKN

SEQ ID NO: 30746 - protein, 9 aa, Homo Sapiens
VLAIALAAL

SEQ ID NO: 30747 - protein, 9 aa, Homo Sapiens
NYLLCLLLL

SEQ ID NO: 30748 - protein, 9 aa, Homo Sapiens
VNINSNRST

SEQ ID NO: 30749 - protein, 9 aa, Homo Sapiens
GCRGSCTLG

SEQ ID NO: 30750 - protein, 9 aa, Homo Sapiens
SATALLLQG

SEQ ID NO: 30751 - protein, 9 aa, Homo Sapiens
GMGDKGRPL

SEQ ID NO: 30752 - protein, 9 aa, Homo Sapiens
EGVFPCQHS

SEQ ID NO: 30753 - protein, 9 aa, Homo Sapiens
PRGPPPHPA

SEQ ID NO: 30754 - protein, 9 aa, Homo Sapiens
KIKDEQDIV

SEQ ID NO: 30755 - protein, 9 aa, Homo Sapiens
CKFHWCCYL

SEQ ID NO: 30756 - protein, 9 aa, Homo Sapiens
HPKRGLVVG

SEQ ID NO: 30757 - protein, 9 aa, Homo Sapiens
VKRYAPDLP

SEQ ID NO: 30758 - protein, 9 aa, Homo Sapiens
ADIQYEYFN

SEQ ID NO: 30759 - protein, 9 aa, Homo Sapiens
DGQHRALAK

SEQ ID NO: 30760 - protein, 9 aa, Homo Sapiens
MQQGILKFL

SEQ ID NO: 30761 - protein, 9 aa, Homo Sapiens
PLARVGALV

SEQ ID NO: 30762 - protein, 9 aa, Homo Sapiens
PDCIAFIHS

SEQ ID NO: 30763 - protein, 9 aa, Homo Sapiens
TPGPATPPT

SEQ ID NO: 30764 - protein, 9 aa, Homo Sapiens
IMAHCRHEL

SEQ ID NO: 30765 - protein, 9 aa, Homo Sapiens
DGWVTDYFS

SEQ ID NO: 30766 - protein, 9 aa, Homo Sapiens
AAVGPLVAV

SEQ ID NO: 30767 - protein, 9 aa, Homo Sapiens
VAVGALVSQ

SEQ ID NO: 30768 - protein, 9 aa, Homo Sapiens
HTESSWGSD

SEQ ID NO: 30769 - protein, 9 aa, Homo Sapiens
MQAADARKF

SEQ ID NO: 30770 - protein, 9 aa, Homo Sapiens
DCCYRRLEK

SEQ ID NO: 30771 - protein, 9 aa, Homo Sapiens
LSREAVHRA

SEQ ID NO: 30772 - protein, 9 aa, Homo Sapiens
LSGFVAEAV

SEQ ID NO: 30773 - protein, 9 aa, Homo Sapiens
HAHDCCYRR

SEQ ID NO: 30774 - protein, 9 aa, Homo Sapiens
LLPFFSTSN

SEQ ID NO: 30775 - protein, 9 aa, Homo Sapiens
SSLSSSSSQ

SEQ ID NO: 30776 - protein, 9 aa, Homo Sapiens
ACFGTFLPG

SEQ ID NO: 30777 - protein, 9 aa, Homo Sapiens
QHNTSVAAK

SEQ ID NO: 30778 - protein, 9 aa, Homo Sapiens
DYFSQTPLM

SEQ ID NO: 30779 - protein, 9 aa, Homo Sapiens
GWPCLHPDD

SEQ ID NO: 30780 - protein, 9 aa, Homo Sapiens
CFDLVTHNQ

SEQ ID NO: 30781 - protein, 9 aa, Homo Sapiens
CGLRLKQQA

SEQ ID NO: 30782 - protein, 9 aa, Homo Sapiens
NKAAIGEEV

SEQ ID NO: 30783 - protein, 9 aa, Homo Sapiens
RLKQQARAC

SEQ ID NO: 30784 - protein, 9 aa, Homo Sapiens
RALAKALAA

SEQ ID NO: 30785 - protein, 9 aa, Homo Sapiens
CFITLKTFT

SEQ ID NO: 30786 - protein, 9 aa, Homo Sapiens
QGILKHLKL

SEQ ID NO: 30787 - protein, 9 aa, Homo Sapiens
QINAASRAL

SEQ ID NO: 30788 - protein, 9 aa, Homo Sapiens
PHIYAWLCG

SEQ ID NO: 30789 - protein, 9 aa, Homo Sapiens
DEQDIVHIR

SEQ ID NO: 30790 - protein, 9 aa, Homo Sapiens
LAPTPGTSA

SEQ ID NO: 30791 - protein, 9 aa, Homo Sapiens
WPCLHPDDL

SEQ ID NO: 30792 - protein, 9 aa, Homo Sapiens
PKPLSEGVQ

SEQ ID NO: 30793 - protein, 9 aa, Homo Sapiens
SPTHISRCK

SEQ ID NO: 30794 - protein, 9 aa, Homo Sapiens
PYNRKGSKS

SEQ ID NO: 30795 - protein, 9 aa, Homo Sapiens
RSKYNSDWG

SEQ ID NO: 30796 - protein, 9 aa, Homo Sapiens
FMAYRKPLK

SEQ ID NO: 30797 - protein, 9 aa, Homo Sapiens
YNCKEAINV

SEQ ID NO: 30798 - protein, 9 aa, Homo Sapiens
ELELLSREA

SEQ ID NO: 30799 - protein, 9 aa, Homo Sapiens
IQYEYFNAV

SEQ ID NO: 30800 - protein, 9 aa, Homo Sapiens
IYLDTCFAL

SEQ ID NO: 30801 - protein, 9 aa, Homo Sapiens
HNTSVAAKQ

SEQ ID NO: 30802 - protein, 9 aa, Homo Sapiens
LLCMEELSK

SEQ ID NO: 30803 - protein, 9 aa, Homo Sapiens
VRPLATVDP

SEQ ID NO: 30804 - protein, 9 aa, Homo Sapiens
HGVWSTDKS

SEQ ID NO: 30805 - protein, 9 aa, Homo Sapiens
NEEQTQINL

SEQ ID NO: 30806 - protein, 9 aa, Homo Sapiens
RTTCCRPNC

SEQ ID NO: 30807 - protein, 9 aa, Homo Sapiens
MFSAVREDF

SEQ ID NO: 30808 - protein, 9 aa, Homo Sapiens
CIVCVTTYA

SEQ ID NO: 30809 - protein, 9 aa, Homo Sapiens
SLLEFFVPP

SEQ ID NO: 30810 - protein, 9 aa, Homo Sapiens
ALGEGLSAV

SEQ ID NO: 30811 - protein, 9 aa, Homo Sapiens
GGGGSLLEF

SEQ ID NO: 30812 - protein, 9 aa, Homo Sapiens
ALEILLYPS

SEQ ID NO: 30813 - protein, 9 aa, Homo Sapiens
PPELELLSR

SEQ ID NO: 30814 - protein, 9 aa, Homo Sapiens
KKIEAPPDN

SEQ ID NO: 30815 - protein, 9 aa, Homo Sapiens
ALGAAVGPL

SEQ ID NO: 30816 - protein, 9 aa, Homo Sapiens
VLGFISRAL

SEQ ID NO: 30817 - protein, 9 aa, Homo Sapiens
EVRSKSFHY

SEQ ID NO: 30818 - protein, 9 aa, Homo Sapiens
YQLKNQIQE

SEQ ID NO: 30819 - protein, 9 aa, Homo Sapiens
ALCRLRQEK

SEQ ID NO: 30820 - protein, 9 aa, Homo Sapiens
VLDESGGAI

SEQ ID NO: 30821 - protein, 9 aa, Homo Sapiens
SLHLRQASV

SEQ ID NO: 30822 - protein, 9 aa, Homo Sapiens
ASEIMPLPQ

SEQ ID NO: 30823 - protein, 9 aa, Homo Sapiens
SSSTISKKP

SEQ ID NO: 30824 - protein, 9 aa, Homo Sapiens
WLCTGMSRS

SEQ ID NO: 30825 - protein, 9 aa, Homo Sapiens
YSDDIDLRK

SEQ ID NO: 30826 - protein, 9 aa, Homo Sapiens
LLEAQKEPV

SEQ ID NO: 30827 - protein, 9 aa, Homo Sapiens
QLPNSDALQ

SEQ ID NO: 30828 - protein, 9 aa, Homo Sapiens
GYCCIYCPR

SEQ ID NO: 30829 - protein, 9 aa, Homo Sapiens
SMDYFDDIG

SEQ ID NO: 30830 - protein, 9 aa, Homo Sapiens
PIPCPLRMS

SEQ ID NO: 30831 - protein, 9 aa, Homo Sapiens
PNSTDLEET

SEQ ID NO: 30832 - protein, 9 aa, Homo Sapiens
RWRGPTGPE

SEQ ID NO: 30833 - protein, 9 aa, Homo Sapiens
HSIDNVCID

SEQ ID NO: 30834 - protein, 9 aa, Homo Sapiens
VDPVMLQKR

SEQ ID NO: 30835 - protein, 9 aa, Homo Sapiens
IHCERKLYQ

SEQ ID NO: 30836 - protein, 9 aa, Homo Sapiens
GKMANRNHL

SEQ ID NO: 30837 - protein, 9 aa, Homo Sapiens
EFDADIQYE

SEQ ID NO: 30838 - protein, 9 aa, Homo Sapiens
MANRNHLKL

SEQ ID NO: 30839 - protein, 9 aa, Homo Sapiens
LAYSPLDEK

SEQ ID NO: 30840 - protein, 9 aa, Homo Sapiens
HPGYLSGKG

SEQ ID NO: 30841 - protein, 9 aa, Homo Sapiens
KFFPCFDEP

SEQ ID NO: 30842 - protein, 9 aa, Homo Sapiens
KEAINVLSH

SEQ ID NO: 30843 - protein, 9 aa, Homo Sapiens
CEMENKETL

SEQ ID NO: 30844 - protein, 9 aa, Homo Sapiens
QYMHTGTMV

SEQ ID NO: 30845 - protein, 9 aa, Homo Sapiens
LATVDPVML

SEQ ID NO: 30846 - protein, 9 aa, Homo Sapiens
QLCDHILFV

SEQ ID NO: 30847 - protein, 9 aa, Homo Sapiens
RSTAYVGTF

SEQ ID NO: 30848 - protein, 9 aa, Homo Sapiens
GEGGGGSLL

SEQ ID NO: 30849 - protein, 9 aa, Homo Sapiens
VNAVNCSMF

SEQ ID NO: 30850 - protein, 9 aa, Homo Sapiens
AEGLATMWA

SEQ ID NO: 30851 - protein, 9 aa, Homo Sapiens
HLEKETPVH

SEQ ID NO: 30852 - protein, 9 aa, Homo Sapiens
GFIPRALGF

SEQ ID NO: 30853 - protein, 9 aa, Homo Sapiens
KEGIHVVDW

SEQ ID NO: 30854 - protein, 9 aa, Homo Sapiens
STISKKPEL

SEQ ID NO: 30855 - protein, 9 aa, Homo Sapiens
AAPAGCEME

SEQ ID NO: 30856 - protein, 9 aa, Homo Sapiens
DGLMDEFPK

SEQ ID NO: 30857 - protein, 9 aa, Homo Sapiens
DLFSTTDCK

SEQ ID NO: 30858 - protein, 9 aa, Homo Sapiens
LASVGALVF

SEQ ID NO: 30859 - protein, 9 aa, Homo Sapiens
QGQLGSLGN

SEQ ID NO: 30860 - protein, 9 aa, Homo Sapiens
TLGLRMLLA

SEQ ID NO: 30861 - protein, 9 aa, Homo Sapiens
YAPDLPCDV

SEQ ID NO: 30862 - protein, 9 aa, Homo Sapiens
YSHNEEGKK

SEQ ID NO: 30863 - protein, 9 aa, Homo Sapiens
EGLAADLTF

SEQ ID NO: 30864 - protein, 9 aa, Homo Sapiens
ETIYLDTCF

SEQ ID NO: 30865 - protein, 9 aa, Homo Sapiens
TKEAMMDFF

SEQ ID NO: 30866 - protein, 9 aa, Homo Sapiens
VVYLPYDYV

SEQ ID NO: 30867 - protein, 9 aa, Homo Sapiens
VLSAQGFLS

SEQ ID NO: 30868 - protein, 9 aa, Homo Sapiens
RALGFIPRA

SEQ ID NO: 30869 - protein, 9 aa, Homo Sapiens
TDYSDDIDL

SEQ ID NO: 30870 - protein, 9 aa, Homo Sapiens
ENFSKDLYL

SEQ ID NO: 30871 - protein, 9 aa, Homo Sapiens
PEAVSMETK

SEQ ID NO: 30872 - protein, 9 aa, Homo Sapiens
CKTDLRFQS

SEQ ID NO: 30873 - protein, 9 aa, Homo Sapiens
ENMALENRG

SEQ ID NO: 30874 - protein, 9 aa, Homo Sapiens
PFFSTSNGW

SEQ ID NO: 30875 - protein, 9 aa, Homo Sapiens
GVHPLMAAQ

SEQ ID NO: 30876 - protein, 9 aa, Homo Sapiens
HWCCYLKCK

SEQ ID NO: 30877 - protein, 9 aa, Homo Sapiens
VDALVLDQG

SEQ ID NO: 30878 - protein, 9 aa, Homo Sapiens
NCKEAINVL

SEQ ID NO: 30879 - protein, 9 aa, Homo Sapiens
AADKRKALE

SEQ ID NO: 30880 - protein, 9 aa, Homo Sapiens
GFITVGCRG

SEQ ID NO: 30881 - protein, 9 aa, Homo Sapiens
RMSEMLVVP

SEQ ID NO: 30882 - protein, 9 aa, Homo Sapiens
PATPPTWTS

SEQ ID NO: 30883 - protein, 9 aa, Homo Sapiens
GPDCGHGSF

SEQ ID NO: 30884 - protein, 9 aa, Homo Sapiens
LGFIPRALG

SEQ ID NO: 30885 - protein, 9 aa, Homo Sapiens
RRFHFVYQA

SEQ ID NO: 30886 - protein, 9 aa, Homo Sapiens
QGGPPGTGL

SEQ ID NO: 30887 - protein, 9 aa, Homo Sapiens
VALTCGSNG

SEQ ID NO: 30888 - protein, 9 aa, Homo Sapiens
RTASQTPSV

SEQ ID NO: 30889 - protein, 9 aa, Homo Sapiens
RKKHKAQHR

SEQ ID NO: 30890 - protein, 9 aa, Homo Sapiens
PAAAPAGCE

SEQ ID NO: 30891 - protein, 9 aa, Homo Sapiens
VMYSQINAA

SEQ ID NO: 30892 - protein, 9 aa, Homo Sapiens
LEFGTLSFK

SEQ ID NO: 30893 - protein, 9 aa, Homo Sapiens
GHLKRWPYG

SEQ ID NO: 30894 - protein, 9 aa, Homo Sapiens
YDYVCKKGE

SEQ ID NO: 30895 - protein, 9 aa, Homo Sapiens
IYCPRGNRY

SEQ ID NO: 30896 - protein, 9 aa, Homo Sapiens
SREAVHRAV

SEQ ID NO: 30897 - protein, 9 aa, Homo Sapiens
LASNQQNIF

SEQ ID NO: 30898 - protein, 9 aa, Homo Sapiens
VEDGFQELN

SEQ ID NO: 30899 - protein, 9 aa, Homo Sapiens
SKLRHPGYL

SEQ ID NO: 30900 - protein, 9 aa, Homo Sapiens
APMKQLKRQ

SEQ ID NO: 30901 - protein, 9 aa, Homo Sapiens
YCSPQKVKS

SEQ ID NO: 30902 - protein, 9 aa, Homo Sapiens
EGEGGGGSL

SEQ ID NO: 30903 - protein, 9 aa, Homo Sapiens
CPLRMSEML

SEQ ID NO: 30904 - protein, 9 aa, Homo Sapiens
LPKPLSEGV

SEQ ID NO: 30905 - protein, 9 aa, Homo Sapiens
HVASPERHP

SEQ ID NO: 30906 - protein, 9 aa, Homo Sapiens
QMINSIAED

SEQ ID NO: 30907 - protein, 9 aa, Homo Sapiens
LQYVNVRLR

SEQ ID NO: 30908 - protein, 9 aa, Homo Sapiens
QGVAQLSME

SEQ ID NO: 30909 - protein, 9 aa, Homo Sapiens
SSSMFQEFQ

SEQ ID NO: 30910 - protein, 9 aa, Homo Sapiens
ARAPGFIPG

SEQ ID NO: 30911 - protein, 9 aa, Homo Sapiens
AFVKNDLYE

SEQ ID NO: 30912 - protein, 9 aa, Homo Sapiens
ELNKNSSKD

SEQ ID NO: 30913 - protein, 9 aa, Homo Sapiens
ALENRGFAR

SEQ ID NO: 30914 - protein, 9 aa, Homo Sapiens
ALVRPLATV

SEQ ID NO: 30915 - protein, 9 aa, Homo Sapiens
GEVVREIGQ

SEQ ID NO: 30916 - protein, 9 aa, Homo Sapiens
LNVFGLPSI

SEQ ID NO: 30917 - protein, 9 aa, Homo Sapiens
SENDRSYSH

SEQ ID NO: 30918 - protein, 9 aa, Homo Sapiens
PRGNRYCRR

SEQ ID NO: 30919 - protein, 9 aa, Homo Sapiens
VPASSFRQR

SEQ ID NO: 30920 - protein, 9 aa, Homo Sapiens
PHPAADSSS

SEQ ID NO: 30921 - protein, 9 aa, Homo Sapiens
LLLLLRLLL

SEQ ID NO: 30922 - protein, 9 aa, Homo Sapiens
FCRLEKCLE

SEQ ID NO: 30923 - protein, 9 aa, Homo Sapiens
LRFIARAPG

SEQ ID NO: 30924 - protein, 9 aa, Homo Sapiens
LDACQNGMN

SEQ ID NO: 30925 - protein, 9 aa, Homo Sapiens
IYAWLCGLL

SEQ ID NO: 30926 - protein, 9 aa, Homo Sapiens
GVAQLSMEE

SEQ ID NO: 30927 - protein, 9 aa, Homo Sapiens
CSYPPCTLT

SEQ ID NO: 30928 - protein, 9 aa, Homo Sapiens
MTGLNLQKS

SEQ ID NO: 30929 - protein, 9 aa, Homo Sapiens
IPGVTSPSN

SEQ ID NO: 30930 - protein, 9 aa, Homo Sapiens
TPPFLLLLV

SEQ ID NO: 30931 - protein, 9 aa, Homo Sapiens
CENNYIQAA

SEQ ID NO: 30932 - protein, 9 aa, Homo Sapiens
RWGKPYNYK

SEQ ID NO: 30933 - protein, 9 aa, Homo Sapiens
QRTLFLGVQ

SEQ ID NO: 30934 - protein, 9 aa, Homo Sapiens
TKKLIKTDK

SEQ ID NO: 30935 - protein, 9 aa, Homo Sapiens
KSGASARRF

SEQ ID NO: 30936 - protein, 9 aa, Homo Sapiens
AKQVRAVGE

SEQ ID NO: 30937 - protein, 9 aa, Homo Sapiens
RVSQRLSPR

SEQ ID NO: 30938 - protein, 9 aa, Homo Sapiens
PLATVDPVM

SEQ ID NO: 30939 - protein, 9 aa, Homo Sapiens
FKDKTRAGK

SEQ ID NO: 30940 - protein, 9 aa, Homo Sapiens
FLVLKGELK

SEQ ID NO: 30941 - protein, 9 aa, Homo Sapiens
MAAVAQRNM

SEQ ID NO: 30942 - protein, 9 aa, Homo Sapiens
LGEGLAADL

SEQ ID NO: 30943 - protein, 9 aa, Homo Sapiens
RPTEEKPGS

SEQ ID NO: 30944 - protein, 9 aa, Homo Sapiens
VEWPDFLSH

SEQ ID NO: 30945 - protein, 9 aa, Homo Sapiens
ILKHLKLRC

SEQ ID NO: 30946 - protein, 9 aa, Homo Sapiens
SNLKSMDYF

SEQ ID NO: 30947 - protein, 9 aa, Homo Sapiens
ISAATGTSA

SEQ ID NO: 30948 - protein, 9 aa, Homo Sapiens
EHRHRWPHG

SEQ ID NO: 30949 - protein, 9 aa, Homo Sapiens
VVFDEAHSI

SEQ ID NO: 30950 - protein, 9 aa, Homo Sapiens
RCWQLSPGH

SEQ ID NO: 30951 - protein, 9 aa, Homo Sapiens
GLMDEFPKA

SEQ ID NO: 30952 - protein, 9 aa, Homo Sapiens
SAGQLLARL

SEQ ID NO: 30953 - protein, 9 aa, Homo Sapiens
REKDHTTHC

SEQ ID NO: 30954 - protein, 9 aa, Homo Sapiens
PVGPLARVG

SEQ ID NO: 30955 - protein, 9 aa, Homo Sapiens
FFLLHLWVK

SEQ ID NO: 30956 - protein, 9 aa, Homo Sapiens
RGPTGPEGT

SEQ ID NO: 30957 - protein, 9 aa, Homo Sapiens
PAFSSTLEG

SEQ ID NO: 30958 - protein, 9 aa, Homo Sapiens
NWFDTFIIF

SEQ ID NO: 30959 - protein, 9 aa, Homo Sapiens
TFTPPVSRN

SEQ ID NO: 30960 - protein, 9 aa, Homo Sapiens
AAHHKFQSQ

SEQ ID NO: 30961 - protein, 9 aa, Homo Sapiens
IVKQKNEKG

SEQ ID NO: 30962 - protein, 9 aa, Homo Sapiens
QDCKTDLRF

SEQ ID NO: 30963 - protein, 9 aa, Homo Sapiens
RAPGFIPGA

SEQ ID NO: 30964 - protein, 9 aa, Homo Sapiens
GGAAEALAA

SEQ ID NO: 30965 - protein, 9 aa, Homo Sapiens
AAWQVGAGV

SEQ ID NO: 30966 - protein, 9 aa, Homo Sapiens
LILMALVKK

SEQ ID NO: 30967 - protein, 9 aa, Homo Sapiens
AMKSLSRIT

SEQ ID NO: 30968 - protein, 9 aa, Homo Sapiens
DAVKLDAIE

SEQ ID NO: 30969 - protein, 9 aa, Homo Sapiens
GQLLARLDA

SEQ ID NO: 30970 - protein, 9 aa, Homo Sapiens
EMVMTNNCS

SEQ ID NO: 30971 - protein, 9 aa, Homo Sapiens
KSFHYGNLS

SEQ ID NO: 30972 - protein, 9 aa, Homo Sapiens
TIFVVDEDC

SEQ ID NO: 30973 - protein, 9 aa, Homo Sapiens
CRLEKCLEM

SEQ ID NO: 30974 - protein, 9 aa, Homo Sapiens
HLRQAFSLQ

SEQ ID NO: 30975 - protein, 9 aa, Homo Sapiens
RNDLEPGLG

SEQ ID NO: 30976 - protein, 9 aa, Homo Sapiens
VAKQVRAVG

SEQ ID NO: 30977 - protein, 9 aa, Homo Sapiens
HRGHVEWPD

SEQ ID NO: 30978 - protein, 9 aa, Homo Sapiens
GLLCMEELS

SEQ ID NO: 30979 - protein, 9 aa, Homo Sapiens
LQFQTRETQ

SEQ ID NO: 30980 - protein, 9 aa, Homo Sapiens
FSYFPSYID

SEQ ID NO: 30981 - protein, 9 aa, Homo Sapiens
HPDSRATGA

SEQ ID NO: 30982 - protein, 9 aa, Homo Sapiens
RGFARRIYE

SEQ ID NO: 30983 - protein, 9 aa, Homo Sapiens
CRDEMAAAL

SEQ ID NO: 30984 - protein, 9 aa, Homo Sapiens
RAKAGVQLG

SEQ ID NO: 30985 - protein, 9 aa, Homo Sapiens
KFLRSQGFK

SEQ ID NO: 30986 - protein, 9 aa, Homo Sapiens
VGALVLDES

SEQ ID NO: 30987 - protein, 9 aa, Homo Sapiens
HRWPHGVWS

SEQ ID NO: 30988 - protein, 9 aa, Homo Sapiens
GFGGVHFVN

SEQ ID NO: 30989 - protein, 9 aa, Homo Sapiens
VLWQRASTT

SEQ ID NO: 30990 - protein, 9 aa, Homo Sapiens
PLSSAALCG

SEQ ID NO: 30991 - protein, 9 aa, Homo Sapiens
TLAAIVDAV

SEQ ID NO: 30992 - protein, 9 aa, Homo Sapiens
LPHIYAWLC

SEQ ID NO: 30993 - protein, 9 aa, Homo Sapiens
DKGRPLGEA

SEQ ID NO: 30994 - protein, 9 aa, Homo Sapiens
LGAAVGPLV

SEQ ID NO: 30995 - protein, 9 aa, Homo Sapiens
NLKSMDYFD

SEQ ID NO: 30996 - protein, 9 aa, Homo Sapiens
QSSSALTDH

SEQ ID NO: 30997 - protein, 9 aa, Homo Sapiens
SDCLHLNPD

SEQ ID NO: 30998 - protein, 9 aa, Homo Sapiens
HLQREPRAR

SEQ ID NO: 30999 - protein, 9 aa, Homo Sapiens
QEKPQSLQA

SEQ ID NO: 31000 - protein, 9 aa, Homo Sapiens
VPILIPCDR

SEQ ID NO: 31001 - protein, 9 aa, Homo Sapiens
AQLLPRLEG

SEQ ID NO: 31002 - protein, 9 aa, Homo Sapiens
IDKNLELFR

SEQ ID NO: 31003 - protein, 9 aa, Homo Sapiens
LKGELKLAR

SEQ ID NO: 31004 - protein, 9 aa, Homo Sapiens
AATGTFVGP

SEQ ID NO: 31005 - protein, 9 aa, Homo Sapiens
TGKSQPKAQ

SEQ ID NO: 31006 - protein, 9 aa, Homo Sapiens
TKGTVLPDL

SEQ ID NO: 31007 - protein, 9 aa, Homo Sapiens
SRTASQTPS

SEQ ID NO: 31008 - protein, 9 aa, Homo Sapiens
LCLLLLGNV

SEQ ID NO: 31009 - protein, 9 aa, Homo Sapiens
GSSLSSSSS

SEQ ID NO: 31010 - protein, 9 aa, Homo Sapiens
EEPNSTDLE

SEQ ID NO: 31011 - protein, 9 aa, Homo Sapiens
HVLALLRWK

SEQ ID NO: 31012 - protein, 9 aa, Homo Sapiens
YVTYTPLLG

SEQ ID NO: 31013 - protein, 9 aa, Homo Sapiens
CMEELSKKD

SEQ ID NO: 31014 - protein, 9 aa, Homo Sapiens
ETQGILKHL

SEQ ID NO: 31015 - protein, 9 aa, Homo Sapiens
YMTMLNQLY

SEQ ID NO: 31016 - protein, 9 aa, Homo Sapiens
SRCKISLSS

SEQ ID NO: 31017 - protein, 9 aa, Homo Sapiens
AALGALKKN

SEQ ID NO: 31018 - protein, 9 aa, Homo Sapiens
CENTAGHLK

SEQ ID NO: 31019 - protein, 9 aa, Homo Sapiens
GVRHLKLNT

SEQ ID NO: 31020 - protein, 9 aa, Homo Sapiens
GSCETQGIL

SEQ ID NO: 31021 - protein, 9 aa, Homo Sapiens
TGLNLQKSF

SEQ ID NO: 31022 - protein, 9 aa, Homo Sapiens
QAADKRKAL

SEQ ID NO: 31023 - protein, 9 aa, Homo Sapiens
AIVKQKNEK

SEQ ID NO: 31024 - protein, 9 aa, Homo Sapiens
ALVLDQGGA

SEQ ID NO: 31025 - protein, 9 aa, Homo Sapiens
HGSFHQQYW

SEQ ID NO: 31026 - protein, 9 aa, Homo Sapiens
ISSGLSSHK

SEQ ID NO: 31027 - protein, 9 aa, Homo Sapiens
LYVHPDSRA

SEQ ID NO: 31028 - protein, 9 aa, Homo Sapiens
RCRQQGPCG

SEQ ID NO: 31029 - protein, 9 aa, Homo Sapiens
ANAPMKQLK

SEQ ID NO: 31030 - protein, 9 aa, Homo Sapiens
ELHNKLSVI

SEQ ID NO: 31031 - protein, 9 aa, Homo Sapiens
INSNRSTAY

SEQ ID NO: 31032 - protein, 9 aa, Homo Sapiens
EEHRHRWPH

SEQ ID NO: 31033 - protein, 9 aa, Homo Sapiens
TQHDQVGFI

SEQ ID NO: 31034 - protein, 9 aa, Homo Sapiens
NWKLSKLNE

SEQ ID NO: 31035 - protein, 9 aa, Homo Sapiens
PRFIARALG

SEQ ID NO: 31036 - protein, 9 aa, Homo Sapiens
VASPERHPL

SEQ ID NO: 31037 - protein, 9 aa, Homo Sapiens
VQGVNSYGD

SEQ ID NO: 31038 - protein, 9 aa, Homo Sapiens
NDLEPGLGH

SEQ ID NO: 31039 - protein, 9 aa, Homo Sapiens
LEVSELNKN

SEQ ID NO: 31040 - protein, 9 aa, Homo Sapiens
EALPADATD

SEQ ID NO: 31041 - protein, 9 aa, Homo Sapiens
CTIFVVDED

SEQ ID NO: 31042 - protein, 9 aa, Homo Sapiens
HNQTYHFQA

SEQ ID NO: 31043 - protein, 9 aa, Homo Sapiens
AEADLPKLD

SEQ ID NO: 31044 - protein, 9 aa, Homo Sapiens
KLRCRQQGP

SEQ ID NO: 31045 - protein, 9 aa, Homo Sapiens
GSLLEFFVP

SEQ ID NO: 31046 - protein, 9 aa, Homo Sapiens
SYCSPQKVK

SEQ ID NO: 31047 - protein, 9 aa, Homo Sapiens
IAEDGSNRT

SEQ ID NO: 31048 - protein, 9 aa, Homo Sapiens
LYQSSSALT

SEQ ID NO: 31049 - protein, 9 aa, Homo Sapiens
PAATGKPPT

SEQ ID NO: 31050 - protein, 9 aa, Homo Sapiens
LVLDQGGAP

SEQ ID NO: 31051 - protein, 9 aa, Homo Sapiens
LSKLNEMND

SEQ ID NO: 31052 - protein, 9 aa, Homo Sapiens
LPTPGPATP

SEQ ID NO: 31053 - protein, 9 aa, Homo Sapiens
VTTYAINVS

SEQ ID NO: 31054 - protein, 9 aa, Homo Sapiens
FSHKFDYEL

SEQ ID NO: 31055 - protein, 9 aa, Homo Sapiens
YFEVEDGFQ

SEQ ID NO: 31056 - protein, 9 aa, Homo Sapiens
KLKFSGFTF

SEQ ID NO: 31057 - protein, 9 aa, Homo Sapiens
LFLHLEKET

SEQ ID NO: 31058 - protein, 9 aa, Homo Sapiens
PLMAAQGRV

SEQ ID NO: 31059 - protein, 9 aa, Homo Sapiens
LVLDESGGA

SEQ ID NO: 31060 - protein, 9 aa, Homo Sapiens
LCMEELSKK

SEQ ID NO: 31061 - protein, 9 aa, Homo Sapiens
KQVRAVGEG

SEQ ID NO: 31062 - protein, 9 aa, Homo Sapiens
PFCSKPTSA

SEQ ID NO: 31063 - protein, 9 aa, Homo Sapiens
RWKAYLLHT

SEQ ID NO: 31064 - protein, 9 aa, Homo Sapiens
LPYDYVCKK

SEQ ID NO: 31065 - protein, 9 aa, Homo Sapiens
RSCAAPGPG

SEQ ID NO: 31066 - protein, 9 aa, Homo Sapiens
GRVSQRLSP

SEQ ID NO: 31067 - protein, 9 aa, Homo Sapiens
EHNWFDTFI

SEQ ID NO: 31068 - protein, 9 aa, Homo Sapiens
TAVLSAQGF

SEQ ID NO: 31069 - protein, 9 aa, Homo Sapiens
ADATAEGPL

SEQ ID NO: 31070 - protein, 9 aa, Homo Sapiens
LLPRLEGYF

SEQ ID NO: 31071 - protein, 9 aa, Homo Sapiens
ALGFKLRAL

SEQ ID NO: 31072 - protein, 9 aa, Homo Sapiens
LLTGVDALV

SEQ ID NO: 31073 - protein, 9 aa, Homo Sapiens
LVLPRRSEE

SEQ ID NO: 31074 - protein, 9 aa, Homo Sapiens
LCGAGPTRR

SEQ ID NO: 31075 - protein, 9 aa, Homo Sapiens
NAASRALDD

SEQ ID NO: 31076 - protein, 9 aa, Homo Sapiens
LSFKFWALG

SEQ ID NO: 31077 - protein, 9 aa, Homo Sapiens
GRPLGEALA

SEQ ID NO: 31078 - protein, 9 aa, Homo Sapiens
ASPERHPLY

SEQ ID NO: 31079 - protein, 9 aa, Homo Sapiens
DCKTDLRFQ

SEQ ID NO: 31080 - protein, 9 aa, Homo Sapiens
CGVDSECIN

SEQ ID NO: 31081 - protein, 9 aa, Homo Sapiens
AGQLLARLD

SEQ ID NO: 31082 - protein, 9 aa, Homo Sapiens
SPAAAPAGC

SEQ ID NO: 31083 - protein, 9 aa, Homo Sapiens
WCCYLKCKK

SEQ ID NO: 31084 - protein, 9 aa, Homo Sapiens
PRRWGKPYN

SEQ ID NO: 31085 - protein, 9 aa, Homo Sapiens
LLAGLPAHL

SEQ ID NO: 31086 - protein, 9 aa, Homo Sapiens
RGHVEWPDF

SEQ ID NO: 31087 - protein, 9 aa, Homo Sapiens
LSVLGFISR

SEQ ID NO: 31088 - protein, 9 aa, Homo Sapiens
FLSVPFTYY

SEQ ID NO: 31089 - protein, 9 aa, Homo Sapiens
AAQGRVLAI

SEQ ID NO: 31090 - protein, 9 aa, Homo Sapiens
TMWALVGLL

SEQ ID NO: 31091 - protein, 9 aa, Homo Sapiens
KFSYFPSYI

SEQ ID NO: 31092 - protein, 9 aa, Homo Sapiens
QVSSSSSMF

SEQ ID NO: 31093 - protein, 9 aa, Homo Sapiens
TKSLTDAAV

SEQ ID NO: 31094 - protein, 9 aa, Homo Sapiens
SGFVAEAVV

SEQ ID NO: 31095 - protein, 9 aa, Homo Sapiens
NTAGHLKDA

SEQ ID NO: 31096 - protein, 9 aa, Homo Sapiens
DLVTHNQTY

SEQ ID NO: 31097 - protein, 9 aa, Homo Sapiens
QWALAIMCR

SEQ ID NO: 31098 - protein, 9 aa, Homo Sapiens
GEGLAATGT

SEQ ID NO: 31099 - protein, 9 aa, Homo Sapiens
GPALAPAES

SEQ ID NO: 31100 - protein, 9 aa, Homo Sapiens
IPRALGFKL

SEQ ID NO: 31101 - protein, 9 aa, Homo Sapiens
ENTAGHLKD

SEQ ID NO: 31102 - protein, 9 aa, Homo Sapiens
GITPLILAL

SEQ ID NO: 31103 - protein, 9 aa, Homo Sapiens
ENDRSYSHH

SEQ ID NO: 31104 - protein, 9 aa, Homo Sapiens
VSEGLRDWL

SEQ ID NO: 31105 - protein, 9 aa, Homo Sapiens
MSEMLVVPE

SEQ ID NO: 31106 - protein, 9 aa, Homo Sapiens
PGAPRFIAR

SEQ ID NO: 31107 - protein, 9 aa, Homo Sapiens
FLEGKVASL

SEQ ID NO: 31108 - protein, 9 aa, Homo Sapiens
RALEGLLPG

SEQ ID NO: 31109 - protein, 9 aa, Homo Sapiens
DLTDYLIKI

SEQ ID NO: 31110 - protein, 9 aa, Homo Sapiens
PWIMEGVFP

SEQ ID NO: 31111 - protein, 9 aa, Homo Sapiens
FWALGFELS

SEQ ID NO: 31112 - protein, 9 aa, Homo Sapiens
ALGEGLAAD

SEQ ID NO: 31113 - protein, 9 aa, Homo Sapiens
VSSSSSMFQ

SEQ ID NO: 31114 - protein, 9 aa, Homo Sapiens
VPFCSKPTS

SEQ ID NO: 31115 - protein, 9 aa, Homo Sapiens
KSHPKRGLV

SEQ ID NO: 31116 - protein, 9 aa, Homo Sapiens
PTWTSKGSC

SEQ ID NO: 31117 - protein, 9 aa, Homo Sapiens
LLLVTSSHK

SEQ ID NO: 31118 - protein, 9 aa, Homo Sapiens
ATMWALVGL

SEQ ID NO: 31119 - protein, 9 aa, Homo Sapiens
QLLPRLEGY

SEQ ID NO: 31120 - protein, 9 aa, Homo Sapiens
MSRSWARLC

SEQ ID NO: 31121 - protein, 9 aa, Homo Sapiens
WTSKGSCET

SEQ ID NO: 31122 - protein, 9 aa, Homo Sapiens
ALTDHDPLG

SEQ ID NO: 31123 - protein, 9 aa, Homo Sapiens
KSFKPAIQE

SEQ ID NO: 31124 - protein, 9 aa, Homo Sapiens
VLKGELKLA

SEQ ID NO: 31125 - protein, 9 aa, Homo Sapiens
ATDENPCGV

SEQ ID NO: 31126 - protein, 9 aa, Homo Sapiens
PMKQLKRQL

SEQ ID NO: 31127 - protein, 9 aa, Homo Sapiens
CPKEMVSTS

SEQ ID NO: 31128 - protein, 9 aa, Homo Sapiens
VFGLPSIYS

SEQ ID NO: 31129 - protein, 9 aa, Homo Sapiens
DQGGAPPEA

SEQ ID NO: 31130 - protein, 9 aa, Homo Sapiens
RFLSGFVAE

SEQ ID NO: 31131 - protein, 9 aa, Homo Sapiens
VTIHVPPTI

SEQ ID NO: 31132 - protein, 9 aa, Homo Sapiens
CIAFIHSND

SEQ ID NO: 31133 - protein, 9 aa, Homo Sapiens
AVLSAQGFL

SEQ ID NO: 31134 - protein, 9 aa, Homo Sapiens
GDLFSTTDC

SEQ ID NO: 31135 - protein, 9 aa, Homo Sapiens
GCEMENKET

SEQ ID NO: 31136 - protein, 9 aa, Homo Sapiens
DRVVCSSGA

SEQ ID NO: 31137 - protein, 9 aa, Homo Sapiens
LPELWALVN

SEQ ID NO: 31138 - protein, 9 aa, Homo Sapiens
GVAAGMGDK

SEQ ID NO: 31139 - protein, 9 aa, Homo Sapiens
SFPAGFGGV

SEQ ID NO: 31140 - protein, 9 aa, Homo Sapiens
AYVDLAPTP

SEQ ID NO: 31141 - protein, 9 aa, Homo Sapiens
HLYLRPVHV

SEQ ID NO: 31142 - protein, 9 aa, Homo Sapiens
INQRFHAAH

SEQ ID NO: 31143 - protein, 9 aa, Homo Sapiens
THSSSTISK

SEQ ID NO: 31144 - protein, 9 aa, Homo Sapiens
VIALVRPLA

SEQ ID NO: 31145 - protein, 9 aa, Homo Sapiens
ILYYGFEDI

SEQ ID NO: 31146 - protein, 9 aa, Homo Sapiens
CPRGNRYCR

SEQ ID NO: 31147 - protein, 9 aa, Homo Sapiens
LQREPRARF

SEQ ID NO: 31148 - protein, 9 aa, Homo Sapiens
KYNSDWGET

SEQ ID NO: 31149 - protein, 9 aa, Homo Sapiens
INECESSPC

SEQ ID NO: 31150 - protein, 9 aa, Homo Sapiens
LVAKQVRAV

SEQ ID NO: 31151 - protein, 9 aa, Homo Sapiens
NNYIQAADK

SEQ ID NO: 31152 - protein, 9 aa, Homo Sapiens
GDIQRTLFL

SEQ ID NO: 31153 - protein, 9 aa, Homo Sapiens
VARLPEAVS

SEQ ID NO: 31154 - protein, 9 aa, Homo Sapiens
GAAWQVGAG

SEQ ID NO: 31155 - protein, 9 aa, Homo Sapiens
AYEWKPDEQ

SEQ ID NO: 31156 - protein, 9 aa, Homo Sapiens
GQVIRKALT

SEQ ID NO: 31157 - protein, 9 aa, Homo Sapiens
GRGWDLMQN

SEQ ID NO: 31158 - protein, 9 aa, Homo Sapiens
AVGEGLAAT

SEQ ID NO: 31159 - protein, 9 aa, Homo Sapiens
VPQSTGELT

SEQ ID NO: 31160 - protein, 9 aa, Homo Sapiens
SKGSCETQG

SEQ ID NO: 31161 - protein, 9 aa, Homo Sapiens
AAALGALKK

SEQ ID NO: 31162 - protein, 9 aa, Homo Sapiens
ITPLILALN

SEQ ID NO: 31163 - protein, 9 aa, Homo Sapiens
SYGSDSEND

SEQ ID NO: 31164 - protein, 9 aa, Homo Sapiens
EPGLGHFSL

SEQ ID NO: 31165 - protein, 9 aa, Homo Sapiens
VSALVAKQV

SEQ ID NO: 31166 - protein, 9 aa, Homo Sapiens
AGVQLGTNA

SEQ ID NO: 31167 - protein, 9 aa, Homo Sapiens
KGELKLARN

SEQ ID NO: 31168 - protein, 9 aa, Homo Sapiens
TQTGRMRRW

SEQ ID NO: 31169 - protein, 9 aa, Homo Sapiens
ALRFIARAP

SEQ ID NO: 31170 - protein, 9 aa, Homo Sapiens
QKHLRTFLE

SEQ ID NO: 31171 - protein, 9 aa, Homo Sapiens
LEETLERIK

SEQ ID NO: 31172 - protein, 9 aa, Homo Sapiens
RAGQVIRKA

SEQ ID NO: 31173 - protein, 9 aa, Homo Sapiens
QAFLEGKVA

SEQ ID NO: 31174 - protein, 9 aa, Homo Sapiens
DYFDDIGPS

SEQ ID NO: 31175 - protein, 9 aa, Homo Sapiens
QGNYLLCLL

SEQ ID NO: 31176 - protein, 9 aa, Homo Sapiens
SGASARRFH

SEQ ID NO: 31177 - protein, 9 aa, Homo Sapiens
PLEVSELNK

SEQ ID NO: 31178 - protein, 9 aa, Homo Sapiens
RDWLPPLGS

SEQ ID NO: 31179 - protein, 9 aa, Homo Sapiens
VGLLTGVDA

SEQ ID NO: 31180 - protein, 9 aa, Homo Sapiens
SFSLCSDQT

SEQ ID NO: 31181 - protein, 9 aa, Homo Sapiens
VPFTYYKQL

SEQ ID NO: 31182 - protein, 9 aa, Homo Sapiens
LFLGVQKHL

SEQ ID NO: 31183 - protein, 9 aa, Homo Sapiens
HHKFQSQAD

SEQ ID NO: 31184 - protein, 9 aa, Homo Sapiens
YYGFEDIFR

SEQ ID NO: 31185 - protein, 9 aa, Homo Sapiens
VGLLARVSA

SEQ ID NO: 31186 - protein, 9 aa, Homo Sapiens
LCTPPTCAP

SEQ ID NO: 31187 - protein, 9 aa, Homo Sapiens
WKAYLLHTT

SEQ ID NO: 31188 - protein, 9 aa, Homo Sapiens
SYFPSYIDK

SEQ ID NO: 31189 - protein, 9 aa, Homo Sapiens
DYELQDVSS

SEQ ID NO: 31190 - protein, 9 aa, Homo Sapiens
CILYYGFED

SEQ ID NO: 31191 - protein, 9 aa, Homo Sapiens
ATGTFVGPL

SEQ ID NO: 31192 - protein, 9 aa, Homo Sapiens
HDCCYRRLE

SEQ ID NO: 31193 - protein, 9 aa, Homo Sapiens
CSKPTSASL

SEQ ID NO: 31194 - protein, 9 aa, Homo Sapiens
CKEAINVLS

SEQ ID NO: 31195 - protein, 9 aa, Homo Sapiens
IALAALGAA

SEQ ID NO: 31196 - protein, 9 aa, Homo Sapiens
ALAADATAE

SEQ ID NO: 31197 - protein, 9 aa, Homo Sapiens
GLLPKPLSE

SEQ ID NO: 31198 - protein, 9 aa, Homo Sapiens
PKAETIYLD

SEQ ID NO: 31199 - protein, 9 aa, Homo Sapiens
EALAAHGAP

SEQ ID NO: 31200 - protein, 9 aa, Homo Sapiens
NRCQFCRLE

SEQ ID NO: 31201 - protein, 9 aa, Homo Sapiens
GAAVGPLVA

SEQ ID NO: 31202 - protein, 9 aa, Homo Sapiens
EGKKAFATC

SEQ ID NO: 31203 - protein, 9 aa, Homo Sapiens
PAQGRVSQR

SEQ ID NO: 31204 - protein, 9 aa, Homo Sapiens
LAFVKNDLY

SEQ ID NO: 31205 - protein, 9 aa, Homo Sapiens
LTDHDPLGP

SEQ ID NO: 31206 - protein, 9 aa, Homo Sapiens
GRMRRWLCT

SEQ ID NO: 31207 - protein, 9 aa, Homo Sapiens
PPAQGRVSQ

SEQ ID NO: 31208 - protein, 9 aa, Homo Sapiens
GWCFITLKT

SEQ ID NO: 31209 - protein, 9 aa, Homo Sapiens
LCENTAGHL

SEQ ID NO: 31210 - protein, 9 aa, Homo Sapiens
FIARALGFI

SEQ ID NO: 31211 - protein, 9 aa, Homo Sapiens
LDSDHKDQL

SEQ ID NO: 31212 - protein, 9 aa, Homo Sapiens
RVRSKYNSD

SEQ ID NO: 31213 - protein, 9 aa, Homo Sapiens
LYVTYTPLL

SEQ ID NO: 31214 - protein, 9 aa, Homo Sapiens
YKCHEVQLL

SEQ ID NO: 31215 - protein, 9 aa, Homo Sapiens
IERFTQHDQ

SEQ ID NO: 31216 - protein, 9 aa, Homo Sapiens
LEFLSVPFT

SEQ ID NO: 31217 - protein, 9 aa, Homo Sapiens
DGDGEDAIV

SEQ ID NO: 31218 - protein, 9 aa, Homo Sapiens
YIQAADKRK

SEQ ID NO: 31219 - protein, 9 aa, Homo Sapiens
KSMDYFDDI

SEQ ID NO: 31220 - protein, 9 aa, Homo Sapiens
LTGVDALVL

SEQ ID NO: 31221 - protein, 9 aa, Homo Sapiens
GVDQPGGLS

SEQ ID NO: 31222 - protein, 9 aa, Homo Sapiens
EKCLEMGMK

SEQ ID NO: 31223 - protein, 9 aa, Homo Sapiens
YKVIMSKRL

SEQ ID NO: 31224 - protein, 9 aa, Homo Sapiens
LLEFFVPPK

SEQ ID NO: 31225 - protein, 9 aa, Homo Sapiens
ALRAGQVIR

SEQ ID NO: 31226 - protein, 9 aa, Homo Sapiens
RQGNYLLCL

SEQ ID NO: 31227 - protein, 9 aa, Homo Sapiens
LRTFLEFGT

SEQ ID NO: 31228 - protein, 9 aa, Homo Sapiens
FIARAPGFI

SEQ ID NO: 31229 - protein, 9 aa, Homo Sapiens
AGPSAGQLL

SEQ ID NO: 31230 - protein, 9 aa, Homo Sapiens
PALAPAESS

SEQ ID NO: 31231 - protein, 9 aa, Homo Sapiens
NDEPPMEAS

SEQ ID NO: 31232 - protein, 9 aa, Homo Sapiens
VEHNWFDTF

SEQ ID NO: 31233 - protein, 9 aa, Homo Sapiens
LTCGSNGSL

SEQ ID NO: 31234 - protein, 9 aa, Homo Sapiens
KTCEDINEC

SEQ ID NO: 31235 - protein, 9 aa, Homo Sapiens
IMPLPQWIH

SEQ ID NO: 31236 - protein, 9 aa, Homo Sapiens
IPRRWGKPY

SEQ ID NO: 31237 - protein, 9 aa, Homo Sapiens
AMLAYSPLD

SEQ ID NO: 31238 - protein, 9 aa, Homo Sapiens
KKHKAQHRC

SEQ ID NO: 31239 - protein, 9 aa, Homo Sapiens
ITDYSDDID

SEQ ID NO: 31240 - protein, 9 aa, Homo Sapiens
FDEAHSIDN

SEQ ID NO: 31241 - protein, 9 aa, Homo Sapiens
ARRFHFVYQ

SEQ ID NO: 31242 - protein, 9 aa, Homo Sapiens
SGCPKEMVS

SEQ ID NO: 31243 - protein, 9 aa, Homo Sapiens
CPADPDCIA

SEQ ID NO: 31244 - protein, 9 aa, Homo Sapiens
EESFSLCSD

SEQ ID NO: 31245 - protein, 9 aa, Homo Sapiens
CRQHSLHLR

SEQ ID NO: 31246 - protein, 9 aa, Homo Sapiens
HVEWPDFLS

SEQ ID NO: 31247 - protein, 9 aa, Homo Sapiens
DLPCDVYTY

SEQ ID NO: 31248 - protein, 9 aa, Homo Sapiens
GDGDGEDAI

SEQ ID NO: 31249 - protein, 9 aa, Homo Sapiens
LCTGMSRSW

SEQ ID NO: 31250 - protein, 9 aa, Homo Sapiens
LSSSSSQQQ

SEQ ID NO: 31251 - protein, 9 aa, Homo Sapiens
QKCTIFVVD

SEQ ID NO: 31252 - protein, 9 aa, Homo Sapiens
SPSNDEPPM

SEQ ID NO: 31253 - protein, 9 aa, Homo Sapiens
HLSDHLMQQ

SEQ ID NO: 31254 - protein, 9 aa, Homo Sapiens
WLTHPYGRG

SEQ ID NO: 31255 - protein, 9 aa, Homo Sapiens
REAVHRAVA

SEQ ID NO: 31256 - protein, 9 aa, Homo Sapiens
TGTFVGPLA

SEQ ID NO: 31257 - protein, 9 aa, Homo Sapiens
RFMAYRKPL

SEQ ID NO: 31258 - protein, 9 aa, Homo Sapiens
GEALAADAT

SEQ ID NO: 31259 - protein, 9 aa, Homo Sapiens
RLECSNTIM

SEQ ID NO: 31260 - protein, 9 aa, Homo Sapiens
SRALRFIAR

SEQ ID NO: 31261 - protein, 9 aa, Homo Sapiens
LAKALAALR

SEQ ID NO: 31262 - protein, 9 aa, Homo Sapiens
QLGTNALLV

SEQ ID NO: 31263 - protein, 9 aa, Homo Sapiens
GLNLQKSFK

SEQ ID NO: 31264 - protein, 9 aa, Homo Sapiens
SIAEDGSNR

SEQ ID NO: 31265 - protein, 9 aa, Homo Sapiens
DLLLAEADL

SEQ ID NO: 31266 - protein, 9 aa, Homo Sapiens
DLNISHISA

SEQ ID NO: 31267 - protein, 9 aa, Homo Sapiens
PLPQWIHYT

SEQ ID NO: 31268 - protein, 9 aa, Homo Sapiens
AYVGWPCLH

SEQ ID NO: 31269 - protein, 9 aa, Homo Sapiens
KEAMMDFFN

SEQ ID NO: 31270 - protein, 9 aa, Homo Sapiens
PEALPADAT

SEQ ID NO: 31271 - protein, 9 aa, Homo Sapiens
GQGGPPGTG

SEQ ID NO: 31272 - protein, 9 aa, Homo Sapiens
RDEMAAALG

SEQ ID NO: 31273 - protein, 9 aa, Homo Sapiens
PPKVPFCSK

SEQ ID NO: 31274 - protein, 9 aa, Homo Sapiens
RPRALPTPG

SEQ ID NO: 31275 - protein, 9 aa, Homo Sapiens
EVVREIGQK

SEQ ID NO: 31276 - protein, 9 aa, Homo Sapiens
PASELLLLL

SEQ ID NO: 31277 - protein, 9 aa, Homo Sapiens
HNKLSVIFP

SEQ ID NO: 31278 - protein, 9 aa, Homo Sapiens
LIKILTERG

SEQ ID NO: 31279 - protein, 9 aa, Homo Sapiens
GFLISSGLS

SEQ ID NO: 31280 - protein, 9 aa, Homo Sapiens
KIEAPPDNK

SEQ ID NO: 31281 - protein, 9 aa, Homo Sapiens
AGCEMENKE

SEQ ID NO: 31282 - protein, 9 aa, Homo Sapiens
LASGLGAGR

SEQ ID NO: 31283 - protein, 9 aa, Homo Sapiens
LQDSFPAGF

SEQ ID NO: 31284 - protein, 9 aa, Homo Sapiens
LISSGLSSH

SEQ ID NO: 31285 - protein, 9 aa, Homo Sapiens
SVLGFISRA

SEQ ID NO: 31286 - protein, 9 aa, Homo Sapiens
LRDWLPPLG

SEQ ID NO: 31287 - protein, 9 aa, Homo Sapiens
GTLSFKFWA

SEQ ID NO: 31288 - protein, 9 aa, Homo Sapiens
PEHFTLTDS

SEQ ID NO: 31289 - protein, 9 aa, Homo Sapiens
QTRYGLYNS

SEQ ID NO: 31290 - protein, 9 aa, Homo Sapiens
KQQARACCP

SEQ ID NO: 31291 - protein, 9 aa, Homo Sapiens
LVSQEVGAV

SEQ ID NO: 31292 - protein, 9 aa, Homo Sapiens
LSVIFPLWK

SEQ ID NO: 31293 - protein, 9 aa, Homo Sapiens
REIAQDCKT

SEQ ID NO: 31294 - protein, 9 aa, Homo Sapiens
SFRQRPSST

SEQ ID NO: 31295 - protein, 9 aa, Homo Sapiens
QINNKAAIG

SEQ ID NO: 31296 - protein, 9 aa, Homo Sapiens
GGSGPALAP

SEQ ID NO: 31297 - protein, 9 aa, Homo Sapiens
PPTCAPRNT

SEQ ID NO: 31298 - protein, 9 aa, Homo Sapiens
GALVFDEVR

SEQ ID NO: 31299 - protein, 9 aa, Homo Sapiens
NKLSLSKLK

SEQ ID NO: 31300 - protein, 9 aa, Homo Sapiens
GHGSFHQQY

SEQ ID NO: 31301 - protein, 9 aa, Homo Sapiens
DTFNKSHPK

SEQ ID NO: 31302 - protein, 9 aa, Homo Sapiens
YITDYSDDI

SEQ ID NO: 31303 - protein, 9 aa, Homo Sapiens
ALAALGAAV

SEQ ID NO: 31304 - protein, 9 aa, Homo Sapiens
TVRKREKDH

SEQ ID NO: 31305 - protein, 9 aa, Homo Sapiens
QINLNCTQK

SEQ ID NO: 31306 - protein, 9 aa, Homo Sapiens
QNLDACQNG

SEQ ID NO: 31307 - protein, 9 aa, Homo Sapiens
NGIKQHSCP

SEQ ID NO: 31308 - protein, 9 aa, Homo Sapiens
NMALENRGF

SEQ ID NO: 31309 - protein, 9 aa, Homo Sapiens
VEVEFRNNY

SEQ ID NO: 31310 - protein, 9 aa, Homo Sapiens
RGWDLMQNI

SEQ ID NO: 31311 - protein, 9 aa, Homo Sapiens
SCGLRLKQQ

SEQ ID NO: 31312 - protein, 9 aa, Homo Sapiens
SRQPCLISP

SEQ ID NO: 31313 - protein, 9 aa, Homo Sapiens
RTFLEFGTL

SEQ ID NO: 31314 - protein, 9 aa, Homo Sapiens
ITLKTFTPP

SEQ ID NO: 31315 - protein, 9 aa, Homo Sapiens
WQRASTTAA

SEQ ID NO: 31316 - protein, 9 aa, Homo Sapiens
SHKFDYELQ

SEQ ID NO: 31317 - protein, 9 aa, Homo Sapiens
IDGLMDEFP

SEQ ID NO: 31318 - protein, 9 aa, Homo Sapiens
CGHGSFHQQ

SEQ ID NO: 31319 - protein, 9 aa, Homo Sapiens
SAGIRQAFL

SEQ ID NO: 31320 - protein, 9 aa, Homo Sapiens
QRNMPLQTG

SEQ ID NO: 31321 - protein, 9 aa, Homo Sapiens
AFSSTLEGK

SEQ ID NO: 31322 - protein, 9 aa, Homo Sapiens
VAQLSMEEG

SEQ ID NO: 31323 - protein, 9 aa, Homo Sapiens
TVLPDLQET

SEQ ID NO: 31324 - protein, 9 aa, Homo Sapiens
FSKDLYLIS

SEQ ID NO: 31325 - protein, 9 aa, Homo Sapiens
KIPMDLSTI

SEQ ID NO: 31326 - protein, 9 aa, Homo Sapiens
DLAPTPGTS

SEQ ID NO: 31327 - protein, 9 aa, Homo Sapiens
AADLTFVGL

SEQ ID NO: 31328 - protein, 9 aa, Homo Sapiens
HQPEPSGKM

SEQ ID NO: 31329 - protein, 9 aa, Homo Sapiens
VIGDHLSTM

SEQ ID NO: 31330 - protein, 9 aa, Homo Sapiens
DINECESSP

SEQ ID NO: 31331 - protein, 9 aa, Homo Sapiens
NGWCFITLK

SEQ ID NO: 31332 - protein, 9 aa, Homo Sapiens
KSLTDAAVT

SEQ ID NO: 31333 - protein, 9 aa, Homo Sapiens
ARREVARFQ

SEQ ID NO: 31334 - protein, 9 aa, Homo Sapiens
SPERHPLYH

SEQ ID NO: 31335 - protein, 9 aa, Homo Sapiens
EGLAATGTF

SEQ ID NO: 31336 - protein, 9 aa, Homo Sapiens
IGITPLILA

SEQ ID NO: 31337 - protein, 9 aa, Homo Sapiens
RFTQHDQVG

SEQ ID NO: 31338 - protein, 9 aa, Homo Sapiens
LARVSALVA

SEQ ID NO: 31339 - protein, 9 aa, Homo Sapiens
GGAIEGLAA

SEQ ID NO: 31340 - protein, 9 aa, Homo Sapiens
INVLSHLPS

SEQ ID NO: 31341 - protein, 9 aa, Homo Sapiens
FPSYIDKNL

SEQ ID NO: 31342 - protein, 9 aa, Homo Sapiens
GGSLLEFFV

SEQ ID NO: 31343 - protein, 9 aa, Homo Sapiens
EVEFRNNYE

SEQ ID NO: 31344 - protein, 9 aa, Homo Sapiens
GVNSYGDIQ

SEQ ID NO: 31345 - protein, 9 aa, Homo Sapiens
YRVRSKYNS

SEQ ID NO: 31346 - protein, 9 aa, Homo Sapiens
FDIVKIPMD

SEQ ID NO: 31347 - protein, 9 aa, Homo Sapiens
KDLNISHIS

SEQ ID NO: 31348 - protein, 9 aa, Homo Sapiens
RQQGPCGHL

SEQ ID NO: 31349 - protein, 9 aa, Homo Sapiens
LIDCGAIVK

SEQ ID NO: 31350 - protein, 9 aa, Homo Sapiens
IQRTLFLGV

SEQ ID NO: 31351 - protein, 9 aa, Homo Sapiens
RTLFLGVQK

SEQ ID NO: 31352 - protein, 9 aa, Homo Sapiens
AINVLSHLP

SEQ ID NO: 31353 - protein, 9 aa, Homo Sapiens
RLYVHPDSR

SEQ ID NO: 31354 - protein, 9 aa, Homo Sapiens
KTDKSVVDR

SEQ ID NO: 31355 - protein, 9 aa, Homo Sapiens
RGPPPHPAA

SEQ ID NO: 31356 - protein, 9 aa, Homo Sapiens
WPYGQVPCG

SEQ ID NO: 31357 - protein, 9 aa, Homo Sapiens
VIFPLWKLP

SEQ ID NO: 31358 - protein, 9 aa, Homo Sapiens
IVHIRREIE

SEQ ID NO: 31359 - protein, 9 aa, Homo Sapiens
KENLYQLKN

SEQ ID NO: 31360 - protein, 9 aa, Homo Sapiens
FDADIQYEY

SEQ ID NO: 31361 - protein, 9 aa, Homo Sapiens
ILIPCDRVV

SEQ ID NO: 31362 - protein, 9 aa, Homo Sapiens
YIDKNLELF

SEQ ID NO: 31363 - protein, 9 aa, Homo Sapiens
MALVKKRNQ

SEQ ID NO: 31364 - protein, 9 aa, Homo Sapiens
GAPPEALPA

SEQ ID NO: 31365 - protein, 9 aa, Homo Sapiens
LRHPGYLSG

SEQ ID NO: 31366 - protein, 9 aa, Homo Sapiens
WCFITLKTF

SEQ ID NO: 31367 - protein, 9 aa, Homo Sapiens
FLLLLVTSS

SEQ ID NO: 31368 - protein, 9 aa, Homo Sapiens
LSGTVARLP

SEQ ID NO: 31369 - protein, 9 aa, Homo Sapiens
KLSVIFPLW

SEQ ID NO: 31370 - protein, 9 aa, Homo Sapiens
LAADATAEG

SEQ ID NO: 31371 - protein, 9 aa, Homo Sapiens
PVKRYAPDL

SEQ ID NO: 31372 - protein, 9 aa, Homo Sapiens
GVFSHKFDY

SEQ ID NO: 31373 - protein, 9 aa, Homo Sapiens
RNNYEELAR

SEQ ID NO: 31374 - protein, 9 aa, Homo Sapiens
SKYNSDWGE

SEQ ID NO: 31375 - protein, 9 aa, Homo Sapiens
LVRKKHKAQ

SEQ ID NO: 31376 - protein, 9 aa, Homo Sapiens
EFYITDYSD

SEQ ID NO: 31377 - protein, 9 aa, Homo Sapiens
LVEVEFRNN

SEQ ID NO: 31378 - protein, 9 aa, Homo Sapiens
LPRPDPQRG

SEQ ID NO: 31379 - protein, 9 aa, Homo Sapiens
NSSDCLHLN

SEQ ID NO: 31380 - protein, 9 aa, Homo Sapiens
GKKAFATCA

SEQ ID NO: 31381 - protein, 9 aa, Homo Sapiens
IAGVLTFAL

SEQ ID NO: 31382 - protein, 9 aa, Homo Sapiens
GFIPGAPRF

SEQ ID NO: 31383 - protein, 9 aa, Homo Sapiens
REVARFQRT

SEQ ID NO: 31384 - protein, 9 aa, Homo Sapiens
FDYELQDVS

SEQ ID NO: 31385 - protein, 9 aa, Homo Sapiens
FSTSNGWCF

SEQ ID NO: 31386 - protein, 9 aa, Homo Sapiens
LYPSEPHQP

SEQ ID NO: 31387 - protein, 9 aa, Homo Sapiens
AATGKPPTL

SEQ ID NO: 31388 - protein, 9 aa, Homo Sapiens
NMPLQTGTA

SEQ ID NO: 31389 - protein, 9 aa, Homo Sapiens
QLALRAGQV

SEQ ID NO: 31390 - protein, 9 aa, Homo Sapiens
ESFSLCSDQ

SEQ ID NO: 31391 - protein, 9 aa, Homo Sapiens
SLYFEVEDG

SEQ ID NO: 31392 - protein, 9 aa, Homo Sapiens
LLYPSEPHQ

SEQ ID NO: 31393 - protein, 9 aa, Homo Sapiens
DACQNGMNI

SEQ ID NO: 31394 - protein, 9 aa, Homo Sapiens
FSSTLEGKR

SEQ ID NO: 31395 - protein, 9 aa, Homo Sapiens
PILIPCDRV

SEQ ID NO: 31396 - protein, 9 aa, Homo Sapiens
ALGFELSVL

SEQ ID NO: 31397 - protein, 9 aa, Homo Sapiens
PAGSPAFSS

SEQ ID NO: 31398 - protein, 9 aa, Homo Sapiens
APAGCEMEN

SEQ ID NO: 31399 - protein, 9 aa, Homo Sapiens
GKGTSCRCW

SEQ ID NO: 31400 - protein, 9 aa, Homo Sapiens
ERQYMHTGT

SEQ ID NO: 31401 - protein, 9 aa, Homo Sapiens
LDPEHRGHV

SEQ ID NO: 31402 - protein, 9 aa, Homo Sapiens
GLRMLLALP

SEQ ID NO: 31403 - protein, 9 aa, Homo Sapiens
AQRNMPLQT

SEQ ID NO: 31404 - protein, 9 aa, Homo Sapiens
RVLLCRQHS

SEQ ID NO: 31405 - protein, 9 aa, Homo Sapiens
TGVDALVLD

SEQ ID NO: 31406 - protein, 9 aa, Homo Sapiens
HLVLPRRSE

SEQ ID NO: 31407 - protein, 9 aa, Homo Sapiens
TLSFKFWAL

SEQ ID NO: 31408 - protein, 9 aa, Homo Sapiens
LPRLEGYFS

SEQ ID NO: 31409 - protein, 9 aa, Homo Sapiens
SPAFSSTLE

SEQ ID NO: 31410 - protein, 9 aa, Homo Sapiens
YMHTGTMVE

SEQ ID NO: 31411 - protein, 9 aa, Homo Sapiens
GVLTFALPV

SEQ ID NO: 31412 - protein, 9 aa, Homo Sapiens
SEGVQGVNS

SEQ ID NO: 31413 - protein, 9 aa, Homo Sapiens
PGASPSRER

SEQ ID NO: 31414 - protein, 9 aa, Homo Sapiens
GLPAHLRQA

SEQ ID NO: 31415 - protein, 9 aa, Homo Sapiens
DAIVILEKT

SEQ ID NO: 31416 - protein, 9 aa, Homo Sapiens
INNKAAIGE

SEQ ID NO: 31417 - protein, 9 aa, Homo Sapiens
LYDFCIVCV

SEQ ID NO: 31418 - protein, 9 aa, Homo Sapiens
EADLPKLDG

SEQ ID NO: 31419 - protein, 9 aa, Homo Sapiens
FDLVTHNQT

SEQ ID NO: 31420 - protein, 9 aa, Homo Sapiens
ADLPKLDGA

SEQ ID NO: 31421 - protein, 9 aa, Homo Sapiens
WFDTFIIFM

SEQ ID NO: 31422 - protein, 9 aa, Homo Sapiens
YSPLDEKSL

SEQ ID NO: 31423 - protein, 9 aa, Homo Sapiens
EVQLLAAWQ

SEQ ID NO: 31424 - protein, 9 aa, Homo Sapiens
IDLTKEMYE

SEQ ID NO: 31425 - protein, 9 aa, Homo Sapiens
LQGVAQLSM

SEQ ID NO: 31426 - protein, 9 aa, Homo Sapiens
LGHNGIKQH

SEQ ID NO: 31427 - protein, 9 aa, Homo Sapiens
TRNDLEPGL

SEQ ID NO: 31428 - protein, 9 aa, Homo Sapiens
LEGKVASLI

SEQ ID NO: 31429 - protein, 9 aa, Homo Sapiens
SQRLSPRKV

SEQ ID NO: 31430 - protein, 9 aa, Homo Sapiens
ESGCPKEMV

SEQ ID NO: 31431 - protein, 9 aa, Homo Sapiens
FNKSHPKRG

SEQ ID NO: 31432 - protein, 9 aa, Homo Sapiens
LFFLLHLWV

SEQ ID NO: 31433 - protein, 9 aa, Homo Sapiens
GNYLLCLLL

SEQ ID NO: 31434 - protein, 9 aa, Homo Sapiens
FVGPLASVG

SEQ ID NO: 31435 - protein, 9 aa, Homo Sapiens
KEIGITPLI

SEQ ID NO: 31436 - protein, 9 aa, Homo Sapiens
GEDAIVILE

SEQ ID NO: 31437 - protein, 9 aa, Homo Sapiens
NNKLSLSKL

SEQ ID NO: 31438 - protein, 9 aa, Homo Sapiens
EVARFQRTK

SEQ ID NO: 31439 - protein, 9 aa, Homo Sapiens
IKTVKENLY

SEQ ID NO: 31440 - protein, 9 aa, Homo Sapiens
VKNDLYEKG

SEQ ID NO: 31441 - protein, 9 aa, Homo Sapiens
FGTLSFKFW

SEQ ID NO: 31442 - protein, 9 aa, Homo Sapiens
DMTNWKLSK

SEQ ID NO: 31443 - protein, 9 aa, Homo Sapiens
DLEETLERI

SEQ ID NO: 31444 - protein, 9 aa, Homo Sapiens
RCQFCRLEK

SEQ ID NO: 31445 - protein, 9 aa, Homo Sapiens
FYITDYSDD

SEQ ID NO: 31446 - protein, 9 aa, Homo Sapiens
GSDSENDRS

SEQ ID NO: 31447 - protein, 9 aa, Homo Sapiens
ALVFDEVRA

SEQ ID NO: 31448 - protein, 9 aa, Homo Sapiens
ATPPTWTSK

SEQ ID NO: 31449 - protein, 9 aa, Homo Sapiens
HCERKLYQS

SEQ ID NO: 31450 - protein, 9 aa, Homo Sapiens
FLISSGLSS

SEQ ID NO: 31451 - protein, 9 aa, Homo Sapiens
NFSKDLYLI

SEQ ID NO: 31452 - protein, 9 aa, Homo Sapiens
LTSPINPQY

SEQ ID NO: 31453 - protein, 9 aa, Homo Sapiens
KILGKKIEA

SEQ ID NO: 31454 - protein, 9 aa, Homo Sapiens
GCPKEMVST

SEQ ID NO: 31455 - protein, 9 aa, Homo Sapiens
VDSECINRM

SEQ ID NO: 31456 - protein, 9 aa, Homo Sapiens
RHRWPHGVW

SEQ ID NO: 31457 - protein, 9 aa, Homo Sapiens
DTFIIFMIL

SEQ ID NO: 31458 - protein, 9 aa, Homo Sapiens
YDFCIVCVT

SEQ ID NO: 31459 - protein, 9 aa, Homo Sapiens
ISHISAATG

SEQ ID NO: 31460 - protein, 9 aa, Homo Sapiens
ALGFIPRAL

SEQ ID NO: 31461 - protein, 9 aa, Homo Sapiens
ALVSQEVGA

SEQ ID NO: 31462 - protein, 9 aa, Homo Sapiens
VPCGLLPKP

SEQ ID NO: 31463 - protein, 9 aa, Homo Sapiens
NQVPVLQHN

SEQ ID NO: 31464 - protein, 9 aa, Homo Sapiens
TFLEFGTLS

SEQ ID NO: 31465 - protein, 9 aa, Homo Sapiens
TEEKPGSPW

SEQ ID NO: 31466 - protein, 9 aa, Homo Sapiens
SKVIGDHLS

SEQ ID NO: 31467 - protein, 9 aa, Homo Sapiens
TAAWASTQT

SEQ ID NO: 31468 - protein, 9 aa, Homo Sapiens
RGGAAEALA

SEQ ID NO: 31469 - protein, 9 aa, Homo Sapiens
GSGPALAPA

SEQ ID NO: 31470 - protein, 9 aa, Homo Sapiens
NNKAAIGEE

SEQ ID NO: 31471 - protein, 9 aa, Homo Sapiens
LGEGLSAVI

SEQ ID NO: 31472 - protein, 9 aa, Homo Sapiens
REQNLDACQ

SEQ ID NO: 31473 - protein, 9 aa, Homo Sapiens
MAAQGRVLA

SEQ ID NO: 31474 - protein, 9 aa, Homo Sapiens
RPNCCVSSC

SEQ ID NO: 31475 - protein, 9 aa, Homo Sapiens
AVKLDAIEP

SEQ ID NO: 31476 - protein, 9 aa, Homo Sapiens
RASTTAAWA

SEQ ID NO: 31477 - protein, 9 aa, Homo Sapiens
HSPREQNLD

SEQ ID NO: 31478 - protein, 9 aa, Homo Sapiens
VLSHLPSHH

SEQ ID NO: 31479 - protein, 9 aa, Homo Sapiens
PTHISRCKI

SEQ ID NO: 31480 - protein, 9 aa, Homo Sapiens
FRNNYEELA

SEQ ID NO: 31481 - protein, 9 aa, Homo Sapiens
VDAVKLDAI

SEQ ID NO: 31482 - protein, 9 aa, Homo Sapiens
GMKSIVGEV

SEQ ID NO: 31483 - protein, 9 aa, Homo Sapiens
QSMAAQRQW

SEQ ID NO: 31484 - protein, 9 aa, Homo Sapiens
GFEDIFRIS

SEQ ID NO: 31485 - protein, 9 aa, Homo Sapiens
QPEPSGKMA

SEQ ID NO: 31486 - protein, 9 aa, Homo Sapiens
PQYMTMLNQ

SEQ ID NO: 31487 - protein, 9 aa, Homo Sapiens
AGQVIRKAL

SEQ ID NO: 31488 - protein, 9 aa, Homo Sapiens
RWLCTGMSR

SEQ ID NO: 31489 - protein, 9 aa, Homo Sapiens
LKHLKLRCR

SEQ ID NO: 31490 - protein, 9 aa, Homo Sapiens
AIAIALRNL

SEQ ID NO: 31491 - protein, 9 aa, Homo Sapiens
IVEHNWFDT

SEQ ID NO: 31492 - protein, 9 aa, Homo Sapiens
NLQKSFKPA

SEQ ID NO: 31493 - protein, 9 aa, Homo Sapiens
KTVKENLYQ

SEQ ID NO: 31494 - protein, 9 aa, Homo Sapiens
DEAHSIDNV

SEQ ID NO: 31495 - protein, 9 aa, Homo Sapiens
PLILALNYN

SEQ ID NO: 31496 - protein, 9 aa, Homo Sapiens
NAVNCSMFS

SEQ ID NO: 31497 - protein, 9 aa, Homo Sapiens
EEGLVNIKY

SEQ ID NO: 31498 - protein, 9 aa, Homo Sapiens
GPSAGQLLA

SEQ ID NO: 31499 - protein, 9 aa, Homo Sapiens
LNESLKVQN

SEQ ID NO: 31500 - protein, 9 aa, Homo Sapiens
LHYKVIMSK

SEQ ID NO: 31501 - protein, 9 aa, Homo Sapiens
LEPGLGHFS

SEQ ID NO: 31502 - protein, 9 aa, Homo Sapiens
PAGCEMENK

SEQ ID NO: 31503 - protein, 9 aa, Homo Sapiens
HISAATGTS

SEQ ID NO: 31504 - protein, 9 aa, Homo Sapiens
WALVGLLAR

SEQ ID NO: 31505 - protein, 9 aa, Homo Sapiens
YNVYRVRSK

SEQ ID NO: 31506 - protein, 9 aa, Homo Sapiens
ALVAKQVRA

SEQ ID NO: 31507 - protein, 9 aa, Homo Sapiens
SNDSDRYSH

SEQ ID NO: 31508 - protein, 9 aa, Homo Sapiens
YLIKILTER

SEQ ID NO: 31509 - protein, 9 aa, Homo Sapiens
TVARLPEAV

SEQ ID NO: 31510 - protein, 9 aa, Homo Sapiens
THNQTYHFQ

SEQ ID NO: 31511 - protein, 9 aa, Homo Sapiens
GWLTHPYGR

SEQ ID NO: 31512 - protein, 9 aa, Homo Sapiens
STTAAWAST

SEQ ID NO: 31513 - protein, 9 aa, Homo Sapiens
SGGAIEGLA

SEQ ID NO: 31514 - protein, 9 aa, Homo Sapiens
YHTESSWGS

SEQ ID NO: 31515 - protein, 9 aa, Homo Sapiens
GAMLAYSPL

SEQ ID NO: 31516 - protein, 9 aa, Homo Sapiens
KKPHYIPRR

SEQ ID NO: 31517 - protein, 9 aa, Homo Sapiens
LRSQGFKDK

SEQ ID NO: 31518 - protein, 9 aa, Homo Sapiens
FHWCCYLKC

SEQ ID NO: 31519 - protein, 9 aa, Homo Sapiens
HIERFTQHD

SEQ ID NO: 31520 - protein, 9 aa, Homo Sapiens
NGSLYVGDF

SEQ ID NO: 31521 - protein, 9 aa, Homo Sapiens
QQGILKFLQ

SEQ ID NO: 31522 - protein, 9 aa, Homo Sapiens
DALVLDQGG

SEQ ID NO: 31523 - protein, 9 aa, Homo Sapiens
PGVAAGMGD

SEQ ID NO: 31524 - protein, 9 aa, Homo Sapiens
HVAPHTGAH

SEQ ID NO: 31525 - protein, 9 aa, Homo Sapiens
MHTGTMVEF

SEQ ID NO: 31526 - protein, 9 aa, Homo Sapiens
ALCGAGPTR

SEQ ID NO: 31527 - protein, 9 aa, Homo Sapiens
KGSCETQGI

SEQ ID NO: 31528 - protein, 9 aa, Homo Sapiens
TCRRWTPPS

SEQ ID NO: 31529 - protein, 9 aa, Homo Sapiens
EPSGKMANR

SEQ ID NO: 31530 - protein, 9 aa, Homo Sapiens
YFSQTPLMS

SEQ ID NO: 31531 - protein, 9 aa, Homo Sapiens
SDRYSHNEE

SEQ ID NO: 31532 - protein, 9 aa, Homo Sapiens
RFIARALGF

SEQ ID NO: 31533 - protein, 9 aa, Homo Sapiens
ERHPLYHYK

SEQ ID NO: 31534 - protein, 9 aa, Homo Sapiens
FHVASPERH

SEQ ID NO: 31535 - protein, 9 aa, Homo Sapiens
DEVRALGEG

SEQ ID NO: 31536 - protein, 9 aa, Homo Sapiens
PPFLLLLVT

SEQ ID NO: 31537 - protein, 9 aa, Homo Sapiens
QGSKLRHPG

SEQ ID NO: 31538 - protein, 9 aa, Homo Sapiens
SSYCSPQKV

SEQ ID NO: 31539 - protein, 9 aa, Homo Sapiens
WQVGAGVDG

SEQ ID NO: 31540 - protein, 9 aa, Homo Sapiens
LGVRHLKLN

SEQ ID NO: 31541 - protein, 9 aa, Homo Sapiens
LSDHLMQQG

SEQ ID NO: 31542 - protein, 9 aa, Homo Sapiens
VGALVSQEV

SEQ ID NO: 31543 - protein, 9 aa, Homo Sapiens
GFELSVLGF

SEQ ID NO: 31544 - protein, 9 aa, Homo Sapiens
NDLYEKGPD

SEQ ID NO: 31545 - protein, 9 aa, Homo Sapiens
HRALAKALA

SEQ ID NO: 31546 - protein, 9 aa, Homo Sapiens
AVAEGLATM

SEQ ID NO: 31547 - protein, 9 aa, Homo Sapiens
PQRGSPGLR

SEQ ID NO: 31548 - protein, 9 aa, Homo Sapiens
LVLKGELKL

SEQ ID NO: 31549 - protein, 9 aa, Homo Sapiens
ILLVNCDWD

SEQ ID NO: 31550 - protein, 9 aa, Homo Sapiens
KGSKSIKYW

SEQ ID NO: 31551 - protein, 9 aa, Homo Sapiens
DEFPKAETI

SEQ ID NO: 31552 - protein, 9 aa, Homo Sapiens
GLLARVSAL

SEQ ID NO: 31553 - protein, 9 aa, Homo Sapiens
LLHLWVKNV

SEQ ID NO: 31554 - protein, 9 aa, Homo Sapiens
LKTFTPPVS

SEQ ID NO: 31555 - protein, 9 aa, Homo Sapiens
CDRVVCSSG

SEQ ID NO: 31556 - protein, 9 aa, Homo Sapiens
GQLGSLGNG

SEQ ID NO: 31557 - protein, 9 aa, Homo Sapiens
LYQLKNQIQ

SEQ ID NO: 31558 - protein, 9 aa, Homo Sapiens
AQGRVLAIA

SEQ ID NO: 31559 - protein, 9 aa, Homo Sapiens
CSNTIMAHC

SEQ ID NO: 31560 - protein, 9 aa, Homo Sapiens
PHTGAHPAT

SEQ ID NO: 31561 - protein, 9 aa, Homo Sapiens
LALLRWKAY

SEQ ID NO: 31562 - protein, 9 aa, Homo Sapiens
GFKLRALRI

SEQ ID NO: 31563 - protein, 9 aa, Homo Sapiens
HFTLTDSTK

SEQ ID NO: 31564 - protein, 9 aa, Homo Sapiens
CRCWQLSPG

SEQ ID NO: 31565 - protein, 9 aa, Homo Sapiens
TSLHLVLPR

SEQ ID NO: 31566 - protein, 9 aa, Homo Sapiens
PFLLLLVTS

SEQ ID NO: 31567 - protein, 9 aa, Homo Sapiens
GALVLDESG

SEQ ID NO: 31568 - protein, 9 aa, Homo Sapiens
PSIYSLILG

SEQ ID NO: 31569 - protein, 9 aa, Homo Sapiens
SVVYLPYDY

SEQ ID NO: 31570 - protein, 9 aa, Homo Sapiens
PINPQYMTM

SEQ ID NO: 31571 - protein, 9 aa, Homo Sapiens
TTDCKAQDE

SEQ ID NO: 31572 - protein, 9 aa, Homo Sapiens
WPPARREVA

SEQ ID NO: 31573 - protein, 9 aa, Homo Sapiens
CGLLPKPLS

SEQ ID NO: 31574 - protein, 9 aa, Homo Sapiens
MDEFPKAET

SEQ ID NO: 31575 - protein, 9 aa, Homo Sapiens
HISRCKISL

SEQ ID NO: 31576 - protein, 9 aa, Homo Sapiens
PYDYVCKKG

SEQ ID NO: 31577 - protein, 9 aa, Homo Sapiens
LAEADLPKL

SEQ ID NO: 31578 - protein, 9 aa, Homo Sapiens
TSPSNDEPP

SEQ ID NO: 31579 - protein, 9 aa, Homo Sapiens
RALEILLYP

SEQ ID NO: 31580 - protein, 9 aa, Homo Sapiens
EPLEVSELN

SEQ ID NO: 31581 - protein, 9 aa, Homo Sapiens
INAASRALD

SEQ ID NO: 31582 - protein, 9 aa, Homo Sapiens
LTFVGLLTG

SEQ ID NO: 31583 - protein, 9 aa, Homo Sapiens
CVTTYAINV

SEQ ID NO: 31584 - protein, 9 aa, Homo Sapiens
NCSYPPCTL

SEQ ID NO: 31585 - protein, 9 aa, Homo Sapiens
TDIDLTKEM

SEQ ID NO: 31586 - protein, 9 aa, Homo Sapiens
EIAQDCKTD

SEQ ID NO: 31587 - protein, 9 aa, Homo Sapiens
PKVPFCSKP

SEQ ID NO: 31588 - protein, 9 aa, Homo Sapiens
LGLRMLLAL

SEQ ID NO: 31589 - protein, 9 aa, Homo Sapiens
LVNFLLPTI

SEQ ID NO: 31590 - protein, 9 aa, Homo Sapiens
RLFFLLHLW

SEQ ID NO: 31591 - protein, 9 aa, Homo Sapiens
LNKNSSKDV

SEQ ID NO: 31592 - protein, 9 aa, Homo Sapiens
LPAHLRQAF

SEQ ID NO: 31593 - protein, 9 aa, Homo Sapiens
PASSFRQRP

SEQ ID NO: 31594 - protein, 9 aa, Homo Sapiens
DIDLTKEMY

SEQ ID NO: 31595 - protein, 9 aa, Homo Sapiens
KVPFCSKPT

SEQ ID NO: 31596 - protein, 9 aa, Homo Sapiens
ETPVHSRSS

SEQ ID NO: 31597 - protein, 9 aa, Homo Sapiens
SRSCAAPGP

SEQ ID NO: 31598 - protein, 9 aa, Homo Sapiens
MYSQINAAS

SEQ ID NO: 31599 - protein, 9 aa, Homo Sapiens
FFPCFDEPA

SEQ ID NO: 31600 - protein, 9 aa, Homo Sapiens
VKQKNEKGF

SEQ ID NO: 31601 - protein, 9 aa, Homo Sapiens
VPAGSPAFS

SEQ ID NO: 31602 - protein, 9 aa, Homo Sapiens
AVGALVSQE

SEQ ID NO: 31603 - protein, 9 aa, Homo Sapiens
FCIVCVTTY

SEQ ID NO: 31604 - protein, 9 aa, Homo Sapiens
QAADARKFF

SEQ ID NO: 31605 - protein, 9 aa, Homo Sapiens
NSTIYEVTG

SEQ ID NO: 31606 - protein, 9 aa, Homo Sapiens
AQKEPVSLQ

SEQ ID NO: 31607 - protein, 9 aa, Homo Sapiens
RMRRWLCTG

SEQ ID NO: 31608 - protein, 9 aa, Homo Sapiens
SGTVARLPE

SEQ ID NO: 31609 - protein, 9 aa, Homo Sapiens
VQKCTIFVV

SEQ ID NO: 31610 - protein, 9 aa, Homo Sapiens
LPRRSEEGS

SEQ ID NO: 31611 - protein, 9 aa, Homo Sapiens
QGVNSYGDI

SEQ ID NO: 31612 - protein, 9 aa, Homo Sapiens
LLLLGNVLV

SEQ ID NO: 31613 - protein, 9 aa, Homo Sapiens
WQLSPGHGP

SEQ ID NO: 31614 - protein, 9 aa, Homo Sapiens
FVVDEDCSD

SEQ ID NO: 31615 - protein, 9 aa, Homo Sapiens
RQTPPFLLL

SEQ ID NO: 31616 - protein, 9 aa, Homo Sapiens
GPPKVPFCS

SEQ ID NO: 31617 - protein, 9 aa, Homo Sapiens
QEVGAVAEG

SEQ ID NO: 31618 - protein, 9 aa, Homo Sapiens
INPQYMTML

SEQ ID NO: 31619 - protein, 9 aa, Homo Sapiens
TIMAHCRHE

SEQ ID NO: 31620 - protein, 9 aa, Homo Sapiens
LENMALENR

SEQ ID NO: 31621 - protein, 9 aa, Homo Sapiens
CCYRRLEKL

SEQ ID NO: 31622 - protein, 9 aa, Homo Sapiens
PRPDPQRGS

SEQ ID NO: 31623 - protein, 9 aa, Homo Sapiens
SFKFWALGF

SEQ ID NO: 31624 - protein, 9 aa, Homo Sapiens
SLHLVLPRR

SEQ ID NO: 31625 - protein, 9 aa, Homo Sapiens
NLAFVKNDL

SEQ ID NO: 31626 - protein, 9 aa, Homo Sapiens
TIYLDTCFA

SEQ ID NO: 31627 - protein, 9 aa, Homo Sapiens
VRSKSFHYG

SEQ ID NO: 31628 - protein, 9 aa, Homo Sapiens
PELELLSRE

SEQ ID NO: 31629 - protein, 9 aa, Homo Sapiens
ELKLARNDI

SEQ ID NO: 31630 - protein, 9 aa, Homo Sapiens
SSSSSMFQE

SEQ ID NO: 31631 - protein, 9 aa, Homo Sapiens
NESLKVQNE

SEQ ID NO: 31632 - protein, 9 aa, Homo Sapiens
RENFSKDLY

SEQ ID NO: 31633 - protein, 9 aa, Homo Sapiens
LQHNTSVAA

SEQ ID NO: 31634 - protein, 9 aa, Homo Sapiens
VFDNDSFLQ

SEQ ID NO: 31635 - protein, 9 aa, Homo Sapiens
PGPATPPTW

SEQ ID NO: 31636 - protein, 9 aa, Homo Sapiens
GAAVGAAWQ

SEQ ID NO: 31637 - protein, 9 aa, Homo Sapiens
VLQHNTSVA

SEQ ID NO: 31638 - protein, 9 aa, Homo Sapiens
VRKKHKAQH

SEQ ID NO: 31639 - protein, 9 aa, Homo Sapiens
ARLPEAVSM

SEQ ID NO: 31640 - protein, 9 aa, Homo Sapiens
PTCAPRNTC

SEQ ID NO: 31641 - protein, 9 aa, Homo Sapiens
TVGCRGSCT

SEQ ID NO: 31642 - protein, 9 aa, Homo Sapiens
RQPGASPSR

SEQ ID NO: 31643 - protein, 9 aa, Homo Sapiens
RPDPQRGSP

SEQ ID NO: 31644 - protein, 9 aa, Homo Sapiens
FLLHLWVKN

SEQ ID NO: 31645 - protein, 9 aa, Homo Sapiens
WLCGLLPFF

SEQ ID NO: 31646 - protein, 9 aa, Homo Sapiens
SDHKDQLIE

SEQ ID NO: 31647 - protein, 9 aa, Homo Sapiens
QGPCGHLKR

SEQ ID NO: 31648 - protein, 9 aa, Homo Sapiens
VRKREKDHT

SEQ ID NO: 31649 - protein, 9 aa, Homo Sapiens
EGLVNIKYD

SEQ ID NO: 31650 - protein, 9 aa, Homo Sapiens
PDCGHGSFH

SEQ ID NO: 31651 - protein, 9 aa, Homo Sapiens
DCGAIVKQK

SEQ ID NO: 31652 - protein, 9 aa, Homo Sapiens
RSQGFKDKT

SEQ ID NO: 31653 - protein, 9 aa, Homo Sapiens
QQNIFLVFR

SEQ ID NO: 31654 - protein, 9 aa, Homo Sapiens
QHRALAKAL

SEQ ID NO: 31655 - protein, 9 aa, Homo Sapiens
KGTSCRCWQ

SEQ ID NO: 31656 - protein, 9 aa, Homo Sapiens
GALVSQEVG

SEQ ID NO: 31657 - protein, 9 aa, Homo Sapiens
RHPLYHYKT

SEQ ID NO: 31658 - protein, 9 aa, Homo Sapiens
VGQAYVGWP

SEQ ID NO: 31659 - protein, 9 aa, Homo Sapiens
CLLLLGNVL

SEQ ID NO: 31660 - protein, 9 aa, Homo Sapiens
PCGHLKRWP

SEQ ID NO: 31661 - protein, 9 aa, Homo Sapiens
IVCVTTYAI

SEQ ID NO: 31662 - protein, 9 aa, Homo Sapiens
TQGILKHLK

SEQ ID NO: 31663 - protein, 9 aa, Homo Sapiens
KGPPKVPFC

SEQ ID NO: 31664 - protein, 9 aa, Homo Sapiens
ARALGFIPR

SEQ ID NO: 31665 - protein, 9 aa, Homo Sapiens
SIHCERKLY

SEQ ID NO: 31666 - protein, 9 aa, Homo Sapiens
KSVVDRAKA

SEQ ID NO: 31667 - protein, 9 aa, Homo Sapiens
GLLPFFSTS

SEQ ID NO: 31668 - protein, 9 aa, Homo Sapiens
GDGEDAIVI

SEQ ID NO: 31669 - protein, 9 aa, Homo Sapiens
QKRGGAAEA

SEQ ID NO: 31670 - protein, 9 aa, Homo Sapiens
LRMLLALPG

SEQ ID NO: 31671 - protein, 9 aa, Homo Sapiens
GNEEQTQIN

SEQ ID NO: 31672 - protein, 9 aa, Homo Sapiens
NVRLRDLYP

SEQ ID NO: 31673 - protein, 9 aa, Homo Sapiens
AAAPAGCEM

SEQ ID NO: 31674 - protein, 9 aa, Homo Sapiens
VQLGTNALL

SEQ ID NO: 31675 - protein, 9 aa, Homo Sapiens
VNCSMFSAV

SEQ ID NO: 31676 - protein, 9 aa, Homo Sapiens
NSPFDPVLF

SEQ ID NO: 31677 - protein, 9 aa, Homo Sapiens
HIYAWLCGL

SEQ ID NO: 31678 - protein, 9 aa, Homo Sapiens
LKLRCRQQG

SEQ ID NO: 31679 - protein, 9 aa, Homo Sapiens
PYGQVPCGL

SEQ ID NO: 31680 - protein, 9 aa, Homo Sapiens
CSMFSAVRE

SEQ ID NO: 31681 - protein, 9 aa, Homo Sapiens
GPATPPTWT

SEQ ID NO: 31682 - protein, 9 aa, Homo Sapiens
GFVAEAVVG

SEQ ID NO: 31683 - protein, 9 aa, Homo Sapiens
NRSTAYVGT

SEQ ID NO: 31684 - protein, 9 aa, Homo Sapiens
AIEGLAAVG

SEQ ID NO: 31685 - protein, 9 aa, Homo Sapiens
LYYGFEDIF

SEQ ID NO: 31686 - protein, 9 aa, Homo Sapiens
VGPLVADEV

SEQ ID NO: 31687 - protein, 9 aa, Homo Sapiens
SLSKLKFSG

SEQ ID NO: 31688 - protein, 9 aa, Homo Sapiens
NCDWDNHRS

SEQ ID NO: 31689 - protein, 9 aa, Homo Sapiens
VRPRALPTP

SEQ ID NO: 31690 - protein, 9 aa, Homo Sapiens
LCDHILFVN

SEQ ID NO: 31691 - protein, 9 aa, Homo Sapiens
GSKLRHPGY

SEQ ID NO: 31692 - protein, 9 aa, Homo Sapiens
PCPLRMSEM

SEQ ID NO: 31693 - protein, 9 aa, Homo Sapiens
SYGDIQRTL

SEQ ID NO: 31694 - protein, 9 aa, Homo Sapiens
WLLESGCPK

SEQ ID NO: 31695 - protein, 9 aa, Homo Sapiens
EGLSAVIAL

SEQ ID NO: 31696 - protein, 9 aa, Homo Sapiens
YSLDSDHKD

SEQ ID NO: 31697 - protein, 9 aa, Homo Sapiens
RLYQVTIHV

SEQ ID NO: 31698 - protein, 9 aa, Homo Sapiens
LEAQKEPVS

SEQ ID NO: 31699 - protein, 9 aa, Homo Sapiens
KVQNEKSIA

SEQ ID NO: 31700 - protein, 9 aa, Homo Sapiens
QDMTNWKLS

SEQ ID NO: 31701 - protein, 9 aa, Homo Sapiens
QCAMKSLSR

SEQ ID NO: 31702 - protein, 9 aa, Homo Sapiens
LAATGTFVG

SEQ ID NO: 31703 - protein, 9 aa, Homo Sapiens
QGRVLAIAL

SEQ ID NO: 31704 - protein, 9 aa, Homo Sapiens
NSTDLEETL

SEQ ID NO: 31705 - protein, 9 aa, Homo Sapiens
DIVKIPMDL

SEQ ID NO: 31706 - protein, 9 aa, Homo Sapiens
YLLCLLLLG

SEQ ID NO: 31707 - protein, 9 aa, Homo Sapiens
KETPVHSRS

SEQ ID NO: 31708 - protein, 9 aa, Homo Sapiens
IPGAPRFIA

SEQ ID NO: 31709 - protein, 9 aa, Homo Sapiens
EEDGWVTDY

SEQ ID NO: 31710 - protein, 9 aa, Homo Sapiens
NNYEELARQ

SEQ ID NO: 31711 - protein, 9 aa, Homo Sapiens
GIHVVDWPF

SEQ ID NO: 31712 - protein, 9 aa, Homo Sapiens
YLKCKKCTE

SEQ ID NO: 31713 - protein, 9 aa, Homo Sapiens
KLIKTDKSV

SEQ ID NO: 31714 - protein, 9 aa, Homo Sapiens
PALSRRLDL

SEQ ID NO: 31715 - protein, 9 aa, Homo Sapiens
YNRKGSKSI

SEQ ID NO: 31716 - protein, 9 aa, Homo Sapiens
TESSWGSDL

SEQ ID NO: 31717 - protein, 9 aa, Homo Sapiens
SSWGSDLSD

SEQ ID NO: 31718 - protein, 9 aa, Homo Sapiens
PVLQHNTSV

SEQ ID NO: 31719 - protein, 9 aa, Homo Sapiens
ALPTPGPAT

SEQ ID NO: 31720 - protein, 9 aa, Homo Sapiens
VVRAIAIAL

SEQ ID NO: 31721 - protein, 9 aa, Homo Sapiens
LEILLYPSE

SEQ ID NO: 31722 - protein, 9 aa, Homo Sapiens
IVKIPMDLS

SEQ ID NO: 31723 - protein, 9 aa, Homo Sapiens
LLCRQHSLH

SEQ ID NO: 31724 - protein, 9 aa, Homo Sapiens
LLARVSALV

SEQ ID NO: 31725 - protein, 9 aa, Homo Sapiens
KPQSLQAAV

SEQ ID NO: 31726 - protein, 9 aa, Homo Sapiens
GPPPHPAAD

SEQ ID NO: 31727 - protein, 9 aa, Homo Sapiens
KNATGNLAS

SEQ ID NO: 31728 - protein, 9 aa, Homo Sapiens
DATAEGPLT

SEQ ID NO: 31729 - protein, 9 aa, Homo Sapiens
DSENDRSYS

SEQ ID NO: 31730 - protein, 9 aa, Homo Sapiens
SKLNEMNDS

SEQ ID NO: 31731 - protein, 9 aa, Homo Sapiens
EQMEKANAP

SEQ ID NO: 31732 - protein, 9 aa, Homo Sapiens
ELYVGFQTR

SEQ ID NO: 31733 - protein, 9 aa, Homo Sapiens
CVPAGSPAF

SEQ ID NO: 31734 - protein, 9 aa, Homo Sapiens
GIRQAFLEG

SEQ ID NO: 31735 - protein, 9 aa, Homo Sapiens
ARKFFPCFD

SEQ ID NO: 31736 - protein, 9 aa, Homo Sapiens
DSVPQSTGE

SEQ ID NO: 31737 - protein, 9 aa, Homo Sapiens
LNISHISAA

SEQ ID NO: 31738 - protein, 9 aa, Homo Sapiens
ARVGALVLD

SEQ ID NO: 31739 - protein, 9 aa, Homo Sapiens
RKLYQSARA

SEQ ID NO: 31740 - protein, 9 aa, Homo Sapiens
LLAEADLPK

SEQ ID NO: 31741 - protein, 9 aa, Homo Sapiens
LRWKAYLLH

SEQ ID NO: 31742 - protein, 9 aa, Homo Sapiens
PGLGHFSLR

SEQ ID NO: 31743 - protein, 9 aa, Homo Sapiens
TDCKAQDER

SEQ ID NO: 31744 - protein, 9 aa, Homo Sapiens
VDLAPTPGT

SEQ ID NO: 31745 - protein, 9 aa, Homo Sapiens
PSGKMANRN

SEQ ID NO: 31746 - protein, 9 aa, Homo Sapiens
STGELTVRA

SEQ ID NO: 31747 - protein, 9 aa, Homo Sapiens
PVHVEFASH

SEQ ID NO: 31748 - protein, 9 aa, Homo Sapiens
RFHAAHHKF

SEQ ID NO: 31749 - protein, 9 aa, Homo Sapiens
GIKQHSCPH

SEQ ID NO: 31750 - protein, 9 aa, Homo Sapiens
RWPYGQVPC

SEQ ID NO: 31751 - protein, 9 aa, Homo Sapiens
EAHSIDNVC

SEQ ID NO: 31752 - protein, 9 aa, Homo Sapiens
LYFEVEDGF

SEQ ID NO: 31753 - protein, 9 aa, Homo Sapiens
DALQFQTRE

SEQ ID NO: 31754 - protein, 9 aa, Homo Sapiens
PVMLQKRGG

SEQ ID NO: 31755 - protein, 9 aa, Homo Sapiens
NLLILMALV

SEQ ID NO: 31756 - protein, 9 aa, Homo Sapiens
EALAADATA

SEQ ID NO: 31757 - protein, 9 aa, Homo Sapiens
GAPRFIARA

SEQ ID NO: 31758 - protein, 9 aa, Homo Sapiens
TPLILALNY

SEQ ID NO: 31759 - protein, 9 aa, Homo Sapiens
WRGPTGPEG

SEQ ID NO: 31760 - protein, 9 aa, Homo Sapiens
TGPEGTEDV

SEQ ID NO: 31761 - protein, 9 aa, Homo Sapiens
MDYFDDIGP

SEQ ID NO: 31762 - protein, 9 aa, Homo Sapiens
DPVMLQKRG

SEQ ID NO: 31763 - protein, 9 aa, Homo Sapiens
EGLRDWLPP

SEQ ID NO: 31764 - protein, 9 aa, Homo Sapiens
DIVHIRREI

SEQ ID NO: 31765 - protein, 9 aa, Homo Sapiens
ALVNFLLPT

SEQ ID NO: 31766 - protein, 9 aa, Homo Sapiens
RATGAHWMR

SEQ ID NO: 31767 - protein, 9 aa, Homo Sapiens
GILKHLKLR

SEQ ID NO: 31768 - protein, 9 aa, Homo Sapiens
NCCVSSCCR

SEQ ID NO: 31769 - protein, 9 aa, Homo Sapiens
ISRCKISLS

SEQ ID NO: 31770 - protein, 9 aa, Homo Sapiens
EILLYPSEP

SEQ ID NO: 31771 - protein, 9 aa, Homo Sapiens
GLVNIKYDT

SEQ ID NO: 31772 - protein, 9 aa, Homo Sapiens
NQMINSIAE

SEQ ID NO: 31773 - protein, 9 aa, Homo Sapiens
KVIMSKRLC

SEQ ID NO: 31774 - protein, 9 aa, Homo Sapiens
PERQYMHTG

SEQ ID NO: 31775 - protein, 9 aa, Homo Sapiens
AAIGEEVPR

SEQ ID NO: 31776 - protein, 9 aa, Homo Sapiens
CFSRENFSK

SEQ ID NO: 31777 - protein, 9 aa, Homo Sapiens
INSIAEDGS

SEQ ID NO: 31778 - protein, 9 aa, Homo Sapiens
VNIKYDTAL

SEQ ID NO: 31779 - protein, 9 aa, Homo Sapiens
LSVPFTYYK

SEQ ID NO: 31780 - protein, 9 aa, Homo Sapiens
TCCRPNCCV

SEQ ID NO: 31781 - protein, 9 aa, Homo Sapiens
DEYHTESSW

SEQ ID NO: 31782 - protein, 9 aa, Homo Sapiens
DDLLCPHAA

SEQ ID NO: 31783 - protein, 9 aa, Homo Sapiens
EAGHAFSPD

SEQ ID NO: 31784 - protein, 9 aa, Homo Sapiens
GRALEQLVL

SEQ ID NO: 31785 - protein, 9 aa, Homo Sapiens
TLHFVDQYL

SEQ ID NO: 31786 - protein, 9 aa, Homo Sapiens
THGSDGDRD

SEQ ID NO: 31787 - protein, 9 aa, Homo Sapiens
LMAQPVTPG

SEQ ID NO: 31788 - protein, 9 aa, Homo Sapiens
QAEITQGRA

SEQ ID NO: 31789 - protein, 9 aa, Homo Sapiens
LYKLGWEKA

SEQ ID NO: 31790 - protein, 9 aa, Homo Sapiens
EEIPHDFDW

SEQ ID NO: 31791 - protein, 9 aa, Homo Sapiens
ILVLNEATA

SEQ ID NO: 31792 - protein, 9 aa, Homo Sapiens
TLIEGKDLK

SEQ ID NO: 31793 - protein, 9 aa, Homo Sapiens
FLKPAYRHH

SEQ ID NO: 31794 - protein, 9 aa, Homo Sapiens
VVVDGVADQ

SEQ ID NO: 31795 - protein, 9 aa, Homo Sapiens
VDVAVRAFR

SEQ ID NO: 31796 - protein, 9 aa, Homo Sapiens
CPHAAAESP

SEQ ID NO: 31797 - protein, 9 aa, Homo Sapiens
SSCMGGMNW

SEQ ID NO: 31798 - protein, 9 aa, Homo Sapiens
GVLPQRLEP

SEQ ID NO: 31799 - protein, 9 aa, Homo Sapiens
VAVRAFRSD

SEQ ID NO: 31800 - protein, 9 aa, Homo Sapiens
LDSNKNAQI

SEQ ID NO: 31801 - protein, 9 aa, Homo Sapiens
IGKPKYMPV

SEQ ID NO: 31802 - protein, 9 aa, Homo Sapiens
LKALGITAS

SEQ ID NO: 31803 - protein, 9 aa, Homo Sapiens
LLKEMRNLR

SEQ ID NO: 31804 - protein, 9 aa, Homo Sapiens
SNGITYISP

SEQ ID NO: 31805 - protein, 9 aa, Homo Sapiens
SLEEVVEIE

SEQ ID NO: 31806 - protein, 9 aa, Homo Sapiens
EFIYSICGR

SEQ ID NO: 31807 - protein, 9 aa, Homo Sapiens
TMNYDKLSR

SEQ ID NO: 31808 - protein, 9 aa, Homo Sapiens
QEGKEKCPY

SEQ ID NO: 31809 - protein, 9 aa, Homo Sapiens
EVRTFLIQE

SEQ ID NO: 31810 - protein, 9 aa, Homo Sapiens
CPFESWVSR

SEQ ID NO: 31811 - protein, 9 aa, Homo Sapiens
GRTKREFIY

SEQ ID NO: 31812 - protein, 9 aa, Homo Sapiens
FTAAKGPAR

SEQ ID NO: 31813 - protein, 9 aa, Homo Sapiens
EPVCGSNGI

SEQ ID NO: 31814 - protein, 9 aa, Homo Sapiens
LVASVAEIN

SEQ ID NO: 31815 - protein, 9 aa, Homo Sapiens
SYSRPAHPV

SEQ ID NO: 31816 - protein, 9 aa, Homo Sapiens
PVPATAASP

SEQ ID NO: 31817 - protein, 9 aa, Homo Sapiens
ENFKEYLRA

SEQ ID NO: 31818 - protein, 9 aa, Homo Sapiens
STSYSRPAH

SEQ ID NO: 31819 - protein, 9 aa, Homo Sapiens
NKNAQITYS

SEQ ID NO: 31820 - protein, 9 aa, Homo Sapiens
LQGTGCPFE

SEQ ID NO: 31821 - protein, 9 aa, Homo Sapiens
NKGGAGGKG

SEQ ID NO: 31822 - protein, 9 aa, Homo Sapiens
QQVEEWRAH

SEQ ID NO: 31823 - protein, 9 aa, Homo Sapiens
GLPNKGGAG

SEQ ID NO: 31824 - protein, 9 aa, Homo Sapiens
ENTEADVPK

SEQ ID NO: 31825 - protein, 9 aa, Homo Sapiens
GQVENTEAD

SEQ ID NO: 31826 - protein, 9 aa, Homo Sapiens
DFQTNWCID

SEQ ID NO: 31827 - protein, 9 aa, Homo Sapiens
NYALEKKDK

SEQ ID NO: 31828 - protein, 9 aa, Homo Sapiens
KAWQVPYVE

SEQ ID NO: 31829 - protein, 9 aa, Homo Sapiens
YIDKYRNDY

SEQ ID NO: 31830 - protein, 9 aa, Homo Sapiens
TYKYLEMRF

SEQ ID NO: 31831 - protein, 9 aa, Homo Sapiens
DLGKYDPLT

SEQ ID NO: 31832 - protein, 9 aa, Homo Sapiens
QVDKDDAIY

SEQ ID NO: 31833 - protein, 9 aa, Homo Sapiens
SSSAKKKGT

SEQ ID NO: 31834 - protein, 9 aa, Homo Sapiens
QAFAKVLRL

SEQ ID NO: 31835 - protein, 9 aa, Homo Sapiens
PHAAAESPS

SEQ ID NO: 31836 - protein, 9 aa, Homo Sapiens
LLRVMQCLP

SEQ ID NO: 31837 - protein, 9 aa, Homo Sapiens
VPYVEKRRR

SEQ ID NO: 31838 - protein, 9 aa, Homo Sapiens
KPWGKLKSG

SEQ ID NO: 31839 - protein, 9 aa, Homo Sapiens
QWLYGCKRA

SEQ ID NO: 31840 - protein, 9 aa, Homo Sapiens
GMLLGDLNH

SEQ ID NO: 31841 - protein, 9 aa, Homo Sapiens
EHPRVHLGR

SEQ ID NO: 31842 - protein, 9 aa, Homo Sapiens
VTCAHGPCF

SEQ ID NO: 31843 - protein, 9 aa, Homo Sapiens
VPSHSPKKL

SEQ ID NO: 31844 - protein, 9 aa, Homo Sapiens
LRPVGLLAV

SEQ ID NO: 31845 - protein, 9 aa, Homo Sapiens
GIQLLYIGR

SEQ ID NO: 31846 - protein, 9 aa, Homo Sapiens
TAASPAPAV

SEQ ID NO: 31847 - protein, 9 aa, Homo Sapiens
AKVLRLPKQ

SEQ ID NO: 31848 - protein, 9 aa, Homo Sapiens
IVGSEHPRV

SEQ ID NO: 31849 - protein, 9 aa, Homo Sapiens
PPRDGVLQP

SEQ ID NO: 31850 - protein, 9 aa, Homo Sapiens
LTQDTTLTE

SEQ ID NO: 31851 - protein, 9 aa, Homo Sapiens
ANEEIPHDF

SEQ ID NO: 31852 - protein, 9 aa, Homo Sapiens
QCRTPARKE

SEQ ID NO: 31853 - protein, 9 aa, Homo Sapiens
SSRPTFPEK

SEQ ID NO: 31854 - protein, 9 aa, Homo Sapiens
FIFYPNGVI

SEQ ID NO: 31855 - protein, 9 aa, Homo Sapiens
SLKEELLCA

SEQ ID NO: 31856 - protein, 9 aa, Homo Sapiens
NPKPWGKLK

SEQ ID NO: 31857 - protein, 9 aa, Homo Sapiens
PNHRSTKQK

SEQ ID NO: 31858 - protein, 9 aa, Homo Sapiens
PGPSRSLKE

SEQ ID NO: 31859 - protein, 9 aa, Homo Sapiens
QFLLCLLLF

SEQ ID NO: 31860 - protein, 9 aa, Homo Sapiens
LKSVQSNLN

SEQ ID NO: 31861 - protein, 9 aa, Homo Sapiens
DLLQLHKLV

SEQ ID NO: 31862 - protein, 9 aa, Homo Sapiens
ESSVFLLTV

SEQ ID NO: 31863 - protein, 9 aa, Homo Sapiens
PAGFRIVQE

SEQ ID NO: 31864 - protein, 9 aa, Homo Sapiens
GRPNRVPGG

SEQ ID NO: 31865 - protein, 9 aa, Homo Sapiens
ACSSESIKK

SEQ ID NO: 31866 - protein, 9 aa, Homo Sapiens
KGNHIHNLR

SEQ ID NO: 31867 - protein, 9 aa, Homo Sapiens
SRRYIDKYR

SEQ ID NO: 31868 - protein, 9 aa, Homo Sapiens
IVGGILHVF

SEQ ID NO: 31869 - protein, 9 aa, Homo Sapiens
EEACYQFIN

SEQ ID NO: 31870 - protein, 9 aa, Homo Sapiens
ENISLEEVV

SEQ ID NO: 31871 - protein, 9 aa, Homo Sapiens
PVFQAVINW

SEQ ID NO: 31872 - protein, 9 aa, Homo Sapiens
HGPCFNGGL

SEQ ID NO: 31873 - protein, 9 aa, Homo Sapiens
PLPMMPNEA

SEQ ID NO: 31874 - protein, 9 aa, Homo Sapiens
LPDLYKVFQ

SEQ ID NO: 31875 - protein, 9 aa, Homo Sapiens
MVLQTQPVS

SEQ ID NO: 31876 - protein, 9 aa, Homo Sapiens
VMQCLPRIE

SEQ ID NO: 31877 - protein, 9 aa, Homo Sapiens
IHLMLPQTR

SEQ ID NO: 31878 - protein, 9 aa, Homo Sapiens
RTPARKEKQ

SEQ ID NO: 31879 - protein, 9 aa, Homo Sapiens
YALEKKDKT

SEQ ID NO: 31880 - protein, 9 aa, Homo Sapiens
SRSLKEELL

SEQ ID NO: 31881 - protein, 9 aa, Homo Sapiens
VRWRKDILE

SEQ ID NO: 31882 - protein, 9 aa, Homo Sapiens
STYTAKALG

SEQ ID NO: 31883 - protein, 9 aa, Homo Sapiens
NVLVASVAE

SEQ ID NO: 31884 - protein, 9 aa, Homo Sapiens
QLKGSSDRI

SEQ ID NO: 31885 - protein, 9 aa, Homo Sapiens
LLQLHKLVE

SEQ ID NO: 31886 - protein, 9 aa, Homo Sapiens
SRKETRKTA

SEQ ID NO: 31887 - protein, 9 aa, Homo Sapiens
QLIKAPSLK

SEQ ID NO: 31888 - protein, 9 aa, Homo Sapiens
MIKAWQVPY

SEQ ID NO: 31889 - protein, 9 aa, Homo Sapiens
TSQKDISIS

SEQ ID NO: 31890 - protein, 9 aa, Homo Sapiens
INNVDLAMG

SEQ ID NO: 31891 - protein, 9 aa, Homo Sapiens
HNSFGEMLE

SEQ ID NO: 31892 - protein, 9 aa, Homo Sapiens
DFWRERSDE

SEQ ID NO: 31893 - protein, 9 aa, Homo Sapiens
QQMDVFEGL

SEQ ID NO: 31894 - protein, 9 aa, Homo Sapiens
RLHREEACY

SEQ ID NO: 31895 - protein, 9 aa, Homo Sapiens
SSESQSESK

SEQ ID NO: 31896 - protein, 9 aa, Homo Sapiens
PRLHWLDLK

SEQ ID NO: 31897 - protein, 9 aa, Homo Sapiens
YSICGRTLP

SEQ ID NO: 31898 - protein, 9 aa, Homo Sapiens
KPTMNYDKL

SEQ ID NO: 31899 - protein, 9 aa, Homo Sapiens
PNTLEKLEV

SEQ ID NO: 31900 - protein, 9 aa, Homo Sapiens
NQKPITWAA

SEQ ID NO: 31901 - protein, 9 aa, Homo Sapiens
AFAKVLRLP

SEQ ID NO: 31902 - protein, 9 aa, Homo Sapiens
GGAGGEASS

SEQ ID NO: 31903 - protein, 9 aa, Homo Sapiens
TAKEKDQIC

SEQ ID NO: 31904 - protein, 9 aa, Homo Sapiens
PRVHLGRAL

SEQ ID NO: 31905 - protein, 9 aa, Homo Sapiens
GVIEAKMHA

SEQ ID NO: 31906 - protein, 9 aa, Homo Sapiens
VSPGPSRSL

SEQ ID NO: 31907 - protein, 9 aa, Homo Sapiens
QQEAQWAQF

SEQ ID NO: 31908 - protein, 9 aa, Homo Sapiens
GDRDGEIVD

SEQ ID NO: 31909 - protein, 9 aa, Homo Sapiens
APTSQKDIS

SEQ ID NO: 31910 - protein, 9 aa, Homo Sapiens
EIPHDFDWD

SEQ ID NO: 31911 - protein, 9 aa, Homo Sapiens
GCECGSFRR

SEQ ID NO: 31912 - protein, 9 aa, Homo Sapiens
RKINAGSQY

SEQ ID NO: 31913 - protein, 9 aa, Homo Sapiens
VEDLLQLHK

SEQ ID NO: 31914 - protein, 9 aa, Homo Sapiens
NEATAAVDL

SEQ ID NO: 31915 - protein, 9 aa, Homo Sapiens
SQAFAKVLR

SEQ ID NO: 31916 - protein, 9 aa, Homo Sapiens
YDEMGCTWG

SEQ ID NO: 31917 - protein, 9 aa, Homo Sapiens
ESPLHPCST

SEQ ID NO: 31918 - protein, 9 aa, Homo Sapiens
HSSPDNRCI

SEQ ID NO: 31919 - protein, 9 aa, Homo Sapiens
KQENEAESD

SEQ ID NO: 31920 - protein, 9 aa, Homo Sapiens
SSTSYSRPA

SEQ ID NO: 31921 - protein, 9 aa, Homo Sapiens
NSTSQAFAK

SEQ ID NO: 31922 - protein, 9 aa, Homo Sapiens
IKAPSLKEA

SEQ ID NO: 31923 - protein, 9 aa, Homo Sapiens
VGASEAAFF

SEQ ID NO: 31924 - protein, 9 aa, Homo Sapiens
PVYSANTWC

SEQ ID NO: 31925 - protein, 9 aa, Homo Sapiens
PRGVSMFSV

SEQ ID NO: 31926 - protein, 9 aa, Homo Sapiens
LTVAALERG

SEQ ID NO: 31927 - protein, 9 aa, Homo Sapiens
GGILHVFQI

SEQ ID NO: 31928 - protein, 9 aa, Homo Sapiens
STWGQIRTK

SEQ ID NO: 31929 - protein, 9 aa, Homo Sapiens
LYIGRPLAA

SEQ ID NO: 31930 - protein, 9 aa, Homo Sapiens
HSSSAESDR

SEQ ID NO: 31931 - protein, 9 aa, Homo Sapiens
DLDSNKNAQ

SEQ ID NO: 31932 - protein, 9 aa, Homo Sapiens
ASEAAFFLK

SEQ ID NO: 31933 - protein, 9 aa, Homo Sapiens
DILEEKDFQ

SEQ ID NO: 31934 - protein, 9 aa, Homo Sapiens
MFSVTAHDP

SEQ ID NO: 31935 - protein, 9 aa, Homo Sapiens
TSQAFAKVL

SEQ ID NO: 31936 - protein, 9 aa, Homo Sapiens
TVASDSSME

SEQ ID NO: 31937 - protein, 9 aa, Homo Sapiens
ENVTFKKPE

SEQ ID NO: 31938 - protein, 9 aa, Homo Sapiens
KKKGTEAEV

SEQ ID NO: 31939 - protein, 9 aa, Homo Sapiens
HFVDQYLNI

SEQ ID NO: 31940 - protein, 9 aa, Homo Sapiens
NQKRRVKCD

SEQ ID NO: 31941 - protein, 9 aa, Homo Sapiens
AHNAVQRAA

SEQ ID NO: 31942 - protein, 9 aa, Homo Sapiens
FQEGKEKCP

SEQ ID NO: 31943 - protein, 9 aa, Homo Sapiens
GCEALHPFT

SEQ ID NO: 31944 - protein, 9 aa, Homo Sapiens
ISTNVEQLI

SEQ ID NO: 31945 - protein, 9 aa, Homo Sapiens
APHYYEQTQ

SEQ ID NO: 31946 - protein, 9 aa, Homo Sapiens
FVHSRKETR

SEQ ID NO: 31947 - protein, 9 aa, Homo Sapiens
SIGSEALLT

SEQ ID NO: 31948 - protein, 9 aa, Homo Sapiens
YELQQLKGS

SEQ ID NO: 31949 - protein, 9 aa, Homo Sapiens
PLPFGPREQ

SEQ ID NO: 31950 - protein, 9 aa, Homo Sapiens
VPATAASPA

SEQ ID NO: 31951 - protein, 9 aa, Homo Sapiens
PSRSLKEEL

SEQ ID NO: 31952 - protein, 9 aa, Homo Sapiens
HPRVHLGRA

SEQ ID NO: 31953 - protein, 9 aa, Homo Sapiens
ANTWCAFDG

SEQ ID NO: 31954 - protein, 9 aa, Homo Sapiens
EALLTISGS

SEQ ID NO: 31955 - protein, 9 aa, Homo Sapiens
VHLGRALEQ

SEQ ID NO: 31956 - protein, 9 aa, Homo Sapiens
AHRVPKSGR

SEQ ID NO: 31957 - protein, 9 aa, Homo Sapiens
KILVLNEAT

SEQ ID NO: 31958 - protein, 9 aa, Homo Sapiens
DYDLMAQPV

SEQ ID NO: 31959 - protein, 9 aa, Homo Sapiens
ASPAPAVAA

SEQ ID NO: 31960 - protein, 9 aa, Homo Sapiens
SLAKSSICN

SEQ ID NO: 31961 - protein, 9 aa, Homo Sapiens
ILDINNVDL

SEQ ID NO: 31962 - protein, 9 aa, Homo Sapiens
SEIWYVSST

SEQ ID NO: 31963 - protein, 9 aa, Homo Sapiens
KAKEAAHIV

SEQ ID NO: 31964 - protein, 9 aa, Homo Sapiens
KTIIIGHSF

SEQ ID NO: 31965 - protein, 9 aa, Homo Sapiens
LSFANKRLP

SEQ ID NO: 31966 - protein, 9 aa, Homo Sapiens
NIAKTEFSP

SEQ ID NO: 31967 - protein, 9 aa, Homo Sapiens
VDGVADQTD

SEQ ID NO: 31968 - protein, 9 aa, Homo Sapiens
FSLSITTES

SEQ ID NO: 31969 - protein, 9 aa, Homo Sapiens
KRARGPPRE

SEQ ID NO: 31970 - protein, 9 aa, Homo Sapiens
KNIAKTEFS

SEQ ID NO: 31971 - protein, 9 aa, Homo Sapiens
SITLIEGKD

SEQ ID NO: 31972 - protein, 9 aa, Homo Sapiens
AYFKKVPCL

SEQ ID NO: 31973 - protein, 9 aa, Homo Sapiens
KVSTWGQIR

SEQ ID NO: 31974 - protein, 9 aa, Homo Sapiens
MCVNERQRL

SEQ ID NO: 31975 - protein, 9 aa, Homo Sapiens
RERSDEHTQ

SEQ ID NO: 31976 - protein, 9 aa, Homo Sapiens
HRVPKSGRS

SEQ ID NO: 31977 - protein, 9 aa, Homo Sapiens
GKDLKAMDS

SEQ ID NO: 31978 - protein, 9 aa, Homo Sapiens
RRFQQMDVF

SEQ ID NO: 31979 - protein, 9 aa, Homo Sapiens
SQIWNLNPV

SEQ ID NO: 31980 - protein, 9 aa, Homo Sapiens
VTPGPSIPG

SEQ ID NO: 31981 - protein, 9 aa, Homo Sapiens
KCADIDVQT

SEQ ID NO: 31982 - protein, 9 aa, Homo Sapiens
LEEVVEIEY

SEQ ID NO: 31983 - protein, 9 aa, Homo Sapiens
SKVPEDLAG

SEQ ID NO: 31984 - protein, 9 aa, Homo Sapiens
HSFGAIAAM

SEQ ID NO: 31985 - protein, 9 aa, Homo Sapiens
HHSPLKPSV

SEQ ID NO: 31986 - protein, 9 aa, Homo Sapiens
TTEFVTATE

SEQ ID NO: 31987 - protein, 9 aa, Homo Sapiens
RCRRRPLAE

SEQ ID NO: 31988 - protein, 9 aa, Homo Sapiens
CGIQLLYIG

SEQ ID NO: 31989 - protein, 9 aa, Homo Sapiens
NNPRGVSMF

SEQ ID NO: 31990 - protein, 9 aa, Homo Sapiens
RKVIKEYPE

SEQ ID NO: 31991 - protein, 9 aa, Homo Sapiens
ELTQDTTLT

SEQ ID NO: 31992 - protein, 9 aa, Homo Sapiens
LNSIGSEAL

SEQ ID NO: 31993 - protein, 9 aa, Homo Sapiens
KPITWAADA

SEQ ID NO: 31994 - protein, 9 aa, Homo Sapiens
DSSTVSSGA

SEQ ID NO: 31995 - protein, 9 aa, Homo Sapiens
TNSDSSTVS

SEQ ID NO: 31996 - protein, 9 aa, Homo Sapiens
GSEIINYAL

SEQ ID NO: 31997 - protein, 9 aa, Homo Sapiens
FYPNGVIEA

SEQ ID NO: 31998 - protein, 9 aa, Homo Sapiens
TAAKGPARR

SEQ ID NO: 31999 - protein, 9 aa, Homo Sapiens
IDKYRNDYT

SEQ ID NO: 32000 - protein, 9 aa, Homo Sapiens
NKFLSFANK

SEQ ID NO: 32001 - protein, 9 aa, Homo Sapiens
KKYHLRLNE

SEQ ID NO: 32002 - protein, 9 aa, Homo Sapiens
GKRSTKKRR

SEQ ID NO: 32003 - protein, 9 aa, Homo Sapiens
DYKYHVSDV

SEQ ID NO: 32004 - protein, 9 aa, Homo Sapiens
GSTYTAKAL

SEQ ID NO: 32005 - protein, 9 aa, Homo Sapiens
CADIDVQTP

SEQ ID NO: 32006 - protein, 9 aa, Homo Sapiens
KLKALGITA

SEQ ID NO: 32007 - protein, 9 aa, Homo Sapiens
YEHLACAFL

SEQ ID NO: 32008 - protein, 9 aa, Homo Sapiens
ARASFSLGQ

SEQ ID NO: 32009 - protein, 9 aa, Homo Sapiens
HSRRYIDKY

SEQ ID NO: 32010 - protein, 9 aa, Homo Sapiens
LGKYDPLTQ

SEQ ID NO: 32011 - protein, 9 aa, Homo Sapiens
EAAFFLKKS

SEQ ID NO: 32012 - protein, 9 aa, Homo Sapiens
QPVPSHSPK

SEQ ID NO: 32013 - protein, 9 aa, Homo Sapiens
GIYTCFAEY

SEQ ID NO: 32014 - protein, 9 aa, Homo Sapiens
GEKLLKEMR

SEQ ID NO: 32015 - protein, 9 aa, Homo Sapiens
DEEERHGEE

SEQ ID NO: 32016 - protein, 9 aa, Homo Sapiens
QKDISISEF

SEQ ID NO: 32017 - protein, 9 aa, Homo Sapiens
GDLNHLKPL

SEQ ID NO: 32018 - protein, 9 aa, Homo Sapiens
AKEAAHIVG

SEQ ID NO: 32019 - protein, 9 aa, Homo Sapiens
NVEQLIKAP

SEQ ID NO: 32020 - protein, 9 aa, Homo Sapiens
SSSAESDRS

SEQ ID NO: 32021 - protein, 9 aa, Homo Sapiens
PKKLDDLVP

SEQ ID NO: 32022 - protein, 9 aa, Homo Sapiens
NPCAMACHG

SEQ ID NO: 32023 - protein, 9 aa, Homo Sapiens
MVIHLMLPQ

SEQ ID NO: 32024 - protein, 9 aa, Homo Sapiens
EARNVTMEL

SEQ ID NO: 32025 - protein, 9 aa, Homo Sapiens
ANMLACSSE

SEQ ID NO: 32026 - protein, 9 aa, Homo Sapiens
KEYLRALDV

SEQ ID NO: 32027 - protein, 9 aa, Homo Sapiens
VQIAHALCL

SEQ ID NO: 32028 - protein, 9 aa, Homo Sapiens
ASGKRQFLL

SEQ ID NO: 32029 - protein, 9 aa, Homo Sapiens
FQQMDVFEG

SEQ ID NO: 32030 - protein, 9 aa, Homo Sapiens
ELVQQVDKD

SEQ ID NO: 32031 - protein, 9 aa, Homo Sapiens
VSGVTCAHG

SEQ ID NO: 32032 - protein, 9 aa, Homo Sapiens
DHTAPPYDS

SEQ ID NO: 32033 - protein, 9 aa, Homo Sapiens
SDTFFSLSI

SEQ ID NO: 32034 - protein, 9 aa, Homo Sapiens
GGMNWRPIL

SEQ ID NO: 32035 - protein, 9 aa, Homo Sapiens
FTLPTSFQE

SEQ ID NO: 32036 - protein, 9 aa, Homo Sapiens
CECGSFRRL

SEQ ID NO: 32037 - protein, 9 aa, Homo Sapiens
AKGPARRCS

SEQ ID NO: 32038 - protein, 9 aa, Homo Sapiens
CMGGMNWRP

SEQ ID NO: 32039 - protein, 9 aa, Homo Sapiens
TNEEEKQEN

SEQ ID NO: 32040 - protein, 9 aa, Homo Sapiens
GLYMVRVPL

SEQ ID NO: 32041 - protein, 9 aa, Homo Sapiens
SNKNAQITY

SEQ ID NO: 32042 - protein, 9 aa, Homo Sapiens
AFLVRWRKD

SEQ ID NO: 32043 - protein, 9 aa, Homo Sapiens
QTGDNAAIN

SEQ ID NO: 32044 - protein, 9 aa, Homo Sapiens
GSQYDEMGC

SEQ ID NO: 32045 - protein, 9 aa, Homo Sapiens
TAKALGFSD

SEQ ID NO: 32046 - protein, 9 aa, Homo Sapiens
ISLEEVVEI

SEQ ID NO: 32047 - protein, 9 aa, Homo Sapiens
DGVLQPKAA

SEQ ID NO: 32048 - protein, 9 aa, Homo Sapiens
VGAFDKLMD

SEQ ID NO: 32049 - protein, 9 aa, Homo Sapiens
KLANRFPQQ

SEQ ID NO: 32050 - protein, 9 aa, Homo Sapiens
LKEELLCAV

SEQ ID NO: 32051 - protein, 9 aa, Homo Sapiens
ALEQLVLIG

SEQ ID NO: 32052 - protein, 9 aa, Homo Sapiens
LTQCNQKRR

SEQ ID NO: 32053 - protein, 9 aa, Homo Sapiens
LQGKKSKHA

SEQ ID NO: 32054 - protein, 9 aa, Homo Sapiens
LIEGKDLKA

SEQ ID NO: 32055 - protein, 9 aa, Homo Sapiens
RKDILEEKD

SEQ ID NO: 32056 - protein, 9 aa, Homo Sapiens
VSSRPTFPE

SEQ ID NO: 32057 - protein, 9 aa, Homo Sapiens
PQTREIYEL

SEQ ID NO: 32058 - protein, 9 aa, Homo Sapiens
PAYRHHLIP

SEQ ID NO: 32059 - protein, 9 aa, Homo Sapiens
LGYGYGCEC

SEQ ID NO: 32060 - protein, 9 aa, Homo Sapiens
EVSGVTCAH

SEQ ID NO: 32061 - protein, 9 aa, Homo Sapiens
EDSHSSPDN

SEQ ID NO: 32062 - protein, 9 aa, Homo Sapiens
PACGFLSEN

SEQ ID NO: 32063 - protein, 9 aa, Homo Sapiens
SDRSYKKSK

SEQ ID NO: 32064 - protein, 9 aa, Homo Sapiens
LNEATAAVD

SEQ ID NO: 32065 - protein, 9 aa, Homo Sapiens
ALSCSLSAY

SEQ ID NO: 32066 - protein, 9 aa, Homo Sapiens
IGSEALLTI

SEQ ID NO: 32067 - protein, 9 aa, Homo Sapiens
CIVGGILHV

SEQ ID NO: 32068 - protein, 9 aa, Homo Sapiens
FLLTVAALE

SEQ ID NO: 32069 - protein, 9 aa, Homo Sapiens
CNQKRRVKC

SEQ ID NO: 32070 - protein, 9 aa, Homo Sapiens
AYRHHLIPS

SEQ ID NO: 32071 - protein, 9 aa, Homo Sapiens
DSHSSPDNR

SEQ ID NO: 32072 - protein, 9 aa, Homo Sapiens
STSQAFAKV

SEQ ID NO: 32073 - protein, 9 aa, Homo Sapiens
EFTMKKYHL

SEQ ID NO: 32074 - protein, 9 aa, Homo Sapiens
TEFTDRGEH

SEQ ID NO: 32075 - protein, 9 aa, Homo Sapiens
RSSHLEGHQ

SEQ ID NO: 32076 - protein, 9 aa, Homo Sapiens
EKLEVVSES

SEQ ID NO: 32077 - protein, 9 aa, Homo Sapiens
PWGKLKSGR

SEQ ID NO: 32078 - protein, 9 aa, Homo Sapiens
KEYWDCLQG

SEQ ID NO: 32079 - protein, 9 aa, Homo Sapiens
SVQSNLNQV

SEQ ID NO: 32080 - protein, 9 aa, Homo Sapiens
DDDDFQTNW

SEQ ID NO: 32081 - protein, 9 aa, Homo Sapiens
NSIGSEALL

SEQ ID NO: 32082 - protein, 9 aa, Homo Sapiens
VYSANTWCA

SEQ ID NO: 32083 - protein, 9 aa, Homo Sapiens
KTKILVLNE

SEQ ID NO: 32084 - protein, 9 aa, Homo Sapiens
EAFETWQSW

SEQ ID NO: 32085 - protein, 9 aa, Homo Sapiens
GTEAEVLAK

SEQ ID NO: 32086 - protein, 9 aa, Homo Sapiens
KYDPLTQAD

SEQ ID NO: 32087 - protein, 9 aa, Homo Sapiens
KEAEEPQKP

SEQ ID NO: 32088 - protein, 9 aa, Homo Sapiens
HSPLKPSVS

SEQ ID NO: 32089 - protein, 9 aa, Homo Sapiens
AESDRSYKK

SEQ ID NO: 32090 - protein, 9 aa, Homo Sapiens
SYCPEVVVD

SEQ ID NO: 32091 - protein, 9 aa, Homo Sapiens
CRRRPLAEK

SEQ ID NO: 32092 - protein, 9 aa, Homo Sapiens
SGKRQFLLC

SEQ ID NO: 32093 - protein, 9 aa, Homo Sapiens
ECGSFRRLG

SEQ ID NO: 32094 - protein, 9 aa, Homo Sapiens
LNQLQQAEI

SEQ ID NO: 32095 - protein, 9 aa, Homo Sapiens
EGKDLKAMD

SEQ ID NO: 32096 - protein, 9 aa, Homo Sapiens
ITASQDRAV

SEQ ID NO: 32097 - protein, 9 aa, Homo Sapiens
HSRKETRKT

SEQ ID NO: 32098 - protein, 9 aa, Homo Sapiens
GTGCPFESW

SEQ ID NO: 32099 - protein, 9 aa, Homo Sapiens
PKPWGKLKS

SEQ ID NO: 32100 - protein, 9 aa, Homo Sapiens
KKGTEAEVL

SEQ ID NO: 32101 - protein, 9 aa, Homo Sapiens
PFLKPAYRH

SEQ ID NO: 32102 - protein, 9 aa, Homo Sapiens
YWDCLQGKK

SEQ ID NO: 32103 - protein, 9 aa, Homo Sapiens
KTEFSPSEA

SEQ ID NO: 32104 - protein, 9 aa, Homo Sapiens
SEAGHAFSP

SEQ ID NO: 32105 - protein, 9 aa, Homo Sapiens
HSPKKLTRS

SEQ ID NO: 32106 - protein, 9 aa, Homo Sapiens
VNERQRLIV

SEQ ID NO: 32107 - protein, 9 aa, Homo Sapiens
QERGWPKDR

SEQ ID NO: 32108 - protein, 9 aa, Homo Sapiens
GNFSFSEIW

SEQ ID NO: 32109 - protein, 9 aa, Homo Sapiens
VDSEEPVFQ

SEQ ID NO: 32110 - protein, 9 aa, Homo Sapiens
TSYSRPAHP

SEQ ID NO: 32111 - protein, 9 aa, Homo Sapiens
ILNSVIYSL

SEQ ID NO: 32112 - protein, 9 aa, Homo Sapiens
QTPDSILVN

SEQ ID NO: 32113 - protein, 9 aa, Homo Sapiens
IYSICGRTL

SEQ ID NO: 32114 - protein, 9 aa, Homo Sapiens
ASSKPKDSS

SEQ ID NO: 32115 - protein, 9 aa, Homo Sapiens
GAFDKLMDS

SEQ ID NO: 32116 - protein, 9 aa, Homo Sapiens
EKEVKKGLD

SEQ ID NO: 32117 - protein, 9 aa, Homo Sapiens
RDGVLQPKA

SEQ ID NO: 32118 - protein, 9 aa, Homo Sapiens
LKPAYRHHL

SEQ ID NO: 32119 - protein, 9 aa, Homo Sapiens
SCALSWRPI

SEQ ID NO: 32120 - protein, 9 aa, Homo Sapiens
PVPSHSPKK

SEQ ID NO: 32121 - protein, 9 aa, Homo Sapiens
LQTQPVSSQ

SEQ ID NO: 32122 - protein, 9 aa, Homo Sapiens
LKLACVDTY

SEQ ID NO: 32123 - protein, 9 aa, Homo Sapiens
NEEEKQENE

SEQ ID NO: 32124 - protein, 9 aa, Homo Sapiens
LKLANRFPQ

SEQ ID NO: 32125 - protein, 9 aa, Homo Sapiens
LACSSESIK

SEQ ID NO: 32126 - protein, 9 aa, Homo Sapiens
QVSCMLCAK

SEQ ID NO: 32127 - protein, 9 aa, Homo Sapiens
LPRIEEGEN

SEQ ID NO: 32128 - protein, 9 aa, Homo Sapiens
VEEWRAHNA

SEQ ID NO: 32129 - protein, 9 aa, Homo Sapiens
PWSPIPLGT

SEQ ID NO: 32130 - protein, 9 aa, Homo Sapiens
KPKYMPVQS

SEQ ID NO: 32131 - protein, 9 aa, Homo Sapiens
WQVPYVEKR

SEQ ID NO: 32132 - protein, 9 aa, Homo Sapiens
AQWAQFLVE

SEQ ID NO: 32133 - protein, 9 aa, Homo Sapiens
TLTENDDSD

SEQ ID NO: 32134 - protein, 9 aa, Homo Sapiens
YQQNPCAMA

SEQ ID NO: 32135 - protein, 9 aa, Homo Sapiens
KSSICNNYL

SEQ ID NO: 32136 - protein, 9 aa, Homo Sapiens
LGTVLSRSQ

SEQ ID NO: 32137 - protein, 9 aa, Homo Sapiens
SICGTLHFV

SEQ ID NO: 32138 - protein, 9 aa, Homo Sapiens
RIQEADNDH

SEQ ID NO: 32139 - protein, 9 aa, Homo Sapiens
CEALHPFTD

SEQ ID NO: 32140 - protein, 9 aa, Homo Sapiens
QVEEWRAHN

SEQ ID NO: 32141 - protein, 9 aa, Homo Sapiens
SHLEGHQRV

SEQ ID NO: 32142 - protein, 9 aa, Homo Sapiens
HNAVQRAAY

SEQ ID NO: 32143 - protein, 9 aa, Homo Sapiens
TRGGAGVVM

SEQ ID NO: 32144 - protein, 9 aa, Homo Sapiens
LDINNVDLA

SEQ ID NO: 32145 - protein, 9 aa, Homo Sapiens
SGKGRGLPN

SEQ ID NO: 32146 - protein, 9 aa, Homo Sapiens
EQLIKAPSL

SEQ ID NO: 32147 - protein, 9 aa, Homo Sapiens
QDTTLTEND

SEQ ID NO: 32148 - protein, 9 aa, Homo Sapiens
LYMVRVPLP

SEQ ID NO: 32149 - protein, 9 aa, Homo Sapiens
QLQQAEITQ

SEQ ID NO: 32150 - protein, 9 aa, Homo Sapiens
KDLKAMDSN

SEQ ID NO: 32151 - protein, 9 aa, Homo Sapiens
DNDHTAPPY

SEQ ID NO: 32152 - protein, 9 aa, Homo Sapiens
SCMGGMNWR

SEQ ID NO: 32153 - protein, 9 aa, Homo Sapiens
IPHDFDWDL

SEQ ID NO: 32154 - protein, 9 aa, Homo Sapiens
RMYYTSPLY

SEQ ID NO: 32155 - protein, 9 aa, Homo Sapiens
YNCGIQLLY

SEQ ID NO: 32156 - protein, 9 aa, Homo Sapiens
KEMRNLRGK

SEQ ID NO: 32157 - protein, 9 aa, Homo Sapiens
VQTGDNAAI

SEQ ID NO: 32158 - protein, 9 aa, Homo Sapiens
GVTCAHGPC

SEQ ID NO: 32159 - protein, 9 aa, Homo Sapiens
LCGKTLGTT

SEQ ID NO: 32160 - protein, 9 aa, Homo Sapiens
KNAQITYSL

SEQ ID NO: 32161 - protein, 9 aa, Homo Sapiens
IQLLYIGRP

SEQ ID NO: 32162 - protein, 9 aa, Homo Sapiens
QEADNDHTA

SEQ ID NO: 32163 - protein, 9 aa, Homo Sapiens
TKQKVEVVS

SEQ ID NO: 32164 - protein, 9 aa, Homo Sapiens
SCSLSAYGM

SEQ ID NO: 32165 - protein, 9 aa, Homo Sapiens
QAIHPACGF

SEQ ID NO: 32166 - protein, 9 aa, Homo Sapiens
YGCKRARGP

SEQ ID NO: 32167 - protein, 9 aa, Homo Sapiens
LPMMPNEAR

SEQ ID NO: 32168 - protein, 9 aa, Homo Sapiens
KGTEAEVLA

SEQ ID NO: 32169 - protein, 9 aa, Homo Sapiens
CLGSQDYLK

SEQ ID NO: 32170 - protein, 9 aa, Homo Sapiens
SSGRPNRVP

SEQ ID NO: 32171 - protein, 9 aa, Homo Sapiens
KPEGLLAWG

SEQ ID NO: 32172 - protein, 9 aa, Homo Sapiens
VRTFLIQEP

SEQ ID NO: 32173 - protein, 9 aa, Homo Sapiens
SRPTFPEKF

SEQ ID NO: 32174 - protein, 9 aa, Homo Sapiens
VLIAMCVSI

SEQ ID NO: 32175 - protein, 9 aa, Homo Sapiens
KGSSDRILE

SEQ ID NO: 32176 - protein, 9 aa, Homo Sapiens
FSPSEASQH

SEQ ID NO: 32177 - protein, 9 aa, Homo Sapiens
KKVLCSNSL

SEQ ID NO: 32178 - protein, 9 aa, Homo Sapiens
GMNWRPILT

SEQ ID NO: 32179 - protein, 9 aa, Homo Sapiens
TFPEKFSVP

SEQ ID NO: 32180 - protein, 9 aa, Homo Sapiens
RGKNGASPS

SEQ ID NO: 32181 - protein, 9 aa, Homo Sapiens
MLNSSAMDR

SEQ ID NO: 32182 - protein, 9 aa, Homo Sapiens
DYLKLANRF

SEQ ID NO: 32183 - protein, 9 aa, Homo Sapiens
IELKSVQSN

SEQ ID NO: 32184 - protein, 9 aa, Homo Sapiens
TGDNAAINP

SEQ ID NO: 32185 - protein, 9 aa, Homo Sapiens
RRYIDKYRN

SEQ ID NO: 32186 - protein, 9 aa, Homo Sapiens
TPARKEKQM

SEQ ID NO: 32187 - protein, 9 aa, Homo Sapiens
VTESPLHPC

SEQ ID NO: 32188 - protein, 9 aa, Homo Sapiens
EAEEPQKPT

SEQ ID NO: 32189 - protein, 9 aa, Homo Sapiens
ALEKEVQAF

SEQ ID NO: 32190 - protein, 9 aa, Homo Sapiens
DKYRNDYTQ

SEQ ID NO: 32191 - protein, 9 aa, Homo Sapiens
VNKFLSFAN

SEQ ID NO: 32192 - protein, 9 aa, Homo Sapiens
CIVAELNST

SEQ ID NO: 32193 - protein, 9 aa, Homo Sapiens
CFAEYNRGK

SEQ ID NO: 32194 - protein, 9 aa, Homo Sapiens
DKDDAIYHV

SEQ ID NO: 32195 - protein, 9 aa, Homo Sapiens
FFLKKSGLS

SEQ ID NO: 32196 - protein, 9 aa, Homo Sapiens
EADNDHTAP

SEQ ID NO: 32197 - protein, 9 aa, Homo Sapiens
YLKLANRFP

SEQ ID NO: 32198 - protein, 9 aa, Homo Sapiens
NERQRLIVP

SEQ ID NO: 32199 - protein, 9 aa, Homo Sapiens
PSVSLTPPM

SEQ ID NO: 32200 - protein, 9 aa, Homo Sapiens
ERSDEHTQE

SEQ ID NO: 32201 - protein, 9 aa, Homo Sapiens
LQMFVTEFT

SEQ ID NO: 32202 - protein, 9 aa, Homo Sapiens
FSPDSEVTS

SEQ ID NO: 32203 - protein, 9 aa, Homo Sapiens
HWLDLKGNH

SEQ ID NO: 32204 - protein, 9 aa, Homo Sapiens
QQAEITQGR

SEQ ID NO: 32205 - protein, 9 aa, Homo Sapiens
ERHGEEEEE

SEQ ID NO: 32206 - protein, 9 aa, Homo Sapiens
WCAFDGPGA

SEQ ID NO: 32207 - protein, 9 aa, Homo Sapiens
VASVAEINV

SEQ ID NO: 32208 - protein, 9 aa, Homo Sapiens
QIAHALCLS

SEQ ID NO: 32209 - protein, 9 aa, Homo Sapiens
RGGAGVVMA

SEQ ID NO: 32210 - protein, 9 aa, Homo Sapiens
AHDLDSNKN

SEQ ID NO: 32211 - protein, 9 aa, Homo Sapiens
RVHLGRALE

SEQ ID NO: 32212 - protein, 9 aa, Homo Sapiens
RRRPLAEKK

SEQ ID NO: 32213 - protein, 9 aa, Homo Sapiens
PGANEEIPH

SEQ ID NO: 32214 - protein, 9 aa, Homo Sapiens
PGDLTAKEK

SEQ ID NO: 32215 - protein, 9 aa, Homo Sapiens
KSESAGSKS

SEQ ID NO: 32216 - protein, 9 aa, Homo Sapiens
ANGIGKPKY

SEQ ID NO: 32217 - protein, 9 aa, Homo Sapiens
KKVPCLKTW

SEQ ID NO: 32218 - protein, 9 aa, Homo Sapiens
SPDLGKYDP

SEQ ID NO: 32219 - protein, 9 aa, Homo Sapiens
VGGILHVFQ

SEQ ID NO: 32220 - protein, 9 aa, Homo Sapiens
REFIYSICG

SEQ ID NO: 32221 - protein, 9 aa, Homo Sapiens
LSAYGMLTF

SEQ ID NO: 32222 - protein, 9 aa, Homo Sapiens
WDCLQGKKS

SEQ ID NO: 32223 - protein, 9 aa, Homo Sapiens
CGTLHFVDQ

SEQ ID NO: 32224 - protein, 9 aa, Homo Sapiens
QPPRDGVLQ

SEQ ID NO: 32225 - protein, 9 aa, Homo Sapiens
QIPCIVAEL

SEQ ID NO: 32226 - protein, 9 aa, Homo Sapiens
IKRTENVTF

SEQ ID NO: 32227 - protein, 9 aa, Homo Sapiens
TCFAEYNRG

SEQ ID NO: 32228 - protein, 9 aa, Homo Sapiens
DSEEPVFQA

SEQ ID NO: 32229 - protein, 9 aa, Homo Sapiens
WSPIPLGTV

SEQ ID NO: 32230 - protein, 9 aa, Homo Sapiens
LDVQTGDNA

SEQ ID NO: 32231 - protein, 9 aa, Homo Sapiens
EALHPFTDV

SEQ ID NO: 32232 - protein, 9 aa, Homo Sapiens
IQWLYGCKR

SEQ ID NO: 32233 - protein, 9 aa, Homo Sapiens
QDYKYHVSD

SEQ ID NO: 32234 - protein, 9 aa, Homo Sapiens
VITAILNSV

SEQ ID NO: 32235 - protein, 9 aa, Homo Sapiens
QLHKLVEAD

SEQ ID NO: 32236 - protein, 9 aa, Homo Sapiens
GEASSKPKD

SEQ ID NO: 32237 - protein, 9 aa, Homo Sapiens
AWQVPYVEK

SEQ ID NO: 32238 - protein, 9 aa, Homo Sapiens
WLYGCKRAR

SEQ ID NO: 32239 - protein, 9 aa, Homo Sapiens
NVTFKKPET

SEQ ID NO: 32240 - protein, 9 aa, Homo Sapiens
TLNQLQQAE

SEQ ID NO: 32241 - protein, 9 aa, Homo Sapiens
ISSCALSWR

SEQ ID NO: 32242 - protein, 9 aa, Homo Sapiens
VASDSSMEG

SEQ ID NO: 32243 - protein, 9 aa, Homo Sapiens
AEYNRGKAN

SEQ ID NO: 32244 - protein, 9 aa, Homo Sapiens
RVLGVLPQR

SEQ ID NO: 32245 - protein, 9 aa, Homo Sapiens
YKYHVSDVT

SEQ ID NO: 32246 - protein, 9 aa, Homo Sapiens
GAPQPGCEA

SEQ ID NO: 32247 - protein, 9 aa, Homo Sapiens
CNNYLNLTF

SEQ ID NO: 32248 - protein, 9 aa, Homo Sapiens
EGQVENTEA

SEQ ID NO: 32249 - protein, 9 aa, Homo Sapiens
SHALQGRKC

SEQ ID NO: 32250 - protein, 9 aa, Homo Sapiens
PTEESSMNY

SEQ ID NO: 32251 - protein, 9 aa, Homo Sapiens
RPFLKPAYR

SEQ ID NO: 32252 - protein, 9 aa, Homo Sapiens
SFDSVVPKK

SEQ ID NO: 32253 - protein, 9 aa, Homo Sapiens
ACKKVLCSN

SEQ ID NO: 32254 - protein, 9 aa, Homo Sapiens
GYVDVAVRA

SEQ ID NO: 32255 - protein, 9 aa, Homo Sapiens
ENVLVASVA

SEQ ID NO: 32256 - protein, 9 aa, Homo Sapiens
RSDEHTQET

SEQ ID NO: 32257 - protein, 9 aa, Homo Sapiens
NSVKNILKT

SEQ ID NO: 32258 - protein, 9 aa, Homo Sapiens
SFTAAKGPA

SEQ ID NO: 32259 - protein, 9 aa, Homo Sapiens
TRKTARAIR

SEQ ID NO: 32260 - protein, 9 aa, Homo Sapiens
FQRVLGVLP

SEQ ID NO: 32261 - protein, 9 aa, Homo Sapiens
SPIPLGTVL

SEQ ID NO: 32262 - protein, 9 aa, Homo Sapiens
IAMCVSITV

SEQ ID NO: 32263 - protein, 9 aa, Homo Sapiens
QIWNLNPVF

SEQ ID NO: 32264 - protein, 9 aa, Homo Sapiens
GPSRSLKEE

SEQ ID NO: 32265 - protein, 9 aa, Homo Sapiens
NENFKEYLR

SEQ ID NO: 32266 - protein, 9 aa, Homo Sapiens
SKLIGSQSF

SEQ ID NO: 32267 - protein, 9 aa, Homo Sapiens
VIKEYPEKE

SEQ ID NO: 32268 - protein, 9 aa, Homo Sapiens
RDGAPLPMM

SEQ ID NO: 32269 - protein, 9 aa, Homo Sapiens
MVRPFLKPA

SEQ ID NO: 32270 - protein, 9 aa, Homo Sapiens
HRHLTLKNS

SEQ ID NO: 32271 - protein, 9 aa, Homo Sapiens
ARRIRGETA

SEQ ID NO: 32272 - protein, 9 aa, Homo Sapiens
RDQERGWPK

SEQ ID NO: 32273 - protein, 9 aa, Homo Sapiens
KELVNRLCE

SEQ ID NO: 32274 - protein, 9 aa, Homo Sapiens
GFSRSSHLE

SEQ ID NO: 32275 - protein, 9 aa, Homo Sapiens
QPVTPGPSI

SEQ ID NO: 32276 - protein, 9 aa, Homo Sapiens
WRPILTIIT

SEQ ID NO: 32277 - protein, 9 aa, Homo Sapiens
NSDSSTVSS

SEQ ID NO: 32278 - protein, 9 aa, Homo Sapiens
SESKSESAG

SEQ ID NO: 32279 - protein, 9 aa, Homo Sapiens
CSNSLLEST

SEQ ID NO: 32280 - protein, 9 aa, Homo Sapiens
NMLACSSES

SEQ ID NO: 32281 - protein, 9 aa, Homo Sapiens
PPLAPRPSR

SEQ ID NO: 32282 - protein, 9 aa, Homo Sapiens
QCNQKRRVK

SEQ ID NO: 32283 - protein, 9 aa, Homo Sapiens
RGWPKDRKH

SEQ ID NO: 32284 - protein, 9 aa, Homo Sapiens
KNASGKRQF

SEQ ID NO: 32285 - protein, 9 aa, Homo Sapiens
PCLKTWLLS

SEQ ID NO: 32286 - protein, 9 aa, Homo Sapiens
RRRRVQIAH

SEQ ID NO: 32287 - protein, 9 aa, Homo Sapiens
VQQVDKDDA

SEQ ID NO: 32288 - protein, 9 aa, Homo Sapiens
SNDEETMVN

SEQ ID NO: 32289 - protein, 9 aa, Homo Sapiens
KTTAENVLV

SEQ ID NO: 32290 - protein, 9 aa, Homo Sapiens
KTRGKNGAS

SEQ ID NO: 32291 - protein, 9 aa, Homo Sapiens
IIIGHSFGA

SEQ ID NO: 32292 - protein, 9 aa, Homo Sapiens
DGAPLPMMP

SEQ ID NO: 32293 - protein, 9 aa, Homo Sapiens
KRRGKRSTK

SEQ ID NO: 32294 - protein, 9 aa, Homo Sapiens
KNGASPSWR

SEQ ID NO: 32295 - protein, 9 aa, Homo Sapiens
TRGKNGASP

SEQ ID NO: 32296 - protein, 9 aa, Homo Sapiens
VLLLSHLLP

SEQ ID NO: 32297 - protein, 9 aa, Homo Sapiens
AKSSICNNY

SEQ ID NO: 32298 - protein, 9 aa, Homo Sapiens
VRPFLKPAY

SEQ ID NO: 32299 - protein, 9 aa, Homo Sapiens
REEACYQFI

SEQ ID NO: 32300 - protein, 9 aa, Homo Sapiens
VGSEHPRVH

SEQ ID NO: 32301 - protein, 9 aa, Homo Sapiens
KKSPDLGKY

SEQ ID NO: 32302 - protein, 9 aa, Homo Sapiens
EQTQGGQVS

SEQ ID NO: 32303 - protein, 9 aa, Homo Sapiens
TQCNQKRRV

SEQ ID NO: 32304 - protein, 9 aa, Homo Sapiens
LVNRLCERD

SEQ ID NO: 32305 - protein, 9 aa, Homo Sapiens
VQTPDSILV

SEQ ID NO: 32306 - protein, 9 aa, Homo Sapiens
AASEPPVEN

SEQ ID NO: 32307 - protein, 9 aa, Homo Sapiens
SASQIWNLN

SEQ ID NO: 32308 - protein, 9 aa, Homo Sapiens
ACVDTYMVG

SEQ ID NO: 32309 - protein, 9 aa, Homo Sapiens
GITASQDRA

SEQ ID NO: 32310 - protein, 9 aa, Homo Sapiens
PNKGGAGGK

SEQ ID NO: 32311 - protein, 9 aa, Homo Sapiens
HMEMENISL

SEQ ID NO: 32312 - protein, 9 aa, Homo Sapiens
TQGGQVSVC

SEQ ID NO: 32313 - protein, 9 aa, Homo Sapiens
SFSEIWYVS

SEQ ID NO: 32314 - protein, 9 aa, Homo Sapiens
ACYQFINEL

SEQ ID NO: 32315 - protein, 9 aa, Homo Sapiens
ERDQERGWP

SEQ ID NO: 32316 - protein, 9 aa, Homo Sapiens
RVQIAHALC

SEQ ID NO: 32317 - protein, 9 aa, Homo Sapiens
EIKKSKLIG

SEQ ID NO: 32318 - protein, 9 aa, Homo Sapiens
EAQWAQFLV

SEQ ID NO: 32319 - protein, 9 aa, Homo Sapiens
SHRHLTLKN

SEQ ID NO: 32320 - protein, 9 aa, Homo Sapiens
CKKVLCSNS

SEQ ID NO: 32321 - protein, 9 aa, Homo Sapiens
DLTAKEKDQ

SEQ ID NO: 32322 - protein, 9 aa, Homo Sapiens
LCPHAAAES

SEQ ID NO: 32323 - protein, 9 aa, Homo Sapiens
DCLQGKKSK

SEQ ID NO: 32324 - protein, 9 aa, Homo Sapiens
TKAKNSRLV

SEQ ID NO: 32325 - protein, 9 aa, Homo Sapiens
VRVPLPFGP

SEQ ID NO: 32326 - protein, 9 aa, Homo Sapiens
LVAPTSQKD

SEQ ID NO: 32327 - protein, 9 aa, Homo Sapiens
PRDGVLQPK

SEQ ID NO: 32328 - protein, 9 aa, Homo Sapiens
PDNRCICYQ

SEQ ID NO: 32329 - protein, 9 aa, Homo Sapiens
KINAGSQYD

SEQ ID NO: 32330 - protein, 9 aa, Homo Sapiens
KGKSKVPED

SEQ ID NO: 32331 - protein, 9 aa, Homo Sapiens
GCPFESWVS

SEQ ID NO: 32332 - protein, 9 aa, Homo Sapiens
IINYALEKK

SEQ ID NO: 32333 - protein, 9 aa, Homo Sapiens
KALGFSDHM

SEQ ID NO: 32334 - protein, 9 aa, Homo Sapiens
SRMWPVLLL

SEQ ID NO: 32335 - protein, 9 aa, Homo Sapiens
MLPQTREIY

SEQ ID NO: 32336 - protein, 9 aa, Homo Sapiens
AYGMLTFCG

SEQ ID NO: 32337 - protein, 9 aa, Homo Sapiens
EEPPLAPRP

SEQ ID NO: 32338 - protein, 9 aa, Homo Sapiens
RKVSTWGQI

SEQ ID NO: 32339 - protein, 9 aa, Homo Sapiens
AKHQKIHTG

SEQ ID NO: 32340 - protein, 9 aa, Homo Sapiens
YDNLSDLTA

SEQ ID NO: 32341 - protein, 9 aa, Homo Sapiens
QEGQVENTE

SEQ ID NO: 32342 - protein, 9 aa, Homo Sapiens
KVLCSNSLL

SEQ ID NO: 32343 - protein, 9 aa, Homo Sapiens
AFETWQSWA

SEQ ID NO: 32344 - protein, 9 aa, Homo Sapiens
ATRGGAGVV

SEQ ID NO: 32345 - protein, 9 aa, Homo Sapiens
GSQDYLKLA

SEQ ID NO: 32346 - protein, 9 aa, Homo Sapiens
RVMQCLPRI

SEQ ID NO: 32347 - protein, 9 aa, Homo Sapiens
LIQEPPSRS

SEQ ID NO: 32348 - protein, 9 aa, Homo Sapiens
MFVTEFTDR

SEQ ID NO: 32349 - protein, 9 aa, Homo Sapiens
GSNGITYIS

SEQ ID NO: 32350 - protein, 9 aa, Homo Sapiens
DLKGNHIHN

SEQ ID NO: 32351 - protein, 9 aa, Homo Sapiens
LQPKAAKEQ

SEQ ID NO: 32352 - protein, 9 aa, Homo Sapiens
ACGFLSENM

SEQ ID NO: 32353 - protein, 9 aa, Homo Sapiens
WNLNPVFGG

SEQ ID NO: 32354 - protein, 9 aa, Homo Sapiens
SGRPNRVPG

SEQ ID NO: 32355 - protein, 9 aa, Homo Sapiens
NSFGEMLET

SEQ ID NO: 32356 - protein, 9 aa, Homo Sapiens
LSAYYPNCV

SEQ ID NO: 32357 - protein, 9 aa, Homo Sapiens
GDFWRERSD

SEQ ID NO: 32358 - protein, 9 aa, Homo Sapiens
SPGDLTAKE

SEQ ID NO: 32359 - protein, 9 aa, Homo Sapiens
IGAVLRPVG

SEQ ID NO: 32360 - protein, 9 aa, Homo Sapiens
GKNGASPSW

SEQ ID NO: 32361 - protein, 9 aa, Homo Sapiens
QQVDKDDAI

SEQ ID NO: 32362 - protein, 9 aa, Homo Sapiens
QYDEMGCTW

SEQ ID NO: 32363 - protein, 9 aa, Homo Sapiens
KFQIPCIVA

SEQ ID NO: 32364 - protein, 9 aa, Homo Sapiens
INAGSQYDE

SEQ ID NO: 32365 - protein, 9 aa, Homo Sapiens
TAENVLVAS

SEQ ID NO: 32366 - protein, 9 aa, Homo Sapiens
ADPWSPIPL

SEQ ID NO: 32367 - protein, 9 aa, Homo Sapiens
PDLGKYDPL

SEQ ID NO: 32368 - protein, 9 aa, Homo Sapiens
NCGIQLLYI

SEQ ID NO: 32369 - protein, 9 aa, Homo Sapiens
QEGLSNDEE

SEQ ID NO: 32370 - protein, 9 aa, Homo Sapiens
IIGHSFGAI

SEQ ID NO: 32371 - protein, 9 aa, Homo Sapiens
LSLAKSSIC

SEQ ID NO: 32372 - protein, 9 aa, Homo Sapiens
WEPVCGSNG

SEQ ID NO: 32373 - protein, 9 aa, Homo Sapiens
KERDQERGW

SEQ ID NO: 32374 - protein, 9 aa, Homo Sapiens
SSCALSWRP

SEQ ID NO: 32375 - protein, 9 aa, Homo Sapiens
VNRLCERDP

SEQ ID NO: 32376 - protein, 9 aa, Homo Sapiens
HLEGHQRVH

SEQ ID NO: 32377 - protein, 9 aa, Homo Sapiens
NASGKRQFL

SEQ ID NO: 32378 - protein, 9 aa, Homo Sapiens
PEKPNTLEK

SEQ ID NO: 32379 - protein, 9 aa, Homo Sapiens
KEKDQICDF

SEQ ID NO: 32380 - protein, 9 aa, Homo Sapiens
ERLHREEAC

SEQ ID NO: 32381 - protein, 9 aa, Homo Sapiens
PPVENAQPA

SEQ ID NO: 32382 - protein, 9 aa, Homo Sapiens
LLYIGRPLA

SEQ ID NO: 32383 - protein, 9 aa, Homo Sapiens
ITAILNSVI

SEQ ID NO: 32384 - protein, 9 aa, Homo Sapiens
YQLLHFVLD

SEQ ID NO: 32385 - protein, 9 aa, Homo Sapiens
PNCVGMSPS

SEQ ID NO: 32386 - protein, 9 aa, Homo Sapiens
QTNWCIDRN

SEQ ID NO: 32387 - protein, 9 aa, Homo Sapiens
QGKKSKHAP

SEQ ID NO: 32388 - protein, 9 aa, Homo Sapiens
APSVGAFDK

SEQ ID NO: 32389 - protein, 9 aa, Homo Sapiens
YHSRRYIDK

SEQ ID NO: 32390 - protein, 9 aa, Homo Sapiens
PSHSPKKLT

SEQ ID NO: 32391 - protein, 9 aa, Homo Sapiens
KLRRPLYEH

SEQ ID NO: 32392 - protein, 9 aa, Homo Sapiens
FRIVQEKVF

SEQ ID NO: 32393 - protein, 9 aa, Homo Sapiens
KKMSAEELD

SEQ ID NO: 32394 - protein, 9 aa, Homo Sapiens
LRNPKPWGK

SEQ ID NO: 32395 - protein, 9 aa, Homo Sapiens
NRVPGGICG

SEQ ID NO: 32396 - protein, 9 aa, Homo Sapiens
LCAKSMLYH

SEQ ID NO: 32397 - protein, 9 aa, Homo Sapiens
PEVVVDGVA

SEQ ID NO: 32398 - protein, 9 aa, Homo Sapiens
DQERGWPKD

SEQ ID NO: 32399 - protein, 9 aa, Homo Sapiens
LHKLVEADI

SEQ ID NO: 32400 - protein, 9 aa, Homo Sapiens
KEVQAFRAQ

SEQ ID NO: 32401 - protein, 9 aa, Homo Sapiens
LHVFQIIAF

SEQ ID NO: 32402 - protein, 9 aa, Homo Sapiens
VELVQQVDK

SEQ ID NO: 32403 - protein, 9 aa, Homo Sapiens
MGMCVNERQ

SEQ ID NO: 32404 - protein, 9 aa, Homo Sapiens
RSPGDLTAK

SEQ ID NO: 32405 - protein, 9 aa, Homo Sapiens
DNQYCPSRW

SEQ ID NO: 32406 - protein, 9 aa, Homo Sapiens
GWPKDRKHR

SEQ ID NO: 32407 - protein, 9 aa, Homo Sapiens
RSLKEELLC

SEQ ID NO: 32408 - protein, 9 aa, Homo Sapiens
DLNSIGSEA

SEQ ID NO: 32409 - protein, 9 aa, Homo Sapiens
PPVPATAAS

SEQ ID NO: 32410 - protein, 9 aa, Homo Sapiens
ELQSKINEI

SEQ ID NO: 32411 - protein, 9 aa, Homo Sapiens
HWERDGAPL

SEQ ID NO: 32412 - protein, 9 aa, Homo Sapiens
MESRMWPVL

SEQ ID NO: 32413 - protein, 9 aa, Homo Sapiens
DDFQTNWCI

SEQ ID NO: 32414 - protein, 9 aa, Homo Sapiens
NQPVPSHSP

SEQ ID NO: 32415 - protein, 9 aa, Homo Sapiens
YAGEVRTFL

SEQ ID NO: 32416 - protein, 9 aa, Homo Sapiens
SAYGMLTFC

SEQ ID NO: 32417 - protein, 9 aa, Homo Sapiens
ESSTVASDS

SEQ ID NO: 32418 - protein, 9 aa, Homo Sapiens
FKKPETFPK

SEQ ID NO: 32419 - protein, 9 aa, Homo Sapiens
EVVVDGVAD

SEQ ID NO: 32420 - protein, 9 aa, Homo Sapiens
GWEKALKKG

SEQ ID NO: 32421 - protein, 9 aa, Homo Sapiens
GELTQDTTL

SEQ ID NO: 32422 - protein, 9 aa, Homo Sapiens
LIGSQSFNN

SEQ ID NO: 32423 - protein, 9 aa, Homo Sapiens
GRGGPGPAH

SEQ ID NO: 32424 - protein, 9 aa, Homo Sapiens
SCVSSGRPN

SEQ ID NO: 32425 - protein, 9 aa, Homo Sapiens
HREEACYQF

SEQ ID NO: 32426 - protein, 9 aa, Homo Sapiens
YTAKALGFS

SEQ ID NO: 32427 - protein, 9 aa, Homo Sapiens
GYGYGCECG

SEQ ID NO: 32428 - protein, 9 aa, Homo Sapiens
PEFTMKKYH

SEQ ID NO: 32429 - protein, 9 aa, Homo Sapiens
GKKSPDLGK

SEQ ID NO: 32430 - protein, 9 aa, Homo Sapiens
KSVQSNLNQ

SEQ ID NO: 32431 - protein, 9 aa, Homo Sapiens
QNPCAMACH

SEQ ID NO: 32432 - protein, 9 aa, Homo Sapiens
KTLGTTEFV

SEQ ID NO: 32433 - protein, 9 aa, Homo Sapiens
VPLPFGPRE

SEQ ID NO: 32434 - protein, 9 aa, Homo Sapiens
RALEQLVLI

SEQ ID NO: 32435 - protein, 9 aa, Homo Sapiens
PEGLLAWGC

SEQ ID NO: 32436 - protein, 9 aa, Homo Sapiens
LCIVGGILH

SEQ ID NO: 32437 - protein, 9 aa, Homo Sapiens
LELQSKINE

SEQ ID NO: 32438 - protein, 9 aa, Homo Sapiens
TCAHGPCFN

SEQ ID NO: 32439 - protein, 9 aa, Homo Sapiens
GGPGPAHRV

SEQ ID NO: 32440 - protein, 9 aa, Homo Sapiens
SEIINYALE

SEQ ID NO: 32441 - protein, 9 aa, Homo Sapiens
ICGTLHFVD

SEQ ID NO: 32442 - protein, 9 aa, Homo Sapiens
GHSFGAIAA

SEQ ID NO: 32443 - protein, 9 aa, Homo Sapiens
TRRRRVQIA

SEQ ID NO: 32444 - protein, 9 aa, Homo Sapiens
PAHRVPKSG

SEQ ID NO: 32445 - protein, 9 aa, Homo Sapiens
PYQQNPCAM

SEQ ID NO: 32446 - protein, 9 aa, Homo Sapiens
GKYDPLTQA

SEQ ID NO: 32447 - protein, 9 aa, Homo Sapiens
NAGSQYDEM

SEQ ID NO: 32448 - protein, 9 aa, Homo Sapiens
LAKHQKIHT

SEQ ID NO: 32449 - protein, 9 aa, Homo Sapiens
MSAEELDNQ

SEQ ID NO: 32450 - protein, 9 aa, Homo Sapiens
RLSASQIWN

SEQ ID NO: 32451 - protein, 9 aa, Homo Sapiens
LPNKGGAGG

SEQ ID NO: 32452 - protein, 9 aa, Homo Sapiens
DTHGSDGDR

SEQ ID NO: 32453 - protein, 9 aa, Homo Sapiens
EYDNLSDLT

SEQ ID NO: 32454 - protein, 9 aa, Homo Sapiens
GNQDYKYHV

SEQ ID NO: 32455 - protein, 9 aa, Homo Sapiens
FWRERSDEH

SEQ ID NO: 32456 - protein, 9 aa, Homo Sapiens
YQALRLLAR

SEQ ID NO: 32457 - protein, 9 aa, Homo Sapiens
SQWEPVCGS

SEQ ID NO: 32458 - protein, 9 aa, Homo Sapiens
PTSFQEGKE

SEQ ID NO: 32459 - protein, 9 aa, Homo Sapiens
FKEYLRALD

SEQ ID NO: 32460 - protein, 9 aa, Homo Sapiens
MLTQCNQKR

SEQ ID NO: 32461 - protein, 9 aa, Homo Sapiens
MKKYHLRLN

SEQ ID NO: 32462 - protein, 9 aa, Homo Sapiens
AYYPNCVGM

SEQ ID NO: 32463 - protein, 9 aa, Homo Sapiens
VSITLIEGK

SEQ ID NO: 32464 - protein, 9 aa, Homo Sapiens
DNQPVPSHS

SEQ ID NO: 32465 - protein, 9 aa, Homo Sapiens
YKYLEMRFS

SEQ ID NO: 32466 - protein, 9 aa, Homo Sapiens
KLIGSQSFN

SEQ ID NO: 32467 - protein, 9 aa, Homo Sapiens
YMVRVPLPF

SEQ ID NO: 32468 - protein, 9 aa, Homo Sapiens
GEDDDDFQT

SEQ ID NO: 32469 - protein, 9 aa, Homo Sapiens
EPPLAPRPS

SEQ ID NO: 32470 - protein, 9 aa, Homo Sapiens
PLLKLACVD

SEQ ID NO: 32471 - protein, 9 aa, Homo Sapiens
VLRPVGLLA

SEQ ID NO: 32472 - protein, 9 aa, Homo Sapiens
VKYELQQLK

SEQ ID NO: 32473 - protein, 9 aa, Homo Sapiens
HPCSTSPSK

SEQ ID NO: 32474 - protein, 9 aa, Homo Sapiens
SLSSTSYSR

SEQ ID NO: 32475 - protein, 9 aa, Homo Sapiens
TFFSLSITT

SEQ ID NO: 32476 - protein, 9 aa, Homo Sapiens
AILNSVIYS

SEQ ID NO: 32477 - protein, 9 aa, Homo Sapiens
RDASHALQG

SEQ ID NO: 32478 - protein, 9 aa, Homo Sapiens
QTREIYELE

SEQ ID NO: 32479 - protein, 9 aa, Homo Sapiens
FSEIWYVSS

SEQ ID NO: 32480 - protein, 9 aa, Homo Sapiens
DEHTQETNS

SEQ ID NO: 32481 - protein, 9 aa, Homo Sapiens
YNRGKANST

SEQ ID NO: 32482 - protein, 9 aa, Homo Sapiens
LKEMRNLRG

SEQ ID NO: 32483 - protein, 9 aa, Homo Sapiens
PAPEEPPLA

SEQ ID NO: 32484 - protein, 9 aa, Homo Sapiens
FQIPCIVAE

SEQ ID NO: 32485 - protein, 9 aa, Homo Sapiens
SSMNYTFKT

SEQ ID NO: 32486 - protein, 9 aa, Homo Sapiens
QDYLKLANR

SEQ ID NO: 32487 - protein, 9 aa, Homo Sapiens
CSTSPSKIV

SEQ ID NO: 32488 - protein, 9 aa, Homo Sapiens
GFRIVQEKV

SEQ ID NO: 32489 - protein, 9 aa, Homo Sapiens
NQDYKYHVS

SEQ ID NO: 32490 - protein, 9 aa, Homo Sapiens
EKQENEAES

SEQ ID NO: 32491 - protein, 9 aa, Homo Sapiens
ATPERPDQT

SEQ ID NO: 32492 - protein, 9 aa, Homo Sapiens
NISLEEVVE

SEQ ID NO: 32493 - protein, 9 aa, Homo Sapiens
LLTVAALER

SEQ ID NO: 32494 - protein, 9 aa, Homo Sapiens
MGGMNWRPI

SEQ ID NO: 32495 - protein, 9 aa, Homo Sapiens
AKEKDQICD

SEQ ID NO: 32496 - protein, 9 aa, Homo Sapiens
VAPTSQKDI

SEQ ID NO: 32497 - protein, 9 aa, Homo Sapiens
NAQPAPAPA

SEQ ID NO: 32498 - protein, 9 aa, Homo Sapiens
LTLKNSLIV

SEQ ID NO: 32499 - protein, 9 aa, Homo Sapiens
CGKTLGTTE

SEQ ID NO: 32500 - protein, 9 aa, Homo Sapiens
VEQLIKAPS

SEQ ID NO: 32501 - protein, 9 aa, Homo Sapiens
WGCGLDFLN

SEQ ID NO: 32502 - protein, 9 aa, Homo Sapiens
QKRRVKCDH

SEQ ID NO: 32503 - protein, 9 aa, Homo Sapiens
VSMFSVTAH

SEQ ID NO: 32504 - protein, 9 aa, Homo Sapiens
RKKKVLIAM

SEQ ID NO: 32505 - protein, 9 aa, Homo Sapiens
GGEASSKPK

SEQ ID NO: 32506 - protein, 9 aa, Homo Sapiens
SDLLELQSK

SEQ ID NO: 32507 - protein, 9 aa, Homo Sapiens
YHVSDVTKA

SEQ ID NO: 32508 - protein, 9 aa, Homo Sapiens
YKLGWEKAL

SEQ ID NO: 32509 - protein, 9 aa, Homo Sapiens
RKETRKTAR

SEQ ID NO: 32510 - protein, 9 aa, Homo Sapiens
GQEGQVENT

SEQ ID NO: 32511 - protein, 9 aa, Homo Sapiens
ALGITASQD

SEQ ID NO: 32512 - protein, 9 aa, Homo Sapiens
TTAENVLVA

SEQ ID NO: 32513 - protein, 9 aa, Homo Sapiens
HGEEEEEAE

SEQ ID NO: 32514 - protein, 9 aa, Homo Sapiens
KLIRKVSTW

SEQ ID NO: 32515 - protein, 9 aa, Homo Sapiens
STYKYLEMR

SEQ ID NO: 32516 - protein, 9 aa, Homo Sapiens
WPKDRKHRQ

SEQ ID NO: 32517 - protein, 9 aa, Homo Sapiens
FQAVINWVK

SEQ ID NO: 32518 - protein, 9 aa, Homo Sapiens
LTAKEKDQI

SEQ ID NO: 32519 - protein, 9 aa, Homo Sapiens
FLSFANKRL

SEQ ID NO: 32520 - protein, 9 aa, Homo Sapiens
NKPTMNYDK

SEQ ID NO: 32521 - protein, 9 aa, Homo Sapiens
PCSTSPSKI

SEQ ID NO: 32522 - protein, 9 aa, Homo Sapiens
MFLGNFSFS

SEQ ID NO: 32523 - protein, 9 aa, Homo Sapiens
DIELKSVQS

SEQ ID NO: 32524 - protein, 9 aa, Homo Sapiens
AQQEAQWAQ

SEQ ID NO: 32525 - protein, 9 aa, Homo Sapiens
MLACSSESI

SEQ ID NO: 32526 - protein, 9 aa, Homo Sapiens
VSTWGQIRT

SEQ ID NO: 32527 - protein, 9 aa, Homo Sapiens
VLGVLPQRL

SEQ ID NO: 32528 - protein, 9 aa, Homo Sapiens
GSEHPRVHL

SEQ ID NO: 32529 - protein, 9 aa, Homo Sapiens
QEAQWAQFL

SEQ ID NO: 32530 - protein, 9 aa, Homo Sapiens
DNAAINPEL

SEQ ID NO: 32531 - protein, 9 aa, Homo Sapiens
QAVINWVKH

SEQ ID NO: 32532 - protein, 9 aa, Homo Sapiens
LQQAEITQG

SEQ ID NO: 32533 - protein, 9 aa, Homo Sapiens
RQVLNQKPI

SEQ ID NO: 32534 - protein, 9 aa, Homo Sapiens
RPAHPVSTD

SEQ ID NO: 32535 - protein, 9 aa, Homo Sapiens
YYPNCVGMS

SEQ ID NO: 32536 - protein, 9 aa, Homo Sapiens
DLGYGYGCE

SEQ ID NO: 32537 - protein, 9 aa, Homo Sapiens
IRKVSTWGQ

SEQ ID NO: 32538 - protein, 9 aa, Homo Sapiens
GSAAARASF

SEQ ID NO: 32539 - protein, 9 aa, Homo Sapiens
AQCGPEPGV

SEQ ID NO: 32540 - protein, 9 aa, Homo Sapiens
RTENVTFKK

SEQ ID NO: 32541 - protein, 9 aa, Homo Sapiens
WQSWADPKV

SEQ ID NO: 32542 - protein, 9 aa, Homo Sapiens
GRGLPNKGG

SEQ ID NO: 32543 - protein, 9 aa, Homo Sapiens
LIGAVLRPV

SEQ ID NO: 32544 - protein, 9 aa, Homo Sapiens
EPQKPTKEK

SEQ ID NO: 32545 - protein, 9 aa, Homo Sapiens
VATEPAGFR

SEQ ID NO: 32546 - protein, 9 aa, Homo Sapiens
FVLDRDFLS

SEQ ID NO: 32547 - protein, 9 aa, Homo Sapiens
EKEVQAFRA

SEQ ID NO: 32548 - protein, 9 aa, Homo Sapiens
HFANGIGKP

SEQ ID NO: 32549 - protein, 9 aa, Homo Sapiens
HAAAESPSD

SEQ ID NO: 32550 - protein, 9 aa, Homo Sapiens
IEGKDLKAM

SEQ ID NO: 32551 - protein, 9 aa, Homo Sapiens
MVRVPLPFG

SEQ ID NO: 32552 - protein, 9 aa, Homo Sapiens
LLELQSKIN

SEQ ID NO: 32553 - protein, 9 aa, Homo Sapiens
LEKLEVVSE

SEQ ID NO: 32554 - protein, 9 aa, Homo Sapiens
TMKKYHLRL

SEQ ID NO: 32555 - protein, 9 aa, Homo Sapiens
SMFSVTAHD

SEQ ID NO: 32556 - protein, 9 aa, Homo Sapiens
EKPNTLEKL

SEQ ID NO: 32557 - protein, 9 aa, Homo Sapiens
IPLGTVLSR

SEQ ID NO: 32558 - protein, 9 aa, Homo Sapiens
CYQFINELN

SEQ ID NO: 32559 - protein, 9 aa, Homo Sapiens
RILDINNVD

SEQ ID NO: 32560 - protein, 9 aa, Homo Sapiens
RPTFPEKFS

SEQ ID NO: 32561 - protein, 9 aa, Homo Sapiens
LPQRLEPDR

SEQ ID NO: 32562 - protein, 9 aa, Homo Sapiens
IDVQTPDSI

SEQ ID NO: 32563 - protein, 9 aa, Homo Sapiens
IEAKMHATG

SEQ ID NO: 32564 - protein, 9 aa, Homo Sapiens
ASQIWNLNP

SEQ ID NO: 32565 - protein, 9 aa, Homo Sapiens
EVAVTCMVL

SEQ ID NO: 32566 - protein, 9 aa, Homo Sapiens
LLHFVLDRD

SEQ ID NO: 32567 - protein, 9 aa, Homo Sapiens
FAKVLRLPK

SEQ ID NO: 32568 - protein, 9 aa, Homo Sapiens
DIDVQTPDS

SEQ ID NO: 32569 - protein, 9 aa, Homo Sapiens
GLLAWGCGL

SEQ ID NO: 32570 - protein, 9 aa, Homo Sapiens
INYALEKKD

SEQ ID NO: 32571 - protein, 9 aa, Homo Sapiens
CLQGKKSKH

SEQ ID NO: 32572 - protein, 9 aa, Homo Sapiens
LGTTEFVTA

SEQ ID NO: 32573 - protein, 9 aa, Homo Sapiens
PSVGAFDKL

SEQ ID NO: 32574 - protein, 9 aa, Homo Sapiens
LGNFSFSEI

SEQ ID NO: 32575 - protein, 9 aa, Homo Sapiens
VAQQEAQWA

SEQ ID NO: 32576 - protein, 9 aa, Homo Sapiens
VKNILKTLV

SEQ ID NO: 32577 - protein, 9 aa, Homo Sapiens
AAAESPSDE

SEQ ID NO: 32578 - protein, 9 aa, Homo Sapiens
FKKVPCLKT

SEQ ID NO: 32579 - protein, 9 aa, Homo Sapiens
LEKEVQAFR

SEQ ID NO: 32580 - protein, 9 aa, Homo Sapiens
TEFSPSEAS

SEQ ID NO: 32581 - protein, 9 aa, Homo Sapiens
GILHVFQII

SEQ ID NO: 32582 - protein, 9 aa, Homo Sapiens
NFSFSEIWY

SEQ ID NO: 32583 - protein, 9 aa, Homo Sapiens
EHLACAFLW

SEQ ID NO: 32584 - protein, 9 aa, Homo Sapiens
LHFVDQYLN

SEQ ID NO: 32585 - protein, 9 aa, Homo Sapiens
EDDEEERHG

SEQ ID NO: 32586 - protein, 9 aa, Homo Sapiens
EPVFQAVIN

SEQ ID NO: 32587 - protein, 9 aa, Homo Sapiens
EKEAEEPQK

SEQ ID NO: 32588 - protein, 9 aa, Homo Sapiens
NCVGMSPSC

SEQ ID NO: 32589 - protein, 9 aa, Homo Sapiens
AGVAPSVGA

SEQ ID NO: 32590 - protein, 9 aa, Homo Sapiens
ITLIEGKDL

SEQ ID NO: 32591 - protein, 9 aa, Homo Sapiens
VMLTQCNQK

SEQ ID NO: 32592 - protein, 9 aa, Homo Sapiens
QVSSRPTFP

SEQ ID NO: 32593 - protein, 9 aa, Homo Sapiens
FHSRILDIN

SEQ ID NO: 32594 - protein, 9 aa, Homo Sapiens
GGSTYTAKA

SEQ ID NO: 32595 - protein, 9 aa, Homo Sapiens
EGLLAWGCG

SEQ ID NO: 32596 - protein, 9 aa, Homo Sapiens
RAHDLDSNK

SEQ ID NO: 32597 - protein, 9 aa, Homo Sapiens
STVASDSSM

SEQ ID NO: 32598 - protein, 9 aa, Homo Sapiens
SCMLCAKSM

SEQ ID NO: 32599 - protein, 9 aa, Homo Sapiens
MYQALRLLA

SEQ ID NO: 32600 - protein, 9 aa, Homo Sapiens
RFQQMDVFE

SEQ ID NO: 32601 - protein, 9 aa, Homo Sapiens
LNHLKPLMD

SEQ ID NO: 32602 - protein, 9 aa, Homo Sapiens
SPLAKHQKI

SEQ ID NO: 32603 - protein, 9 aa, Homo Sapiens
LSICGTLHF

SEQ ID NO: 32604 - protein, 9 aa, Homo Sapiens
LPQTREIYE

SEQ ID NO: 32605 - protein, 9 aa, Homo Sapiens
IAKTEFSPS

SEQ ID NO: 32606 - protein, 9 aa, Homo Sapiens
NHLKPLMDQ

SEQ ID NO: 32607 - protein, 9 aa, Homo Sapiens
YYEQTQGGQ

SEQ ID NO: 32608 - protein, 9 aa, Homo Sapiens
QMFVTEFTD

SEQ ID NO: 32609 - protein, 9 aa, Homo Sapiens
FFSLSITTE

SEQ ID NO: 32610 - protein, 9 aa, Homo Sapiens
SPDNRCICY

SEQ ID NO: 32611 - protein, 9 aa, Homo Sapiens
LVQQVDKDD

SEQ ID NO: 32612 - protein, 9 aa, Homo Sapiens
LDLKGNHIH

SEQ ID NO: 32613 - protein, 9 aa, Homo Sapiens
DRDGEIVDE

SEQ ID NO: 32614 - protein, 9 aa, Homo Sapiens
CAYFKKVPC

SEQ ID NO: 32615 - protein, 9 aa, Homo Sapiens
KMLVNENFK

SEQ ID NO: 32616 - protein, 9 aa, Homo Sapiens
PVLLLSHLL

SEQ ID NO: 32617 - protein, 9 aa, Homo Sapiens
RRVQIAHAL

SEQ ID NO: 32618 - protein, 9 aa, Homo Sapiens
GDLTAKEKD

SEQ ID NO: 32619 - protein, 9 aa, Homo Sapiens
FAEYNRGKA

SEQ ID NO: 32620 - protein, 9 aa, Homo Sapiens
AAQCGPEPG

SEQ ID NO: 32621 - protein, 9 aa, Homo Sapiens
FPTEESSMN

SEQ ID NO: 32622 - protein, 9 aa, Homo Sapiens
ALQMFVTEF

SEQ ID NO: 32623 - protein, 9 aa, Homo Sapiens
SEHPRVHLG

SEQ ID NO: 32624 - protein, 9 aa, Homo Sapiens
SAAARASFS

SEQ ID NO: 32625 - protein, 9 aa, Homo Sapiens
IKAWQVPYV

SEQ ID NO: 32626 - protein, 9 aa, Homo Sapiens
LLRNPKPWG

SEQ ID NO: 32627 - protein, 9 aa, Homo Sapiens
RAFRSDSAV

SEQ ID NO: 32628 - protein, 9 aa, Homo Sapiens
PLAPRPSRE

SEQ ID NO: 32629 - protein, 9 aa, Homo Sapiens
NLSDLTAAQ

SEQ ID NO: 32630 - protein, 9 aa, Homo Sapiens
KDILEEKDF

SEQ ID NO: 32631 - protein, 9 aa, Homo Sapiens
LLCPHAAAE

SEQ ID NO: 32632 - protein, 9 aa, Homo Sapiens
QPNHRSTKQ

SEQ ID NO: 32633 - protein, 9 aa, Homo Sapiens
LGLTSTYKY

SEQ ID NO: 32634 - protein, 9 aa, Homo Sapiens
SAKKKGTEA

SEQ ID NO: 32635 - protein, 9 aa, Homo Sapiens
GKLKSGRET

SEQ ID NO: 32636 - protein, 9 aa, Homo Sapiens
GIGKPKYMP

SEQ ID NO: 32637 - protein, 9 aa, Homo Sapiens
KVPEDLAGF

SEQ ID NO: 32638 - protein, 9 aa, Homo Sapiens
NTEADVPKE

SEQ ID NO: 32639 - protein, 9 aa, Homo Sapiens
MNYTFKTPE

SEQ ID NO: 32640 - protein, 9 aa, Homo Sapiens
GKKRRGKRS

SEQ ID NO: 32641 - protein, 9 aa, Homo Sapiens
GSEALLTIS

SEQ ID NO: 32642 - protein, 9 aa, Homo Sapiens
WRAHNAVQR

SEQ ID NO: 32643 - protein, 9 aa, Homo Sapiens
LSITTESEP

SEQ ID NO: 32644 - protein, 9 aa, Homo Sapiens
FPEKFSVPH

SEQ ID NO: 32645 - protein, 9 aa, Homo Sapiens
SKEYWDCLQ

SEQ ID NO: 32646 - protein, 9 aa, Homo Sapiens
FLQGTGCPF

SEQ ID NO: 32647 - protein, 9 aa, Homo Sapiens
LKGNHIHNL

SEQ ID NO: 32648 - protein, 9 aa, Homo Sapiens
MENPRCRRR

SEQ ID NO: 32649 - protein, 9 aa, Homo Sapiens
APLPMMPNE

SEQ ID NO: 32650 - protein, 9 aa, Homo Sapiens
SVGAFDKLM

SEQ ID NO: 32651 - protein, 9 aa, Homo Sapiens
HYYEQTQGG

SEQ ID NO: 32652 - protein, 9 aa, Homo Sapiens
KLACVDTYM

SEQ ID NO: 32653 - protein, 9 aa, Homo Sapiens
LSSTSYSRP

SEQ ID NO: 32654 - protein, 9 aa, Homo Sapiens
ESSMNYTFK

SEQ ID NO: 32655 - protein, 9 aa, Homo Sapiens
SSAESDRSY

SEQ ID NO: 32656 - protein, 9 aa, Homo Sapiens
VVMAVWSLL

SEQ ID NO: 32657 - protein, 9 aa, Homo Sapiens
RELRQAAQC

SEQ ID NO: 32658 - protein, 9 aa, Homo Sapiens
RSTKQKVEV

SEQ ID NO: 32659 - protein, 9 aa, Homo Sapiens
EFSPSEASQ

SEQ ID NO: 32660 - protein, 9 aa, Homo Sapiens
PIPLGTVLS

SEQ ID NO: 32661 - protein, 9 aa, Homo Sapiens
IGHSFGAIA

SEQ ID NO: 32662 - protein, 9 aa, Homo Sapiens
GLVAPTSQK

SEQ ID NO: 32663 - protein, 9 aa, Homo Sapiens
DEETMVNVP

SEQ ID NO: 32664 - protein, 9 aa, Homo Sapiens
DVQTPDSIL

SEQ ID NO: 32665 - protein, 9 aa, Homo Sapiens
TDNQPVPSH

SEQ ID NO: 32666 - protein, 9 aa, Homo Sapiens
SIANMLACS

SEQ ID NO: 32667 - protein, 9 aa, Homo Sapiens
KMSAEELDN

SEQ ID NO: 32668 - protein, 9 aa, Homo Sapiens
KYHVSDVTK

SEQ ID NO: 32669 - protein, 9 aa, Homo Sapiens
AAINPELVL

SEQ ID NO: 32670 - protein, 9 aa, Homo Sapiens
GDNAAINPE

SEQ ID NO: 32671 - protein, 9 aa, Homo Sapiens
GTLHFVDQY

SEQ ID NO: 32672 - protein, 9 aa, Homo Sapiens
DTTLTENDD

SEQ ID NO: 32673 - protein, 9 aa, Homo Sapiens
YISSCALSW

SEQ ID NO: 32674 - protein, 9 aa, Homo Sapiens
QQNPCAMAC

SEQ ID NO: 32675 - protein, 9 aa, Homo Sapiens
HAFSPDSEV

SEQ ID NO: 32676 - protein, 9 aa, Homo Sapiens
VSSGRPNRV

SEQ ID NO: 32677 - protein, 9 aa, Homo Sapiens
SFSLGQGSG

SEQ ID NO: 32678 - protein, 9 aa, Homo Sapiens
AIYQLLHFV

SEQ ID NO: 32679 - protein, 9 aa, Homo Sapiens
IWNLNPVFG

SEQ ID NO: 32680 - protein, 9 aa, Homo Sapiens
KSKVPEDLA

SEQ ID NO: 32681 - protein, 9 aa, Homo Sapiens
GGSEIINYA

SEQ ID NO: 32682 - protein, 9 aa, Homo Sapiens
AAQAIHPAC

SEQ ID NO: 32683 - protein, 9 aa, Homo Sapiens
PRCRRRPLA

SEQ ID NO: 32684 - protein, 9 aa, Homo Sapiens
SFGAIAAMR

SEQ ID NO: 32685 - protein, 9 aa, Homo Sapiens
KYLEMRFSR

SEQ ID NO: 32686 - protein, 9 aa, Homo Sapiens
KKVLIAMCV

SEQ ID NO: 32687 - protein, 9 aa, Homo Sapiens
SLSITTESE

SEQ ID NO: 32688 - protein, 9 aa, Homo Sapiens
QTQGGQVSV

SEQ ID NO: 32689 - protein, 9 aa, Homo Sapiens
RPEFTMKKY

SEQ ID NO: 32690 - protein, 9 aa, Homo Sapiens
NHLATPERP

SEQ ID NO: 32691 - protein, 9 aa, Homo Sapiens
AQCRTPARK

SEQ ID NO: 32692 - protein, 9 aa, Homo Sapiens
GSQSFNNQA

SEQ ID NO: 32693 - protein, 9 aa, Homo Sapiens
FLIQEPPSR

SEQ ID NO: 32694 - protein, 9 aa, Homo Sapiens
GKGRGLPNK

SEQ ID NO: 32695 - protein, 9 aa, Homo Sapiens
LRVMQCLPR

SEQ ID NO: 32696 - protein, 9 aa, Homo Sapiens
PNSVKNILK

SEQ ID NO: 32697 - protein, 9 aa, Homo Sapiens
CLPRIEEGE

SEQ ID NO: 32698 - protein, 9 aa, Homo Sapiens
MGHNSFGEM

SEQ ID NO: 32699 - protein, 9 aa, Homo Sapiens
KALKKGYDL

SEQ ID NO: 32700 - protein, 9 aa, Homo Sapiens
PHYYEQTQG

SEQ ID NO: 32701 - protein, 9 aa, Homo Sapiens
GPGPAHRVP

SEQ ID NO: 32702 - protein, 9 aa, Homo Sapiens
PVGLLAVAE

SEQ ID NO: 32703 - protein, 9 aa, Homo Sapiens
LVRWRKDIL

SEQ ID NO: 32704 - protein, 9 aa, Homo Sapiens
FDSVVPKKL

SEQ ID NO: 32705 - protein, 9 aa, Homo Sapiens
YVEKRRRLL

SEQ ID NO: 32706 - protein, 9 aa, Homo Sapiens
LPTSFQEGK

SEQ ID NO: 32707 - protein, 9 aa, Homo Sapiens
VPKKLDDLV

SEQ ID NO: 32708 - protein, 9 aa, Homo Sapiens
SQDYLKLAN

SEQ ID NO: 32709 - protein, 9 aa, Homo Sapiens
SVKNILKTL

SEQ ID NO: 32710 - protein, 9 aa, Homo Sapiens
WEKALKKGY

SEQ ID NO: 32711 - protein, 9 aa, Homo Sapiens
KVLRLPKQQ

SEQ ID NO: 32712 - protein, 9 aa, Homo Sapiens
PERPDQTVT

SEQ ID NO: 32713 - protein, 9 aa, Homo Sapiens
EQVSSRPTF

SEQ ID NO: 32714 - protein, 9 aa, Homo Sapiens
PVCGSNGIT

SEQ ID NO: 32715 - protein, 9 aa, Homo Sapiens
EGAPQPGCE

SEQ ID NO: 32716 - protein, 9 aa, Homo Sapiens
EKLLKEMRN

SEQ ID NO: 32717 - protein, 9 aa, Homo Sapiens
AWGCGLDFL

SEQ ID NO: 32718 - protein, 9 aa, Homo Sapiens
DLYKVFQRC

SEQ ID NO: 32719 - protein, 9 aa, Homo Sapiens
FESWVSRPL

SEQ ID NO: 32720 - protein, 9 aa, Homo Sapiens
VDLNSIGSE

SEQ ID NO: 32721 - protein, 9 aa, Homo Sapiens
HPLLKLACV

SEQ ID NO: 32722 - protein, 9 aa, Homo Sapiens
GHNSFGEML

SEQ ID NO: 32723 - protein, 9 aa, Homo Sapiens
AKALGFSDH

SEQ ID NO: 32724 - protein, 9 aa, Homo Sapiens
DPWSPIPLG

SEQ ID NO: 32725 - protein, 9 aa, Homo Sapiens
AVLRPVGLL

SEQ ID NO: 32726 - protein, 9 aa, Homo Sapiens
ERPDQTVTN

SEQ ID NO: 32727 - protein, 9 aa, Homo Sapiens
IPCIVAELN

SEQ ID NO: 32728 - protein, 9 aa, Homo Sapiens
VTFKKPETF

SEQ ID NO: 32729 - protein, 9 aa, Homo Sapiens
ENNPRGVSM

SEQ ID NO: 32730 - protein, 9 aa, Homo Sapiens
AHIVGSEHP

SEQ ID NO: 32731 - protein, 9 aa, Homo Sapiens
QSKINEINT

SEQ ID NO: 32732 - protein, 9 aa, Homo Sapiens
AAHIVGSEH

SEQ ID NO: 32733 - protein, 9 aa, Homo Sapiens
PYVEKRRRL

SEQ ID NO: 32734 - protein, 9 aa, Homo Sapiens
PDLYKVFQR

SEQ ID NO: 32735 - protein, 9 aa, Homo Sapiens
TEFVTATEC

SEQ ID NO: 32736 - protein, 9 aa, Homo Sapiens
KLVEADIAV

SEQ ID NO: 32737 - protein, 9 aa, Homo Sapiens
LTRRRRVQI

SEQ ID NO: 32738 - protein, 9 aa, Homo Sapiens
LVLIGAVLR

SEQ ID NO: 32739 - protein, 9 aa, Homo Sapiens
FTMKKYHLR

SEQ ID NO: 32740 - protein, 9 aa, Homo Sapiens
ARNVTMELS

SEQ ID NO: 32741 - protein, 9 aa, Homo Sapiens
QKILCTKAK

SEQ ID NO: 32742 - protein, 9 aa, Homo Sapiens
GVAPSVGAF

SEQ ID NO: 32743 - protein, 9 aa, Homo Sapiens
NRCICYQSP

SEQ ID NO: 32744 - protein, 9 aa, Homo Sapiens
LIKAPSLKE

SEQ ID NO: 32745 - protein, 9 aa, Homo Sapiens
LSCSLSAYG

SEQ ID NO: 32746 - protein, 9 aa, Homo Sapiens
ETWQSWADP

SEQ ID NO: 32747 - protein, 9 aa, Homo Sapiens
SEEPVFQAV

SEQ ID NO: 32748 - protein, 9 aa, Homo Sapiens
TLRQVLNQK

SEQ ID NO: 32749 - protein, 9 aa, Homo Sapiens
SRSSHLEGH

SEQ ID NO: 32750 - protein, 9 aa, Homo Sapiens
ASDSSMEGK

SEQ ID NO: 32751 - protein, 9 aa, Homo Sapiens
FSLGQGSGS

SEQ ID NO: 32752 - protein, 9 aa, Homo Sapiens
YPNGVIEAK

SEQ ID NO: 32753 - protein, 9 aa, Homo Sapiens
YGYGCECGS

SEQ ID NO: 32754 - protein, 9 aa, Homo Sapiens
ICNNYLNLT

SEQ ID NO: 32755 - protein, 9 aa, Homo Sapiens
AAFFLKKSG

SEQ ID NO: 32756 - protein, 9 aa, Homo Sapiens
LRQVLNQKP

SEQ ID NO: 32757 - protein, 9 aa, Homo Sapiens
SQYDEMGCT

SEQ ID NO: 32758 - protein, 9 aa, Homo Sapiens
QLLHFVLDR

SEQ ID NO: 32759 - protein, 9 aa, Homo Sapiens
HLTLKNSLI

SEQ ID NO: 32760 - protein, 9 aa, Homo Sapiens
HSDLLELQS

SEQ ID NO: 32761 - protein, 9 aa, Homo Sapiens
TVNKFLSFA

SEQ ID NO: 32762 - protein, 9 aa, Homo Sapiens
TPERPDQTV

SEQ ID NO: 32763 - protein, 9 aa, Homo Sapiens
NWRPILTII

SEQ ID NO: 32764 - protein, 9 aa, Homo Sapiens
KRSTKKRRR

SEQ ID NO: 32765 - protein, 9 aa, Homo Sapiens
EMGHNSFGE

SEQ ID NO: 32766 - protein, 9 aa, Homo Sapiens
TNVEQLIKA

SEQ ID NO: 32767 - protein, 9 aa, Homo Sapiens
CSSESIKKP

SEQ ID NO: 32768 - protein, 9 aa, Homo Sapiens
AMCVSITVV

SEQ ID NO: 32769 - protein, 9 aa, Homo Sapiens
TKCADIDVQ

SEQ ID NO: 32770 - protein, 9 aa, Homo Sapiens
SRLSASQIW

SEQ ID NO: 32771 - protein, 9 aa, Homo Sapiens
IQEADNDHT

SEQ ID NO: 32772 - protein, 9 aa, Homo Sapiens
SHSPKKLTR

SEQ ID NO: 32773 - protein, 9 aa, Homo Sapiens
TEAEVLAKD

SEQ ID NO: 32774 - protein, 9 aa, Homo Sapiens
ASFSLGQGS

SEQ ID NO: 32775 - protein, 9 aa, Homo Sapiens
KDISISEFT

SEQ ID NO: 32776 - protein, 9 aa, Homo Sapiens
AVTCMVLQT

SEQ ID NO: 32777 - protein, 9 aa, Homo Sapiens
SSVFLLTVA

SEQ ID NO: 32778 - protein, 9 aa, Homo Sapiens
EVQAFRAQL

SEQ ID NO: 32779 - protein, 9 aa, Homo Sapiens
RLHWLDLKG

SEQ ID NO: 32780 - protein, 9 aa, Homo Sapiens
EERHGEEEE

SEQ ID NO: 32781 - protein, 9 aa, Homo Sapiens
TENVTFKKP

SEQ ID NO: 32782 - protein, 9 aa, Homo Sapiens
PVLSHRHLT

SEQ ID NO: 32783 - protein, 9 aa, Homo Sapiens
VLVASVAEI

SEQ ID NO: 32784 - protein, 9 aa, Homo Sapiens
SICNNYLNL

SEQ ID NO: 32785 - protein, 9 aa, Homo Sapiens
PATAASPAP

SEQ ID NO: 32786 - protein, 9 aa, Homo Sapiens
TVITAILNS

SEQ ID NO: 32787 - protein, 9 aa, Homo Sapiens
VSCMLCAKS

SEQ ID NO: 32788 - protein, 9 aa, Homo Sapiens
GVKELVNRL

SEQ ID NO: 32789 - protein, 9 aa, Homo Sapiens
CMLCAKSML

SEQ ID NO: 32790 - protein, 9 aa, Homo Sapiens
LSASQIWNL

SEQ ID NO: 32791 - protein, 9 aa, Homo Sapiens
RWRKDILEE

SEQ ID NO: 32792 - protein, 9 aa, Homo Sapiens
LATPERPDQ

SEQ ID NO: 32793 - protein, 9 aa, Homo Sapiens
SVFLLTVAA

SEQ ID NO: 32794 - protein, 9 aa, Homo Sapiens
KLGWEKALK

SEQ ID NO: 32795 - protein, 9 aa, Homo Sapiens
AKTEFSPSE

SEQ ID NO: 32796 - protein, 9 aa, Homo Sapiens
SRPAHPVST

SEQ ID NO: 32797 - protein, 9 aa, Homo Sapiens
GKSKVPEDL

SEQ ID NO: 32798 - protein, 9 aa, Homo Sapiens
RGVSMFSVT

SEQ ID NO: 32799 - protein, 9 aa, Homo Sapiens
EYWDCLQGK

SEQ ID NO: 32800 - protein, 9 aa, Homo Sapiens
VLIGAVLRP

SEQ ID NO: 32801 - protein, 9 aa, Homo Sapiens
TEPAGFRIV

SEQ ID NO: 32802 - protein, 9 aa, Homo Sapiens
TWGQIRTKT

SEQ ID NO: 32803 - protein, 9 aa, Homo Sapiens
ELVNRLCER

SEQ ID NO: 32804 - protein, 9 aa, Homo Sapiens
HFVLDRDFL

SEQ ID NO: 32805 - protein, 9 aa, Homo Sapiens
DRMYYTSPL

SEQ ID NO: 32806 - protein, 9 aa, Homo Sapiens
NTLEKLEVV

SEQ ID NO: 32807 - protein, 9 aa, Homo Sapiens
VIEAKMHAT

SEQ ID NO: 32808 - protein, 9 aa, Homo Sapiens
LARRIRGET

SEQ ID NO: 32809 - protein, 9 aa, Homo Sapiens
VTEFTDRGE

SEQ ID NO: 32810 - protein, 9 aa, Homo Sapiens
KILCTKAKN

SEQ ID NO: 32811 - protein, 9 aa, Homo Sapiens
ELQQLKGSS

SEQ ID NO: 32812 - protein, 9 aa, Homo Sapiens
FLGNFSFSE

SEQ ID NO: 32813 - protein, 9 aa, Homo Sapiens
SVVPKKLDD

SEQ ID NO: 32814 - protein, 9 aa, Homo Sapiens
LGDLNHLKP

SEQ ID NO: 32815 - protein, 9 aa, Homo Sapiens
LHREEACYQ

SEQ ID NO: 32816 - protein, 9 aa, Homo Sapiens
VTCMVLQTQ

SEQ ID NO: 32817 - protein, 9 aa, Homo Sapiens
AFSPDSEVT

SEQ ID NO: 32818 - protein, 9 aa, Homo Sapiens
ILCTKAKNS

SEQ ID NO: 32819 - protein, 9 aa, Homo Sapiens
DLLCPHAAA

SEQ ID NO: 32820 - protein, 9 aa, Homo Sapiens
RGKRSTKKR

SEQ ID NO: 32821 - protein, 9 aa, Homo Sapiens
GMVYISSCA

SEQ ID NO: 32822 - protein, 9 aa, Homo Sapiens
EEKQENEAE

SEQ ID NO: 32823 - protein, 9 aa, Homo Sapiens
HVFQIIAFL

SEQ ID NO: 32824 - protein, 9 aa, Homo Sapiens
PNRVPGGIC

SEQ ID NO: 32825 - protein, 9 aa, Homo Sapiens
KSEAGHAFS

SEQ ID NO: 32826 - protein, 9 aa, Homo Sapiens
LRRPLYEHL

SEQ ID NO: 32827 - protein, 9 aa, Homo Sapiens
TLGTTEFVT

SEQ ID NO: 32828 - protein, 9 aa, Homo Sapiens
ADNDHTAPP

SEQ ID NO: 32829 - protein, 9 aa, Homo Sapiens
TWQSWADPK

SEQ ID NO: 32830 - protein, 9 aa, Homo Sapiens
APQPGCEAL

SEQ ID NO: 32831 - protein, 9 aa, Homo Sapiens
QSESKSESA

SEQ ID NO: 32832 - protein, 9 aa, Homo Sapiens
WLDLKGNHI

SEQ ID NO: 32833 - protein, 9 aa, Homo Sapiens
CALSWRPIL

SEQ ID NO: 32834 - protein, 9 aa, Homo Sapiens
NDHTAPPYD

SEQ ID NO: 32835 - protein, 9 aa, Homo Sapiens
TEESSMNYT

SEQ ID NO: 32836 - protein, 9 aa, Homo Sapiens
PCAMACHGD

SEQ ID NO: 32837 - protein, 9 aa, Homo Sapiens
LIAMCVSIT

SEQ ID NO: 32838 - protein, 9 aa, Homo Sapiens
SAMDRMYYT

SEQ ID NO: 32839 - protein, 9 aa, Homo Sapiens
LGRALEQLV

SEQ ID NO: 32840 - protein, 9 aa, Homo Sapiens
GAVLRPVGL

SEQ ID NO: 32841 - protein, 9 aa, Homo Sapiens
EMENISLEE

SEQ ID NO: 32842 - protein, 9 aa, Homo Sapiens
IKKSKLIGS

SEQ ID NO: 32843 - protein, 9 aa, Homo Sapiens
QQLKGSSDR

SEQ ID NO: 32844 - protein, 9 aa, Homo Sapiens
DTFFSLSIT

SEQ ID NO: 32845 - protein, 9 aa, Homo Sapiens
VLDRDFLSP

SEQ ID NO: 32846 - protein, 9 aa, Homo Sapiens
SPVSRDASH

SEQ ID NO: 32847 - protein, 9 aa, Homo Sapiens
GAGGEASSK

SEQ ID NO: 32848 - protein, 9 aa, Homo Sapiens
ASEPPVENA

SEQ ID NO: 32849 - protein, 9 aa, Homo Sapiens
MCVSITVVL

SEQ ID NO: 32850 - protein, 9 aa, Homo Sapiens
SRILDINNV

SEQ ID NO: 32851 - protein, 9 aa, Homo Sapiens
GTTEFVTAT

SEQ ID NO: 32852 - protein, 9 aa, Homo Sapiens
NRLCERDPY

SEQ ID NO: 32853 - protein, 9 aa, Homo Sapiens
TWCAFDGPG

SEQ ID NO: 32854 - protein, 9 aa, Homo Sapiens
FANGIGKPK

SEQ ID NO: 32855 - protein, 9 aa, Homo Sapiens
ERDGAPLPM

SEQ ID NO: 32856 - protein, 9 aa, Homo Sapiens
VAPSVGAFD

SEQ ID NO: 32857 - protein, 9 aa, Homo Sapiens
DNLSDLTAA

SEQ ID NO: 32858 - protein, 9 aa, Homo Sapiens
ENAQPAPAP

SEQ ID NO: 32859 - protein, 9 aa, Homo Sapiens
VQAFRAQLE

SEQ ID NO: 32860 - protein, 9 aa, Homo Sapiens
SPLHPCSTS

SEQ ID NO: 32861 - protein, 9 aa, Homo Sapiens
LTSTYKYLE

SEQ ID NO: 32862 - protein, 9 aa, Homo Sapiens
KGRGLPNKG

SEQ ID NO: 32863 - protein, 9 aa, Homo Sapiens
DSVVPKKLD

SEQ ID NO: 32864 - protein, 9 aa, Homo Sapiens
HDLDSNKNA

SEQ ID NO: 32865 - protein, 9 aa, Homo Sapiens
KKSKLIGSQ

SEQ ID NO: 32866 - protein, 9 aa, Homo Sapiens
GKTLGTTEF

SEQ ID NO: 32867 - protein, 9 aa, Homo Sapiens
PLLSAYYPN

SEQ ID NO: 32868 - protein, 9 aa, Homo Sapiens
QRLIVPPHL

SEQ ID NO: 32869 - protein, 9 aa, Homo Sapiens
AQEGLSNDE

SEQ ID NO: 32870 - protein, 9 aa, Homo Sapiens
RGGPGPAHR

SEQ ID NO: 32871 - protein, 9 aa, Homo Sapiens
QAAQCGPEP

SEQ ID NO: 32872 - protein, 9 aa, Homo Sapiens
CPEVVVDGV

SEQ ID NO: 32873 - protein, 9 aa, Homo Sapiens
TLPTSFQEG

SEQ ID NO: 32874 - protein, 9 aa, Homo Sapiens
NPRGVSMFS

SEQ ID NO: 32875 - protein, 9 aa, Homo Sapiens
GLTSTYKYL

SEQ ID NO: 32876 - protein, 9 aa, Homo Sapiens
NRPEFTMKK

SEQ ID NO: 32877 - protein, 9 aa, Homo Sapiens
RRPLYEHLA

SEQ ID NO: 32878 - protein, 9 aa, Homo Sapiens
KVPCLKTWL

SEQ ID NO: 32879 - protein, 9 aa, Homo Sapiens
KLYKLGWEK

SEQ ID NO: 32880 - protein, 9 aa, Homo Sapiens
RPVGLLAVA

SEQ ID NO: 32881 - protein, 9 aa, Homo Sapiens
NTWCAFDGP

SEQ ID NO: 32882 - protein, 9 aa, Homo Sapiens
EALKDEYDN

SEQ ID NO: 32883 - protein, 9 aa, Homo Sapiens
KSKLIGSQS

SEQ ID NO: 32884 - protein, 9 aa, Homo Sapiens
RKTKILVLN

SEQ ID NO: 32885 - protein, 9 aa, Homo Sapiens
SDEHTQETN

SEQ ID NO: 32886 - protein, 9 aa, Homo Sapiens
PEKEVKKGL

SEQ ID NO: 32887 - protein, 9 aa, Homo Sapiens
MEMENISLE

SEQ ID NO: 32888 - protein, 9 aa, Homo Sapiens
VIHLMLPQT

SEQ ID NO: 32889 - protein, 9 aa, Homo Sapiens
EELDNQYCP

SEQ ID NO: 32890 - protein, 9 aa, Homo Sapiens
ILHVFQIIA

SEQ ID NO: 32891 - protein, 9 aa, Homo Sapiens
RALQMFVTE

SEQ ID NO: 32892 - protein, 9 aa, Homo Sapiens
PQKPTKEKE

SEQ ID NO: 32893 - protein, 9 aa, Homo Sapiens
DSNKNAQIT

SEQ ID NO: 32894 - protein, 9 aa, Homo Sapiens
MGMVYISSC

SEQ ID NO: 32895 - protein, 9 aa, Homo Sapiens
CHFANGIGK

SEQ ID NO: 32896 - protein, 9 aa, Homo Sapiens
EETMVNVPH

SEQ ID NO: 32897 - protein, 9 aa, Homo Sapiens
IEAFETWQS

SEQ ID NO: 32898 - protein, 9 aa, Homo Sapiens
CVDTYMVGL

SEQ ID NO: 32899 - protein, 9 aa, Homo Sapiens
QGGQVSVCP

SEQ ID NO: 32900 - protein, 9 aa, Homo Sapiens
RVGASEAAF

SEQ ID NO: 32901 - protein, 9 aa, Homo Sapiens
IGELTQDTT

SEQ ID NO: 32902 - protein, 9 aa, Homo Sapiens
VPCLKTWLL

SEQ ID NO: 32903 - protein, 9 aa, Homo Sapiens
ATEPAGFRI

SEQ ID NO: 32904 - protein, 9 aa, Homo Sapiens
KKSEAGHAF

SEQ ID NO: 32905 - protein, 9 aa, Homo Sapiens
AGSQYDEMG

SEQ ID NO: 32906 - protein, 9 aa, Homo Sapiens
RVPLPFGPR

SEQ ID NO: 32907 - protein, 9 aa, Homo Sapiens
VAVTCMVLQ

SEQ ID NO: 32908 - protein, 9 aa, Homo Sapiens
VHSRKETRK

SEQ ID NO: 32909 - protein, 9 aa, Homo Sapiens
GAPLPMMPN

SEQ ID NO: 32910 - protein, 9 aa, Homo Sapiens
HPVLSHRHL

SEQ ID NO: 32911 - protein, 9 aa, Homo Sapiens
HLMLPQTRE

SEQ ID NO: 32912 - protein, 9 aa, Homo Sapiens
LGITASQDR

SEQ ID NO: 32913 - protein, 9 aa, Homo Sapiens
KGKKRRGKR

SEQ ID NO: 32914 - protein, 9 aa, Homo Sapiens
RNPKPWGKL

SEQ ID NO: 32915 - protein, 9 aa, Homo Sapiens
KYHLRLNED

SEQ ID NO: 32916 - protein, 9 aa, Homo Sapiens
KSPDLGKYD

SEQ ID NO: 32917 - protein, 9 aa, Homo Sapiens
TLEKLEVVS

SEQ ID NO: 32918 - protein, 9 aa, Homo Sapiens
FPNSVKNIL

SEQ ID NO: 32919 - protein, 9 aa, Homo Sapiens
VSRDASHAL

SEQ ID NO: 32920 - protein, 9 aa, Homo Sapiens
EEERHGEEE

SEQ ID NO: 32921 - protein, 9 aa, Homo Sapiens
HTAPPYDSI

SEQ ID NO: 32922 - protein, 9 aa, Homo Sapiens
CRTPARKEK

SEQ ID NO: 32923 - protein, 9 aa, Homo Sapiens
TFLIQEPPS

SEQ ID NO: 32924 - protein, 9 aa, Homo Sapiens
LVNENFKEY

SEQ ID NO: 32925 - protein, 9 aa, Homo Sapiens
EFTDRGEHP

SEQ ID NO: 32926 - protein, 9 aa, Homo Sapiens
LHFVLDRDF

SEQ ID NO: 32927 - protein, 9 aa, Homo Sapiens
VLPQRLEPD

SEQ ID NO: 32928 - protein, 9 aa, Homo Sapiens
QWAQFLVEK

SEQ ID NO: 32929 - protein, 9 aa, Homo Sapiens
KPSVSLTPP

SEQ ID NO: 32930 - protein, 9 aa, Homo Sapiens
RRRVQIAHA

SEQ ID NO: 32931 - protein, 9 aa, Homo Sapiens
DDEEERHGE

SEQ ID NO: 32932 - protein, 9 aa, Homo Sapiens
SFPTEESSM

SEQ ID NO: 32933 - protein, 9 aa, Homo Sapiens
RTKREFIYS

SEQ ID NO: 32934 - protein, 9 aa, Homo Sapiens
EKAGEKLLK

SEQ ID NO: 32935 - protein, 9 aa, Homo Sapiens
HSRILDINN

SEQ ID NO: 32936 - protein, 9 aa, Homo Sapiens
EEEKQENEA

SEQ ID NO: 32937 - protein, 9 aa, Homo Sapiens
EESSMNYTF

SEQ ID NO: 32938 - protein, 9 aa, Homo Sapiens
FEGLNVLVT

SEQ ID NO: 32939 - protein, 9 aa, Homo Sapiens
RPLYEHLAC

SEQ ID NO: 32940 - protein, 9 aa, Homo Sapiens
CAFDGPGAH

SEQ ID NO: 32941 - protein, 9 aa, Homo Sapiens
SDSSMEGKE

SEQ ID NO: 32942 - protein, 9 aa, Homo Sapiens
PLAKHQKIH

SEQ ID NO: 32943 - protein, 9 aa, Homo Sapiens
KPAYRHHLI

SEQ ID NO: 32944 - protein, 9 aa, Homo Sapiens
YGMLTFCGP

SEQ ID NO: 32945 - protein, 9 aa, Homo Sapiens
MLLGDLNHL

SEQ ID NO: 32946 - protein, 9 aa, Homo Sapiens
QKPTKEKEE

SEQ ID NO: 32947 - protein, 9 aa, Homo Sapiens
LCSNSLLES

SEQ ID NO: 32948 - protein, 9 aa, Homo Sapiens
AVRAFRSDS

SEQ ID NO: 32949 - protein, 9 aa, Homo Sapiens
VAELNSTIS

SEQ ID NO: 32950 - protein, 9 aa, Homo Sapiens
IANMLACSS

SEQ ID NO: 32951 - protein, 9 aa, Homo Sapiens
QAFRAQLEA

SEQ ID NO: 32952 - protein, 9 aa, Homo Sapiens
KYELQQLKG

SEQ ID NO: 32953 - protein, 9 aa, Homo Sapiens
AARASFSLG

SEQ ID NO: 32954 - protein, 9 aa, Homo Sapiens
RQRLIVPPH

SEQ ID NO: 32955 - protein, 9 aa, Homo Sapiens
NGASPSWRA

SEQ ID NO: 32956 - protein, 9 aa, Homo Sapiens
AELNSTISA

SEQ ID NO: 32957 - protein, 9 aa, Homo Sapiens
CMVLQTQPV

SEQ ID NO: 32958 - protein, 9 aa, Homo Sapiens
SSAKKKGTE

SEQ ID NO: 32959 - protein, 9 aa, Homo Sapiens
EYNRGKANS

SEQ ID NO: 32960 - protein, 9 aa, Homo Sapiens
TSFDSVVPK

SEQ ID NO: 32961 - protein, 9 aa, Homo Sapiens
STNEEEKQE

SEQ ID NO: 32962 - protein, 9 aa, Homo Sapiens
LQSKINEIN

SEQ ID NO: 32963 - protein, 9 aa, Homo Sapiens
FSFSEIWYV

SEQ ID NO: 32964 - protein, 9 aa, Homo Sapiens
ASHALQGRK

SEQ ID NO: 32965 - protein, 9 aa, Homo Sapiens
RERAQCRTP

SEQ ID NO: 32966 - protein, 9 aa, Homo Sapiens
NGIGKPKYM

SEQ ID NO: 32967 - protein, 9 aa, Homo Sapiens
RMWPVLLLS

SEQ ID NO: 32968 - protein, 9 aa, Homo Sapiens
PEEPPLAPR

SEQ ID NO: 32969 - protein, 9 aa, Homo Sapiens
FGAIAAMRY

SEQ ID NO: 32970 - protein, 9 aa, Homo Sapiens
TGCPFESWV

SEQ ID NO: 32971 - protein, 9 aa, Homo Sapiens
CLKTWLLSE

SEQ ID NO: 32972 - protein, 9 aa, Homo Sapiens
NQLQQAEIT

SEQ ID NO: 32973 - protein, 9 aa, Homo Sapiens
CGNQDYKYH

SEQ ID NO: 32974 - protein, 9 aa, Homo Sapiens
KKKVLIAMC

SEQ ID NO: 32975 - protein, 9 aa, Homo Sapiens
MDRMYYTSP

SEQ ID NO: 32976 - protein, 9 aa, Homo Sapiens
LLGDLNHLK

SEQ ID NO: 32977 - protein, 9 aa, Homo Sapiens
GKRQFLLCL

SEQ ID NO: 32978 - protein, 9 aa, Homo Sapiens
EAAHIVGSE

SEQ ID NO: 32979 - protein, 9 aa, Homo Sapiens
ATNSDSSTV

SEQ ID NO: 32980 - protein, 9 aa, Homo Sapiens
QALRLLARS

SEQ ID NO: 32981 - protein, 9 aa, Homo Sapiens
VMAVWSLLS

SEQ ID NO: 32982 - protein, 9 aa, Homo Sapiens
EPAGFRIVQ

SEQ ID NO: 32983 - protein, 9 aa, Homo Sapiens
SAYYPNCVG

SEQ ID NO: 32984 - protein, 9 aa, Homo Sapiens
YLTRRRRVQ

SEQ ID NO: 32985 - protein, 9 aa, Homo Sapiens
AEELDNQYC

SEQ ID NO: 32986 - protein, 9 aa, Homo Sapiens
EPAPEEPPL

SEQ ID NO: 32987 - protein, 9 aa, Homo Sapiens
LMLPQTREI

SEQ ID NO: 32988 - protein, 9 aa, Homo Sapiens
GANEEIPHD

SEQ ID NO: 32989 - protein, 9 aa, Homo Sapiens
SFANKRLPV

SEQ ID NO: 32990 - protein, 9 aa, Homo Sapiens
FLVRWRKDI

SEQ ID NO: 32991 - protein, 9 aa, Homo Sapiens
RASFSLGQG

SEQ ID NO: 32992 - protein, 9 aa, Homo Sapiens
KKLDDLVPK

SEQ ID NO: 32993 - protein, 9 aa, Homo Sapiens
TGMLLGDLN

SEQ ID NO: 32994 - protein, 9 aa, Homo Sapiens
YTCFAEYNR

SEQ ID NO: 32995 - protein, 9 aa, Homo Sapiens
GCKRARGPP

SEQ ID NO: 32996 - protein, 9 aa, Homo Sapiens
KKRRGKRST

SEQ ID NO: 32997 - protein, 9 aa, Homo Sapiens
DRSYKKSKK

SEQ ID NO: 32998 - protein, 9 aa, Homo Sapiens
EQLVLIGAV

SEQ ID NO: 32999 - protein, 9 aa, Homo Sapiens
GVSMFSVTA

SEQ ID NO: 33000 - protein, 9 aa, Homo Sapiens
PKGKSKVPE

SEQ ID NO: 33001 - protein, 9 aa, Homo Sapiens
PLKPSVSLT

SEQ ID NO: 33002 - protein, 9 aa, Homo Sapiens
LLSAYYPNC

SEQ ID NO: 33003 - protein, 9 aa, Homo Sapiens
SPGPSRSLK

SEQ ID NO: 33004 - protein, 9 aa, Homo Sapiens
WRKDILEEK

SEQ ID NO: 33005 - protein, 9 aa, Homo Sapiens
KPNTLEKLE

SEQ ID NO: 33006 - protein, 9 aa, Homo Sapiens
KREFIYSIC

SEQ ID NO: 33007 - protein, 9 aa, Homo Sapiens
QEMGHNSFG

SEQ ID NO: 33008 - protein, 9 aa, Homo Sapiens
PVTPGPSIP

SEQ ID NO: 33009 - protein, 9 aa, Homo Sapiens
DDDFQTNWC

SEQ ID NO: 33010 - protein, 9 aa, Homo Sapiens
NNVDLAMGK

SEQ ID NO: 33011 - protein, 9 aa, Homo Sapiens
IGSQSFNNQ

SEQ ID NO: 33012 - protein, 9 aa, Homo Sapiens
SLSAYGMLT

SEQ ID NO: 33013 - protein, 9 aa, Homo Sapiens
VLSHRHLTL

SEQ ID NO: 33014 - protein, 9 aa, Homo Sapiens
TVAALERGF

SEQ ID NO: 33015 - protein, 9 aa, Homo Sapiens
SHSSPDNRC

SEQ ID NO: 33016 - protein, 9 aa, Homo Sapiens
YGCECGSFR

SEQ ID NO: 33017 - protein, 9 aa, Homo Sapiens
AFTLPTSFQ

SEQ ID NO: 33018 - protein, 9 aa, Homo Sapiens
TESPLHPCS

SEQ ID NO: 33019 - protein, 9 aa, Homo Sapiens
LHWLDLKGN

SEQ ID NO: 33020 - protein, 9 aa, Homo Sapiens
QVPYVEKRR

SEQ ID NO: 33021 - protein, 9 aa, Homo Sapiens
AFFLKKSGL

SEQ ID NO: 33022 - protein, 9 aa, Homo Sapiens
KEYPEKEVK

SEQ ID NO: 33023 - protein, 9 aa, Homo Sapiens
AEEPQKPTK

SEQ ID NO: 33024 - protein, 9 aa, Homo Sapiens
KDEYDNLSD

SEQ ID NO: 33025 - protein, 9 aa, Homo Sapiens
SITTESEPL

SEQ ID NO: 33026 - protein, 9 aa, Homo Sapiens
GASEAAFFL

SEQ ID NO: 33027 - protein, 9 aa, Homo Sapiens
QCLPRIEEG

SEQ ID NO: 33028 - protein, 9 aa, Homo Sapiens
ETRKTARAI

SEQ ID NO: 33029 - protein, 9 aa, Homo Sapiens
DVFEGLNVL

SEQ ID NO: 33030 - protein, 9 aa, Homo Sapiens
QVAQQEAQW

SEQ ID NO: 33031 - protein, 9 aa, Homo Sapiens
VFQAVINWV

SEQ ID NO: 33032 - protein, 9 aa, Homo Sapiens
GNKLKALGI

SEQ ID NO: 33033 - protein, 9 aa, Homo Sapiens
SDSSTVSSG

SEQ ID NO: 33034 - protein, 9 aa, Homo Sapiens
EACYQFINE

SEQ ID NO: 33035 - protein, 9 aa, Homo Sapiens
TPKGKSKVP

SEQ ID NO: 33036 - protein, 9 aa, Homo Sapiens
CVNERQRLI

SEQ ID NO: 33037 - protein, 9 aa, Homo Sapiens
YSRPAHPVS

SEQ ID NO: 33038 - protein, 9 aa, Homo Sapiens
LSNDEETMV

SEQ ID NO: 33039 - protein, 9 aa, Homo Sapiens
IYQLLHFVL

SEQ ID NO: 33040 - protein, 9 aa, Homo Sapiens
LQLHKLVEA

SEQ ID NO: 33041 - protein, 9 aa, Homo Sapiens
PTMNYDKLS

SEQ ID NO: 33042 - protein, 9 aa, Homo Sapiens
LGWEKALKK

SEQ ID NO: 33043 - protein, 9 aa, Homo Sapiens
AGVVMAVWS

SEQ ID NO: 33044 - protein, 9 aa, Homo Sapiens
LKDEYDNLS

SEQ ID NO: 33045 - protein, 9 aa, Homo Sapiens
VENAQPAPA

SEQ ID NO: 33046 - protein, 9 aa, Homo Sapiens
DSSMEGKEG

SEQ ID NO: 33047 - protein, 9 aa, Homo Sapiens
NGVIEAKMH

SEQ ID NO: 33048 - protein, 9 aa, Homo Sapiens
GKPEGLLAW

SEQ ID NO: 33049 - protein, 9 aa, Homo Sapiens
DNRCICYQS

SEQ ID NO: 33050 - protein, 9 aa, Homo Sapiens
KVLIAMCVS

SEQ ID NO: 33051 - protein, 9 aa, Homo Sapiens
HESFTAAKG

SEQ ID NO: 33052 - protein, 9 aa, Homo Sapiens
NEEIPHDFD

SEQ ID NO: 33053 - protein, 9 aa, Homo Sapiens
HDFDWDLIT

SEQ ID NO: 33054 - protein, 9 aa, Homo Sapiens
KQKVEVVSP

SEQ ID NO: 33055 - protein, 9 aa, Homo Sapiens
GNHLATPER

SEQ ID NO: 33056 - protein, 9 aa, Homo Sapiens
PLGTVLSRS

SEQ ID NO: 33057 - protein, 9 aa, Homo Sapiens
QMDVFEGLN

SEQ ID NO: 33058 - protein, 9 aa, Homo Sapiens
MVYISSCAL

SEQ ID NO: 33059 - protein, 9 aa, Homo Sapiens
TAILNSVIY

SEQ ID NO: 33060 - protein, 9 aa, Homo Sapiens
FANKRLPVK

SEQ ID NO: 33061 - protein, 9 aa, Homo Sapiens
RAQCRTPAR

SEQ ID NO: 33062 - protein, 9 aa, Homo Sapiens
AKSMLYHCM

SEQ ID NO: 33063 - protein, 9 aa, Homo Sapiens
HALQGRKCL

SEQ ID NO: 33064 - protein, 9 aa, Homo Sapiens
SSKPKDSSF

SEQ ID NO: 33065 - protein, 9 aa, Homo Sapiens
TIIIGHSFG

SEQ ID NO: 33066 - protein, 9 aa, Homo Sapiens
SAEELDNQY

SEQ ID NO: 33067 - protein, 9 aa, Homo Sapiens
SKSESAGSK

SEQ ID NO: 33068 - protein, 9 aa, Homo Sapiens
NGYVDVAVR

SEQ ID NO: 33069 - protein, 9 aa, Homo Sapiens
AGEVRTFLI

SEQ ID NO: 33070 - protein, 9 aa, Homo Sapiens
DLMAQPVTP

SEQ ID NO: 33071 - protein, 9 aa, Homo Sapiens
KLLKEMRNL

SEQ ID NO: 33072 - protein, 9 aa, Homo Sapiens
STNVEQLIK

SEQ ID NO: 33073 - protein, 9 aa, Homo Sapiens
EVATEPAGF

SEQ ID NO: 33074 - protein, 9 aa, Homo Sapiens
MLVNENFKE

SEQ ID NO: 33075 - protein, 9 aa, Homo Sapiens
VENTEADVP

SEQ ID NO: 33076 - protein, 9 aa, Homo Sapiens
SEALLTISG

SEQ ID NO: 33077 - protein, 9 aa, Homo Sapiens
LCTKAKNSR

SEQ ID NO: 33078 - protein, 9 aa, Homo Sapiens
AENVLVASV

SEQ ID NO: 33079 - protein, 9 aa, Homo Sapiens
ESKSESAGS

SEQ ID NO: 33080 - protein, 9 aa, Homo Sapiens
VLQTQPVSS

SEQ ID NO: 33081 - protein, 9 aa, Homo Sapiens
VDTYMVGLI

SEQ ID NO: 33082 - protein, 9 aa, Homo Sapiens
ESFTAAKGP

SEQ ID NO: 33083 - protein, 9 aa, Homo Sapiens
LAKSSICNN

SEQ ID NO: 33084 - protein, 9 aa, Homo Sapiens
YPNCVGMSP

SEQ ID NO: 33085 - protein, 9 aa, Homo Sapiens
YCPEVVVDG

SEQ ID NO: 33086 - protein, 9 aa, Homo Sapiens
SFQEGKEKC

SEQ ID NO: 33087 - protein, 9 aa, Homo Sapiens
QENEAESDV

SEQ ID NO: 33088 - protein, 9 aa, Homo Sapiens
VKNIAKTEF

SEQ ID NO: 33089 - protein, 9 aa, Homo Sapiens
PLYEHLACA

SEQ ID NO: 33090 - protein, 9 aa, Homo Sapiens
SGVTCAHGP

SEQ ID NO: 33091 - protein, 9 aa, Homo Sapiens
RGLPNKGGA

SEQ ID NO: 33092 - protein, 9 aa, Homo Sapiens
LPFGPREQS

SEQ ID NO: 33093 - protein, 9 aa, Homo Sapiens
SSMEGKEGS

SEQ ID NO: 33094 - protein, 9 aa, Homo Sapiens
TTLTENDDS

SEQ ID NO: 33095 - protein, 9 aa, Homo Sapiens
GVLQPKAAK

SEQ ID NO: 33096 - protein, 9 aa, Homo Sapiens
PHDFDWDLI

SEQ ID NO: 33097 - protein, 9 aa, Homo Sapiens
EHSSSAESD

SEQ ID NO: 33098 - protein, 9 aa, Homo Sapiens
RAHNAVQRA

SEQ ID NO: 33099 - protein, 9 aa, Homo Sapiens
EITQGRANS

SEQ ID NO: 33100 - protein, 9 aa, Homo Sapiens
TSFQEGKEK

SEQ ID NO: 33101 - protein, 9 aa, Homo Sapiens
LLAWGCGLD

SEQ ID NO: 33102 - protein, 9 aa, Homo Sapiens
AIHPACGFL

SEQ ID NO: 33103 - protein, 9 aa, Homo Sapiens
QAHHSPLKP

SEQ ID NO: 33104 - protein, 9 aa, Homo Sapiens
FETWQSWAD

SEQ ID NO: 33105 - protein, 9 aa, Homo Sapiens
KDDAIYHVT

SEQ ID NO: 33106 - protein, 9 aa, Homo Sapiens
GAGVVMAVW

SEQ ID NO: 33107 - protein, 9 aa, Homo Sapiens
ASYCPEVVV

SEQ ID NO: 33108 - protein, 9 aa, Homo Sapiens
CAMACHGDP

SEQ ID NO: 33109 - protein, 9 aa, Homo Sapiens
LIEAFETWQ

SEQ ID NO: 33110 - protein, 9 aa, Homo Sapiens
LNSSAMDRM

SEQ ID NO: 33111 - protein, 9 aa, Homo Sapiens
DINNVDLAM

SEQ ID NO: 33112 - protein, 9 aa, Homo Sapiens
MGGSTYTAK

SEQ ID NO: 33113 - protein, 9 aa, Homo Sapiens
DLLELQSKI

SEQ ID NO: 33114 - protein, 9 aa, Homo Sapiens
ELKSVQSNL

SEQ ID NO: 33115 - protein, 9 aa, Homo Sapiens
NAAINPELV

SEQ ID NO: 33116 - protein, 9 aa, Homo Sapiens
ESRMWPVLL

SEQ ID NO: 33117 - protein, 9 aa, Homo Sapiens
QRVLGVLPQ

SEQ ID NO: 33118 - protein, 9 aa, Homo Sapiens
TKREFIYSI

SEQ ID NO: 33119 - protein, 9 aa, Homo Sapiens
LAPRPSREQ

SEQ ID NO: 33120 - protein, 9 aa, Homo Sapiens
AGGEASSKP

SEQ ID NO: 33121 - protein, 9 aa, Homo Sapiens
LKGSSDRIL

SEQ ID NO: 33122 - protein, 9 aa, Homo Sapiens
KGQEGQVEN

SEQ ID NO: 33123 - protein, 9 aa, Homo Sapiens
ALKDEYDNL

SEQ ID NO: 33124 - protein, 9 aa, Homo Sapiens
ATAASPAPA

SEQ ID NO: 33125 - protein, 9 aa, Homo Sapiens
VRAFRSDSA

SEQ ID NO: 33126 - protein, 9 aa, Homo Sapiens
SSICNNYLN

SEQ ID NO: 33127 - protein, 9 aa, Homo Sapiens
QWEPVCGSN

SEQ ID NO: 33128 - protein, 9 aa, Homo Sapiens
RYIDKYRND

SEQ ID NO: 33129 - protein, 9 aa, Homo Sapiens
YFKKVPCLK

SEQ ID NO: 33130 - protein, 9 aa, Homo Sapiens
KFLSFANKR

SEQ ID NO: 33131 - protein, 9 aa, Homo Sapiens
RHGEEEEEA

SEQ ID NO: 33132 - protein, 9 aa, Homo Sapiens
GGAGVVMAV

SEQ ID NO: 33133 - protein, 9 aa, Homo Sapiens
AQPVTPGPS

SEQ ID NO: 33134 - protein, 9 aa, Homo Sapiens
KNILKTLVK

SEQ ID NO: 33135 - protein, 9 aa, Homo Sapiens
LYGCKRARG

SEQ ID NO: 33136 - protein, 9 aa, Homo Sapiens
TYTAKALGF

SEQ ID NO: 33137 - protein, 9 aa, Homo Sapiens
RQFLLCLLL

SEQ ID NO: 33138 - protein, 9 aa, Homo Sapiens
VAALERGFS

SEQ ID NO: 33139 - protein, 9 aa, Homo Sapiens
FVTEFTDRG

SEQ ID NO: 33140 - protein, 9 aa, Homo Sapiens
NDEETMVNV

SEQ ID NO: 33141 - protein, 9 aa, Homo Sapiens
PQPGCEALH

SEQ ID NO: 33142 - protein, 9 aa, Homo Sapiens
QSWADPKVC

SEQ ID NO: 33143 - protein, 9 aa, Homo Sapiens
HVSDVTKAG

SEQ ID NO: 33144 - protein, 9 aa, Homo Sapiens
VFLLTVAAL

SEQ ID NO: 33145 - protein, 9 aa, Homo Sapiens
SESQSESKS

SEQ ID NO: 33146 - protein, 9 aa, Homo Sapiens
ERGWPKDRK

SEQ ID NO: 33147 - protein, 9 aa, Homo Sapiens
GHSDLLELQ

SEQ ID NO: 33148 - protein, 9 aa, Homo Sapiens
SEPPVENAQ

SEQ ID NO: 33149 - protein, 9 aa, Homo Sapiens
QSNLNQVSH

SEQ ID NO: 33150 - protein, 9 aa, Homo Sapiens
IVAELNSTI

SEQ ID NO: 33151 - protein, 9 aa, Homo Sapiens
WRERSDEHT

SEQ ID NO: 33152 - protein, 9 aa, Homo Sapiens
MDVFEGLNV

SEQ ID NO: 33153 - protein, 9 aa, Homo Sapiens
MNWRPILTI

SEQ ID NO: 33154 - protein, 9 aa, Homo Sapiens
KRTENVTFK

SEQ ID NO: 33155 - protein, 9 aa, Homo Sapiens
WGQIRTKTS

SEQ ID NO: 33156 - protein, 9 aa, Homo Sapiens
CKRARGPPR

SEQ ID NO: 33157 - protein, 9 aa, Homo Sapiens
APEEPPLAP

SEQ ID NO: 33158 - protein, 9 aa, Homo Sapiens
CVSSGRPNR

SEQ ID NO: 33159 - protein, 9 aa, Homo Sapiens
KALGITASQ

SEQ ID NO: 33160 - protein, 9 aa, Homo Sapiens
EASSKPKDS

SEQ ID NO: 33161 - protein, 9 aa, Homo Sapiens
LVLNEATAA

SEQ ID NO: 33162 - protein, 9 aa, Homo Sapiens
RDGEIVDED

SEQ ID NO: 33163 - protein, 9 aa, Homo Sapiens
VVPKKLDDL

SEQ ID NO: 33164 - protein, 9 aa, Homo Sapiens
IAGVAPSVG

SEQ ID NO: 33165 - protein, 9 aa, Homo Sapiens
QDIELKSVQ

SEQ ID NO: 33166 - protein, 9 aa, Homo Sapiens
VKELVNRLC

SEQ ID NO: 33167 - protein, 9 aa, Homo Sapiens
VGLLAVAEW

SEQ ID NO: 33168 - protein, 9 aa, Homo Sapiens
VLQPKAAKE

SEQ ID NO: 33169 - protein, 9 aa, Homo Sapiens
WGKLKSGRE

SEQ ID NO: 33170 - protein, 9 aa, Homo Sapiens
IYTCFAEYN

SEQ ID NO: 33171 - protein, 9 aa, Homo Sapiens
PLHPCSTSP

SEQ ID NO: 33172 - protein, 9 aa, Homo Sapiens
SMNYTFKTP

SEQ ID NO: 33173 - protein, 9 aa, Homo Sapiens
VSIANMLAC

SEQ ID NO: 33174 - protein, 9 aa, Homo Sapiens
EGHQRVHTG

SEQ ID NO: 33175 - protein, 9 aa, Homo Sapiens
GVVMAVWSL

SEQ ID NO: 33176 - protein, 9 aa, Homo Sapiens
EKALKKGYD

SEQ ID NO: 33177 - protein, 9 aa, Homo Sapiens
SQKDISISE

SEQ ID NO: 33178 - protein, 9 aa, Homo Sapiens
SSPDNRCIC

SEQ ID NO: 33179 - protein, 9 aa, Homo Sapiens
TGGAGGEAS

SEQ ID NO: 33180 - protein, 9 aa, Homo Sapiens
VVDGVADQT

SEQ ID NO: 33181 - protein, 9 aa, Homo Sapiens
KSMLYHCMS

SEQ ID NO: 33182 - protein, 9 aa, Homo Sapiens
HRSTKQKVE

SEQ ID NO: 33183 - protein, 9 aa, Homo Sapiens
LQQLKGSSD

SEQ ID NO: 33184 - protein, 9 aa, Homo Sapiens
NFKEYLRAL

SEQ ID NO: 33185 - protein, 9 aa, Homo Sapiens
SGNHLATPE

SEQ ID NO: 33186 - protein, 9 aa, Homo Sapiens
KVIKEYPEK

SEQ ID NO: 33187 - protein, 9 aa, Homo Sapiens
NSSAMDRMY

SEQ ID NO: 33188 - protein, 9 aa, Homo Sapiens
LIRKVSTWG

SEQ ID NO: 33189 - protein, 9 aa, Homo Sapiens
VYISSCALS

SEQ ID NO: 33190 - protein, 9 aa, Homo Sapiens
KLEVVSESC

SEQ ID NO: 33191 - protein, 9 aa, Homo Sapiens
KEGVKELVN

SEQ ID NO: 33192 - protein, 9 aa, Homo Sapiens
LNQKPITWA

SEQ ID NO: 33193 - protein, 9 aa, Homo Sapiens
QKVEVVSPA

SEQ ID NO: 33194 - protein, 9 aa, Homo Sapiens
VLCSNSLLE

SEQ ID NO: 33195 - protein, 9 aa, Homo Sapiens
SRDASHALQ

SEQ ID NO: 33196 - protein, 9 aa, Homo Sapiens
MQCLPRIEE

SEQ ID NO: 33197 - protein, 9 aa, Homo Sapiens
RRGKRSTKK

SEQ ID NO: 33198 - protein, 9 aa, Homo Sapiens
NWFPNSVKN

SEQ ID NO: 33199 - protein, 9 aa, Homo Sapiens
DASHALQGR

SEQ ID NO: 33200 - protein, 9 aa, Homo Sapiens
LAWGCGLDF

SEQ ID NO: 33201 - protein, 9 aa, Homo Sapiens
GHAFSPDSE

SEQ ID NO: 33202 - protein, 9 aa, Homo Sapiens
SSPLAKHQK

SEQ ID NO: 33203 - protein, 9 aa, Homo Sapiens
YVDVAVRAF

SEQ ID NO: 33204 - protein, 9 aa, Homo Sapiens
LRQAAQCGP

SEQ ID NO: 33205 - protein, 9 aa, Homo Sapiens
STKQKVEVV

SEQ ID NO: 33206 - protein, 9 aa, Homo Sapiens
QVLNQKPIT

SEQ ID NO: 33207 - protein, 9 aa, Homo Sapiens
EGLSNDEET

SEQ ID NO: 33208 - protein, 9 aa, Homo Sapiens
QCGPEPGVS

SEQ ID NO: 33209 - protein, 9 aa, Homo Sapiens
ESQSESKSE

SEQ ID NO: 33210 - protein, 9 aa, Homo Sapiens
AGEKLLKEM

SEQ ID NO: 33211 - protein, 9 aa, Homo Sapiens
LSHRHLTLK

SEQ ID NO: 33212 - protein, 9 aa, Homo Sapiens
KNSRLVSQI

SEQ ID NO: 33213 - protein, 9 aa, Homo Sapiens
YSANTWCAF

SEQ ID NO: 33214 - protein, 9 aa, Homo Sapiens
CSLSAYGML

SEQ ID NO: 33215 - protein, 9 aa, Homo Sapiens
HIVGSEHPR

SEQ ID NO: 33216 - protein, 9 aa, Homo Sapiens
AHESFTAAK

SEQ ID NO: 33217 - protein, 9 aa, Homo Sapiens
LRTPKGKSK

SEQ ID NO: 33218 - protein, 9 aa, Homo Sapiens
SEAAFFLKK

SEQ ID NO: 33219 - protein, 9 aa, Homo Sapiens
PRIEEGENL

SEQ ID NO: 33220 - protein, 9 aa, Homo Sapiens
MLCAKSMLY

SEQ ID NO: 33221 - protein, 9 aa, Homo Sapiens
AQEMGHNSF

SEQ ID NO: 33222 - protein, 9 aa, Homo Sapiens
LKLRRPLYE

SEQ ID NO: 33223 - protein, 9 aa, Homo Sapiens
KAGEKLLKE

SEQ ID NO: 33224 - protein, 9 aa, Homo Sapiens
LGVLPQRLE

SEQ ID NO: 33225 - protein, 9 aa, Homo Sapiens
SAAQAIHPA

SEQ ID NO: 33226 - protein, 9 aa, Homo Sapiens
SSHLEGHQR

SEQ ID NO: 33227 - protein, 9 aa, Homo Sapiens
EEPQKPTKE

SEQ ID NO: 33228 - protein, 9 aa, Homo Sapiens
ESDRSYKKS

SEQ ID NO: 33229 - protein, 9 aa, Homo Sapiens
AHHSPLKPS

SEQ ID NO: 33230 - protein, 9 aa, Homo Sapiens
HLGRALEQL

SEQ ID NO: 33231 - protein, 9 aa, Homo Sapiens
QPKAAKEQP

SEQ ID NO: 33232 - protein, 9 aa, Homo Sapiens
YIGRPLAAF

SEQ ID NO: 33233 - protein, 9 aa, Homo Sapiens
EWRAHNAVQ

SEQ ID NO: 33234 - protein, 9 aa, Homo Sapiens
QVENTEADV

SEQ ID NO: 33235 - protein, 9 aa, Homo Sapiens
HLATPERPD

SEQ ID NO: 33236 - protein, 9 aa, Homo Sapiens
LGSQDYLKL

SEQ ID NO: 33237 - protein, 9 aa, Homo Sapiens
AASPAPAVA

SEQ ID NO: 33238 - protein, 9 aa, Homo Sapiens
IVMLTQCNQ

SEQ ID NO: 33239 - protein, 9 aa, Homo Sapiens
AGHAFSPDS

SEQ ID NO: 33240 - protein, 9 aa, Homo Sapiens
TACKKVLCS

SEQ ID NO: 33241 - protein, 9 aa, Homo Sapiens
VFEGLNVLV

SEQ ID NO: 33242 - protein, 9 aa, Homo Sapiens
DGDRDGEIV

SEQ ID NO: 33243 - protein, 9 aa, Homo Sapiens
DLNHLKPLM

SEQ ID NO: 33244 - protein, 9 aa, Homo Sapiens
LACVDTYMV

SEQ ID NO: 33245 - protein, 9 aa, Homo Sapiens
TCMVLQTQP

SEQ ID NO: 33246 - protein, 9 aa, Homo Sapiens
TQDTTLTEN

SEQ ID NO: 33247 - protein, 9 aa, Homo Sapiens
QGTGCPFES

SEQ ID NO: 33248 - protein, 9 aa, Homo Sapiens
PNGVIEAKM

SEQ ID NO: 33249 - protein, 9 aa, Homo Sapiens
HPACGFLSE

SEQ ID NO: 33250 - protein, 9 aa, Homo Sapiens
KAKNSRLVS

SEQ ID NO: 33251 - protein, 9 aa, Homo Sapiens
HGSDGDRDG

SEQ ID NO: 33252 - protein, 9 aa, Homo Sapiens
AAARASFSL

SEQ ID NO: 33253 - protein, 9 aa, Homo Sapiens
ISTNEEEKQ

SEQ ID NO: 33254 - protein, 9 aa, Homo Sapiens
EDDDDFQTN

SEQ ID NO: 33255 - protein, 9 aa, Homo Sapiens
YEQTQGGQV

SEQ ID NO: 33256 - protein, 9 aa, Homo Sapiens
NPRCRRRPL

SEQ ID NO: 33257 - protein, 9 aa, Homo Sapiens
NKLKALGIT

SEQ ID NO: 33258 - protein, 9 aa, Homo Sapiens
KNKPTMNYD

SEQ ID NO: 33259 - protein, 9 aa, Homo Sapiens
CGSNGITYI

SEQ ID NO: 33260 - protein, 9 aa, Homo Sapiens
RQAAQCGPE

SEQ ID NO: 33261 - protein, 9 aa, Homo Sapiens
QLVLIGAVL

SEQ ID NO: 33262 - protein, 9 aa, Homo Sapiens
GKPKYMPVQ

SEQ ID NO: 33263 - protein, 9 aa, Homo Sapiens
GYGCECGSF

SEQ ID NO: 33264 - protein, 9 aa, Homo Sapiens
GEVRTFLIQ

SEQ ID NO: 33265 - protein, 9 aa, Homo Sapiens
SQSESKSES

SEQ ID NO: 33266 - protein, 9 aa, Homo Sapiens
GPAHRVPKS

SEQ ID NO: 33267 - protein, 9 aa, Homo Sapiens
TSTYKYLEM

SEQ ID NO: 33268 - protein, 9 aa, Homo Sapiens
VDKDDAIYH

SEQ ID NO: 33269 - protein, 9 aa, Homo Sapiens
PVENAQPAP

SEQ ID NO: 33270 - protein, 9 aa, Homo Sapiens
RRELRQAAQ

SEQ ID NO: 33271 - protein, 9 aa, Homo Sapiens
FRAQLEAWR

SEQ ID NO: 33272 - protein, 9 aa, Homo Sapiens
TFKKPETFP

SEQ ID NO: 33273 - protein, 9 aa, Homo Sapiens
WFPNSVKNI

SEQ ID NO: 33274 - protein, 9 aa, Homo Sapiens
CAHGPCFNG

SEQ ID NO: 33275 - protein, 9 aa, Homo Sapiens
FVDQYLNIK

SEQ ID NO: 33276 - protein, 9 aa, Homo Sapiens
WERDGAPLP

SEQ ID NO: 33277 - protein, 9 aa, Homo Sapiens
SSAMDRMYY

SEQ ID NO: 33278 - protein, 9 aa, Homo Sapiens
PGPAHRVPK

SEQ ID NO: 33279 - protein, 9 aa, Homo Sapiens
PCIVAELNS

SEQ ID NO: 33280 - protein, 9 aa, Homo Sapiens
FIYSICGRT

SEQ ID NO: 33281 - protein, 9 aa, Homo Sapiens
ERAQCRTPA

SEQ ID NO: 33282 - protein, 9 aa, Homo Sapiens
APPVPATAA

SEQ ID NO: 33283 - protein, 9 aa, Homo Sapiens
QPGCEALHP

SEQ ID NO: 33284 - protein, 9 aa, Homo Sapiens
KYRNDYTQG

SEQ ID NO: 33285 - protein, 9 aa, Homo Sapiens
DVAVRAFRS

SEQ ID NO: 33286 - protein, 9 aa, Homo Sapiens
VNENFKEYL

SEQ ID NO: 33287 - protein, 9 aa, Homo Sapiens
AFRAQLEAW

SEQ ID NO: 33288 - protein, 9 aa, Homo Sapiens
AHGPCFNGG

SEQ ID NO: 33289 - protein, 9 aa, Homo Sapiens
ELDNQYCPS

SEQ ID NO: 33290 - protein, 9 aa, Homo Sapiens
AGFRIVQEK

SEQ ID NO: 33291 - protein, 9 aa, Homo Sapiens
AQAIHPACG

SEQ ID NO: 33292 - protein, 9 aa, Homo Sapiens
WPVLLLSHL

SEQ ID NO: 33293 - protein, 9 aa, Homo Sapiens
PDDLLCPHA

SEQ ID NO: 33294 - protein, 9 aa, Homo Sapiens
LKPSVSLTP

SEQ ID NO: 33295 - protein, 9 aa, Homo Sapiens
QKPITWAAD

SEQ ID NO: 33296 - protein, 9 aa, Homo Sapiens
ALEKKDKTK

SEQ ID NO: 33297 - protein, 9 aa, Homo Sapiens
KETRKTARA

SEQ ID NO: 33298 - protein, 9 aa, Homo Sapiens
ENPRCRRRP

SEQ ID NO: 33299 - protein, 9 aa, Homo Sapiens
AAKGPARRC

SEQ ID NO: 33300 - protein, 9 aa, Homo Sapiens
RTPKGKSKV

SEQ ID NO: 33301 - protein, 9 aa, Homo Sapiens
DEYDNLSDL

SEQ ID NO: 33302 - protein, 9 aa, Homo Sapiens
SSTVASDSS

SEQ ID NO: 33303 - protein, 9 aa, Homo Sapiens
HKLVEADIA

SEQ ID NO: 33304 - protein, 9 aa, Homo Sapiens
GKGKKRRGK

SEQ ID NO: 33305 - protein, 9 aa, Homo Sapiens
MENISLEEV

SEQ ID NO: 33306 - protein, 9 aa, Homo Sapiens
VLNQKPITW

SEQ ID NO: 33307 - protein, 9 aa, Homo Sapiens
ERQRLIVPP

SEQ ID NO: 33308 - protein, 9 aa, Homo Sapiens
RTFLIQEPP

SEQ ID NO: 33309 - protein, 9 aa, Homo Sapiens
SVIYSLRNA

SEQ ID NO: 33310 - protein, 9 aa, Homo Sapiens
FQTNWCIDR

SEQ ID NO: 33311 - protein, 9 aa, Homo Sapiens
EGVKELVNR

SEQ ID NO: 33312 - protein, 9 aa, Homo Sapiens
KGPARRCSS

SEQ ID NO: 33313 - protein, 9 aa, Homo Sapiens
PARKEKQMA

SEQ ID NO: 33314 - protein, 9 aa, Homo Sapiens
ITACKKVLC

SEQ ID NO: 33315 - protein, 9 aa, Homo Sapiens
FSRSSHLEG

SEQ ID NO: 33316 - protein, 9 aa, Homo Sapiens
RKTARAIRD

SEQ ID NO: 33317 - protein, 9 aa, Homo Sapiens
LYEHLACAF

SEQ ID NO: 33318 - protein, 9 aa, Homo Sapiens
KEAAHIVGS

SEQ ID NO: 33319 - protein, 9 aa, Homo Sapiens
VCGSNGITY

SEQ ID NO: 33320 - protein, 9 aa, Homo Sapiens
VIQWLYGCK

SEQ ID NO: 33321 - protein, 9 aa, Homo Sapiens
SPLKPSVSL

SEQ ID NO: 33322 - protein, 9 aa, Homo Sapiens
PFESWVSRP

SEQ ID NO: 33323 - protein, 9 aa, Homo Sapiens
DVQTGDNAA

SEQ ID NO: 33324 - protein, 9 aa, Homo Sapiens
VQSNLNQVS

SEQ ID NO: 33325 - protein, 9 aa, Homo Sapiens
QLLYIGRPL

SEQ ID NO: 33326 - protein, 9 aa, Homo Sapiens
MACHGDPGN

SEQ ID NO: 33327 - protein, 9 aa, Homo Sapiens
SDGDRDGEI

SEQ ID NO: 33328 - protein, 9 aa, Homo Sapiens
RPNRVPGGI

SEQ ID NO: 33329 - protein, 9 aa, Homo Sapiens
TKILVLNEA

SEQ ID NO: 33330 - protein, 9 aa, Homo Sapiens
MAQPVTPGP

SEQ ID NO: 33331 - protein, 9 aa, Homo Sapiens
YDLMAQPVT

SEQ ID NO: 33332 - protein, 9 aa, Homo Sapiens
KRQFLLCLL

SEQ ID NO: 33333 - protein, 9 aa, Homo Sapiens
GLSNDEETM

SEQ ID NO: 33334 - protein, 9 aa, Homo Sapiens
IFYPNGVIE

SEQ ID NO: 33335 - protein, 9 aa, Homo Sapiens
PVSRDASHA

SEQ ID NO: 33336 - protein, 9 aa, Homo Sapiens
ADIDVQTPD

SEQ ID NO: 33337 - protein, 9 aa, Homo Sapiens
GMCVNERQR

SEQ ID NO: 33338 - protein, 9 aa, Homo Sapiens
GSDGDRDGE

SEQ ID NO: 33339 - protein, 9 aa, Homo Sapiens
IHPACGFLS

SEQ ID NO: 33340 - protein, 9 aa, Homo Sapiens
EEWRAHNAV

SEQ ID NO: 33341 - protein, 9 aa, Homo Sapiens
PGCEALHPF

SEQ ID NO: 33342 - protein, 9 aa, Homo Sapiens
TTVNKFLSF

SEQ ID NO: 33343 - protein, 9 aa, Homo Sapiens
EDLLQLHKL

SEQ ID NO: 33344 - protein, 9 aa, Homo Sapiens
AKNSRLVSQ

SEQ ID NO: 33345 - protein, 9 aa, Homo Sapiens
EPPVENAQP

SEQ ID NO: 33346 - protein, 9 aa, Homo Sapiens
CAKSMLYHC

SEQ ID NO: 33347 - protein, 9 aa, Homo Sapiens
FKNASGKRQ

SEQ ID NO: 33348 - protein, 9 aa, Homo Sapiens
LEGHQRVHT

SEQ ID NO: 33349 - protein, 9 aa, Homo Sapiens
SAESDRSYK

SEQ ID NO: 33350 - protein, 9 aa, Homo Sapiens
EIINYALEK

SEQ ID NO: 33351 - protein, 9 aa, Homo Sapiens
RLGLTSTYK

SEQ ID NO: 33352 - protein, 9 aa, Homo Sapiens
LEQLVLIGA

SEQ ID NO: 33353 - protein, 9 aa, Homo Sapiens
AMDRMYYTS

SEQ ID NO: 33354 - protein, 9 aa, Homo Sapiens
SANTWCAFD

SEQ ID NO: 33355 - protein, 9 aa, Homo Sapiens
ELRQAAQCG

SEQ ID NO: 33356 - protein, 9 aa, Homo Sapiens
EYPEKEVKK

SEQ ID NO: 33357 - protein, 9 aa, Homo Sapiens
YSDTFFSLS

SEQ ID NO: 33358 - protein, 9 aa, Homo Sapiens
NEDDEEERH

SEQ ID NO: 33359 - protein, 9 aa, Homo Sapiens
PTFPEKFSV

SEQ ID NO: 33360 - protein, 9 aa, Homo Sapiens
MWPVLLLSH

SEQ ID NO: 33361 - protein, 9 aa, Homo Sapiens
EEPVFQAVI

SEQ ID NO: 33362 - protein, 9 aa, Homo Sapiens
VLNEATAAV

SEQ ID NO: 33363 - protein, 9 aa, Homo Sapiens
AMACHGDPG

SEQ ID NO: 33364 - protein, 9 aa, Homo Sapiens
QEKEAEEPQ

SEQ ID NO: 33365 - protein, 9 aa, Homo Sapiens
PTSQKDISI

SEQ ID NO: 33366 - protein, 9 aa, Homo Sapiens
LNWFPNSVK

SEQ ID NO: 33367 - protein, 9 aa, Homo Sapiens
IKEYPEKEV

SEQ ID NO: 33368 - protein, 9 aa, Homo Sapiens
NHRSTKQKV

SEQ ID NO: 33369 - protein, 9 aa, Homo Sapiens
RHLTLKNSL

SEQ ID NO: 33370 - protein, 9 aa, Homo Sapiens
WAQFLVEKA

SEQ ID NO: 33371 - protein, 9 aa, Homo Sapiens
YPEKEVKKG

SEQ ID NO: 33372 - protein, 9 aa, Homo Sapiens
FGEDDDDFQ

SEQ ID NO: 33373 - protein, 9 aa, Homo Sapiens
LHPCSTSPS

SEQ ID NO: 33374 - protein, 9 aa, Homo Sapiens
LDNQYCPSR

SEQ ID NO: 33375 - protein, 9 aa, Homo Sapiens
AEITQGRAN

SEQ ID NO: 33376 - protein, 9 aa, Homo Sapiens
CTKAKNSRL

SEQ ID NO: 33377 - protein, 9 aa, Homo Sapiens
AKKKGTEAE

SEQ ID NO: 33378 - protein, 9 aa, Homo Sapiens
FLRGSGASH

SEQ ID NO: 33379 - protein, 9 aa, Homo Sapiens
YEETRGVKV

SEQ ID NO: 33380 - protein, 9 aa, Homo Sapiens
DITRPKEVK

SEQ ID NO: 33381 - protein, 9 aa, Homo Sapiens
KFDNENFIL

SEQ ID NO: 33382 - protein, 9 aa, Homo Sapiens
FISTKFHYI

SEQ ID NO: 33383 - protein, 9 aa, Homo Sapiens
GRYIVTCMV

SEQ ID NO: 33384 - protein, 9 aa, Homo Sapiens
GDSTSEVQK

SEQ ID NO: 33385 - protein, 9 aa, Homo Sapiens
KSFPLYPQP

SEQ ID NO: 33386 - protein, 9 aa, Homo Sapiens
LCPHLDSRG

SEQ ID NO: 33387 - protein, 9 aa, Homo Sapiens
ELLSSFSLF

SEQ ID NO: 33388 - protein, 9 aa, Homo Sapiens
GGHPSAVKA

SEQ ID NO: 33389 - protein, 9 aa, Homo Sapiens
RQKKNQKME

SEQ ID NO: 33390 - protein, 9 aa, Homo Sapiens
YVIKVSRDK

SEQ ID NO: 33391 - protein, 9 aa, Homo Sapiens
PWGGPAAHA

SEQ ID NO: 33392 - protein, 9 aa, Homo Sapiens
PHTCPECGK

SEQ ID NO: 33393 - protein, 9 aa, Homo Sapiens
TGGVRKPHR

SEQ ID NO: 33394 - protein, 9 aa, Homo Sapiens
AKAGMVAAG

SEQ ID NO: 33395 - protein, 9 aa, Homo Sapiens
PPKSFPLYP

SEQ ID NO: 33396 - protein, 9 aa, Homo Sapiens
KYLKRYLSG

SEQ ID NO: 33397 - protein, 9 aa, Homo Sapiens
ALEAKLDTA

SEQ ID NO: 33398 - protein, 9 aa, Homo Sapiens
TEDNGKENS

SEQ ID NO: 33399 - protein, 9 aa, Homo Sapiens
TGCQILTRR

SEQ ID NO: 33400 - protein, 9 aa, Homo Sapiens
RCGRLWDSS

SEQ ID NO: 33401 - protein, 9 aa, Homo Sapiens
KFHYINYFQ

SEQ ID NO: 33402 - protein, 9 aa, Homo Sapiens
ENEGKLERQ

SEQ ID NO: 33403 - protein, 9 aa, Homo Sapiens
GVRKPHRYR

SEQ ID NO: 33404 - protein, 9 aa, Homo Sapiens
MFELSQGEE

SEQ ID NO: 33405 - protein, 9 aa, Homo Sapiens
LEWDMKINC

SEQ ID NO: 33406 - protein, 9 aa, Homo Sapiens
RDEFHCDSY

SEQ ID NO: 33407 - protein, 9 aa, Homo Sapiens
EEKAKAKGT

SEQ ID NO: 33408 - protein, 9 aa, Homo Sapiens
GLHQSTFAH

SEQ ID NO: 33409 - protein, 9 aa, Homo Sapiens
LHDLFNLPN

SEQ ID NO: 33410 - protein, 9 aa, Homo Sapiens
EDNGKENSL

SEQ ID NO: 33411 - protein, 9 aa, Homo Sapiens
LSRPFSAEM

SEQ ID NO: 33412 - protein, 9 aa, Homo Sapiens
VNAKLSFFG

SEQ ID NO: 33413 - protein, 9 aa, Homo Sapiens
HASTSDPWP

SEQ ID NO: 33414 - protein, 9 aa, Homo Sapiens
QGLPEEGSG

SEQ ID NO: 33415 - protein, 9 aa, Homo Sapiens
RGPPGKNGD

SEQ ID NO: 33416 - protein, 9 aa, Homo Sapiens
GSGDLIFQN

SEQ ID NO: 33417 - protein, 9 aa, Homo Sapiens
EAKLDTAVV

SEQ ID NO: 33418 - protein, 9 aa, Homo Sapiens
VTFLYEILL

SEQ ID NO: 33419 - protein, 9 aa, Homo Sapiens
RGVKVFLEN

SEQ ID NO: 33420 - protein, 9 aa, Homo Sapiens
APSTGGVRK

SEQ ID NO: 33421 - protein, 9 aa, Homo Sapiens
LMTEMNELL

SEQ ID NO: 33422 - protein, 9 aa, Homo Sapiens
RSQQPQALS

SEQ ID NO: 33423 - protein, 9 aa, Homo Sapiens
MLLNKPLYF

SEQ ID NO: 33424 - protein, 9 aa, Homo Sapiens
CSAFRAHAQ

SEQ ID NO: 33425 - protein, 9 aa, Homo Sapiens
AALAAKAGM

SEQ ID NO: 33426 - protein, 9 aa, Homo Sapiens
KEEFNPDQF

SEQ ID NO: 33427 - protein, 9 aa, Homo Sapiens
MLSIPSGFG

SEQ ID NO: 33428 - protein, 9 aa, Homo Sapiens
QKKNQKMEK

SEQ ID NO: 33429 - protein, 9 aa, Homo Sapiens
SGDLIFQNG

SEQ ID NO: 33430 - protein, 9 aa, Homo Sapiens
LVPFLLILS

SEQ ID NO: 33431 - protein, 9 aa, Homo Sapiens
KGRGRYIVT

SEQ ID NO: 33432 - protein, 9 aa, Homo Sapiens
VRKPHRYRP

SEQ ID NO: 33433 - protein, 9 aa, Homo Sapiens
YTLQYWKDH

SEQ ID NO: 33434 - protein, 9 aa, Homo Sapiens
PKEVKHQEQ

SEQ ID NO: 33435 - protein, 9 aa, Homo Sapiens
SFPLYPQPV

SEQ ID NO: 33436 - protein, 9 aa, Homo Sapiens
FNPDQFMLP

SEQ ID NO: 33437 - protein, 9 aa, Homo Sapiens
SEGDSTSEV

SEQ ID NO: 33438 - protein, 9 aa, Homo Sapiens
LHLSKKQRE

SEQ ID NO: 33439 - protein, 9 aa, Homo Sapiens
LDSRGEVTK

SEQ ID NO: 33440 - protein, 9 aa, Homo Sapiens
PKRPSASQT

SEQ ID NO: 33441 - protein, 9 aa, Homo Sapiens
LPENPNNYT

SEQ ID NO: 33442 - protein, 9 aa, Homo Sapiens
HSRERPHTC

SEQ ID NO: 33443 - protein, 9 aa, Homo Sapiens
VIKVSRDKI

SEQ ID NO: 33444 - protein, 9 aa, Homo Sapiens
GASHLLGLL

SEQ ID NO: 33445 - protein, 9 aa, Homo Sapiens
GNSATIWVT

SEQ ID NO: 33446 - protein, 9 aa, Homo Sapiens
STSEVQKAK

SEQ ID NO: 33447 - protein, 9 aa, Homo Sapiens
QVELSHSGI

SEQ ID NO: 33448 - protein, 9 aa, Homo Sapiens
AHLQSTKDS

SEQ ID NO: 33449 - protein, 9 aa, Homo Sapiens
PAAHASTSD

SEQ ID NO: 33450 - protein, 9 aa, Homo Sapiens
FAHQALEAK

SEQ ID NO: 33451 - protein, 9 aa, Homo Sapiens
TRGVKVFLE

SEQ ID NO: 33452 - protein, 9 aa, Homo Sapiens
RPKEVKHQE

SEQ ID NO: 33453 - protein, 9 aa, Homo Sapiens
RQEAMFELS

SEQ ID NO: 33454 - protein, 9 aa, Homo Sapiens
SGFGNKKSS

SEQ ID NO: 33455 - protein, 9 aa, Homo Sapiens
LQSTKDSYS

SEQ ID NO: 33456 - protein, 9 aa, Homo Sapiens
VVFQVELSH

SEQ ID NO: 33457 - protein, 9 aa, Homo Sapiens
HLLGLLGCP

SEQ ID NO: 33458 - protein, 9 aa, Homo Sapiens
WVTQVLQKK

SEQ ID NO: 33459 - protein, 9 aa, Homo Sapiens
SVSRRPAAT

SEQ ID NO: 33460 - protein, 9 aa, Homo Sapiens
HQALEAKLD

SEQ ID NO: 33461 - protein, 9 aa, Homo Sapiens
STGTFGLHQ

SEQ ID NO: 33462 - protein, 9 aa, Homo Sapiens
QREARDSLI

SEQ ID NO: 33463 - protein, 9 aa, Homo Sapiens
SDRSQPDLV

SEQ ID NO: 33464 - protein, 9 aa, Homo Sapiens
VFFLHRSQQ

SEQ ID NO: 33465 - protein, 9 aa, Homo Sapiens
HIPVDLPEA

SEQ ID NO: 33466 - protein, 9 aa, Homo Sapiens
IYEETRGVK

SEQ ID NO: 33467 - protein, 9 aa, Homo Sapiens
EGNLNTLMT

SEQ ID NO: 33468 - protein, 9 aa, Homo Sapiens
LSSFSLFSM

SEQ ID NO: 33469 - protein, 9 aa, Homo Sapiens
LPEVQTIRA

SEQ ID NO: 33470 - protein, 9 aa, Homo Sapiens
SRFCVSISV

SEQ ID NO: 33471 - protein, 9 aa, Homo Sapiens
SGPGGCPGR

SEQ ID NO: 33472 - protein, 9 aa, Homo Sapiens
NSFPSPFIE

SEQ ID NO: 33473 - protein, 9 aa, Homo Sapiens
FQVELSHSG

SEQ ID NO: 33474 - protein, 9 aa, Homo Sapiens
QQLEKRLEA

SEQ ID NO: 33475 - protein, 9 aa, Homo Sapiens
QLEKRLEAT

SEQ ID NO: 33476 - protein, 9 aa, Homo Sapiens
ELSLRPMEA

SEQ ID NO: 33477 - protein, 9 aa, Homo Sapiens
GARSTGTFG

SEQ ID NO: 33478 - protein, 9 aa, Homo Sapiens
NHDPSHIPV

SEQ ID NO: 33479 - protein, 9 aa, Homo Sapiens
NNNSNDCGN

SEQ ID NO: 33480 - protein, 9 aa, Homo Sapiens
QVAQLHWVL

SEQ ID NO: 33481 - protein, 9 aa, Homo Sapiens
PVTEELLKQ

SEQ ID NO: 33482 - protein, 9 aa, Homo Sapiens
ETGLLPASY

SEQ ID NO: 33483 - protein, 9 aa, Homo Sapiens
EEMLSSVMP

SEQ ID NO: 33484 - protein, 9 aa, Homo Sapiens
LPEEGSGSH

SEQ ID NO: 33485 - protein, 9 aa, Homo Sapiens
LGAARCASI

SEQ ID NO: 33486 - protein, 9 aa, Homo Sapiens
AAKAGMVAA

SEQ ID NO: 33487 - protein, 9 aa, Homo Sapiens
LREQGLPEE

SEQ ID NO: 33488 - protein, 9 aa, Homo Sapiens
GSQGFKQHR

SEQ ID NO: 33489 - protein, 9 aa, Homo Sapiens
GVKVFLENV

SEQ ID NO: 33490 - protein, 9 aa, Homo Sapiens
AAIKRHRVH

SEQ ID NO: 33491 - protein, 9 aa, Homo Sapiens
GLGKTIQSV

SEQ ID NO: 33492 - protein, 9 aa, Homo Sapiens
LMTSVSRRP

SEQ ID NO: 33493 - protein, 9 aa, Homo Sapiens
FGLGFAFPG

SEQ ID NO: 33494 - protein, 9 aa, Homo Sapiens
PGRPPALAG

SEQ ID NO: 33495 - protein, 9 aa, Homo Sapiens
GHPSAVKAG

SEQ ID NO: 33496 - protein, 9 aa, Homo Sapiens
RPFSAEMAG

SEQ ID NO: 33497 - protein, 9 aa, Homo Sapiens
RGRYIVTCM

SEQ ID NO: 33498 - protein, 9 aa, Homo Sapiens
SGASHLLGL

SEQ ID NO: 33499 - protein, 9 aa, Homo Sapiens
RGETGLLPA

SEQ ID NO: 33500 - protein, 9 aa, Homo Sapiens
YRSWCQQLE

SEQ ID NO: 33501 - protein, 9 aa, Homo Sapiens
MTSVSRRPA

SEQ ID NO: 33502 - protein, 9 aa, Homo Sapiens
WCQQLEKRL

SEQ ID NO: 33503 - protein, 9 aa, Homo Sapiens
ERQKKNQKM

SEQ ID NO: 33504 - protein, 9 aa, Homo Sapiens
NPEEWQLSG

SEQ ID NO: 33505 - protein, 9 aa, Homo Sapiens
ELCSLASDR

SEQ ID NO: 33506 - protein, 9 aa, Homo Sapiens
SRGEVTKED

SEQ ID NO: 33507 - protein, 9 aa, Homo Sapiens
YYRNPDAEI

SEQ ID NO: 33508 - protein, 9 aa, Homo Sapiens
VQPETTLPA

SEQ ID NO: 33509 - protein, 9 aa, Homo Sapiens
IWVTQVLQK

SEQ ID NO: 33510 - protein, 9 aa, Homo Sapiens
LHQSTFAHQ

SEQ ID NO: 33511 - protein, 9 aa, Homo Sapiens
EIKRQEAMF

SEQ ID NO: 33512 - protein, 9 aa, Homo Sapiens
SAEMAGLDE

SEQ ID NO: 33513 - protein, 9 aa, Homo Sapiens
PPLSKAKYL

SEQ ID NO: 33514 - protein, 9 aa, Homo Sapiens
NGLMTSVSR

SEQ ID NO: 33515 - protein, 9 aa, Homo Sapiens
KTGQIDRRQ

SEQ ID NO: 33516 - protein, 8 aa, Homo Sapiens
NLEPPKAE

SEQ ID NO: 33517 - protein, 9 aa, Homo Sapiens
HDLFNLPND

SEQ ID NO: 33518 - protein, 9 aa, Homo Sapiens
NTLREQGLP

SEQ ID NO: 33519 - protein, 9 aa, Homo Sapiens
RHLYVIKVS

SEQ ID NO: 33520 - protein, 9 aa, Homo Sapiens
AIKRHRVHL

SEQ ID NO: 33521 - protein, 9 aa, Homo Sapiens
EEHVQPETT

SEQ ID NO: 33522 - protein, 9 aa, Homo Sapiens
LHRSQQPQA

SEQ ID NO: 33523 - protein, 9 aa, Homo Sapiens
LVTDTGCQI

SEQ ID NO: 33524 - protein, 9 aa, Homo Sapiens
FCVSISVTC

SEQ ID NO: 33525 - protein, 9 aa, Homo Sapiens
IVTCMVIFA

SEQ ID NO: 33526 - protein, 9 aa, Homo Sapiens
IRIKEEEPN

SEQ ID NO: 33527 - protein, 9 aa, Homo Sapiens
DEAAIKRHR

SEQ ID NO: 33528 - protein, 9 aa, Homo Sapiens
GRGRYIVTC

SEQ ID NO: 33529 - protein, 9 aa, Homo Sapiens
STPVNSFPS

SEQ ID NO: 33530 - protein, 9 aa, Homo Sapiens
RGPRGPPGK

SEQ ID NO: 33531 - protein, 9 aa, Homo Sapiens
SWCQQLEKR

SEQ ID NO: 33532 - protein, 9 aa, Homo Sapiens
LGCASLFGL

SEQ ID NO: 33533 - protein, 9 aa, Homo Sapiens
TACSAFRAH

SEQ ID NO: 33534 - protein, 9 aa, Homo Sapiens
LLGCPSRLP

SEQ ID NO: 33535 - protein, 9 aa, Homo Sapiens
LPRLGCASL

SEQ ID NO: 33536 - protein, 9 aa, Homo Sapiens
KEEEPNPEE

SEQ ID NO: 33537 - protein, 9 aa, Homo Sapiens
SAVKAGGMR

SEQ ID NO: 33538 - protein, 9 aa, Homo Sapiens
GGCPGRPPA

SEQ ID NO: 33539 - protein, 9 aa, Homo Sapiens
QELSLRPME

SEQ ID NO: 33540 - protein, 9 aa, Homo Sapiens
VHSRERPHT

SEQ ID NO: 33541 - protein, 9 aa, Homo Sapiens
WGGPAAHAS

SEQ ID NO: 33542 - protein, 9 aa, Homo Sapiens
NGGLTRNYY

SEQ ID NO: 33543 - protein, 9 aa, Homo Sapiens
PTSMEVQPV

SEQ ID NO: 33544 - protein, 9 aa, Homo Sapiens
TGQIDRRQT

SEQ ID NO: 33545 - protein, 9 aa, Homo Sapiens
GLMTSVSRR

SEQ ID NO: 33546 - protein, 9 aa, Homo Sapiens
FNLHLSKKQ

SEQ ID NO: 33547 - protein, 9 aa, Homo Sapiens
IKKKLYSLE

SEQ ID NO: 33548 - protein, 9 aa, Homo Sapiens
QPVTEELLK

SEQ ID NO: 33549 - protein, 9 aa, Homo Sapiens
SSFSLFSML

SEQ ID NO: 33550 - protein, 9 aa, Homo Sapiens
LGFAFPGSR

SEQ ID NO: 33551 - protein, 9 aa, Homo Sapiens
IFQNGHLIS

SEQ ID NO: 33552 - protein, 9 aa, Homo Sapiens
DPSHIPVDL

SEQ ID NO: 33553 - protein, 9 aa, Homo Sapiens
IKRQEAMFE

SEQ ID NO: 33554 - protein, 9 aa, Homo Sapiens
PSASQTVST

SEQ ID NO: 33555 - protein, 9 aa, Homo Sapiens
VSISVTCIS

SEQ ID NO: 33556 - protein, 9 aa, Homo Sapiens
SPGLRRPKS

SEQ ID NO: 33557 - protein, 9 aa, Homo Sapiens
WDMKINCSG

SEQ ID NO: 33558 - protein, 9 aa, Homo Sapiens
SAPSTGGVR

SEQ ID NO: 33559 - protein, 9 aa, Homo Sapiens
CPSRLPRLG

SEQ ID NO: 33560 - protein, 9 aa, Homo Sapiens
ASHLLGLLG

SEQ ID NO: 33561 - protein, 9 aa, Homo Sapiens
LEQLLIEEC

SEQ ID NO: 33562 - protein, 9 aa, Homo Sapiens
LYPQPVTIT

SEQ ID NO: 33563 - protein, 9 aa, Homo Sapiens
CGRLWDSSG

SEQ ID NO: 33564 - protein, 9 aa, Homo Sapiens
LGKTIQSVT

SEQ ID NO: 33565 - protein, 9 aa, Homo Sapiens
GCASLFGLG

SEQ ID NO: 33566 - protein, 9 aa, Homo Sapiens
LLILSSYIR

SEQ ID NO: 33567 - protein, 9 aa, Homo Sapiens
SLEQLLIEE

SEQ ID NO: 33568 - protein, 9 aa, Homo Sapiens
HLDSRGEVT

SEQ ID NO: 33569 - protein, 9 aa, Homo Sapiens
CASIVTTGL

SEQ ID NO: 33570 - protein, 9 aa, Homo Sapiens
TIVTPNGNE

SEQ ID NO: 33571 - protein, 9 aa, Homo Sapiens
KLEEKAKAK

SEQ ID NO: 33572 - protein, 9 aa, Homo Sapiens
IPELLSSFS

SEQ ID NO: 33573 - protein, 9 aa, Homo Sapiens
STFAHQALE

SEQ ID NO: 33574 - protein, 9 aa, Homo Sapiens
ILSSYIRVL

SEQ ID NO: 33575 - protein, 9 aa, Homo Sapiens
RPSASQTVS

SEQ ID NO: 33576 - protein, 9 aa, Homo Sapiens
PMGPRGPRG

SEQ ID NO: 33577 - protein, 9 aa, Homo Sapiens
SVTCISMSS

SEQ ID NO: 33578 - protein, 9 aa, Homo Sapiens
CPHLDSRGE

SEQ ID NO: 33579 - protein, 9 aa, Homo Sapiens
EEEMLSSVM

SEQ ID NO: 33580 - protein, 9 aa, Homo Sapiens
HCDSYCSWN

SEQ ID NO: 33581 - protein, 9 aa, Homo Sapiens
AARCASIVT

SEQ ID NO: 33582 - protein, 9 aa, Homo Sapiens
NNSNDCGNI

SEQ ID NO: 33583 - protein, 9 aa, Homo Sapiens
MAERWESRM

SEQ ID NO: 33584 - protein, 9 aa, Homo Sapiens
PENPNNYTL

SEQ ID NO: 33585 - protein, 9 aa, Homo Sapiens
TQTRAKLCN

SEQ ID NO: 33586 - protein, 9 aa, Homo Sapiens
QLHWVLVED

SEQ ID NO: 33587 - protein, 9 aa, Homo Sapiens
TRPKEVKHQ

SEQ ID NO: 33588 - protein, 9 aa, Homo Sapiens
LRGSGASHL

SEQ ID NO: 33589 - protein, 9 aa, Homo Sapiens
ENPNNYTLQ

SEQ ID NO: 33590 - protein, 9 aa, Homo Sapiens
DQFMLPHPE

SEQ ID NO: 33591 - protein, 9 aa, Homo Sapiens
YRNPDAEIR

SEQ ID NO: 33592 - protein, 9 aa, Homo Sapiens
VAQLHWVLV

SEQ ID NO: 33593 - protein, 9 aa, Homo Sapiens
GLGFAFPGS

SEQ ID NO: 33594 - protein, 9 aa, Homo Sapiens
KKGRGRYIV

SEQ ID NO: 33595 - protein, 9 aa, Homo Sapiens
STGGVRKPH

SEQ ID NO: 33596 - protein, 9 aa, Homo Sapiens
SLRPMEARD

SEQ ID NO: 33597 - protein, 9 aa, Homo Sapiens
WESRMYASE

SEQ ID NO: 33598 - protein, 9 aa, Homo Sapiens
HWVLVEDAA

SEQ ID NO: 33599 - protein, 9 aa, Homo Sapiens
GSRFLVEFE

SEQ ID NO: 33600 - protein, 9 aa, Homo Sapiens
LASDRSQPD

SEQ ID NO: 33601 - protein, 9 aa, Homo Sapiens
SRWFEVDRR

SEQ ID NO: 33602 - protein, 9 aa, Homo Sapiens
TTIVTPNGN

SEQ ID NO: 33603 - protein, 9 aa, Homo Sapiens
ATIWVTQVL

SEQ ID NO: 33604 - protein, 9 aa, Homo Sapiens
FGHNVPLSS

SEQ ID NO: 33605 - protein, 9 aa, Homo Sapiens
VTCISMSSF

SEQ ID NO: 33606 - protein, 9 aa, Homo Sapiens
HPSAVKAGG

SEQ ID NO: 33607 - protein, 9 aa, Homo Sapiens
GKGTQTRAK

SEQ ID NO: 33608 - protein, 9 aa, Homo Sapiens
FGNKKSSNW

SEQ ID NO: 33609 - protein, 9 aa, Homo Sapiens
SGDEAAIKR

SEQ ID NO: 33610 - protein, 9 aa, Homo Sapiens
ESRMYASEE

SEQ ID NO: 33611 - protein, 9 aa, Homo Sapiens
EGARSTGTF

SEQ ID NO: 33612 - protein, 9 aa, Homo Sapiens
VNSFPSPFI

SEQ ID NO: 33613 - protein, 9 aa, Homo Sapiens
KAGMVAAGA

SEQ ID NO: 33614 - protein, 9 aa, Homo Sapiens
FFKLEWDMK

SEQ ID NO: 33615 - protein, 9 aa, Homo Sapiens
CDSYCSWNQ

SEQ ID NO: 33616 - protein, 9 aa, Homo Sapiens
AKLCNNPPP

SEQ ID NO: 33617 - protein, 9 aa, Homo Sapiens
AGAERPRRC

SEQ ID NO: 33618 - protein, 9 aa, Homo Sapiens
FEGARSTGT

SEQ ID NO: 33619 - protein, 9 aa, Homo Sapiens
VSRRPAATR

SEQ ID NO: 33620 - protein, 9 aa, Homo Sapiens
LSSVMPDSR

SEQ ID NO: 33621 - protein, 9 aa, Homo Sapiens
STKDSYSAI

SEQ ID NO: 33622 - protein, 9 aa, Homo Sapiens
KAKAKGTFR

SEQ ID NO: 33623 - protein, 9 aa, Homo Sapiens
FNLPNDRPY

SEQ ID NO: 33624 - protein, 9 aa, Homo Sapiens
EEEPNPEEW

SEQ ID NO: 33625 - protein, 9 aa, Homo Sapiens
FQNGHLISG

SEQ ID NO: 33626 - protein, 9 aa, Homo Sapiens
GDLIFQNGH

SEQ ID NO: 33627 - protein, 9 aa, Homo Sapiens
LSLRPMEAR

SEQ ID NO: 33628 - protein, 9 aa, Homo Sapiens
DGSQGFKQH

SEQ ID NO: 33629 - protein, 9 aa, Homo Sapiens
ITACSAFRA

SEQ ID NO: 33630 - protein, 9 aa, Homo Sapiens
TCRKPDVSQ

SEQ ID NO: 33631 - protein, 9 aa, Homo Sapiens
LNTTIVTPN

SEQ ID NO: 33632 - protein, 9 aa, Homo Sapiens
GDEAAIKRH

SEQ ID NO: 33633 - protein, 9 aa, Homo Sapiens
EFHCDSYCS

SEQ ID NO: 33634 - protein, 9 aa, Homo Sapiens
EETRGVKVF

SEQ ID NO: 33635 - protein, 9 aa, Homo Sapiens
RCASIVTTG

SEQ ID NO: 33636 - protein, 9 aa, Homo Sapiens
ALAAKAGMV

SEQ ID NO: 33637 - protein, 9 aa, Homo Sapiens
DFFKLEWDM

SEQ ID NO: 33638 - protein, 9 aa, Homo Sapiens
RSWCQQLEK

SEQ ID NO: 33639 - protein, 9 aa, Homo Sapiens
LRPMEARDW

SEQ ID NO: 33640 - protein, 9 aa, Homo Sapiens
KSGERHLYV

SEQ ID NO: 33641 - protein, 9 aa, Homo Sapiens
EHVQPETTL

SEQ ID NO: 33642 - protein, 9 aa, Homo Sapiens
HVQPETTLP

SEQ ID NO: 33643 - protein, 9 aa, Homo Sapiens
AEGNLNTLM

SEQ ID NO: 33644 - protein, 9 aa, Homo Sapiens
EVQTIRACS

SEQ ID NO: 33645 - protein, 9 aa, Homo Sapiens
QNVVFQVEL

SEQ ID NO: 33646 - protein, 9 aa, Homo Sapiens
NLPNDRPYF

SEQ ID NO: 33647 - protein, 9 aa, Homo Sapiens
LYVIKVSRD

SEQ ID NO: 33648 - protein, 9 aa, Homo Sapiens
EMAGLDEKS

SEQ ID NO: 33649 - protein, 9 aa, Homo Sapiens
YSLEQLLIE

SEQ ID NO: 33650 - protein, 9 aa, Homo Sapiens
SSYIRVLFA

SEQ ID NO: 33651 - protein, 9 aa, Homo Sapiens
QPETTLPAR

SEQ ID NO: 33652 - protein, 9 aa, Homo Sapiens
DNNNSNDCG

SEQ ID NO: 33653 - protein, 9 aa, Homo Sapiens
ITRPKEVKH

SEQ ID NO: 33654 - protein, 9 aa, Homo Sapiens
ERWESRMYA

SEQ ID NO: 33655 - protein, 9 aa, Homo Sapiens
PSAVKAGGM

SEQ ID NO: 33656 - protein, 9 aa, Homo Sapiens
KGGHPSAVK

SEQ ID NO: 33657 - protein, 9 aa, Homo Sapiens
ERHLYVIKV

SEQ ID NO: 33658 - protein, 9 aa, Homo Sapiens
PSRLPRLGC

SEQ ID NO: 33659 - protein, 9 aa, Homo Sapiens
KLERQKKNQ

SEQ ID NO: 33660 - protein, 9 aa, Homo Sapiens
PGSRFLVEF

SEQ ID NO: 33661 - protein, 9 aa, Homo Sapiens
SFSLFSMLL

SEQ ID NO: 33662 - protein, 9 aa, Homo Sapiens
AQLHWVLVE

SEQ ID NO: 33663 - protein, 9 aa, Homo Sapiens
YPQPVTITL

SEQ ID NO: 33664 - protein, 9 aa, Homo Sapiens
GFGNKKSSN

SEQ ID NO: 33665 - protein, 9 aa, Homo Sapiens
GTLPEVQTI

SEQ ID NO: 33666 - protein, 9 aa, Homo Sapiens
TPKRPSASQ

SEQ ID NO: 33667 - protein, 9 aa, Homo Sapiens
NVHAHLQST

SEQ ID NO: 33668 - protein, 9 aa, Homo Sapiens
TFAHQALEA

SEQ ID NO: 33669 - protein, 9 aa, Homo Sapiens
GTFGLHQST

SEQ ID NO: 33670 - protein, 9 aa, Homo Sapiens
LCSLASDRS

SEQ ID NO: 33671 - protein, 9 aa, Homo Sapiens
FSAEMAGLD

SEQ ID NO: 33672 - protein, 9 aa, Homo Sapiens
DLCPHLDSR

SEQ ID NO: 33673 - protein, 9 aa, Homo Sapiens
RKPHRYRPG

SEQ ID NO: 33674 - protein, 9 aa, Homo Sapiens
REQGLPEEG

SEQ ID NO: 33675 - protein, 9 aa, Homo Sapiens
NDRPYFKRS

SEQ ID NO: 33676 - protein, 9 aa, Homo Sapiens
GLNTTIVTP

SEQ ID NO: 33677 - protein, 9 aa, Homo Sapiens
VVFFLHRSQ

SEQ ID NO: 33678 - protein, 9 aa, Homo Sapiens
QGEMVSGFG

SEQ ID NO: 33679 - protein, 9 aa, Homo Sapiens
IKEEEPNPE

SEQ ID NO: 33680 - protein, 9 aa, Homo Sapiens
QNVHAHLQS

SEQ ID NO: 33681 - protein, 9 aa, Homo Sapiens
ETRGVKVFL

SEQ ID NO: 33682 - protein, 9 aa, Homo Sapiens
CVSISVTCI

SEQ ID NO: 33683 - protein, 9 aa, Homo Sapiens
AKLDTAVVF

SEQ ID NO: 33684 - protein, 9 aa, Homo Sapiens
ISVTCISMS

SEQ ID NO: 33685 - protein, 9 aa, Homo Sapiens
GGLTRNYYR

SEQ ID NO: 33686 - protein, 9 aa, Homo Sapiens
QALEAKLDT

SEQ ID NO: 33687 - protein, 9 aa, Homo Sapiens
ISRWFEVDR

SEQ ID NO: 33688 - protein, 9 aa, Homo Sapiens
INHDPSHIP

SEQ ID NO: 33689 - protein, 9 aa, Homo Sapiens
EEEEKLEEK

SEQ ID NO: 33690 - protein, 9 aa, Homo Sapiens
AEMAGLDEK

SEQ ID NO: 33691 - protein, 9 aa, Homo Sapiens
HAHLQSTKD

SEQ ID NO: 33692 - protein, 9 aa, Homo Sapiens
TIWVTQVLQ

SEQ ID NO: 33693 - protein, 9 aa, Homo Sapiens
GQIDRRQTL

SEQ ID NO: 33694 - protein, 9 aa, Homo Sapiens
VGLNTTIVT

SEQ ID NO: 33695 - protein, 9 aa, Homo Sapiens
AFLRGSGAS

SEQ ID NO: 33696 - protein, 9 aa, Homo Sapiens
EGDSTSEVQ

SEQ ID NO: 33697 - protein, 9 aa, Homo Sapiens
CPGRPPALA

SEQ ID NO: 33698 - protein, 9 aa, Homo Sapiens
NKEEFNPDQ

SEQ ID NO: 33699 - protein, 9 aa, Homo Sapiens
GKKFDNENF

SEQ ID NO: 33700 - protein, 9 aa, Homo Sapiens
TSEVQKAKD

SEQ ID NO: 33701 - protein, 9 aa, Homo Sapiens
PRGPRGPPG

SEQ ID NO: 33702 - protein, 9 aa, Homo Sapiens
PSEGDSTSE

SEQ ID NO: 33703 - protein, 9 aa, Homo Sapiens
GAARCASIV

SEQ ID NO: 33704 - protein, 9 aa, Homo Sapiens
PDQFMLPHP

SEQ ID NO: 33705 - protein, 9 aa, Homo Sapiens
RGEVTKEDL

SEQ ID NO: 33706 - protein, 9 aa, Homo Sapiens
MEARDWRQS

SEQ ID NO: 33707 - protein, 9 aa, Homo Sapiens
VKVFLENVI

SEQ ID NO: 33708 - protein, 9 aa, Homo Sapiens
VTPNGNEDT

SEQ ID NO: 33709 - protein, 9 aa, Homo Sapiens
RLGCASLFG

SEQ ID NO: 33710 - protein, 9 aa, Homo Sapiens
RMYASEEDD

SEQ ID NO: 33711 - protein, 9 aa, Homo Sapiens
RHPLFGHNV

SEQ ID NO: 33712 - protein, 9 aa, Homo Sapiens
VEFEGARST

SEQ ID NO: 33713 - protein, 9 aa, Homo Sapiens
ETQNVVFQV

SEQ ID NO: 33714 - protein, 9 aa, Homo Sapiens
HDPSHIPVD

SEQ ID NO: 33715 - protein, 9 aa, Homo Sapiens
PRRCGRLWD

SEQ ID NO: 33716 - protein, 9 aa, Homo Sapiens
GPAAHASTS

SEQ ID NO: 33717 - protein, 9 aa, Homo Sapiens
TRAKLCNNP

SEQ ID NO: 33718 - protein, 9 aa, Homo Sapiens
TQNVVFQVE

SEQ ID NO: 33719 - protein, 9 aa, Homo Sapiens
DRSQPDLVY

SEQ ID NO: 33720 - protein, 9 aa, Homo Sapiens
RNYYRNPDA

SEQ ID NO: 33721 - protein, 9 aa, Homo Sapiens
MAAAALAAK

SEQ ID NO: 33722 - protein, 9 aa, Homo Sapiens
SRPFSAEMA

SEQ ID NO: 33723 - protein, 9 aa, Homo Sapiens
FSLFSMLLP

SEQ ID NO: 33724 - protein, 9 aa, Homo Sapiens
PELLSSFSL

SEQ ID NO: 33725 - protein, 9 aa, Homo Sapiens
ASTPHRSPH

SEQ ID NO: 33726 - protein, 9 aa, Homo Sapiens
SRLPRLGCA

SEQ ID NO: 33727 - protein, 9 aa, Homo Sapiens
ASPGLRRPK

SEQ ID NO: 33728 - protein, 9 aa, Homo Sapiens
HYINYFQTN

SEQ ID NO: 33729 - protein, 9 aa, Homo Sapiens
KLEWDMKIN

SEQ ID NO: 33730 - protein, 9 aa, Homo Sapiens
KLYSLEQLL

SEQ ID NO: 33731 - protein, 9 aa, Homo Sapiens
ASDRSQPDL

SEQ ID NO: 33732 - protein, 9 aa, Homo Sapiens
KFPIVNAKL

SEQ ID NO: 33733 - protein, 9 aa, Homo Sapiens
GTQTRAKLC

SEQ ID NO: 33734 - protein, 9 aa, Homo Sapiens
ISTKFHYIN

SEQ ID NO: 33735 - protein, 9 aa, Homo Sapiens
NNYTLQYWK

SEQ ID NO: 33736 - protein, 9 aa, Homo Sapiens
QTIRACSMP

SEQ ID NO: 33737 - protein, 9 aa, Homo Sapiens
LPTVTNAVS

SEQ ID NO: 33738 - protein, 9 aa, Homo Sapiens
CITACSAFR

SEQ ID NO: 33739 - protein, 9 aa, Homo Sapiens
VPSEGDSTS

SEQ ID NO: 33740 - protein, 9 aa, Homo Sapiens
KGTQTRAKL

SEQ ID NO: 33741 - protein, 9 aa, Homo Sapiens
QPICITACS

SEQ ID NO: 33742 - protein, 9 aa, Homo Sapiens
DVSQGEMVS

SEQ ID NO: 33743 - protein, 9 aa, Homo Sapiens
TLGTLPEVQ

SEQ ID NO: 33744 - protein, 9 aa, Homo Sapiens
LGTLPEVQT

SEQ ID NO: 33745 - protein, 9 aa, Homo Sapiens
GGPAAHAST

SEQ ID NO: 33746 - protein, 9 aa, Homo Sapiens
AQELSLRPM

SEQ ID NO: 33747 - protein, 9 aa, Homo Sapiens
SHIPVDLPE

SEQ ID NO: 33748 - protein, 9 aa, Homo Sapiens
PIVNAKLSF

SEQ ID NO: 33749 - protein, 9 aa, Homo Sapiens
KKKLYSLEQ

SEQ ID NO: 33750 - protein, 9 aa, Homo Sapiens
IVNAKLSFF

SEQ ID NO: 33751 - protein, 9 aa, Homo Sapiens
WFEVDRREL

SEQ ID NO: 33752 - protein, 9 aa, Homo Sapiens
LSKKQREAR

SEQ ID NO: 33753 - protein, 9 aa, Homo Sapiens
KRPSASQTV

SEQ ID NO: 33754 - protein, 9 aa, Homo Sapiens
PTPASTPHR

SEQ ID NO: 33755 - protein, 9 aa, Homo Sapiens
KLCNNPPPA

SEQ ID NO: 33756 - protein, 9 aa, Homo Sapiens
LHWVLVEDA

SEQ ID NO: 33757 - protein, 9 aa, Homo Sapiens
GERHLYVIK

SEQ ID NO: 33758 - protein, 9 aa, Homo Sapiens
KKQREARDS

SEQ ID NO: 33759 - protein, 9 aa, Homo Sapiens
DEFHCDSYC

SEQ ID NO: 33760 - protein, 9 aa, Homo Sapiens
LFGLGFAFP

SEQ ID NO: 33761 - protein, 9 aa, Homo Sapiens
RERPHTCPE

SEQ ID NO: 33762 - protein, 9 aa, Homo Sapiens
FEVDRRELV

SEQ ID NO: 33763 - protein, 9 aa, Homo Sapiens
SRRPAATRQ

SEQ ID NO: 33764 - protein, 9 aa, Homo Sapiens
GGVRKPHRY

SEQ ID NO: 33765 - protein, 9 aa, Homo Sapiens
SMEVQPVTE

SEQ ID NO: 33766 - protein, 9 aa, Homo Sapiens
RPMEARDWR

SEQ ID NO: 33767 - protein, 9 aa, Homo Sapiens
CRKPDVSQG

SEQ ID NO: 33768 - protein, 9 aa, Homo Sapiens
MTEMNELLT

SEQ ID NO: 33769 - protein, 9 aa, Homo Sapiens
YCSWNQFAC

SEQ ID NO: 33770 - protein, 9 aa, Homo Sapiens
RAASPGLRR

SEQ ID NO: 33771 - protein, 9 aa, Homo Sapiens
AERPRRCGR

SEQ ID NO: 33772 - protein, 9 aa, Homo Sapiens
LLSSFSLFS

SEQ ID NO: 33773 - protein, 9 aa, Homo Sapiens
RRQTLSFNE

SEQ ID NO: 33774 - protein, 9 aa, Homo Sapiens
GCPSRLPRL

SEQ ID NO: 33775 - protein, 9 aa, Homo Sapiens
RPHTCPECG

SEQ ID NO: 33776 - protein, 9 aa, Homo Sapiens
ESGDEAAIK

SEQ ID NO: 33777 - protein, 9 aa, Homo Sapiens
GPGGCPGRP

SEQ ID NO: 33778 - protein, 9 aa, Homo Sapiens
VQPVTEELL

SEQ ID NO: 33779 - protein, 9 aa, Homo Sapiens
CASLFGLGF

SEQ ID NO: 33780 - protein, 9 aa, Homo Sapiens
NSRGETGLL

SEQ ID NO: 33781 - protein, 9 aa, Homo Sapiens
HLQSTKDSY

SEQ ID NO: 33782 - protein, 9 aa, Homo Sapiens
CEEHVQPET

SEQ ID NO: 33783 - protein, 9 aa, Homo Sapiens
SLFGLGFAF

SEQ ID NO: 33784 - protein, 9 aa, Homo Sapiens
GVPSEGDST

SEQ ID NO: 33785 - protein, 9 aa, Homo Sapiens
MPDSRRENE

SEQ ID NO: 33786 - protein, 9 aa, Homo Sapiens
DRRELVEVS

SEQ ID NO: 33787 - protein, 9 aa, Homo Sapiens
TEDFFKLEW

SEQ ID NO: 33788 - protein, 9 aa, Homo Sapiens
GKTIQSVTF

SEQ ID NO: 33789 - protein, 9 aa, Homo Sapiens
VTCMVIFAP

SEQ ID NO: 33790 - protein, 9 aa, Homo Sapiens
RFLVEFEGA

SEQ ID NO: 33791 - protein, 9 aa, Homo Sapiens
CQILTRRLD

SEQ ID NO: 33792 - protein, 9 aa, Homo Sapiens
EFEGARSTG

SEQ ID NO: 33793 - protein, 9 aa, Homo Sapiens
NLNTLMTEM

SEQ ID NO: 33794 - protein, 9 aa, Homo Sapiens
EWDMKINCS

SEQ ID NO: 33795 - protein, 9 aa, Homo Sapiens
ASTPKRPSA

SEQ ID NO: 33796 - protein, 9 aa, Homo Sapiens
DLFNLPNDR

SEQ ID NO: 33797 - protein, 9 aa, Homo Sapiens
HTCPECGKS

SEQ ID NO: 33798 - protein, 9 aa, Homo Sapiens
PHLDSRGEV

SEQ ID NO: 33799 - protein, 9 aa, Homo Sapiens
SRMYASEED

SEQ ID NO: 33800 - protein, 9 aa, Homo Sapiens
RIKEEEPNP

SEQ ID NO: 33801 - protein, 9 aa, Homo Sapiens
ARSTGTFGL

SEQ ID NO: 33802 - protein, 9 aa, Homo Sapiens
VLPTVTNAV

SEQ ID NO: 33803 - protein, 9 aa, Homo Sapiens
EKLEEKAKA

SEQ ID NO: 33804 - protein, 9 aa, Homo Sapiens
DNENFILKH

SEQ ID NO: 33805 - protein, 9 aa, Homo Sapiens
KEIKRQEAM

SEQ ID NO: 33806 - protein, 9 aa, Homo Sapiens
AMFELSQGE

SEQ ID NO: 33807 - protein, 9 aa, Homo Sapiens
KAKYLKRYL

SEQ ID NO: 33808 - protein, 9 aa, Homo Sapiens
CQQLEKRLE

SEQ ID NO: 33809 - protein, 9 aa, Homo Sapiens
FLVEFEGAR

SEQ ID NO: 33810 - protein, 9 aa, Homo Sapiens
LETGKSRVL

SEQ ID NO: 33811 - protein, 9 aa, Homo Sapiens
LSIPSGFGN

SEQ ID NO: 33812 - protein, 9 aa, Homo Sapiens
EYRAASPGL

SEQ ID NO: 33813 - protein, 9 aa, Homo Sapiens
VFQVELSHS

SEQ ID NO: 33814 - protein, 9 aa, Homo Sapiens
CSLASDRSQ

SEQ ID NO: 33815 - protein, 9 aa, Homo Sapiens
DSRGEVTKE

SEQ ID NO: 33816 - protein, 9 aa, Homo Sapiens
STPHRSPHC

SEQ ID NO: 33817 - protein, 9 aa, Homo Sapiens
RYIVTCMVI

SEQ ID NO: 33818 - protein, 9 aa, Homo Sapiens
PLSKAKYLK

SEQ ID NO: 33819 - protein, 9 aa, Homo Sapiens
HQSTFAHQA

SEQ ID NO: 33820 - protein, 9 aa, Homo Sapiens
PKSFPLYPQ

SEQ ID NO: 33821 - protein, 9 aa, Homo Sapiens
KEVKHQEQH

SEQ ID NO: 33822 - protein, 9 aa, Homo Sapiens
SQGEMVSGF

SEQ ID NO: 33823 - protein, 9 aa, Homo Sapiens
QSVTFLYEI

SEQ ID NO: 33824 - protein, 9 aa, Homo Sapiens
GRPPALAGP

SEQ ID NO: 33825 - protein, 9 aa, Homo Sapiens
SRGETGLLP

SEQ ID NO: 33826 - protein, 9 aa, Homo Sapiens
TIQSVTFLY

SEQ ID NO: 33827 - protein, 9 aa, Homo Sapiens
TLCEEHVQP

SEQ ID NO: 33828 - protein, 9 aa, Homo Sapiens
GAERPRRCG

SEQ ID NO: 33829 - protein, 9 aa, Homo Sapiens
AAAALAAKA

SEQ ID NO: 33830 - protein, 9 aa, Homo Sapiens
YGKKFDNEN

SEQ ID NO: 33831 - protein, 9 aa, Homo Sapiens
SSVMPDSRR

SEQ ID NO: 33832 - protein, 9 aa, Homo Sapiens
GLPEEGSGS

SEQ ID NO: 33833 - protein, 9 aa, Homo Sapiens
SRVLPTVTN

SEQ ID NO: 33834 - protein, 9 aa, Homo Sapiens
RQVAQLHWV

SEQ ID NO: 33835 - protein, 9 aa, Homo Sapiens
SISVTCISM

SEQ ID NO: 33836 - protein, 9 aa, Homo Sapiens
SNDCGNILP

SEQ ID NO: 33837 - protein, 9 aa, Homo Sapiens
SFPSPFIEG

SEQ ID NO: 33838 - protein, 9 aa, Homo Sapiens
PSGFGNKKS

SEQ ID NO: 33839 - protein, 9 aa, Homo Sapiens
DAFLRGSGA

SEQ ID NO: 33840 - protein, 9 aa, Homo Sapiens
SKAKYLKRY

SEQ ID NO: 33841 - protein, 9 aa, Homo Sapiens
ICITACSAF

SEQ ID NO: 33842 - protein, 9 aa, Homo Sapiens
APPLSKAKY

SEQ ID NO: 33843 - protein, 9 aa, Homo Sapiens
EAAIKRHRV

SEQ ID NO: 33844 - protein, 9 aa, Homo Sapiens
EMLSSVMPD

SEQ ID NO: 33845 - protein, 9 aa, Homo Sapiens
PASTPHRSP

SEQ ID NO: 33846 - protein, 9 aa, Homo Sapiens
STLCEEHVQ

SEQ ID NO: 33847 - protein, 9 aa, Homo Sapiens
QNGHLISGS

SEQ ID NO: 33848 - protein, 9 aa, Homo Sapiens
AHQALEAKL

SEQ ID NO: 33849 - protein, 9 aa, Homo Sapiens
SLASDRSQP

SEQ ID NO: 33850 - protein, 9 aa, Homo Sapiens
KLSFFGHAH

SEQ ID NO: 33851 - protein, 9 aa, Homo Sapiens
HLYVIKVSR

SEQ ID NO: 33852 - protein, 9 aa, Homo Sapiens
RWFEVDRRE

SEQ ID NO: 33853 - protein, 9 aa, Homo Sapiens
PSHIPVDLP

SEQ ID NO: 33854 - protein, 9 aa, Homo Sapiens
DIPELLSSF

SEQ ID NO: 33855 - protein, 9 aa, Homo Sapiens
QYRSWCQQL

SEQ ID NO: 33856 - protein, 9 aa, Homo Sapiens
VSQGEMVSG

SEQ ID NO: 33857 - protein, 9 aa, Homo Sapiens
QIDRRQTLS

SEQ ID NO: 33858 - protein, 9 aa, Homo Sapiens
FHCDSYCSW

SEQ ID NO: 33859 - protein, 9 aa, Homo Sapiens
RLPRLGCAS

SEQ ID NO: 33860 - protein, 9 aa, Homo Sapiens
FLRHPLFGH

SEQ ID NO: 33861 - protein, 9 aa, Homo Sapiens
PDVSQGEMV

SEQ ID NO: 33862 - protein, 9 aa, Homo Sapiens
PSTGGVRKP

SEQ ID NO: 33863 - protein, 9 aa, Homo Sapiens
GLRRPKSPK

SEQ ID NO: 33864 - protein, 9 aa, Homo Sapiens
TGLLPASYV

SEQ ID NO: 33865 - protein, 9 aa, Homo Sapiens
KQREARDSL

SEQ ID NO: 33866 - protein, 9 aa, Homo Sapiens
NYYRNPDAE

SEQ ID NO: 33867 - protein, 9 aa, Homo Sapiens
RKPDVSQGE

SEQ ID NO: 33868 - protein, 9 aa, Homo Sapiens
PFSAEMAGL

SEQ ID NO: 33869 - protein, 9 aa, Homo Sapiens
HRSQQPQAL

SEQ ID NO: 33870 - protein, 9 aa, Homo Sapiens
GKLERQKKN

SEQ ID NO: 33871 - protein, 9 aa, Homo Sapiens
GVGLNTTIV

SEQ ID NO: 33872 - protein, 9 aa, Homo Sapiens
VDRRELVEV

SEQ ID NO: 33873 - protein, 9 aa, Homo Sapiens
GCPGRPPAL

SEQ ID NO: 33874 - protein, 9 aa, Homo Sapiens
PHRSPHCQA

SEQ ID NO: 33875 - protein, 9 aa, Homo Sapiens
PSPFIEGNH

SEQ ID NO: 33876 - protein, 9 aa, Homo Sapiens
SPRKGGHPS

SEQ ID NO: 33877 - protein, 9 aa, Homo Sapiens
PLFGHNVPL

SEQ ID NO: 33878 - protein, 9 aa, Homo Sapiens
LVEFEGARS

SEQ ID NO: 33879 - protein, 9 aa, Homo Sapiens
PGLRRPKSP

SEQ ID NO: 33880 - protein, 9 aa, Homo Sapiens
LGLLGCPSR

SEQ ID NO: 33881 - protein, 9 aa, Homo Sapiens
GNLNTLMTE

SEQ ID NO: 33882 - protein, 9 aa, Homo Sapiens
NLHLSKKQR

SEQ ID NO: 33883 - protein, 9 aa, Homo Sapiens
TGTFGLHQS

SEQ ID NO: 33884 - protein, 9 aa, Homo Sapiens
EGKLERQKK

SEQ ID NO: 33885 - protein, 9 aa, Homo Sapiens
KYIDITRPK

SEQ ID NO: 33886 - protein, 9 aa, Homo Sapiens
DTGCQILTR

SEQ ID NO: 33887 - protein, 9 aa, Homo Sapiens
SRERPHTCP

SEQ ID NO: 33888 - protein, 9 aa, Homo Sapiens
LEAKLDTAV

SEQ ID NO: 33889 - protein, 9 aa, Homo Sapiens
TFGLHQSTF

SEQ ID NO: 33890 - protein, 9 aa, Homo Sapiens
YIDITRPKE

SEQ ID NO: 33891 - protein, 9 aa, Homo Sapiens
SKKQREARD

SEQ ID NO: 33892 - protein, 9 aa, Homo Sapiens
VLVEDAAAR

SEQ ID NO: 33893 - protein, 9 aa, Homo Sapiens
EVQPVTEEL

SEQ ID NO: 33894 - protein, 9 aa, Homo Sapiens
ERPRRCGRL

SEQ ID NO: 33895 - protein, 9 aa, Homo Sapiens
INYFQTNNF

SEQ ID NO: 33896 - protein, 9 aa, Homo Sapiens
SGERHLYVI

SEQ ID NO: 33897 - protein, 9 aa, Homo Sapiens
FKLEWDMKI

SEQ ID NO: 33898 - protein, 9 aa, Homo Sapiens
DTAVVFFLH

SEQ ID NO: 33899 - protein, 9 aa, Homo Sapiens
VQTIRACSM

SEQ ID NO: 33900 - protein, 9 aa, Homo Sapiens
LLVTDTGCQ

SEQ ID NO: 33901 - protein, 9 aa, Homo Sapiens
PNNYTLQYW

SEQ ID NO: 33902 - protein, 9 aa, Homo Sapiens
RRCGRLWDS

SEQ ID NO: 33903 - protein, 9 aa, Homo Sapiens
QFMLPHPED

SEQ ID NO: 33904 - protein, 9 aa, Homo Sapiens
GISRWFEVD

SEQ ID NO: 33905 - protein, 9 aa, Homo Sapiens
LTRNYYRNP

SEQ ID NO: 33906 - protein, 9 aa, Homo Sapiens
EKAKAKGTF

SEQ ID NO: 33907 - protein, 9 aa, Homo Sapiens
LCEEHVQPE

SEQ ID NO: 33908 - protein, 9 aa, Homo Sapiens
FLHRSQQPQ

SEQ ID NO: 33909 - protein, 9 aa, Homo Sapiens
GSGPGGCPG

SEQ ID NO: 33910 - protein, 9 aa, Homo Sapiens
TPHRSPHCQ

SEQ ID NO: 33911 - protein, 9 aa, Homo Sapiens
SVTFLYEIL

SEQ ID NO: 33912 - protein, 9 aa, Homo Sapiens
ASQTVSTPA

SEQ ID NO: 33913 - protein, 9 aa, Homo Sapiens
ETGKSRVLP

SEQ ID NO: 33914 - protein, 9 aa, Homo Sapiens
LYSLEQLLI

SEQ ID NO: 33915 - protein, 9 aa, Homo Sapiens
RAKLCNNPP

SEQ ID NO: 33916 - protein, 9 aa, Homo Sapiens
HNVPLSSGS

SEQ ID NO: 33917 - protein, 9 aa, Homo Sapiens
GKSRVLPTV

SEQ ID NO: 33918 - protein, 9 aa, Homo Sapiens
SIPSGFGNK

SEQ ID NO: 33919 - protein, 9 aa, Homo Sapiens
TCPECGKSF

SEQ ID NO: 33920 - protein, 9 aa, Homo Sapiens
EVDRRELVE

SEQ ID NO: 33921 - protein, 9 aa, Homo Sapiens
AERWESRMY

SEQ ID NO: 33922 - protein, 9 aa, Homo Sapiens
RKGGHPSAV

SEQ ID NO: 33923 - protein, 9 aa, Homo Sapiens
EEKLEEKAK

SEQ ID NO: 33924 - protein, 9 aa, Homo Sapiens
FPGSRFLVE

SEQ ID NO: 33925 - protein, 9 aa, Homo Sapiens
SIYGKKFDN

SEQ ID NO: 33926 - protein, 9 aa, Homo Sapiens
SYCSWNQFA

SEQ ID NO: 33927 - protein, 9 aa, Homo Sapiens
STPKRPSAS

SEQ ID NO: 33928 - protein, 9 aa, Homo Sapiens
YRAASPGLR

SEQ ID NO: 33929 - protein, 9 aa, Homo Sapiens
DSTSEVQKA

SEQ ID NO: 33930 - protein, 9 aa, Homo Sapiens
TRNYYRNPD

SEQ ID NO: 33931 - protein, 9 aa, Homo Sapiens
NENFILKHT

SEQ ID NO: 33932 - protein, 9 aa, Homo Sapiens
LPASYVEIV

SEQ ID NO: 33933 - protein, 9 aa, Homo Sapiens
PNPEEWQLS

SEQ ID NO: 33934 - protein, 9 aa, Homo Sapiens
NSNDCGNIL

SEQ ID NO: 33935 - protein, 9 aa, Homo Sapiens
GFAFPGSRF

SEQ ID NO: 33936 - protein, 9 aa, Homo Sapiens
PMEARDWRQ

SEQ ID NO: 33937 - protein, 9 aa, Homo Sapiens
TKFPIVNAK

SEQ ID NO: 33938 - protein, 9 aa, Homo Sapiens
DLIFQNGHL

SEQ ID NO: 33939 - protein, 9 aa, Homo Sapiens
YSINHDPSH

SEQ ID NO: 33940 - protein, 9 aa, Homo Sapiens
PRKGGHPSA

SEQ ID NO: 33941 - protein, 9 aa, Homo Sapiens
IQSVTFLYE

SEQ ID NO: 33942 - protein, 9 aa, Homo Sapiens
NYTLQYWKD

SEQ ID NO: 33943 - protein, 9 aa, Homo Sapiens
PRLGCASLF

SEQ ID NO: 33944 - protein, 9 aa, Homo Sapiens
ARCASIVTT

SEQ ID NO: 33945 - protein, 9 aa, Homo Sapiens
RSTGTFGLH

SEQ ID NO: 33946 - protein, 9 aa, Homo Sapiens
TLPENPNNY

SEQ ID NO: 33947 - protein, 9 aa, Homo Sapiens
LLGNSATIW

SEQ ID NO: 33948 - protein, 9 aa, Homo Sapiens
NVVFQVELS

SEQ ID NO: 33949 - protein, 9 aa, Homo Sapiens
GLLGCPSRL

SEQ ID NO: 33950 - protein, 9 aa, Homo Sapiens
VMPDSRREN

SEQ ID NO: 33951 - protein, 9 aa, Homo Sapiens
QEAMFELSQ

SEQ ID NO: 33952 - protein, 9 aa, Homo Sapiens
IKRHRVHLR

SEQ ID NO: 33953 - protein, 9 aa, Homo Sapiens
RPRRCGRLW

SEQ ID NO: 33954 - protein, 9 aa, Homo Sapiens
NTLMTEMNE

SEQ ID NO: 33955 - protein, 9 aa, Homo Sapiens
LNTLMTEMN

SEQ ID NO: 33956 - protein, 9 aa, Homo Sapiens
QTRAKLCNN

SEQ ID NO: 33957 - protein, 9 aa, Homo Sapiens
SASQTVSTP

SEQ ID NO: 33958 - protein, 9 aa, Homo Sapiens
FPLYPQPVT

SEQ ID NO: 33959 - protein, 9 aa, Homo Sapiens
LQYRSWCQQ

SEQ ID NO: 33960 - protein, 9 aa, Homo Sapiens
LGNSATIWV

SEQ ID NO: 33961 - protein, 9 aa, Homo Sapiens
FPIVNAKLS

SEQ ID NO: 33962 - protein, 9 aa, Homo Sapiens
STKFHYINY

SEQ ID NO: 33963 - protein, 9 aa, Homo Sapiens
GSGASHLLG

SEQ ID NO: 33964 - protein, 9 aa, Homo Sapiens
HNGLMTSVS

SEQ ID NO: 33965 - protein, 9 aa, Homo Sapiens
FFLHRSQQP

SEQ ID NO: 33966 - protein, 9 aa, Homo Sapiens
PEYRAASPG

SEQ ID NO: 33967 - protein, 9 aa, Homo Sapiens
LGCPSRLPR

SEQ ID NO: 33968 - protein, 9 aa, Homo Sapiens
FPSPFIEGN

SEQ ID NO: 33969 - protein, 9 aa, Homo Sapiens
NPDQFMLPH

SEQ ID NO: 33970 - protein, 9 aa, Homo Sapiens
LFDAFLRGS

SEQ ID NO: 33971 - protein, 9 aa, Homo Sapiens
LSSYIRVLF

SEQ ID NO: 33972 - protein, 9 aa, Homo Sapiens
GLTRNYYRN

SEQ ID NO: 33973 - protein, 9 aa, Homo Sapiens
LFNLPNDRP

SEQ ID NO: 33974 - protein, 9 aa, Homo Sapiens
VHAHLQSTK

SEQ ID NO: 33975 - protein, 9 aa, Homo Sapiens
VTEELLKQQ

SEQ ID NO: 33976 - protein, 9 aa, Homo Sapiens
QSTFAHQAL

SEQ ID NO: 33977 - protein, 9 aa, Homo Sapiens
PNDRPYFKR

SEQ ID NO: 33978 - protein, 9 aa, Homo Sapiens
WVLVEDAAA

SEQ ID NO: 33979 - protein, 9 aa, Homo Sapiens
RQTLSFNEQ

SEQ ID NO: 33980 - protein, 9 aa, Homo Sapiens
LSKAKYLKR

SEQ ID NO: 33981 - protein, 9 aa, Homo Sapiens
NGHLISGSL

SEQ ID NO: 33982 - protein, 9 aa, Homo Sapiens
NPNNYTLQY

SEQ ID NO: 33983 - protein, 9 aa, Homo Sapiens
KTIQSVTFL

SEQ ID NO: 33984 - protein, 9 aa, Homo Sapiens
TLMTEMNEL

SEQ ID NO: 33985 - protein, 9 aa, Homo Sapiens
SATIWVTQV

SEQ ID NO: 33986 - protein, 9 aa, Homo Sapiens
QILTRRLDS

SEQ ID NO: 33987 - protein, 9 aa, Homo Sapiens
TDTGCQILT

SEQ ID NO: 33988 - protein, 9 aa, Homo Sapiens
IDITRPKEV

SEQ ID NO: 33989 - protein, 9 aa, Homo Sapiens
QPPKSFPLY

SEQ ID NO: 33990 - protein, 9 aa, Homo Sapiens
SLGAARCAS

SEQ ID NO: 33991 - protein, 9 aa, Homo Sapiens
ERPHTCPEC

SEQ ID NO: 33992 - protein, 9 aa, Homo Sapiens
TSVSRRPAA

SEQ ID NO: 33993 - protein, 9 aa, Homo Sapiens
HPLFGHNVP

SEQ ID NO: 33994 - protein, 9 aa, Homo Sapiens
TKFHYINYF

SEQ ID NO: 33995 - protein, 9 aa, Homo Sapiens
RFCVSISVT

SEQ ID NO: 33996 - protein, 9 aa, Homo Sapiens
SDNNNSNDC

SEQ ID NO: 33997 - protein, 9 aa, Homo Sapiens
EEPNPEEWQ

SEQ ID NO: 33998 - protein, 9 aa, Homo Sapiens
YIVTCMVIF

SEQ ID NO: 33999 - protein, 9 aa, Homo Sapiens
AKYLKRYLS

SEQ ID NO: 34000 - protein, 9 aa, Homo Sapiens
GLSRPFSAE

SEQ ID NO: 34001 - protein, 9 aa, Homo Sapiens
SRFLVEFEG

SEQ ID NO: 34002 - protein, 9 aa, Homo Sapiens
SAFRAHAQK

SEQ ID NO: 34003 - protein, 9 aa, Homo Sapiens
TLREQGLPE

SEQ ID NO: 34004 - protein, 9 aa, Homo Sapiens
TAVVFFLHR

SEQ ID NO: 34005 - protein, 9 aa, Homo Sapiens
SVMPDSRRE

SEQ ID NO: 34006 - protein, 9 aa, Homo Sapiens
LDTAVVFFL

SEQ ID NO: 34007 - protein, 9 aa, Homo Sapiens
FDAFLRGSG

SEQ ID NO: 34008 - protein, 9 aa, Homo Sapiens
FHYINYFQT

SEQ ID NO: 34009 - protein, 9 aa, Homo Sapiens
EPNPEEWQL

SEQ ID NO: 34010 - protein, 9 aa, Homo Sapiens
LIFQNGHLI

SEQ ID NO: 34011 - protein, 9 aa, Homo Sapiens
NEGKLERQK

SEQ ID NO: 34012 - protein, 9 aa, Homo Sapiens
RGSGASHLL

SEQ ID NO: 34013 - protein, 9 aa, Homo Sapiens
EDFFKLEWD

SEQ ID NO: 34014 - protein, 9 aa, Homo Sapiens
DSYCSWNQF

SEQ ID NO: 34015 - protein, 9 aa, Homo Sapiens
KPDVSQGEM

SEQ ID NO: 34016 - protein, 9 aa, Homo Sapiens
AHASTSDPW

SEQ ID NO: 34017 - protein, 9 aa, Homo Sapiens
LFGHNVPLS

SEQ ID NO: 34018 - protein, 9 aa, Homo Sapiens
RSQPDLVYK

SEQ ID NO: 34019 - protein, 9 aa, Homo Sapiens
EQGLPEEGS

SEQ ID NO: 34020 - protein, 9 aa, Homo Sapiens
GPMGPRGPR

SEQ ID NO: 34021 - protein, 9 aa, Homo Sapiens
LLPASYVEI

SEQ ID NO: 34022 - protein, 9 aa, Homo Sapiens
GHNVPLSSG

SEQ ID NO: 34023 - protein, 9 aa, Homo Sapiens
VPFLLILSS

SEQ ID NO: 34024 - protein, 9 aa, Homo Sapiens
SPFIEGNHS

SEQ ID NO: 34025 - protein, 9 aa, Homo Sapiens
MEVQPVTEE

SEQ ID NO: 34026 - protein, 9 aa, Homo Sapiens
KLDTAVVFF

SEQ ID NO: 34027 - protein, 9 aa, Homo Sapiens
IVTPNGNED

SEQ ID NO: 34028 - protein, 9 aa, Homo Sapiens
GCQILTRRL

SEQ ID NO: 34029 - protein, 9 aa, Homo Sapiens
LRHPLFGHN

SEQ ID NO: 34030 - protein, 9 aa, Homo Sapiens
AAALAAKAG

SEQ ID NO: 34031 - protein, 9 aa, Homo Sapiens
ACSAFRAHA

SEQ ID NO: 34032 - protein, 9 aa, Homo Sapiens
EEEKLEEKA

SEQ ID NO: 34033 - protein, 9 aa, Homo Sapiens
RVLPTVTNA

SEQ ID NO: 34034 - protein, 9 aa, Homo Sapiens
IPSGFGNKK

SEQ ID NO: 34035 - protein, 9 aa, Homo Sapiens
EEFNPDQFM

SEQ ID NO: 34036 - protein, 9 aa, Homo Sapiens
DSDNNNSND

SEQ ID NO: 34037 - protein, 9 aa, Homo Sapiens
EFNPDQFML

SEQ ID NO: 34038 - protein, 9 aa, Homo Sapiens
EMLSIPSGF

SEQ ID NO: 34039 - protein, 9 aa, Homo Sapiens
MGPRGPRGP

SEQ ID NO: 34040 - protein, 9 aa, Homo Sapiens
PEVQTIRAC

SEQ ID NO: 34041 - protein, 9 aa, Homo Sapiens
AAHASTSDP

SEQ ID NO: 34042 - protein, 9 aa, Homo Sapiens
DNGKENSLL

SEQ ID NO: 34043 - protein, 9 aa, Homo Sapiens
NDCGNILPS

SEQ ID NO: 34044 - protein, 9 aa, Homo Sapiens
GLLPASYVE

SEQ ID NO: 34045 - protein, 9 aa, Homo Sapiens
PFLLILSSY

SEQ ID NO: 34046 - protein, 9 aa, Homo Sapiens
EAMFELSQG

SEQ ID NO: 34047 - protein, 9 aa, Homo Sapiens
FAFPGSRFL

SEQ ID NO: 34048 - protein, 9 aa, Homo Sapiens
NAKLSFFGH

SEQ ID NO: 34049 - protein, 9 aa, Homo Sapiens
AASPGLRRP

SEQ ID NO: 34050 - protein, 9 aa, Homo Sapiens
TETQNVVFQ

SEQ ID NO: 34051 - protein, 9 aa, Homo Sapiens
AVVFFLHRS

SEQ ID NO: 34052 - protein, 9 aa, Homo Sapiens
LPNDRPYFK

SEQ ID NO: 34053 - protein, 9 aa, Homo Sapiens
NSATIWVTQ

SEQ ID NO: 34054 - protein, 9 aa, Homo Sapiens
PLYPQPVTI

SEQ ID NO: 34055 - protein, 9 aa, Homo Sapiens
KKLYSLEQL

SEQ ID NO: 34056 - protein, 9 aa, Homo Sapiens
VSLGAARCA

SEQ ID NO: 34057 - protein, 9 aa, Homo Sapiens
ASLFGLGFA

SEQ ID NO: 34058 - protein, 9 aa, Homo Sapiens
MLSSVMPDS

SEQ ID NO: 34059 - protein, 9 aa, Homo Sapiens
PICITACSA

SEQ ID NO: 34060 - protein, 9 aa, Homo Sapiens
YINYFQTNN

SEQ ID NO: 34061 - protein, 9 aa, Homo Sapiens
KRQEAMFEL

SEQ ID NO: 34062 - protein, 9 aa, Homo Sapiens
QTLSFNEQE

SEQ ID NO: 34063 - protein, 9 aa, Homo Sapiens
PVNSFPSPF

SEQ ID NO: 34064 - protein, 9 aa, Homo Sapiens
ASIVTTGLG

SEQ ID NO: 34065 - protein, 9 aa, Homo Sapiens
VIKKKLYSL

SEQ ID NO: 34066 - protein, 9 aa, Homo Sapiens
SDSDNNNSN

SEQ ID NO: 34067 - protein, 9 aa, Homo Sapiens
GPRGPRGPP

SEQ ID NO: 34068 - protein, 9 aa, Homo Sapiens
IYGKKFDNE

SEQ ID NO: 34069 - protein, 9 aa, Homo Sapiens
LERQKKNQK

SEQ ID NO: 34070 - protein, 9 aa, Homo Sapiens
TGKSRVLPT

SEQ ID NO: 34071 - protein, 9 aa, Homo Sapiens
FDNENFILK

SEQ ID NO: 34072 - protein, 9 aa, Homo Sapiens
AFPGSRFLV

SEQ ID NO: 34073 - protein, 9 aa, Homo Sapiens
IDRRQTLSF

SEQ ID NO: 34074 - protein, 9 aa, Homo Sapiens
FLLILSSYI

SEQ ID NO: 34075 - protein, 9 aa, Homo Sapiens
TPVNSFPSP

SEQ ID NO: 34076 - protein, 9 aa, Homo Sapiens
PGGCPGRPP

SEQ ID NO: 34077 - protein, 9 aa, Homo Sapiens
KRHRVHLRS

SEQ ID NO: 34078 - protein, 9 aa, Homo Sapiens
RWESRMYAS

SEQ ID NO: 34079 - protein, 9 aa, Homo Sapiens
NTTIVTPNG

SEQ ID NO: 34080 - protein, 9 aa, Homo Sapiens
DRRQTLSFN

SEQ ID NO: 34081 - protein, 9 aa, Homo Sapiens
LILSSYIRV

SEQ ID NO: 34082 - protein, 9 aa, Homo Sapiens
VTDTGCQIL

SEQ ID NO: 34083 - protein, 9 aa, Homo Sapiens
GETGLLPAS

SEQ ID NO: 34084 - protein, 9 aa, Homo Sapiens
TLPEVQTIR

SEQ ID NO: 34085 - protein, 9 aa, Homo Sapiens
KKFDNENFI

SEQ ID NO: 34086 - protein, 9 aa, Homo Sapiens
AKLSFFGHA

SEQ ID NO: 34087 - protein, 9 aa, Homo Sapiens
SHLLGLLGC

SEQ ID NO: 34088 - protein, 9 aa, Homo Sapiens
NPWGGPAAH

SEQ ID NO: 34089 - protein, 9 aa, Homo Sapiens
AAPPLSKAK

SEQ ID NO: 34090 - protein, 9 aa, Homo Sapiens
RNTLREQGL

SEQ ID NO: 34091 - protein, 9 aa, Homo Sapiens
SINHDPSHI

SEQ ID NO: 34092 - protein, 9 aa, Homo Sapiens
HLSKKQREA

SEQ ID NO: 34093 - protein, 9 aa, Homo Sapiens
LEEKAKAKG

SEQ ID NO: 34094 - protein, 9 aa, Homo Sapiens
QSTKDSYSA

SEQ ID NO: 34095 - protein, 9 aa, Homo Sapiens
TPASTPHRS

SEQ ID NO: 34096 - protein, 9 aa, Homo Sapiens
TSMEVQPVT

SEQ ID NO: 34097 - protein, 9 aa, Homo Sapiens
LLGLLGCPS

SEQ ID NO: 34098 - protein, 9 aa, Homo Sapiens
LAAKAGMVA

SEQ ID NO: 34099 - protein, 9 aa, Homo Sapiens
FGLHQSTFA

SEQ ID NO: 34100 - protein, 9 aa, Homo Sapiens
KSRVLPTVT

SEQ ID NO: 34101 - protein, 9 aa, Homo Sapiens
EKLCNKEEA

SEQ ID NO: 34102 - protein, 9 aa, Homo Sapiens
ALYFSNMRK

SEQ ID NO: 34103 - protein, 9 aa, Homo Sapiens
LLPQQVHSE

SEQ ID NO: 34104 - protein, 9 aa, Homo Sapiens
LIRARYISG

SEQ ID NO: 34105 - protein, 9 aa, Homo Sapiens
QDQYPPFRV

SEQ ID NO: 34106 - protein, 9 aa, Homo Sapiens
EQEICRLKS

SEQ ID NO: 34107 - protein, 9 aa, Homo Sapiens
PSPPAPAAA

SEQ ID NO: 34108 - protein, 9 aa, Homo Sapiens
DRGNRAFPS

SEQ ID NO: 34109 - protein, 9 aa, Homo Sapiens
RAFPSRARG

SEQ ID NO: 34110 - protein, 9 aa, Homo Sapiens
KPCTNVKKS

SEQ ID NO: 34111 - protein, 9 aa, Homo Sapiens
HLFPLLPRD

SEQ ID NO: 34112 - protein, 9 aa, Homo Sapiens
STQLENKDV

SEQ ID NO: 34113 - protein, 9 aa, Homo Sapiens
TNSFSTLTV

SEQ ID NO: 34114 - protein, 9 aa, Homo Sapiens
VYSSAQDPN

SEQ ID NO: 34115 - protein, 9 aa, Homo Sapiens
PPPPTTVGD

SEQ ID NO: 34116 - protein, 9 aa, Homo Sapiens
NPDEEQRNV

SEQ ID NO: 34117 - protein, 9 aa, Homo Sapiens
HQRMLSAYQ

SEQ ID NO: 34118 - protein, 9 aa, Homo Sapiens
SELAKVPAA

SEQ ID NO: 34119 - protein, 9 aa, Homo Sapiens
AVQPSLPLP

SEQ ID NO: 34120 - protein, 9 aa, Homo Sapiens
DKIFTLGNS

SEQ ID NO: 34121 - protein, 9 aa, Homo Sapiens
YLILHEAQN

SEQ ID NO: 34122 - protein, 9 aa, Homo Sapiens
PVADVLIEI

SEQ ID NO: 34123 - protein, 9 aa, Homo Sapiens
QALYFSNMR

SEQ ID NO: 34124 - protein, 9 aa, Homo Sapiens
PTSRSGGPT

SEQ ID NO: 34125 - protein, 9 aa, Homo Sapiens
DAESQPTPM

SEQ ID NO: 34126 - protein, 9 aa, Homo Sapiens
YGFTFLLGG

SEQ ID NO: 34127 - protein, 9 aa, Homo Sapiens
QVCINLRGY

SEQ ID NO: 34128 - protein, 9 aa, Homo Sapiens
DRNAYRDSM

SEQ ID NO: 34129 - protein, 9 aa, Homo Sapiens
KDTAPGIIV

SEQ ID NO: 34130 - protein, 9 aa, Homo Sapiens
VEEYVKTPE

SEQ ID NO: 34131 - protein, 9 aa, Homo Sapiens
ACFSHSSEY

SEQ ID NO: 34132 - protein, 9 aa, Homo Sapiens
TPQVTNKGE

SEQ ID NO: 34133 - protein, 9 aa, Homo Sapiens
CHVIGTFSS

SEQ ID NO: 34134 - protein, 9 aa, Homo Sapiens
ICKSETVHS

SEQ ID NO: 34135 - protein, 9 aa, Homo Sapiens
KHAAVNKGQ

SEQ ID NO: 34136 - protein, 9 aa, Homo Sapiens
HEVALIFTG

SEQ ID NO: 34137 - protein, 9 aa, Homo Sapiens
LRANNVQLS

SEQ ID NO: 34138 - protein, 9 aa, Homo Sapiens
QQQIIYDSP

SEQ ID NO: 34139 - protein, 9 aa, Homo Sapiens
VADVLIEIF

SEQ ID NO: 34140 - protein, 9 aa, Homo Sapiens
SAVFNISLC

SEQ ID NO: 34141 - protein, 9 aa, Homo Sapiens
CMHAEIRSR

SEQ ID NO: 34142 - protein, 9 aa, Homo Sapiens
RLQETKGMV

SEQ ID NO: 34143 - protein, 9 aa, Homo Sapiens
EEASELAKV

SEQ ID NO: 34144 - protein, 9 aa, Homo Sapiens
KPIAVGSIS

SEQ ID NO: 34145 - protein, 9 aa, Homo Sapiens
HKELIVDAE

SEQ ID NO: 34146 - protein, 9 aa, Homo Sapiens
GEVMTVGIS

SEQ ID NO: 34147 - protein, 9 aa, Homo Sapiens
LRQLRFIDE

SEQ ID NO: 34148 - protein, 9 aa, Homo Sapiens
TSAEQHQRM

SEQ ID NO: 34149 - protein, 9 aa, Homo Sapiens
LPSIFTLLI

SEQ ID NO: 34150 - protein, 9 aa, Homo Sapiens
HIYFDYPSL

SEQ ID NO: 34151 - protein, 9 aa, Homo Sapiens
GSAVFNISL

SEQ ID NO: 34152 - protein, 9 aa, Homo Sapiens
PQQVHSEGR

SEQ ID NO: 34153 - protein, 9 aa, Homo Sapiens
VKSKSAKPC

SEQ ID NO: 34154 - protein, 9 aa, Homo Sapiens
ANESERGMK

SEQ ID NO: 34155 - protein, 9 aa, Homo Sapiens
DIDLAVSRE

SEQ ID NO: 34156 - protein, 9 aa, Homo Sapiens
VGDPRSLQG

SEQ ID NO: 34157 - protein, 9 aa, Homo Sapiens
KANPSFRKS

SEQ ID NO: 34158 - protein, 9 aa, Homo Sapiens
KLCNKEEAR

SEQ ID NO: 34159 - protein, 9 aa, Homo Sapiens
AERVSKANP

SEQ ID NO: 34160 - protein, 9 aa, Homo Sapiens
RYLILHEAQ

SEQ ID NO: 34161 - protein, 9 aa, Homo Sapiens
VKTPEGGSV

SEQ ID NO: 34162 - protein, 9 aa, Homo Sapiens
QLLEDFREK

SEQ ID NO: 34163 - protein, 9 aa, Homo Sapiens
IDLMHHAAH

SEQ ID NO: 34164 - protein, 9 aa, Homo Sapiens
PQALYFSNM

SEQ ID NO: 34165 - protein, 9 aa, Homo Sapiens
FTFLLGGRD

SEQ ID NO: 34166 - protein, 9 aa, Homo Sapiens
KPNPDEEQR

SEQ ID NO: 34167 - protein, 9 aa, Homo Sapiens
NRAFPSRAR

SEQ ID NO: 34168 - protein, 9 aa, Homo Sapiens
ETKGMVAVS

SEQ ID NO: 34169 - protein, 9 aa, Homo Sapiens
ADSNSSEPL

SEQ ID NO: 34170 - protein, 9 aa, Homo Sapiens
LETLCSQII

SEQ ID NO: 34171 - protein, 9 aa, Homo Sapiens
KGLGQELGA

SEQ ID NO: 34172 - protein, 9 aa, Homo Sapiens
LAKVPAAAG

SEQ ID NO: 34173 - protein, 9 aa, Homo Sapiens
IARAKLYKR

SEQ ID NO: 34174 - protein, 9 aa, Homo Sapiens
LLGDWYRRN

SEQ ID NO: 34175 - protein, 9 aa, Homo Sapiens
LERECIEKL

SEQ ID NO: 34176 - protein, 9 aa, Homo Sapiens
VFLHTQHAL

SEQ ID NO: 34177 - protein, 9 aa, Homo Sapiens
QDTPYNQNI

SEQ ID NO: 34178 - protein, 9 aa, Homo Sapiens
MHQECLPPS

SEQ ID NO: 34179 - protein, 9 aa, Homo Sapiens
ESQPTPMGP

SEQ ID NO: 34180 - protein, 9 aa, Homo Sapiens
RPAVFLHTQ

SEQ ID NO: 34181 - protein, 9 aa, Homo Sapiens
PSPQSDGRD

SEQ ID NO: 34182 - protein, 9 aa, Homo Sapiens
LPQALYFSN

SEQ ID NO: 34183 - protein, 9 aa, Homo Sapiens
KLLRANNVQ

SEQ ID NO: 34184 - protein, 9 aa, Homo Sapiens
WQSSKSVKR

SEQ ID NO: 34185 - protein, 9 aa, Homo Sapiens
NYQVDAESQ

SEQ ID NO: 34186 - protein, 9 aa, Homo Sapiens
TRPALAAPM

SEQ ID NO: 34187 - protein, 9 aa, Homo Sapiens
TEHQAVLVE

SEQ ID NO: 34188 - protein, 9 aa, Homo Sapiens
GGRDLELLP

SEQ ID NO: 34189 - protein, 9 aa, Homo Sapiens
AVGSISMLS

SEQ ID NO: 34190 - protein, 9 aa, Homo Sapiens
LGGRDLELL

SEQ ID NO: 34191 - protein, 9 aa, Homo Sapiens
ETRKRLPTL

SEQ ID NO: 34192 - protein, 9 aa, Homo Sapiens
GISAIKEIT

SEQ ID NO: 34193 - protein, 9 aa, Homo Sapiens
ADIHTTNSF

SEQ ID NO: 34194 - protein, 9 aa, Homo Sapiens
CYANEVGKA

SEQ ID NO: 34195 - protein, 9 aa, Homo Sapiens
AVLVEQKGH

SEQ ID NO: 34196 - protein, 9 aa, Homo Sapiens
ASKDTAPGI

SEQ ID NO: 34197 - protein, 9 aa, Homo Sapiens
LELLPQQVH

SEQ ID NO: 34198 - protein, 9 aa, Homo Sapiens
HLQEQKQQE

SEQ ID NO: 34199 - protein, 9 aa, Homo Sapiens
NGFFQQQII

SEQ ID NO: 34200 - protein, 9 aa, Homo Sapiens
HTTNSFSTL

SEQ ID NO: 34201 - protein, 9 aa, Homo Sapiens
QDVYNLLKT

SEQ ID NO: 34202 - protein, 9 aa, Homo Sapiens
PPTTVGDPR

SEQ ID NO: 34203 - protein, 9 aa, Homo Sapiens
GSLLGDWYR

SEQ ID NO: 34204 - protein, 9 aa, Homo Sapiens
LGDSAIDKI

SEQ ID NO: 34205 - protein, 9 aa, Homo Sapiens
YNSMKNEKL

SEQ ID NO: 34206 - protein, 9 aa, Homo Sapiens
EASELAKVP

SEQ ID NO: 34207 - protein, 9 aa, Homo Sapiens
VLQVKESLG

SEQ ID NO: 34208 - protein, 9 aa, Homo Sapiens
SLQLHHSVH

SEQ ID NO: 34209 - protein, 9 aa, Homo Sapiens
NHLETLCSQ

SEQ ID NO: 34210 - protein, 9 aa, Homo Sapiens
KLCPGLVNR

SEQ ID NO: 34211 - protein, 9 aa, Homo Sapiens
IDEEECRAL

SEQ ID NO: 34212 - protein, 9 aa, Homo Sapiens
VDMDLHDTD

SEQ ID NO: 34213 - protein, 9 aa, Homo Sapiens
LLQKLLRAN

SEQ ID NO: 34214 - protein, 9 aa, Homo Sapiens
HKKKYQQVF

SEQ ID NO: 34215 - protein, 9 aa, Homo Sapiens
SSLQLHHSV

SEQ ID NO: 34216 - protein, 9 aa, Homo Sapiens
QDIDLAVSR

SEQ ID NO: 34217 - protein, 9 aa, Homo Sapiens
LVKEQKKAK

SEQ ID NO: 34218 - protein, 9 aa, Homo Sapiens
NLLAQENRD

SEQ ID NO: 34219 - protein, 9 aa, Homo Sapiens
VQPSLPLPG

SEQ ID NO: 34220 - protein, 9 aa, Homo Sapiens
VQIIFCMHA

SEQ ID NO: 34221 - protein, 9 aa, Homo Sapiens
ISLCHWHLF

SEQ ID NO: 34222 - protein, 9 aa, Homo Sapiens
GDSAIDKIF

SEQ ID NO: 34223 - protein, 9 aa, Homo Sapiens
EAEKAANES

SEQ ID NO: 34224 - protein, 9 aa, Homo Sapiens
STHQPVADV

SEQ ID NO: 34225 - protein, 9 aa, Homo Sapiens
NNPPWGSYR

SEQ ID NO: 34226 - protein, 9 aa, Homo Sapiens
HAEIRSREE

SEQ ID NO: 34227 - protein, 9 aa, Homo Sapiens
QLRVPPPTL

SEQ ID NO: 34228 - protein, 9 aa, Homo Sapiens
PGSSASPPG

SEQ ID NO: 34229 - protein, 9 aa, Homo Sapiens
PAPAAAHTG

SEQ ID NO: 34230 - protein, 9 aa, Homo Sapiens
CNTTARAFA

SEQ ID NO: 34231 - protein, 9 aa, Homo Sapiens
FRVGTVPNG

SEQ ID NO: 34232 - protein, 9 aa, Homo Sapiens
KEKIEKQRQ

SEQ ID NO: 34233 - protein, 9 aa, Homo Sapiens
GLRAKGLGQ

SEQ ID NO: 34234 - protein, 9 aa, Homo Sapiens
KKTFGVNDY

SEQ ID NO: 34235 - protein, 9 aa, Homo Sapiens
VTLKGEPGG

SEQ ID NO: 34236 - protein, 9 aa, Homo Sapiens
DPNGRCICT

SEQ ID NO: 34237 - protein, 9 aa, Homo Sapiens
TAILAPGSS

SEQ ID NO: 34238 - protein, 9 aa, Homo Sapiens
EEQGRERDL

SEQ ID NO: 34239 - protein, 9 aa, Homo Sapiens
HTQHALQPA

SEQ ID NO: 34240 - protein, 9 aa, Homo Sapiens
HEAQNIKNF

SEQ ID NO: 34241 - protein, 9 aa, Homo Sapiens
DSTQLENKD

SEQ ID NO: 34242 - protein, 9 aa, Homo Sapiens
TFQAFQIER

SEQ ID NO: 34243 - protein, 9 aa, Homo Sapiens
LQWKPNPDE

SEQ ID NO: 34244 - protein, 9 aa, Homo Sapiens
KQVFQRFLE

SEQ ID NO: 34245 - protein, 9 aa, Homo Sapiens
SVVDMDLHD

SEQ ID NO: 34246 - protein, 9 aa, Homo Sapiens
LLANARERR

SEQ ID NO: 34247 - protein, 9 aa, Homo Sapiens
RERRRVHTI

SEQ ID NO: 34248 - protein, 9 aa, Homo Sapiens
ICRLKSIKS

SEQ ID NO: 34249 - protein, 9 aa, Homo Sapiens
KDRNAYRDS

SEQ ID NO: 34250 - protein, 9 aa, Homo Sapiens
YNLLKTNLY

SEQ ID NO: 34251 - protein, 9 aa, Homo Sapiens
NNNPPWGSY

SEQ ID NO: 34252 - protein, 9 aa, Homo Sapiens
VEQKGHLLL

SEQ ID NO: 34253 - protein, 9 aa, Homo Sapiens
CIPEADVRE

SEQ ID NO: 34254 - protein, 9 aa, Homo Sapiens
RSRKLCPGL

SEQ ID NO: 34255 - protein, 9 aa, Homo Sapiens
TEEASELAK

SEQ ID NO: 34256 - protein, 9 aa, Homo Sapiens
PAVFLHTQH

SEQ ID NO: 34257 - protein, 9 aa, Homo Sapiens
QIIYDSPPS

SEQ ID NO: 34258 - protein, 9 aa, Homo Sapiens
SPQKHIYFD

SEQ ID NO: 34259 - protein, 9 aa, Homo Sapiens
IHTTNSFST

SEQ ID NO: 34260 - protein, 9 aa, Homo Sapiens
VNDYRHWIK

SEQ ID NO: 34261 - protein, 9 aa, Homo Sapiens
LGDWYRRNQ

SEQ ID NO: 34262 - protein, 9 aa, Homo Sapiens
RLPTLSSQF

SEQ ID NO: 34263 - protein, 9 aa, Homo Sapiens
SGDTTPLPV

SEQ ID NO: 34264 - protein, 9 aa, Homo Sapiens
KSETVHSKS

SEQ ID NO: 34265 - protein, 9 aa, Homo Sapiens
ALRQYYFTI

SEQ ID NO: 34266 - protein, 9 aa, Homo Sapiens
LFTLLLPSP

SEQ ID NO: 34267 - protein, 9 aa, Homo Sapiens
VVQIIFCMH

SEQ ID NO: 34268 - protein, 9 aa, Homo Sapiens
QQTYAVQPS

SEQ ID NO: 34269 - protein, 9 aa, Homo Sapiens
TSRSGGPTR

SEQ ID NO: 34270 - protein, 9 aa, Homo Sapiens
KSKSAKPCT

SEQ ID NO: 34271 - protein, 9 aa, Homo Sapiens
VMMKGYRQR

SEQ ID NO: 34272 - protein, 9 aa, Homo Sapiens
LEFIIKNSV

SEQ ID NO: 34273 - protein, 9 aa, Homo Sapiens
IVTLKGEPG

SEQ ID NO: 34274 - protein, 9 aa, Homo Sapiens
QIERHDSCA

SEQ ID NO: 34275 - protein, 9 aa, Homo Sapiens
IEKLCNKEE

SEQ ID NO: 34276 - protein, 9 aa, Homo Sapiens
TDGSHKELI

SEQ ID NO: 34277 - protein, 9 aa, Homo Sapiens
MKNEKLEWA

SEQ ID NO: 34278 - protein, 9 aa, Homo Sapiens
THQPVADVL

SEQ ID NO: 34279 - protein, 9 aa, Homo Sapiens
IDNMDEYVC

SEQ ID NO: 34280 - protein, 9 aa, Homo Sapiens
MAMLIRARY

SEQ ID NO: 34281 - protein, 9 aa, Homo Sapiens
IFCMHAEIR

SEQ ID NO: 34282 - protein, 9 aa, Homo Sapiens
LLGDSAIDK

SEQ ID NO: 34283 - protein, 9 aa, Homo Sapiens
QDPNGRCIC

SEQ ID NO: 34284 - protein, 9 aa, Homo Sapiens
SQPTPMGPP

SEQ ID NO: 34285 - protein, 9 aa, Homo Sapiens
KAAIAGYVN

SEQ ID NO: 34286 - protein, 9 aa, Homo Sapiens
ADVREGQMQ

SEQ ID NO: 34287 - protein, 9 aa, Homo Sapiens
TVGDPRSLQ

SEQ ID NO: 34288 - protein, 9 aa, Homo Sapiens
DQYPPFRVG

SEQ ID NO: 34289 - protein, 9 aa, Homo Sapiens
ELLPQQVHS

SEQ ID NO: 34290 - protein, 9 aa, Homo Sapiens
AFQIERHDS

SEQ ID NO: 34291 - protein, 9 aa, Homo Sapiens
LVEQKGHLL

SEQ ID NO: 34292 - protein, 9 aa, Homo Sapiens
TTVGDPRSL

SEQ ID NO: 34293 - protein, 9 aa, Homo Sapiens
LLRANNVQL

SEQ ID NO: 34294 - protein, 9 aa, Homo Sapiens
QAVLVEQKG

SEQ ID NO: 34295 - protein, 9 aa, Homo Sapiens
NSMKNEKLE

SEQ ID NO: 34296 - protein, 9 aa, Homo Sapiens
ALIFTGPQS

SEQ ID NO: 34297 - protein, 9 aa, Homo Sapiens
GEPEAGASV

SEQ ID NO: 34298 - protein, 9 aa, Homo Sapiens
ICYANEVGK

SEQ ID NO: 34299 - protein, 9 aa, Homo Sapiens
QVLPQALYF

SEQ ID NO: 34300 - protein, 9 aa, Homo Sapiens
GTARQDVYN

SEQ ID NO: 34301 - protein, 9 aa, Homo Sapiens
QIIFCMHAE

SEQ ID NO: 34302 - protein, 9 aa, Homo Sapiens
CPGLVNRGL

SEQ ID NO: 34303 - protein, 9 aa, Homo Sapiens
WGSYRHHQY

SEQ ID NO: 34304 - protein, 9 aa, Homo Sapiens
RDLVPKPSV

SEQ ID NO: 34305 - protein, 9 aa, Homo Sapiens
PALAAPMGG

SEQ ID NO: 34306 - protein, 9 aa, Homo Sapiens
IKYSASVNP

SEQ ID NO: 34307 - protein, 9 aa, Homo Sapiens
PPPTLVVTA

SEQ ID NO: 34308 - protein, 9 aa, Homo Sapiens
ELRQLRFID

SEQ ID NO: 34309 - protein, 9 aa, Homo Sapiens
GSYRHHQYE

SEQ ID NO: 34310 - protein, 9 aa, Homo Sapiens
TTNSFSTLT

SEQ ID NO: 34311 - protein, 9 aa, Homo Sapiens
TITCILRDG

SEQ ID NO: 34312 - protein, 9 aa, Homo Sapiens
NLLKTNLYQ

SEQ ID NO: 34313 - protein, 9 aa, Homo Sapiens
SHSSEYHLE

SEQ ID NO: 34314 - protein, 9 aa, Homo Sapiens
PSLPLPGFE

SEQ ID NO: 34315 - protein, 9 aa, Homo Sapiens
AKVPAAAGE

SEQ ID NO: 34316 - protein, 9 aa, Homo Sapiens
IPEADVREG

SEQ ID NO: 34317 - protein, 9 aa, Homo Sapiens
LAAPMGGPE

SEQ ID NO: 34318 - protein, 9 aa, Homo Sapiens
AKLYKRQSF

SEQ ID NO: 34319 - protein, 9 aa, Homo Sapiens
FNISLCHWH

SEQ ID NO: 34320 - protein, 9 aa, Homo Sapiens
TPVMMKGYR

SEQ ID NO: 34321 - protein, 9 aa, Homo Sapiens
PGAQACFSH

SEQ ID NO: 34322 - protein, 9 aa, Homo Sapiens
DLELLPQQV

SEQ ID NO: 34323 - protein, 9 aa, Homo Sapiens
PSIFTLLII

SEQ ID NO: 34324 - protein, 9 aa, Homo Sapiens
VDCLEFIIK

SEQ ID NO: 34325 - protein, 9 aa, Homo Sapiens
EEAEKAANE

SEQ ID NO: 34326 - protein, 9 aa, Homo Sapiens
FIIKNSVTD

SEQ ID NO: 34327 - protein, 9 aa, Homo Sapiens
TPEGGSVFS

SEQ ID NO: 34328 - protein, 9 aa, Homo Sapiens
ADELMHQEC

SEQ ID NO: 34329 - protein, 9 aa, Homo Sapiens
KKYQQVFAS

SEQ ID NO: 34330 - protein, 9 aa, Homo Sapiens
PVMMKGYRQ

SEQ ID NO: 34331 - protein, 9 aa, Homo Sapiens
LCSQIINAA

SEQ ID NO: 34332 - protein, 9 aa, Homo Sapiens
IDLAVSREV

SEQ ID NO: 34333 - protein, 9 aa, Homo Sapiens
KRLPTLSSQ

SEQ ID NO: 34334 - protein, 9 aa, Homo Sapiens
AKPCTNVKK

SEQ ID NO: 34335 - protein, 9 aa, Homo Sapiens
DEEQRNVNL

SEQ ID NO: 34336 - protein, 9 aa, Homo Sapiens
RQGTADSNS

SEQ ID NO: 34337 - protein, 9 aa, Homo Sapiens
VGLTFQAFQ

SEQ ID NO: 34338 - protein, 9 aa, Homo Sapiens
VHAAKVVLQ

SEQ ID NO: 34339 - protein, 9 aa, Homo Sapiens
TCILRDGKV

SEQ ID NO: 34340 - protein, 9 aa, Homo Sapiens
LLAQENRDK

SEQ ID NO: 34341 - protein, 9 aa, Homo Sapiens
NNVQLSTGR

SEQ ID NO: 34342 - protein, 9 aa, Homo Sapiens
EALICKSET

SEQ ID NO: 34343 - protein, 9 aa, Homo Sapiens
NLTKIPYVA

SEQ ID NO: 34344 - protein, 9 aa, Homo Sapiens
KGEPEKGLC

SEQ ID NO: 34345 - protein, 9 aa, Homo Sapiens
SEGRPAVFL

SEQ ID NO: 34346 - protein, 9 aa, Homo Sapiens
GHRLQETKG

SEQ ID NO: 34347 - protein, 9 aa, Homo Sapiens
SAIKEITAR

SEQ ID NO: 34348 - protein, 9 aa, Homo Sapiens
SASSGDTTP

SEQ ID NO: 34349 - protein, 9 aa, Homo Sapiens
AADELMHQE

SEQ ID NO: 34350 - protein, 9 aa, Homo Sapiens
RRRVHTISA

SEQ ID NO: 34351 - protein, 9 aa, Homo Sapiens
LAVSREVFD

SEQ ID NO: 34352 - protein, 9 aa, Homo Sapiens
IHKKKYQQV

SEQ ID NO: 34353 - protein, 9 aa, Homo Sapiens
LTKIPYVAD

SEQ ID NO: 34354 - protein, 9 aa, Homo Sapiens
KAFRSLVPA

SEQ ID NO: 34355 - protein, 9 aa, Homo Sapiens
DRQGTADSN

SEQ ID NO: 34356 - protein, 9 aa, Homo Sapiens
EKPETKTLV

SEQ ID NO: 34357 - protein, 9 aa, Homo Sapiens
MVTRPALAA

SEQ ID NO: 34358 - protein, 9 aa, Homo Sapiens
ELQDSTQLE

SEQ ID NO: 34359 - protein, 9 aa, Homo Sapiens
ECAAGFQLS

SEQ ID NO: 34360 - protein, 9 aa, Homo Sapiens
VKEQKKAKT

SEQ ID NO: 34361 - protein, 9 aa, Homo Sapiens
QNILVEQLY

SEQ ID NO: 34362 - protein, 9 aa, Homo Sapiens
ENWQSSKSV

SEQ ID NO: 34363 - protein, 9 aa, Homo Sapiens
HVIGTFSSD

SEQ ID NO: 34364 - protein, 9 aa, Homo Sapiens
AQGAERVSK

SEQ ID NO: 34365 - protein, 9 aa, Homo Sapiens
LRAKGLGQE

SEQ ID NO: 34366 - protein, 9 aa, Homo Sapiens
SRLFTLLLP

SEQ ID NO: 34367 - protein, 9 aa, Homo Sapiens
EEECRALIR

SEQ ID NO: 34368 - protein, 9 aa, Homo Sapiens
IIKNSVTDG

SEQ ID NO: 34369 - protein, 9 aa, Homo Sapiens
DYRHWIKEE

SEQ ID NO: 34370 - protein, 9 aa, Homo Sapiens
SAQDPNGRC

SEQ ID NO: 34371 - protein, 9 aa, Homo Sapiens
YFACQCPPG

SEQ ID NO: 34372 - protein, 9 aa, Homo Sapiens
KIPYVADKQ

SEQ ID NO: 34373 - protein, 9 aa, Homo Sapiens
GKAFRSLVP

SEQ ID NO: 34374 - protein, 9 aa, Homo Sapiens
PDEEQRNVN

SEQ ID NO: 34375 - protein, 9 aa, Homo Sapiens
NGSLLGDWY

SEQ ID NO: 34376 - protein, 9 aa, Homo Sapiens
PYNQNILVE

SEQ ID NO: 34377 - protein, 9 aa, Homo Sapiens
DTAPGIIVA

SEQ ID NO: 34378 - protein, 9 aa, Homo Sapiens
NGRCICTVV

SEQ ID NO: 34379 - protein, 9 aa, Homo Sapiens
INLRGYFAC

SEQ ID NO: 34380 - protein, 9 aa, Homo Sapiens
PNGRCICTV

SEQ ID NO: 34381 - protein, 9 aa, Homo Sapiens
PWGSYRHHQ

SEQ ID NO: 34382 - protein, 9 aa, Homo Sapiens
FSNMRKAVK

SEQ ID NO: 34383 - protein, 9 aa, Homo Sapiens
LRFIDEFST

SEQ ID NO: 34384 - protein, 9 aa, Homo Sapiens
VKAKQVFQR

SEQ ID NO: 34385 - protein, 9 aa, Homo Sapiens
ARERRRVHT

SEQ ID NO: 34386 - protein, 9 aa, Homo Sapiens
AYGFTFLLG

SEQ ID NO: 34387 - protein, 9 aa, Homo Sapiens
RPALAAPMG

SEQ ID NO: 34388 - protein, 9 aa, Homo Sapiens
RMLSAYQQR

SEQ ID NO: 34389 - protein, 9 aa, Homo Sapiens
QPTPMGPPP

SEQ ID NO: 34390 - protein, 9 aa, Homo Sapiens
AKHAAVNKG

SEQ ID NO: 34391 - protein, 9 aa, Homo Sapiens
ASSLQLHHS

SEQ ID NO: 34392 - protein, 9 aa, Homo Sapiens
FSHSSEYHL

SEQ ID NO: 34393 - protein, 9 aa, Homo Sapiens
SMKNEKLEW

SEQ ID NO: 34394 - protein, 9 aa, Homo Sapiens
AILAPGSSA

SEQ ID NO: 34395 - protein, 9 aa, Homo Sapiens
ESPQKHIYF

SEQ ID NO: 34396 - protein, 9 aa, Homo Sapiens
ERRRVHTIS

SEQ ID NO: 34397 - protein, 9 aa, Homo Sapiens
ARAKLYKRQ

SEQ ID NO: 34398 - protein, 9 aa, Homo Sapiens
PPSRLFTLL

SEQ ID NO: 34399 - protein, 9 aa, Homo Sapiens
RAKGLGQEL

SEQ ID NO: 34400 - protein, 9 aa, Homo Sapiens
RAKLYKRQS

SEQ ID NO: 34401 - protein, 9 aa, Homo Sapiens
EVGKAFRSL

SEQ ID NO: 34402 - protein, 9 aa, Homo Sapiens
PQKHIYFDY

SEQ ID NO: 34403 - protein, 9 aa, Homo Sapiens
HIHKKKYQQ

SEQ ID NO: 34404 - protein, 9 aa, Homo Sapiens
IFTGPQSIS

SEQ ID NO: 34405 - protein, 9 aa, Homo Sapiens
AAIAGYVNK

SEQ ID NO: 34406 - protein, 9 aa, Homo Sapiens
AEKAANESE

SEQ ID NO: 34407 - protein, 9 aa, Homo Sapiens
ETVHSKSVE

SEQ ID NO: 34408 - protein, 9 aa, Homo Sapiens
TYAVQPSLP

SEQ ID NO: 34409 - protein, 9 aa, Homo Sapiens
PTLVVTALT

SEQ ID NO: 34410 - protein, 9 aa, Homo Sapiens
IAGYVNKVM

SEQ ID NO: 34411 - protein, 9 aa, Homo Sapiens
FLHTQHALQ

SEQ ID NO: 34412 - protein, 9 aa, Homo Sapiens
ANARERRRV

SEQ ID NO: 34413 - protein, 9 aa, Homo Sapiens
RGNRAFPSR

SEQ ID NO: 34414 - protein, 9 aa, Homo Sapiens
PPWGSYRHH

SEQ ID NO: 34415 - protein, 9 aa, Homo Sapiens
GAERVSKAN

SEQ ID NO: 34416 - protein, 9 aa, Homo Sapiens
TGPQSISIK

SEQ ID NO: 34417 - protein, 9 aa, Homo Sapiens
TVGISAIKE

SEQ ID NO: 34418 - protein, 9 aa, Homo Sapiens
LCHWHLFPL

SEQ ID NO: 34419 - protein, 9 aa, Homo Sapiens
LKTPQVTNK

SEQ ID NO: 34420 - protein, 9 aa, Homo Sapiens
LFPLLPRDP

SEQ ID NO: 34421 - protein, 9 aa, Homo Sapiens
QSDGRDPNQ

SEQ ID NO: 34422 - protein, 9 aa, Homo Sapiens
RCYVPIPYG

SEQ ID NO: 34423 - protein, 9 aa, Homo Sapiens
MLSSCIRPV

SEQ ID NO: 34424 - protein, 9 aa, Homo Sapiens
GLYKDRNAY

SEQ ID NO: 34425 - protein, 9 aa, Homo Sapiens
RADIHTTNS

SEQ ID NO: 34426 - protein, 9 aa, Homo Sapiens
STDSRCYVP

SEQ ID NO: 34427 - protein, 9 aa, Homo Sapiens
VGSAVFNIS

SEQ ID NO: 34428 - protein, 9 aa, Homo Sapiens
LRQYYFTIG

SEQ ID NO: 34429 - protein, 9 aa, Homo Sapiens
ALAAPMGGP

SEQ ID NO: 34430 - protein, 9 aa, Homo Sapiens
DSRCYVPIP

SEQ ID NO: 34431 - protein, 9 aa, Homo Sapiens
GYVNKVMES

SEQ ID NO: 34432 - protein, 9 aa, Homo Sapiens
SDGRDPNQP

SEQ ID NO: 34433 - protein, 9 aa, Homo Sapiens
TQLENKDVS

SEQ ID NO: 34434 - protein, 9 aa, Homo Sapiens
GRDLELLPQ

SEQ ID NO: 34435 - protein, 9 aa, Homo Sapiens
FLLGGRDLE

SEQ ID NO: 34436 - protein, 9 aa, Homo Sapiens
ALICKSETV

SEQ ID NO: 34437 - protein, 9 aa, Homo Sapiens
QGRERDLVP

SEQ ID NO: 34438 - protein, 9 aa, Homo Sapiens
GDPRSLQGD

SEQ ID NO: 34439 - protein, 9 aa, Homo Sapiens
AIAGYVNKV

SEQ ID NO: 34440 - protein, 9 aa, Homo Sapiens
RGLRAKGLG

SEQ ID NO: 34441 - protein, 9 aa, Homo Sapiens
LLIIAEFII

SEQ ID NO: 34442 - protein, 9 aa, Homo Sapiens
VLPQALYFS

SEQ ID NO: 34443 - protein, 9 aa, Homo Sapiens
VRIPPPSRL

SEQ ID NO: 34444 - protein, 9 aa, Homo Sapiens
GSISMLSTS

SEQ ID NO: 34445 - protein, 9 aa, Homo Sapiens
EFIIKNSVT

SEQ ID NO: 34446 - protein, 9 aa, Homo Sapiens
MLIRARYIS

SEQ ID NO: 34447 - protein, 9 aa, Homo Sapiens
SRSGGPTRH

SEQ ID NO: 34448 - protein, 9 aa, Homo Sapiens
PPFRVGTVP

SEQ ID NO: 34449 - protein, 9 aa, Homo Sapiens
HAAHNGQVN

SEQ ID NO: 34450 - protein, 9 aa, Homo Sapiens
CRALIRYAQ

SEQ ID NO: 34451 - protein, 9 aa, Homo Sapiens
TKGMVAVSG

SEQ ID NO: 34452 - protein, 9 aa, Homo Sapiens
HQECLPPST

SEQ ID NO: 34453 - protein, 9 aa, Homo Sapiens
SSMAMLIRA

SEQ ID NO: 34454 - protein, 9 aa, Homo Sapiens
RVSKANPSF

SEQ ID NO: 34455 - protein, 9 aa, Homo Sapiens
YNQNILVEQ

SEQ ID NO: 34456 - protein, 9 aa, Homo Sapiens
RDGKVMWSG

SEQ ID NO: 34457 - protein, 9 aa, Homo Sapiens
APAAAHTGP

SEQ ID NO: 34458 - protein, 9 aa, Homo Sapiens
ILAPGSSAS

SEQ ID NO: 34459 - protein, 9 aa, Homo Sapiens
SASPPGSLE

SEQ ID NO: 34460 - protein, 9 aa, Homo Sapiens
AEQHQRMLS

SEQ ID NO: 34461 - protein, 9 aa, Homo Sapiens
DPRSLQGDW

SEQ ID NO: 34462 - protein, 9 aa, Homo Sapiens
TADSNSSEP

SEQ ID NO: 34463 - protein, 9 aa, Homo Sapiens
RLFTLLLPS

SEQ ID NO: 34464 - protein, 9 aa, Homo Sapiens
PCTNVKKSI

SEQ ID NO: 34465 - protein, 9 aa, Homo Sapiens
RDLELLPQQ

SEQ ID NO: 34466 - protein, 9 aa, Homo Sapiens
LVVTALTPT

SEQ ID NO: 34467 - protein, 9 aa, Homo Sapiens
QDSTQLENK

SEQ ID NO: 34468 - protein, 9 aa, Homo Sapiens
YQVDAESQP

SEQ ID NO: 34469 - protein, 9 aa, Homo Sapiens
HSSEYHLED

SEQ ID NO: 34470 - protein, 9 aa, Homo Sapiens
KGQMEFTAW

SEQ ID NO: 34471 - protein, 9 aa, Homo Sapiens
HHSVHTGEK

SEQ ID NO: 34472 - protein, 9 aa, Homo Sapiens
GKVKGLIVT

SEQ ID NO: 34473 - protein, 9 aa, Homo Sapiens
TLVVTALTP

SEQ ID NO: 34474 - protein, 9 aa, Homo Sapiens
DIIARAKLY

SEQ ID NO: 34475 - protein, 9 aa, Homo Sapiens
GCIPEADVR

SEQ ID NO: 34476 - protein, 9 aa, Homo Sapiens
EPEAGASVL

SEQ ID NO: 34477 - protein, 9 aa, Homo Sapiens
KSVKRWKSG

SEQ ID NO: 34478 - protein, 9 aa, Homo Sapiens
RDPNQPDDR

SEQ ID NO: 34479 - protein, 9 aa, Homo Sapiens
QGTADSNSS

SEQ ID NO: 34480 - protein, 9 aa, Homo Sapiens
EHQAVLVEQ

SEQ ID NO: 34481 - protein, 9 aa, Homo Sapiens
DHEVALIFT

SEQ ID NO: 34482 - protein, 9 aa, Homo Sapiens
LRADIHTTN

SEQ ID NO: 34483 - protein, 9 aa, Homo Sapiens
DVLIEIFTN

SEQ ID NO: 34484 - protein, 9 aa, Homo Sapiens
SGVDCLEFI

SEQ ID NO: 34485 - protein, 9 aa, Homo Sapiens
LIVTLKGEP

SEQ ID NO: 34486 - protein, 9 aa, Homo Sapiens
DSAIDKIFT

SEQ ID NO: 34487 - protein, 9 aa, Homo Sapiens
LQDSTQLEN

SEQ ID NO: 34488 - protein, 9 aa, Homo Sapiens
AESQPTPMG

SEQ ID NO: 34489 - protein, 9 aa, Homo Sapiens
LIRYAQEHD

SEQ ID NO: 34490 - protein, 9 aa, Homo Sapiens
QPSLPLPGF

SEQ ID NO: 34491 - protein, 9 aa, Homo Sapiens
QTYAVQPSL

SEQ ID NO: 34492 - protein, 9 aa, Homo Sapiens
DVYNLLKTN

SEQ ID NO: 34493 - protein, 9 aa, Homo Sapiens
IDKIFTLGN

SEQ ID NO: 34494 - protein, 9 aa, Homo Sapiens
TPYNQNILV

SEQ ID NO: 34495 - protein, 9 aa, Homo Sapiens
SYRHHQYEQ

SEQ ID NO: 34496 - protein, 9 aa, Homo Sapiens
AFPSRARGG

SEQ ID NO: 34497 - protein, 9 aa, Homo Sapiens
WLTPVMMKG

SEQ ID NO: 34498 - protein, 9 aa, Homo Sapiens
VGKAFRSLV

SEQ ID NO: 34499 - protein, 9 aa, Homo Sapiens
GRERDLVPK

SEQ ID NO: 34500 - protein, 9 aa, Homo Sapiens
NDYRHWIKE

SEQ ID NO: 34501 - protein, 9 aa, Homo Sapiens
TVHSKSVES

SEQ ID NO: 34502 - protein, 9 aa, Homo Sapiens
KTPEGGSVF

SEQ ID NO: 34503 - protein, 9 aa, Homo Sapiens
YQQVFASPS

SEQ ID NO: 34504 - protein, 9 aa, Homo Sapiens
AQACFSHSS

SEQ ID NO: 34505 - protein, 9 aa, Homo Sapiens
SVSDIGLDT

SEQ ID NO: 34506 - protein, 9 aa, Homo Sapiens
QQVHSEGRP

SEQ ID NO: 34507 - protein, 9 aa, Homo Sapiens
IIYDSPPSR

SEQ ID NO: 34508 - protein, 9 aa, Homo Sapiens
QVDAESQPT

SEQ ID NO: 34509 - protein, 9 aa, Homo Sapiens
DPQPHLVAL

SEQ ID NO: 34510 - protein, 9 aa, Homo Sapiens
KYQQVFASP

SEQ ID NO: 34511 - protein, 9 aa, Homo Sapiens
SMIRTGEPE

SEQ ID NO: 34512 - protein, 9 aa, Homo Sapiens
LPRDPQPHL

SEQ ID NO: 34513 - protein, 9 aa, Homo Sapiens
STDGSHKEL

SEQ ID NO: 34514 - protein, 9 aa, Homo Sapiens
NKGQMEFTA

SEQ ID NO: 34515 - protein, 9 aa, Homo Sapiens
GSHKELIVD

SEQ ID NO: 34516 - protein, 9 aa, Homo Sapiens
SKANPSFRK

SEQ ID NO: 34517 - protein, 9 aa, Homo Sapiens
PEADVREGQ

SEQ ID NO: 34518 - protein, 9 aa, Homo Sapiens
APGIIVASG

SEQ ID NO: 34519 - protein, 9 aa, Homo Sapiens
SSGDTTPLP

SEQ ID NO: 34520 - protein, 9 aa, Homo Sapiens
HQPVADVLI

SEQ ID NO: 34521 - protein, 9 aa, Homo Sapiens
SAEQHQRML

SEQ ID NO: 34522 - protein, 9 aa, Homo Sapiens
SQIINAALA

SEQ ID NO: 34523 - protein, 9 aa, Homo Sapiens
WDRGNRAFP

SEQ ID NO: 34524 - protein, 9 aa, Homo Sapiens
TFGVNDYRH

SEQ ID NO: 34525 - protein, 9 aa, Homo Sapiens
HGLYKDRNA

SEQ ID NO: 34526 - protein, 9 aa, Homo Sapiens
SIFTLLIIA

SEQ ID NO: 34527 - protein, 9 aa, Homo Sapiens
RQQLLEDFR

SEQ ID NO: 34528 - protein, 9 aa, Homo Sapiens
NSFSTLTVE

SEQ ID NO: 34529 - protein, 9 aa, Homo Sapiens
DKPIAVGSI

SEQ ID NO: 34530 - protein, 9 aa, Homo Sapiens
AVFLHTQHA

SEQ ID NO: 34531 - protein, 9 aa, Homo Sapiens
LYKDRNAYR

SEQ ID NO: 34532 - protein, 9 aa, Homo Sapiens
YSASVNPHL

SEQ ID NO: 34533 - protein, 9 aa, Homo Sapiens
GIIVASGNI

SEQ ID NO: 34534 - protein, 9 aa, Homo Sapiens
RQDVYNLLK

SEQ ID NO: 34535 - protein, 9 aa, Homo Sapiens
EKQRQSIRS

SEQ ID NO: 34536 - protein, 9 aa, Homo Sapiens
AKVVLQVKE

SEQ ID NO: 34537 - protein, 9 aa, Homo Sapiens
DNMDEYVCN

SEQ ID NO: 34538 - protein, 9 aa, Homo Sapiens
FFQQQIIYD

SEQ ID NO: 34539 - protein, 9 aa, Homo Sapiens
RTGEPEAGA

SEQ ID NO: 34540 - protein, 9 aa, Homo Sapiens
CSQIINAAL

SEQ ID NO: 34541 - protein, 9 aa, Homo Sapiens
VMTVGISAI

SEQ ID NO: 34542 - protein, 9 aa, Homo Sapiens
LHTQHALQP

SEQ ID NO: 34543 - protein, 9 aa, Homo Sapiens
KTPQVTNKG

SEQ ID NO: 34544 - protein, 9 aa, Homo Sapiens
DRELRQLRF

SEQ ID NO: 34545 - protein, 9 aa, Homo Sapiens
VTNKGEPEK

SEQ ID NO: 34546 - protein, 9 aa, Homo Sapiens
ITCILRDGK

SEQ ID NO: 34547 - protein, 9 aa, Homo Sapiens
FQQQIIYDS

SEQ ID NO: 34548 - protein, 9 aa, Homo Sapiens
PSSASSGDT

SEQ ID NO: 34549 - protein, 9 aa, Homo Sapiens
GYANEVGKA

SEQ ID NO: 34550 - protein, 9 aa, Homo Sapiens
TFLLGGRDL

SEQ ID NO: 34551 - protein, 9 aa, Homo Sapiens
LAMVTRPAL

SEQ ID NO: 34552 - protein, 9 aa, Homo Sapiens
VLIEIFTNQ

SEQ ID NO: 34553 - protein, 9 aa, Homo Sapiens
GLTFQAFQI

SEQ ID NO: 34554 - protein, 9 aa, Homo Sapiens
CKSETVHSK

SEQ ID NO: 34555 - protein, 9 aa, Homo Sapiens
SETVHSKSV

SEQ ID NO: 34556 - protein, 9 aa, Homo Sapiens
YAVQPSLPL

SEQ ID NO: 34557 - protein, 9 aa, Homo Sapiens
ELMHQECLP

SEQ ID NO: 34558 - protein, 9 aa, Homo Sapiens
WRQDIDLAV

SEQ ID NO: 34559 - protein, 9 aa, Homo Sapiens
MTVGISAIK

SEQ ID NO: 34560 - protein, 9 aa, Homo Sapiens
MLSAYQQRV

SEQ ID NO: 34561 - protein, 9 aa, Homo Sapiens
DIHTTNSFS

SEQ ID NO: 34562 - protein, 9 aa, Homo Sapiens
TLLIIAEFI

SEQ ID NO: 34563 - protein, 9 aa, Homo Sapiens
VLVEQKGHL

SEQ ID NO: 34564 - protein, 9 aa, Homo Sapiens
LEDFREKQQ

SEQ ID NO: 34565 - protein, 9 aa, Homo Sapiens
EQHQRMLSA

SEQ ID NO: 34566 - protein, 9 aa, Homo Sapiens
NKEGCIPEA

SEQ ID NO: 34567 - protein, 9 aa, Homo Sapiens
FSWLTPVMM

SEQ ID NO: 34568 - protein, 9 aa, Homo Sapiens
KAANESERG

SEQ ID NO: 34569 - protein, 9 aa, Homo Sapiens
QQIIYDSPP

SEQ ID NO: 34570 - protein, 9 aa, Homo Sapiens
DCLEFIIKN

SEQ ID NO: 34571 - protein, 9 aa, Homo Sapiens
AGNGSLLGD

SEQ ID NO: 34572 - protein, 9 aa, Homo Sapiens
VYNLLKTNL

SEQ ID NO: 34573 - protein, 9 aa, Homo Sapiens
CWDRGNRAF

SEQ ID NO: 34574 - protein, 9 aa, Homo Sapiens
RFIDEFSTR

SEQ ID NO: 34575 - protein, 9 aa, Homo Sapiens
PNPDEEQRN

SEQ ID NO: 34576 - protein, 9 aa, Homo Sapiens
MHAEIRSRE

SEQ ID NO: 34577 - protein, 9 aa, Homo Sapiens
VSDIGLDTA

SEQ ID NO: 34578 - protein, 9 aa, Homo Sapiens
LDTALMPTL

SEQ ID NO: 34579 - protein, 9 aa, Homo Sapiens
ANEVGKAFR

SEQ ID NO: 34580 - protein, 9 aa, Homo Sapiens
GFFQQQIIY

SEQ ID NO: 34581 - protein, 9 aa, Homo Sapiens
LVNRGLSAQ

SEQ ID NO: 34582 - protein, 9 aa, Homo Sapiens
QYYFTIGWN

SEQ ID NO: 34583 - protein, 9 aa, Homo Sapiens
RANNVQLST

SEQ ID NO: 34584 - protein, 9 aa, Homo Sapiens
KKKYQQVFA

SEQ ID NO: 34585 - protein, 9 aa, Homo Sapiens
SMAMLIRAR

SEQ ID NO: 34586 - protein, 9 aa, Homo Sapiens
KPETKTLVK

SEQ ID NO: 34587 - protein, 9 aa, Homo Sapiens
HHAAHNGQV

SEQ ID NO: 34588 - protein, 9 aa, Homo Sapiens
EEQRNVNLE

SEQ ID NO: 34589 - protein, 9 aa, Homo Sapiens
SDIGLDTAL

SEQ ID NO: 34590 - protein, 9 aa, Homo Sapiens
VGSISMLST

SEQ ID NO: 34591 - protein, 9 aa, Homo Sapiens
KCHVIGTFS

SEQ ID NO: 34592 - protein, 9 aa, Homo Sapiens
TKIPYVADK

SEQ ID NO: 34593 - protein, 9 aa, Homo Sapiens
NLERECIEK

SEQ ID NO: 34594 - protein, 9 aa, Homo Sapiens
DFREKQQEV

SEQ ID NO: 34595 - protein, 9 aa, Homo Sapiens
HSVHTGEKP

SEQ ID NO: 34596 - protein, 9 aa, Homo Sapiens
PPTLVVTAL

SEQ ID NO: 34597 - protein, 9 aa, Homo Sapiens
IRPVPTTVR

SEQ ID NO: 34598 - protein, 9 aa, Homo Sapiens
EADVREGQM

SEQ ID NO: 34599 - protein, 9 aa, Homo Sapiens
RQDIDLAVS

SEQ ID NO: 34600 - protein, 9 aa, Homo Sapiens
KQRQSIRSS

SEQ ID NO: 34601 - protein, 9 aa, Homo Sapiens
AGNLTKIPY

SEQ ID NO: 34602 - protein, 9 aa, Homo Sapiens
RELRQLRFI

SEQ ID NO: 34603 - protein, 9 aa, Homo Sapiens
QHQRMLSAY

SEQ ID NO: 34604 - protein, 9 aa, Homo Sapiens
HWHLFPLLP

SEQ ID NO: 34605 - protein, 9 aa, Homo Sapiens
PGLVNRGLS

SEQ ID NO: 34606 - protein, 9 aa, Homo Sapiens
FTGPQSISI

SEQ ID NO: 34607 - protein, 9 aa, Homo Sapiens
LPQQVHSEG

SEQ ID NO: 34608 - protein, 9 aa, Homo Sapiens
YPPFRVGTV

SEQ ID NO: 34609 - protein, 9 aa, Homo Sapiens
RKRLPTLSS

SEQ ID NO: 34610 - protein, 9 aa, Homo Sapiens
EICRLKSIK

SEQ ID NO: 34611 - protein, 9 aa, Homo Sapiens
SPQSDGRDP

SEQ ID NO: 34612 - protein, 9 aa, Homo Sapiens
LHEAQNIKN

SEQ ID NO: 34613 - protein, 9 aa, Homo Sapiens
MQDTPYNQN

SEQ ID NO: 34614 - protein, 9 aa, Homo Sapiens
AQENRDKWE

SEQ ID NO: 34615 - protein, 9 aa, Homo Sapiens
RIPPPSRLF

SEQ ID NO: 34616 - protein, 9 aa, Homo Sapiens
QAVHAAKVV

SEQ ID NO: 34617 - protein, 9 aa, Homo Sapiens
QRQSIRSSP

SEQ ID NO: 34618 - protein, 9 aa, Homo Sapiens
HDTDDGDDN

SEQ ID NO: 34619 - protein, 9 aa, Homo Sapiens
YKSTDGSHK

SEQ ID NO: 34620 - protein, 9 aa, Homo Sapiens
ERDLVPKPS

SEQ ID NO: 34621 - protein, 9 aa, Homo Sapiens
ILRDGKVMW

SEQ ID NO: 34622 - protein, 9 aa, Homo Sapiens
LQETKGMVA

SEQ ID NO: 34623 - protein, 9 aa, Homo Sapiens
NWQSSKSVK

SEQ ID NO: 34624 - protein, 9 aa, Homo Sapiens
ANNVQLSTG

SEQ ID NO: 34625 - protein, 9 aa, Homo Sapiens
KYSASVNPH

SEQ ID NO: 34626 - protein, 9 aa, Homo Sapiens
QRMLSAYQQ

SEQ ID NO: 34627 - protein, 9 aa, Homo Sapiens
KVPAAAGET

SEQ ID NO: 34628 - protein, 9 aa, Homo Sapiens
RGYFACQCP

SEQ ID NO: 34629 - protein, 9 aa, Homo Sapiens
RKGVKAKQV

SEQ ID NO: 34630 - protein, 9 aa, Homo Sapiens
VGTVPNGST

SEQ ID NO: 34631 - protein, 9 aa, Homo Sapiens
KSAKPCTNV

SEQ ID NO: 34632 - protein, 9 aa, Homo Sapiens
SHKELIVDA

SEQ ID NO: 34633 - protein, 9 aa, Homo Sapiens
SLLGDWYRR

SEQ ID NO: 34634 - protein, 9 aa, Homo Sapiens
FTLLIIAEF

SEQ ID NO: 34635 - protein, 9 aa, Homo Sapiens
RARYISGIP

SEQ ID NO: 34636 - protein, 9 aa, Homo Sapiens
QSSKSVKRW

SEQ ID NO: 34637 - protein, 9 aa, Homo Sapiens
SSASPPGSL

SEQ ID NO: 34638 - protein, 9 aa, Homo Sapiens
RNAYRDSMT

SEQ ID NO: 34639 - protein, 9 aa, Homo Sapiens
FIDEFSTRC

SEQ ID NO: 34640 - protein, 9 aa, Homo Sapiens
GLDRQGTAD

SEQ ID NO: 34641 - protein, 9 aa, Homo Sapiens
HQAVLVEQK

SEQ ID NO: 34642 - protein, 9 aa, Homo Sapiens
DGGESPQKH

SEQ ID NO: 34643 - protein, 9 aa, Homo Sapiens
FGVNDYRHW

SEQ ID NO: 34644 - protein, 9 aa, Homo Sapiens
ELRGLRAKG

SEQ ID NO: 34645 - protein, 9 aa, Homo Sapiens
LKTLYNSMK

SEQ ID NO: 34646 - protein, 9 aa, Homo Sapiens
TDSRCYVPI

SEQ ID NO: 34647 - protein, 9 aa, Homo Sapiens
VCNTTARAF

SEQ ID NO: 34648 - protein, 9 aa, Homo Sapiens
AKGLGQELG

SEQ ID NO: 34649 - protein, 9 aa, Homo Sapiens
KEGCIPEAD

SEQ ID NO: 34650 - protein, 9 aa, Homo Sapiens
SCIRPVPTT

SEQ ID NO: 34651 - protein, 9 aa, Homo Sapiens
NKGEPEKGL

SEQ ID NO: 34652 - protein, 9 aa, Homo Sapiens
EGCIPEADV

SEQ ID NO: 34653 - protein, 9 aa, Homo Sapiens
LPTLSSQFK

SEQ ID NO: 34654 - protein, 9 aa, Homo Sapiens
LEEAEKAAN

SEQ ID NO: 34655 - protein, 9 aa, Homo Sapiens
GAYGFTFLL

SEQ ID NO: 34656 - protein, 9 aa, Homo Sapiens
LTPVMMKGY

SEQ ID NO: 34657 - protein, 9 aa, Homo Sapiens
NEVGKAFRS

SEQ ID NO: 34658 - protein, 9 aa, Homo Sapiens
AVNKGQMEF

SEQ ID NO: 34659 - protein, 9 aa, Homo Sapiens
KGMVAVSGS

SEQ ID NO: 34660 - protein, 9 aa, Homo Sapiens
LLKTLYNSM

SEQ ID NO: 34661 - protein, 9 aa, Homo Sapiens
SRCYVPIPY

SEQ ID NO: 34662 - protein, 9 aa, Homo Sapiens
PQVTNKGEP

SEQ ID NO: 34663 - protein, 9 aa, Homo Sapiens
TEQEICRLK

SEQ ID NO: 34664 - protein, 9 aa, Homo Sapiens
AAAHTGPEG

SEQ ID NO: 34665 - protein, 9 aa, Homo Sapiens
KAKQVFQRF

SEQ ID NO: 34666 - protein, 9 aa, Homo Sapiens
DKQRQKHLQ

SEQ ID NO: 34667 - protein, 9 aa, Homo Sapiens
SKDTAPGII

SEQ ID NO: 34668 - protein, 9 aa, Homo Sapiens
MNGFFQQQI

SEQ ID NO: 34669 - protein, 9 aa, Homo Sapiens
QLHHSVHTG

SEQ ID NO: 34670 - protein, 9 aa, Homo Sapiens
IHKAAIAGY

SEQ ID NO: 34671 - protein, 9 aa, Homo Sapiens
ECIEKLCNK

SEQ ID NO: 34672 - protein, 9 aa, Homo Sapiens
YANEVGKAF

SEQ ID NO: 34673 - protein, 9 aa, Homo Sapiens
ETLCSQIIN

SEQ ID NO: 34674 - protein, 9 aa, Homo Sapiens
DVEEYVKTP

SEQ ID NO: 34675 - protein, 9 aa, Homo Sapiens
LSVSDIGLD

SEQ ID NO: 34676 - protein, 9 aa, Homo Sapiens
LRVPPPTLV

SEQ ID NO: 34677 - protein, 9 aa, Homo Sapiens
VGISAIKEI

SEQ ID NO: 34678 - protein, 9 aa, Homo Sapiens
AAGNLTKIP

SEQ ID NO: 34679 - protein, 9 aa, Homo Sapiens
HSEGRPAVF

SEQ ID NO: 34680 - protein, 9 aa, Homo Sapiens
DLVPKPSVL

SEQ ID NO: 34681 - protein, 9 aa, Homo Sapiens
ISMLSTSNY

SEQ ID NO: 34682 - protein, 9 aa, Homo Sapiens
QETKGMVAV

SEQ ID NO: 34683 - protein, 9 aa, Homo Sapiens
NMDKQRQKH

SEQ ID NO: 34684 - protein, 9 aa, Homo Sapiens
GGESPQKHI

SEQ ID NO: 34685 - protein, 9 aa, Homo Sapiens
QPVADVLIE

SEQ ID NO: 34686 - protein, 9 aa, Homo Sapiens
VTRPALAAP

SEQ ID NO: 34687 - protein, 9 aa, Homo Sapiens
GAETRKRLP

SEQ ID NO: 34688 - protein, 9 aa, Homo Sapiens
CYVPIPYGL

SEQ ID NO: 34689 - protein, 9 aa, Homo Sapiens
RDPQPHLVA

SEQ ID NO: 34690 - protein, 9 aa, Homo Sapiens
YKDRNAYRD

SEQ ID NO: 34691 - protein, 9 aa, Homo Sapiens
TARQDVYNL

SEQ ID NO: 34692 - protein, 9 aa, Homo Sapiens
NARERRRVH

SEQ ID NO: 34693 - protein, 9 aa, Homo Sapiens
YVPIPYGLI

SEQ ID NO: 34694 - protein, 9 aa, Homo Sapiens
HAAKVVLQV

SEQ ID NO: 34695 - protein, 9 aa, Homo Sapiens
LANARERRR

SEQ ID NO: 34696 - protein, 9 aa, Homo Sapiens
EYVCNTTAR

SEQ ID NO: 34697 - protein, 9 aa, Homo Sapiens
ALPSIFTLL

SEQ ID NO: 34698 - protein, 9 aa, Homo Sapiens
IPPPSRLFT

SEQ ID NO: 34699 - protein, 9 aa, Homo Sapiens
GVDCLEFII

SEQ ID NO: 34700 - protein, 9 aa, Homo Sapiens
TETITCILR

SEQ ID NO: 34701 - protein, 9 aa, Homo Sapiens
SVKRWKSGW

SEQ ID NO: 34702 - protein, 9 aa, Homo Sapiens
SAKPCTNVK

SEQ ID NO: 34703 - protein, 9 aa, Homo Sapiens
PGAGNGSLL

SEQ ID NO: 34704 - protein, 9 aa, Homo Sapiens
QKHIYFDYP

SEQ ID NO: 34705 - protein, 9 aa, Homo Sapiens
KTLVKEQKK

SEQ ID NO: 34706 - protein, 9 aa, Homo Sapiens
SLPLPGFES

SEQ ID NO: 34707 - protein, 9 aa, Homo Sapiens
PAAAHTGPE

SEQ ID NO: 34708 - protein, 9 aa, Homo Sapiens
KGLIVTLKG

SEQ ID NO: 34709 - protein, 9 aa, Homo Sapiens
VSSMAMLIR

SEQ ID NO: 34710 - protein, 9 aa, Homo Sapiens
SVNPHLREF

SEQ ID NO: 34711 - protein, 9 aa, Homo Sapiens
IPYVADKQQ

SEQ ID NO: 34712 - protein, 9 aa, Homo Sapiens
DIGLDTALM

SEQ ID NO: 34713 - protein, 9 aa, Homo Sapiens
PRDPQPHLV

SEQ ID NO: 34714 - protein, 9 aa, Homo Sapiens
KQRQKHLQE

SEQ ID NO: 34715 - protein, 9 aa, Homo Sapiens
ETKTLVKEQ

SEQ ID NO: 34716 - protein, 9 aa, Homo Sapiens
GAGNGSLLG

SEQ ID NO: 34717 - protein, 9 aa, Homo Sapiens
EECRALIRY

SEQ ID NO: 34718 - protein, 9 aa, Homo Sapiens
KTLYNSMKN

SEQ ID NO: 34719 - protein, 9 aa, Homo Sapiens
GRPAVFLHT

SEQ ID NO: 34720 - protein, 9 aa, Homo Sapiens
AIDKIFTLG

SEQ ID NO: 34721 - protein, 9 aa, Homo Sapiens
SNLLAQENR

SEQ ID NO: 34722 - protein, 9 aa, Homo Sapiens
DGSHKELIV

SEQ ID NO: 34723 - protein, 9 aa, Homo Sapiens
RQKHLQEQK

SEQ ID NO: 34724 - protein, 9 aa, Homo Sapiens
ILHEAQNIK

SEQ ID NO: 34725 - protein, 9 aa, Homo Sapiens
QKHLQEQKQ

SEQ ID NO: 34726 - protein, 9 aa, Homo Sapiens
QLRFIDEFS

SEQ ID NO: 34727 - protein, 9 aa, Homo Sapiens
EVALIFTGP

SEQ ID NO: 34728 - protein, 9 aa, Homo Sapiens
SPPAPAAAH

SEQ ID NO: 34729 - protein, 9 aa, Homo Sapiens
VKGLIVTLK

SEQ ID NO: 34730 - protein, 9 aa, Homo Sapiens
VNKGQMEFT

SEQ ID NO: 34731 - protein, 9 aa, Homo Sapiens
GSSASPPGS

SEQ ID NO: 34732 - protein, 9 aa, Homo Sapiens
LSSCIRPVP

SEQ ID NO: 34733 - protein, 9 aa, Homo Sapiens
KTFGVNDYR

SEQ ID NO: 34734 - protein, 9 aa, Homo Sapiens
CRLKSIKSL

SEQ ID NO: 34735 - protein, 9 aa, Homo Sapiens
ETITCILRD

SEQ ID NO: 34736 - protein, 9 aa, Homo Sapiens
LAQENRDKW

SEQ ID NO: 34737 - protein, 9 aa, Homo Sapiens
EAGASVLAA

SEQ ID NO: 34738 - protein, 9 aa, Homo Sapiens
NESERGMKV

SEQ ID NO: 34739 - protein, 9 aa, Homo Sapiens
NMDEYVCNT

SEQ ID NO: 34740 - protein, 9 aa, Homo Sapiens
CILRDGKVM

SEQ ID NO: 34741 - protein, 9 aa, Homo Sapiens
VIGTFSSDE

SEQ ID NO: 34742 - protein, 9 aa, Homo Sapiens
KVKGLIVTL

SEQ ID NO: 34743 - protein, 9 aa, Homo Sapiens
PTTVGDPRS

SEQ ID NO: 34744 - protein, 9 aa, Homo Sapiens
HKAAIAGYV

SEQ ID NO: 34745 - protein, 9 aa, Homo Sapiens
GAQACFSHS

SEQ ID NO: 34746 - protein, 9 aa, Homo Sapiens
AVHAAKVVL

SEQ ID NO: 34747 - protein, 9 aa, Homo Sapiens
DLAVSREVF

SEQ ID NO: 34748 - protein, 9 aa, Homo Sapiens
MMKGYRQRL

SEQ ID NO: 34749 - protein, 9 aa, Homo Sapiens
AHNGQVNLT

SEQ ID NO: 34750 - protein, 9 aa, Homo Sapiens
YSSAQDPNG

SEQ ID NO: 34751 - protein, 9 aa, Homo Sapiens
QASSLQLHH

SEQ ID NO: 34752 - protein, 9 aa, Homo Sapiens
GNRAFPSRA

SEQ ID NO: 34753 - protein, 9 aa, Homo Sapiens
AAKVVLQVK

SEQ ID NO: 34754 - protein, 9 aa, Homo Sapiens
DMDLHDTDD

SEQ ID NO: 34755 - protein, 9 aa, Homo Sapiens
VHGLYKDRN

SEQ ID NO: 34756 - protein, 9 aa, Homo Sapiens
ILSNLLAQE

SEQ ID NO: 34757 - protein, 9 aa, Homo Sapiens
MKKTFGVND

SEQ ID NO: 34758 - protein, 9 aa, Homo Sapiens
YFSNMRKAV

SEQ ID NO: 34759 - protein, 9 aa, Homo Sapiens
KHIYFDYPS

SEQ ID NO: 34760 - protein, 9 aa, Homo Sapiens
LLPRDPQPH

SEQ ID NO: 34761 - protein, 9 aa, Homo Sapiens
PPPSRLFTL

SEQ ID NO: 34762 - protein, 9 aa, Homo Sapiens
EKEKIEKQR

SEQ ID NO: 34763 - protein, 9 aa, Homo Sapiens
GTADSNSSE

SEQ ID NO: 34764 - protein, 9 aa, Homo Sapiens
TGEPEAGAS

SEQ ID NO: 34765 - protein, 9 aa, Homo Sapiens
EDFREKQQE

SEQ ID NO: 34766 - protein, 9 aa, Homo Sapiens
PPPTTVGDP

SEQ ID NO: 34767 - protein, 9 aa, Homo Sapiens
PQSDGRDPN

SEQ ID NO: 34768 - protein, 9 aa, Homo Sapiens
WHLFPLLPR

SEQ ID NO: 34769 - protein, 9 aa, Homo Sapiens
LRGLRAKGL

SEQ ID NO: 34770 - protein, 9 aa, Homo Sapiens
CLEFIIKNS

SEQ ID NO: 34771 - protein, 9 aa, Homo Sapiens
QVFQRFLES

SEQ ID NO: 34772 - protein, 9 aa, Homo Sapiens
KIFTLGNSE

SEQ ID NO: 34773 - protein, 9 aa, Homo Sapiens
LQKLLRANN

SEQ ID NO: 34774 - protein, 9 aa, Homo Sapiens
CFSHSSEYH

SEQ ID NO: 34775 - protein, 9 aa, Homo Sapiens
SSCIRPVPT

SEQ ID NO: 34776 - protein, 9 aa, Homo Sapiens
NQNILVEQL

SEQ ID NO: 34777 - protein, 9 aa, Homo Sapiens
VCINLRGYF

SEQ ID NO: 34778 - protein, 9 aa, Homo Sapiens
AETRKRLPT

SEQ ID NO: 34779 - protein, 9 aa, Homo Sapiens
RQLRFIDEF

SEQ ID NO: 34780 - protein, 9 aa, Homo Sapiens
ECRALIRYA

SEQ ID NO: 34781 - protein, 9 aa, Homo Sapiens
GESPQKHIY

SEQ ID NO: 34782 - protein, 9 aa, Homo Sapiens
SSAQDPNGR

SEQ ID NO: 34783 - protein, 9 aa, Homo Sapiens
LIIAEFIIG

SEQ ID NO: 34784 - protein, 9 aa, Homo Sapiens
QACFSHSSE

SEQ ID NO: 34785 - protein, 9 aa, Homo Sapiens
VSKANPSFR

SEQ ID NO: 34786 - protein, 9 aa, Homo Sapiens
LRDGKVMWS

SEQ ID NO: 34787 - protein, 9 aa, Homo Sapiens
APGSSASPP

SEQ ID NO: 34788 - protein, 9 aa, Homo Sapiens
NAYRDSMTD

SEQ ID NO: 34789 - protein, 9 aa, Homo Sapiens
AVSREVFDF

SEQ ID NO: 34790 - protein, 9 aa, Homo Sapiens
PYVADKQQS

SEQ ID NO: 34791 - protein, 9 aa, Homo Sapiens
GMQDTPYNQ

SEQ ID NO: 34792 - protein, 9 aa, Homo Sapiens
LVPKPSVLF

SEQ ID NO: 34793 - protein, 9 aa, Homo Sapiens
SASVNPHLR

SEQ ID NO: 34794 - protein, 9 aa, Homo Sapiens
FQIERHDSC

SEQ ID NO: 34795 - protein, 9 aa, Homo Sapiens
GYFACQCPP

SEQ ID NO: 34796 - protein, 9 aa, Homo Sapiens
AKCHVIGTF

SEQ ID NO: 34797 - protein, 9 aa, Homo Sapiens
ELAKVPAAA

SEQ ID NO: 34798 - protein, 9 aa, Homo Sapiens
SRKLCPGLV

SEQ ID NO: 34799 - protein, 9 aa, Homo Sapiens
GFTFLLGGR

SEQ ID NO: 34800 - protein, 9 aa, Homo Sapiens
IRTGEPEAG

SEQ ID NO: 34801 - protein, 9 aa, Homo Sapiens
VKRWKSGWE

SEQ ID NO: 34802 - protein, 9 aa, Homo Sapiens
ASELAKVPA

SEQ ID NO: 34803 - protein, 9 aa, Homo Sapiens
PSRLFTLLL

SEQ ID NO: 34804 - protein, 9 aa, Homo Sapiens
ANHLETLCS

SEQ ID NO: 34805 - protein, 9 aa, Homo Sapiens
AIECAAGFQ

SEQ ID NO: 34806 - protein, 9 aa, Homo Sapiens
IIFCMHAEI

SEQ ID NO: 34807 - protein, 9 aa, Homo Sapiens
DLMHHAAHN

SEQ ID NO: 34808 - protein, 9 aa, Homo Sapiens
VIKYSASVN

SEQ ID NO: 34809 - protein, 9 aa, Homo Sapiens
AKQVFQRFL

SEQ ID NO: 34810 - protein, 9 aa, Homo Sapiens
MKGYRQRLT

SEQ ID NO: 34811 - protein, 9 aa, Homo Sapiens
TAPGIIVAS

SEQ ID NO: 34812 - protein, 9 aa, Homo Sapiens
EEYVKTPEG

SEQ ID NO: 34813 - protein, 9 aa, Homo Sapiens
QPHLVALIP

SEQ ID NO: 34814 - protein, 9 aa, Homo Sapiens
RLKSIKSLA

SEQ ID NO: 34815 - protein, 9 aa, Homo Sapiens
FTEQEICRL

SEQ ID NO: 34816 - protein, 9 aa, Homo Sapiens
GLDTALMPT

SEQ ID NO: 34817 - protein, 9 aa, Homo Sapiens
GNGSLLGDW

SEQ ID NO: 34818 - protein, 9 aa, Homo Sapiens
PFRVGTVPN

SEQ ID NO: 34819 - protein, 9 aa, Homo Sapiens
ADVLIEIFT

SEQ ID NO: 34820 - protein, 9 aa, Homo Sapiens
DTALMPTLL

SEQ ID NO: 34821 - protein, 9 aa, Homo Sapiens
LIFTGPQSI

SEQ ID NO: 34822 - protein, 9 aa, Homo Sapiens
SSASSGDTT

SEQ ID NO: 34823 - protein, 9 aa, Homo Sapiens
QEICRLKSI

SEQ ID NO: 34824 - protein, 9 aa, Homo Sapiens
VPPPTLVVT

SEQ ID NO: 34825 - protein, 9 aa, Homo Sapiens
IGTFSSDEK

SEQ ID NO: 34826 - protein, 9 aa, Homo Sapiens
EVMTVGISA

SEQ ID NO: 34827 - protein, 9 aa, Homo Sapiens
LILHEAQNI

SEQ ID NO: 34828 - protein, 9 aa, Homo Sapiens
DIHIHKKKY

SEQ ID NO: 34829 - protein, 9 aa, Homo Sapiens
RTEHQAVLV

SEQ ID NO: 34830 - protein, 9 aa, Homo Sapiens
AAADELMHQ

SEQ ID NO: 34831 - protein, 9 aa, Homo Sapiens
AANESERGM

SEQ ID NO: 34832 - protein, 9 aa, Homo Sapiens
WKPNPDEEQ

SEQ ID NO: 34833 - protein, 9 aa, Homo Sapiens
GNLTKIPYV

SEQ ID NO: 34834 - protein, 9 aa, Homo Sapiens
YVNKVMESI

SEQ ID NO: 34835 - protein, 9 aa, Homo Sapiens
TNKGEPEKG

SEQ ID NO: 34836 - protein, 9 aa, Homo Sapiens
SLCHWHLFP

SEQ ID NO: 34837 - protein, 9 aa, Homo Sapiens
YRHHQYEQH

SEQ ID NO: 34838 - protein, 9 aa, Homo Sapiens
NISLCHWHL

SEQ ID NO: 34839 - protein, 9 aa, Homo Sapiens
GLIVTLKGE

SEQ ID NO: 34840 - protein, 9 aa, Homo Sapiens
PEAGASVLA

SEQ ID NO: 34841 - protein, 9 aa, Homo Sapiens
SISMLSTSN

SEQ ID NO: 34842 - protein, 9 aa, Homo Sapiens
CHWHLFPLL

SEQ ID NO: 34843 - protein, 9 aa, Homo Sapiens
SPSSASSGD

SEQ ID NO: 34844 - protein, 9 aa, Homo Sapiens
EYVKTPEGG

SEQ ID NO: 34845 - protein, 9 aa, Homo Sapiens
QVHSEGRPA

SEQ ID NO: 34846 - protein, 9 aa, Homo Sapiens
KHLQEQKQQ

SEQ ID NO: 34847 - protein, 9 aa, Homo Sapiens
RERDLVPKP

SEQ ID NO: 34848 - protein, 9 aa, Homo Sapiens
AAHNGQVNL

SEQ ID NO: 34849 - protein, 9 aa, Homo Sapiens
CTNVKKSIR

SEQ ID NO: 34850 - protein, 9 aa, Homo Sapiens
YVKTPEGGS

SEQ ID NO: 34851 - protein, 9 aa, Homo Sapiens
ALIRYAQEH

SEQ ID NO: 34852 - protein, 9 aa, Homo Sapiens
FREKQQEVL

SEQ ID NO: 34853 - protein, 9 aa, Homo Sapiens
TFSSDEKSA

SEQ ID NO: 34854 - protein, 9 aa, Homo Sapiens
FCMHAEIRS

SEQ ID NO: 34855 - protein, 9 aa, Homo Sapiens
MDLHDTDDG

SEQ ID NO: 34856 - protein, 9 aa, Homo Sapiens
NSTDSRCYV

SEQ ID NO: 34857 - protein, 9 aa, Homo Sapiens
PRKGVKAKQ

SEQ ID NO: 34858 - protein, 9 aa, Homo Sapiens
VHSEGRPAV

SEQ ID NO: 34859 - protein, 9 aa, Homo Sapiens
PLLPRDPQP

SEQ ID NO: 34860 - protein, 9 aa, Homo Sapiens
SKSAKPCTN

SEQ ID NO: 34861 - protein, 9 aa, Homo Sapiens
IASKDTAPG

SEQ ID NO: 34862 - protein, 9 aa, Homo Sapiens
TGKVKGLIV

SEQ ID NO: 34863 - protein, 9 aa, Homo Sapiens
LICKSETVH

SEQ ID NO: 34864 - protein, 9 aa, Homo Sapiens
DLHDTDDGD

SEQ ID NO: 34865 - protein, 9 aa, Homo Sapiens
AAVNKGQME

SEQ ID NO: 34866 - protein, 9 aa, Homo Sapiens
AGYVNKVME

SEQ ID NO: 34867 - protein, 9 aa, Homo Sapiens
DELMHQECL

SEQ ID NO: 34868 - protein, 9 aa, Homo Sapiens
GVNDYRHWI

SEQ ID NO: 34869 - protein, 9 aa, Homo Sapiens
LHHSVHTGE

SEQ ID NO: 34870 - protein, 9 aa, Homo Sapiens
SKSVKRWKS

SEQ ID NO: 34871 - protein, 9 aa, Homo Sapiens
KIEKQRQSI

SEQ ID NO: 34872 - protein, 9 aa, Homo Sapiens
LSNLLAQEN

SEQ ID NO: 34873 - protein, 9 aa, Homo Sapiens
SAKHAAVNK

SEQ ID NO: 34874 - protein, 9 aa, Homo Sapiens
HLETLCSQI

SEQ ID NO: 34875 - protein, 9 aa, Homo Sapiens
RKLCPGLVN

SEQ ID NO: 34876 - protein, 9 aa, Homo Sapiens
AVFNISLCH

SEQ ID NO: 34877 - protein, 9 aa, Homo Sapiens
FQAFQIERH

SEQ ID NO: 34878 - protein, 9 aa, Homo Sapiens
LGYANEVGK

SEQ ID NO: 34879 - protein, 9 aa, Homo Sapiens
ISQELQDST

SEQ ID NO: 34880 - protein, 9 aa, Homo Sapiens
IPSPQSDGR

SEQ ID NO: 34881 - protein, 9 aa, Homo Sapiens
MIRTGEPEA

SEQ ID NO: 34882 - protein, 9 aa, Homo Sapiens
AMLIRARYI

SEQ ID NO: 34883 - protein, 9 aa, Homo Sapiens
GLVNRGLSA

SEQ ID NO: 34884 - protein, 9 aa, Homo Sapiens
QWKPNPDEE

SEQ ID NO: 34885 - protein, 9 aa, Homo Sapiens
MGAETRKRL

SEQ ID NO: 34886 - protein, 9 aa, Homo Sapiens
DEYVCNTTA

SEQ ID NO: 34887 - protein, 9 aa, Homo Sapiens
LQLHHSVHT

SEQ ID NO: 34888 - protein, 9 aa, Homo Sapiens
IFTLLIIAE

SEQ ID NO: 34889 - protein, 9 aa, Homo Sapiens
CIRPVPTTV

SEQ ID NO: 34890 - protein, 9 aa, Homo Sapiens
TLCSQIINA

SEQ ID NO: 34891 - protein, 9 aa, Homo Sapiens
WRYLILHEA

SEQ ID NO: 34892 - protein, 9 aa, Homo Sapiens
TRKRLPTLS

SEQ ID NO: 34893 - protein, 9 aa, Homo Sapiens
GVKAKQVFQ

SEQ ID NO: 34894 - protein, 9 aa, Homo Sapiens
LDRQGTADS

SEQ ID NO: 34895 - protein, 9 aa, Homo Sapiens
NDIIARAKL

SEQ ID NO: 34896 - protein, 9 aa, Homo Sapiens
ASSGDTTPL

SEQ ID NO: 34897 - protein, 9 aa, Homo Sapiens
EGRPAVFLH

SEQ ID NO: 34898 - protein, 9 aa, Homo Sapiens
RALIRYAQE

SEQ ID NO: 34899 - protein, 9 aa, Homo Sapiens
SAIDKIFTL

SEQ ID NO: 34900 - protein, 9 aa, Homo Sapiens
AMVTRPALA

SEQ ID NO: 34901 - protein, 9 aa, Homo Sapiens
HNGQVNLTV

SEQ ID NO: 34902 - protein, 9 aa, Homo Sapiens
NLRGYFACQ

SEQ ID NO: 34903 - protein, 9 aa, Homo Sapiens
QQLLEDFRE

SEQ ID NO: 34904 - protein, 9 aa, Homo Sapiens
LRGYFACQC

SEQ ID NO: 34905 - protein, 9 aa, Homo Sapiens
EKAANESER

SEQ ID NO: 34906 - protein, 9 aa, Homo Sapiens
LAPGSSASP

SEQ ID NO: 34907 - protein, 9 aa, Homo Sapiens
RVGTVPNGS

SEQ ID NO: 34908 - protein, 9 aa, Homo Sapiens
TKTLVKEQK

SEQ ID NO: 34909 - protein, 9 aa, Homo Sapiens
IEKQRQSIR

SEQ ID NO: 34910 - protein, 9 aa, Homo Sapiens
KSTDGSHKE

SEQ ID NO: 34911 - protein, 9 aa, Homo Sapiens
QELQDSTQL

SEQ ID NO: 34912 - protein, 9 aa, Homo Sapiens
FSSDEKSAF

SEQ ID NO: 34913 - protein, 9 aa, Homo Sapiens
IGHRLQETK

SEQ ID NO: 34914 - protein, 9 aa, Homo Sapiens
YVCNTTARA

SEQ ID NO: 34915 - protein, 9 aa, Homo Sapiens
QILSNLLAQ

SEQ ID NO: 34916 - protein, 9 aa, Homo Sapiens
DGRDPNQPD

SEQ ID NO: 34917 - protein, 9 aa, Homo Sapiens
MHHAAHNGQ

SEQ ID NO: 34918 - protein, 9 aa, Homo Sapiens
LCPGLVNRG

SEQ ID NO: 34919 - protein, 9 aa, Homo Sapiens
LYFSNMRKA

SEQ ID NO: 34920 - protein, 9 aa, Homo Sapiens
KGVKAKQVF

SEQ ID NO: 34921 - protein, 9 aa, Homo Sapiens
LLGGRDLEL

SEQ ID NO: 34922 - protein, 9 aa, Homo Sapiens
IIARAKLYK

SEQ ID NO: 34923 - protein, 9 aa, Homo Sapiens
IAVGSISML

SEQ ID NO: 34924 - protein, 9 aa, Homo Sapiens
KNWRYLILH

SEQ ID NO: 34925 - protein, 9 aa, Homo Sapiens
PGIIVASGN

SEQ ID NO: 34926 - protein, 9 aa, Homo Sapiens
QYPPFRVGT

SEQ ID NO: 34927 - protein, 9 aa, Homo Sapiens
LTFQAFQIE

SEQ ID NO: 34928 - protein, 9 aa, Homo Sapiens
VVDMDLHDT

SEQ ID NO: 34929 - protein, 9 aa, Homo Sapiens
TEKEKIEKQ

SEQ ID NO: 34930 - protein, 9 aa, Homo Sapiens
IGLDTALMP

SEQ ID NO: 34931 - protein, 9 aa, Homo Sapiens
SSKSVKRWK

SEQ ID NO: 34932 - protein, 9 aa, Homo Sapiens
QECLPPSTV

SEQ ID NO: 34933 - protein, 9 aa, Homo Sapiens
CINLRGYFA

SEQ ID NO: 34934 - protein, 9 aa, Homo Sapiens
PPAPAAAHT

SEQ ID NO: 34935 - protein, 9 aa, Homo Sapiens
DSNSSEPLL

SEQ ID NO: 34936 - protein, 9 aa, Homo Sapiens
QKLLRANNV

SEQ ID NO: 34937 - protein, 9 aa, Homo Sapiens
VPIPYGLIR

SEQ ID NO: 34938 - protein, 9 aa, Homo Sapiens
CIEKLCNKE

SEQ ID NO: 34939 - protein, 9 aa, Homo Sapiens
RVIKYSASV

SEQ ID NO: 34940 - protein, 9 aa, Homo Sapiens
LMHQECLPP

SEQ ID NO: 34941 - protein, 9 aa, Homo Sapiens
ASVNPHLRE

SEQ ID NO: 34942 - protein, 9 aa, Homo Sapiens
RECIEKLCN

SEQ ID NO: 34943 - protein, 9 aa, Homo Sapiens
LKSIKSLAL

SEQ ID NO: 34944 - protein, 9 aa, Homo Sapiens
VFNISLCHW

SEQ ID NO: 34945 - protein, 9 aa, Homo Sapiens
IHIHKKKYQ

SEQ ID NO: 34946 - protein, 9 aa, Homo Sapiens
IRARYISGI

SEQ ID NO: 34947 - protein, 9 aa, Homo Sapiens
QVTNKGEPE

SEQ ID NO: 34948 - protein, 9 aa, Homo Sapiens
TLVKEQKKA

SEQ ID NO: 34949 - protein, 9 aa, Homo Sapiens
ARQDVYNLL

SEQ ID NO: 34950 - protein, 9 aa, Homo Sapiens
FPLLPRDPQ

SEQ ID NO: 34951 - protein, 9 aa, Homo Sapiens
PETKTLVKE

SEQ ID NO: 34952 - protein, 9 aa, Homo Sapiens
QAFQIERHD

SEQ ID NO: 34953 - protein, 9 aa, Homo Sapiens
ERQQLLEDF

SEQ ID NO: 34954 - protein, 9 aa, Homo Sapiens
NPPWGSYRH

SEQ ID NO: 34955 - protein, 9 aa, Homo Sapiens
QRQKHLQEQ

SEQ ID NO: 34956 - protein, 9 aa, Homo Sapiens
HRLQETKGM

SEQ ID NO: 34957 - protein, 9 aa, Homo Sapiens
LMHHAAHNG

SEQ ID NO: 34958 - protein, 9 aa, Homo Sapiens
LWRQDIDLA

SEQ ID NO: 34959 - protein, 9 aa, Homo Sapiens
QGAERVSKA

SEQ ID NO: 34960 - protein, 9 aa, Homo Sapiens
RVPPPTLVV

SEQ ID NO: 34961 - protein, 9 aa, Homo Sapiens
LLEDFREKQ

SEQ ID NO: 34962 - protein, 9 aa, Homo Sapiens
ISAIKEITA

SEQ ID NO: 34963 - protein, 9 aa, Homo Sapiens
ERVSKANPS

SEQ ID NO: 34964 - protein, 9 aa, Homo Sapiens
AQDPNGRCI

SEQ ID NO: 34965 - protein, 9 aa, Homo Sapiens
RQYYFTIGW

SEQ ID NO: 34966 - protein, 9 aa, Homo Sapiens
ERECIEKLC

SEQ ID NO: 34967 - protein, 9 aa, Homo Sapiens
PIAVGSISM

SEQ ID NO: 34968 - protein, 9 aa, Homo Sapiens
HAAVNKGQM

SEQ ID NO: 34969 - protein, 9 aa, Homo Sapiens
MDKQRQKHL

SEQ ID NO: 34970 - protein, 9 aa, Homo Sapiens
VVLQVKESL

SEQ ID NO: 34971 - protein, 9 aa, Homo Sapiens
EKIEKQRQS

SEQ ID NO: 34972 - protein, 9 aa, Homo Sapiens
KVVLQVKES

SEQ ID NO: 34973 - protein, 9 aa, Homo Sapiens
SQELQDSTQ

SEQ ID NO: 34974 - protein, 9 aa, Homo Sapiens
RRVHTISAA

SEQ ID NO: 34975 - protein, 9 aa, Homo Sapiens
IRVIKYSAS

SEQ ID NO: 34976 - protein, 9 aa, Homo Sapiens
NWRYLILHE

SEQ ID NO: 34977 - protein, 9 aa, Homo Sapiens
EQGRERDLV

SEQ ID NO: 34978 - protein, 9 aa, Homo Sapiens
GRDPNQPDD

SEQ ID NO: 34979 - protein, 9 aa, Homo Sapiens
IECAAGFQL

SEQ ID NO: 34980 - protein, 9 aa, Homo Sapiens
VALIFTGPQ

SEQ ID NO: 34981 - protein, 9 aa, Homo Sapiens
GTFSSDEKS

SEQ ID NO: 34982 - protein, 9 aa, Homo Sapiens
AELRGLRAK

SEQ ID NO: 34983 - protein, 9 aa, Homo Sapiens
FPSRARGGY

SEQ ID NO: 34984 - protein, 9 aa, Homo Sapiens
MDEYVCNTT

SEQ ID NO: 34985 - protein, 9 aa, Homo Sapiens
LHDTDDGDD

SEQ ID NO: 34986 - protein, 9 aa, Homo Sapiens
LYNSMKNEK

SEQ ID NO: 34987 - protein, 9 aa, Homo Sapiens
SWLTPVMMK

SEQ ID NO: 34988 - protein, 9 aa, Homo Sapiens
RSVVDMDLH

SEQ ID NO: 34989 - protein, 9 aa, Homo Sapiens
WDVEEYVKT

SEQ ID NO: 34990 - protein, 9 aa, Homo Sapiens
TLYNSMKNE

SEQ ID NO: 34991 - protein, 9 aa, Homo Sapiens
DTPYNQNIL

SEQ ID NO: 34992 - protein, 9 aa, Homo Sapiens
PQPHLVALI

SEQ ID NO: 34993 - protein, 9 aa, Homo Sapiens
TYKSTDGSH

SEQ ID NO: 34994 - protein, 9 aa, Homo Sapiens
VDAESQPTP

SEQ ID NO: 34995 - protein, 9 aa, Homo Sapiens
QENRDKWEE

SEQ ID NO: 34996 - protein, 9 aa, Homo Sapiens
DEEECRALI

SEQ ID NO: 34997 - protein, 9 aa, Homo Sapiens
TYKGQVPKN

SEQ ID NO: 34998 - protein, 9 aa, Homo Sapiens
NGNSFDMLR

SEQ ID NO: 34999 - protein, 9 aa, Homo Sapiens
HGQPKLSRS

SEQ ID NO: 35000 - protein, 9 aa, Homo Sapiens
PVPPEDDAC

SEQ ID NO: 35001 - protein, 9 aa, Homo Sapiens
LRVSYARLA

SEQ ID NO: 35002 - protein, 9 aa, Homo Sapiens
SEPSVSKGQ

SEQ ID NO: 35003 - protein, 9 aa, Homo Sapiens
QAIVTWRGH

SEQ ID NO: 35004 - protein, 9 aa, Homo Sapiens
NKWHGRFLA

SEQ ID NO: 35005 - protein, 9 aa, Homo Sapiens
RSSHFLRHQ

SEQ ID NO: 35006 - protein, 9 aa, Homo Sapiens
AFLVEVSGP

SEQ ID NO: 35007 - protein, 9 aa, Homo Sapiens
SLRTRRKEA

SEQ ID NO: 35008 - protein, 9 aa, Homo Sapiens
TQAQPAFLV

SEQ ID NO: 35009 - protein, 9 aa, Homo Sapiens
SSCFAGCSN

SEQ ID NO: 35010 - protein, 9 aa, Homo Sapiens
DGSYNIRKH

SEQ ID NO: 35011 - protein, 9 aa, Homo Sapiens
HPEVELLCS

SEQ ID NO: 35012 - protein, 9 aa, Homo Sapiens
INEFSTLPL

SEQ ID NO: 35013 - protein, 9 aa, Homo Sapiens
RSPEKLSLA

SEQ ID NO: 35014 - protein, 9 aa, Homo Sapiens
GSFNTSFQD

SEQ ID NO: 35015 - protein, 9 aa, Homo Sapiens
ELPPLGSPG

SEQ ID NO: 35016 - protein, 9 aa, Homo Sapiens
DFVLVGPVP

SEQ ID NO: 35017 - protein, 9 aa, Homo Sapiens
GRRYNRRLN

SEQ ID NO: 35018 - protein, 9 aa, Homo Sapiens
GIVALLDEE

SEQ ID NO: 35019 - protein, 9 aa, Homo Sapiens
RMKNNEEAQ

SEQ ID NO: 35020 - protein, 9 aa, Homo Sapiens
VKHELLKQP

SEQ ID NO: 35021 - protein, 9 aa, Homo Sapiens
VPKAPSNPH

SEQ ID NO: 35022 - protein, 9 aa, Homo Sapiens
CPLDHTTPP

SEQ ID NO: 35023 - protein, 9 aa, Homo Sapiens
PEFNQKEDD

SEQ ID NO: 35024 - protein, 9 aa, Homo Sapiens
HVSKHVKTH

SEQ ID NO: 35025 - protein, 9 aa, Homo Sapiens
ISAIEKSRK

SEQ ID NO: 35026 - protein, 9 aa, Homo Sapiens
LQLHRDKRV

SEQ ID NO: 35027 - protein, 9 aa, Homo Sapiens
EKSLLVAFS

SEQ ID NO: 35028 - protein, 9 aa, Homo Sapiens
SEDKIALYT

SEQ ID NO: 35029 - protein, 9 aa, Homo Sapiens
KNQLIKQFP

SEQ ID NO: 35030 - protein, 9 aa, Homo Sapiens
CGSESFQSN

SEQ ID NO: 35031 - protein, 9 aa, Homo Sapiens
FHNIAVKEN

SEQ ID NO: 35032 - protein, 9 aa, Homo Sapiens
QPKLSRSAS

SEQ ID NO: 35033 - protein, 9 aa, Homo Sapiens
SLPAAILSD

SEQ ID NO: 35034 - protein, 9 aa, Homo Sapiens
GLPRGAPSP

SEQ ID NO: 35035 - protein, 9 aa, Homo Sapiens
LVAFSLSRV

SEQ ID NO: 35036 - protein, 9 aa, Homo Sapiens
RKEAEMELS

SEQ ID NO: 35037 - protein, 9 aa, Homo Sapiens
CVLISLLVP

SEQ ID NO: 35038 - protein, 9 aa, Homo Sapiens
GAASYPPGG

SEQ ID NO: 35039 - protein, 9 aa, Homo Sapiens
DLLRHLPLL

SEQ ID NO: 35040 - protein, 9 aa, Homo Sapiens
LASGKYLPQ

SEQ ID NO: 35041 - protein, 9 aa, Homo Sapiens
SEDLEANDI

SEQ ID NO: 35042 - protein, 9 aa, Homo Sapiens
YMAIIEEAK

SEQ ID NO: 35043 - protein, 9 aa, Homo Sapiens
EVWEILLTP

SEQ ID NO: 35044 - protein, 9 aa, Homo Sapiens
LDHTTPPAW

SEQ ID NO: 35045 - protein, 9 aa, Homo Sapiens
PAHRPPQPW

SEQ ID NO: 35046 - protein, 9 aa, Homo Sapiens
CPHRPILQA

SEQ ID NO: 35047 - protein, 9 aa, Homo Sapiens
GQPPEPCLG

SEQ ID NO: 35048 - protein, 9 aa, Homo Sapiens
LLKQRLNVA

SEQ ID NO: 35049 - protein, 9 aa, Homo Sapiens
KKNTKKCHS

SEQ ID NO: 35050 - protein, 9 aa, Homo Sapiens
ASVTMAISQ

SEQ ID NO: 35051 - protein, 9 aa, Homo Sapiens
AATWNLEKK

SEQ ID NO: 35052 - protein, 9 aa, Homo Sapiens
IKNQLIKQF

SEQ ID NO: 35053 - protein, 9 aa, Homo Sapiens
GSYNIRKHD

SEQ ID NO: 35054 - protein, 9 aa, Homo Sapiens
GYWGERINQ

SEQ ID NO: 35055 - protein, 9 aa, Homo Sapiens
RVHRDIPMP

SEQ ID NO: 35056 - protein, 9 aa, Homo Sapiens
DRNKWHGRF

SEQ ID NO: 35057 - protein, 9 aa, Homo Sapiens
GPAPRAGAP

SEQ ID NO: 35058 - protein, 9 aa, Homo Sapiens
LVPKAPSNP

SEQ ID NO: 35059 - protein, 9 aa, Homo Sapiens
ADLPGHPDG

SEQ ID NO: 35060 - protein, 9 aa, Homo Sapiens
LLRHLPLLR

SEQ ID NO: 35061 - protein, 9 aa, Homo Sapiens
EAQDYDDDL

SEQ ID NO: 35062 - protein, 9 aa, Homo Sapiens
CCPPPMKRK

SEQ ID NO: 35063 - protein, 9 aa, Homo Sapiens
NIRKHDIIA

SEQ ID NO: 35064 - protein, 9 aa, Homo Sapiens
ELAMKANTL

SEQ ID NO: 35065 - protein, 9 aa, Homo Sapiens
EAIETAISL

SEQ ID NO: 35066 - protein, 9 aa, Homo Sapiens
VSKGQMVTV

SEQ ID NO: 35067 - protein, 9 aa, Homo Sapiens
TQYAVIEGL

SEQ ID NO: 35068 - protein, 9 aa, Homo Sapiens
GTPPHPGKP

SEQ ID NO: 35069 - protein, 9 aa, Homo Sapiens
RVYRVHRDI

SEQ ID NO: 35070 - protein, 9 aa, Homo Sapiens
GYCFRAQQQ

SEQ ID NO: 35071 - protein, 9 aa, Homo Sapiens
LPLLRHLDL

SEQ ID NO: 35072 - protein, 9 aa, Homo Sapiens
QPWLPAPAA

SEQ ID NO: 35073 - protein, 9 aa, Homo Sapiens
TPPHPGKPE

SEQ ID NO: 35074 - protein, 9 aa, Homo Sapiens
EQNANQILS

SEQ ID NO: 35075 - protein, 9 aa, Homo Sapiens
PMHPPPACP

SEQ ID NO: 35076 - protein, 9 aa, Homo Sapiens
EVQSFHSET

SEQ ID NO: 35077 - protein, 9 aa, Homo Sapiens
KKCHSFTAL

SEQ ID NO: 35078 - protein, 9 aa, Homo Sapiens
ACDPVPLPP

SEQ ID NO: 35079 - protein, 9 aa, Homo Sapiens
RRYNRRLNL

SEQ ID NO: 35080 - protein, 9 aa, Homo Sapiens
LGAESGWGL

SEQ ID NO: 35081 - protein, 9 aa, Homo Sapiens
AYTEYPVNT

SEQ ID NO: 35082 - protein, 9 aa, Homo Sapiens
VAINEFSTL

SEQ ID NO: 35083 - protein, 9 aa, Homo Sapiens
HRGHVFKAG

SEQ ID NO: 35084 - protein, 9 aa, Homo Sapiens
YQNLRVSYA

SEQ ID NO: 35085 - protein, 9 aa, Homo Sapiens
AVVRISRAQ

SEQ ID NO: 35086 - protein, 9 aa, Homo Sapiens
RDLLRHLPL

SEQ ID NO: 35087 - protein, 9 aa, Homo Sapiens
PSDGPGSGA

SEQ ID NO: 35088 - protein, 9 aa, Homo Sapiens
TKGSASTLV

SEQ ID NO: 35089 - protein, 9 aa, Homo Sapiens
FSEDKIALY

SEQ ID NO: 35090 - protein, 9 aa, Homo Sapiens
RSAAHEAVR

SEQ ID NO: 35091 - protein, 9 aa, Homo Sapiens
VQYFSSCFA

SEQ ID NO: 35092 - protein, 9 aa, Homo Sapiens
PMRVHEVAE

SEQ ID NO: 35093 - protein, 9 aa, Homo Sapiens
VTMAISQMN

SEQ ID NO: 35094 - protein, 9 aa, Homo Sapiens
PKLSRSASE

SEQ ID NO: 35095 - protein, 9 aa, Homo Sapiens
PSLRTRRKE

SEQ ID NO: 35096 - protein, 9 aa, Homo Sapiens
DDTQYAVIE

SEQ ID NO: 35097 - protein, 9 aa, Homo Sapiens
PEDDACGSE

SEQ ID NO: 35098 - protein, 9 aa, Homo Sapiens
NANQILSVS

SEQ ID NO: 35099 - protein, 9 aa, Homo Sapiens
PWLPAPAAD

SEQ ID NO: 35100 - protein, 9 aa, Homo Sapiens
RVSYARLAP

SEQ ID NO: 35101 - protein, 9 aa, Homo Sapiens
VPPEDDACG

SEQ ID NO: 35102 - protein, 9 aa, Homo Sapiens
PSKIAYTEY

SEQ ID NO: 35103 - protein, 9 aa, Homo Sapiens
KCHSFTALS

SEQ ID NO: 35104 - protein, 9 aa, Homo Sapiens
VYRVHRDIP

SEQ ID NO: 35105 - protein, 9 aa, Homo Sapiens
YGGSVDSDP

SEQ ID NO: 35106 - protein, 9 aa, Homo Sapiens
ASYPPGGFS

SEQ ID NO: 35107 - protein, 9 aa, Homo Sapiens
PLGSPGGSS

SEQ ID NO: 35108 - protein, 9 aa, Homo Sapiens
YTEYPVNTI

SEQ ID NO: 35109 - protein, 9 aa, Homo Sapiens
TQQREVQSF

SEQ ID NO: 35110 - protein, 9 aa, Homo Sapiens
SDMTAINNV

SEQ ID NO: 35111 - protein, 9 aa, Homo Sapiens
STPGKKHRG

SEQ ID NO: 35112 - protein, 9 aa, Homo Sapiens
YVLVAINEF

SEQ ID NO: 35113 - protein, 9 aa, Homo Sapiens
VVTVHPNGN

SEQ ID NO: 35114 - protein, 9 aa, Homo Sapiens
FLPVVDFCL

SEQ ID NO: 35115 - protein, 9 aa, Homo Sapiens
SRSAAHEAV

SEQ ID NO: 35116 - protein, 9 aa, Homo Sapiens
DKIALYTAL

SEQ ID NO: 35117 - protein, 9 aa, Homo Sapiens
YGLQLHRDK

SEQ ID NO: 35118 - protein, 9 aa, Homo Sapiens
PVRGESIPM

SEQ ID NO: 35119 - protein, 9 aa, Homo Sapiens
MGTPGYWGE

SEQ ID NO: 35120 - protein, 9 aa, Homo Sapiens
PGGFSLYTG

SEQ ID NO: 35121 - protein, 9 aa, Homo Sapiens
VLISLLVPL

SEQ ID NO: 35122 - protein, 9 aa, Homo Sapiens
MPSLRTRRK

SEQ ID NO: 35123 - protein, 9 aa, Homo Sapiens
ETAISLETA

SEQ ID NO: 35124 - protein, 9 aa, Homo Sapiens
AIEKSRKHI

SEQ ID NO: 35125 - protein, 9 aa, Homo Sapiens
RCGSSENLH

SEQ ID NO: 35126 - protein, 9 aa, Homo Sapiens
KQFPGIEPW

SEQ ID NO: 35127 - protein, 9 aa, Homo Sapiens
RTRRKEAEM

SEQ ID NO: 35128 - protein, 9 aa, Homo Sapiens
PPGIVALLD

SEQ ID NO: 35129 - protein, 9 aa, Homo Sapiens
MRLFLAGYE

SEQ ID NO: 35130 - protein, 9 aa, Homo Sapiens
HYQNLRVSY

SEQ ID NO: 35131 - protein, 9 aa, Homo Sapiens
KEEFDTLCV

SEQ ID NO: 35132 - protein, 9 aa, Homo Sapiens
SGWGLPRGA

SEQ ID NO: 35133 - protein, 9 aa, Homo Sapiens
PVQSWKGLG

SEQ ID NO: 35134 - protein, 9 aa, Homo Sapiens
SVYGLQLHR

SEQ ID NO: 35135 - protein, 9 aa, Homo Sapiens
LSEITKQEK

SEQ ID NO: 35136 - protein, 9 aa, Homo Sapiens
LPAPAADLP

SEQ ID NO: 35137 - protein, 9 aa, Homo Sapiens
AEQNANQIL

SEQ ID NO: 35138 - protein, 9 aa, Homo Sapiens
KKHRGLLTS

SEQ ID NO: 35139 - protein, 9 aa, Homo Sapiens
NNEEAQDYD

SEQ ID NO: 35140 - protein, 9 aa, Homo Sapiens
KYSSGFHNI

SEQ ID NO: 35141 - protein, 9 aa, Homo Sapiens
EEKSLLVAF

SEQ ID NO: 35142 - protein, 9 aa, Homo Sapiens
VNPKISFLP

SEQ ID NO: 35143 - protein, 9 aa, Homo Sapiens
AFSLSRVRS

SEQ ID NO: 35144 - protein, 9 aa, Homo Sapiens
SKGCFSEED

SEQ ID NO: 35145 - protein, 9 aa, Homo Sapiens
TILDDTQYA

SEQ ID NO: 35146 - protein, 9 aa, Homo Sapiens
AFIFNEKFF

SEQ ID NO: 35147 - protein, 9 aa, Homo Sapiens
KLSRSASES

SEQ ID NO: 35148 - protein, 9 aa, Homo Sapiens
FRAQQQRSL

SEQ ID NO: 35149 - protein, 9 aa, Homo Sapiens
AEEKSLLVA

SEQ ID NO: 35150 - protein, 9 aa, Homo Sapiens
TEAIETAIS

SEQ ID NO: 35151 - protein, 9 aa, Homo Sapiens
SALHFSEDK

SEQ ID NO: 35152 - protein, 9 aa, Homo Sapiens
KVSDIKEQV

SEQ ID NO: 35153 - protein, 9 aa, Homo Sapiens
PEPCLGAES

SEQ ID NO: 35154 - protein, 9 aa, Homo Sapiens
LLCSQLILK

SEQ ID NO: 35155 - protein, 9 aa, Homo Sapiens
VRHVQDLLK

SEQ ID NO: 35156 - protein, 9 aa, Homo Sapiens
DGQPPEPCL

SEQ ID NO: 35157 - protein, 9 aa, Homo Sapiens
PDTELPPLG

SEQ ID NO: 35158 - protein, 9 aa, Homo Sapiens
ILSDMTAIN

SEQ ID NO: 35159 - protein, 9 aa, Homo Sapiens
ERCPHRPIL

SEQ ID NO: 35160 - protein, 9 aa, Homo Sapiens
GIKNQLIKQ

SEQ ID NO: 35161 - protein, 9 aa, Homo Sapiens
PEVELLCSQ

SEQ ID NO: 35162 - protein, 9 aa, Homo Sapiens
LRLVGDRNK

SEQ ID NO: 35163 - protein, 9 aa, Homo Sapiens
VGDRNKWHG

SEQ ID NO: 35164 - protein, 9 aa, Homo Sapiens
ASGKYLPQT

SEQ ID NO: 35165 - protein, 9 aa, Homo Sapiens
SNKKVSIDL

SEQ ID NO: 35166 - protein, 9 aa, Homo Sapiens
HELAMKANT

SEQ ID NO: 35167 - protein, 9 aa, Homo Sapiens
ILDDTQYAV

SEQ ID NO: 35168 - protein, 9 aa, Homo Sapiens
PASVTMAIS

SEQ ID NO: 35169 - protein, 9 aa, Homo Sapiens
KIALYTALV

SEQ ID NO: 35170 - protein, 9 aa, Homo Sapiens
IFRTAMQFV

SEQ ID NO: 35171 - protein, 9 aa, Homo Sapiens
RPPQPWLPA

SEQ ID NO: 35172 - protein, 9 aa, Homo Sapiens
VQSFHSETD

SEQ ID NO: 35173 - protein, 9 aa, Homo Sapiens
PMRLFLAGY

SEQ ID NO: 35174 - protein, 9 aa, Homo Sapiens
TELPPLGSP

SEQ ID NO: 35175 - protein, 9 aa, Homo Sapiens
KYLPQTYVV

SEQ ID NO: 35176 - protein, 9 aa, Homo Sapiens
KSAVKALGK

SEQ ID NO: 35177 - protein, 9 aa, Homo Sapiens
MKNNEEAQD

SEQ ID NO: 35178 - protein, 9 aa, Homo Sapiens
PHPEVELLC

SEQ ID NO: 35179 - protein, 9 aa, Homo Sapiens
WLAQAIVTW

SEQ ID NO: 35180 - protein, 9 aa, Homo Sapiens
AAILSDMTA

SEQ ID NO: 35181 - protein, 9 aa, Homo Sapiens
PAAILSDMT

SEQ ID NO: 35182 - protein, 9 aa, Homo Sapiens
RFMRSDHVS

SEQ ID NO: 35183 - protein, 9 aa, Homo Sapiens
EITKQEKDF

SEQ ID NO: 35184 - protein, 9 aa, Homo Sapiens
PCHKNKDRL

SEQ ID NO: 35185 - protein, 9 aa, Homo Sapiens
EQVLAAACH

SEQ ID NO: 35186 - protein, 9 aa, Homo Sapiens
GYVLVAINE

SEQ ID NO: 35187 - protein, 9 aa, Homo Sapiens
RKPCHKNKD

SEQ ID NO: 35188 - protein, 9 aa, Homo Sapiens
SGKYLPQTY

SEQ ID NO: 35189 - protein, 9 aa, Homo Sapiens
VLERCPHRP

SEQ ID NO: 35190 - protein, 9 aa, Homo Sapiens
PCLGAESGW

SEQ ID NO: 35191 - protein, 9 aa, Homo Sapiens
SENLHDSVR

SEQ ID NO: 35192 - protein, 9 aa, Homo Sapiens
HRPPQPWLP

SEQ ID NO: 35193 - protein, 9 aa, Homo Sapiens
TKEEFDTLC

SEQ ID NO: 35194 - protein, 9 aa, Homo Sapiens
FRLVPKAPS

SEQ ID NO: 35195 - protein, 9 aa, Homo Sapiens
QPGAGPAPR

SEQ ID NO: 35196 - protein, 9 aa, Homo Sapiens
KQEKDFLWS

SEQ ID NO: 35197 - protein, 9 aa, Homo Sapiens
KVSIDLLKQ

SEQ ID NO: 35198 - protein, 9 aa, Homo Sapiens
RLVPKAPSN

SEQ ID NO: 35199 - protein, 9 aa, Homo Sapiens
IEKSRKHIN

SEQ ID NO: 35200 - protein, 9 aa, Homo Sapiens
FSKGCFSEE

SEQ ID NO: 35201 - protein, 9 aa, Homo Sapiens
LPPLGSPGG

SEQ ID NO: 35202 - protein, 9 aa, Homo Sapiens
QQQRSLEAM

SEQ ID NO: 35203 - protein, 9 aa, Homo Sapiens
DGVQYFSSC

SEQ ID NO: 35204 - protein, 9 aa, Homo Sapiens
AMKANTLCI

SEQ ID NO: 35205 - protein, 9 aa, Homo Sapiens
FDSACDPVP

SEQ ID NO: 35206 - protein, 9 aa, Homo Sapiens
AHEAVRMQP

SEQ ID NO: 35207 - protein, 9 aa, Homo Sapiens
QKEDDEWIL

SEQ ID NO: 35208 - protein, 9 aa, Homo Sapiens
AVIEGLETF

SEQ ID NO: 35209 - protein, 9 aa, Homo Sapiens
LEKKRLTWR

SEQ ID NO: 35210 - protein, 9 aa, Homo Sapiens
LTKEEFDTL

SEQ ID NO: 35211 - protein, 9 aa, Homo Sapiens
FFSKGCFSE

SEQ ID NO: 35212 - protein, 9 aa, Homo Sapiens
FNEKFFQDL

SEQ ID NO: 35213 - protein, 9 aa, Homo Sapiens
PLYSAEIAE

SEQ ID NO: 35214 - protein, 9 aa, Homo Sapiens
VFEKPLYSA

SEQ ID NO: 35215 - protein, 9 aa, Homo Sapiens
HEAVRMQPG

SEQ ID NO: 35216 - protein, 9 aa, Homo Sapiens
IETAISLET

SEQ ID NO: 35217 - protein, 9 aa, Homo Sapiens
APAHRPPQP

SEQ ID NO: 35218 - protein, 9 aa, Homo Sapiens
PHSAVVRIS

SEQ ID NO: 35219 - protein, 9 aa, Homo Sapiens
GLGLPRAGC

SEQ ID NO: 35220 - protein, 9 aa, Homo Sapiens
YSSGFHNIA

SEQ ID NO: 35221 - protein, 9 aa, Homo Sapiens
QAQPAFLVE

SEQ ID NO: 35222 - protein, 9 aa, Homo Sapiens
TKQEKDFLW

SEQ ID NO: 35223 - protein, 9 aa, Homo Sapiens
NMDPSKIAY

SEQ ID NO: 35224 - protein, 9 aa, Homo Sapiens
EDDACGSES

SEQ ID NO: 35225 - protein, 9 aa, Homo Sapiens
DIMNRKPCH

SEQ ID NO: 35226 - protein, 9 aa, Homo Sapiens
ELLCSQLIL

SEQ ID NO: 35227 - protein, 9 aa, Homo Sapiens
MGHRGHVFK

SEQ ID NO: 35228 - protein, 9 aa, Homo Sapiens
VLVAINEFS

SEQ ID NO: 35229 - protein, 9 aa, Homo Sapiens
EYDQVLDFV

SEQ ID NO: 35230 - protein, 9 aa, Homo Sapiens
QLIKQFPGI

SEQ ID NO: 35231 - protein, 9 aa, Homo Sapiens
YKGQVPKNE

SEQ ID NO: 35232 - protein, 9 aa, Homo Sapiens
KNEANVVIT

SEQ ID NO: 35233 - protein, 9 aa, Homo Sapiens
ASEDLEAND

SEQ ID NO: 35234 - protein, 9 aa, Homo Sapiens
GDGVQYFSS

SEQ ID NO: 35235 - protein, 9 aa, Homo Sapiens
YDQVLDFVL

SEQ ID NO: 35236 - protein, 9 aa, Homo Sapiens
EGEGEVEEE

SEQ ID NO: 35237 - protein, 9 aa, Homo Sapiens
SVDSDPPPK

SEQ ID NO: 35238 - protein, 9 aa, Homo Sapiens
IRKHDIIAL

SEQ ID NO: 35239 - protein, 9 aa, Homo Sapiens
FVLVGPVPA

SEQ ID NO: 35240 - protein, 9 aa, Homo Sapiens
PVFEKPLYS

SEQ ID NO: 35241 - protein, 9 aa, Homo Sapiens
EKSFFSKGC

SEQ ID NO: 35242 - protein, 9 aa, Homo Sapiens
TPMRVHEVA

SEQ ID NO: 35243 - protein, 9 aa, Homo Sapiens
AMPVFEKPL

SEQ ID NO: 35244 - protein, 9 aa, Homo Sapiens
EHELAMKAN

SEQ ID NO: 35245 - protein, 9 aa, Homo Sapiens
YFRLVPKAP

SEQ ID NO: 35246 - protein, 9 aa, Homo Sapiens
KHDIIALYP

SEQ ID NO: 35247 - protein, 9 aa, Homo Sapiens
AMQFVGLLL

SEQ ID NO: 35248 - protein, 9 aa, Homo Sapiens
PWTRVYRVH

SEQ ID NO: 35249 - protein, 9 aa, Homo Sapiens
VLDFVLVGP

SEQ ID NO: 35250 - protein, 9 aa, Homo Sapiens
YTKGSASTL

SEQ ID NO: 35251 - protein, 9 aa, Homo Sapiens
QREVQSFHS

SEQ ID NO: 35252 - protein, 9 aa, Homo Sapiens
FMRSDHVSK

SEQ ID NO: 35253 - protein, 9 aa, Homo Sapiens
TKKCHSFTA

SEQ ID NO: 35254 - protein, 9 aa, Homo Sapiens
GEVVTVHPN

SEQ ID NO: 35255 - protein, 9 aa, Homo Sapiens
MHPPPACPL

SEQ ID NO: 35256 - protein, 9 aa, Homo Sapiens
WTRVYRVHR

SEQ ID NO: 35257 - protein, 9 aa, Homo Sapiens
ISLLVPLAF

SEQ ID NO: 35258 - protein, 9 aa, Homo Sapiens
CTPSDGPGS

SEQ ID NO: 35259 - protein, 9 aa, Homo Sapiens
YRVHRDIPM

SEQ ID NO: 35260 - protein, 9 aa, Homo Sapiens
EAKCIKGDS

SEQ ID NO: 35261 - protein, 9 aa, Homo Sapiens
EPEFNQKED

SEQ ID NO: 35262 - protein, 9 aa, Homo Sapiens
TTYKGQVPK

SEQ ID NO: 35263 - protein, 9 aa, Homo Sapiens
PKNEANVVI

SEQ ID NO: 35264 - protein, 9 aa, Homo Sapiens
LIFRTAMQF

SEQ ID NO: 35265 - protein, 9 aa, Homo Sapiens
AIETAISLE

SEQ ID NO: 35266 - protein, 9 aa, Homo Sapiens
APAADLPGH

SEQ ID NO: 35267 - protein, 9 aa, Homo Sapiens
KQPWKESAE

SEQ ID NO: 35268 - protein, 9 aa, Homo Sapiens
SYARLAPGY

SEQ ID NO: 35269 - protein, 9 aa, Homo Sapiens
GYGGSVDSD

SEQ ID NO: 35270 - protein, 9 aa, Homo Sapiens
SFFSKGCFS

SEQ ID NO: 35271 - protein, 9 aa, Homo Sapiens
KGDVFDSAC

SEQ ID NO: 35272 - protein, 9 aa, Homo Sapiens
GKYSSGFHN

SEQ ID NO: 35273 - protein, 9 aa, Homo Sapiens
GGPGWLAQA

SEQ ID NO: 35274 - protein, 9 aa, Homo Sapiens
ISFLPVVDF

SEQ ID NO: 35275 - protein, 9 aa, Homo Sapiens
DIKEQVLAA

SEQ ID NO: 35276 - protein, 9 aa, Homo Sapiens
KEQVLAAAC

SEQ ID NO: 35277 - protein, 9 aa, Homo Sapiens
RLVGDRNKW

SEQ ID NO: 35278 - protein, 9 aa, Homo Sapiens
VKALGKAAS

SEQ ID NO: 35279 - protein, 9 aa, Homo Sapiens
PPEPCLGAE

SEQ ID NO: 35280 - protein, 9 aa, Homo Sapiens
DHTTPPAWS

SEQ ID NO: 35281 - protein, 9 aa, Homo Sapiens
DSDPPPKRK

SEQ ID NO: 35282 - protein, 9 aa, Homo Sapiens
DTQYAVIEG

SEQ ID NO: 35283 - protein, 9 aa, Homo Sapiens
PPASVTMAI

SEQ ID NO: 35284 - protein, 9 aa, Homo Sapiens
SGKHGQPKL

SEQ ID NO: 35285 - protein, 9 aa, Homo Sapiens
LRTRRKEAE

SEQ ID NO: 35286 - protein, 9 aa, Homo Sapiens
ASTLVQGSI

SEQ ID NO: 35287 - protein, 9 aa, Homo Sapiens
SVSKGQMVT

SEQ ID NO: 35288 - protein, 9 aa, Homo Sapiens
RYNRRLNLD

SEQ ID NO: 35289 - protein, 9 aa, Homo Sapiens
EEAKCIKGD

SEQ ID NO: 35290 - protein, 9 aa, Homo Sapiens
EEEKSFFSK

SEQ ID NO: 35291 - protein, 9 aa, Homo Sapiens
AGAPAHRPP

SEQ ID NO: 35292 - protein, 9 aa, Homo Sapiens
QFVGLLLSL

SEQ ID NO: 35293 - protein, 9 aa, Homo Sapiens
GSVDSDPPP

SEQ ID NO: 35294 - protein, 9 aa, Homo Sapiens
SQGTPPHPG

SEQ ID NO: 35295 - protein, 9 aa, Homo Sapiens
NQKEDDEWI

SEQ ID NO: 35296 - protein, 9 aa, Homo Sapiens
TTPPAWSPP

SEQ ID NO: 35297 - protein, 9 aa, Homo Sapiens
AISQMNHLS

SEQ ID NO: 35298 - protein, 9 aa, Homo Sapiens
RSDHVSKHV

SEQ ID NO: 35299 - protein, 9 aa, Homo Sapiens
PPAWSPPWV

SEQ ID NO: 35300 - protein, 9 aa, Homo Sapiens
GAGPAPRAG

SEQ ID NO: 35301 - protein, 9 aa, Homo Sapiens
AHRPPQPWL

SEQ ID NO: 35302 - protein, 9 aa, Homo Sapiens
TPGYWGERI

SEQ ID NO: 35303 - protein, 9 aa, Homo Sapiens
GFHNIAVKE

SEQ ID NO: 35304 - protein, 9 aa, Homo Sapiens
GGSVDSDPP

SEQ ID NO: 35305 - protein, 9 aa, Homo Sapiens
HVQDLLKSL

SEQ ID NO: 35306 - protein, 9 aa, Homo Sapiens
TLCVPLFDG

SEQ ID NO: 35307 - protein, 9 aa, Homo Sapiens
DLPGHPDGQ

SEQ ID NO: 35308 - protein, 9 aa, Homo Sapiens
LSDMTAINN

SEQ ID NO: 35309 - protein, 9 aa, Homo Sapiens
RHLPLLRHL

SEQ ID NO: 35310 - protein, 9 aa, Homo Sapiens
ELDFISAIE

SEQ ID NO: 35311 - protein, 9 aa, Homo Sapiens
KKRLTWRLP

SEQ ID NO: 35312 - protein, 9 aa, Homo Sapiens
LISLLVPLA

SEQ ID NO: 35313 - protein, 9 aa, Homo Sapiens
DKSAVKALG

SEQ ID NO: 35314 - protein, 9 aa, Homo Sapiens
IHVRHVQDL

SEQ ID NO: 35315 - protein, 9 aa, Homo Sapiens
SKGQMVTVT

SEQ ID NO: 35316 - protein, 9 aa, Homo Sapiens
KKVSDIKEQ

SEQ ID NO: 35317 - protein, 9 aa, Homo Sapiens
FLVEVSGPV

SEQ ID NO: 35318 - protein, 9 aa, Homo Sapiens
PPACPLDHT

SEQ ID NO: 35319 - protein, 9 aa, Homo Sapiens
EELDFISAI

SEQ ID NO: 35320 - protein, 9 aa, Homo Sapiens
QQRSLEAMM

SEQ ID NO: 35321 - protein, 9 aa, Homo Sapiens
VTGYVLVAI

SEQ ID NO: 35322 - protein, 9 aa, Homo Sapiens
LPVVDFCLL

SEQ ID NO: 35323 - protein, 9 aa, Homo Sapiens
KGIKNQLIK

SEQ ID NO: 35324 - protein, 9 aa, Homo Sapiens
LLKQPWKES

SEQ ID NO: 35325 - protein, 9 aa, Homo Sapiens
KNTKKCHSF

SEQ ID NO: 35326 - protein, 9 aa, Homo Sapiens
FEKPLYSAE

SEQ ID NO: 35327 - protein, 9 aa, Homo Sapiens
ATWNLEKKR

SEQ ID NO: 35328 - protein, 9 aa, Homo Sapiens
ACCPPPMKR

SEQ ID NO: 35329 - protein, 9 aa, Homo Sapiens
QVLDFVLVG

SEQ ID NO: 35330 - protein, 9 aa, Homo Sapiens
GSSENLHDS

SEQ ID NO: 35331 - protein, 9 aa, Homo Sapiens
PKISFLPVV

SEQ ID NO: 35332 - protein, 9 aa, Homo Sapiens
NQILSVSEE

SEQ ID NO: 35333 - protein, 9 aa, Homo Sapiens
RFYFRLVPK

SEQ ID NO: 35334 - protein, 9 aa, Homo Sapiens
LSVSEEVAR

SEQ ID NO: 35335 - protein, 9 aa, Homo Sapiens
VQSWKGLGL

SEQ ID NO: 35336 - protein, 9 aa, Homo Sapiens
FISAIEKSR

SEQ ID NO: 35337 - protein, 9 aa, Homo Sapiens
PTPMHPPPA

SEQ ID NO: 35338 - protein, 9 aa, Homo Sapiens
GPGWLAQAI

SEQ ID NO: 35339 - protein, 9 aa, Homo Sapiens
ESGWGLPRG

SEQ ID NO: 35340 - protein, 9 aa, Homo Sapiens
SYMAIIEEA

SEQ ID NO: 35341 - protein, 9 aa, Homo Sapiens
AGAASYPPG

SEQ ID NO: 35342 - protein, 9 aa, Homo Sapiens
KGQMVTVTC

SEQ ID NO: 35343 - protein, 9 aa, Homo Sapiens
HPNGNSFDM

SEQ ID NO: 35344 - protein, 9 aa, Homo Sapiens
AADLPGHPD

SEQ ID NO: 35345 - protein, 9 aa, Homo Sapiens
SSGFHNIAV

SEQ ID NO: 35346 - protein, 9 aa, Homo Sapiens
QDGFILVGF

SEQ ID NO: 35347 - protein, 9 aa, Homo Sapiens
SAVVRISRA

SEQ ID NO: 35348 - protein, 9 aa, Homo Sapiens
FIFNEKFFQ

SEQ ID NO: 35349 - protein, 9 aa, Homo Sapiens
EVVTVHPNG

SEQ ID NO: 35350 - protein, 9 aa, Homo Sapiens
TVTQAQPAF

SEQ ID NO: 35351 - protein, 9 aa, Homo Sapiens
SVTMAISQM

SEQ ID NO: 35352 - protein, 9 aa, Homo Sapiens
FSYMAIIEE

SEQ ID NO: 35353 - protein, 9 aa, Homo Sapiens
LYSAEIAES

SEQ ID NO: 35354 - protein, 9 aa, Homo Sapiens
HNIAVKENL

SEQ ID NO: 35355 - protein, 9 aa, Homo Sapiens
RRKEAEMEL

SEQ ID NO: 35356 - protein, 9 aa, Homo Sapiens
AIIEEAKCI

SEQ ID NO: 35357 - protein, 9 aa, Homo Sapiens
LFGKLASGK

SEQ ID NO: 35358 - protein, 9 aa, Homo Sapiens
DTELPPLGS

SEQ ID NO: 35359 - protein, 9 aa, Homo Sapiens
AGPPGIVAL

SEQ ID NO: 35360 - protein, 9 aa, Homo Sapiens
ANQILSVSE

SEQ ID NO: 35361 - protein, 9 aa, Homo Sapiens
LAMKANTLC

SEQ ID NO: 35362 - protein, 9 aa, Homo Sapiens
LRHLPLLRH

SEQ ID NO: 35363 - protein, 9 aa, Homo Sapiens
ITKQEKDFL

SEQ ID NO: 35364 - protein, 9 aa, Homo Sapiens
AESGWGLPR

SEQ ID NO: 35365 - protein, 9 aa, Homo Sapiens
AASYPPGGF

SEQ ID NO: 35366 - protein, 9 aa, Homo Sapiens
KGCFSEEDA

SEQ ID NO: 35367 - protein, 9 aa, Homo Sapiens
SGNGGRQAQ

SEQ ID NO: 35368 - protein, 9 aa, Homo Sapiens
TPPAWSPPW

SEQ ID NO: 35369 - protein, 9 aa, Homo Sapiens
PRCGSSENL

SEQ ID NO: 35370 - protein, 9 aa, Homo Sapiens
TSFQDGFIL

SEQ ID NO: 35371 - protein, 9 aa, Homo Sapiens
KISFLPVVD

SEQ ID NO: 35372 - protein, 9 aa, Homo Sapiens
MPVFEKPLY

SEQ ID NO: 35373 - protein, 9 aa, Homo Sapiens
IKQFPGIEP

SEQ ID NO: 35374 - protein, 9 aa, Homo Sapiens
WKGLGLPRA

SEQ ID NO: 35375 - protein, 9 aa, Homo Sapiens
CPPPPTSRL

SEQ ID NO: 35376 - protein, 9 aa, Homo Sapiens
QNLRVSYAR

SEQ ID NO: 35377 - protein, 9 aa, Homo Sapiens
VAFIFNEKF

SEQ ID NO: 35378 - protein, 9 aa, Homo Sapiens
PHYQNLRVS

SEQ ID NO: 35379 - protein, 9 aa, Homo Sapiens
PCVLISLLV

SEQ ID NO: 35380 - protein, 9 aa, Homo Sapiens
QSFHSETDQ

SEQ ID NO: 35381 - protein, 9 aa, Homo Sapiens
NRKPCHKNK

SEQ ID NO: 35382 - protein, 9 aa, Homo Sapiens
GSGNGGRQA

SEQ ID NO: 35383 - protein, 9 aa, Homo Sapiens
SIDLLKQRL

SEQ ID NO: 35384 - protein, 9 aa, Homo Sapiens
PNGNSFDML

SEQ ID NO: 35385 - protein, 9 aa, Homo Sapiens
AGPAPRAGA

SEQ ID NO: 35386 - protein, 9 aa, Homo Sapiens
LPGHPDGQP

SEQ ID NO: 35387 - protein, 9 aa, Homo Sapiens
RHVQDLLKS

SEQ ID NO: 35388 - protein, 9 aa, Homo Sapiens
AFRRSSHFL

SEQ ID NO: 35389 - protein, 9 aa, Homo Sapiens
QGTPPHPGK

SEQ ID NO: 35390 - protein, 9 aa, Homo Sapiens
DHVSKHVKT

SEQ ID NO: 35391 - protein, 9 aa, Homo Sapiens
EGEVEEEEG

SEQ ID NO: 35392 - protein, 9 aa, Homo Sapiens
SDHVSKHVK

SEQ ID NO: 35393 - protein, 9 aa, Homo Sapiens
GPPGIVALL

SEQ ID NO: 35394 - protein, 9 aa, Homo Sapiens
AQAIVTWRG

SEQ ID NO: 35395 - protein, 9 aa, Homo Sapiens
RLEHELAMK

SEQ ID NO: 35396 - protein, 9 aa, Homo Sapiens
DACGSESFQ

SEQ ID NO: 35397 - protein, 9 aa, Homo Sapiens
GRQAQCASG

SEQ ID NO: 35398 - protein, 9 aa, Homo Sapiens
TWNLEKKRL

SEQ ID NO: 35399 - protein, 9 aa, Homo Sapiens
FRRSSHFLR

SEQ ID NO: 35400 - protein, 9 aa, Homo Sapiens
IAYTEYPVN

SEQ ID NO: 35401 - protein, 9 aa, Homo Sapiens
DGKKNTKKC

SEQ ID NO: 35402 - protein, 9 aa, Homo Sapiens
QPPEPCLGA

SEQ ID NO: 35403 - protein, 9 aa, Homo Sapiens
NKKVSIDLL

SEQ ID NO: 35404 - protein, 9 aa, Homo Sapiens
EFLLDKSAV

SEQ ID NO: 35405 - protein, 9 aa, Homo Sapiens
DIVSLLTWV

SEQ ID NO: 35406 - protein, 9 aa, Homo Sapiens
MNRKPCHKN

SEQ ID NO: 35407 - protein, 9 aa, Homo Sapiens
LLVAFSLSR

SEQ ID NO: 35408 - protein, 9 aa, Homo Sapiens
QDYDDDLTD

SEQ ID NO: 35409 - protein, 9 aa, Homo Sapiens
SWKGLGLPR

SEQ ID NO: 35410 - protein, 9 aa, Homo Sapiens
VALLDEECW

SEQ ID NO: 35411 - protein, 9 aa, Homo Sapiens
KWHGRFLAA

SEQ ID NO: 35412 - protein, 9 aa, Homo Sapiens
TGYVLVAIN

SEQ ID NO: 35413 - protein, 9 aa, Homo Sapiens
QDLLKSLDP

SEQ ID NO: 35414 - protein, 9 aa, Homo Sapiens
SRARSPEKL

SEQ ID NO: 35415 - protein, 9 aa, Homo Sapiens
CRLEHELAM

SEQ ID NO: 35416 - protein, 9 aa, Homo Sapiens
EILLTPMRV

SEQ ID NO: 35417 - protein, 9 aa, Homo Sapiens
NLHDSVREG

SEQ ID NO: 35418 - protein, 9 aa, Homo Sapiens
GSASTLVQG

SEQ ID NO: 35419 - protein, 9 aa, Homo Sapiens
PAATWNLEK

SEQ ID NO: 35420 - protein, 9 aa, Homo Sapiens
LVAINEFST

SEQ ID NO: 35421 - protein, 9 aa, Homo Sapiens
IDLLKQRLN

SEQ ID NO: 35422 - protein, 9 aa, Homo Sapiens
QSWKGLGLP

SEQ ID NO: 35423 - protein, 9 aa, Homo Sapiens
MGSFNTSFQ

SEQ ID NO: 35424 - protein, 9 aa, Homo Sapiens
QRRRCPPPP

SEQ ID NO: 35425 - protein, 9 aa, Homo Sapiens
TPGKKHRGL

SEQ ID NO: 35426 - protein, 9 aa, Homo Sapiens
MAIIEEAKC

SEQ ID NO: 35427 - protein, 9 aa, Homo Sapiens
EPCLGAESG

SEQ ID NO: 35428 - protein, 9 aa, Homo Sapiens
GGFSLYTGS

SEQ ID NO: 35429 - protein, 9 aa, Homo Sapiens
SGVAFIFNE

SEQ ID NO: 35430 - protein, 9 aa, Homo Sapiens
SPDTELPPL

SEQ ID NO: 35431 - protein, 9 aa, Homo Sapiens
RTAMQFVGL

SEQ ID NO: 35432 - protein, 9 aa, Homo Sapiens
GVAFIFNEK

SEQ ID NO: 35433 - protein, 9 aa, Homo Sapiens
SSENLHDSV

SEQ ID NO: 35434 - protein, 9 aa, Homo Sapiens
LCSQLILKL

SEQ ID NO: 35435 - protein, 9 aa, Homo Sapiens
ITEAIETAI

SEQ ID NO: 35436 - protein, 9 aa, Homo Sapiens
AINEFSTLP

SEQ ID NO: 35437 - protein, 9 aa, Homo Sapiens
SGSGNGGRQ

SEQ ID NO: 35438 - protein, 9 aa, Homo Sapiens
LEHELAMKA

SEQ ID NO: 35439 - protein, 9 aa, Homo Sapiens
EKPLYSAEI

SEQ ID NO: 35440 - protein, 9 aa, Homo Sapiens
EGGPGWLAQ

SEQ ID NO: 35441 - protein, 9 aa, Homo Sapiens
KGQVPKNEA

SEQ ID NO: 35442 - protein, 9 aa, Homo Sapiens
LACCPPPMK

SEQ ID NO: 35443 - protein, 9 aa, Homo Sapiens
IVALLDEEC

SEQ ID NO: 35444 - protein, 9 aa, Homo Sapiens
SACDPVPLP

SEQ ID NO: 35445 - protein, 9 aa, Homo Sapiens
GAPAHRPPQ

SEQ ID NO: 35446 - protein, 9 aa, Homo Sapiens
LGSPGGSSA

SEQ ID NO: 35447 - protein, 9 aa, Homo Sapiens
QVPKNEANV

SEQ ID NO: 35448 - protein, 9 aa, Homo Sapiens
SDIKEQVLA

SEQ ID NO: 35449 - protein, 9 aa, Homo Sapiens
LAQAIVTWR

SEQ ID NO: 35450 - protein, 9 aa, Homo Sapiens
FLRHQRIHT

SEQ ID NO: 35451 - protein, 9 aa, Homo Sapiens
KPAGPPGIV

SEQ ID NO: 35452 - protein, 9 aa, Homo Sapiens
LEANDIVSL

SEQ ID NO: 35453 - protein, 9 aa, Homo Sapiens
VSKHVKTHQ

SEQ ID NO: 35454 - protein, 9 aa, Homo Sapiens
VHRDIPMPL

SEQ ID NO: 35455 - protein, 9 aa, Homo Sapiens
VVRISRAQY

SEQ ID NO: 35456 - protein, 9 aa, Homo Sapiens
MQRRRCPPP

SEQ ID NO: 35457 - protein, 9 aa, Homo Sapiens
RGESIPMRL

SEQ ID NO: 35458 - protein, 9 aa, Homo Sapiens
TVHPNGNSF

SEQ ID NO: 35459 - protein, 9 aa, Homo Sapiens
DLLKQRLNV

SEQ ID NO: 35460 - protein, 9 aa, Homo Sapiens
NLEKKRLTW

SEQ ID NO: 35461 - protein, 9 aa, Homo Sapiens
DPLSEITKQ

SEQ ID NO: 35462 - protein, 9 aa, Homo Sapiens
PLDHTTPPA

SEQ ID NO: 35463 - protein, 9 aa, Homo Sapiens
SAIEKSRKH

SEQ ID NO: 35464 - protein, 9 aa, Homo Sapiens
PAPLACCPP

SEQ ID NO: 35465 - protein, 9 aa, Homo Sapiens
DVFDSACDP

SEQ ID NO: 35466 - protein, 9 aa, Homo Sapiens
DITEAIETA

SEQ ID NO: 35467 - protein, 9 aa, Homo Sapiens
EFNQKEDDE

SEQ ID NO: 35468 - protein, 9 aa, Homo Sapiens
YNIRKHDII

SEQ ID NO: 35469 - protein, 9 aa, Homo Sapiens
KIAYTEYPV

SEQ ID NO: 35470 - protein, 9 aa, Homo Sapiens
CEDCGRRYN

SEQ ID NO: 35471 - protein, 9 aa, Homo Sapiens
NQSQGTPPH

SEQ ID NO: 35472 - protein, 9 aa, Homo Sapiens
FGKLASGKY

SEQ ID NO: 35473 - protein, 9 aa, Homo Sapiens
GKKNTKKCH

SEQ ID NO: 35474 - protein, 9 aa, Homo Sapiens
LLVPLAFHL

SEQ ID NO: 35475 - protein, 9 aa, Homo Sapiens
HLPLLRHLD

SEQ ID NO: 35476 - protein, 9 aa, Homo Sapiens
NDIVSLLTW

SEQ ID NO: 35477 - protein, 9 aa, Homo Sapiens
DPSKIAYTE

SEQ ID NO: 35478 - protein, 9 aa, Homo Sapiens
VFDSACDPV

SEQ ID NO: 35479 - protein, 9 aa, Homo Sapiens
MQPGAGPAP

SEQ ID NO: 35480 - protein, 9 aa, Homo Sapiens
RRSSHFLRH

SEQ ID NO: 35481 - protein, 9 aa, Homo Sapiens
KPLYSAEIA

SEQ ID NO: 35482 - protein, 9 aa, Homo Sapiens
GEVEEEEGE

SEQ ID NO: 35483 - protein, 9 aa, Homo Sapiens
PPLGSPGGS

SEQ ID NO: 35484 - protein, 9 aa, Homo Sapiens
ARSPEKLSL

SEQ ID NO: 35485 - protein, 9 aa, Homo Sapiens
LIKQFPGIE

SEQ ID NO: 35486 - protein, 9 aa, Homo Sapiens
EVELLCSQL

SEQ ID NO: 35487 - protein, 9 aa, Homo Sapiens
HPPPACPLD

SEQ ID NO: 35488 - protein, 9 aa, Homo Sapiens
GHPDGQPPE

SEQ ID NO: 35489 - protein, 9 aa, Homo Sapiens
HDIIALYPQ

SEQ ID NO: 35490 - protein, 9 aa, Homo Sapiens
GGRQAQCAS

SEQ ID NO: 35491 - protein, 9 aa, Homo Sapiens
PAPRAGAPA

SEQ ID NO: 35492 - protein, 9 aa, Homo Sapiens
NSSTPGKKH

SEQ ID NO: 35493 - protein, 9 aa, Homo Sapiens
YWGERINQL

SEQ ID NO: 35494 - protein, 9 aa, Homo Sapiens
PAADLPGHP

SEQ ID NO: 35495 - protein, 9 aa, Homo Sapiens
RDPLSEITK

SEQ ID NO: 35496 - protein, 9 aa, Homo Sapiens
KEAEMELSV

SEQ ID NO: 35497 - protein, 9 aa, Homo Sapiens
SCFAGCSNP

SEQ ID NO: 35498 - protein, 9 aa, Homo Sapiens
SDPPPKRKK

SEQ ID NO: 35499 - protein, 9 aa, Homo Sapiens
DPVQSWKGL

SEQ ID NO: 35500 - protein, 9 aa, Homo Sapiens
ANDIVSLLT

SEQ ID NO: 35501 - protein, 9 aa, Homo Sapiens
DFISAIEKS

SEQ ID NO: 35502 - protein, 9 aa, Homo Sapiens
CGRRYNRRL

SEQ ID NO: 35503 - protein, 9 aa, Homo Sapiens
PGYWGERIN

SEQ ID NO: 35504 - protein, 9 aa, Homo Sapiens
VDSDPPPKR

SEQ ID NO: 35505 - protein, 9 aa, Homo Sapiens
EEEGEGEVE

SEQ ID NO: 35506 - protein, 9 aa, Homo Sapiens
SLLVAFSLS

SEQ ID NO: 35507 - protein, 9 aa, Homo Sapiens
LVQGSIPEG

SEQ ID NO: 35508 - protein, 9 aa, Homo Sapiens
IMNRKPCHK

SEQ ID NO: 35509 - protein, 9 aa, Homo Sapiens
LLTPMRVHE

SEQ ID NO: 35510 - protein, 9 aa, Homo Sapiens
RNKWHGRFL

SEQ ID NO: 35511 - protein, 9 aa, Homo Sapiens
GKKHRGLLT

SEQ ID NO: 35512 - protein, 9 aa, Homo Sapiens
DSVYGLQLH

SEQ ID NO: 35513 - protein, 9 aa, Homo Sapiens
KLSLATQLY

SEQ ID NO: 35514 - protein, 9 aa, Homo Sapiens
AILSDMTAI

SEQ ID NO: 35515 - protein, 9 aa, Homo Sapiens
NVNPKISFL

SEQ ID NO: 35516 - protein, 9 aa, Homo Sapiens
PLLPAPLAC

SEQ ID NO: 35517 - protein, 9 aa, Homo Sapiens
DVLERCPHR

SEQ ID NO: 35518 - protein, 9 aa, Homo Sapiens
VSDIKEQVL

SEQ ID NO: 35519 - protein, 9 aa, Homo Sapiens
KPCHKNKDR

SEQ ID NO: 35520 - protein, 9 aa, Homo Sapiens
DPPPKRKKK

SEQ ID NO: 35521 - protein, 9 aa, Homo Sapiens
TAMQFVGLL

SEQ ID NO: 35522 - protein, 9 aa, Homo Sapiens
SEITKQEKD

SEQ ID NO: 35523 - protein, 9 aa, Homo Sapiens
GTPGYWGER

SEQ ID NO: 35524 - protein, 9 aa, Homo Sapiens
KKVSIDLLK

SEQ ID NO: 35525 - protein, 9 aa, Homo Sapiens
EFDTLCVPL

SEQ ID NO: 35526 - protein, 9 aa, Homo Sapiens
DSACDPVPL

SEQ ID NO: 35527 - protein, 9 aa, Homo Sapiens
HVRHVQDLL

SEQ ID NO: 35528 - protein, 9 aa, Homo Sapiens
QHGPHSAVV

SEQ ID NO: 35529 - protein, 9 aa, Homo Sapiens
ESIPMRLFL

SEQ ID NO: 35530 - protein, 9 aa, Homo Sapiens
HELLKQPWK

SEQ ID NO: 35531 - protein, 9 aa, Homo Sapiens
EEFDTLCVP

SEQ ID NO: 35532 - protein, 9 aa, Homo Sapiens
EEEEGEGEV

SEQ ID NO: 35533 - protein, 9 aa, Homo Sapiens
QVLAAACHP

SEQ ID NO: 35534 - protein, 9 aa, Homo Sapiens
VLTKEEFDT

SEQ ID NO: 35535 - protein, 9 aa, Homo Sapiens
LTPMRVHEV

SEQ ID NO: 35536 - protein, 9 aa, Homo Sapiens
FQDGFILVG

SEQ ID NO: 35537 - protein, 9 aa, Homo Sapiens
KHELLKQPW

SEQ ID NO: 35538 - protein, 9 aa, Homo Sapiens
ATQQREVQS

SEQ ID NO: 35539 - protein, 9 aa, Homo Sapiens
PAGPPGIVA

SEQ ID NO: 35540 - protein, 9 aa, Homo Sapiens
HSAVVRISR

SEQ ID NO: 35541 - protein, 9 aa, Homo Sapiens
QNANQILSV

SEQ ID NO: 35542 - protein, 9 aa, Homo Sapiens
ISQMNHLST

SEQ ID NO: 35543 - protein, 9 aa, Homo Sapiens
GKLASGKYL

SEQ ID NO: 35544 - protein, 9 aa, Homo Sapiens
WEILLTPMR

SEQ ID NO: 35545 - protein, 9 aa, Homo Sapiens
GDRNKWHGR

SEQ ID NO: 35546 - protein, 9 aa, Homo Sapiens
VSYARLAPG

SEQ ID NO: 35547 - protein, 9 aa, Homo Sapiens
LLDKSAVKA

SEQ ID NO: 35548 - protein, 9 aa, Homo Sapiens
PSVSKGQMV

SEQ ID NO: 35549 - protein, 9 aa, Homo Sapiens
HPDGQPPEP

SEQ ID NO: 35550 - protein, 9 aa, Homo Sapiens
YAVIEGLET

SEQ ID NO: 35551 - protein, 9 aa, Homo Sapiens
SDIMNRKPC

SEQ ID NO: 35552 - protein, 9 aa, Homo Sapiens
LVGDRNKWH

SEQ ID NO: 35553 - protein, 9 aa, Homo Sapiens
GAESGWGLP

SEQ ID NO: 35554 - protein, 9 aa, Homo Sapiens
GKHGQPKLS

SEQ ID NO: 35555 - protein, 9 aa, Homo Sapiens
NGGRQAQCA

SEQ ID NO: 35556 - protein, 9 aa, Homo Sapiens
YPPGGFSLY

SEQ ID NO: 35557 - protein, 9 aa, Homo Sapiens
ELLKQPWKE

SEQ ID NO: 35558 - protein, 9 aa, Homo Sapiens
DTLCVPLFD

SEQ ID NO: 35559 - protein, 9 aa, Homo Sapiens
GWLAQAIVT

SEQ ID NO: 35560 - protein, 9 aa, Homo Sapiens
GEGEVEEEE

SEQ ID NO: 35561 - protein, 9 aa, Homo Sapiens
QSQGTPPHP

SEQ ID NO: 35562 - protein, 9 aa, Homo Sapiens
EEYDQVLDF

SEQ ID NO: 35563 - protein, 9 aa, Homo Sapiens
ARIHVRHVQ

SEQ ID NO: 35564 - protein, 9 aa, Homo Sapiens
MRSDHVSKH

SEQ ID NO: 35565 - protein, 9 aa, Homo Sapiens
DCGRRYNRR

SEQ ID NO: 35566 - protein, 9 aa, Homo Sapiens
KLASGKYLP

SEQ ID NO: 35567 - protein, 9 aa, Homo Sapiens
ILSVSEEVA

SEQ ID NO: 35568 - protein, 9 aa, Homo Sapiens
PGHPDGQPP

SEQ ID NO: 35569 - protein, 9 aa, Homo Sapiens
QPAFLVEVS

SEQ ID NO: 35570 - protein, 9 aa, Homo Sapiens
MKANTLCID

SEQ ID NO: 35571 - protein, 9 aa, Homo Sapiens
RARSPEKLS

SEQ ID NO: 35572 - protein, 9 aa, Homo Sapiens
PAPAADLPG

SEQ ID NO: 35573 - protein, 9 aa, Homo Sapiens
EDCGRRYNR

SEQ ID NO: 35574 - protein, 9 aa, Homo Sapiens
DGPGSGAAA

SEQ ID NO: 35575 - protein, 9 aa, Homo Sapiens
KATQQREVQ

SEQ ID NO: 35576 - protein, 9 aa, Homo Sapiens
IFNEKFFQD

SEQ ID NO: 35577 - protein, 9 aa, Homo Sapiens
RKHDIIALY

SEQ ID NO: 35578 - protein, 9 aa, Homo Sapiens
ILLTPMRVH

SEQ ID NO: 35579 - protein, 9 aa, Homo Sapiens
LDVLERCPH

SEQ ID NO: 35580 - protein, 9 aa, Homo Sapiens
IIEEAKCIK

SEQ ID NO: 35581 - protein, 9 aa, Homo Sapiens
CLGAESGWG

SEQ ID NO: 35582 - protein, 9 aa, Homo Sapiens
VHPNGNSFD

SEQ ID NO: 35583 - protein, 9 aa, Homo Sapiens
IFKYEVPAK

SEQ ID NO: 35584 - protein, 9 aa, Homo Sapiens
SYNIRKHDI

SEQ ID NO: 35585 - protein, 9 aa, Homo Sapiens
GQPKLSRSA

SEQ ID NO: 35586 - protein, 9 aa, Homo Sapiens
EANDIVSLL

SEQ ID NO: 35587 - protein, 9 aa, Homo Sapiens
LSEPSVSKG

SEQ ID NO: 35588 - protein, 9 aa, Homo Sapiens
LDFISAIEK

SEQ ID NO: 35589 - protein, 9 aa, Homo Sapiens
EEGEGEVEE

SEQ ID NO: 35590 - protein, 9 aa, Homo Sapiens
DLEANDIVS

SEQ ID NO: 35591 - protein, 9 aa, Homo Sapiens
IEEAKCIKG

SEQ ID NO: 35592 - protein, 9 aa, Homo Sapiens
RIHVRHVQD

SEQ ID NO: 35593 - protein, 9 aa, Homo Sapiens
ENLHDSVRE

SEQ ID NO: 35594 - protein, 9 aa, Homo Sapiens
KAFRRSSHF

SEQ ID NO: 35595 - protein, 9 aa, Homo Sapiens
KVKHELLKQ

SEQ ID NO: 35596 - protein, 9 aa, Homo Sapiens
IPMRLFLAG

SEQ ID NO: 35597 - protein, 9 aa, Homo Sapiens
LDKSAVKAL

SEQ ID NO: 35598 - protein, 9 aa, Homo Sapiens
EKKRLTWRL

SEQ ID NO: 35599 - protein, 9 aa, Homo Sapiens
LDFVLVGPV

SEQ ID NO: 35600 - protein, 9 aa, Homo Sapiens
KAPSNPHFS

SEQ ID NO: 35601 - protein, 9 aa, Homo Sapiens
LPAPLACCP

SEQ ID NO: 35602 - protein, 9 aa, Homo Sapiens
SFLPVVDFC

SEQ ID NO: 35603 - protein, 9 aa, Homo Sapiens
CGSSENLHD

SEQ ID NO: 35604 - protein, 9 aa, Homo Sapiens
ALHFSEDKI

SEQ ID NO: 35605 - protein, 9 aa, Homo Sapiens
MGVSRSAAH

SEQ ID NO: 35606 - protein, 9 aa, Homo Sapiens
EKLSLATQL

SEQ ID NO: 35607 - protein, 9 aa, Homo Sapiens
GVQYFSSCF

SEQ ID NO: 35608 - protein, 9 aa, Homo Sapiens
VELLCSQLI

SEQ ID NO: 35609 - protein, 9 aa, Homo Sapiens
EMGTPGYWG

SEQ ID NO: 35610 - protein, 9 aa, Homo Sapiens
SFQDGFILV

SEQ ID NO: 35611 - protein, 9 aa, Homo Sapiens
SPEKLSLAT

SEQ ID NO: 35612 - protein, 9 aa, Homo Sapiens
NRRLNLDIL

SEQ ID NO: 35613 - protein, 9 aa, Homo Sapiens
VTVHPNGNS

SEQ ID NO: 35614 - protein, 9 aa, Homo Sapiens
PRAGAPAHR

SEQ ID NO: 35615 - protein, 9 aa, Homo Sapiens
GHRGHVFKA

SEQ ID NO: 35616 - protein, 9 aa, Homo Sapiens
VEEEEGEEE

SEQ ID NO: 35617 - protein, 9 aa, Homo Sapiens
FDTLCVPLF

SEQ ID NO: 35618 - protein, 9 aa, Homo Sapiens
DDACGSESF

SEQ ID NO: 35619 - protein, 9 aa, Homo Sapiens
PAFLVEVSG

SEQ ID NO: 35620 - protein, 9 aa, Homo Sapiens
RMQPGAGPA

SEQ ID NO: 35621 - protein, 9 aa, Homo Sapiens
VYGLQLHRD

SEQ ID NO: 35622 - protein, 9 aa, Homo Sapiens
LKQPWKESA

SEQ ID NO: 35623 - protein, 9 aa, Homo Sapiens
FRTAMQFVG

SEQ ID NO: 35624 - protein, 9 aa, Homo Sapiens
NTKKCHSFT

SEQ ID NO: 35625 - protein, 9 aa, Homo Sapiens
TPTPMHPPP

SEQ ID NO: 35626 - protein, 9 aa, Homo Sapiens
EDLEANDIV

SEQ ID NO: 35627 - protein, 9 aa, Homo Sapiens
FSSCFAGCS

SEQ ID NO: 35628 - protein, 9 aa, Homo Sapiens
LDRDLLRHL

SEQ ID NO: 35629 - protein, 9 aa, Homo Sapiens
PPGGFSLYT

SEQ ID NO: 35630 - protein, 9 aa, Homo Sapiens
PPQPWLPAP

SEQ ID NO: 35631 - protein, 9 aa, Homo Sapiens
RGKYSSGFH

SEQ ID NO: 35632 - protein, 9 aa, Homo Sapiens
CDPVPLPPA

SEQ ID NO: 35633 - protein, 9 aa, Homo Sapiens
AVKALGKAA

SEQ ID NO: 35634 - protein, 9 aa, Homo Sapiens
VSIDLLKQR

SEQ ID NO: 35635 - protein, 9 aa, Homo Sapiens
DMTAINNVP

SEQ ID NO: 35636 - protein, 9 aa, Homo Sapiens
TPMHPPPAC

SEQ ID NO: 35637 - protein, 9 aa, Homo Sapiens
VPKNEANVV

SEQ ID NO: 35638 - protein, 9 aa, Homo Sapiens
NQEPEFNQK

SEQ ID NO: 35639 - protein, 9 aa, Homo Sapiens
EEAQDYDDD

SEQ ID NO: 35640 - protein, 9 aa, Homo Sapiens
LVPLAFHLP

SEQ ID NO: 35641 - protein, 9 aa, Homo Sapiens
PLSEITKQE

SEQ ID NO: 35642 - protein, 9 aa, Homo Sapiens
PEKLSLATQ

SEQ ID NO: 35643 - protein, 9 aa, Homo Sapiens
FLLDKSAVK

SEQ ID NO: 35644 - protein, 9 aa, Homo Sapiens
LLPAPLACC

SEQ ID NO: 35645 - protein, 9 aa, Homo Sapiens
KGSASTLVQ

SEQ ID NO: 35646 - protein, 9 aa, Homo Sapiens
LPAAILSDM

SEQ ID NO: 35647 - protein, 9 aa, Homo Sapiens
TLVQGSIPE

SEQ ID NO: 35648 - protein, 9 aa, Homo Sapiens
MDPSKIAYT

SEQ ID NO: 35649 - protein, 9 aa, Homo Sapiens
STLVQGSIP

SEQ ID NO: 35650 - protein, 9 aa, Homo Sapiens
QEPEFNQKE

SEQ ID NO: 35651 - protein, 9 aa, Homo Sapiens
GPHSAVVRI

SEQ ID NO: 35652 - protein, 9 aa, Homo Sapiens
SNQEPEFNQ

SEQ ID NO: 35653 - protein, 9 aa, Homo Sapiens
NQLIKQFPG

SEQ ID NO: 35654 - protein, 9 aa, Homo Sapiens
HRDIPMPLV

SEQ ID NO: 35655 - protein, 9 aa, Homo Sapiens
APLACCPPP

SEQ ID NO: 35656 - protein, 9 aa, Homo Sapiens
GESIPMRLF

SEQ ID NO: 35657 - protein, 9 aa, Homo Sapiens
PGAGPAPRA

SEQ ID NO: 35658 - protein, 9 aa, Homo Sapiens
NEKFFQDLK

SEQ ID NO: 35659 - protein, 9 aa, Homo Sapiens
PKAPSNPHF

SEQ ID NO: 35660 - protein, 9 aa, Homo Sapiens
SYPPGGFSL

SEQ ID NO: 35661 - protein, 9 aa, Homo Sapiens
SDGPGSGAA

SEQ ID NO: 35662 - protein, 9 aa, Homo Sapiens
LSRARSPEK

SEQ ID NO: 35663 - protein, 9 aa, Homo Sapiens
WGERINQLI

SEQ ID NO: 35664 - protein, 9 aa, Homo Sapiens
KHGQPKLSR

SEQ ID NO: 35665 - protein, 9 aa, Homo Sapiens
DQVLDFVLV

SEQ ID NO: 35666 - protein, 9 aa, Homo Sapiens
PLACCPPPM

SEQ ID NO: 35667 - protein, 9 aa, Homo Sapiens
KRFMRSDHV

SEQ ID NO: 35668 - protein, 9 aa, Homo Sapiens
TMAISQMNH

SEQ ID NO: 35669 - protein, 9 aa, Homo Sapiens
GKYLPQTYV

SEQ ID NO: 35670 - protein, 9 aa, Homo Sapiens
KEMGTPGYW

SEQ ID NO: 35671 - protein, 9 aa, Homo Sapiens
VAFSLSRVR

SEQ ID NO: 35672 - protein, 9 aa, Homo Sapiens
VQDLLKSLD

SEQ ID NO: 35673 - protein, 9 aa, Homo Sapiens
NLRVSYARL

SEQ ID NO: 35674 - protein, 9 aa, Homo Sapiens
PQPWLPAPA

SEQ ID NO: 35675 - protein, 9 aa, Homo Sapiens
RQAQCASGT

SEQ ID NO: 35676 - protein, 9 aa, Homo Sapiens
TPSDGPGSG

SEQ ID NO: 35677 - protein, 9 aa, Homo Sapiens
EKFFQDLKE

SEQ ID NO: 35678 - protein, 9 aa, Homo Sapiens
PDGQPPEPC

SEQ ID NO: 35679 - protein, 9 aa, Homo Sapiens
EAVRMQPGA

SEQ ID NO: 35680 - protein, 9 aa, Homo Sapiens
YCFRAQQQR

SEQ ID NO: 35681 - protein, 9 aa, Homo Sapiens
YTLDVLERC

SEQ ID NO: 35682 - protein, 9 aa, Homo Sapiens
VRMQPGAGP

SEQ ID NO: 35683 - protein, 9 aa, Homo Sapiens
GLQLHRDKR

SEQ ID NO: 35684 - protein, 9 aa, Homo Sapiens
HTTPPAWSP

SEQ ID NO: 35685 - protein, 9 aa, Homo Sapiens
WGLPRGAPS

SEQ ID NO: 35686 - protein, 9 aa, Homo Sapiens
GSGSGNGGR

SEQ ID NO: 35687 - protein, 9 aa, Homo Sapiens
ACGSESFQS

SEQ ID NO: 35688 - protein, 9 aa, Homo Sapiens
APRAGAPAH

SEQ ID NO: 35689 - protein, 9 aa, Homo Sapiens
AAHEAVRMQ

SEQ ID NO: 35690 - protein, 9 aa, Homo Sapiens
SGFHNIAVK

SEQ ID NO: 35691 - protein, 9 aa, Homo Sapiens
KDSVYGLQL

SEQ ID NO: 35692 - protein, 9 aa, Homo Sapiens
CFRAQQQRS

SEQ ID NO: 35693 - protein, 9 aa, Homo Sapiens
RRRCPPPPT

SEQ ID NO: 35694 - protein, 9 aa, Homo Sapiens
HFLRHQRIH

SEQ ID NO: 35695 - protein, 9 aa, Homo Sapiens
GKDSVYGLQ

SEQ ID NO: 35696 - protein, 9 aa, Homo Sapiens
GDVFDSACD

SEQ ID NO: 35697 - protein, 9 aa, Homo Sapiens
KHRGLLTST

SEQ ID NO: 35698 - protein, 9 aa, Homo Sapiens
GNGGRQAQC

SEQ ID NO: 35699 - protein, 9 aa, Homo Sapiens
RCPHRPILQ

SEQ ID NO: 35700 - protein, 9 aa, Homo Sapiens
YFSSCFAGC

SEQ ID NO: 35701 - protein, 9 aa, Homo Sapiens
KNNEEAQDY

SEQ ID NO: 35702 - protein, 9 aa, Homo Sapiens
FNQKEDDEW

SEQ ID NO: 35703 - protein, 9 aa, Homo Sapiens
EPSVSKGQM

SEQ ID NO: 35704 - protein, 9 aa, Homo Sapiens
QPWKESAEG

SEQ ID NO: 35705 - protein, 9 aa, Homo Sapiens
LHFSEDKIA

SEQ ID NO: 35706 - protein, 9 aa, Homo Sapiens
RCPPPPTSR

SEQ ID NO: 35707 - protein, 9 aa, Homo Sapiens
LSRSASESA

SEQ ID NO: 35708 - protein, 9 aa, Homo Sapiens
KSLLVAFSL

SEQ ID NO: 35709 - protein, 9 aa, Homo Sapiens
RAQQQRSLE

SEQ ID NO: 35710 - protein, 9 aa, Homo Sapiens
SHFLRHQRI

SEQ ID NO: 35711 - protein, 9 aa, Homo Sapiens
KSFFSKGCF

SEQ ID NO: 35712 - protein, 9 aa, Homo Sapiens
VTQAQPAFL

SEQ ID NO: 35713 - protein, 9 aa, Homo Sapiens
HFSEDKIAL

SEQ ID NO: 35714 - protein, 9 aa, Homo Sapiens
QQREVQSFH

SEQ ID NO: 35715 - protein, 9 aa, Homo Sapiens
SASTLVQGS

SEQ ID NO: 35716 - protein, 9 aa, Homo Sapiens
FVGLLLSLL

SEQ ID NO: 35717 - protein, 9 aa, Homo Sapiens
SAVKALGKA

SEQ ID NO: 35718 - protein, 9 aa, Homo Sapiens
FNTSFQDGF

SEQ ID NO: 35719 - protein, 9 aa, Homo Sapiens
DRDLLRHLP

SEQ ID NO: 35720 - protein, 9 aa, Homo Sapiens
QYFSSCFAG

SEQ ID NO: 35721 - protein, 9 aa, Homo Sapiens
HGPHSAVVR

SEQ ID NO: 35722 - protein, 9 aa, Homo Sapiens
AQDYDDDLT

SEQ ID NO: 35723 - protein, 9 aa, Homo Sapiens
GWGLPRGAP

SEQ ID NO: 35724 - protein, 9 aa, Homo Sapiens
WLPAPAADL

SEQ ID NO: 35725 - protein, 9 aa, Homo Sapiens
EDKIALYTA

SEQ ID NO: 35726 - protein, 9 aa, Homo Sapiens
NTSFQDGFI

SEQ ID NO: 35727 - protein, 9 aa, Homo Sapiens
QYAVIEGLE

SEQ ID NO: 35728 - protein, 9 aa, Homo Sapiens
NGYCFRAQQ

SEQ ID NO: 35729 - protein, 9 aa, Homo Sapiens
SSHFLRHQR

SEQ ID NO: 35730 - protein, 9 aa, Homo Sapiens
SAAHEAVRM

SEQ ID NO: 35731 - protein, 9 aa, Homo Sapiens
RRCPPPPTS

SEQ ID NO: 35732 - protein, 9 aa, Homo Sapiens
GQVPKNEAN

SEQ ID NO: 35733 - protein, 9 aa, Homo Sapiens
SFNTSFQDG

SEQ ID NO: 35734 - protein, 9 aa, Homo Sapiens
VPLAFHLPA

SEQ ID NO: 35735 - protein, 9 aa, Homo Sapiens
TAISLETAR

SEQ ID NO: 35736 - protein, 9 aa, Homo Sapiens
ACPLDHTTP

SEQ ID NO: 35737 - protein, 9 aa, Homo Sapiens
QLHRDKRVL

SEQ ID NO: 35738 - protein, 9 aa, Homo Sapiens
PGWLAQAIV

SEQ ID NO: 35739 - protein, 9 aa, Homo Sapiens
TLDVLERCP

SEQ ID NO: 35740 - protein, 9 aa, Homo Sapiens
VRISRAQYN

SEQ ID NO: 35741 - protein, 9 aa, Homo Sapiens
PPPACPLDH

SEQ ID NO: 35742 - protein, 9 aa, Homo Sapiens
HRGLLTSTP

SEQ ID NO: 35743 - protein, 9 aa, Homo Sapiens
LGLPRAGCS

SEQ ID NO: 35744 - protein, 9 aa, Homo Sapiens
PGKKHRGLL

SEQ ID NO: 35745 - protein, 9 aa, Homo Sapiens
REVQSFHSE

SEQ ID NO: 35746 - protein, 9 aa, Homo Sapiens
YNRRLNLDI

SEQ ID NO: 35747 - protein, 9 aa, Homo Sapiens
PPEDDACGS

SEQ ID NO: 35748 - protein, 9 aa, Homo Sapiens
PGIVALLDE

SEQ ID NO: 35749 - protein, 9 aa, Homo Sapiens
NEEAQDYDD

SEQ ID NO: 35750 - protein, 9 aa, Homo Sapiens
FYFRLVPKA

SEQ ID NO: 35751 - protein, 9 aa, Homo Sapiens
SSTPGKKHR

SEQ ID NO: 35752 - protein, 9 aa, Homo Sapiens
KGLGLPRAG

SEQ ID NO: 35753 - protein, 9 aa, Homo Sapiens
MAISQMNHL

SEQ ID NO: 35754 - protein, 9 aa, Homo Sapiens
CHKNKDRLV

SEQ ID NO: 35755 - protein, 9 aa, Homo Sapiens
GVSRSAAHE

SEQ ID NO: 35756 - protein, 9 aa, Homo Sapiens
SKIAYTEYP

SEQ ID NO: 35757 - protein, 9 aa, Homo Sapiens
EEKSFFSKG

SEQ ID NO: 35758 - protein, 9 aa, Homo Sapiens
AQPAFLVEV

SEQ ID NO: 35759 - protein, 9 aa, Homo Sapiens
GPRCGSSEN

SEQ ID NO: 35760 - protein, 9 aa, Homo Sapiens
LERCPHRPI

SEQ ID NO: 35761 - protein, 9 aa, Homo Sapiens
TRVYRVHRD

SEQ ID NO: 35762 - protein, 9 aa, Homo Sapiens
AISLETARA

SEQ ID NO: 35763 - protein, 9 aa, Homo Sapiens
TRRKEAEME

SEQ ID NO: 35764 - protein, 9 aa, Homo Sapiens
LDDTQYAVI

SEQ ID NO: 35765 - protein, 9 aa, Homo Sapiens
SIPMRLFLA

SEQ ID NO: 35766 - protein, 9 aa, Homo Sapiens
VRGESIPMR

SEQ ID NO: 35767 - protein, 9 aa, Homo Sapiens
VWEILLTPM

SEQ ID NO: 35768 - protein, 9 aa, Homo Sapiens
VSRSAAHEA

SEQ ID NO: 35769 - protein, 9 aa, Homo Sapiens
SLLVPLAFH

SEQ ID NO: 35770 - protein, 9 aa, Homo Sapiens
TLSEPSVSK

SEQ ID NO: 35771 - protein, 9 aa, Homo Sapiens
RAGAPAHRP

SEQ ID NO: 35772 - protein, 9 aa, Homo Sapiens
IKEQVLAAA

SEQ ID NO: 35773 - protein, 9 aa, Homo Sapiens
AQQQRSLEA

SEQ ID NO: 35774 - protein, 9 aa, Homo Sapiens
QILSVSEEV

SEQ ID NO: 35775 - protein, 9 aa, Homo Sapiens
CHSFTALSV

SEQ ID NO: 35776 - protein, 9 aa, Homo Sapiens
NPKISFLPV

SEQ ID NO: 35777 - protein, 9 aa, Homo Sapiens
WNLEKKRLT

SEQ ID NO: 35778 - protein, 9 aa, Homo Sapiens
PACPLDHTT

SEQ ID NO: 35779 - protein, 9 aa, Homo Sapiens
CSQLILKLR

SEQ ID NO: 35780 - protein, 9 aa, Homo Sapiens
AVRMQPGAG

SEQ ID NO: 35781 - protein, 9 aa, Homo Sapiens
MQFVGLLLS

SEQ ID NO: 35782 - protein, 9 aa, Homo Sapiens
LQWHLHSVD

SEQ ID NO: 35783 - protein, 9 aa, Homo Sapiens
SLQVGRLIC

SEQ ID NO: 35784 - protein, 9 aa, Homo Sapiens
HSRASTRSR

SEQ ID NO: 35785 - protein, 9 aa, Homo Sapiens
NSSERLLGL

SEQ ID NO: 35786 - protein, 9 aa, Homo Sapiens
RNTFRHIVV

SEQ ID NO: 35787 - protein, 9 aa, Homo Sapiens
SSERLLGLL

SEQ ID NO: 35788 - protein, 9 aa, Homo Sapiens
LPGRKRKRH

SEQ ID NO: 35789 - protein, 9 aa, Homo Sapiens
HSSLTRGGS

SEQ ID NO: 35790 - protein, 9 aa, Homo Sapiens
LLPLGIILF

SEQ ID NO: 35791 - protein, 9 aa, Homo Sapiens
PGPQKEDGE

SEQ ID NO: 35792 - protein, 9 aa, Homo Sapiens
FKAKAQKQV

SEQ ID NO: 35793 - protein, 9 aa, Homo Sapiens
EFKKLICNR

SEQ ID NO: 35794 - protein, 9 aa, Homo Sapiens
PCAASWWDA

SEQ ID NO: 35795 - protein, 9 aa, Homo Sapiens
AASNSSERL

SEQ ID NO: 35796 - protein, 9 aa, Homo Sapiens
ACCATSSCQ

SEQ ID NO: 35797 - protein, 9 aa, Homo Sapiens
QTVTVSPSN

SEQ ID NO: 35798 - protein, 9 aa, Homo Sapiens
PCNKFKIRL

SEQ ID NO: 35799 - protein, 9 aa, Homo Sapiens
ASSFQPIEW

SEQ ID NO: 35800 - protein, 9 aa, Homo Sapiens
VGRCSQMRA

SEQ ID NO: 35801 - protein, 9 aa, Homo Sapiens
NDRENRCDI

SEQ ID NO: 35802 - protein, 9 aa, Homo Sapiens
FQPIEWGPV

SEQ ID NO: 35803 - protein, 9 aa, Homo Sapiens
DDAPLAVFP

SEQ ID NO: 35804 - protein, 9 aa, Homo Sapiens
RKRKRHQPH

SEQ ID NO: 35805 - protein, 9 aa, Homo Sapiens
ELCWDMFSK

SEQ ID NO: 35806 - protein, 9 aa, Homo Sapiens
ITDTIVVVA

SEQ ID NO: 35807 - protein, 9 aa, Homo Sapiens
AVPKPGPHL

SEQ ID NO: 35808 - protein, 9 aa, Homo Sapiens
GRITDTIVV

SEQ ID NO: 35809 - protein, 9 aa, Homo Sapiens
NTFRHIVVV

SEQ ID NO: 35810 - protein, 9 aa, Homo Sapiens
CVRTWPHSR

SEQ ID NO: 35811 - protein, 9 aa, Homo Sapiens
GFYTGNMTL

SEQ ID NO: 35812 - protein, 9 aa, Homo Sapiens
GPAVRPCSV

SEQ ID NO: 35813 - protein, 9 aa, Homo Sapiens
NRNTGSQSA

SEQ ID NO: 35814 - protein, 9 aa, Homo Sapiens
DITELCWDM

SEQ ID NO: 35815 - protein, 9 aa, Homo Sapiens
CPGRITDTI

SEQ ID NO: 35816 - protein, 9 aa, Homo Sapiens
RGTKRPWDD

SEQ ID NO: 35817 - protein, 9 aa, Homo Sapiens
KFKIRLVNI

SEQ ID NO: 35818 - protein, 9 aa, Homo Sapiens
RKQCHKPQQ

SEQ ID NO: 35819 - protein, 9 aa, Homo Sapiens
VIPQQFDGV

SEQ ID NO: 35820 - protein, 9 aa, Homo Sapiens
GPHLLRKQG

SEQ ID NO: 35821 - protein, 9 aa, Homo Sapiens
FRHPGSHHE

SEQ ID NO: 35822 - protein, 9 aa, Homo Sapiens
DKDFKAKAQ

SEQ ID NO: 35823 - protein, 9 aa, Homo Sapiens
CLPPGHTDA

SEQ ID NO: 35824 - protein, 9 aa, Homo Sapiens
SAVPKPGPH

SEQ ID NO: 35825 - protein, 9 aa, Homo Sapiens
IPPPTTKED

SEQ ID NO: 35826 - protein, 9 aa, Homo Sapiens
ESSFSQVPE

SEQ ID NO: 35827 - protein, 9 aa, Homo Sapiens
RIPPPTTKE

SEQ ID NO: 35828 - protein, 9 aa, Homo Sapiens
IICLNSSHL

SEQ ID NO: 35829 - protein, 9 aa, Homo Sapiens
SIICLNSSH

SEQ ID NO: 35830 - protein, 9 aa, Homo Sapiens
FSIMCLEGT

SEQ ID NO: 35831 - protein, 9 aa, Homo Sapiens
PACCATSSC

SEQ ID NO: 35832 - protein, 9 aa, Homo Sapiens
FQKVIPQQF

SEQ ID NO: 35833 - protein, 9 aa, Homo Sapiens
LLADASLVS

SEQ ID NO: 35834 - protein, 9 aa, Homo Sapiens
EADITELCW

SEQ ID NO: 35835 - protein, 9 aa, Homo Sapiens
STWQGPCAA

SEQ ID NO: 35836 - protein, 9 aa, Homo Sapiens
RVTLKVSSM

SEQ ID NO: 35837 - protein, 9 aa, Homo Sapiens
HLLSVCGFR

SEQ ID NO: 35838 - protein, 9 aa, Homo Sapiens
DEDIITKIE

SEQ ID NO: 35839 - protein, 9 aa, Homo Sapiens
WNDRENRCD

SEQ ID NO: 35840 - protein, 9 aa, Homo Sapiens
IRKAWNDRE

SEQ ID NO: 35841 - protein, 9 aa, Homo Sapiens
NKYTMNQTS

SEQ ID NO: 35842 - protein, 9 aa, Homo Sapiens
CNECKKAFR

SEQ ID NO: 35843 - protein, 9 aa, Homo Sapiens
SKTKGNKVN

SEQ ID NO: 35844 - protein, 9 aa, Homo Sapiens
QSRDGFRHP

SEQ ID NO: 35845 - protein, 9 aa, Homo Sapiens
TSLTQWLAA

SEQ ID NO: 35846 - protein, 9 aa, Homo Sapiens
STLGYSRSH

SEQ ID NO: 35847 - protein, 9 aa, Homo Sapiens
CLNSSHLEP

SEQ ID NO: 35848 - protein, 9 aa, Homo Sapiens
CVNYTGGYT

SEQ ID NO: 35849 - protein, 9 aa, Homo Sapiens
TGHVSHSSR

SEQ ID NO: 35850 - protein, 9 aa, Homo Sapiens
SNVQLGGVG

SEQ ID NO: 35851 - protein, 9 aa, Homo Sapiens
LRLCSTWQG

SEQ ID NO: 35852 - protein, 9 aa, Homo Sapiens
DWHSLQVGR

SEQ ID NO: 35853 - protein, 9 aa, Homo Sapiens
LTQWLAAAT

SEQ ID NO: 35854 - protein, 9 aa, Homo Sapiens
FKKLICNRQ

SEQ ID NO: 35855 - protein, 9 aa, Homo Sapiens
LRAVFRVPS

SEQ ID NO: 35856 - protein, 9 aa, Homo Sapiens
NIAFFSIMC

SEQ ID NO: 35857 - protein, 9 aa, Homo Sapiens
ISMERRMKI

SEQ ID NO: 35858 - protein, 9 aa, Homo Sapiens
ATSSCQQSC

SEQ ID NO: 35859 - protein, 9 aa, Homo Sapiens
KEDGEVALV

SEQ ID NO: 35860 - protein, 9 aa, Homo Sapiens
LRGPPFASG

SEQ ID NO: 35861 - protein, 9 aa, Homo Sapiens
MIPHRLSAS

SEQ ID NO: 35862 - protein, 9 aa, Homo Sapiens
NPSPGLFAV

SEQ ID NO: 35863 - protein, 9 aa, Homo Sapiens
RSPSPAPPA

SEQ ID NO: 35864 - protein, 9 aa, Homo Sapiens
RLLGLLALS

SEQ ID NO: 35865 - protein, 9 aa, Homo Sapiens
ITELCWDMF

SEQ ID NO: 35866 - protein, 9 aa, Homo Sapiens
KTQDHLRQQ

SEQ ID NO: 35867 - protein, 9 aa, Homo Sapiens
KSQLAAHQK

SEQ ID NO: 35868 - protein, 9 aa, Homo Sapiens
QKVIPQQFD

SEQ ID NO: 35869 - protein, 9 aa, Homo Sapiens
FEEFKKLIC

SEQ ID NO: 35870 - protein, 9 aa, Homo Sapiens
NVIPSFQIL

SEQ ID NO: 35871 - protein, 9 aa, Homo Sapiens
HFQKVIPQQ

SEQ ID NO: 35872 - protein, 9 aa, Homo Sapiens
DAPLAVFPS

SEQ ID NO: 35873 - protein, 9 aa, Homo Sapiens
HLASALQLK

SEQ ID NO: 35874 - protein, 9 aa, Homo Sapiens
SHVRAVVPT

SEQ ID NO: 35875 - protein, 9 aa, Homo Sapiens
YTGGYTCYC

SEQ ID NO: 35876 - protein, 9 aa, Homo Sapiens
EEKEERDEE

SEQ ID NO: 35877 - protein, 9 aa, Homo Sapiens
YMNQLDMRS

SEQ ID NO: 35878 - protein, 9 aa, Homo Sapiens
YILRAVFRV

SEQ ID NO: 35879 - protein, 9 aa, Homo Sapiens
NKFKIRLVN

SEQ ID NO: 35880 - protein, 9 aa, Homo Sapiens
RHQPHPTAS

SEQ ID NO: 35881 - protein, 9 aa, Homo Sapiens
DPLYVFNPS

SEQ ID NO: 35882 - protein, 9 aa, Homo Sapiens
AQPQLLQWH

SEQ ID NO: 35883 - protein, 9 aa, Homo Sapiens
NANVIPSFQ

SEQ ID NO: 35884 - protein, 9 aa, Homo Sapiens
AQLSCKSRG

SEQ ID NO: 35885 - protein, 9 aa, Homo Sapiens
TDTIVVVAG

SEQ ID NO: 35886 - protein, 9 aa, Homo Sapiens
EAAQLSCKS

SEQ ID NO: 35887 - protein, 9 aa, Homo Sapiens
YRSRSTLGY

SEQ ID NO: 35888 - protein, 9 aa, Homo Sapiens
PKTQDHLRQ

SEQ ID NO: 35889 - protein, 9 aa, Homo Sapiens
DTAAVGQLV

SEQ ID NO: 35890 - protein, 9 aa, Homo Sapiens
LPFALILLV

SEQ ID NO: 35891 - protein, 9 aa, Homo Sapiens
SWFPSILRL

SEQ ID NO: 35892 - protein, 9 aa, Homo Sapiens
LVSAGPCVR

SEQ ID NO: 35893 - protein, 9 aa, Homo Sapiens
FLLPLGIIL

SEQ ID NO: 35894 - protein, 9 aa, Homo Sapiens
YAHMYGITD

SEQ ID NO: 35895 - protein, 9 aa, Homo Sapiens
AAQLSCKSR

SEQ ID NO: 35896 - protein, 9 aa, Homo Sapiens
GTKRPWDDE

SEQ ID NO: 35897 - protein, 9 aa, Homo Sapiens
GHVSHSSRK

SEQ ID NO: 35898 - protein, 9 aa, Homo Sapiens
RWRNICAIS

SEQ ID NO: 35899 - protein, 9 aa, Homo Sapiens
QKPSFFFFS

SEQ ID NO: 35900 - protein, 9 aa, Homo Sapiens
AMFLLEFLL

SEQ ID NO: 35901 - protein, 9 aa, Homo Sapiens
SNSSERLLG

SEQ ID NO: 35902 - protein, 9 aa, Homo Sapiens
GSQTVTVSP

SEQ ID NO: 35903 - protein, 9 aa, Homo Sapiens
LCGTGNRNT

SEQ ID NO: 35904 - protein, 9 aa, Homo Sapiens
LPCNKFKIR

SEQ ID NO: 35905 - protein, 9 aa, Homo Sapiens
QVLRGPPFA

SEQ ID NO: 35906 - protein, 9 aa, Homo Sapiens
VGKTSLTQW

SEQ ID NO: 35907 - protein, 9 aa, Homo Sapiens
PCVRTWPHS

SEQ ID NO: 35908 - protein, 9 aa, Homo Sapiens
MLGPAVRPC

SEQ ID NO: 35909 - protein, 9 aa, Homo Sapiens
STCCLRGMT

SEQ ID NO: 35910 - protein, 9 aa, Homo Sapiens
CATSSCQQS

SEQ ID NO: 35911 - protein, 9 aa, Homo Sapiens
LDCPGRITD

SEQ ID NO: 35912 - protein, 9 aa, Homo Sapiens
PFALILLVF

SEQ ID NO: 35913 - protein, 9 aa, Homo Sapiens
RGESSQEEK

SEQ ID NO: 35914 - protein, 9 aa, Homo Sapiens
TMGSQTVTV

SEQ ID NO: 35915 - protein, 9 aa, Homo Sapiens
KLICNRQSE

SEQ ID NO: 35916 - protein, 9 aa, Homo Sapiens
RLCSTWQGP

SEQ ID NO: 35917 - protein, 9 aa, Homo Sapiens
CSQMRARCH

SEQ ID NO: 35918 - protein, 9 aa, Homo Sapiens
KPGPHLLRK

SEQ ID NO: 35919 - protein, 9 aa, Homo Sapiens
PNRGTKRPW

SEQ ID NO: 35920 - protein, 9 aa, Homo Sapiens
VGRLICAGV

SEQ ID NO: 35921 - protein, 9 aa, Homo Sapiens
ASNSSERLL

SEQ ID NO: 35922 - protein, 9 aa, Homo Sapiens
SRDGFRHPG

SEQ ID NO: 35923 - protein, 9 aa, Homo Sapiens
RVVGRCSQM

SEQ ID NO: 35924 - protein, 9 aa, Homo Sapiens
APCTMRIPP

SEQ ID NO: 35925 - protein, 9 aa, Homo Sapiens
KAWNDRENR

SEQ ID NO: 35926 - protein, 9 aa, Homo Sapiens
VSHSSRKQC

SEQ ID NO: 35927 - protein, 9 aa, Homo Sapiens
PKPGPHLLR

SEQ ID NO: 35928 - protein, 9 aa, Homo Sapiens
RNVEIRTSK

SEQ ID NO: 35929 - protein, 9 aa, Homo Sapiens
RFIHSQLRQ

SEQ ID NO: 35930 - protein, 9 aa, Homo Sapiens
KDFKAKAQK

SEQ ID NO: 35931 - protein, 9 aa, Homo Sapiens
IAVSHVRAV

SEQ ID NO: 35932 - protein, 9 aa, Homo Sapiens
TSWFPSILR

SEQ ID NO: 35933 - protein, 9 aa, Homo Sapiens
LAAHQKTHT

SEQ ID NO: 35934 - protein, 9 aa, Homo Sapiens
VTVSPSNAR

SEQ ID NO: 35935 - protein, 9 aa, Homo Sapiens
TLGYSRSHW

SEQ ID NO: 35936 - protein, 9 aa, Homo Sapiens
GRCSQMRAR

SEQ ID NO: 35937 - protein, 9 aa, Homo Sapiens
WQHSRDSGS

SEQ ID NO: 35938 - protein, 9 aa, Homo Sapiens
SRASTRSRV

SEQ ID NO: 35939 - protein, 9 aa, Homo Sapiens
AASWWDASA

SEQ ID NO: 35940 - protein, 9 aa, Homo Sapiens
PQLLQWHLH

SEQ ID NO: 35941 - protein, 9 aa, Homo Sapiens
SQTVTVSPS

SEQ ID NO: 35942 - protein, 9 aa, Homo Sapiens
TGSQSARVV

SEQ ID NO: 35943 - protein, 9 aa, Homo Sapiens
TLKVSSMIP

SEQ ID NO: 35944 - protein, 9 aa, Homo Sapiens
VCDTAAVGQ

SEQ ID NO: 35945 - protein, 9 aa, Homo Sapiens
VLQDEDIIT

SEQ ID NO: 35946 - protein, 9 aa, Homo Sapiens
TVSPSNARD

SEQ ID NO: 35947 - protein, 9 aa, Homo Sapiens
APPAPPEPQ

SEQ ID NO: 35948 - protein, 9 aa, Homo Sapiens
LYSTCCLRG

SEQ ID NO: 35949 - protein, 9 aa, Homo Sapiens
FLLEFLLPL

SEQ ID NO: 35950 - protein, 9 aa, Homo Sapiens
VSHVRAVVP

SEQ ID NO: 35951 - protein, 9 aa, Homo Sapiens
QEILTSILP

SEQ ID NO: 35952 - protein, 9 aa, Homo Sapiens
RSTLGYSRS

SEQ ID NO: 35953 - protein, 9 aa, Homo Sapiens
GFAGDDAPL

SEQ ID NO: 35954 - protein, 9 aa, Homo Sapiens
FNPSPGLFA

SEQ ID NO: 35955 - protein, 9 aa, Homo Sapiens
YSNVQLGGV

SEQ ID NO: 35956 - protein, 9 aa, Homo Sapiens
DRNTFRHIV

SEQ ID NO: 35957 - protein, 9 aa, Homo Sapiens
ALAWQHSRD

SEQ ID NO: 35958 - protein, 9 aa, Homo Sapiens
YIYSNVQLG

SEQ ID NO: 35959 - protein, 9 aa, Homo Sapiens
LASALQLKS

SEQ ID NO: 35960 - protein, 9 aa, Homo Sapiens
GYSRSHWSQ

SEQ ID NO: 35961 - protein, 9 aa, Homo Sapiens
LQVGRLICA

SEQ ID NO: 35962 - protein, 9 aa, Homo Sapiens
PHLLRKQGQ

SEQ ID NO: 35963 - protein, 9 aa, Homo Sapiens
SQEEKEERD

SEQ ID NO: 35964 - protein, 9 aa, Homo Sapiens
HMYGITDFR

SEQ ID NO: 35965 - protein, 9 aa, Homo Sapiens
TDAINFDDS

SEQ ID NO: 35966 - protein, 9 aa, Homo Sapiens
EIRTSKETK

SEQ ID NO: 35967 - protein, 9 aa, Homo Sapiens
IPQQFDGVP

SEQ ID NO: 35968 - protein, 9 aa, Homo Sapiens
SSQEEKEER

SEQ ID NO: 35969 - protein, 9 aa, Homo Sapiens
EDIITKIEG

SEQ ID NO: 35970 - protein, 9 aa, Homo Sapiens
GTATLPCLG

SEQ ID NO: 35971 - protein, 9 aa, Homo Sapiens
CNRQSEAAD

SEQ ID NO: 35972 - protein, 9 aa, Homo Sapiens
KPYKCNECK

SEQ ID NO: 35973 - protein, 9 aa, Homo Sapiens
GKTSLTQWL

SEQ ID NO: 35974 - protein, 9 aa, Homo Sapiens
CCGFYTGNM

SEQ ID NO: 35975 - protein, 9 aa, Homo Sapiens
SSFSQVPEG

SEQ ID NO: 35976 - protein, 9 aa, Homo Sapiens
PSPSPGPQK

SEQ ID NO: 35977 - protein, 9 aa, Homo Sapiens
KRHQPHPTA

SEQ ID NO: 35978 - protein, 9 aa, Homo Sapiens
YEKYAHMYG

SEQ ID NO: 35979 - protein, 9 aa, Homo Sapiens
TMRIPPPTT

SEQ ID NO: 35980 - protein, 9 aa, Homo Sapiens
IQKSQLAAH

SEQ ID NO: 35981 - protein, 9 aa, Homo Sapiens
PYKCNECKK

SEQ ID NO: 35982 - protein, 9 aa, Homo Sapiens
TATLPCLGA

SEQ ID NO: 35983 - protein, 9 aa, Homo Sapiens
DHLRQQRAS

SEQ ID NO: 35984 - protein, 9 aa, Homo Sapiens
LGYSRSHWS

SEQ ID NO: 35985 - protein, 9 aa, Homo Sapiens
TGGYTCYCD

SEQ ID NO: 35986 - protein, 9 aa, Homo Sapiens
QDHLRQQRA

SEQ ID NO: 35987 - protein, 9 aa, Homo Sapiens
GNRNTGSQS

SEQ ID NO: 35988 - protein, 9 aa, Homo Sapiens
TMNQTSAVF

SEQ ID NO: 35989 - protein, 9 aa, Homo Sapiens
WDMFSKMAT

SEQ ID NO: 35990 - protein, 9 aa, Homo Sapiens
SIMCLEGTV

SEQ ID NO: 35991 - protein, 9 aa, Homo Sapiens
IRTSKETKD

SEQ ID NO: 35992 - protein, 9 aa, Homo Sapiens
SHLEPLVLF

SEQ ID NO: 35993 - protein, 9 aa, Homo Sapiens
PTHSSLTRG

SEQ ID NO: 35994 - protein, 9 aa, Homo Sapiens
NRGLKKKKQ

SEQ ID NO: 35995 - protein, 9 aa, Homo Sapiens
PKEYEKYAH

SEQ ID NO: 35996 - protein, 9 aa, Homo Sapiens
GTGNRNTGS

SEQ ID NO: 35997 - protein, 9 aa, Homo Sapiens
IEWGPVSLK

SEQ ID NO: 35998 - protein, 9 aa, Homo Sapiens
ASLVSAGPC

SEQ ID NO: 35999 - protein, 9 aa, Homo Sapiens
QLLQWHLHS

SEQ ID NO: 36000 - protein, 9 aa, Homo Sapiens
SCQPACCAT

SEQ ID NO: 36001 - protein, 9 aa, Homo Sapiens
SSHLEPLVL

SEQ ID NO: 36002 - protein, 9 aa, Homo Sapiens
KRPWDDEEE

SEQ ID NO: 36003 - protein, 9 aa, Homo Sapiens
QPACCATSS

SEQ ID NO: 36004 - protein, 9 aa, Homo Sapiens
IMCLEGTVQ

SEQ ID NO: 36005 - protein, 9 aa, Homo Sapiens
PSFFFFSRP

SEQ ID NO: 36006 - protein, 9 aa, Homo Sapiens
LCSTWQGPC

SEQ ID NO: 36007 - protein, 9 aa, Homo Sapiens
KVSSMIPHR

SEQ ID NO: 36008 - protein, 9 aa, Homo Sapiens
PWDDEEEEQ

SEQ ID NO: 36009 - protein, 9 aa, Homo Sapiens
QMRARCHLW

SEQ ID NO: 36010 - protein, 9 aa, Homo Sapiens
HSQLRQWRE

SEQ ID NO: 36011 - protein, 9 aa, Homo Sapiens
DNKYTMNQT

SEQ ID NO: 36012 - protein, 9 aa, Homo Sapiens
VSPSNARDS

SEQ ID NO: 36013 - protein, 9 aa, Homo Sapiens
TQDHLRQQR

SEQ ID NO: 36014 - protein, 9 aa, Homo Sapiens
LNSSHLEPL

SEQ ID NO: 36015 - protein, 9 aa, Homo Sapiens
TSKETKDVS

SEQ ID NO: 36016 - protein, 9 aa, Homo Sapiens
FRVPSHDAQ

SEQ ID NO: 36017 - protein, 9 aa, Homo Sapiens
ASTRSRVVG

SEQ ID NO: 36018 - protein, 9 aa, Homo Sapiens
FKPTHSSLT

SEQ ID NO: 36019 - protein, 9 aa, Homo Sapiens
VLRGPPFAS

SEQ ID NO: 36020 - protein, 9 aa, Homo Sapiens
VGQLVKDGV

SEQ ID NO: 36021 - protein, 9 aa, Homo Sapiens
PVRYQVLRG

SEQ ID NO: 36022 - protein, 9 aa, Homo Sapiens
SQVPEGVRL

SEQ ID NO: 36023 - protein, 9 aa, Homo Sapiens
NSSHLEPLV

SEQ ID NO: 36024 - protein, 9 aa, Homo Sapiens
WHLHSVDHN

SEQ ID NO: 36025 - protein, 9 aa, Homo Sapiens
ATLPCLGAG

SEQ ID NO: 36026 - protein, 9 aa, Homo Sapiens
RAVFRVPSH

SEQ ID NO: 36027 - protein, 9 aa, Homo Sapiens
SPCGKQRYS

SEQ ID NO: 36028 - protein, 9 aa, Homo Sapiens
PLAVFPSIV

SEQ ID NO: 36029 - protein, 9 aa, Homo Sapiens
IHCCGFYTG

SEQ ID NO: 36030 - protein, 9 aa, Homo Sapiens
RNICAISME

SEQ ID NO: 36031 - protein, 9 aa, Homo Sapiens
IAFFSIMCL

SEQ ID NO: 36032 - protein, 9 aa, Homo Sapiens
PIEWGPVSL

SEQ ID NO: 36033 - protein, 9 aa, Homo Sapiens
VRAVVPTHG

SEQ ID NO: 36034 - protein, 9 aa, Homo Sapiens
EQSRDGFRH

SEQ ID NO: 36035 - protein, 9 aa, Homo Sapiens
RGPPFASGL

SEQ ID NO: 36036 - protein, 9 aa, Homo Sapiens
EALAWQHSR

SEQ ID NO: 36037 - protein, 9 aa, Homo Sapiens
PPAPPEPQQ

SEQ ID NO: 36038 - protein, 9 aa, Homo Sapiens
HVRAVVPTH

SEQ ID NO: 36039 - protein, 9 aa, Homo Sapiens
FPSILRLCS

SEQ ID NO: 36040 - protein, 9 aa, Homo Sapiens
AFFSIMCLE

SEQ ID NO: 36041 - protein, 9 aa, Homo Sapiens
GHTDAINFD

SEQ ID NO: 36042 - protein, 9 aa, Homo Sapiens
ERLLGLLAL

SEQ ID NO: 36043 - protein, 9 aa, Homo Sapiens
SQLRQWREY

SEQ ID NO: 36044 - protein, 9 aa, Homo Sapiens
YYYIYSNVQ

SEQ ID NO: 36045 - protein, 9 aa, Homo Sapiens
LKSTQVKIW

SEQ ID NO: 36046 - protein, 9 aa, Homo Sapiens
NYTGGYTCY

SEQ ID NO: 36047 - protein, 9 aa, Homo Sapiens
GLQLEAAQL

SEQ ID NO: 36048 - protein, 9 aa, Homo Sapiens
FYTGNMTLA

SEQ ID NO: 36049 - protein, 9 aa, Homo Sapiens
PGRKRKRHQ

SEQ ID NO: 36050 - protein, 9 aa, Homo Sapiens
SLTQWLAAA

SEQ ID NO: 36051 - protein, 9 aa, Homo Sapiens
FIQKSQLAA

SEQ ID NO: 36052 - protein, 9 aa, Homo Sapiens
WFPSILRLC

SEQ ID NO: 36053 - protein, 9 aa, Homo Sapiens
CGKQRYSSS

SEQ ID NO: 36054 - protein, 9 aa, Homo Sapiens
LPCLGAGGL

SEQ ID NO: 36055 - protein, 9 aa, Homo Sapiens
QSGTATLPC

SEQ ID NO: 36056 - protein, 9 aa, Homo Sapiens
TPNLPQEIL

SEQ ID NO: 36057 - protein, 9 aa, Homo Sapiens
ALASMSKTK

SEQ ID NO: 36058 - protein, 9 aa, Homo Sapiens
AWNDRENRC

SEQ ID NO: 36059 - protein, 9 aa, Homo Sapiens
WEQSRDGFR

SEQ ID NO: 36060 - protein, 9 aa, Homo Sapiens
KIRLVNIMP

SEQ ID NO: 36061 - protein, 9 aa, Homo Sapiens
VVGRCSQMR

SEQ ID NO: 36062 - protein, 9 aa, Homo Sapiens
SFQHHNDFI

SEQ ID NO: 36063 - protein, 9 aa, Homo Sapiens
TSVGKTSLT

SEQ ID NO: 36064 - protein, 9 aa, Homo Sapiens
VPKPGPHLL

SEQ ID NO: 36065 - protein, 9 aa, Homo Sapiens
CQPACCATS

SEQ ID NO: 36066 - protein, 9 aa, Homo Sapiens
ILRAVFRVP

SEQ ID NO: 36067 - protein, 9 aa, Homo Sapiens
DGFRHPGSH

SEQ ID NO: 36068 - protein, 9 aa, Homo Sapiens
ILRLCSTWQ

SEQ ID NO: 36069 - protein, 9 aa, Homo Sapiens
LNRGLKKKK

SEQ ID NO: 36070 - protein, 9 aa, Homo Sapiens
AQLCVNYTG

SEQ ID NO: 36071 - protein, 9 aa, Homo Sapiens
ALQEYMNQL

SEQ ID NO: 36072 - protein, 9 aa, Homo Sapiens
RITDTIVVV

SEQ ID NO: 36073 - protein, 9 aa, Homo Sapiens
PAVRPCSVF

SEQ ID NO: 36074 - protein, 9 aa, Homo Sapiens
SELLADASL

SEQ ID NO: 36075 - protein, 9 aa, Homo Sapiens
RTWPHSRAS

SEQ ID NO: 36076 - protein, 9 aa, Homo Sapiens
RPWDDEEEE

SEQ ID NO: 36077 - protein, 9 aa, Homo Sapiens
IKSSCLYST

SEQ ID NO: 36078 - protein, 9 aa, Homo Sapiens
PGPHLLRKQ

SEQ ID NO: 36079 - protein, 9 aa, Homo Sapiens
HVSHSSRKQ

SEQ ID NO: 36080 - protein, 9 aa, Homo Sapiens
SRKQCHKPQ

SEQ ID NO: 36081 - protein, 9 aa, Homo Sapiens
QKSQLAAHQ

SEQ ID NO: 36082 - protein, 9 aa, Homo Sapiens
TVTVSPSNA

SEQ ID NO: 36083 - protein, 9 aa, Homo Sapiens
GPCAASWWD

SEQ ID NO: 36084 - protein, 9 aa, Homo Sapiens
GRKRKRHQP

SEQ ID NO: 36085 - protein, 9 aa, Homo Sapiens
VFRVPSHDA

SEQ ID NO: 36086 - protein, 9 aa, Homo Sapiens
SPGPQKEDG

SEQ ID NO: 36087 - protein, 9 aa, Homo Sapiens
SMIPHRLSA

SEQ ID NO: 36088 - protein, 9 aa, Homo Sapiens
LCWDMFSKM

SEQ ID NO: 36089 - protein, 9 aa, Homo Sapiens
LADASLVSA

SEQ ID NO: 36090 - protein, 9 aa, Homo Sapiens
PSFQILFVS

SEQ ID NO: 36091 - protein, 9 aa, Homo Sapiens
KVIPQQFDG

SEQ ID NO: 36092 - protein, 9 aa, Homo Sapiens
EKDKDFKAK

SEQ ID NO: 36093 - protein, 9 aa, Homo Sapiens
LRQQRASAR

SEQ ID NO: 36094 - protein, 9 aa, Homo Sapiens
SCLYSTCCL

SEQ ID NO: 36095 - protein, 9 aa, Homo Sapiens
PSILRLCST

SEQ ID NO: 36096 - protein, 9 aa, Homo Sapiens
NTGSQSARV

SEQ ID NO: 36097 - protein, 9 aa, Homo Sapiens
PGHTDAINF

SEQ ID NO: 36098 - protein, 9 aa, Homo Sapiens
AAVGQLVKD

SEQ ID NO: 36099 - protein, 9 aa, Homo Sapiens
RDGFRHPGS

SEQ ID NO: 36100 - protein, 9 aa, Homo Sapiens
SNARFPWLP

SEQ ID NO: 36101 - protein, 9 aa, Homo Sapiens
SSSKFKPTH

SEQ ID NO: 36102 - protein, 9 aa, Homo Sapiens
LCVNYTGGY

SEQ ID NO: 36103 - protein, 9 aa, Homo Sapiens
SRVVGRCSQ

SEQ ID NO: 36104 - protein, 9 aa, Homo Sapiens
PIKSSCLYS

SEQ ID NO: 36105 - protein, 9 aa, Homo Sapiens
SPKTQDHLR

SEQ ID NO: 36106 - protein, 9 aa, Homo Sapiens
QVPEGVRLA

SEQ ID NO: 36107 - protein, 9 aa, Homo Sapiens
QWHLHSVDH

SEQ ID NO: 36108 - protein, 9 aa, Homo Sapiens
CLYSTCCLR

SEQ ID NO: 36109 - protein, 9 aa, Homo Sapiens
SPSPGPQKE

SEQ ID NO: 36110 - protein, 9 aa, Homo Sapiens
PAPPEPQQT

SEQ ID NO: 36111 - protein, 9 aa, Homo Sapiens
TSSCQQSCR

SEQ ID NO: 36112 - protein, 9 aa, Homo Sapiens
QHHNDFIYW

SEQ ID NO: 36113 - protein, 9 aa, Homo Sapiens
PNAPCTMRI

SEQ ID NO: 36114 - protein, 9 aa, Homo Sapiens
HLEPLVLFL

SEQ ID NO: 36115 - protein, 9 aa, Homo Sapiens
FKCIHCCGF

SEQ ID NO: 36116 - protein, 9 aa, Homo Sapiens
PQKEDGEVA

SEQ ID NO: 36117 - protein, 9 aa, Homo Sapiens
RNTGSQSAR

SEQ ID NO: 36118 - protein, 9 aa, Homo Sapiens
RYQVLRGPP

SEQ ID NO: 36119 - protein, 9 aa, Homo Sapiens
RHIVVVPYE

SEQ ID NO: 36120 - protein, 9 aa, Homo Sapiens
EYMNQLDMR

SEQ ID NO: 36121 - protein, 9 aa, Homo Sapiens
KEYEKYAHM

SEQ ID NO: 36122 - protein, 9 aa, Homo Sapiens
GPPFASGLP

SEQ ID NO: 36123 - protein, 9 aa, Homo Sapiens
MFLLEFLLP

SEQ ID NO: 36124 - protein, 9 aa, Homo Sapiens
PCGKQRYSS

SEQ ID NO: 36125 - protein, 9 aa, Homo Sapiens
VTLKVSSMI

SEQ ID NO: 36126 - protein, 9 aa, Homo Sapiens
QHFQKVIPQ

SEQ ID NO: 36127 - protein, 9 aa, Homo Sapiens
QPIEWGPVS

SEQ ID NO: 36128 - protein, 9 aa, Homo Sapiens
DVCLPPGHT

SEQ ID NO: 36129 - protein, 9 aa, Homo Sapiens
LQLEAAQLS

SEQ ID NO: 36130 - protein, 9 aa, Homo Sapiens
QVGRLICAG

SEQ ID NO: 36131 - protein, 9 aa, Homo Sapiens
LRQWREYWN

SEQ ID NO: 36132 - protein, 9 aa, Homo Sapiens
ENRCDICAT

SEQ ID NO: 36133 - protein, 9 aa, Homo Sapiens
AVFRVPSHD

SEQ ID NO: 36134 - protein, 9 aa, Homo Sapiens
RKAWNDREN

SEQ ID NO: 36135 - protein, 9 aa, Homo Sapiens
TLPCLGAGG

SEQ ID NO: 36136 - protein, 9 aa, Homo Sapiens
RSRSTLGYS

SEQ ID NO: 36137 - protein, 9 aa, Homo Sapiens
KRKRHQPHP

SEQ ID NO: 36138 - protein, 9 aa, Homo Sapiens
KAKAQKQVQ

SEQ ID NO: 36139 - protein, 9 aa, Homo Sapiens
TAASNSSER

SEQ ID NO: 36140 - protein, 9 aa, Homo Sapiens
NAPCTMRIP

SEQ ID NO: 36141 - protein, 9 aa, Homo Sapiens
TAAVGQLVK

SEQ ID NO: 36142 - protein, 9 aa, Homo Sapiens
EFPEALAWQ

SEQ ID NO: 36143 - protein, 9 aa, Homo Sapiens
LPQEILTSI

SEQ ID NO: 36144 - protein, 9 aa, Homo Sapiens
EILTSILPE

SEQ ID NO: 36145 - protein, 9 aa, Homo Sapiens
RNIAFFSIM

SEQ ID NO: 36146 - protein, 9 aa, Homo Sapiens
AKAQKQVQF

SEQ ID NO: 36147 - protein, 9 aa, Homo Sapiens
HHNDFIYWL

SEQ ID NO: 36148 - protein, 9 aa, Homo Sapiens
EWGPVSLKC

SEQ ID NO: 36149 - protein, 9 aa, Homo Sapiens
HCCGFYTGN

SEQ ID NO: 36150 - protein, 9 aa, Homo Sapiens
LICNRQSEA

SEQ ID NO: 36151 - protein, 9 aa, Homo Sapiens
FRHIVVVPY

SEQ ID NO: 36152 - protein, 9 aa, Homo Sapiens
GESSQEEKE

SEQ ID NO: 36153 - protein, 9 aa, Homo Sapiens
GYYYIYSNV

SEQ ID NO: 36154 - protein, 9 aa, Homo Sapiens
WLPFALILL

SEQ ID NO: 36155 - protein, 9 aa, Homo Sapiens
YYIYSNVQL

SEQ ID NO: 36156 - protein, 9 aa, Homo Sapiens
EAMFLLEFL

SEQ ID NO: 36157 - protein, 9 aa, Homo Sapiens
CGTGNRNTG

SEQ ID NO: 36158 - protein, 9 aa, Homo Sapiens
LQLKSTQVK

SEQ ID NO: 36159 - protein, 9 aa, Homo Sapiens
ASALQLKST

SEQ ID NO: 36160 - protein, 9 aa, Homo Sapiens
AVSHVRAVV

SEQ ID NO: 36161 - protein, 9 aa, Homo Sapiens
CNKFKIRLV

SEQ ID NO: 36162 - protein, 9 aa, Homo Sapiens
CLGAGGLAS

SEQ ID NO: 36163 - protein, 9 aa, Homo Sapiens
TWPHSRAST

SEQ ID NO: 36164 - protein, 9 aa, Homo Sapiens
ANVIPSFQI

SEQ ID NO: 36165 - protein, 9 aa, Homo Sapiens
APLAVFPSI

SEQ ID NO: 36166 - protein, 9 aa, Homo Sapiens
AGPCVRTWP

SEQ ID NO: 36167 - protein, 9 aa, Homo Sapiens
ARFPWLPFA

SEQ ID NO: 36168 - protein, 9 aa, Homo Sapiens
VSSMIPHRL

SEQ ID NO: 36169 - protein, 9 aa, Homo Sapiens
YVFNPSPGL

SEQ ID NO: 36170 - protein, 9 aa, Homo Sapiens
SERLLGLLA

SEQ ID NO: 36171 - protein, 9 aa, Homo Sapiens
FPEALAWQH

SEQ ID NO: 36172 - protein, 9 aa, Homo Sapiens
QWREYWNEQ

SEQ ID NO: 36173 - protein, 9 aa, Homo Sapiens
ICLNSSHLE

SEQ ID NO: 36174 - protein, 9 aa, Homo Sapiens
KDNKYTMNQ

SEQ ID NO: 36175 - protein, 9 aa, Homo Sapiens
LEFLLPLGI

SEQ ID NO: 36176 - protein, 9 aa, Homo Sapiens
IYSNVQLGG

SEQ ID NO: 36177 - protein, 9 aa, Homo Sapiens
SLVSAGPCV

SEQ ID NO: 36178 - protein, 9 aa, Homo Sapiens
RNANVIPSF

SEQ ID NO: 36179 - protein, 9 aa, Homo Sapiens
KCNECKKAF

SEQ ID NO: 36180 - protein, 9 aa, Homo Sapiens
QGPCAASWW

SEQ ID NO: 36181 - protein, 9 aa, Homo Sapiens
YTMNQTSAV

SEQ ID NO: 36182 - protein, 9 aa, Homo Sapiens
ASWWDASAA

SEQ ID NO: 36183 - protein, 9 aa, Homo Sapiens
QLAAHQKTH

SEQ ID NO: 36184 - protein, 9 aa, Homo Sapiens
TKRPWDDEE

SEQ ID NO: 36185 - protein, 9 aa, Homo Sapiens
GDIAVSHVR

SEQ ID NO: 36186 - protein, 9 aa, Homo Sapiens
WGPVSLKCE

SEQ ID NO: 36187 - protein, 9 aa, Homo Sapiens
PQEILTSIL

SEQ ID NO: 36188 - protein, 9 aa, Homo Sapiens
NARFPWLPF

SEQ ID NO: 36189 - protein, 9 aa, Homo Sapiens
PSPKTQDHL

SEQ ID NO: 36190 - protein, 9 aa, Homo Sapiens
STPNLPQEI

SEQ ID NO: 36191 - protein, 9 aa, Homo Sapiens
KQRYSSSGT

SEQ ID NO: 36192 - protein, 9 aa, Homo Sapiens
AWEQSRDGF

SEQ ID NO: 36193 - protein, 9 aa, Homo Sapiens
AGYYYIYSN

SEQ ID NO: 36194 - protein, 9 aa, Homo Sapiens
LQDEDIITK

SEQ ID NO: 36195 - protein, 9 aa, Homo Sapiens
RSRVVGRCS

SEQ ID NO: 36196 - protein, 9 aa, Homo Sapiens
PWLPFALIL

SEQ ID NO: 36197 - protein, 9 aa, Homo Sapiens
TQWLAAATG

SEQ ID NO: 36198 - protein, 9 aa, Homo Sapiens
PQQFDGVPD

SEQ ID NO: 36199 - protein, 9 aa, Homo Sapiens
AEFPEALAW

SEQ ID NO: 36200 - protein, 9 aa, Homo Sapiens
QGLQLEAAQ

SEQ ID NO: 36201 - protein, 9 aa, Homo Sapiens
LLEFLLPLG

SEQ ID NO: 36202 - protein, 9 aa, Homo Sapiens
CAISMERRM

SEQ ID NO: 36203 - protein, 9 aa, Homo Sapiens
VSFQHHNDF

SEQ ID NO: 36204 - protein, 9 aa, Homo Sapiens
ILTSILPEN

SEQ ID NO: 36205 - protein, 9 aa, Homo Sapiens
MRARCHLWS

SEQ ID NO: 36206 - protein, 9 aa, Homo Sapiens
EKYAHMYGI

SEQ ID NO: 36207 - protein, 9 aa, Homo Sapiens
APPEPQQTI

SEQ ID NO: 36208 - protein, 9 aa, Homo Sapiens
RPSPKTQDH

SEQ ID NO: 36209 - protein, 9 aa, Homo Sapiens
NPESSFSQV

SEQ ID NO: 36210 - protein, 9 aa, Homo Sapiens
PAQPQLLQW

SEQ ID NO: 36211 - protein, 9 aa, Homo Sapiens
SKFKPTHSS

SEQ ID NO: 36212 - protein, 9 aa, Homo Sapiens
ELLADASLV

SEQ ID NO: 36213 - protein, 9 aa, Homo Sapiens
TFIQKSQLA

SEQ ID NO: 36214 - protein, 9 aa, Homo Sapiens
FQHHNDFIY

SEQ ID NO: 36215 - protein, 9 aa, Homo Sapiens
HSLQVGRLI

SEQ ID NO: 36216 - protein, 9 aa, Homo Sapiens
TGNRNTGSQ

SEQ ID NO: 36217 - protein, 9 aa, Homo Sapiens
HLDCPGRIT

SEQ ID NO: 36218 - protein, 9 aa, Homo Sapiens
CAASWWDAS

SEQ ID NO: 36219 - protein, 9 aa, Homo Sapiens
SPGLFAVMH

SEQ ID NO: 36220 - protein, 9 aa, Homo Sapiens
AWQHSRDSG

SEQ ID NO: 36221 - protein, 9 aa, Homo Sapiens
ASPCGKQRY

SEQ ID NO: 36222 - protein, 9 aa, Homo Sapiens
VVLQDEDII

SEQ ID NO: 36223 - protein, 9 aa, Homo Sapiens
LGPAVRPCS

SEQ ID NO: 36224 - protein, 9 aa, Homo Sapiens
KSSCLYSTC

SEQ ID NO: 36225 - protein, 9 aa, Homo Sapiens
LAWQHSRDS

SEQ ID NO: 36226 - protein, 9 aa, Homo Sapiens
FFFSRPSPK

SEQ ID NO: 36227 - protein, 9 aa, Homo Sapiens
QLCVNYTGG

SEQ ID NO: 36228 - protein, 9 aa, Homo Sapiens
TLLALASMS

SEQ ID NO: 36229 - protein, 9 aa, Homo Sapiens
IITKIEGDW

SEQ ID NO: 36230 - protein, 9 aa, Homo Sapiens
KYTMNQTSA

SEQ ID NO: 36231 - protein, 9 aa, Homo Sapiens
EEFKKLICN

SEQ ID NO: 36232 - protein, 9 aa, Homo Sapiens
LLQWHLHSV

SEQ ID NO: 36233 - protein, 9 aa, Homo Sapiens
YSTCCLRGM

SEQ ID NO: 36234 - protein, 9 aa, Homo Sapiens
SKETKDVSA

SEQ ID NO: 36235 - protein, 9 aa, Homo Sapiens
SMSKTKGNK

SEQ ID NO: 36236 - protein, 9 aa, Homo Sapiens
FSQVPEGVR

SEQ ID NO: 36237 - protein, 9 aa, Homo Sapiens
ALQLKSTQV

SEQ ID NO: 36238 - protein, 9 aa, Homo Sapiens
RPASPCGKQ

SEQ ID NO: 36239 - protein, 9 aa, Homo Sapiens
VCLPPGHTD

SEQ ID NO: 36240 - protein, 9 aa, Homo Sapiens
AVGQLVKDG

SEQ ID NO: 36241 - protein, 9 aa, Homo Sapiens
MGSQTVTVS

SEQ ID NO: 36242 - protein, 9 aa, Homo Sapiens
YKCNECKKA

SEQ ID NO: 36243 - protein, 9 aa, Homo Sapiens
PGRITDTIV

SEQ ID NO: 36244 - protein, 9 aa, Homo Sapiens
IPSFQILFV

SEQ ID NO: 36245 - protein, 9 aa, Homo Sapiens
QLRQWREYW

SEQ ID NO: 36246 - protein, 9 aa, Homo Sapiens
QQFDGVPDK

SEQ ID NO: 36247 - protein, 9 aa, Homo Sapiens
SSKFKPTHS

SEQ ID NO: 36248 - protein, 9 aa, Homo Sapiens
NICAISMER

SEQ ID NO: 36249 - protein, 9 aa, Homo Sapiens
SSFQPIEWG

SEQ ID NO: 36250 - protein, 9 aa, Homo Sapiens
CAQLCVNYT

SEQ ID NO: 36251 - protein, 9 aa, Homo Sapiens
WQGPCAASW

SEQ ID NO: 36252 - protein, 9 aa, Homo Sapiens
QTKDNKYTM

SEQ ID NO: 36253 - protein, 9 aa, Homo Sapiens
KFKPTHSSL

SEQ ID NO: 36254 - protein, 9 aa, Homo Sapiens
IHSQLRQWR

SEQ ID NO: 36255 - protein, 9 aa, Homo Sapiens
SSMIPHRLS

SEQ ID NO: 36256 - protein, 9 aa, Homo Sapiens
QLKSTQVKI

SEQ ID NO: 36257 - protein, 9 aa, Homo Sapiens
TRSRVVGRC

SEQ ID NO: 36258 - protein, 9 aa, Homo Sapiens
MNQTSAVFD

SEQ ID NO: 36259 - protein, 9 aa, Homo Sapiens
MSKTKGNKV

SEQ ID NO: 36260 - protein, 9 aa, Homo Sapiens
LYVFNPSPG

SEQ ID NO: 36261 - protein, 9 aa, Homo Sapiens
LPPGHTDAI

SEQ ID NO: 36262 - protein, 9 aa, Homo Sapiens
DIITKIEGD

SEQ ID NO: 36263 - protein, 9 aa, Homo Sapiens
PNLPQEILT

SEQ ID NO: 36264 - protein, 9 aa, Homo Sapiens
VIPSFQILF

SEQ ID NO: 36265 - protein, 9 aa, Homo Sapiens
FFSIMCLEG

SEQ ID NO: 36266 - protein, 9 aa, Homo Sapiens
IRLVNIMPY

SEQ ID NO: 36267 - protein, 9 aa, Homo Sapiens
PLYVFNPSP

SEQ ID NO: 36268 - protein, 9 aa, Homo Sapiens
AEKDKDFKA

SEQ ID NO: 36269 - protein, 9 aa, Homo Sapiens
TFRHIVVVP

SEQ ID NO: 36270 - protein, 9 aa, Homo Sapiens
ERGESSQEE

SEQ ID NO: 36271 - protein, 9 aa, Homo Sapiens
GKQRYSSSG

SEQ ID NO: 36272 - protein, 9 aa, Homo Sapiens
SILRLCSTW

SEQ ID NO: 36273 - protein, 9 aa, Homo Sapiens
FIHSQLRQW

SEQ ID NO: 36274 - protein, 9 aa, Homo Sapiens
FKIRLVNIM

SEQ ID NO: 36275 - protein, 9 aa, Homo Sapiens
CSTWQGPCA

SEQ ID NO: 36276 - protein, 9 aa, Homo Sapiens
PPGHTDAIN

SEQ ID NO: 36277 - protein, 9 aa, Homo Sapiens
LALASMSKT

SEQ ID NO: 36278 - protein, 9 aa, Homo Sapiens
SHSSRKQCH

SEQ ID NO: 36279 - protein, 9 aa, Homo Sapiens
DIAVSHVRA

SEQ ID NO: 36280 - protein, 9 aa, Homo Sapiens
HTDAINFDD

SEQ ID NO: 36281 - protein, 9 aa, Homo Sapiens
RGLKKKKQY

SEQ ID NO: 36282 - protein, 9 aa, Homo Sapiens
AVCDTAAVG

SEQ ID NO: 36283 - protein, 9 aa, Homo Sapiens
RAVVPTHGF

SEQ ID NO: 36284 - protein, 9 aa, Homo Sapiens
AHMYGITDF

SEQ ID NO: 36285 - protein, 9 aa, Homo Sapiens
YSRSHWSQG

SEQ ID NO: 36286 - protein, 9 aa, Homo Sapiens
SQLAAHQKT

SEQ ID NO: 36287 - protein, 9 aa, Homo Sapiens
RKRHQPHPT

SEQ ID NO: 36288 - protein, 9 aa, Homo Sapiens
KDKDFKAKA

SEQ ID NO: 36289 - protein, 9 aa, Homo Sapiens
RLICAGVLC

SEQ ID NO: 36290 - protein, 9 aa, Homo Sapiens
PCTMRIPPP

SEQ ID NO: 36291 - protein, 9 aa, Homo Sapiens
PEALAWQHS

SEQ ID NO: 36292 - protein, 9 aa, Homo Sapiens
KYAHMYGIT

SEQ ID NO: 36293 - protein, 9 aa, Homo Sapiens
NLPCNKFKI

SEQ ID NO: 36294 - protein, 9 aa, Homo Sapiens
DDRNTFRHI

SEQ ID NO: 36295 - protein, 9 aa, Homo Sapiens
KPSFFFFSR

SEQ ID NO: 36296 - protein, 9 aa, Homo Sapiens
EFLLPLGII

SEQ ID NO: 36297 - protein, 9 aa, Homo Sapiens
VRYQVLRGP

SEQ ID NO: 36298 - protein, 9 aa, Homo Sapiens
DCPGRITDT

SEQ ID NO: 36299 - protein, 9 aa, Homo Sapiens
GPCVRTWPH

SEQ ID NO: 36300 - protein, 9 aa, Homo Sapiens
LERGESSQE

SEQ ID NO: 36301 - protein, 9 aa, Homo Sapiens
ESSQEEKEE

SEQ ID NO: 36302 - protein, 9 aa, Homo Sapiens
RHLLSVCGF

SEQ ID NO: 36303 - protein, 9 aa, Homo Sapiens
IVVVPYEPP

SEQ ID NO: 36304 - protein, 9 aa, Homo Sapiens
SFQPIEWGP

SEQ ID NO: 36305 - protein, 9 aa, Homo Sapiens
SWWDASAAE

SEQ ID NO: 36306 - protein, 9 aa, Homo Sapiens
VNYTGGYTC

SEQ ID NO: 36307 - protein, 9 aa, Homo Sapiens
RVPSHDAQL

SEQ ID NO: 36308 - protein, 9 aa, Homo Sapiens
THSSLTRGG

SEQ ID NO: 36309 - protein, 9 aa, Homo Sapiens
LEAAQLSCK

SEQ ID NO: 36310 - protein, 9 aa, Homo Sapiens
GPQKEDGEV

SEQ ID NO: 36311 - protein, 9 aa, Homo Sapiens
LLALASMSK

SEQ ID NO: 36312 - protein, 9 aa, Homo Sapiens
TWQGPCAAS

SEQ ID NO: 36313 - protein, 9 aa, Homo Sapiens
SRNVEIRTS

SEQ ID NO: 36314 - protein, 9 aa, Homo Sapiens
VRTWPHSRA

SEQ ID NO: 36315 - protein, 9 aa, Homo Sapiens
VPSHDAQLK

SEQ ID NO: 36316 - protein, 9 aa, Homo Sapiens
HLRQQRASA

SEQ ID NO: 36317 - protein, 9 aa, Homo Sapiens
WPHSRASTR

SEQ ID NO: 36318 - protein, 9 aa, Homo Sapiens
RTSKETKDV

SEQ ID NO: 36319 - protein, 9 aa, Homo Sapiens
PSPAPPAPP

SEQ ID NO: 36320 - protein, 9 aa, Homo Sapiens
RCSQMRARC

SEQ ID NO: 36321 - protein, 9 aa, Homo Sapiens
GRLICAGVL

SEQ ID NO: 36322 - protein, 9 aa, Homo Sapiens
QPQLLQWHL

SEQ ID NO: 36323 - protein, 9 aa, Homo Sapiens
KALQEYMNQ

SEQ ID NO: 36324 - protein, 9 aa, Homo Sapiens
CCATSSCQQ

SEQ ID NO: 36325 - protein, 9 aa, Homo Sapiens
WHSLQVGRL

SEQ ID NO: 36326 - protein, 9 aa, Homo Sapiens
RLVSFQHHN

SEQ ID NO: 36327 - protein, 9 aa, Homo Sapiens
KCIHCCGFY

SEQ ID NO: 36328 - protein, 9 aa, Homo Sapiens
FFFFSRPSP

SEQ ID NO: 36329 - protein, 9 aa, Homo Sapiens
NRGTKRPWD

SEQ ID NO: 36330 - protein, 9 aa, Homo Sapiens
LKVSSMIPH

SEQ ID NO: 36331 - protein, 9 aa, Homo Sapiens
FAGDDAPLA

SEQ ID NO: 36332 - protein, 9 aa, Homo Sapiens
DRENRCDIC

SEQ ID NO: 36333 - protein, 9 aa, Homo Sapiens
RENRCDICA

SEQ ID NO: 36334 - protein, 9 aa, Homo Sapiens
CIHCCGFYT

SEQ ID NO: 36335 - protein, 9 aa, Homo Sapiens
QRLVSFQHH

SEQ ID NO: 36336 - protein, 9 aa, Homo Sapiens
QKEDGEVAL

SEQ ID NO: 36337 - protein, 9 aa, Homo Sapiens
NVQLGGVGC

SEQ ID NO: 36338 - protein, 9 aa, Homo Sapiens
PCLGAGGLA

SEQ ID NO: 36339 - protein, 9 aa, Homo Sapiens
SFSQVPEGV

SEQ ID NO: 36340 - protein, 9 aa, Homo Sapiens
ITKIEGDWK

SEQ ID NO: 36341 - protein, 9 aa, Homo Sapiens
TRNIAFFSI

SEQ ID NO: 36342 - protein, 9 aa, Homo Sapiens
CTMRIPPPT

SEQ ID NO: 36343 - protein, 9 aa, Homo Sapiens
ADITELCWD

SEQ ID NO: 36344 - protein, 9 aa, Homo Sapiens
GDDAPLAVF

SEQ ID NO: 36345 - protein, 9 aa, Homo Sapiens
WDDEEEEQK

SEQ ID NO: 36346 - protein, 9 aa, Homo Sapiens
AGDDAPLAV

SEQ ID NO: 36347 - protein, 9 aa, Homo Sapiens
PHSRASTRS

SEQ ID NO: 36348 - protein, 9 aa, Homo Sapiens
ICAISMERR

SEQ ID NO: 36349 - protein, 9 aa, Homo Sapiens
QDEDIITKI

SEQ ID NO: 36350 - protein, 9 aa, Homo Sapiens
FFSRPSPKT

SEQ ID NO: 36351 - protein, 9 aa, Homo Sapiens
QEEKEERDE

SEQ ID NO: 36352 - protein, 9 aa, Homo Sapiens
ENPESSFSQ

SEQ ID NO: 36353 - protein, 9 aa, Homo Sapiens
AISMERRMK

SEQ ID NO: 36354 - protein, 9 aa, Homo Sapiens
DASLVSAGP

SEQ ID NO: 36355 - protein, 9 aa, Homo Sapiens
SSCLYSTCC

SEQ ID NO: 36356 - protein, 9 aa, Homo Sapiens
SSRKQCHKP

SEQ ID NO: 36357 - protein, 9 aa, Homo Sapiens
NLPQEILTS

SEQ ID NO: 36358 - protein, 9 aa, Homo Sapiens
QLEAAQLSC

SEQ ID NO: 36359 - protein, 9 aa, Homo Sapiens
WRNICAISM

SEQ ID NO: 36360 - protein, 9 aa, Homo Sapiens
KSTQVKIWF

SEQ ID NO: 36361 - protein, 9 aa, Homo Sapiens
HIVVVPYEP

SEQ ID NO: 36362 - protein, 9 aa, Homo Sapiens
DFKAKAQKQ

SEQ ID NO: 36363 - protein, 9 aa, Homo Sapiens
VSAGPCVRT

SEQ ID NO: 36364 - protein, 9 aa, Homo Sapiens
SQMRARCHL

SEQ ID NO: 36365 - protein, 9 aa, Homo Sapiens
RRWRNICAI

SEQ ID NO: 36366 - protein, 9 aa, Homo Sapiens
LVSFQHHND

SEQ ID NO: 36367 - protein, 9 aa, Homo Sapiens
STRSRVVGR

SEQ ID NO: 36368 - protein, 9 aa, Homo Sapiens
SVGKTSLTQ

SEQ ID NO: 36369 - protein, 9 aa, Homo Sapiens
QLSCKSRGA

SEQ ID NO: 36370 - protein, 9 aa, Homo Sapiens
YQVLRGPPF

SEQ ID NO: 36371 - protein, 9 aa, Homo Sapiens
GFRHPGSHH

SEQ ID NO: 36372 - protein, 9 aa, Homo Sapiens
TKDNKYTMN

SEQ ID NO: 36373 - protein, 9 aa, Homo Sapiens
MRIPPPTTK

SEQ ID NO: 36374 - protein, 9 aa, Homo Sapiens
ADASLVSAG

SEQ ID NO: 36375 - protein, 9 aa, Homo Sapiens
RASTRSRVV

SEQ ID NO: 36376 - protein, 9 aa, Homo Sapiens
KKLICNRQS

SEQ ID NO: 36377 - protein, 9 aa, Homo Sapiens
PSPGLFAVM

SEQ ID NO: 36378 - protein, 9 aa, Homo Sapiens
LQEYMNQLD

SEQ ID NO: 36379 - protein, 9 aa, Homo Sapiens
SFQILFVST

SEQ ID NO: 36380 - protein, 9 aa, Homo Sapiens
KTSLTQWLA

SEQ ID NO: 36381 - protein, 9 aa, Homo Sapiens
PSPGPQKED

SEQ ID NO: 36382 - protein, 9 aa, Homo Sapiens
LAVFPSIVG

SEQ ID NO: 36383 - protein, 9 aa, Homo Sapiens
HSSRKQCHK

SEQ ID NO: 36384 - protein, 9 aa, Homo Sapiens
SAGPCVRTW

SEQ ID NO: 36385 - protein, 9 aa, Homo Sapiens
FAVCDTAAV

SEQ ID NO: 36386 - protein, 9 aa, Homo Sapiens
SALQLKSTQ

SEQ ID NO: 36387 - protein, 9 aa, Homo Sapiens
HLLRKQGQG

SEQ ID NO: 36388 - protein, 9 aa, Homo Sapiens
SFFFFSRPS

SEQ ID NO: 36389 - protein, 9 aa, Homo Sapiens
ASMSKTKGN

SEQ ID NO: 36390 - protein, 9 aa, Homo Sapiens
QQRLVSFQH

SEQ ID NO: 36391 - protein, 9 aa, Homo Sapiens
PASPCGKQR

SEQ ID NO: 36392 - protein, 9 aa, Homo Sapiens
CGFYTGNMT

SEQ ID NO: 36393 - protein, 9 aa, Homo Sapiens
TELCWDMFS

SEQ ID NO: 36394 - protein, 9 aa, Homo Sapiens
QEYMNQLDM

SEQ ID NO: 36395 - protein, 9 aa, Homo Sapiens
ICNRQSEAA

SEQ ID NO: 36396 - protein, 9 aa, Homo Sapiens
RQWREYWNE

SEQ ID NO: 36397 - protein, 9 aa, Homo Sapiens
RRNANVIPS

SEQ ID NO: 36398 - protein, 9 aa, Homo Sapiens
SPAPPAPPE

SEQ ID NO: 36399 - protein, 9 aa, Homo Sapiens
VEIRTSKET

SEQ ID NO: 36400 - protein, 9 aa, Homo Sapiens
FSRPSPKTQ

SEQ ID NO: 36401 - protein, 9 aa, Homo Sapiens
SRSTLGYSR

SEQ ID NO: 36402 - protein, 9 aa, Homo Sapiens
CWDMFSKMA

SEQ ID NO: 36403 - protein, 9 aa, Homo Sapiens
CDTAAVGQL

SEQ ID NO: 36404 - protein, 9 aa, Homo Sapiens
SRPSPKTQD

SEQ ID NO: 36405 - protein, 9 aa, Homo Sapiens
PESSFSQVP

SEQ ID NO: 36406 - protein, 9 aa, Homo Sapiens
RFPWLPFAL

SEQ ID NO: 36407 - protein, 9 aa, Homo Sapiens
NVEIRTSKE

SEQ ID NO: 36408 - protein, 9 aa, Homo Sapiens
FPWLPFALI

SEQ ID NO: 36409 - protein, 9 aa, Homo Sapiens
EYEKYAHMY

SEQ ID NO: 36410 - protein, 9 aa, Homo Sapiens
NECKKAFRQ

SEQ ID NO: 36411 - protein, 9 aa, Homo Sapiens
SGTATLPCL

SEQ ID NO: 36412 - protein, 9 aa, Homo Sapiens
KPTHSSLTR

SEQ ID NO: 36413 - protein, 9 aa, Homo Sapiens
AAHQKTHTK

SEQ ID NO: 36414 - protein, 9 aa, Homo Sapiens
QRYSSSGTP

SEQ ID NO: 36415 - protein, 9 aa, Homo Sapiens
LASMSKTKG

SEQ ID NO: 36416 - protein, 9 aa, Homo Sapiens
VFNPSPGLF

SEQ ID NO: 36417 - protein, 9 aa, Homo Sapiens
SPSPAPPAP

SEQ ID NO: 36418 - protein, 9 aa, Homo Sapiens
NNIHRDIKP

SEQ ID NO: 36419 - protein, 9 aa, Homo Sapiens
VTDARDRQS

SEQ ID NO: 36420 - protein, 9 aa, Homo Sapiens
LHHKRRETD

SEQ ID NO: 36421 - protein, 9 aa, Homo Sapiens
PCVMALRAQ

SEQ ID NO: 36422 - protein, 9 aa, Homo Sapiens
HPCVMALRA

SEQ ID NO: 36423 - protein, 9 aa, Homo Sapiens
AWAHNLSNY

SEQ ID NO: 36424 - protein, 9 aa, Homo Sapiens
FVFSHGLIC

SEQ ID NO: 36425 - protein, 9 aa, Homo Sapiens
GVSSKLLQN

SEQ ID NO: 36426 - protein, 9 aa, Homo Sapiens
SPGTLPRRP

SEQ ID NO: 36427 - protein, 9 aa, Homo Sapiens
EAWAHNLSN

SEQ ID NO: 36428 - protein, 9 aa, Homo Sapiens
NVLAVEYYV

SEQ ID NO: 36429 - protein, 9 aa, Homo Sapiens
LSKCTSHML

SEQ ID NO: 36430 - protein, 9 aa, Homo Sapiens
HKRRETDKR

SEQ ID NO: 36431 - protein, 9 aa, Homo Sapiens
GNLHHMALD

SEQ ID NO: 36432 - protein, 9 aa, Homo Sapiens
IVKLCSQYE

SEQ ID NO: 36433 - protein, 9 aa, Homo Sapiens
RLHPCVMAL

SEQ ID NO: 36434 - protein, 9 aa, Homo Sapiens
VMEHTKRHC

SEQ ID NO: 36435 - protein, 9 aa, Homo Sapiens
YDVHEEDPV

SEQ ID NO: 36436 - protein, 9 aa, Homo Sapiens
TSQAKEPSP

SEQ ID NO: 36437 - protein, 9 aa, Homo Sapiens
KKLLSPGTL

SEQ ID NO: 36438 - protein, 9 aa, Homo Sapiens
CHSHNNIHR

SEQ ID NO: 36439 - protein, 9 aa, Homo Sapiens
VASWDNGEL

SEQ ID NO: 36440 - protein, 9 aa, Homo Sapiens
GFCHSHNNI

SEQ ID NO: 36441 - protein, 9 aa, Homo Sapiens
EYKLYMYIY

SEQ ID NO: 36442 - protein, 9 aa, Homo Sapiens
ASGPWRTLQ

SEQ ID NO: 36443 - protein, 9 aa, Homo Sapiens
QYENQAKNG

SEQ ID NO: 36444 - protein, 9 aa, Homo Sapiens
AKEPSPQTN

SEQ ID NO: 36445 - protein, 9 aa, Homo Sapiens
MALRAQSPI

SEQ ID NO: 36446 - protein, 9 aa, Homo Sapiens
AAGVLMLPV

SEQ ID NO: 36447 - protein, 9 aa, Homo Sapiens
HCDPDKSLQ

SEQ ID NO: 36448 - protein, 9 aa, Homo Sapiens
RDKPLISHT

SEQ ID NO: 36449 - protein, 9 aa, Homo Sapiens
VCAAAVMKK

SEQ ID NO: 36450 - protein, 9 aa, Homo Sapiens
ARDRQSRTI

SEQ ID NO: 36451 - protein, 9 aa, Homo Sapiens
HPTTSQAKE

SEQ ID NO: 36452 - protein, 9 aa, Homo Sapiens
PQWEYKLYM

SEQ ID NO: 36453 - protein, 9 aa, Homo Sapiens
TPSLASGPW

SEQ ID NO: 36454 - protein, 9 aa, Homo Sapiens
FSHGLICWS

SEQ ID NO: 36455 - protein, 9 aa, Homo Sapiens
GRNKALSKC

SEQ ID NO: 36456 - protein, 9 aa, Homo Sapiens
SHNNIHRDI

SEQ ID NO: 36457 - protein, 9 aa, Homo Sapiens
LMAHYDVHE

SEQ ID NO: 36458 - protein, 9 aa, Homo Sapiens
CAAAVMKKD

SEQ ID NO: 36459 - protein, 9 aa, Homo Sapiens
TPAEVQPPP

SEQ ID NO: 36460 - protein, 9 aa, Homo Sapiens
EEQPQWEYK

SEQ ID NO: 36461 - protein, 9 aa, Homo Sapiens
EQPQWEYKL

SEQ ID NO: 36462 - protein, 9 aa, Homo Sapiens
HNLSNYTLP

SEQ ID NO: 36463 - protein, 9 aa, Homo Sapiens
RFTRRYYRS

SEQ ID NO: 36464 - protein, 9 aa, Homo Sapiens
PVTVLLYRK

SEQ ID NO: 36465 - protein, 9 aa, Homo Sapiens
KLCSQYENQ

SEQ ID NO: 36466 - protein, 9 aa, Homo Sapiens
DKPLISHTM

SEQ ID NO: 36467 - protein, 9 aa, Homo Sapiens
SLASGPWRT

SEQ ID NO: 36468 - protein, 9 aa, Homo Sapiens
YPLVIAGKH

SEQ ID NO: 36469 - protein, 9 aa, Homo Sapiens
EGRNKALSK

SEQ ID NO: 36470 - protein, 9 aa, Homo Sapiens
YKLYMYIYF

SEQ ID NO: 36471 - protein, 9 aa, Homo Sapiens
PTPSLASGP

SEQ ID NO: 36472 - protein, 9 aa, Homo Sapiens
AVMKKDLAL

SEQ ID NO: 36473 - protein, 9 aa, Homo Sapiens
KALSKCTSH

SEQ ID NO: 36474 - protein, 9 aa, Homo Sapiens
EKKLLSPGT

SEQ ID NO: 36475 - protein, 9 aa, Homo Sapiens
AAAVMKKDL

SEQ ID NO: 36476 - protein, 9 aa, Homo Sapiens
DYVDSIESL

SEQ ID NO: 36477 - protein, 9 aa, Homo Sapiens
NIQKSMAAF

SEQ ID NO: 36478 - protein, 9 aa, Homo Sapiens
YVDSIESLP

SEQ ID NO: 36479 - protein, 9 aa, Homo Sapiens
DRQNIQKSM

SEQ ID NO: 36480 - protein, 9 aa, Homo Sapiens
NVASWDNGE

SEQ ID NO: 36481 - protein, 9 aa, Homo Sapiens
HDEAWAHNL

SEQ ID NO: 36482 - protein, 9 aa, Homo Sapiens
GNGGAWNIE

SEQ ID NO: 36483 - protein, 9 aa, Homo Sapiens
FCHSHNNIH

SEQ ID NO: 36484 - protein, 9 aa, Homo Sapiens
ENQAKNGIL

SEQ ID NO: 36485 - protein, 9 aa, Homo Sapiens
RCFNVLAVE

SEQ ID NO: 36486 - protein, 9 aa, Homo Sapiens
VSSKLLQNG

SEQ ID NO: 36487 - protein, 9 aa, Homo Sapiens
HTSDGRRRA

SEQ ID NO: 36488 - protein, 9 aa, Homo Sapiens
VNYVEDYVD

SEQ ID NO: 36489 - protein, 9 aa, Homo Sapiens
GVCAAAVMK

SEQ ID NO: 36490 - protein, 9 aa, Homo Sapiens
LVNYVEDYV

SEQ ID NO: 36491 - protein, 9 aa, Homo Sapiens
SANGVSSKL

SEQ ID NO: 36492 - protein, 9 aa, Homo Sapiens
GGVCAAAVM

SEQ ID NO: 36493 - protein, 9 aa, Homo Sapiens
KLLSPGTLP

SEQ ID NO: 36494 - protein, 9 aa, Homo Sapiens
TTSQAKEPS

SEQ ID NO: 36495 - protein, 9 aa, Homo Sapiens
KVTDARDRQ

SEQ ID NO: 36496 - protein, 9 aa, Homo Sapiens
RRYRERRYR

SEQ ID NO: 36497 - protein, 9 aa, Homo Sapiens
IGNLHHMAL

SEQ ID NO: 36498 - protein, 9 aa, Homo Sapiens
GTLPRRPYK

SEQ ID NO: 36499 - protein, 9 aa, Homo Sapiens
LRIHTSDGR

SEQ ID NO: 36500 - protein, 9 aa, Homo Sapiens
ANGVSSKLL

SEQ ID NO: 36501 - protein, 9 aa, Homo Sapiens
LCSQYENQA

SEQ ID NO: 36502 - protein, 9 aa, Homo Sapiens
LHHMALDMG

SEQ ID NO: 36503 - protein, 9 aa, Homo Sapiens
NGGAWNIEQ

SEQ ID NO: 36504 - protein, 9 aa, Homo Sapiens
DNTPALLAP

SEQ ID NO: 36505 - protein, 9 aa, Homo Sapiens
LSNYTLPAF

SEQ ID NO: 36506 - protein, 9 aa, Homo Sapiens
LSPGTLPRR

SEQ ID NO: 36507 - protein, 9 aa, Homo Sapiens
RIHTSDGRR

SEQ ID NO: 36508 - protein, 9 aa, Homo Sapiens
YFDYINVAS

SEQ ID NO: 36509 - protein, 9 aa, Homo Sapiens
VFSHGLICW

SEQ ID NO: 36510 - protein, 9 aa, Homo Sapiens
LTYLHHKRR

SEQ ID NO: 36511 - protein, 9 aa, Homo Sapiens
VIAGKHNIP

SEQ ID NO: 36512 - protein, 9 aa, Homo Sapiens
GGAWNIEQP

SEQ ID NO: 36513 - protein, 9 aa, Homo Sapiens
LTGNGGAWN

SEQ ID NO: 36514 - protein, 9 aa, Homo Sapiens
HTKRHCDPD

SEQ ID NO: 36515 - protein, 9 aa, Homo Sapiens
LIAQAQTGT

SEQ ID NO: 36516 - protein, 9 aa, Homo Sapiens
SRPETVRPC

SEQ ID NO: 36517 - protein, 9 aa, Homo Sapiens
MLPVTVLLY

SEQ ID NO: 36518 - protein, 9 aa, Homo Sapiens
GIIGNLHHM

SEQ ID NO: 36519 - protein, 9 aa, Homo Sapiens
HLLSVCGFR

SEQ ID NO: 36520 - protein, 9 aa, Homo Sapiens
TPALLAPRV

SEQ ID NO: 36521 - protein, 9 aa, Homo Sapiens
HVDRCFNVL

SEQ ID NO: 36522 - protein, 9 aa, Homo Sapiens
VLDENDNTP

SEQ ID NO: 36523 - protein, 9 aa, Homo Sapiens
IHTSDGRRR

SEQ ID NO: 36524 - protein, 9 aa, Homo Sapiens
SHGLICWSD

SEQ ID NO: 36525 - protein, 9 aa, Homo Sapiens
VEDYVDSIE

SEQ ID NO: 36526 - protein, 9 aa, Homo Sapiens
TKRHCDPDK

SEQ ID NO: 36527 - protein, 9 aa, Homo Sapiens
VMALRAQSP

SEQ ID NO: 36528 - protein, 9 aa, Homo Sapiens
IAGKHNIPW

SEQ ID NO: 36529 - protein, 9 aa, Homo Sapiens
QWEYKLYMY

SEQ ID NO: 36530 - protein, 9 aa, Homo Sapiens
RETDKRQIA

SEQ ID NO: 36531 - protein, 9 aa, Homo Sapiens
VLMAHYDVH

SEQ ID NO: 36532 - protein, 9 aa, Homo Sapiens
ALRAQSPIP

SEQ ID NO: 36533 - protein, 9 aa, Homo Sapiens
KRCPDSSRP

SEQ ID NO: 36534 - protein, 9 aa, Homo Sapiens
SGIIGNLHH

SEQ ID NO: 36535 - protein, 9 aa, Homo Sapiens
GKHNIPWLL

SEQ ID NO: 36536 - protein, 9 aa, Homo Sapiens
IAQAQTGTG

SEQ ID NO: 36537 - protein, 9 aa, Homo Sapiens
FNVLAVEYY

SEQ ID NO: 36538 - protein, 9 aa, Homo Sapiens
RYRFTRRYY

SEQ ID NO: 36539 - protein, 9 aa, Homo Sapiens
CSQYENQAK

SEQ ID NO: 36540 - protein, 9 aa, Homo Sapiens
KEPSPQTNK

SEQ ID NO: 36541 - protein, 9 aa, Homo Sapiens
PAEETPAEV

SEQ ID NO: 36542 - protein, 9 aa, Homo Sapiens
VLMLPVTVL

SEQ ID NO: 36543 - protein, 9 aa, Homo Sapiens
ALSKCTSHM

SEQ ID NO: 36544 - protein, 9 aa, Homo Sapiens
TMLTGNGGA

SEQ ID NO: 36545 - protein, 9 aa, Homo Sapiens
VKLCSQYEN

SEQ ID NO: 36546 - protein, 9 aa, Homo Sapiens
SSRPETVRP

SEQ ID NO: 36547 - protein, 9 aa, Homo Sapiens
GLICWSDVS

SEQ ID NO: 36548 - protein, 9 aa, Homo Sapiens
HEEDPVLTV

SEQ ID NO: 36549 - protein, 9 aa, Homo Sapiens
CVMALRAQS

SEQ ID NO: 36550 - protein, 9 aa, Homo Sapiens
KRHCDPDKS

SEQ ID NO: 36551 - protein, 9 aa, Homo Sapiens
SILRIHTSD

SEQ ID NO: 36552 - protein, 9 aa, Homo Sapiens
SHTMMKNIL

SEQ ID NO: 36553 - protein, 9 aa, Homo Sapiens
SKCTSHMLV

SEQ ID NO: 36554 - protein, 9 aa, Homo Sapiens
CFNVLAVEY

SEQ ID NO: 36555 - protein, 9 aa, Homo Sapiens
QAQTGTGKT

SEQ ID NO: 36556 - protein, 9 aa, Homo Sapiens
PPPAEETPA

SEQ ID NO: 36557 - protein, 9 aa, Homo Sapiens
LMLPVTVLL

SEQ ID NO: 36558 - protein, 9 aa, Homo Sapiens
NDNTPALLA

SEQ ID NO: 36559 - protein, 9 aa, Homo Sapiens
RQNIQKSMA

SEQ ID NO: 36560 - protein, 9 aa, Homo Sapiens
QNIQKSMAA

SEQ ID NO: 36561 - protein, 9 aa, Homo Sapiens
PDSSRPETV

SEQ ID NO: 36562 - protein, 9 aa, Homo Sapiens
IGFCHSHNN

SEQ ID NO: 36563 - protein, 9 aa, Homo Sapiens
ETPAEVQPP

SEQ ID NO: 36564 - protein, 9 aa, Homo Sapiens
LPVTVLLYR

SEQ ID NO: 36565 - protein, 9 aa, Homo Sapiens
NLHHMALDM

SEQ ID NO: 36566 - protein, 9 aa, Homo Sapiens
EETPAEVQP

SEQ ID NO: 36567 - protein, 9 aa, Homo Sapiens
QAKEPSPQT

SEQ ID NO: 36568 - protein, 9 aa, Homo Sapiens
TKRCPDSSR

SEQ ID NO: 36569 - protein, 9 aa, Homo Sapiens
PLVIAGKHN

SEQ ID NO: 36570 - protein, 9 aa, Homo Sapiens
LGGVCAAAV

SEQ ID NO: 36571 - protein, 9 aa, Homo Sapiens
HHMALDMGN

SEQ ID NO: 36572 - protein, 9 aa, Homo Sapiens
DYINVASWD

SEQ ID NO: 36573 - protein, 9 aa, Homo Sapiens
PPAEETPAE

SEQ ID NO: 36574 - protein, 9 aa, Homo Sapiens
NLSNYTLPA

SEQ ID NO: 36575 - protein, 9 aa, Homo Sapiens
DYHTDRQNI

SEQ ID NO: 36576 - protein, 9 aa, Homo Sapiens
KLLQNGRHE

SEQ ID NO: 36577 - protein, 9 aa, Homo Sapiens
SSKLLQNGR

SEQ ID NO: 36578 - protein, 9 aa, Homo Sapiens
DHVDRCFNV

SEQ ID NO: 36579 - protein, 9 aa, Homo Sapiens
MLTGNGGAW

SEQ ID NO: 36580 - protein, 9 aa, Homo Sapiens
SKLLQNGRH

SEQ ID NO: 36581 - protein, 9 aa, Homo Sapiens
EDYVDSIES

SEQ ID NO: 36582 - protein, 9 aa, Homo Sapiens
AGVLMLPVT

SEQ ID NO: 36583 - protein, 9 aa, Homo Sapiens
DRQSRTIRQ

SEQ ID NO: 36584 - protein, 9 aa, Homo Sapiens
HSHNNIHRD

SEQ ID NO: 36585 - protein, 9 aa, Homo Sapiens
MAHYDVHEE

SEQ ID NO: 36586 - protein, 9 aa, Homo Sapiens
TGNGGAWNI

SEQ ID NO: 36587 - protein, 9 aa, Homo Sapiens
YINVASWDN

SEQ ID NO: 36588 - protein, 9 aa, Homo Sapiens
KHNIPWLLH

SEQ ID NO: 36589 - protein, 9 aa, Homo Sapiens
RCPDSSRPE

SEQ ID NO: 36590 - protein, 9 aa, Homo Sapiens
HTDRQNIQK

SEQ ID NO: 36591 - protein, 9 aa, Homo Sapiens
VTVLLYRKL

SEQ ID NO: 36592 - protein, 9 aa, Homo Sapiens
HHKRRETDK

SEQ ID NO: 36593 - protein, 9 aa, Homo Sapiens
DLIAQAQTG

SEQ ID NO: 36594 - protein, 9 aa, Homo Sapiens
NGVSSKLLQ

SEQ ID NO: 36595 - protein, 9 aa, Homo Sapiens
VHEEDPVLT

SEQ ID NO: 36596 - protein, 9 aa, Homo Sapiens
FVLDENDNT

SEQ ID NO: 36597 - protein, 9 aa, Homo Sapiens
LLQNGRHEN

SEQ ID NO: 36598 - protein, 9 aa, Homo Sapiens
MEHTKRHCD

SEQ ID NO: 36599 - protein, 9 aa, Homo Sapiens
AWNIEQPSI

SEQ ID NO: 36600 - protein, 9 aa, Homo Sapiens
YENQAKNGI

SEQ ID NO: 36601 - protein, 9 aa, Homo Sapiens
ILRIHTSDG

SEQ ID NO: 36602 - protein, 9 aa, Homo Sapiens
RHCDPDKSL

SEQ ID NO: 36603 - protein, 9 aa, Homo Sapiens
EHTKRHCDP

SEQ ID NO: 36604 - protein, 9 aa, Homo Sapiens
TDARDRQSR

SEQ ID NO: 36605 - protein, 9 aa, Homo Sapiens
LISHTMMKN

SEQ ID NO: 36606 - protein, 9 aa, Homo Sapiens
KCTSHMLVV

SEQ ID NO: 36607 - protein, 9 aa, Homo Sapiens
SQAKEPSPQ

SEQ ID NO: 36608 - protein, 9 aa, Homo Sapiens
PLISHTMMK

SEQ ID NO: 36609 - protein, 9 aa, Homo Sapiens
QPQWEYKLY

SEQ ID NO: 36610 - protein, 9 aa, Homo Sapiens
PSLASGPWR

SEQ ID NO: 36611 - protein, 9 aa, Homo Sapiens
VDSIESLPF

SEQ ID NO: 36612 - protein, 9 aa, Homo Sapiens
EEKKLLSPG

SEQ ID NO: 36613 - protein, 9 aa, Homo Sapiens
DEAWAHNLS

SEQ ID NO: 36614 - protein, 9 aa, Homo Sapiens
AEETPAEVQ

SEQ ID NO: 36615 - protein, 9 aa, Homo Sapiens
HNNIHRDIK

SEQ ID NO: 36616 - protein, 9 aa, Homo Sapiens
MTKRCPDSS

SEQ ID NO: 36617 - protein, 9 aa, Homo Sapiens
NIHRDIKPE

SEQ ID NO: 36618 - protein, 9 aa, Homo Sapiens
ISHTMMKNI

SEQ ID NO: 36619 - protein, 9 aa, Homo Sapiens
SGPWRTLQV

SEQ ID NO: 36620 - protein, 9 aa, Homo Sapiens
CDPDKSLQD

SEQ ID NO: 36621 - protein, 9 aa, Homo Sapiens
INVASWDNG

SEQ ID NO: 36622 - protein, 9 aa, Homo Sapiens
DRCFNVLAV

SEQ ID NO: 36623 - protein, 9 aa, Homo Sapiens
YRERRYRFT

SEQ ID NO: 36624 - protein, 9 aa, Homo Sapiens
RRYRFTRRY

SEQ ID NO: 36625 - protein, 9 aa, Homo Sapiens
AQTGTGKTF

SEQ ID NO: 36626 - protein, 9 aa, Homo Sapiens
CWSDVSEEA

SEQ ID NO: 36627 - protein, 9 aa, Homo Sapiens
AGKHNIPWL

SEQ ID NO: 36628 - protein, 9 aa, Homo Sapiens
WAHNLSNYT

SEQ ID NO: 36629 - protein, 9 aa, Homo Sapiens
PYPLVIAGK

SEQ ID NO: 36630 - protein, 9 aa, Homo Sapiens
FDYINVASW

SEQ ID NO: 36631 - protein, 9 aa, Homo Sapiens
VSGIIGNLH

SEQ ID NO: 36632 - protein, 9 aa, Homo Sapiens
IIGNLHHMA

SEQ ID NO: 36633 - protein, 9 aa, Homo Sapiens
DENDNTPAL

SEQ ID NO: 36634 - protein, 9 aa, Homo Sapiens
TYLHHKRRE

SEQ ID NO: 36635 - protein, 9 aa, Homo Sapiens
QTGTGKTFS

SEQ ID NO: 36636 - protein, 9 aa, Homo Sapiens
ERRYRFTRR

SEQ ID NO: 36637 - protein, 9 aa, Homo Sapiens
RQSRTIRQF

SEQ ID NO: 36638 - protein, 9 aa, Homo Sapiens
KPLISHTMM

SEQ ID NO: 36639 - protein, 9 aa, Homo Sapiens
HGLICWSDV

SEQ ID NO: 36640 - protein, 9 aa, Homo Sapiens
DVHEEDPVL

SEQ ID NO: 36641 - protein, 9 aa, Homo Sapiens
DARDRQSRT

SEQ ID NO: 36642 - protein, 9 aa, Homo Sapiens
RERRYRFTR

SEQ ID NO: 36643 - protein, 9 aa, Homo Sapiens
SQYENQAKN

SEQ ID NO: 36644 - protein, 9 aa, Homo Sapiens
HYDVHEEDP

SEQ ID NO: 36645 - protein, 9 aa, Homo Sapiens
VDRCFNVLA

SEQ ID NO: 36646 - protein, 9 aa, Homo Sapiens
EDYHTDRQN

SEQ ID NO: 36647 - protein, 9 aa, Homo Sapiens
MDHVDRCFN

SEQ ID NO: 36648 - protein, 9 aa, Homo Sapiens
LLSPGTLPR

SEQ ID NO: 36649 - protein, 9 aa, Homo Sapiens
TDRQNIQKS

SEQ ID NO: 36650 - protein, 9 aa, Homo Sapiens
AHYDVHEED

SEQ ID NO: 36651 - protein, 9 aa, Homo Sapiens
DYFDYINVA

SEQ ID NO: 36652 - protein, 9 aa, Homo Sapiens
VQPPPAEET

SEQ ID NO: 36653 - protein, 9 aa, Homo Sapiens
RRETDKRQI

SEQ ID NO: 36654 - protein, 9 aa, Homo Sapiens
LDENDNTPA

SEQ ID NO: 36655 - protein, 9 aa, Homo Sapiens
PTTSQAKEP

SEQ ID NO: 36656 - protein, 9 aa, Homo Sapiens
PWRTLQVGW

SEQ ID NO: 36657 - protein, 9 aa, Homo Sapiens
EPSPQTNKE

SEQ ID NO: 36658 - protein, 9 aa, Homo Sapiens
AHNLSNYTL

SEQ ID NO: 36659 - protein, 9 aa, Homo Sapiens
YLHHKRRET

SEQ ID NO: 36660 - protein, 9 aa, Homo Sapiens
FKVTDARDR

SEQ ID NO: 36661 - protein, 9 aa, Homo Sapiens
RYRERRYRF

SEQ ID NO: 36662 - protein, 9 aa, Homo Sapiens
NKALSKCTS

SEQ ID NO: 36663 - protein, 9 aa, Homo Sapiens
LVIAGKHNI

SEQ ID NO: 36664 - protein, 9 aa, Homo Sapiens
RHLLSVCGF

SEQ ID NO: 36665 - protein, 9 aa, Homo Sapiens
PGTLPRRPY

SEQ ID NO: 36666 - protein, 9 aa, Homo Sapiens
YHTDRQNIQ

SEQ ID NO: 36667 - protein, 9 aa, Homo Sapiens
VMKKDLALP

SEQ ID NO: 36668 - protein, 9 aa, Homo Sapiens
DSSRPETVR

SEQ ID NO: 36669 - protein, 9 aa, Homo Sapiens
QPPPAEETP

SEQ ID NO: 36670 - protein, 9 aa, Homo Sapiens
ENDNTPALL

SEQ ID NO: 36671 - protein, 9 aa, Homo Sapiens
WEYKLYMYI

SEQ ID NO: 36672 - protein, 9 aa, Homo Sapiens
YRFTRRYYR

SEQ ID NO: 36673 - protein, 9 aa, Homo Sapiens
HTMMKNILG

SEQ ID NO: 36674 - protein, 9 aa, Homo Sapiens
KRRETDKRQ

SEQ ID NO: 36675 - protein, 9 aa, Homo Sapiens
RNKALSKCT

SEQ ID NO: 36676 - protein, 9 aa, Homo Sapiens
AQAQTGTGK

SEQ ID NO: 36677 - protein, 9 aa, Homo Sapiens
NTPALLAPR

SEQ ID NO: 36678 - protein, 9 aa, Homo Sapiens
YVEDYVDSI

SEQ ID NO: 36679 - protein, 9 aa, Homo Sapiens
GKDLIAQAQ

SEQ ID NO: 36680 - protein, 9 aa, Homo Sapiens
KLYMYIYFV

SEQ ID NO: 36681 - protein, 9 aa, Homo Sapiens
LICWSDVSE

SEQ ID NO: 36682 - protein, 9 aa, Homo Sapiens
CPDSSRPET

SEQ ID NO: 36683 - protein, 9 aa, Homo Sapiens
KDLIAQAQT

SEQ ID NO: 36684 - protein, 9 aa, Homo Sapiens
ASWDNGELK

SEQ ID NO: 36685 - protein, 9 aa, Homo Sapiens
RDRQSRTIR

SEQ ID NO: 36686 - protein, 9 aa, Homo Sapiens
LASGPWRTL

SEQ ID NO: 36687 - protein, 9 aa, Homo Sapiens
GAWNIEQPS

SEQ ID NO: 36688 - protein, 9 aa, Homo Sapiens
LHPCVMALR

SEQ ID NO: 36689 - protein, 9 aa, Homo Sapiens
GRDKPLISH

SEQ ID NO: 36690 - protein, 9 aa, Homo Sapiens
GPWRTLQVG

SEQ ID NO: 36691 - protein, 9 aa, Homo Sapiens
NYVEDYVDS

SEQ ID NO: 36692 - protein, 9 aa, Homo Sapiens
ICWSDVSEE

SEQ ID NO: 36693 - protein, 9 aa, Homo Sapiens
AAVMKKDLA

SEQ ID NO: 36694 - protein, 9 aa, Homo Sapiens
GVLMLPVTV

SEQ ID NO: 36695 - protein, 9 aa, Homo Sapiens
IENRDVLGD

SEQ ID NO: 36696 - protein, 9 aa, Homo Sapiens
HEAPMRKIK

SEQ ID NO: 36697 - protein, 9 aa, Homo Sapiens
RQVTIWFQT

SEQ ID NO: 36698 - protein, 9 aa, Homo Sapiens
LNDLPVFDS

SEQ ID NO: 36699 - protein, 9 aa, Homo Sapiens
CLPQFQMTD

SEQ ID NO: 36700 - protein, 9 aa, Homo Sapiens
KTLQEEVIE

SEQ ID NO: 36701 - protein, 9 aa, Homo Sapiens
GVKESDWFQ

SEQ ID NO: 36702 - protein, 9 aa, Homo Sapiens
FGCESCAEL

SEQ ID NO: 36703 - protein, 9 aa, Homo Sapiens
LLQKHRTKR

SEQ ID NO: 36704 - protein, 9 aa, Homo Sapiens
LALEGERVC

SEQ ID NO: 36705 - protein, 9 aa, Homo Sapiens
EIHMKMIVT

SEQ ID NO: 36706 - protein, 9 aa, Homo Sapiens
CLHRVSLGS

SEQ ID NO: 36707 - protein, 9 aa, Homo Sapiens
DNRPGNPRE

SEQ ID NO: 36708 - protein, 9 aa, Homo Sapiens
QVMEKASGK

SEQ ID NO: 36709 - protein, 9 aa, Homo Sapiens
KGLPESLSP

SEQ ID NO: 36710 - protein, 9 aa, Homo Sapiens
FDDSVGSNP

SEQ ID NO: 36711 - protein, 9 aa, Homo Sapiens
YFATTAVTG

SEQ ID NO: 36712 - protein, 9 aa, Homo Sapiens
RHWRSHNDV

SEQ ID NO: 36713 - protein, 9 aa, Homo Sapiens
EGSGKARTQ

SEQ ID NO: 36714 - protein, 9 aa, Homo Sapiens
GLLSSSTGP

SEQ ID NO: 36715 - protein, 9 aa, Homo Sapiens
ADLPPAKPG

SEQ ID NO: 36716 - protein, 9 aa, Homo Sapiens
EEDEASGNQ

SEQ ID NO: 36717 - protein, 9 aa, Homo Sapiens
QSSFVAVTE

SEQ ID NO: 36718 - protein, 9 aa, Homo Sapiens
GAELPSHRT

SEQ ID NO: 36719 - protein, 9 aa, Homo Sapiens
ARFCWEGAQ

SEQ ID NO: 36720 - protein, 9 aa, Homo Sapiens
SVKQEKEIH

SEQ ID NO: 36721 - protein, 9 aa, Homo Sapiens
LSIAEMLHR

SEQ ID NO: 36722 - protein, 9 aa, Homo Sapiens
AKSAVELVH

SEQ ID NO: 36723 - protein, 9 aa, Homo Sapiens
NFEEDHGKG

SEQ ID NO: 36724 - protein, 9 aa, Homo Sapiens
AERFHCQCP

SEQ ID NO: 36725 - protein, 9 aa, Homo Sapiens
DEASGNQSD

SEQ ID NO: 36726 - protein, 9 aa, Homo Sapiens
LDNLLADLP

SEQ ID NO: 36727 - protein, 9 aa, Homo Sapiens
QNLEAERFH

SEQ ID NO: 36728 - protein, 9 aa, Homo Sapiens
TIWFQTRRV

SEQ ID NO: 36729 - protein, 9 aa, Homo Sapiens
SHPTRVRRC

SEQ ID NO: 36730 - protein, 9 aa, Homo Sapiens
PGTAALGGS

SEQ ID NO: 36731 - protein, 9 aa, Homo Sapiens
EDDDLLETE

SEQ ID NO: 36732 - protein, 9 aa, Homo Sapiens
NGNITHIPE

SEQ ID NO: 36733 - protein, 9 aa, Homo Sapiens
ITHIPEYGD

SEQ ID NO: 36734 - protein, 9 aa, Homo Sapiens
VWIECRLHT

SEQ ID NO: 36735 - protein, 9 aa, Homo Sapiens
DAPSRKNRS

SEQ ID NO: 36736 - protein, 9 aa, Homo Sapiens
TGDGTNNGP

SEQ ID NO: 36737 - protein, 9 aa, Homo Sapiens
TALFSHNRA

SEQ ID NO: 36738 - protein, 9 aa, Homo Sapiens
IEGSGKART

SEQ ID NO: 36739 - protein, 9 aa, Homo Sapiens
AERWERQKK

SEQ ID NO: 36740 - protein, 9 aa, Homo Sapiens
VLELNIKYS

SEQ ID NO: 36741 - protein, 9 aa, Homo Sapiens
PTRVRRCPG

SEQ ID NO: 36742 - protein, 9 aa, Homo Sapiens
MATVWIECR

SEQ ID NO: 36743 - protein, 9 aa, Homo Sapiens
RKNRSSGVL

SEQ ID NO: 36744 - protein, 9 aa, Homo Sapiens
ATVSGGQTR

SEQ ID NO: 36745 - protein, 9 aa, Homo Sapiens
ASLIEKYEK

SEQ ID NO: 36746 - protein, 9 aa, Homo Sapiens
EVIEAMGIK

SEQ ID NO: 36747 - protein, 9 aa, Homo Sapiens
CKEACSQRS

SEQ ID NO: 36748 - protein, 9 aa, Homo Sapiens
AAWGAELPS

SEQ ID NO: 36749 - protein, 9 aa, Homo Sapiens
EKPTDGRQV

SEQ ID NO: 36750 - protein, 9 aa, Homo Sapiens
ARNNSMCTT

SEQ ID NO: 36751 - protein, 9 aa, Homo Sapiens
NSSFTGESE

SEQ ID NO: 36752 - protein, 9 aa, Homo Sapiens
LQDPDGIEG

SEQ ID NO: 36753 - protein, 9 aa, Homo Sapiens
CSVLVCGAL

SEQ ID NO: 36754 - protein, 9 aa, Homo Sapiens
EAERFHCQC

SEQ ID NO: 36755 - protein, 9 aa, Homo Sapiens
HHFPDNKNW

SEQ ID NO: 36756 - protein, 9 aa, Homo Sapiens
GRHKLEAQL

SEQ ID NO: 36757 - protein, 9 aa, Homo Sapiens
QFLLMQLVS

SEQ ID NO: 36758 - protein, 9 aa, Homo Sapiens
IQLAFFFFS

SEQ ID NO: 36759 - protein, 9 aa, Homo Sapiens
SGHSGYHYS

SEQ ID NO: 36760 - protein, 9 aa, Homo Sapiens
RDLHLSHAR

SEQ ID NO: 36761 - protein, 9 aa, Homo Sapiens
DTQDFHSLA

SEQ ID NO: 36762 - protein, 9 aa, Homo Sapiens
VELVHEFLN

SEQ ID NO: 36763 - protein, 9 aa, Homo Sapiens
PIEGSGKAR

SEQ ID NO: 36764 - protein, 9 aa, Homo Sapiens
EIMPGGHKT

SEQ ID NO: 36765 - protein, 9 aa, Homo Sapiens
DLLETEFRQ

SEQ ID NO: 36766 - protein, 9 aa, Homo Sapiens
HPKNRYLFW

SEQ ID NO: 36767 - protein, 9 aa, Homo Sapiens
NTEMFIAGF

SEQ ID NO: 36768 - protein, 9 aa, Homo Sapiens
ELVHEFLND

SEQ ID NO: 36769 - protein, 9 aa, Homo Sapiens
FCGLLSSST

SEQ ID NO: 36770 - protein, 9 aa, Homo Sapiens
ETGAISFVH

SEQ ID NO: 36771 - protein, 9 aa, Homo Sapiens
SYRSVYGVE

SEQ ID NO: 36772 - protein, 9 aa, Homo Sapiens
EAHQKSEFI

SEQ ID NO: 36773 - protein, 9 aa, Homo Sapiens
FLREIMEAM

SEQ ID NO: 36774 - protein, 9 aa, Homo Sapiens
RLGAGEVGI

SEQ ID NO: 36775 - protein, 9 aa, Homo Sapiens
TRDLHLSHA

SEQ ID NO: 36776 - protein, 9 aa, Homo Sapiens
SWPDGMLCM

SEQ ID NO: 36777 - protein, 9 aa, Homo Sapiens
MKLSIAEML

SEQ ID NO: 36778 - protein, 9 aa, Homo Sapiens
ERYHGYRGA

SEQ ID NO: 36779 - protein, 9 aa, Homo Sapiens
CRLHTPMYL

SEQ ID NO: 36780 - protein, 9 aa, Homo Sapiens
YPERRQSRS

SEQ ID NO: 36781 - protein, 9 aa, Homo Sapiens
TEMFIAGFL

SEQ ID NO: 36782 - protein, 9 aa, Homo Sapiens
LLETEFRQY

SEQ ID NO: 36783 - protein, 9 aa, Homo Sapiens
HNDVDESSL

SEQ ID NO: 36784 - protein, 9 aa, Homo Sapiens
RHSHPTRVR

SEQ ID NO: 36785 - protein, 9 aa, Homo Sapiens
ELLPSRFQE

SEQ ID NO: 36786 - protein, 9 aa, Homo Sapiens
ATTAVTGEK

SEQ ID NO: 36787 - protein, 9 aa, Homo Sapiens
RRDRTHVSE

SEQ ID NO: 36788 - protein, 9 aa, Homo Sapiens
KNRSSGVLD

SEQ ID NO: 36789 - protein, 9 aa, Homo Sapiens
EENKHIALG

SEQ ID NO: 36790 - protein, 9 aa, Homo Sapiens
LPSRFQEKC

SEQ ID NO: 36791 - protein, 9 aa, Homo Sapiens
ARTQIITNT

SEQ ID NO: 36792 - protein, 9 aa, Homo Sapiens
SVLQMVQVM

SEQ ID NO: 36793 - protein, 9 aa, Homo Sapiens
PVAQRWTVS

SEQ ID NO: 36794 - protein, 9 aa, Homo Sapiens
AQMPFNAAP

SEQ ID NO: 36795 - protein, 9 aa, Homo Sapiens
ENKHIALGT

SEQ ID NO: 36796 - protein, 9 aa, Homo Sapiens
KTEAASDTQ

SEQ ID NO: 36797 - protein, 9 aa, Homo Sapiens
APSRKNRSS

SEQ ID NO: 36798 - protein, 9 aa, Homo Sapiens
SFVHLFDPG

SEQ ID NO: 36799 - protein, 9 aa, Homo Sapiens
SPAPSVSVE

SEQ ID NO: 36800 - protein, 9 aa, Homo Sapiens
MVSQISMQG

SEQ ID NO: 36801 - protein, 9 aa, Homo Sapiens
RQFEKDNLI

SEQ ID NO: 36802 - protein, 9 aa, Homo Sapiens
EPASPVKYC

SEQ ID NO: 36803 - protein, 9 aa, Homo Sapiens
WFQYRDLAT

SEQ ID NO: 36804 - protein, 9 aa, Homo Sapiens
DCKEACSQR

SEQ ID NO: 36805 - protein, 9 aa, Homo Sapiens
GPKGLPESL

SEQ ID NO: 36806 - protein, 9 aa, Homo Sapiens
FEPSRLCKS

SEQ ID NO: 36807 - protein, 9 aa, Homo Sapiens
QTSGCKVSK

SEQ ID NO: 36808 - protein, 9 aa, Homo Sapiens
KLSIAEMLH

SEQ ID NO: 36809 - protein, 9 aa, Homo Sapiens
LLPSRFQEK

SEQ ID NO: 36810 - protein, 9 aa, Homo Sapiens
ISFVHLFDP

SEQ ID NO: 36811 - protein, 9 aa, Homo Sapiens
SSNDHGSFA

SEQ ID NO: 36812 - protein, 9 aa, Homo Sapiens
ESRSRSRSH

SEQ ID NO: 36813 - protein, 9 aa, Homo Sapiens
HIVVHPKNR

SEQ ID NO: 36814 - protein, 9 aa, Homo Sapiens
VRGSGSYQY

SEQ ID NO: 36815 - protein, 9 aa, Homo Sapiens
EMSQKIETR

SEQ ID NO: 36816 - protein, 9 aa, Homo Sapiens
SSSTGPLSS

SEQ ID NO: 36817 - protein, 9 aa, Homo Sapiens
RKIKKLMGS

SEQ ID NO: 36818 - protein, 9 aa, Homo Sapiens
SQKIETRQF

SEQ ID NO: 36819 - protein, 9 aa, Homo Sapiens
IEKYEKHPK

SEQ ID NO: 36820 - protein, 9 aa, Homo Sapiens
RSVYGVEQK

SEQ ID NO: 36821 - protein, 9 aa, Homo Sapiens
VYGVEQKGK

SEQ ID NO: 36822 - protein, 9 aa, Homo Sapiens
QVVLATAME

SEQ ID NO: 36823 - protein, 9 aa, Homo Sapiens
EVSKVEKEH

SEQ ID NO: 36824 - protein, 9 aa, Homo Sapiens
FEFWENFEE

SEQ ID NO: 36825 - protein, 9 aa, Homo Sapiens
GFDIEAARK

SEQ ID NO: 36826 - protein, 9 aa, Homo Sapiens
VGNSQERYH

SEQ ID NO: 36827 - protein, 9 aa, Homo Sapiens
KSMSGRHKL

SEQ ID NO: 36828 - protein, 9 aa, Homo Sapiens
RGTQADWEY

SEQ ID NO: 36829 - protein, 9 aa, Homo Sapiens
GSHMAPVSL

SEQ ID NO: 36830 - protein, 9 aa, Homo Sapiens
VAHIQLAFF

SEQ ID NO: 36831 - protein, 9 aa, Homo Sapiens
DTLPCLWQE

SEQ ID NO: 36832 - protein, 9 aa, Homo Sapiens
KDLQDPDGI

SEQ ID NO: 36833 - protein, 9 aa, Homo Sapiens
SRKNRSSGV

SEQ ID NO: 36834 - protein, 9 aa, Homo Sapiens
YKEAEKSPH

SEQ ID NO: 36835 - protein, 9 aa, Homo Sapiens
GDTQFDDEE

SEQ ID NO: 36836 - protein, 9 aa, Homo Sapiens
LPVAQRWTV

SEQ ID NO: 36837 - protein, 9 aa, Homo Sapiens
SVSVEPQAW

SEQ ID NO: 36838 - protein, 9 aa, Homo Sapiens
GSGKARTQI

SEQ ID NO: 36839 - protein, 9 aa, Homo Sapiens
SMSKGGKHK

SEQ ID NO: 36840 - protein, 9 aa, Homo Sapiens
LFIEHHFPD

SEQ ID NO: 36841 - protein, 9 aa, Homo Sapiens
EQLAQKGGK

SEQ ID NO: 36842 - protein, 9 aa, Homo Sapiens
LHLSHARFV

SEQ ID NO: 36843 - protein, 9 aa, Homo Sapiens
DPITASCIN

SEQ ID NO: 36844 - protein, 9 aa, Homo Sapiens
SLIEKYEKH

SEQ ID NO: 36845 - protein, 9 aa, Homo Sapiens
HYSHTTPQG

SEQ ID NO: 36846 - protein, 9 aa, Homo Sapiens
ATVLCSVLV

SEQ ID NO: 36847 - protein, 9 aa, Homo Sapiens
PKHALPVSG

SEQ ID NO: 36848 - protein, 9 aa, Homo Sapiens
MGYDRYSAI

SEQ ID NO: 36849 - protein, 9 aa, Homo Sapiens
WFQTRRVKD

SEQ ID NO: 36850 - protein, 9 aa, Homo Sapiens
IMEAMLKAY

SEQ ID NO: 36851 - protein, 9 aa, Homo Sapiens
YSAICHPLH

SEQ ID NO: 36852 - protein, 9 aa, Homo Sapiens
FATTAVTGE

SEQ ID NO: 36853 - protein, 9 aa, Homo Sapiens
CGLECPGNT

SEQ ID NO: 36854 - protein, 9 aa, Homo Sapiens
SQSISENFP

SEQ ID NO: 36855 - protein, 9 aa, Homo Sapiens
QAAAWGAEL

SEQ ID NO: 36856 - protein, 9 aa, Homo Sapiens
VVLATAMEI

SEQ ID NO: 36857 - protein, 9 aa, Homo Sapiens
DNSCGKKEY

SEQ ID NO: 36858 - protein, 9 aa, Homo Sapiens
NLPHVETWH

SEQ ID NO: 36859 - protein, 9 aa, Homo Sapiens
FQYRDLATY

SEQ ID NO: 36860 - protein, 9 aa, Homo Sapiens
VALKYDHKF

SEQ ID NO: 36861 - protein, 9 aa, Homo Sapiens
VDNSSFTGE

SEQ ID NO: 36862 - protein, 9 aa, Homo Sapiens
KMVDDGKTM

SEQ ID NO: 36863 - protein, 9 aa, Homo Sapiens
RDVLGDTQD

SEQ ID NO: 36864 - protein, 9 aa, Homo Sapiens
PTARNNSMC

SEQ ID NO: 36865 - protein, 9 aa, Homo Sapiens
SVGSNPQPS

SEQ ID NO: 36866 - protein, 9 aa, Homo Sapiens
LDQLQYDQQ

SEQ ID NO: 36867 - protein, 9 aa, Homo Sapiens
KNTEMFIAG

SEQ ID NO: 36868 - protein, 9 aa, Homo Sapiens
THVSEIIND

SEQ ID NO: 36869 - protein, 9 aa, Homo Sapiens
QTRRVKDKK

SEQ ID NO: 36870 - protein, 9 aa, Homo Sapiens
AIKDMKEAI

SEQ ID NO: 36871 - protein, 9 aa, Homo Sapiens
ITVTALFSH

SEQ ID NO: 36872 - protein, 9 aa, Homo Sapiens
LEKPTDGRQ

SEQ ID NO: 36873 - protein, 9 aa, Homo Sapiens
SVALKYDHK

SEQ ID NO: 36874 - protein, 9 aa, Homo Sapiens
SEIQTSGCK

SEQ ID NO: 36875 - protein, 9 aa, Homo Sapiens
PPIEGSGKA

SEQ ID NO: 36876 - protein, 9 aa, Homo Sapiens
ERCLHRVSL

SEQ ID NO: 36877 - protein, 9 aa, Homo Sapiens
LKLAGWQCP

SEQ ID NO: 36878 - protein, 9 aa, Homo Sapiens
DEKTVEVLE

SEQ ID NO: 36879 - protein, 9 aa, Homo Sapiens
KLAGWQCPE

SEQ ID NO: 36880 - protein, 9 aa, Homo Sapiens
SHSRSASSN

SEQ ID NO: 36881 - protein, 9 aa, Homo Sapiens
FVHLFDPGF

SEQ ID NO: 36882 - protein, 9 aa, Homo Sapiens
RKKILKETL

SEQ ID NO: 36883 - protein, 9 aa, Homo Sapiens
LFLNGARFC

SEQ ID NO: 36884 - protein, 9 aa, Homo Sapiens
VHFLREIME

SEQ ID NO: 36885 - protein, 9 aa, Homo Sapiens
YDQQFLSCH

SEQ ID NO: 36886 - protein, 9 aa, Homo Sapiens
LDEAEQLAQ

SEQ ID NO: 36887 - protein, 9 aa, Homo Sapiens
LCSVLVCGA

SEQ ID NO: 36888 - protein, 9 aa, Homo Sapiens
AICFNVSAH

SEQ ID NO: 36889 - protein, 9 aa, Homo Sapiens
EEEEEDEAS

SEQ ID NO: 36890 - protein, 9 aa, Homo Sapiens
PPVSHNPEG

SEQ ID NO: 36891 - protein, 9 aa, Homo Sapiens
TVWIECRLH

SEQ ID NO: 36892 - protein, 9 aa, Homo Sapiens
SEPASPVKY

SEQ ID NO: 36893 - protein, 9 aa, Homo Sapiens
RLCKSCYSS

SEQ ID NO: 36894 - protein, 9 aa, Homo Sapiens
KFLQSSFVA

SEQ ID NO: 36895 - protein, 9 aa, Homo Sapiens
TPGSHMAPV

SEQ ID NO: 36896 - protein, 9 aa, Homo Sapiens
PHLGLGCLS

SEQ ID NO: 36897 - protein, 9 aa, Homo Sapiens
SYSSSAIPR

SEQ ID NO: 36898 - protein, 9 aa, Homo Sapiens
DAASYRSVY

SEQ ID NO: 36899 - protein, 9 aa, Homo Sapiens
ENISENDRA

SEQ ID NO: 36900 - protein, 9 aa, Homo Sapiens
VFDSIIKES

SEQ ID NO: 36901 - protein, 9 aa, Homo Sapiens
EFCGLLSSS

SEQ ID NO: 36902 - protein, 9 aa, Homo Sapiens
TRRVKDKKI

SEQ ID NO: 36903 - protein, 9 aa, Homo Sapiens
ACSQRSRLT

SEQ ID NO: 36904 - protein, 9 aa, Homo Sapiens
DENTKRRNH

SEQ ID NO: 36905 - protein, 9 aa, Homo Sapiens
EVTSVALKY

SEQ ID NO: 36906 - protein, 9 aa, Homo Sapiens
TNNGPALKK

SEQ ID NO: 36907 - protein, 9 aa, Homo Sapiens
TFGGRLGAG

SEQ ID NO: 36908 - protein, 9 aa, Homo Sapiens
DTRKKILKE

SEQ ID NO: 36909 - protein, 9 aa, Homo Sapiens
DLIGQTHID

SEQ ID NO: 36910 - protein, 9 aa, Homo Sapiens
QVSEPASPV

SEQ ID NO: 36911 - protein, 9 aa, Homo Sapiens
TDREENKHI

SEQ ID NO: 36912 - protein, 9 aa, Homo Sapiens
SGRLPPCAS

SEQ ID NO: 36913 - protein, 9 aa, Homo Sapiens
VVAHIQLAF

SEQ ID NO: 36914 - protein, 9 aa, Homo Sapiens
KDDSHCLPQ

SEQ ID NO: 36915 - protein, 9 aa, Homo Sapiens
SMDAPSRKN

SEQ ID NO: 36916 - protein, 9 aa, Homo Sapiens
LPVSGRLPP

SEQ ID NO: 36917 - protein, 9 aa, Homo Sapiens
GSFALTPRP

SEQ ID NO: 36918 - protein, 9 aa, Homo Sapiens
RCLHRVSLG

SEQ ID NO: 36919 - protein, 9 aa, Homo Sapiens
GTAALGGSS

SEQ ID NO: 36920 - protein, 9 aa, Homo Sapiens
HPTRVRRCP

SEQ ID NO: 36921 - protein, 9 aa, Homo Sapiens
AASDTQHPA

SEQ ID NO: 36922 - protein, 9 aa, Homo Sapiens
SKGGKHKDS

SEQ ID NO: 36923 - protein, 9 aa, Homo Sapiens
DATVSGGQT

SEQ ID NO: 36924 - protein, 9 aa, Homo Sapiens
GLECPGNTV

SEQ ID NO: 36925 - protein, 9 aa, Homo Sapiens
SRSSPAPSV

SEQ ID NO: 36926 - protein, 9 aa, Homo Sapiens
GKHKDSVWG

SEQ ID NO: 36927 - protein, 9 aa, Homo Sapiens
ASDTQHPAA

SEQ ID NO: 36928 - protein, 9 aa, Homo Sapiens
QVHFLREIM

SEQ ID NO: 36929 - protein, 9 aa, Homo Sapiens
RHKLEAQLT

SEQ ID NO: 36930 - protein, 9 aa, Homo Sapiens
QELLSQIEM

SEQ ID NO: 36931 - protein, 9 aa, Homo Sapiens
GTPGSHMAP

SEQ ID NO: 36932 - protein, 9 aa, Homo Sapiens
YSHTTPQGR

SEQ ID NO: 36933 - protein, 9 aa, Homo Sapiens
EKHPKTDSS

SEQ ID NO: 36934 - protein, 9 aa, Homo Sapiens
NDHGSFALT

SEQ ID NO: 36935 - protein, 9 aa, Homo Sapiens
HIIPETLLE

SEQ ID NO: 36936 - protein, 9 aa, Homo Sapiens
PGNPREAKG

SEQ ID NO: 36937 - protein, 9 aa, Homo Sapiens
VSGGQTRLQ

SEQ ID NO: 36938 - protein, 9 aa, Homo Sapiens
EEFEEIMPG

SEQ ID NO: 36939 - protein, 9 aa, Homo Sapiens
SAVELVHEF

SEQ ID NO: 36940 - protein, 9 aa, Homo Sapiens
GSNPQPSHF

SEQ ID NO: 36941 - protein, 9 aa, Homo Sapiens
SDWFQYRDL

SEQ ID NO: 36942 - protein, 9 aa, Homo Sapiens
ESPWDSQSI

SEQ ID NO: 36943 - protein, 9 aa, Homo Sapiens
MVDDGKTMR

SEQ ID NO: 36944 - protein, 9 aa, Homo Sapiens
AALGGSSLD

SEQ ID NO: 36945 - protein, 9 aa, Homo Sapiens
LSMSKGGKH

SEQ ID NO: 36946 - protein, 9 aa, Homo Sapiens
SDTQHPAAS

SEQ ID NO: 36947 - protein, 9 aa, Homo Sapiens
EKSPHLGLG

SEQ ID NO: 36948 - protein, 9 aa, Homo Sapiens
WENFEEDHG

SEQ ID NO: 36949 - protein, 9 aa, Homo Sapiens
LEGLLQKHR

SEQ ID NO: 36950 - protein, 9 aa, Homo Sapiens
KPLCNRVRI

SEQ ID NO: 36951 - protein, 9 aa, Homo Sapiens
KPGTLLPTA

SEQ ID NO: 36952 - protein, 9 aa, Homo Sapiens
LPNSHEEPQ

SEQ ID NO: 36953 - protein, 9 aa, Homo Sapiens
APMRKIKKL

SEQ ID NO: 36954 - protein, 9 aa, Homo Sapiens
SDLFVMGAA

SEQ ID NO: 36955 - protein, 9 aa, Homo Sapiens
GSYQYPVAE

SEQ ID NO: 36956 - protein, 9 aa, Homo Sapiens
AIPRKLKTC

SEQ ID NO: 36957 - protein, 9 aa, Homo Sapiens
RSGHSGYHY

SEQ ID NO: 36958 - protein, 9 aa, Homo Sapiens
KKNTEMFIA

SEQ ID NO: 36959 - protein, 9 aa, Homo Sapiens
QMVQVMEKA

SEQ ID NO: 36960 - protein, 9 aa, Homo Sapiens
IFGCESCAE

SEQ ID NO: 36961 - protein, 9 aa, Homo Sapiens
ENTKRRNHY

SEQ ID NO: 36962 - protein, 9 aa, Homo Sapiens
FQVSEPASP

SEQ ID NO: 36963 - protein, 9 aa, Homo Sapiens
AESLPNSHE

SEQ ID NO: 36964 - protein, 9 aa, Homo Sapiens
KGGKHKDSV

SEQ ID NO: 36965 - protein, 9 aa, Homo Sapiens
EGERVCKSG

SEQ ID NO: 36966 - protein, 9 aa, Homo Sapiens
SLSRCYHII

SEQ ID NO: 36967 - protein, 9 aa, Homo Sapiens
ILKETLLQL

SEQ ID NO: 36968 - protein, 9 aa, Homo Sapiens
EVNTDEDIE

SEQ ID NO: 36969 - protein, 9 aa, Homo Sapiens
HQKSEFILR

SEQ ID NO: 36970 - protein, 9 aa, Homo Sapiens
DGMLCMEQV

SEQ ID NO: 36971 - protein, 9 aa, Homo Sapiens
LLPTARNNS

SEQ ID NO: 36972 - protein, 9 aa, Homo Sapiens
TQFDDEETW

SEQ ID NO: 36973 - protein, 9 aa, Homo Sapiens
QERYHGYRG

SEQ ID NO: 36974 - protein, 9 aa, Homo Sapiens
VGSNPQPSH

SEQ ID NO: 36975 - protein, 9 aa, Homo Sapiens
EFILRVFSR

SEQ ID NO: 36976 - protein, 9 aa, Homo Sapiens
NPGPKGLPE

SEQ ID NO: 36977 - protein, 9 aa, Homo Sapiens
RYSAICHPL

SEQ ID NO: 36978 - protein, 9 aa, Homo Sapiens
THIPEYGDT

SEQ ID NO: 36979 - protein, 9 aa, Homo Sapiens
VDDGKTMRV

SEQ ID NO: 36980 - protein, 9 aa, Homo Sapiens
CQNLEAERF

SEQ ID NO: 36981 - protein, 9 aa, Homo Sapiens
GLYAQKFLQ

SEQ ID NO: 36982 - protein, 9 aa, Homo Sapiens
SMSGRHKLE

SEQ ID NO: 36983 - protein, 9 aa, Homo Sapiens
FTGESEPQS

SEQ ID NO: 36984 - protein, 9 aa, Homo Sapiens
GVTPVVTLY

SEQ ID NO: 36985 - protein, 9 aa, Homo Sapiens
YQYPVAEKA

SEQ ID NO: 36986 - protein, 9 aa, Homo Sapiens
FSTFGGRLG

SEQ ID NO: 36987 - protein, 9 aa, Homo Sapiens
LWDTLPCLW

SEQ ID NO: 36988 - protein, 9 aa, Homo Sapiens
QGFDIEAAR

SEQ ID NO: 36989 - protein, 9 aa, Homo Sapiens
DSHCLPQFQ

SEQ ID NO: 36990 - protein, 9 aa, Homo Sapiens
VHLFDPGFE

SEQ ID NO: 36991 - protein, 9 aa, Homo Sapiens
VLCSVLVCG

SEQ ID NO: 36992 - protein, 9 aa, Homo Sapiens
DSQSISENF

SEQ ID NO: 36993 - protein, 9 aa, Homo Sapiens
HLFDPGFEV

SEQ ID NO: 36994 - protein, 9 aa, Homo Sapiens
EKYEKHPKT

SEQ ID NO: 36995 - protein, 9 aa, Homo Sapiens
ALFIEHHFP

SEQ ID NO: 36996 - protein, 9 aa, Homo Sapiens
QNGNITHIP

SEQ ID NO: 36997 - protein, 9 aa, Homo Sapiens
VRLFQVSEP

SEQ ID NO: 36998 - protein, 9 aa, Homo Sapiens
QKKRKNPDL

SEQ ID NO: 36999 - protein, 9 aa, Homo Sapiens
QDQFLLMQL

SEQ ID NO: 37000 - protein, 9 aa, Homo Sapiens
ICFNVSAHI

SEQ ID NO: 37001 - protein, 9 aa, Homo Sapiens
DIDILPGLY

SEQ ID NO: 37002 - protein, 9 aa, Homo Sapiens
KGFDDSVGS

SEQ ID NO: 37003 - protein, 9 aa, Homo Sapiens
KEAEKSPHL

SEQ ID NO: 37004 - protein, 9 aa, Homo Sapiens
RGSGSYQYP

SEQ ID NO: 37005 - protein, 9 aa, Homo Sapiens
SRLCKSCYS

SEQ ID NO: 37006 - protein, 9 aa, Homo Sapiens
KNGVTPVVT

SEQ ID NO: 37007 - protein, 9 aa, Homo Sapiens
YPEIGYCHG

SEQ ID NO: 37008 - protein, 9 aa, Homo Sapiens
QADWEYPER

SEQ ID NO: 37009 - protein, 9 aa, Homo Sapiens
EVRGSGSYQ

SEQ ID NO: 37010 - protein, 9 aa, Homo Sapiens
WIECRLHTP

SEQ ID NO: 37011 - protein, 9 aa, Homo Sapiens
GSGSYQYPV

SEQ ID NO: 37012 - protein, 9 aa, Homo Sapiens
LQELLSQIE

SEQ ID NO: 37013 - protein, 9 aa, Homo Sapiens
SQERYHGYR

SEQ ID NO: 37014 - protein, 9 aa, Homo Sapiens
PVSGRLPPC

SEQ ID NO: 37015 - protein, 9 aa, Homo Sapiens
DVLGDTQDF

SEQ ID NO: 37016 - protein, 9 aa, Homo Sapiens
LYPEIGYCH

SEQ ID NO: 37017 - protein, 9 aa, Homo Sapiens
TGMGTPGSH

SEQ ID NO: 37018 - protein, 9 aa, Homo Sapiens
LLDATVSGG

SEQ ID NO: 37019 - protein, 9 aa, Homo Sapiens
GYDRYSAIC

SEQ ID NO: 37020 - protein, 9 aa, Homo Sapiens
MSGRHKLEA

SEQ ID NO: 37021 - protein, 9 aa, Homo Sapiens
RNGHEAPMR

SEQ ID NO: 37022 - protein, 9 aa, Homo Sapiens
LMTRDLHLS

SEQ ID NO: 37023 - protein, 9 aa, Homo Sapiens
AELNDLPVF

SEQ ID NO: 37024 - protein, 9 aa, Homo Sapiens
TRVRRCPGG

SEQ ID NO: 37025 - protein, 9 aa, Homo Sapiens
MALDNLLAD

SEQ ID NO: 37026 - protein, 9 aa, Homo Sapiens
PMRKIKKLM

SEQ ID NO: 37027 - protein, 9 aa, Homo Sapiens
EAEQLAQKG

SEQ ID NO: 37028 - protein, 9 aa, Homo Sapiens
SCAELVAES

SEQ ID NO: 37029 - protein, 9 aa, Homo Sapiens
LPTARNNSM

SEQ ID NO: 37030 - protein, 9 aa, Homo Sapiens
SEEAESLPN

SEQ ID NO: 37031 - protein, 9 aa, Homo Sapiens
SLPNSHEEP

SEQ ID NO: 37032 - protein, 9 aa, Homo Sapiens
DDLIGQTHI

SEQ ID NO: 37033 - protein, 9 aa, Homo Sapiens
IHMKMIVTR

SEQ ID NO: 37034 - protein, 9 aa, Homo Sapiens
LLVHLPLST

SEQ ID NO: 37035 - protein, 9 aa, Homo Sapiens
RVRRCPGGL

SEQ ID NO: 37036 - protein, 9 aa, Homo Sapiens
WGKAGKQGL

SEQ ID NO: 37037 - protein, 9 aa, Homo Sapiens
HLGLGCLSF

SEQ ID NO: 37038 - protein, 9 aa, Homo Sapiens
AQDQFLLMQ

SEQ ID NO: 37039 - protein, 9 aa, Homo Sapiens
LLEGLLQKH

SEQ ID NO: 37040 - protein, 9 aa, Homo Sapiens
LQMVQVMEK

SEQ ID NO: 37041 - protein, 9 aa, Homo Sapiens
KILKETLLQ

SEQ ID NO: 37042 - protein, 9 aa, Homo Sapiens
KTFITVTAL

SEQ ID NO: 37043 - protein, 9 aa, Homo Sapiens
RMLMTRDLH

SEQ ID NO: 37044 - protein, 9 aa, Homo Sapiens
LDNSCGKKE

SEQ ID NO: 37045 - protein, 9 aa, Homo Sapiens
DNSSFTGES

SEQ ID NO: 37046 - protein, 9 aa, Homo Sapiens
HRTKRLGAK

SEQ ID NO: 37047 - protein, 9 aa, Homo Sapiens
ISLAIKDMK

SEQ ID NO: 37048 - protein, 9 aa, Homo Sapiens
IVVHPKNRY

SEQ ID NO: 37049 - protein, 9 aa, Homo Sapiens
CHGTGMVAA

SEQ ID NO: 37050 - protein, 9 aa, Homo Sapiens
TKDLQDPDG

SEQ ID NO: 37051 - protein, 9 aa, Homo Sapiens
ASYRSVYGV

SEQ ID NO: 37052 - protein, 9 aa, Homo Sapiens
SGKARTQII

SEQ ID NO: 37053 - protein, 9 aa, Homo Sapiens
VLFLNGARF

SEQ ID NO: 37054 - protein, 9 aa, Homo Sapiens
IETRQFEKD

SEQ ID NO: 37055 - protein, 9 aa, Homo Sapiens
NAQDQFLLM

SEQ ID NO: 37056 - protein, 9 aa, Homo Sapiens
CAELVAESM

SEQ ID NO: 37057 - protein, 9 aa, Homo Sapiens
ECRLHTPMY

SEQ ID NO: 37058 - protein, 9 aa, Homo Sapiens
VHEFLNDLN

SEQ ID NO: 37059 - protein, 9 aa, Homo Sapiens
VRHWRSHND

SEQ ID NO: 37060 - protein, 9 aa, Homo Sapiens
PRKLKTCSS

SEQ ID NO: 37061 - protein, 9 aa, Homo Sapiens
DDDLLETEF

SEQ ID NO: 37062 - protein, 9 aa, Homo Sapiens
LAFFFFSVG

SEQ ID NO: 37063 - protein, 9 aa, Homo Sapiens
PLCNRVRIA

SEQ ID NO: 37064 - protein, 9 aa, Homo Sapiens
RQKKRKNPD

SEQ ID NO: 37065 - protein, 9 aa, Homo Sapiens
KAMVSQISM

SEQ ID NO: 37066 - protein, 9 aa, Homo Sapiens
KFEFWENFE

SEQ ID NO: 37067 - protein, 9 aa, Homo Sapiens
KNLPHVETW

SEQ ID NO: 37068 - protein, 9 aa, Homo Sapiens
FQEKCAEEP

SEQ ID NO: 37069 - protein, 9 aa, Homo Sapiens
GAALVLESA

SEQ ID NO: 37070 - protein, 9 aa, Homo Sapiens
KCKDCDKVF

SEQ ID NO: 37071 - protein, 9 aa, Homo Sapiens
DDLLETEFR

SEQ ID NO: 37072 - protein, 9 aa, Homo Sapiens
CKDCDKVFR

SEQ ID NO: 37073 - protein, 9 aa, Homo Sapiens
TDGRQVVCH

SEQ ID NO: 37074 - protein, 9 aa, Homo Sapiens
RQVVCHASA

SEQ ID NO: 37075 - protein, 9 aa, Homo Sapiens
TSVALKYDH

SEQ ID NO: 37076 - protein, 9 aa, Homo Sapiens
EIGYCHGTG

SEQ ID NO: 37077 - protein, 9 aa, Homo Sapiens
NNPWVRLAA

SEQ ID NO: 37078 - protein, 9 aa, Homo Sapiens
DQQFLSCHD

SEQ ID NO: 37079 - protein, 9 aa, Homo Sapiens
CLDEKTVEV

SEQ ID NO: 37080 - protein, 9 aa, Homo Sapiens
ERRDRTHVS

SEQ ID NO: 37081 - protein, 9 aa, Homo Sapiens
VLQELLSQI

SEQ ID NO: 37082 - protein, 9 aa, Homo Sapiens
RPGNPREAK

SEQ ID NO: 37083 - protein, 9 aa, Homo Sapiens
EGSYKCKDC

SEQ ID NO: 37084 - protein, 9 aa, Homo Sapiens
EYPERRQSR

SEQ ID NO: 37085 - protein, 9 aa, Homo Sapiens
DSEVNTDED

SEQ ID NO: 37086 - protein, 9 aa, Homo Sapiens
EACSQRSRL

SEQ ID NO: 37087 - protein, 9 aa, Homo Sapiens
TLDNSCGKK

SEQ ID NO: 37088 - protein, 9 aa, Homo Sapiens
HTKDLQDPD

SEQ ID NO: 37089 - protein, 9 aa, Homo Sapiens
LIEKYEKHP

SEQ ID NO: 37090 - protein, 9 aa, Homo Sapiens
LVHEFLNDL

SEQ ID NO: 37091 - protein, 9 aa, Homo Sapiens
EIMEAMLKA

SEQ ID NO: 37092 - protein, 9 aa, Homo Sapiens
GLPESLSPE

SEQ ID NO: 37093 - protein, 9 aa, Homo Sapiens
VMGAALVLE

SEQ ID NO: 37094 - protein, 9 aa, Homo Sapiens
DAISIIGTE

SEQ ID NO: 37095 - protein, 9 aa, Homo Sapiens
QKIETRQFE

SEQ ID NO: 37096 - protein, 9 aa, Homo Sapiens
PAPSVSVEP

SEQ ID NO: 37097 - protein, 9 aa, Homo Sapiens
TVEVLELNI

SEQ ID NO: 37098 - protein, 9 aa, Homo Sapiens
NISENDRAY

SEQ ID NO: 37099 - protein, 9 aa, Homo Sapiens
DLPPAKPGK

SEQ ID NO: 37100 - protein, 9 aa, Homo Sapiens
QISMQGFKS

SEQ ID NO: 37101 - protein, 9 aa, Homo Sapiens
PVVTLYHFD

SEQ ID NO: 37102 - protein, 9 aa, Homo Sapiens
CKVSKKTRM

SEQ ID NO: 37103 - protein, 9 aa, Homo Sapiens
YHGYRGAFR

SEQ ID NO: 37104 - protein, 9 aa, Homo Sapiens
HLDQLQYDQ

SEQ ID NO: 37105 - protein, 9 aa, Homo Sapiens
GDTQDFHSL

SEQ ID NO: 37106 - protein, 9 aa, Homo Sapiens
QEKEIHMKM

SEQ ID NO: 37107 - protein, 9 aa, Homo Sapiens
LGAGEVGIL

SEQ ID NO: 37108 - protein, 9 aa, Homo Sapiens
NEVNRQGFD

SEQ ID NO: 37109 - protein, 9 aa, Homo Sapiens
AISLAIKDM

SEQ ID NO: 37110 - protein, 9 aa, Homo Sapiens
MSTEGGGRG

SEQ ID NO: 37111 - protein, 9 aa, Homo Sapiens
TDEDIEKNL

SEQ ID NO: 37112 - protein, 9 aa, Homo Sapiens
LPESLSPEV

SEQ ID NO: 37113 - protein, 9 aa, Homo Sapiens
VWGKAGKQG

SEQ ID NO: 37114 - protein, 9 aa, Homo Sapiens
TPLKLAGWQ

SEQ ID NO: 37115 - protein, 9 aa, Homo Sapiens
YILTLDNSC

SEQ ID NO: 37116 - protein, 9 aa, Homo Sapiens
REVWGKAGK

SEQ ID NO: 37117 - protein, 9 aa, Homo Sapiens
GNITHIPEY

SEQ ID NO: 37118 - protein, 9 aa, Homo Sapiens
NDVDESSLS

SEQ ID NO: 37119 - protein, 9 aa, Homo Sapiens
SLAIKDMKE

SEQ ID NO: 37120 - protein, 9 aa, Homo Sapiens
TVTALFSHN

SEQ ID NO: 37121 - protein, 9 aa, Homo Sapiens
RFQEKCAEE

SEQ ID NO: 37122 - protein, 9 aa, Homo Sapiens
AHQKSEFIL

SEQ ID NO: 37123 - protein, 9 aa, Homo Sapiens
AEKSPHLGL

SEQ ID NO: 37124 - protein, 9 aa, Homo Sapiens
FDIEAARKE

SEQ ID NO: 37125 - protein, 9 aa, Homo Sapiens
TTAVTGEKK

SEQ ID NO: 37126 - protein, 9 aa, Homo Sapiens
DEAEQLAQK

SEQ ID NO: 37127 - protein, 9 aa, Homo Sapiens
HVSEIINDL

SEQ ID NO: 37128 - protein, 9 aa, Homo Sapiens
SEVTSVALK

SEQ ID NO: 37129 - protein, 9 aa, Homo Sapiens
KTVEVLELN

SEQ ID NO: 37130 - protein, 9 aa, Homo Sapiens
RVIQYFATT

SEQ ID NO: 37131 - protein, 9 aa, Homo Sapiens
PCQNLEAER

SEQ ID NO: 37132 - protein, 9 aa, Homo Sapiens
GRQVVCHAS

SEQ ID NO: 37133 - protein, 9 aa, Homo Sapiens
DSYSSSAIP

SEQ ID NO: 37134 - protein, 9 aa, Homo Sapiens
RHRAICFNV

SEQ ID NO: 37135 - protein, 9 aa, Homo Sapiens
EEAESLPNS

SEQ ID NO: 37136 - protein, 9 aa, Homo Sapiens
SRFQEKCAE

SEQ ID NO: 37137 - protein, 9 aa, Homo Sapiens
LLMQLVSNV

SEQ ID NO: 37138 - protein, 9 aa, Homo Sapiens
YCHGTGMVA

SEQ ID NO: 37139 - protein, 9 aa, Homo Sapiens
NDRAYSGDA

SEQ ID NO: 37140 - protein, 9 aa, Homo Sapiens
TVLCSVLVC

SEQ ID NO: 37141 - protein, 9 aa, Homo Sapiens
PEKFEFWEN

SEQ ID NO: 37142 - protein, 9 aa, Homo Sapiens
QKLEKTKKA

SEQ ID NO: 37143 - protein, 9 aa, Homo Sapiens
SGCKVSKKT

SEQ ID NO: 37144 - protein, 9 aa, Homo Sapiens
EDIEKNLDK

SEQ ID NO: 37145 - protein, 9 aa, Homo Sapiens
PSRKNRSSG

SEQ ID NO: 37146 - protein, 9 aa, Homo Sapiens
PISGDTQFD

SEQ ID NO: 37147 - protein, 9 aa, Homo Sapiens
SVQAAAWGA

SEQ ID NO: 37148 - protein, 9 aa, Homo Sapiens
KYEKHPKTD

SEQ ID NO: 37149 - protein, 9 aa, Homo Sapiens
WERQKKRKN

SEQ ID NO: 37150 - protein, 9 aa, Homo Sapiens
KLPVAQRWT

SEQ ID NO: 37151 - protein, 9 aa, Homo Sapiens
FLLMQLVSN

SEQ ID NO: 37152 - protein, 9 aa, Homo Sapiens
ILATVLCSV

SEQ ID NO: 37153 - protein, 9 aa, Homo Sapiens
THPALFIEH

SEQ ID NO: 37154 - protein, 9 aa, Homo Sapiens
TGAISFVHL

SEQ ID NO: 37155 - protein, 9 aa, Homo Sapiens
EAEKSPHLG

SEQ ID NO: 37156 - protein, 9 aa, Homo Sapiens
PWDSQSISE

SEQ ID NO: 37157 - protein, 9 aa, Homo Sapiens
IDILPGLYG

SEQ ID NO: 37158 - protein, 9 aa, Homo Sapiens
RLFQVSEPA

SEQ ID NO: 37159 - protein, 9 aa, Homo Sapiens
EVWGKAGKQ

SEQ ID NO: 37160 - protein, 9 aa, Homo Sapiens
PALFIEHHF

SEQ ID NO: 37161 - protein, 9 aa, Homo Sapiens
SHCLPQFQM

SEQ ID NO: 37162 - protein, 9 aa, Homo Sapiens
QYFATTAVT

SEQ ID NO: 37163 - protein, 9 aa, Homo Sapiens
RCYHIIPET

SEQ ID NO: 37164 - protein, 9 aa, Homo Sapiens
DLPVFDSII

SEQ ID NO: 37165 - protein, 9 aa, Homo Sapiens
ADSEVNTDE

SEQ ID NO: 37166 - protein, 9 aa, Homo Sapiens
TFITVTALF

SEQ ID NO: 37167 - protein, 9 aa, Homo Sapiens
RWTVSIEVG

SEQ ID NO: 37168 - protein, 9 aa, Homo Sapiens
EVNRQGFDI

SEQ ID NO: 37169 - protein, 9 aa, Homo Sapiens
GKAGKQGLL

SEQ ID NO: 37170 - protein, 9 aa, Homo Sapiens
FNVSAHIES

SEQ ID NO: 37171 - protein, 9 aa, Homo Sapiens
VQAAAWGAE

SEQ ID NO: 37172 - protein, 9 aa, Homo Sapiens
TTNGCGLEC

SEQ ID NO: 37173 - protein, 9 aa, Homo Sapiens
RAICFNVSA

SEQ ID NO: 37174 - protein, 9 aa, Homo Sapiens
MTRDLHLSH

SEQ ID NO: 37175 - protein, 9 aa, Homo Sapiens
ELLSQIEML

SEQ ID NO: 37176 - protein, 9 aa, Homo Sapiens
LREIMEAML

SEQ ID NO: 37177 - protein, 9 aa, Homo Sapiens
SHMAPVSLN

SEQ ID NO: 37178 - protein, 9 aa, Homo Sapiens
VTALFSHNR

SEQ ID NO: 37179 - protein, 9 aa, Homo Sapiens
TLPCLWQEA

SEQ ID NO: 37180 - protein, 9 aa, Homo Sapiens
PKMVDDGKT

SEQ ID NO: 37181 - protein, 9 aa, Homo Sapiens
SMQGFKSPF

SEQ ID NO: 37182 - protein, 9 aa, Homo Sapiens
LEVSKVEKE

SEQ ID NO: 37183 - protein, 9 aa, Homo Sapiens
DRTHVSEII

SEQ ID NO: 37184 - protein, 9 aa, Homo Sapiens
LSPGTAALG

SEQ ID NO: 37185 - protein, 9 aa, Homo Sapiens
INKQNCSHL

SEQ ID NO: 37186 - protein, 9 aa, Homo Sapiens
AFFFFSVGI

SEQ ID NO: 37187 - protein, 9 aa, Homo Sapiens
SAIPRKLKT

SEQ ID NO: 37188 - protein, 9 aa, Homo Sapiens
GHSGYHYSH

SEQ ID NO: 37189 - protein, 9 aa, Homo Sapiens
GSYKCKDCD

SEQ ID NO: 37190 - protein, 9 aa, Homo Sapiens
TLQEEVIEA

SEQ ID NO: 37191 - protein, 9 aa, Homo Sapiens
CEKTFITVT

SEQ ID NO: 37192 - protein, 9 aa, Homo Sapiens
HEFLNDLNK

SEQ ID NO: 37193 - protein, 9 aa, Homo Sapiens
FALTPRPQL

SEQ ID NO: 37194 - protein, 9 aa, Homo Sapiens
IMATVWIEC

SEQ ID NO: 37195 - protein, 9 aa, Homo Sapiens
RQGFDIEAA

SEQ ID NO: 37196 - protein, 9 aa, Homo Sapiens
QLAQKGGKK

SEQ ID NO: 37197 - protein, 9 aa, Homo Sapiens
GERVCKSGD

SEQ ID NO: 37198 - protein, 9 aa, Homo Sapiens
PLKLAGWQC

SEQ ID NO: 37199 - protein, 9 aa, Homo Sapiens
RTDNRPGNP

SEQ ID NO: 37200 - protein, 9 aa, Homo Sapiens
SHNDVDESS

SEQ ID NO: 37201 - protein, 9 aa, Homo Sapiens
KVDNSSFTG

SEQ ID NO: 37202 - protein, 9 aa, Homo Sapiens
RSHNDVDES

SEQ ID NO: 37203 - protein, 9 aa, Homo Sapiens
ALNPGPKGL

SEQ ID NO: 37204 - protein, 9 aa, Homo Sapiens
LEAERFHCQ

SEQ ID NO: 37205 - protein, 9 aa, Homo Sapiens
EKEIHMKMI

SEQ ID NO: 37206 - protein, 9 aa, Homo Sapiens
TPVVTLYHF

SEQ ID NO: 37207 - protein, 9 aa, Homo Sapiens
YSSSAIPRK

SEQ ID NO: 37208 - protein, 9 aa, Homo Sapiens
DGRQVVCHA

SEQ ID NO: 37209 - protein, 9 aa, Homo Sapiens
LFQVSEPAS

SEQ ID NO: 37210 - protein, 9 aa, Homo Sapiens
KNLQALEVS

SEQ ID NO: 37211 - protein, 9 aa, Homo Sapiens
PYCVDENTK

SEQ ID NO: 37212 - protein, 9 aa, Homo Sapiens
NITHIPEYG

SEQ ID NO: 37213 - protein, 9 aa, Homo Sapiens
GTNNGPALK

SEQ ID NO: 37214 - protein, 9 aa, Homo Sapiens
QLFEPSRLC

SEQ ID NO: 37215 - protein, 9 aa, Homo Sapiens
SGSYQYPVA

SEQ ID NO: 37216 - protein, 9 aa, Homo Sapiens
SSAIPRKLK

SEQ ID NO: 37217 - protein, 9 aa, Homo Sapiens
GEGSYKCKD

SEQ ID NO: 37218 - protein, 9 aa, Homo Sapiens
DGKTMRVKH

SEQ ID NO: 37219 - protein, 9 aa, Homo Sapiens
AASYRSVYG

SEQ ID NO: 37220 - protein, 9 aa, Homo Sapiens
ATDREENKH

SEQ ID NO: 37221 - protein, 9 aa, Homo Sapiens
EVLELNIKY

SEQ ID NO: 37222 - protein, 9 aa, Homo Sapiens
AALVLESAA

SEQ ID NO: 37223 - protein, 9 aa, Homo Sapiens
AGKYILTLD

SEQ ID NO: 37224 - protein, 9 aa, Homo Sapiens
MGTPGSHMA

SEQ ID NO: 37225 - protein, 9 aa, Homo Sapiens
YHIIPETLL

SEQ ID NO: 37226 - protein, 9 aa, Homo Sapiens
EAPMRKIKK

SEQ ID NO: 37227 - protein, 9 aa, Homo Sapiens
LKLPVAQRW

SEQ ID NO: 37228 - protein, 9 aa, Homo Sapiens
EVRHWRSHN

SEQ ID NO: 37229 - protein, 9 aa, Homo Sapiens
LLKNGVTPV

SEQ ID NO: 37230 - protein, 9 aa, Homo Sapiens
LSQIEMLER

SEQ ID NO: 37231 - protein, 9 aa, Homo Sapiens
DGTNNGPAL

SEQ ID NO: 37232 - protein, 9 aa, Homo Sapiens
QVTIWFQTR

SEQ ID NO: 37233 - protein, 9 aa, Homo Sapiens
GGRGCQAQV

SEQ ID NO: 37234 - protein, 9 aa, Homo Sapiens
GCKVDNSSF

SEQ ID NO: 37235 - protein, 9 aa, Homo Sapiens
KYILTLDNS

SEQ ID NO: 37236 - protein, 9 aa, Homo Sapiens
QKFLQSSFV

SEQ ID NO: 37237 - protein, 9 aa, Homo Sapiens
MLCMEQVSH

SEQ ID NO: 37238 - protein, 9 aa, Homo Sapiens
ASCINKQNC

SEQ ID NO: 37239 - protein, 9 aa, Homo Sapiens
HVETWHKDV

SEQ ID NO: 37240 - protein, 9 aa, Homo Sapiens
GELLPSRFQ

SEQ ID NO: 37241 - protein, 9 aa, Homo Sapiens
ISMQGFKSP

SEQ ID NO: 37242 - protein, 9 aa, Homo Sapiens
FGGRLGAGE

SEQ ID NO: 37243 - protein, 9 aa, Homo Sapiens
YDRYSAICH

SEQ ID NO: 37244 - protein, 9 aa, Homo Sapiens
KTMRVKHPK

SEQ ID NO: 37245 - protein, 9 aa, Homo Sapiens
QFDDEETWT

SEQ ID NO: 37246 - protein, 9 aa, Homo Sapiens
HMAPVSLNV

SEQ ID NO: 37247 - protein, 9 aa, Homo Sapiens
LPVFDSIIK

SEQ ID NO: 37248 - protein, 9 aa, Homo Sapiens
RSSPAPSVS

SEQ ID NO: 37249 - protein, 9 aa, Homo Sapiens
GTLLPTARN

SEQ ID NO: 37250 - protein, 9 aa, Homo Sapiens
FFFFSVGIL

SEQ ID NO: 37251 - protein, 9 aa, Homo Sapiens
IHLKNLPHV

SEQ ID NO: 37252 - protein, 9 aa, Homo Sapiens
CVDENTKRR

SEQ ID NO: 37253 - protein, 9 aa, Homo Sapiens
VIEAMGIKE

SEQ ID NO: 37254 - protein, 9 aa, Homo Sapiens
ELALEGERV

SEQ ID NO: 37255 - protein, 9 aa, Homo Sapiens
LFEPSRLCK

SEQ ID NO: 37256 - protein, 9 aa, Homo Sapiens
EAESLPNSH

SEQ ID NO: 37257 - protein, 9 aa, Homo Sapiens
DRAYSGDAQ

SEQ ID NO: 37258 - protein, 9 aa, Homo Sapiens
PRHSHPTRV

SEQ ID NO: 37259 - protein, 9 aa, Homo Sapiens
SRCYHIIPE

SEQ ID NO: 37260 - protein, 9 aa, Homo Sapiens
PWVRLAAVM

SEQ ID NO: 37261 - protein, 9 aa, Homo Sapiens
KSEFILRVF

SEQ ID NO: 37262 - protein, 9 aa, Homo Sapiens
GCESCAELV

SEQ ID NO: 37263 - protein, 9 aa, Homo Sapiens
EMFIAGFLY

SEQ ID NO: 37264 - protein, 9 aa, Homo Sapiens
HGTGMVAAC

SEQ ID NO: 37265 - protein, 9 aa, Homo Sapiens
LSLSRCYHI

SEQ ID NO: 37266 - protein, 9 aa, Homo Sapiens
EPSRLCKSC

SEQ ID NO: 37267 - protein, 9 aa, Homo Sapiens
EKFEFWENF

SEQ ID NO: 37268 - protein, 9 aa, Homo Sapiens
DLFVMGAAL

SEQ ID NO: 37269 - protein, 9 aa, Homo Sapiens
IPRKLKTCS

SEQ ID NO: 37270 - protein, 9 aa, Homo Sapiens
NLQALEVSK

SEQ ID NO: 37271 - protein, 9 aa, Homo Sapiens
IECRLHTPM

SEQ ID NO: 37272 - protein, 9 aa, Homo Sapiens
QVLQELLSQ

SEQ ID NO: 37273 - protein, 9 aa, Homo Sapiens
GKARTQIIT

SEQ ID NO: 37274 - protein, 9 aa, Homo Sapiens
FQTRRVKDK

SEQ ID NO: 37275 - protein, 9 aa, Homo Sapiens
MVQVMEKAS

SEQ ID NO: 37276 - protein, 9 aa, Homo Sapiens
PVSHNPEGQ

SEQ ID NO: 37277 - protein, 9 aa, Homo Sapiens
ERWERQKKR

SEQ ID NO: 37278 - protein, 9 aa, Homo Sapiens
ISENDRAYS

SEQ ID NO: 37279 - protein, 9 aa, Homo Sapiens
STFGGRLGA

SEQ ID NO: 37280 - protein, 9 aa, Homo Sapiens
VTPLKLAGW

SEQ ID NO: 37281 - protein, 9 aa, Homo Sapiens
SAQMPFNAA

SEQ ID NO: 37282 - protein, 9 aa, Homo Sapiens
LADLPPAKP

SEQ ID NO: 37283 - protein, 9 aa, Homo Sapiens
NSQERYHGY

SEQ ID NO: 37284 - protein, 9 aa, Homo Sapiens
MQGFKSPFS

SEQ ID NO: 37285 - protein, 9 aa, Homo Sapiens
TKRRNHYLD

SEQ ID NO: 37286 - protein, 9 aa, Homo Sapiens
KQEKEIHMK

SEQ ID NO: 37287 - protein, 9 aa, Homo Sapiens
KHIALGTSK

SEQ ID NO: 37288 - protein, 9 aa, Homo Sapiens
SNPQPSHFE

SEQ ID NO: 37289 - protein, 9 aa, Homo Sapiens
LPGLYGSVI

SEQ ID NO: 37290 - protein, 9 aa, Homo Sapiens
NRDVLGDTQ

SEQ ID NO: 37291 - protein, 9 aa, Homo Sapiens
GGKHKDSVW

SEQ ID NO: 37292 - protein, 9 aa, Homo Sapiens
DHGSFALTP

SEQ ID NO: 37293 - protein, 9 aa, Homo Sapiens
SPHLGLGCL

SEQ ID NO: 37294 - protein, 9 aa, Homo Sapiens
MLMTRDLHL

SEQ ID NO: 37295 - protein, 9 aa, Homo Sapiens
DREENKHIA

SEQ ID NO: 37296 - protein, 9 aa, Homo Sapiens
TEDFPQKWP

SEQ ID NO: 37297 - protein, 9 aa, Homo Sapiens
QNEVNRQGF

SEQ ID NO: 37298 - protein, 9 aa, Homo Sapiens
HLSHARFVQ

SEQ ID NO: 37299 - protein, 9 aa, Homo Sapiens
GKNLQALEV

SEQ ID NO: 37300 - protein, 9 aa, Homo Sapiens
FDSIIKESL

SEQ ID NO: 37301 - protein, 9 aa, Homo Sapiens
HGYRGAFRC

SEQ ID NO: 37302 - protein, 9 aa, Homo Sapiens
MPRHIVVHP

SEQ ID NO: 37303 - protein, 9 aa, Homo Sapiens
GEPPVSHNP

SEQ ID NO: 37304 - protein, 9 aa, Homo Sapiens
DETEDDDLL

SEQ ID NO: 37305 - protein, 9 aa, Homo Sapiens
VRIAAVEHR

SEQ ID NO: 37306 - protein, 9 aa, Homo Sapiens
LNPGPKGLP

SEQ ID NO: 37307 - protein, 9 aa, Homo Sapiens
LQYDQQFLS

SEQ ID NO: 37308 - protein, 9 aa, Homo Sapiens
AQRWTVSIE

SEQ ID NO: 37309 - protein, 9 aa, Homo Sapiens
ALDNLLADL

SEQ ID NO: 37310 - protein, 9 aa, Homo Sapiens
LSSSTGPLS

SEQ ID NO: 37311 - protein, 9 aa, Homo Sapiens
LPHVETWHK

SEQ ID NO: 37312 - protein, 9 aa, Homo Sapiens
WDTLPCLWQ

SEQ ID NO: 37313 - protein, 9 aa, Homo Sapiens
VSAHIESLG

SEQ ID NO: 37314 - protein, 9 aa, Homo Sapiens
TRKKILKET

SEQ ID NO: 37315 - protein, 9 aa, Homo Sapiens
CMEQVSHGT

SEQ ID NO: 37316 - protein, 9 aa, Homo Sapiens
DWEYPERRQ

SEQ ID NO: 37317 - protein, 9 aa, Homo Sapiens
DLQDPDGIE

SEQ ID NO: 37318 - protein, 9 aa, Homo Sapiens
ERFHCQCPP

SEQ ID NO: 37319 - protein, 9 aa, Homo Sapiens
TDNRPGNPR

SEQ ID NO: 37320 - protein, 9 aa, Homo Sapiens
TEGGGRGCQ

SEQ ID NO: 37321 - protein, 9 aa, Homo Sapiens
AMVSQISMQ

SEQ ID NO: 37322 - protein, 9 aa, Homo Sapiens
QRWTVSIEV

SEQ ID NO: 37323 - protein, 9 aa, Homo Sapiens
NLEAERFHC

SEQ ID NO: 37324 - protein, 9 aa, Homo Sapiens
HWRSHNDVD

SEQ ID NO: 37325 - protein, 9 aa, Homo Sapiens
PEIGYCHGT

SEQ ID NO: 37326 - protein, 9 aa, Homo Sapiens
VTSVALKYD

SEQ ID NO: 37327 - protein, 9 aa, Homo Sapiens
HMKMIVTRG

SEQ ID NO: 37328 - protein, 9 aa, Homo Sapiens
QVVCHASAW

SEQ ID NO: 37329 - protein, 9 aa, Homo Sapiens
LIGQTHIDL

SEQ ID NO: 37330 - protein, 9 aa, Homo Sapiens
WGAELPSHR

SEQ ID NO: 37331 - protein, 9 aa, Homo Sapiens
RGCQAQVSR

SEQ ID NO: 37332 - protein, 9 aa, Homo Sapiens
YAQKFLQSS

SEQ ID NO: 37333 - protein, 9 aa, Homo Sapiens
AVMLTRCTM

SEQ ID NO: 37334 - protein, 9 aa, Homo Sapiens
QRSRLTGLQ

SEQ ID NO: 37335 - protein, 9 aa, Homo Sapiens
NKQNCSHLD

SEQ ID NO: 37336 - protein, 9 aa, Homo Sapiens
HSGYHYSHT

SEQ ID NO: 37337 - protein, 9 aa, Homo Sapiens
ELNDLPVFD

SEQ ID NO: 37338 - protein, 9 aa, Homo Sapiens
PFNAAPTPP

SEQ ID NO: 37339 - protein, 9 aa, Homo Sapiens
ALKYDHKFI

SEQ ID NO: 37340 - protein, 9 aa, Homo Sapiens
LEGERVCKS

SEQ ID NO: 37341 - protein, 9 aa, Homo Sapiens
MQLVSNVLI

SEQ ID NO: 37342 - protein, 9 aa, Homo Sapiens
IAVTPLKLA

SEQ ID NO: 37343 - protein, 9 aa, Homo Sapiens
ISGDTQFDD

SEQ ID NO: 37344 - protein, 9 aa, Homo Sapiens
EDEASGNQS

SEQ ID NO: 37345 - protein, 9 aa, Homo Sapiens
VMGYDRYSA

SEQ ID NO: 37346 - protein, 9 aa, Homo Sapiens
VEVLELNIK

SEQ ID NO: 37347 - protein, 9 aa, Homo Sapiens
GDGTNNGPA

SEQ ID NO: 37348 - protein, 9 aa, Homo Sapiens
LAGWQCPEC

SEQ ID NO: 37349 - protein, 9 aa, Homo Sapiens
VFHTKDLQD

SEQ ID NO: 37350 - protein, 9 aa, Homo Sapiens
KDCDKVFRS

SEQ ID NO: 37351 - protein, 9 aa, Homo Sapiens
NGVTPVVTL

SEQ ID NO: 37352 - protein, 9 aa, Homo Sapiens
NVSAHIESL

SEQ ID NO: 37353 - protein, 9 aa, Homo Sapiens
AVTPLKLAG

SEQ ID NO: 37354 - protein, 9 aa, Homo Sapiens
NGHEAPMRK

SEQ ID NO: 37355 - protein, 9 aa, Homo Sapiens
EVSREVWGK

SEQ ID NO: 37356 - protein, 9 aa, Homo Sapiens
MDAPSRKNR

SEQ ID NO: 37357 - protein, 9 aa, Homo Sapiens
NPWVRLAAV

SEQ ID NO: 37358 - protein, 9 aa, Homo Sapiens
PKGLPESLS

SEQ ID NO: 37359 - protein, 9 aa, Homo Sapiens
SGGQTRLQA

SEQ ID NO: 37360 - protein, 9 aa, Homo Sapiens
QKSEFILRV

SEQ ID NO: 37361 - protein, 9 aa, Homo Sapiens
KQNGNITHI

SEQ ID NO: 37362 - protein, 9 aa, Homo Sapiens
GKQNGNITH

SEQ ID NO: 37363 - protein, 9 aa, Homo Sapiens
LCKSCYSSL

SEQ ID NO: 37364 - protein, 9 aa, Homo Sapiens
QMPFNAAPT

SEQ ID NO: 37365 - protein, 9 aa, Homo Sapiens
LPCLWQEAL

SEQ ID NO: 37366 - protein, 9 aa, Homo Sapiens
PGKNLQALE

SEQ ID NO: 37367 - protein, 9 aa, Homo Sapiens
GLSEVTSVA

SEQ ID NO: 37368 - protein, 9 aa, Homo Sapiens
SVYGVEQKG

SEQ ID NO: 37369 - protein, 9 aa, Homo Sapiens
FITVTALFS

SEQ ID NO: 37370 - protein, 9 aa, Homo Sapiens
LSVFHTKDL

SEQ ID NO: 37371 - protein, 9 aa, Homo Sapiens
SYQYPVAEK

SEQ ID NO: 37372 - protein, 9 aa, Homo Sapiens
EEEEDEASG

SEQ ID NO: 37373 - protein, 9 aa, Homo Sapiens
TARNNSMCT

SEQ ID NO: 37374 - protein, 9 aa, Homo Sapiens
GKKNTEMFI

SEQ ID NO: 37375 - protein, 9 aa, Homo Sapiens
IGQTHIDLE

SEQ ID NO: 37376 - protein, 9 aa, Homo Sapiens
SGKSIQKLE

SEQ ID NO: 37377 - protein, 9 aa, Homo Sapiens
FNAAPTPPP

SEQ ID NO: 37378 - protein, 9 aa, Homo Sapiens
AWGAELPSH

SEQ ID NO: 37379 - protein, 9 aa, Homo Sapiens
AYSGDAQVD

SEQ ID NO: 37380 - protein, 9 aa, Homo Sapiens
QEEVIEAMG

SEQ ID NO: 37381 - protein, 9 aa, Homo Sapiens
LAAVMLTRC

SEQ ID NO: 37382 - protein, 9 aa, Homo Sapiens
LEDTRKKIL

SEQ ID NO: 37383 - protein, 9 aa, Homo Sapiens
PSVSVEPQA

SEQ ID NO: 37384 - protein, 9 aa, Homo Sapiens
MKEAIEEVK

SEQ ID NO: 37385 - protein, 9 aa, Homo Sapiens
EDTRKKILK

SEQ ID NO: 37386 - protein, 9 aa, Homo Sapiens
HRAICFNVS

SEQ ID NO: 37387 - protein, 9 aa, Homo Sapiens
LAIKDMKEA

SEQ ID NO: 37388 - protein, 9 aa, Homo Sapiens
SPGTAALGG

SEQ ID NO: 37389 - protein, 9 aa, Homo Sapiens
SGYHYSHTT

SEQ ID NO: 37390 - protein, 9 aa, Homo Sapiens
SSFTGESEP

SEQ ID NO: 37391 - protein, 9 aa, Homo Sapiens
KPTDGRQVV

SEQ ID NO: 37392 - protein, 9 aa, Homo Sapiens
GGGRGCQAQ

SEQ ID NO: 37393 - protein, 9 aa, Homo Sapiens
IQKLEKTKK

SEQ ID NO: 37394 - protein, 9 aa, Homo Sapiens
VSDLFVMGA

SEQ ID NO: 37395 - protein, 9 aa, Homo Sapiens
KEIHMKMIV

SEQ ID NO: 37396 - protein, 9 aa, Homo Sapiens
QLQYDQQFL

SEQ ID NO: 37397 - protein, 9 aa, Homo Sapiens
VSREVWGKA

SEQ ID NO: 37398 - protein, 9 aa, Homo Sapiens
DIESPWDSQ

SEQ ID NO: 37399 - protein, 9 aa, Homo Sapiens
HALPVSGRL

SEQ ID NO: 37400 - protein, 9 aa, Homo Sapiens
LDATVSGGQ

SEQ ID NO: 37401 - protein, 9 aa, Homo Sapiens
SENDRAYSG

SEQ ID NO: 37402 - protein, 9 aa, Homo Sapiens
QQLFEPSRL

SEQ ID NO: 37403 - protein, 9 aa, Homo Sapiens
GARFCWEGA

SEQ ID NO: 37404 - protein, 9 aa, Homo Sapiens
PRHIVVHPK

SEQ ID NO: 37405 - protein, 9 aa, Homo Sapiens
GAGEVGILS

SEQ ID NO: 37406 - protein, 9 aa, Homo Sapiens
IESPWDSQS

SEQ ID NO: 37407 - protein, 9 aa, Homo Sapiens
FHTKDLQDP

SEQ ID NO: 37408 - protein, 9 aa, Homo Sapiens
NLWDTLPCL

SEQ ID NO: 37409 - protein, 9 aa, Homo Sapiens
PKTEAASDT

SEQ ID NO: 37410 - protein, 9 aa, Homo Sapiens
LTLDNSCGK

SEQ ID NO: 37411 - protein, 9 aa, Homo Sapiens
TQADWEYPE

SEQ ID NO: 37412 - protein, 9 aa, Homo Sapiens
YHYSHTTPQ

SEQ ID NO: 37413 - protein, 9 aa, Homo Sapiens
SYKCKDCDK

SEQ ID NO: 37414 - protein, 9 aa, Homo Sapiens
PVFDSIIKE

SEQ ID NO: 37415 - protein, 9 aa, Homo Sapiens
ENRDVLGDT

SEQ ID NO: 37416 - protein, 9 aa, Homo Sapiens
MPFNAAPTP

SEQ ID NO: 37417 - protein, 9 aa, Homo Sapiens
TAALGGSSL

SEQ ID NO: 37418 - protein, 9 aa, Homo Sapiens
KHALPVSGR

SEQ ID NO: 37419 - protein, 9 aa, Homo Sapiens
IEHHFPDNK

SEQ ID NO: 37420 - protein, 9 aa, Homo Sapiens
NTDEDIEKN

SEQ ID NO: 37421 - protein, 9 aa, Homo Sapiens
NRPGNPREA

SEQ ID NO: 37422 - protein, 9 aa, Homo Sapiens
DMKEAIEEV

SEQ ID NO: 37423 - protein, 9 aa, Homo Sapiens
GQTHIDLEN

SEQ ID NO: 37424 - protein, 9 aa, Homo Sapiens
SFALTPRPQ

SEQ ID NO: 37425 - protein, 9 aa, Homo Sapiens
AHIQLAFFF

SEQ ID NO: 37426 - protein, 9 aa, Homo Sapiens
NTKRRNHYL

SEQ ID NO: 37427 - protein, 9 aa, Homo Sapiens
KVSKKTRMK

SEQ ID NO: 37428 - protein, 9 aa, Homo Sapiens
GFDDSVGSN

SEQ ID NO: 37429 - protein, 9 aa, Homo Sapiens
LSEVTSVAL

SEQ ID NO: 37430 - protein, 9 aa, Homo Sapiens
EGLLQKHRT

SEQ ID NO: 37431 - protein, 9 aa, Homo Sapiens
TMRVKHPKW

SEQ ID NO: 37432 - protein, 9 aa, Homo Sapiens
VHPKNRYLF

SEQ ID NO: 37433 - protein, 9 aa, Homo Sapiens
SRTDNRPGN

SEQ ID NO: 37434 - protein, 9 aa, Homo Sapiens
VGVKESDWF

SEQ ID NO: 37435 - protein, 9 aa, Homo Sapiens
SLSGKSIQK

SEQ ID NO: 37436 - protein, 9 aa, Homo Sapiens
VRRCPGGLP

SEQ ID NO: 37437 - protein, 9 aa, Homo Sapiens
QHLDQLQYD

SEQ ID NO: 37438 - protein, 9 aa, Homo Sapiens
KDMKEAIEE

SEQ ID NO: 37439 - protein, 9 aa, Homo Sapiens
GNSQERYHG

SEQ ID NO: 37440 - protein, 9 aa, Homo Sapiens
IIGTEDFPQ

SEQ ID NO: 37441 - protein, 9 aa, Homo Sapiens
LNGARFCWE

SEQ ID NO: 37442 - protein, 9 aa, Homo Sapiens
DCDKVFRSD

SEQ ID NO: 37443 - protein, 9 aa, Homo Sapiens
EEVIEAMGI

SEQ ID NO: 37444 - protein, 9 aa, Homo Sapiens
NLLADLPPA

SEQ ID NO: 37445 - protein, 9 aa, Homo Sapiens
GYHYSHTTP

SEQ ID NO: 37446 - protein, 9 aa, Homo Sapiens
ILPGLYGSV

SEQ ID NO: 37447 - protein, 9 aa, Homo Sapiens
IWFQTRRVK

SEQ ID NO: 37448 - protein, 9 aa, Homo Sapiens
MLLVHLPLS

SEQ ID NO: 37449 - protein, 9 aa, Homo Sapiens
CESCAELVA

SEQ ID NO: 37450 - protein, 9 aa, Homo Sapiens
VSVEPQAWV

SEQ ID NO: 37451 - protein, 9 aa, Homo Sapiens
VKQEKEIHM

SEQ ID NO: 37452 - protein, 9 aa, Homo Sapiens
HIALGTSKL

SEQ ID NO: 37453 - protein, 9 aa, Homo Sapiens
RSMDAPSRK

SEQ ID NO: 37454 - protein, 9 aa, Homo Sapiens
VCKSGDCRA

SEQ ID NO: 37455 - protein, 9 aa, Homo Sapiens
TSGCKVSKK

SEQ ID NO: 37456 - protein, 9 aa, Homo Sapiens
DEDIEKNLD

SEQ ID NO: 37457 - protein, 9 aa, Homo Sapiens
SKSMSGRHK

SEQ ID NO: 37458 - protein, 9 aa, Homo Sapiens
NDLPVFDSI

SEQ ID NO: 37459 - protein, 9 aa, Homo Sapiens
EFEEIMPGG

SEQ ID NO: 37460 - protein, 9 aa, Homo Sapiens
VNRQGFDIE

SEQ ID NO: 37461 - protein, 9 aa, Homo Sapiens
RHIVVHPKN

SEQ ID NO: 37462 - protein, 9 aa, Homo Sapiens
TPKHALPVS

SEQ ID NO: 37463 - protein, 9 aa, Homo Sapiens
EGEPPVSHN

SEQ ID NO: 37464 - protein, 9 aa, Homo Sapiens
MFIAGFLYV

SEQ ID NO: 37465 - protein, 9 aa, Homo Sapiens
SNDHGSFAL

SEQ ID NO: 37466 - protein, 9 aa, Homo Sapiens
CNRVRIAAV

SEQ ID NO: 37467 - protein, 9 aa, Homo Sapiens
PASPVKYCE

SEQ ID NO: 37468 - protein, 9 aa, Homo Sapiens
LEGEPPVSH

SEQ ID NO: 37469 - protein, 9 aa, Homo Sapiens
TLLPTARNN

SEQ ID NO: 37470 - protein, 9 aa, Homo Sapiens
PTDGRQVVC

SEQ ID NO: 37471 - protein, 9 aa, Homo Sapiens
RVRIAAVEH

SEQ ID NO: 37472 - protein, 9 aa, Homo Sapiens
NKHIALGTS

SEQ ID NO: 37473 - protein, 9 aa, Homo Sapiens
FEEIMPGGH

SEQ ID NO: 37474 - protein, 9 aa, Homo Sapiens
LCMEQVSHG

SEQ ID NO: 37475 - protein, 9 aa, Homo Sapiens
SPWDSQSIS

SEQ ID NO: 37476 - protein, 9 aa, Homo Sapiens
HKDSVWGSG

SEQ ID NO: 37477 - protein, 9 aa, Homo Sapiens
MCDIDILPG

SEQ ID NO: 37478 - protein, 9 aa, Homo Sapiens
EASGNQSDR

SEQ ID NO: 37479 - protein, 9 aa, Homo Sapiens
RFCWEGAQA

SEQ ID NO: 37480 - protein, 9 aa, Homo Sapiens
IQTSGCKVS

SEQ ID NO: 37481 - protein, 9 aa, Homo Sapiens
GVMGYDRYS

SEQ ID NO: 37482 - protein, 9 aa, Homo Sapiens
SDAISIIGT

SEQ ID NO: 37483 - protein, 9 aa, Homo Sapiens
NRQGFDIEA

SEQ ID NO: 37484 - protein, 9 aa, Homo Sapiens
PSRLCKSCY

SEQ ID NO: 37485 - protein, 9 aa, Homo Sapiens
GHEAPMRKI

SEQ ID NO: 37486 - protein, 9 aa, Homo Sapiens
VDENTKRRN

SEQ ID NO: 37487 - protein, 9 aa, Homo Sapiens
KLEKTKKAL

SEQ ID NO: 37488 - protein, 9 aa, Homo Sapiens
GMLCMEQVS

SEQ ID NO: 37489 - protein, 9 aa, Homo Sapiens
DSVGSNPQP

SEQ ID NO: 37490 - protein, 9 aa, Homo Sapiens
VTGDGTNNG

SEQ ID NO: 37491 - protein, 9 aa, Homo Sapiens
GCKVSKKTR

SEQ ID NO: 37492 - protein, 9 aa, Homo Sapiens
VSEPASPVK

SEQ ID NO: 37493 - protein, 9 aa, Homo Sapiens
LSRCYHIIP

SEQ ID NO: 37494 - protein, 9 aa, Homo Sapiens
LSGKSIQKL

SEQ ID NO: 37495 - protein, 9 aa, Homo Sapiens
VTIWFQTRR

SEQ ID NO: 37496 - protein, 9 aa, Homo Sapiens
SAICHPLHY

SEQ ID NO: 37497 - protein, 9 aa, Homo Sapiens
STGPLSSCH

SEQ ID NO: 37498 - protein, 9 aa, Homo Sapiens
EDAERWERQ

SEQ ID NO: 37499 - protein, 9 aa, Homo Sapiens
REIMEAMLK

SEQ ID NO: 37500 - protein, 9 aa, Homo Sapiens
SIIGTEDFP

SEQ ID NO: 37501 - protein, 9 aa, Homo Sapiens
PNSHEEPQI

SEQ ID NO: 37502 - protein, 9 aa, Homo Sapiens
PSRFQEKCA

SEQ ID NO: 37503 - protein, 9 aa, Homo Sapiens
VSEIINDLQ

SEQ ID NO: 37504 - protein, 9 aa, Homo Sapiens
AELPSHRTV

SEQ ID NO: 37505 - protein, 9 aa, Homo Sapiens
FNISAQMPF

SEQ ID NO: 37506 - protein, 9 aa, Homo Sapiens
LLADLPPAK

SEQ ID NO: 37507 - protein, 9 aa, Homo Sapiens
MEAMLKAYQ

SEQ ID NO: 37508 - protein, 9 aa, Homo Sapiens
HGSFALTPR

SEQ ID NO: 37509 - protein, 9 aa, Homo Sapiens
GEVSREVWG

SEQ ID NO: 37510 - protein, 9 aa, Homo Sapiens
YKCKDCDKV

SEQ ID NO: 37511 - protein, 9 aa, Homo Sapiens
GKTMRVKHP

SEQ ID NO: 37512 - protein, 9 aa, Homo Sapiens
CDIDILPGL

SEQ ID NO: 37513 - protein, 9 aa, Homo Sapiens
EAASDTQHP

SEQ ID NO: 37514 - protein, 9 aa, Homo Sapiens
GMCDIDILP

SEQ ID NO: 37515 - protein, 9 aa, Homo Sapiens
GAISFVHLF

SEQ ID NO: 37516 - protein, 9 aa, Homo Sapiens
ESLPNSHEE

SEQ ID NO: 37517 - protein, 9 aa, Homo Sapiens
QIEMLEREV

SEQ ID NO: 37518 - protein, 9 aa, Homo Sapiens
LWQEALDGL

SEQ ID NO: 37519 - protein, 9 aa, Homo Sapiens
DDSVGSNPQ

SEQ ID NO: 37520 - protein, 9 aa, Homo Sapiens
TPLEGEPPV

SEQ ID NO: 37521 - protein, 9 aa, Homo Sapiens
ILTLDNSCG

SEQ ID NO: 37522 - protein, 9 aa, Homo Sapiens
SQIEMLERE

SEQ ID NO: 37523 - protein, 9 aa, Homo Sapiens
WIFGCESCA

SEQ ID NO: 37524 - protein, 9 aa, Homo Sapiens
QSISENFPQ

SEQ ID NO: 37525 - protein, 9 aa, Homo Sapiens
VLQMVQVME

SEQ ID NO: 37526 - protein, 9 aa, Homo Sapiens
YSVLQMVQV

SEQ ID NO: 37527 - protein, 9 aa, Homo Sapiens
NGARFCWEG

SEQ ID NO: 37528 - protein, 9 aa, Homo Sapiens
GCQAQVSRR

SEQ ID NO: 37529 - protein, 9 aa, Homo Sapiens
HSHPTRVRR

SEQ ID NO: 37530 - protein, 9 aa, Homo Sapiens
PCLWQEALD

SEQ ID NO: 37531 - protein, 9 aa, Homo Sapiens
ECPGNTVTP

SEQ ID NO: 37532 - protein, 9 aa, Homo Sapiens
AAVMLTRCT

SEQ ID NO: 37533 - protein, 9 aa, Homo Sapiens
TVSGGQTRL

SEQ ID NO: 37534 - protein, 9 aa, Homo Sapiens
KHRTKRLGA

SEQ ID NO: 37535 - protein, 9 aa, Homo Sapiens
EFWENFEED

SEQ ID NO: 37536 - protein, 9 aa, Homo Sapiens
VIQYFATTA

SEQ ID NO: 37537 - protein, 9 aa, Homo Sapiens
SDDLIGQTH

SEQ ID NO: 37538 - protein, 9 aa, Homo Sapiens
LVLFLNGAR

SEQ ID NO: 37539 - protein, 9 aa, Homo Sapiens
DNLLADLPP

SEQ ID NO: 37540 - protein, 9 aa, Homo Sapiens
LKNGVTPVV

SEQ ID NO: 37541 - protein, 9 aa, Homo Sapiens
EEEDEASGN

SEQ ID NO: 37542 - protein, 9 aa, Homo Sapiens
RLAAVMLTR

SEQ ID NO: 37543 - protein, 9 aa, Homo Sapiens
GLLQKHRTK

SEQ ID NO: 37544 - protein, 9 aa, Homo Sapiens
NRVRIAAVE

SEQ ID NO: 37545 - protein, 9 aa, Homo Sapiens
PAAAAAAAI

SEQ ID NO: 37546 - protein, 9 aa, Homo Sapiens
DQFLLMQLV

SEQ ID NO: 37547 - protein, 9 aa, Homo Sapiens
SVLVCGALL

SEQ ID NO: 37548 - protein, 9 aa, Homo Sapiens
IKDDSHCLP

SEQ ID NO: 37549 - protein, 9 aa, Homo Sapiens
IEAMGIKET

SEQ ID NO: 37550 - protein, 9 aa, Homo Sapiens
SCINKQNCS

SEQ ID NO: 37551 - protein, 9 aa, Homo Sapiens
TASCINKQN

SEQ ID NO: 37552 - protein, 9 aa, Homo Sapiens
DTQHPAASE

SEQ ID NO: 37553 - protein, 9 aa, Homo Sapiens
LKNLPHVET

SEQ ID NO: 37554 - protein, 9 aa, Homo Sapiens
FILRVFSRK

SEQ ID NO: 37555 - protein, 9 aa, Homo Sapiens
YASLIEKYE

SEQ ID NO: 37556 - protein, 9 aa, Homo Sapiens
TNGCGLECP

SEQ ID NO: 37557 - protein, 9 aa, Homo Sapiens
QTHIDLENR

SEQ ID NO: 37558 - protein, 9 aa, Homo Sapiens
FWENFEEDH

SEQ ID NO: 37559 - protein, 9 aa, Homo Sapiens
HFLREIMEA

SEQ ID NO: 37560 - protein, 9 aa, Homo Sapiens
LFVMGAALV

SEQ ID NO: 37561 - protein, 9 aa, Homo Sapiens
RCLLDATVS

SEQ ID NO: 37562 - protein, 9 aa, Homo Sapiens
VTPVVTLYH

SEQ ID NO: 37563 - protein, 9 aa, Homo Sapiens
TEDDDLLET

SEQ ID NO: 37564 - protein, 9 aa, Homo Sapiens
SREVWGKAG

SEQ ID NO: 37565 - protein, 9 aa, Homo Sapiens
VSQISMQGF

SEQ ID NO: 37566 - protein, 9 aa, Homo Sapiens
YCVDENTKR

SEQ ID NO: 37567 - protein, 9 aa, Homo Sapiens
GKSIQKLEK

SEQ ID NO: 37568 - protein, 9 aa, Homo Sapiens
LARCHPRAP

SEQ ID NO: 37569 - protein, 9 aa, Homo Sapiens
DDGKTMRVK

SEQ ID NO: 37570 - protein, 9 aa, Homo Sapiens
EEEEEEDEA

SEQ ID NO: 37571 - protein, 9 aa, Homo Sapiens
GSWPDGMLC

SEQ ID NO: 37572 - protein, 9 aa, Homo Sapiens
ILRVFSRKH

SEQ ID NO: 37573 - protein, 9 aa, Homo Sapiens
QALEVSKVE

SEQ ID NO: 37574 - protein, 9 aa, Homo Sapiens
AQKFLQSSF

SEQ ID NO: 37575 - protein, 9 aa, Homo Sapiens
WEYPERRQS

SEQ ID NO: 37576 - protein, 9 aa, Homo Sapiens
LLSSSTGPL

SEQ ID NO: 37577 - protein, 9 aa, Homo Sapiens
FIAGFLYVA

SEQ ID NO: 37578 - protein, 9 aa, Homo Sapiens
QKHRTKRLG

SEQ ID NO: 37579 - protein, 9 aa, Homo Sapiens
DRYSAICHP

SEQ ID NO: 37580 - protein, 9 aa, Homo Sapiens
SGDTQFDDE

SEQ ID NO: 37581 - protein, 9 aa, Homo Sapiens
EIQTSGCKV

SEQ ID NO: 37582 - protein, 9 aa, Homo Sapiens
PLEGEPPVS

SEQ ID NO: 37583 - protein, 9 aa, Homo Sapiens
WDSQSISEN

SEQ ID NO: 37584 - protein, 9 aa, Homo Sapiens
AISIIGTED

SEQ ID NO: 37585 - protein, 9 aa, Homo Sapiens
LSKSMSGRH

SEQ ID NO: 37586 - protein, 9 aa, Homo Sapiens
WVRLAAVML

SEQ ID NO: 37587 - protein, 9 aa, Homo Sapiens
TRQFEKDNL

SEQ ID NO: 37588 - protein, 9 aa, Homo Sapiens
MERCLHRVS

SEQ ID NO: 37589 - protein, 9 aa, Homo Sapiens
GRGCQAQVS

SEQ ID NO: 37590 - protein, 9 aa, Homo Sapiens
LETEFRQYK

SEQ ID NO: 37591 - protein, 9 aa, Homo Sapiens
LATVLCSVL

SEQ ID NO: 37592 - protein, 9 aa, Homo Sapiens
WPDGMLCME

SEQ ID NO: 37593 - protein, 9 aa, Homo Sapiens
RIAAVEHRH

SEQ ID NO: 37594 - protein, 9 aa, Homo Sapiens
IKDMKEAIE

SEQ ID NO: 37595 - protein, 9 aa, Homo Sapiens
CGLLSSSTG

SEQ ID NO: 37596 - protein, 9 aa, Homo Sapiens
SVFHTKDLQ

SEQ ID NO: 37597 - protein, 9 aa, Homo Sapiens
SSSAIPRKL

SEQ ID NO: 37598 - protein, 9 aa, Homo Sapiens
KSPHLGLGC

SEQ ID NO: 37599 - protein, 9 aa, Homo Sapiens
KSSNDHGSF

SEQ ID NO: 37600 - protein, 9 aa, Homo Sapiens
ETEDDDLLE

SEQ ID NO: 37601 - protein, 9 aa, Homo Sapiens
HLSLSRCYH

SEQ ID NO: 37602 - protein, 9 aa, Homo Sapiens
GCGLECPGN

SEQ ID NO: 37603 - protein, 9 aa, Homo Sapiens
TEAASDTQH

SEQ ID NO: 37604 - protein, 9 aa, Homo Sapiens
APCQNLEAE

SEQ ID NO: 37605 - protein, 9 aa, Homo Sapiens
NISAQMPFN

SEQ ID NO: 37606 - protein, 9 aa, Homo Sapiens
RAYSGDAQV

SEQ ID NO: 37607 - protein, 9 aa, Homo Sapiens
SFTGESEPQ

SEQ ID NO: 37608 - protein, 9 aa, Homo Sapiens
LLSQIEMLE

SEQ ID NO: 37609 - protein, 9 aa, Homo Sapiens
RSHSRSASS

SEQ ID NO: 37610 - protein, 9 aa, Homo Sapiens
VVHPKNRYL

SEQ ID NO: 37611 - protein, 9 aa, Homo Sapiens
KGKKNTEMF

SEQ ID NO: 37612 - protein, 9 aa, Homo Sapiens
TQHPAASEG

SEQ ID NO: 37613 - protein, 9 aa, Homo Sapiens
EEIMPGGHK

SEQ ID NO: 37614 - protein, 9 aa, Homo Sapiens
NGCGLECPG

SEQ ID NO: 37615 - protein, 9 aa, Homo Sapiens
KDAASYRSV

SEQ ID NO: 37616 - protein, 9 aa, Homo Sapiens
CSQRSRLTG

SEQ ID NO: 37617 - protein, 9 aa, Homo Sapiens
PGTLLPTAR

SEQ ID NO: 37618 - protein, 9 aa, Homo Sapiens
RYHGYRGAF

SEQ ID NO: 37619 - protein, 9 aa, Homo Sapiens
VNTDEDIEK

SEQ ID NO: 37620 - protein, 9 aa, Homo Sapiens
AISFVHLFD

SEQ ID NO: 37621 - protein, 9 aa, Homo Sapiens
PDGMLCMEQ

SEQ ID NO: 37622 - protein, 9 aa, Homo Sapiens
IAAVEHRHS

SEQ ID NO: 37623 - protein, 9 aa, Homo Sapiens
SIQKLEKTK

SEQ ID NO: 37624 - protein, 9 aa, Homo Sapiens
KHKDSVWGS

SEQ ID NO: 37625 - protein, 9 aa, Homo Sapiens
IMPGGHKTK

SEQ ID NO: 37626 - protein, 9 aa, Homo Sapiens
LKTLQEEVI

SEQ ID NO: 37627 - protein, 9 aa, Homo Sapiens
LATAMEICV

SEQ ID NO: 37628 - protein, 9 aa, Homo Sapiens
DLHLSHARF

SEQ ID NO: 37629 - protein, 9 aa, Homo Sapiens
ENFEEDHGK

SEQ ID NO: 37630 - protein, 9 aa, Homo Sapiens
TAVTGEKKK

SEQ ID NO: 37631 - protein, 9 aa, Homo Sapiens
SSPAPSVSV

SEQ ID NO: 37632 - protein, 9 aa, Homo Sapiens
FLQSSFVAV

SEQ ID NO: 37633 - protein, 9 aa, Homo Sapiens
CYHIIPETL

SEQ ID NO: 37634 - protein, 9 aa, Homo Sapiens
HCLPQFQMT

SEQ ID NO: 37635 - protein, 9 aa, Homo Sapiens
CLLDATVSG

SEQ ID NO: 37636 - protein, 9 aa, Homo Sapiens
AEQLAQKGG

SEQ ID NO: 37637 - protein, 9 aa, Homo Sapiens
GKYILTLDN

SEQ ID NO: 37638 - protein, 9 aa, Homo Sapiens
IGTEDFPQK

SEQ ID NO: 37639 - protein, 9 aa, Homo Sapiens
SQISMQGFK

SEQ ID NO: 37640 - protein, 9 aa, Homo Sapiens
LWIFGCESC

SEQ ID NO: 37641 - protein, 9 aa, Homo Sapiens
LQSSFVAVT

SEQ ID NO: 37642 - protein, 9 aa, Homo Sapiens
IQYFATTAV

SEQ ID NO: 37643 - protein, 9 aa, Homo Sapiens
KARTQIITN

SEQ ID NO: 37644 - protein, 9 aa, Homo Sapiens
LYAQKFLQS

SEQ ID NO: 37645 - protein, 9 aa, Homo Sapiens
FVMGAALVL

SEQ ID NO: 37646 - protein, 9 aa, Homo Sapiens
ALEGERVCK

SEQ ID NO: 37647 - protein, 9 aa, Homo Sapiens
NNGPALKKA

SEQ ID NO: 37648 - protein, 9 aa, Homo Sapiens
AQKGGKKQI

SEQ ID NO: 37649 - protein, 9 aa, Homo Sapiens
WTVSIEVGV

SEQ ID NO: 37650 - protein, 9 aa, Homo Sapiens
MGAALVLES

SEQ ID NO: 37651 - protein, 9 aa, Homo Sapiens
GTEDFPQKW

SEQ ID NO: 37652 - protein, 9 aa, Homo Sapiens
ALGGSSLDS

SEQ ID NO: 37653 - protein, 9 aa, Homo Sapiens
HKLEAQLTE

SEQ ID NO: 37654 - protein, 9 aa, Homo Sapiens
AAAWGAELP

SEQ ID NO: 37655 - protein, 9 aa, Homo Sapiens
FLNGARFCW

SEQ ID NO: 37656 - protein, 9 aa, Homo Sapiens
DIAVTPLKL

SEQ ID NO: 37657 - protein, 9 aa, Homo Sapiens
VMEKASGKK

SEQ ID NO: 37658 - protein, 9 aa, Homo Sapiens
ITASCINKQ

SEQ ID NO: 37659 - protein, 9 aa, Homo Sapiens
SSTGPLSSC

SEQ ID NO: 37660 - protein, 9 aa, Homo Sapiens
VKESDWFQY

SEQ ID NO: 37661 - protein, 9 aa, Homo Sapiens
CFNVSAHIE

SEQ ID NO: 37662 - protein, 9 aa, Homo Sapiens
SEVNTDEDI

SEQ ID NO: 37663 - protein, 9 aa, Homo Sapiens
DMPRHIVVH

SEQ ID NO: 37664 - protein, 9 aa, Homo Sapiens
ASGNQSDRS

SEQ ID NO: 37665 - protein, 9 aa, Homo Sapiens
AVELVHEFL

SEQ ID NO: 37666 - protein, 9 aa, Homo Sapiens
CLWQEALDG

SEQ ID NO: 37667 - protein, 9 aa, Homo Sapiens
LMQLVSNVL

SEQ ID NO: 37668 - protein, 9 aa, Homo Sapiens
ADWEYPERR

SEQ ID NO: 37669 - protein, 9 aa, Homo Sapiens
ERQKKRKNP

SEQ ID NO: 37670 - protein, 9 aa, Homo Sapiens
QYPVAEKAE

SEQ ID NO: 37671 - protein, 9 aa, Homo Sapiens
VIHLKNLPH

SEQ ID NO: 37672 - protein, 9 aa, Homo Sapiens
KSIQKLEKT

SEQ ID NO: 37673 - protein, 9 aa, Homo Sapiens
HSRSASSNS

SEQ ID NO: 37674 - protein, 9 aa, Homo Sapiens
EHHFPDNKN

SEQ ID NO: 37675 - protein, 9 aa, Homo Sapiens
ALEVSKVEK

SEQ ID NO: 37676 - protein, 9 aa, Homo Sapiens
SGRHKLEAQ

SEQ ID NO: 37677 - protein, 9 aa, Homo Sapiens
LGDTQDFHS

SEQ ID NO: 37678 - protein, 9 aa, Homo Sapiens
HPISGDTQF

SEQ ID NO: 37679 - protein, 9 aa, Homo Sapiens
CINKQNCSH

SEQ ID NO: 37680 - protein, 9 aa, Homo Sapiens
LECPGNTVT

SEQ ID NO: 37681 - protein, 9 aa, Homo Sapiens
KEACSQRSR

SEQ ID NO: 37682 - protein, 9 aa, Homo Sapiens
YEKHPKTDS

SEQ ID NO: 37683 - protein, 9 aa, Homo Sapiens
YRSVYGVEQ

SEQ ID NO: 37684 - protein, 9 aa, Homo Sapiens
GQVVLATAM

SEQ ID NO: 37685 - protein, 9 aa, Homo Sapiens
KRRNHYLDL

SEQ ID NO: 37686 - protein, 9 aa, Homo Sapiens
QKGGKKQIQ

SEQ ID NO: 37687 - protein, 9 aa, Homo Sapiens
MSQKIETRQ

SEQ ID NO: 37688 - protein, 9 aa, Homo Sapiens
KKILKETLL

SEQ ID NO: 37689 - protein, 9 aa, Homo Sapiens
KSAVELVHE

SEQ ID NO: 37690 - protein, 9 aa, Homo Sapiens
ISIIGTEDF

SEQ ID NO: 37691 - protein, 9 aa, Homo Sapiens
VGSDDLIGQ

SEQ ID NO: 37692 - protein, 9 aa, Homo Sapiens
REENKHIAL

SEQ ID NO: 37693 - protein, 9 aa, Homo Sapiens
MSKGGKHKD

SEQ ID NO: 37694 - protein, 9 aa, Homo Sapiens
DDSHCLPQF

SEQ ID NO: 37695 - protein, 9 aa, Homo Sapiens
SQRSRLTGL

SEQ ID NO: 37696 - protein, 9 aa, Homo Sapiens
QLAFFFFSV

SEQ ID NO: 37697 - protein, 9 aa, Homo Sapiens
CPGNTVTPV

SEQ ID NO: 37698 - protein, 9 aa, Homo Sapiens
HIQLAFFFF

SEQ ID NO: 37699 - protein, 9 aa, Homo Sapiens
HPALFIEHH

SEQ ID NO: 37700 - protein, 9 aa, Homo Sapiens
MRKIKKLMG

SEQ ID NO: 37701 - protein, 9 aa, Homo Sapiens
HIPEYGDTC

SEQ ID NO: 37702 - protein, 9 aa, Homo Sapiens
LQEEVIEAM

SEQ ID NO: 37703 - protein, 9 aa, Homo Sapiens
LCNRVRIAA

SEQ ID NO: 37704 - protein, 9 aa, Homo Sapiens
NGPALKKAD

SEQ ID NO: 37705 - protein, 9 aa, Homo Sapiens
VVTLYHFDL

SEQ ID NO: 37706 - protein, 9 aa, Homo Sapiens
ISAQMPFNA

SEQ ID NO: 37707 - protein, 9 aa, Homo Sapiens
LAQKGGKKQ

SEQ ID NO: 37708 - protein, 9 aa, Homo Sapiens
GNPREAKGR

SEQ ID NO: 37709 - protein, 9 aa, Homo Sapiens
EPPVSHNPE

SEQ ID NO: 37710 - protein, 9 aa, Homo Sapiens
ARCHPRAPA

SEQ ID NO: 37711 - protein, 9 aa, Homo Sapiens
FIEHHFPDN

SEQ ID NO: 37712 - protein, 9 aa, Homo Sapiens
HLKNLPHVE

SEQ ID NO: 37713 - protein, 9 aa, Homo Sapiens
PHVETWHKD

SEQ ID NO: 37714 - protein, 9 aa, Homo Sapiens
DAERWERQK

SEQ ID NO: 37715 - protein, 9 aa, Homo Sapiens
ETRQFEKDN

SEQ ID NO: 37716 - protein, 9 aa, Homo Sapiens
LQKHRTKRL

SEQ ID NO: 37717 - protein, 9 aa, Homo Sapiens
EKTFITVTA

SEQ ID NO: 37718 - protein, 9 aa, Homo Sapiens
CKVDNSSFT

SEQ ID NO: 37719 - protein, 9 aa, Homo Sapiens
LGEEFEEIM

SEQ ID NO: 37720 - protein, 9 aa, Homo Sapiens
GRLGAGEVG

SEQ ID NO: 37721 - protein, 9 aa, Homo Sapiens
LQALEVSKV

SEQ ID NO: 37722 - protein, 9 aa, Homo Sapiens
SEFILRVFS

SEQ ID NO: 37723 - protein, 9 aa, Homo Sapiens
VQVMEKASG

SEQ ID NO: 37724 - protein, 9 aa, Homo Sapiens
FSEEAESLP

SEQ ID NO: 37725 - protein, 9 aa, Homo Sapiens
ENDRAYSGD

SEQ ID NO: 37726 - protein, 9 aa, Homo Sapiens
GGRLGAGEV

SEQ ID NO: 37727 - protein, 9 aa, Homo Sapiens
VAQRWTVSI

SEQ ID NO: 37728 - protein, 9 aa, Homo Sapiens
LDEKTVEVL

SEQ ID NO: 37729 - protein, 9 aa, Homo Sapiens
AVTGDGTNN

SEQ ID NO: 37730 - protein, 9 aa, Homo Sapiens
GSDDLIGQT

SEQ ID NO: 37731 - protein, 9 aa, Homo Sapiens
LILATVLCS

SEQ ID NO: 37732 - protein, 9 aa, Homo Sapiens
DQLQYDQQF

SEQ ID NO: 37733 - protein, 9 aa, Homo Sapiens
HSRTDNRPG

SEQ ID NO: 37734 - protein, 9 aa, Homo Sapiens
RDRTHVSEI

SEQ ID NO: 37735 - protein, 9 aa, Homo Sapiens
GYCHGTGMV

SEQ ID NO: 37736 - protein, 9 aa, Homo Sapiens
MPGGHKTKS

SEQ ID NO: 37737 - protein, 9 aa, Homo Sapiens
VSHNPEGQQ

SEQ ID NO: 37738 - protein, 9 aa, Homo Sapiens
IGYCHGTGM

SEQ ID NO: 37739 - protein, 9 aa, Homo Sapiens
ERVCKSGDC

SEQ ID NO: 37740 - protein, 9 aa, Homo Sapiens
VLATAMEIC

SEQ ID NO: 37741 - protein, 9 aa, Homo Sapiens
RWERQKKRK

SEQ ID NO: 37742 - protein, 9 aa, Homo Sapiens
EGGGRGCQA

SEQ ID NO: 37743 - protein, 9 aa, Homo Sapiens
DWFQYRDLA

SEQ ID NO: 37744 - protein, 9 aa, Homo Sapiens
ALPVSGRLP

SEQ ID NO: 37745 - protein, 9 aa, Homo Sapiens
GTQADWEYP

SEQ ID NO: 37746 - protein, 9 aa, Homo Sapiens
SERRDRTHV

SEQ ID NO: 37747 - protein, 9 aa, Homo Sapiens
ESDWFQYRD

SEQ ID NO: 37748 - protein, 9 aa, Homo Sapiens
KESDWFQYR

SEQ ID NO: 37749 - protein, 9 aa, Homo Sapiens
PGSHMAPVS

SEQ ID NO: 37750 - protein, 9 aa, Homo Sapiens
WRSHNDVDE

SEQ ID NO: 37751 - protein, 9 aa, Homo Sapiens
EKTVEVLEL

SEQ ID NO: 37752 - protein, 9 aa, Homo Sapiens
SLSPGTAAL

SEQ ID NO: 37753 - protein, 9 aa, Homo Sapiens
RTHVSEIIN

SEQ ID NO: 37754 - protein, 9 aa, Homo Sapiens
PGPKGLPES

SEQ ID NO: 37755 - protein, 9 aa, Homo Sapiens
LKETLLQLD

SEQ ID NO: 37756 - protein, 9 aa, Homo Sapiens
VLGDTQDFH

SEQ ID NO: 37757 - protein, 9 aa, Homo Sapiens
ATVWIECRL

SEQ ID NO: 37758 - protein, 9 aa, Homo Sapiens
STEGGGRGC

SEQ ID NO: 37759 - protein, 9 aa, Homo Sapiens
LGGSSLDSP

SEQ ID NO: 37760 - protein, 9 aa, Homo Sapiens
VSGRLPPCA

SEQ ID NO: 37761 - protein, 9 aa, Homo Sapiens
IGMCDIDIL

SEQ ID NO: 37762 - protein, 9 aa, Homo Sapiens
GEEFEEIMP

SEQ ID NO: 37763 - protein, 9 aa, Homo Sapiens
ESCAELVAE

SEQ ID NO: 37764 - protein, 9 aa, Homo Sapiens
EHPISGDTQ

SEQ ID NO: 37765 - protein, 9 aa, Homo Sapiens
RSRLTGLQD

SEQ ID NO: 37766 - protein, 9 aa, Homo Sapiens
KIETRQFEK

SEQ ID NO: 37767 - protein, 9 aa, Homo Sapiens
QYDQQFLSC

SEQ ID NO: 37768 - protein, 9 aa, Homo Sapiens
RVCKSGDCR

SEQ ID NO: 37769 - protein, 9 aa, Homo Sapiens
PITASCINK

SEQ ID NO: 37770 - protein, 9 aa, Homo Sapiens
APSVSVEPQ

SEQ ID NO: 37771 - protein, 9 aa, Homo Sapiens
DILPGLYGS

SEQ ID NO: 37772 - protein, 9 aa, Homo Sapiens
VRLAAVMLT

SEQ ID NO: 37773 - protein, 9 aa, Homo Sapiens
DTQFDDEET

SEQ ID NO: 37774 - protein, 9 aa, Homo Sapiens
EIKDDSHCL

SEQ ID NO: 37775 - protein, 9 aa, Homo Sapiens
GMGTPGSHM

SEQ ID NO: 37776 - protein, 9 aa, Homo Sapiens
KDVSVSDQM

SEQ ID NO: 37777 - protein, 9 aa, Homo Sapiens
LLHYKKDVS

SEQ ID NO: 37778 - protein, 9 aa, Homo Sapiens
QSMRSGAGV

SEQ ID NO: 37779 - protein, 9 aa, Homo Sapiens
PKINILHIQ

SEQ ID NO: 37780 - protein, 9 aa, Homo Sapiens
MLLNKKYGS

SEQ ID NO: 37781 - protein, 9 aa, Homo Sapiens
PYILDVLPD

SEQ ID NO: 37782 - protein, 9 aa, Homo Sapiens
KLSLPESLK

SEQ ID NO: 37783 - protein, 9 aa, Homo Sapiens
TNWSIDIKK

SEQ ID NO: 37784 - protein, 9 aa, Homo Sapiens
DRDRGHRDL

SEQ ID NO: 37785 - protein, 9 aa, Homo Sapiens
IITSQTLLL

SEQ ID NO: 37786 - protein, 9 aa, Homo Sapiens
FEDPTDSDF

SEQ ID NO: 37787 - protein, 9 aa, Homo Sapiens
LHYKKDVSV

SEQ ID NO: 37788 - protein, 9 aa, Homo Sapiens
WSKPLPLSE

SEQ ID NO: 37789 - protein, 9 aa, Homo Sapiens
KILCATYVK

SEQ ID NO: 37790 - protein, 9 aa, Homo Sapiens
KVCISQLTR

SEQ ID NO: 37791 - protein, 9 aa, Homo Sapiens
VCWIYYPNG

SEQ ID NO: 37792 - protein, 9 aa, Homo Sapiens
IMKLSLPES

SEQ ID NO: 37793 - protein, 9 aa, Homo Sapiens
MQDMVEDYW

SEQ ID NO: 37794 - protein, 9 aa, Homo Sapiens
AIDRVAPRA

SEQ ID NO: 37795 - protein, 9 aa, Homo Sapiens
CWIYYPNGG

SEQ ID NO: 37796 - protein, 9 aa, Homo Sapiens
LDRCSQEPR

SEQ ID NO: 37797 - protein, 9 aa, Homo Sapiens
RVLHDWAHG

SEQ ID NO: 37798 - protein, 9 aa, Homo Sapiens
HRDLPSSRD

SEQ ID NO: 37799 - protein, 9 aa, Homo Sapiens
WNKYEDEIN

SEQ ID NO: 37800 - protein, 9 aa, Homo Sapiens
CTNWSIDIK

SEQ ID NO: 37801 - protein, 9 aa, Homo Sapiens
YILDVLPDT

SEQ ID NO: 37802 - protein, 9 aa, Homo Sapiens
LTGKKGQQK

SEQ ID NO: 37803 - protein, 9 aa, Homo Sapiens
HYKKDVSVS

SEQ ID NO: 37804 - protein, 9 aa, Homo Sapiens
KEIESLKVC

SEQ ID NO: 37805 - protein, 9 aa, Homo Sapiens
PPYILDVLP

SEQ ID NO: 37806 - protein, 9 aa, Homo Sapiens
MRSGAGVQA

SEQ ID NO: 37807 - protein, 9 aa, Homo Sapiens
ARVLHDWAH

SEQ ID NO: 37808 - protein, 9 aa, Homo Sapiens
TGANPYHCN

SEQ ID NO: 37809 - protein, 9 aa, Homo Sapiens
CQQLTYHLS

SEQ ID NO: 37810 - protein, 9 aa, Homo Sapiens
DTVLPIKKR

SEQ ID NO: 37811 - protein, 9 aa, Homo Sapiens
FHKLKSPSQ

SEQ ID NO: 37812 - protein, 9 aa, Homo Sapiens
DDWSKPLPL

SEQ ID NO: 37813 - protein, 9 aa, Homo Sapiens
NWSIDIKKY

SEQ ID NO: 37814 - protein, 9 aa, Homo Sapiens
ESSIRSVQD

SEQ ID NO: 37815 - protein, 9 aa, Homo Sapiens
DFHKLKSPS

SEQ ID NO: 37816 - protein, 9 aa, Homo Sapiens
ILDVLPDTY

SEQ ID NO: 37817 - protein, 9 aa, Homo Sapiens
YYYYTNTPQ

SEQ ID NO: 37818 - protein, 9 aa, Homo Sapiens
EAQTRELSN

SEQ ID NO: 37819 - protein, 9 aa, Homo Sapiens
QDMVEDYWN

SEQ ID NO: 37820 - protein, 9 aa, Homo Sapiens
KTTQSMRSG

SEQ ID NO: 37821 - protein, 9 aa, Homo Sapiens
PCDTMKVAG

SEQ ID NO: 37822 - protein, 9 aa, Homo Sapiens
ADGCTNWSI

SEQ ID NO: 37823 - protein, 9 aa, Homo Sapiens
AMEKLCQQL

SEQ ID NO: 37824 - protein, 9 aa, Homo Sapiens
LCATYVKVN

SEQ ID NO: 37825 - protein, 9 aa, Homo Sapiens
RLLYMAIDR

SEQ ID NO: 37826 - protein, 9 aa, Homo Sapiens
LREKIMKLS

SEQ ID NO: 37827 - protein, 9 aa, Homo Sapiens
YWNKYEDEI

SEQ ID NO: 37828 - protein, 9 aa, Homo Sapiens
KPLPLSERL

SEQ ID NO: 37829 - protein, 9 aa, Homo Sapiens
NVNWKKKKS

SEQ ID NO: 37830 - protein, 9 aa, Homo Sapiens
DVLPDTYQH

SEQ ID NO: 37831 - protein, 9 aa, Homo Sapiens
VAGNLDSKG

SEQ ID NO: 37832 - protein, 9 aa, Homo Sapiens
YYTNTPQVW

SEQ ID NO: 37833 - protein, 9 aa, Homo Sapiens
VPPRQPWTL

SEQ ID NO: 37834 - protein, 9 aa, Homo Sapiens
KVNIRDIDK

SEQ ID NO: 37835 - protein, 9 aa, Homo Sapiens
CISQLTRQV

SEQ ID NO: 37836 - protein, 9 aa, Homo Sapiens
RELSNQVRS

SEQ ID NO: 37837 - protein, 9 aa, Homo Sapiens
RNWKQYRQE

SEQ ID NO: 37838 - protein, 9 aa, Homo Sapiens
INILHIQTS

SEQ ID NO: 37839 - protein, 9 aa, Homo Sapiens
SNVNWKKKK

SEQ ID NO: 37840 - protein, 9 aa, Homo Sapiens
LVIHTGANP

SEQ ID NO: 37841 - protein, 9 aa, Homo Sapiens
DWSKPLPLS

SEQ ID NO: 37842 - protein, 9 aa, Homo Sapiens
VKVNIRDID

SEQ ID NO: 37843 - protein, 9 aa, Homo Sapiens
EDYWNKYED

SEQ ID NO: 37844 - protein, 9 aa, Homo Sapiens
GCTNWSIDI

SEQ ID NO: 37845 - protein, 9 aa, Homo Sapiens
AHMLLNKKY

SEQ ID NO: 37846 - protein, 9 aa, Homo Sapiens
HDWAHGKCS

SEQ ID NO: 37847 - protein, 9 aa, Homo Sapiens
MEPRFCEDH

SEQ ID NO: 37848 - protein, 9 aa, Homo Sapiens
KINILHIQT

SEQ ID NO: 37849 - protein, 9 aa, Homo Sapiens
AILDRCSQE

SEQ ID NO: 37850 - protein, 9 aa, Homo Sapiens
KIMKLSLPE

SEQ ID NO: 37851 - protein, 9 aa, Homo Sapiens
QEESIWGFP

SEQ ID NO: 37852 - protein, 9 aa, Homo Sapiens
IPPRMCAAP

SEQ ID NO: 37853 - protein, 9 aa, Homo Sapiens
LGSVAHMLL

SEQ ID NO: 37854 - protein, 9 aa, Homo Sapiens
LDRDRGHRD

SEQ ID NO: 37855 - protein, 9 aa, Homo Sapiens
CSQEPRWTC

SEQ ID NO: 37856 - protein, 9 aa, Homo Sapiens
LHIQTSGYI

SEQ ID NO: 37857 - protein, 9 aa, Homo Sapiens
GRNWKQYRQ

SEQ ID NO: 37858 - protein, 9 aa, Homo Sapiens
LSNQVRSGV

SEQ ID NO: 37859 - protein, 9 aa, Homo Sapiens
LSLPESLKA

SEQ ID NO: 37860 - protein, 9 aa, Homo Sapiens
DWAHGKCSH

SEQ ID NO: 37861 - protein, 9 aa, Homo Sapiens
GLGSVAHML

SEQ ID NO: 37862 - protein, 9 aa, Homo Sapiens
RVAPRAKMN

SEQ ID NO: 37863 - protein, 9 aa, Homo Sapiens
SSNVNWKKK

SEQ ID NO: 37864 - protein, 9 aa, Homo Sapiens
VVIPPRMCA

SEQ ID NO: 37865 - protein, 9 aa, Homo Sapiens
PPRMCAAPT

SEQ ID NO: 37866 - protein, 9 aa, Homo Sapiens
MCAAPTRIT

SEQ ID NO: 37867 - protein, 9 aa, Homo Sapiens
YRQEESIWG

SEQ ID NO: 37868 - protein, 9 aa, Homo Sapiens
YPNGGSLVG

SEQ ID NO: 37869 - protein, 9 aa, Homo Sapiens
SLTGKKGQQ

SEQ ID NO: 37870 - protein, 9 aa, Homo Sapiens
TMKVAGNLD

SEQ ID NO: 37871 - protein, 9 aa, Homo Sapiens
PHIHKSLTG

SEQ ID NO: 37872 - protein, 9 aa, Homo Sapiens
REKIMKLSL

SEQ ID NO: 37873 - protein, 9 aa, Homo Sapiens
LHDWAHGKC

SEQ ID NO: 37874 - protein, 9 aa, Homo Sapiens
QEPRWTCYD

SEQ ID NO: 37875 - protein, 9 aa, Homo Sapiens
SLKVCISQL

SEQ ID NO: 37876 - protein, 9 aa, Homo Sapiens
SVAHMLLNK

SEQ ID NO: 37877 - protein, 9 aa, Homo Sapiens
QTCSPKSYE

SEQ ID NO: 37878 - protein, 9 aa, Homo Sapiens
QQLTYHLSP

SEQ ID NO: 37879 - protein, 9 aa, Homo Sapiens
VCISQLTRQ

SEQ ID NO: 37880 - protein, 9 aa, Homo Sapiens
SPKSYENDL

SEQ ID NO: 37881 - protein, 9 aa, Homo Sapiens
SPPYILDVL

SEQ ID NO: 37882 - protein, 9 aa, Homo Sapiens
GSADGCTNW

SEQ ID NO: 37883 - protein, 9 aa, Homo Sapiens
ESSNVNWKK

SEQ ID NO: 37884 - protein, 9 aa, Homo Sapiens
LKVCISQLT

SEQ ID NO: 37885 - protein, 9 aa, Homo Sapiens
DYWNKYEDE

SEQ ID NO: 37886 - protein, 9 aa, Homo Sapiens
SVESSNVNW

SEQ ID NO: 37887 - protein, 9 aa, Homo Sapiens
PKTTQSMRS

SEQ ID NO: 37888 - protein, 9 aa, Homo Sapiens
KHLVIHTGA

SEQ ID NO: 37889 - protein, 9 aa, Homo Sapiens
CEDHPFLFF

SEQ ID NO: 37890 - protein, 9 aa, Homo Sapiens
VEDYWNKYE

SEQ ID NO: 37891 - protein, 9 aa, Homo Sapiens
VLPDTYQHL

SEQ ID NO: 37892 - protein, 9 aa, Homo Sapiens
TNTPQVWSH

SEQ ID NO: 37893 - protein, 9 aa, Homo Sapiens
PRFCEDHPF

SEQ ID NO: 37894 - protein, 9 aa, Homo Sapiens
RGHRDLPSS

SEQ ID NO: 37895 - protein, 9 aa, Homo Sapiens
IESLKVCIS

SEQ ID NO: 37896 - protein, 9 aa, Homo Sapiens
IRSVQDTVL

SEQ ID NO: 37897 - protein, 9 aa, Homo Sapiens
ESLKVCISQ

SEQ ID NO: 37898 - protein, 9 aa, Homo Sapiens
FCEDHPFLF

SEQ ID NO: 37899 - protein, 9 aa, Homo Sapiens
GHRDLPSSR

SEQ ID NO: 37900 - protein, 9 aa, Homo Sapiens
DSDFHKLKS

SEQ ID NO: 37901 - protein, 9 aa, Homo Sapiens
ETPMVPPRQ

SEQ ID NO: 37902 - protein, 9 aa, Homo Sapiens
SYENDLPRK

SEQ ID NO: 37903 - protein, 9 aa, Homo Sapiens
WSLDRDRGH

SEQ ID NO: 37904 - protein, 9 aa, Homo Sapiens
AVQTCSPKS

SEQ ID NO: 37905 - protein, 9 aa, Homo Sapiens
RVVIPPRMC

SEQ ID NO: 37906 - protein, 9 aa, Homo Sapiens
ILHIQTSGY

SEQ ID NO: 37907 - protein, 9 aa, Homo Sapiens
RSGAGVQAA

SEQ ID NO: 37908 - protein, 9 aa, Homo Sapiens
KKDVSVSDQ

SEQ ID NO: 37909 - protein, 9 aa, Homo Sapiens
LCQQLTYHL

SEQ ID NO: 37910 - protein, 9 aa, Homo Sapiens
MKLSLPESL

SEQ ID NO: 37911 - protein, 9 aa, Homo Sapiens
RFCEDHPFL

SEQ ID NO: 37912 - protein, 9 aa, Homo Sapiens
TRELSNQVR

SEQ ID NO: 37913 - protein, 9 aa, Homo Sapiens
QVWSHPSDP

SEQ ID NO: 37914 - protein, 9 aa, Homo Sapiens
IQTSGYIVY

SEQ ID NO: 37915 - protein, 9 aa, Homo Sapiens
PSLCIITSQ

SEQ ID NO: 37916 - protein, 9 aa, Homo Sapiens
VIPPRMCAA

SEQ ID NO: 37917 - protein, 9 aa, Homo Sapiens
LGAMEKLCQ

SEQ ID NO: 37918 - protein, 9 aa, Homo Sapiens
LSVESSNVN

SEQ ID NO: 37919 - protein, 9 aa, Homo Sapiens
LLNKKYGSY

SEQ ID NO: 37920 - protein, 9 aa, Homo Sapiens
WIYYPNGGS

SEQ ID NO: 37921 - protein, 9 aa, Homo Sapiens
RDRGHRDLP

SEQ ID NO: 37922 - protein, 9 aa, Homo Sapiens
VESSNVNWK

SEQ ID NO: 37923 - protein, 9 aa, Homo Sapiens
PLPLSERLE

SEQ ID NO: 37924 - protein, 9 aa, Homo Sapiens
DPTDSDFHK

SEQ ID NO: 37925 - protein, 9 aa, Homo Sapiens
GAMEKLCQQ

SEQ ID NO: 37926 - protein, 9 aa, Homo Sapiens
EKLCQQLTY

SEQ ID NO: 37927 - protein, 9 aa, Homo Sapiens
DTMKVAGNL

SEQ ID NO: 37928 - protein, 9 aa, Homo Sapiens
TTQSMRSGA

SEQ ID NO: 37929 - protein, 9 aa, Homo Sapiens
SGAGVQAAH

SEQ ID NO: 37930 - protein, 9 aa, Homo Sapiens
IYYPNGGSL

SEQ ID NO: 37931 - protein, 9 aa, Homo Sapiens
IPKINILHI

SEQ ID NO: 37932 - protein, 9 aa, Homo Sapiens
SLPESLKAY

SEQ ID NO: 37933 - protein, 9 aa, Homo Sapiens
TQSMRSGAG

SEQ ID NO: 37934 - protein, 9 aa, Homo Sapiens
EDHPFLFFI

SEQ ID NO: 37935 - protein, 9 aa, Homo Sapiens
DGCTNWSID

SEQ ID NO: 37936 - protein, 9 aa, Homo Sapiens
ITSQTLLLV

SEQ ID NO: 37937 - protein, 9 aa, Homo Sapiens
YMAIDRVAP

SEQ ID NO: 37938 - protein, 9 aa, Homo Sapiens
YYYTNTPQV

SEQ ID NO: 37939 - protein, 9 aa, Homo Sapiens
CDTMKVAGN

SEQ ID NO: 37940 - protein, 9 aa, Homo Sapiens
WAHGKCSHL

SEQ ID NO: 37941 - protein, 9 aa, Homo Sapiens
SMRSGAGVQ

SEQ ID NO: 37942 - protein, 9 aa, Homo Sapiens
SQEPRWTCY

SEQ ID NO: 37943 - protein, 9 aa, Homo Sapiens
RCSQEPRWT

SEQ ID NO: 37944 - protein, 9 aa, Homo Sapiens
IHKSLTGKK

SEQ ID NO: 37945 - protein, 9 aa, Homo Sapiens
SSIRSVQDT

SEQ ID NO: 37946 - protein, 9 aa, Homo Sapiens
GYLSVESSN

SEQ ID NO: 37947 - protein, 9 aa, Homo Sapiens
DMVEDYWNK

SEQ ID NO: 37948 - protein, 9 aa, Homo Sapiens
PQVWSHPSD

SEQ ID NO: 37949 - protein, 9 aa, Homo Sapiens
GANPYHCNE

SEQ ID NO: 37950 - protein, 9 aa, Homo Sapiens
TPQVWSHPS

SEQ ID NO: 37951 - protein, 9 aa, Homo Sapiens
SNQVRSGVY

SEQ ID NO: 37952 - protein, 9 aa, Homo Sapiens
HIQTSGYIV

SEQ ID NO: 37953 - protein, 9 aa, Homo Sapiens
VQDTVLPIK

SEQ ID NO: 37954 - protein, 9 aa, Homo Sapiens
GVCWIYYPN

SEQ ID NO: 37955 - protein, 9 aa, Homo Sapiens
RSVQDTVLP

SEQ ID NO: 37956 - protein, 9 aa, Homo Sapiens
DRVAPRAKM

SEQ ID NO: 37957 - protein, 9 aa, Homo Sapiens
PLSERLEQE

SEQ ID NO: 37958 - protein, 9 aa, Homo Sapiens
WKQYRQEES

SEQ ID NO: 37959 - protein, 9 aa, Homo Sapiens
NQVRSGVYA

SEQ ID NO: 37960 - protein, 9 aa, Homo Sapiens
TYVKVNIRD

SEQ ID NO: 37961 - protein, 9 aa, Homo Sapiens
PTDSDFHKL

SEQ ID NO: 37962 - protein, 9 aa, Homo Sapiens
ANPYHCNEF

SEQ ID NO: 37963 - protein, 9 aa, Homo Sapiens
VQTCSPKSY

SEQ ID NO: 37964 - protein, 9 aa, Homo Sapiens
PPRQPWTLV

SEQ ID NO: 37965 - protein, 9 aa, Homo Sapiens
YYPNGGSLV

SEQ ID NO: 37966 - protein, 9 aa, Homo Sapiens
SLDRDRGHR

SEQ ID NO: 37967 - protein, 9 aa, Homo Sapiens
CIITSQTLL

SEQ ID NO: 37968 - protein, 9 aa, Homo Sapiens
HIHKSLTGK

SEQ ID NO: 37969 - protein, 9 aa, Homo Sapiens
MKVAGNLDS

SEQ ID NO: 37970 - protein, 9 aa, Homo Sapiens
HTGANPYHC

SEQ ID NO: 37971 - protein, 9 aa, Homo Sapiens
FFLLHYKKD

SEQ ID NO: 37972 - protein, 9 aa, Homo Sapiens
ELSNQVRSG

SEQ ID NO: 37973 - protein, 9 aa, Homo Sapiens
TPMVPPRQP

SEQ ID NO: 37974 - protein, 9 aa, Homo Sapiens
QDTVLPIKK

SEQ ID NO: 37975 - protein, 9 aa, Homo Sapiens
IDRVAPRAK

SEQ ID NO: 37976 - protein, 9 aa, Homo Sapiens
NILHIQTSG

SEQ ID NO: 37977 - protein, 9 aa, Homo Sapiens
AGNLDSKGY

SEQ ID NO: 37978 - protein, 9 aa, Homo Sapiens
DRCSQEPRW

SEQ ID NO: 37979 - protein, 9 aa, Homo Sapiens
VIHTGANPY

SEQ ID NO: 37980 - protein, 9 aa, Homo Sapiens
HGKCSHLLE

SEQ ID NO: 37981 - protein, 9 aa, Homo Sapiens
LLYMAIDRV

SEQ ID NO: 37982 - protein, 9 aa, Homo Sapiens
SRMEPRFCE

SEQ ID NO: 37983 - protein, 9 aa, Homo Sapiens
SADGCTNWS

SEQ ID NO: 37984 - protein, 9 aa, Homo Sapiens
KVAGNLDSK

SEQ ID NO: 37985 - protein, 9 aa, Homo Sapiens
DVSVSDQME

SEQ ID NO: 37986 - protein, 9 aa, Homo Sapiens
PMVPPRQPW

SEQ ID NO: 37987 - protein, 9 aa, Homo Sapiens
YVKVNIRDI

SEQ ID NO: 37988 - protein, 9 aa, Homo Sapiens
YKKDVSVSD

SEQ ID NO: 37989 - protein, 9 aa, Homo Sapiens
HKSLTGKKG

SEQ ID NO: 37990 - protein, 9 aa, Homo Sapiens
NTPQVWSHP

SEQ ID NO: 37991 - protein, 9 aa, Homo Sapiens
MVPPRQPWT

SEQ ID NO: 37992 - protein, 9 aa, Homo Sapiens
ILDRCSQEP

SEQ ID NO: 37993 - protein, 9 aa, Homo Sapiens
RMEPRFCED

SEQ ID NO: 37994 - protein, 9 aa, Homo Sapiens
AHGKCSHLL

SEQ ID NO: 37995 - protein, 9 aa, Homo Sapiens
ATYVKVNIR

SEQ ID NO: 37996 - protein, 9 aa, Homo Sapiens
EPRWTCYDQ

SEQ ID NO: 37997 - protein, 9 aa, Homo Sapiens
QPWTLVNWL

SEQ ID NO: 37998 - protein, 9 aa, Homo Sapiens
TSQTLLLVQ

SEQ ID NO: 37999 - protein, 9 aa, Homo Sapiens
CSPKSYEND

SEQ ID NO: 38000 - protein, 9 aa, Homo Sapiens
CATYVKVNI

SEQ ID NO: 38001 - protein, 9 aa, Homo Sapiens
LDVLPDTYQ

SEQ ID NO: 38002 - protein, 9 aa, Homo Sapiens
MEKLCQQLT

SEQ ID NO: 38003 - protein, 9 aa, Homo Sapiens
ILCATYVKV

SEQ ID NO: 38004 - protein, 9 aa, Homo Sapiens
KPCDTMKVA

SEQ ID NO: 38005 - protein, 9 aa, Homo Sapiens
IPHIHKSLT

SEQ ID NO: 38006 - protein, 9 aa, Homo Sapiens
TDSDFHKLK

SEQ ID NO: 38007 - protein, 9 aa, Homo Sapiens
YTNTPQVWS

SEQ ID NO: 38008 - protein, 9 aa, Homo Sapiens
SVQDTVLPI

SEQ ID NO: 38009 - protein, 9 aa, Homo Sapiens
SKPLPLSER

SEQ ID NO: 38010 - protein, 9 aa, Homo Sapiens
TGKKGQQKT

SEQ ID NO: 38011 - protein, 9 aa, Homo Sapiens
SDFHKLKSP

SEQ ID NO: 38012 - protein, 9 aa, Homo Sapiens
QYRQEESIW

SEQ ID NO: 38013 - protein, 9 aa, Homo Sapiens
PRMCAAPTR

SEQ ID NO: 38014 - protein, 9 aa, Homo Sapiens
SIRSVQDTV

SEQ ID NO: 38015 - protein, 9 aa, Homo Sapiens
SLCIITSQT

SEQ ID NO: 38016 - protein, 9 aa, Homo Sapiens
RQPWTLVNW

SEQ ID NO: 38017 - protein, 9 aa, Homo Sapiens
VLHDWAHGK

SEQ ID NO: 38018 - protein, 9 aa, Homo Sapiens
HLVIHTGAN

SEQ ID NO: 38019 - protein, 9 aa, Homo Sapiens
LSERLEQEL

SEQ ID NO: 38020 - protein, 9 aa, Homo Sapiens
MVEDYWNKY

SEQ ID NO: 38021 - protein, 9 aa, Homo Sapiens
IHTGANPYH

SEQ ID NO: 38022 - protein, 9 aa, Homo Sapiens
RGSADGCTN

SEQ ID NO: 38023 - protein, 9 aa, Homo Sapiens
DRGHRDLPS

SEQ ID NO: 38024 - protein, 9 aa, Homo Sapiens
VAHMLLNKK

SEQ ID NO: 38025 - protein, 9 aa, Homo Sapiens
RQEESIWGF

SEQ ID NO: 38026 - protein, 9 aa, Homo Sapiens
EKIMKLSLP

SEQ ID NO: 38027 - protein, 9 aa, Homo Sapiens
AQTRELSNQ

SEQ ID NO: 38028 - protein, 9 aa, Homo Sapiens
KQYRQEESI

SEQ ID NO: 38029 - protein, 9 aa, Homo Sapiens
LYMAIDRVA

SEQ ID NO: 38030 - protein, 9 aa, Homo Sapiens
LCIITSQTL

SEQ ID NO: 38031 - protein, 9 aa, Homo Sapiens
YLSVESSNV

SEQ ID NO: 38032 - protein, 9 aa, Homo Sapiens
PKSYENDLP

SEQ ID NO: 38033 - protein, 9 aa, Homo Sapiens
EPRFCEDHP

SEQ ID NO: 38034 - protein, 9 aa, Homo Sapiens
LPLSERLEQ

SEQ ID NO: 38035 - protein, 9 aa, Homo Sapiens
PRQPWTLVN

SEQ ID NO: 38036 - protein, 9 aa, Homo Sapiens
KLCQQLTYH

SEQ ID NO: 38037 - protein, 9 aa, Homo Sapiens
LRVVIPPRM

SEQ ID NO: 38038 - protein, 9 aa, Homo Sapiens
PEPSLCIIT

SEQ ID NO: 38039 - protein, 9 aa, Homo Sapiens
NWKQYRQEE

SEQ ID NO: 38040 - protein, 9 aa, Homo Sapiens
KSYENDLPR

SEQ ID NO: 38041 - protein, 9 aa, Homo Sapiens
TCSPKSYEN

SEQ ID NO: 38042 - protein, 9 aa, Homo Sapiens
QTRELSNQV

SEQ ID NO: 38043 - protein, 9 aa, Homo Sapiens
EPSLCIITS

SEQ ID NO: 38044 - protein, 9 aa, Homo Sapiens
NGGSLVGEV

SEQ ID NO: 38045 - protein, 9 aa, Homo Sapiens
NSPPYILDV

SEQ ID NO: 38046 - protein, 9 aa, Homo Sapiens
PNGGSLVGE

SEQ ID NO: 38047 - protein, 9 aa, Homo Sapiens
RMCAAPTRI

SEQ ID NO: 38048 - protein, 9 aa, Homo Sapiens
MAIDRVAPR

SEQ ID NO: 38049 - protein, 9 aa, Homo Sapiens
EIESLKVCI

SEQ ID NO: 38050 - protein, 9 aa, Homo Sapiens
FLLHYKKDV

SEQ ID NO: 38051 - protein, 9 aa, Homo Sapiens
GSVAHMLLN

SEQ ID NO: 38052 - protein, 9 aa, Homo Sapiens
KSLTGKKGQ

SEQ ID NO: 38053 - protein, 9 aa, Homo Sapiens
HMLLNKKYG

SEQ ID NO: 38054 - protein, 9 aa, Homo Sapiens
EDPTDSDFH

SEQ ID NO: 38055 - protein, 9 aa, Homo Sapiens
PAIVQLHTA

SEQ ID NO: 38056 - protein, 9 aa, Homo Sapiens
DTTMYATMQ

SEQ ID NO: 38057 - protein, 9 aa, Homo Sapiens
KVACLVPGR

SEQ ID NO: 38058 - protein, 9 aa, Homo Sapiens
LEAEPAKEA

SEQ ID NO: 38059 - protein, 9 aa, Homo Sapiens
LFPENFTRC

SEQ ID NO: 38060 - protein, 9 aa, Homo Sapiens
RSGLQRGTS

SEQ ID NO: 38061 - protein, 9 aa, Homo Sapiens
LLFPPFRMV

SEQ ID NO: 38062 - protein, 9 aa, Homo Sapiens
FVSALPHDV

SEQ ID NO: 38063 - protein, 9 aa, Homo Sapiens
KPFEYKECG

SEQ ID NO: 38064 - protein, 9 aa, Homo Sapiens
LNGRQEERL

SEQ ID NO: 38065 - protein, 9 aa, Homo Sapiens
KCGTQLRYT

SEQ ID NO: 38066 - protein, 9 aa, Homo Sapiens
APNLGTFSK

SEQ ID NO: 38067 - protein, 9 aa, Homo Sapiens
FQGRRSHSE

SEQ ID NO: 38068 - protein, 9 aa, Homo Sapiens
VHVKDKLMN

SEQ ID NO: 38069 - protein, 9 aa, Homo Sapiens
IIGSQKFVA

SEQ ID NO: 38070 - protein, 9 aa, Homo Sapiens
LDRPHSVSS

SEQ ID NO: 38071 - protein, 9 aa, Homo Sapiens
CGNYRGRFR

SEQ ID NO: 38072 - protein, 9 aa, Homo Sapiens
QYLLPIVHG

SEQ ID NO: 38073 - protein, 9 aa, Homo Sapiens
SPVTNAGLA

SEQ ID NO: 38074 - protein, 9 aa, Homo Sapiens
PPHDPEHGP

SEQ ID NO: 38075 - protein, 9 aa, Homo Sapiens
MRAGVCARR

SEQ ID NO: 38076 - protein, 9 aa, Homo Sapiens
TTMYATMQR

SEQ ID NO: 38077 - protein, 9 aa, Homo Sapiens
ASQIWNLNP

SEQ ID NO: 38078 - protein, 9 aa, Homo Sapiens
LKCKLCGRV

SEQ ID NO: 38079 - protein, 9 aa, Homo Sapiens
TTCRWPSCG

SEQ ID NO: 38080 - protein, 9 aa, Homo Sapiens
DGWDNVVFN

SEQ ID NO: 38081 - protein, 9 aa, Homo Sapiens
ERLLEGGRE

SEQ ID NO: 38082 - protein, 9 aa, Homo Sapiens
HVKDKLMNH

SEQ ID NO: 38083 - protein, 9 aa, Homo Sapiens
GAFTFFVSA

SEQ ID NO: 38084 - protein, 9 aa, Homo Sapiens
LFKATKKDQ

SEQ ID NO: 38085 - protein, 9 aa, Homo Sapiens
ITRDFFHPL

SEQ ID NO: 38086 - protein, 9 aa, Homo Sapiens
ESPHDLQFS

SEQ ID NO: 38087 - protein, 9 aa, Homo Sapiens
NGRQEERLR

SEQ ID NO: 38088 - protein, 9 aa, Homo Sapiens
MADVGASWS

SEQ ID NO: 38089 - protein, 9 aa, Homo Sapiens
EAAHPTNLP

SEQ ID NO: 38090 - protein, 9 aa, Homo Sapiens
LKISSTRNE

SEQ ID NO: 38091 - protein, 9 aa, Homo Sapiens
HSRTIRLAR

SEQ ID NO: 38092 - protein, 9 aa, Homo Sapiens
RKVSPLATT

SEQ ID NO: 38093 - protein, 9 aa, Homo Sapiens
EQDHSLSSS

SEQ ID NO: 38094 - protein, 9 aa, Homo Sapiens
HRGKHKVAC

SEQ ID NO: 38095 - protein, 9 aa, Homo Sapiens
TFCLWLAAS

SEQ ID NO: 38096 - protein, 9 aa, Homo Sapiens
PHSVSSPVV

SEQ ID NO: 38097 - protein, 9 aa, Homo Sapiens
LRMLLKRNP

SEQ ID NO: 38098 - protein, 9 aa, Homo Sapiens
FHKKKCEDC

SEQ ID NO: 38099 - protein, 9 aa, Homo Sapiens
GISGPTNTR

SEQ ID NO: 38100 - protein, 9 aa, Homo Sapiens
RLSGLVVLA

SEQ ID NO: 38101 - protein, 9 aa, Homo Sapiens
QGVNQICLS

SEQ ID NO: 38102 - protein, 9 aa, Homo Sapiens
TAPNLGTFS

SEQ ID NO: 38103 - protein, 9 aa, Homo Sapiens
FNITRDFFH

SEQ ID NO: 38104 - protein, 9 aa, Homo Sapiens
GYKLHSRTI

SEQ ID NO: 38105 - protein, 9 aa, Homo Sapiens
AKMVALKDI

SEQ ID NO: 38106 - protein, 9 aa, Homo Sapiens
LWRKNANGR

SEQ ID NO: 38107 - protein, 9 aa, Homo Sapiens
PPDSIAAGR

SEQ ID NO: 38108 - protein, 9 aa, Homo Sapiens
CEVNNRKSI

SEQ ID NO: 38109 - protein, 9 aa, Homo Sapiens
SDFLQMCFT

SEQ ID NO: 38110 - protein, 9 aa, Homo Sapiens
RNNYQIGYD

SEQ ID NO: 38111 - protein, 9 aa, Homo Sapiens
YLQFWAGRI

SEQ ID NO: 38112 - protein, 9 aa, Homo Sapiens
AAHNHDWRH

SEQ ID NO: 38113 - protein, 9 aa, Homo Sapiens
CVGEKLGAA

SEQ ID NO: 38114 - protein, 9 aa, Homo Sapiens
DINKVMAQN

SEQ ID NO: 38115 - protein, 9 aa, Homo Sapiens
IFGGLHTGK

SEQ ID NO: 38116 - protein, 9 aa, Homo Sapiens
LPYYATYCQ

SEQ ID NO: 38117 - protein, 9 aa, Homo Sapiens
LSSCFHFLR

SEQ ID NO: 38118 - protein, 9 aa, Homo Sapiens
LEGGREPLL

SEQ ID NO: 38119 - protein, 9 aa, Homo Sapiens
NTRRPPLRR

SEQ ID NO: 38120 - protein, 9 aa, Homo Sapiens
NPQVSHDAP

SEQ ID NO: 38121 - protein, 9 aa, Homo Sapiens
PSADVQRCR

SEQ ID NO: 38122 - protein, 9 aa, Homo Sapiens
TVLWGTCGQ

SEQ ID NO: 38123 - protein, 9 aa, Homo Sapiens
VTSDFLQMC

SEQ ID NO: 38124 - protein, 9 aa, Homo Sapiens
NMVDGRNIY

SEQ ID NO: 38125 - protein, 9 aa, Homo Sapiens
HKKKCEDCV

SEQ ID NO: 38126 - protein, 9 aa, Homo Sapiens
PYYATYCQT

SEQ ID NO: 38127 - protein, 9 aa, Homo Sapiens
PGTHLQALT

SEQ ID NO: 38128 - protein, 9 aa, Homo Sapiens
VSFPAIVQL

SEQ ID NO: 38129 - protein, 9 aa, Homo Sapiens
AFTFFVSAL

SEQ ID NO: 38130 - protein, 9 aa, Homo Sapiens
HLQALTPVW

SEQ ID NO: 38131 - protein, 9 aa, Homo Sapiens
AHNHDWRHG

SEQ ID NO: 38132 - protein, 9 aa, Homo Sapiens
HFLPPSSNT

SEQ ID NO: 38133 - protein, 9 aa, Homo Sapiens
LLRLVEGYG

SEQ ID NO: 38134 - protein, 9 aa, Homo Sapiens
IQGIMNLGT

SEQ ID NO: 38135 - protein, 9 aa, Homo Sapiens
KVGEEIVPS

SEQ ID NO: 38136 - protein, 9 aa, Homo Sapiens
IVQLHTAVE

SEQ ID NO: 38137 - protein, 9 aa, Homo Sapiens
SFHKKKCED

SEQ ID NO: 38138 - protein, 9 aa, Homo Sapiens
LFGLQTIYV

SEQ ID NO: 38139 - protein, 9 aa, Homo Sapiens
SWVKEKKLL

SEQ ID NO: 38140 - protein, 9 aa, Homo Sapiens
HRSGLQRGT

SEQ ID NO: 38141 - protein, 9 aa, Homo Sapiens
CCTLKISST

SEQ ID NO: 38142 - protein, 9 aa, Homo Sapiens
TGKSVHVKD

SEQ ID NO: 38143 - protein, 9 aa, Homo Sapiens
GLHTGKMVM

SEQ ID NO: 38144 - protein, 9 aa, Homo Sapiens
DMDDEESWV

SEQ ID NO: 38145 - protein, 9 aa, Homo Sapiens
DPEHGPSAD

SEQ ID NO: 38146 - protein, 9 aa, Homo Sapiens
EGGREPLLQ

SEQ ID NO: 38147 - protein, 9 aa, Homo Sapiens
VNIIGSQKF

SEQ ID NO: 38148 - protein, 9 aa, Homo Sapiens
YRGRFRRYF

SEQ ID NO: 38149 - protein, 9 aa, Homo Sapiens
YCQTRLLIH

SEQ ID NO: 38150 - protein, 9 aa, Homo Sapiens
TARTFGPEL

SEQ ID NO: 38151 - protein, 9 aa, Homo Sapiens
TLHRQSTSC

SEQ ID NO: 38152 - protein, 9 aa, Homo Sapiens
LQALTPVWR

SEQ ID NO: 38153 - protein, 9 aa, Homo Sapiens
STFQGVNQI

SEQ ID NO: 38154 - protein, 9 aa, Homo Sapiens
GERLGRKVS

SEQ ID NO: 38155 - protein, 9 aa, Homo Sapiens
EIRMQLQEI

SEQ ID NO: 38156 - protein, 9 aa, Homo Sapiens
VDGRNIYEQ

SEQ ID NO: 38157 - protein, 9 aa, Homo Sapiens
CLVPGREAQ

SEQ ID NO: 38158 - protein, 9 aa, Homo Sapiens
GTKNMQTTQ

SEQ ID NO: 38159 - protein, 9 aa, Homo Sapiens
TMYATMQRN

SEQ ID NO: 38160 - protein, 9 aa, Homo Sapiens
CALTNAEAA

SEQ ID NO: 38161 - protein, 9 aa, Homo Sapiens
VLESPHDLQ

SEQ ID NO: 38162 - protein, 9 aa, Homo Sapiens
TFNGISGPT

SEQ ID NO: 38163 - protein, 9 aa, Homo Sapiens
KRSTFQGVN

SEQ ID NO: 38164 - protein, 9 aa, Homo Sapiens
ARRWSSIPA

SEQ ID NO: 38165 - protein, 9 aa, Homo Sapiens
LGKVYQCPH

SEQ ID NO: 38166 - protein, 9 aa, Homo Sapiens
NTPLLRLVE

SEQ ID NO: 38167 - protein, 9 aa, Homo Sapiens
GKVYQCPHQ

SEQ ID NO: 38168 - protein, 9 aa, Homo Sapiens
CLSGELAPT

SEQ ID NO: 38169 - protein, 9 aa, Homo Sapiens
FDGWDNVVF

SEQ ID NO: 38170 - protein, 9 aa, Homo Sapiens
YRLHRPVHP

SEQ ID NO: 38171 - protein, 9 aa, Homo Sapiens
NLRSRTVLW

SEQ ID NO: 38172 - protein, 9 aa, Homo Sapiens
LPIVHGTKN

SEQ ID NO: 38173 - protein, 9 aa, Homo Sapiens
NGCEVNNRK

SEQ ID NO: 38174 - protein, 9 aa, Homo Sapiens
EEGSLAQTL

SEQ ID NO: 38175 - protein, 9 aa, Homo Sapiens
NYQIGYDGS

SEQ ID NO: 38176 - protein, 9 aa, Homo Sapiens
SKSSLDVTS

SEQ ID NO: 38177 - protein, 9 aa, Homo Sapiens
FFHPLYPGT

SEQ ID NO: 38178 - protein, 9 aa, Homo Sapiens
ELEAEPAKE

SEQ ID NO: 38179 - protein, 9 aa, Homo Sapiens
TEKYAGIFY

SEQ ID NO: 38180 - protein, 9 aa, Homo Sapiens
NQMLSLLNG

SEQ ID NO: 38181 - protein, 9 aa, Homo Sapiens
WKRSTFQGV

SEQ ID NO: 38182 - protein, 9 aa, Homo Sapiens
QQLREGLQL

SEQ ID NO: 38183 - protein, 9 aa, Homo Sapiens
SSFHKKKCE

SEQ ID NO: 38184 - protein, 9 aa, Homo Sapiens
WIRGNADFP

SEQ ID NO: 38185 - protein, 9 aa, Homo Sapiens
GNADFPLSG

SEQ ID NO: 38186 - protein, 9 aa, Homo Sapiens
SGPTNTRRP

SEQ ID NO: 38187 - protein, 9 aa, Homo Sapiens
PATTCRWPS

SEQ ID NO: 38188 - protein, 9 aa, Homo Sapiens
MKVMLGKVY

SEQ ID NO: 38189 - protein, 9 aa, Homo Sapiens
IHSLTAPNL

SEQ ID NO: 38190 - protein, 9 aa, Homo Sapiens
VPVKWFKVG

SEQ ID NO: 38191 - protein, 9 aa, Homo Sapiens
WVKEKKLLV

SEQ ID NO: 38192 - protein, 9 aa, Homo Sapiens
WGPYLQFWA

SEQ ID NO: 38193 - protein, 9 aa, Homo Sapiens
PSCGPIPSC

SEQ ID NO: 38194 - protein, 9 aa, Homo Sapiens
WGRWKRSTF

SEQ ID NO: 38195 - protein, 9 aa, Homo Sapiens
PHDDRFSQS

SEQ ID NO: 38196 - protein, 9 aa, Homo Sapiens
TSDFLQMCF

SEQ ID NO: 38197 - protein, 9 aa, Homo Sapiens
PSPVTNAGL

SEQ ID NO: 38198 - protein, 9 aa, Homo Sapiens
DIDGSFLGM

SEQ ID NO: 38199 - protein, 9 aa, Homo Sapiens
IRMQLQEIR

SEQ ID NO: 38200 - protein, 9 aa, Homo Sapiens
LLPIVHGTK

SEQ ID NO: 38201 - protein, 9 aa, Homo Sapiens
ARTFGPELE

SEQ ID NO: 38202 - protein, 9 aa, Homo Sapiens
CTLKISSTR

SEQ ID NO: 38203 - protein, 9 aa, Homo Sapiens
RRWSSIPAL

SEQ ID NO: 38204 - protein, 9 aa, Homo Sapiens
HDAPSPVTN

SEQ ID NO: 38205 - protein, 9 aa, Homo Sapiens
HTGKMVMLQ

SEQ ID NO: 38206 - protein, 9 aa, Homo Sapiens
TFSKSSLDV

SEQ ID NO: 38207 - protein, 9 aa, Homo Sapiens
GKEGRQADR

SEQ ID NO: 38208 - protein, 9 aa, Homo Sapiens
RPVYDGKTL

SEQ ID NO: 38209 - protein, 9 aa, Homo Sapiens
QNQESGIEE

SEQ ID NO: 38210 - protein, 9 aa, Homo Sapiens
TLKISSTRN

SEQ ID NO: 38211 - protein, 9 aa, Homo Sapiens
KKSWAQNLY

SEQ ID NO: 38212 - protein, 9 aa, Homo Sapiens
KCCTLKISS

SEQ ID NO: 38213 - protein, 9 aa, Homo Sapiens
KEVGGQQLR

SEQ ID NO: 38214 - protein, 9 aa, Homo Sapiens
PLRRSSASC

SEQ ID NO: 38215 - protein, 9 aa, Homo Sapiens
TKPKKSWAQ

SEQ ID NO: 38216 - protein, 9 aa, Homo Sapiens
PWSAAHNHD

SEQ ID NO: 38217 - protein, 9 aa, Homo Sapiens
KFVAHLTVQ

SEQ ID NO: 38218 - protein, 9 aa, Homo Sapiens
FSKSSLDVT

SEQ ID NO: 38219 - protein, 9 aa, Homo Sapiens
RRPPLRRSS

SEQ ID NO: 38220 - protein, 9 aa, Homo Sapiens
DRNSDYAIP

SEQ ID NO: 38221 - protein, 9 aa, Homo Sapiens
AGIFYFRFW

SEQ ID NO: 38222 - protein, 9 aa, Homo Sapiens
RRSSASCRA

SEQ ID NO: 38223 - protein, 9 aa, Homo Sapiens
RHAGGPSCC

SEQ ID NO: 38224 - protein, 9 aa, Homo Sapiens
PGREAQLIH

SEQ ID NO: 38225 - protein, 9 aa, Homo Sapiens
EAIKYLKNF

SEQ ID NO: 38226 - protein, 9 aa, Homo Sapiens
SLLRMLLKR

SEQ ID NO: 38227 - protein, 9 aa, Homo Sapiens
DDEESWVKE

SEQ ID NO: 38228 - protein, 9 aa, Homo Sapiens
KVYQCPHQL

SEQ ID NO: 38229 - protein, 9 aa, Homo Sapiens
AQSLLRMLL

SEQ ID NO: 38230 - protein, 9 aa, Homo Sapiens
GKTLHRQST

SEQ ID NO: 38231 - protein, 9 aa, Homo Sapiens
QRIRMLNAD

SEQ ID NO: 38232 - protein, 9 aa, Homo Sapiens
MMIPEEHDL

SEQ ID NO: 38233 - protein, 9 aa, Homo Sapiens
VSHDAPSPV

SEQ ID NO: 38234 - protein, 9 aa, Homo Sapiens
FTWGRWKRS

SEQ ID NO: 38235 - protein, 9 aa, Homo Sapiens
DGYKLHSRT

SEQ ID NO: 38236 - protein, 9 aa, Homo Sapiens
MLGKVYQCP

SEQ ID NO: 38237 - protein, 9 aa, Homo Sapiens
SQKFVAHLT

SEQ ID NO: 38238 - protein, 9 aa, Homo Sapiens
TNLPWSAAH

SEQ ID NO: 38239 - protein, 9 aa, Homo Sapiens
NTLMDLVLF

SEQ ID NO: 38240 - protein, 9 aa, Homo Sapiens
NYRGRFRRY

SEQ ID NO: 38241 - protein, 9 aa, Homo Sapiens
QHHYNLKCL

SEQ ID NO: 38242 - protein, 9 aa, Homo Sapiens
QLQEIRKIL

SEQ ID NO: 38243 - protein, 9 aa, Homo Sapiens
RKNANGRYV

SEQ ID NO: 38244 - protein, 9 aa, Homo Sapiens
GLQTIYVTA

SEQ ID NO: 38245 - protein, 9 aa, Homo Sapiens
MIPEEHDLE

SEQ ID NO: 38246 - protein, 9 aa, Homo Sapiens
WRVLHPWVQ

SEQ ID NO: 38247 - protein, 9 aa, Homo Sapiens
GWDNVVFNT

SEQ ID NO: 38248 - protein, 9 aa, Homo Sapiens
NNRKSILSR

SEQ ID NO: 38249 - protein, 9 aa, Homo Sapiens
AQNLYELDS

SEQ ID NO: 38250 - protein, 9 aa, Homo Sapiens
EVLKCCTLK

SEQ ID NO: 38251 - protein, 9 aa, Homo Sapiens
RAAPPGTHL

SEQ ID NO: 38252 - protein, 9 aa, Homo Sapiens
GSSFHKKKC

SEQ ID NO: 38253 - protein, 9 aa, Homo Sapiens
IGSQKFVAH

SEQ ID NO: 38254 - protein, 9 aa, Homo Sapiens
WSAAHNHDW

SEQ ID NO: 38255 - protein, 9 aa, Homo Sapiens
SCGPIPSCA

SEQ ID NO: 38256 - protein, 9 aa, Homo Sapiens
PTNLPWSAA

SEQ ID NO: 38257 - protein, 9 aa, Homo Sapiens
GPSADVQRC

SEQ ID NO: 38258 - protein, 9 aa, Homo Sapiens
NFVKIARNN

SEQ ID NO: 38259 - protein, 9 aa, Homo Sapiens
VMMIPEEHD

SEQ ID NO: 38260 - protein, 9 aa, Homo Sapiens
WRHGFRTLL

SEQ ID NO: 38261 - protein, 9 aa, Homo Sapiens
IIGLHFLPP

SEQ ID NO: 38262 - protein, 9 aa, Homo Sapiens
QDQLRNNYQ

SEQ ID NO: 38263 - protein, 9 aa, Homo Sapiens
PSCALTNAE

SEQ ID NO: 38264 - protein, 9 aa, Homo Sapiens
GLQRGTSGE

SEQ ID NO: 38265 - protein, 9 aa, Homo Sapiens
ASCRAAPPG

SEQ ID NO: 38266 - protein, 9 aa, Homo Sapiens
FGGLHTGKM

SEQ ID NO: 38267 - protein, 9 aa, Homo Sapiens
NAGLALGEP

SEQ ID NO: 38268 - protein, 9 aa, Homo Sapiens
TLFGLQTIY

SEQ ID NO: 38269 - protein, 9 aa, Homo Sapiens
FHPLYPGTK

SEQ ID NO: 38270 - protein, 9 aa, Homo Sapiens
QRLSGLVVL

SEQ ID NO: 38271 - protein, 9 aa, Homo Sapiens
KATKKDQGF

SEQ ID NO: 38272 - protein, 9 aa, Homo Sapiens
GPGMVVADE

SEQ ID NO: 38273 - protein, 9 aa, Homo Sapiens
GASWSAAAA

SEQ ID NO: 38274 - protein, 9 aa, Homo Sapiens
RRRQPIQLL

SEQ ID NO: 38275 - protein, 9 aa, Homo Sapiens
EGSLAQTLA

SEQ ID NO: 38276 - protein, 9 aa, Homo Sapiens
QFWAGRIAS

SEQ ID NO: 38277 - protein, 9 aa, Homo Sapiens
KVMLGKVYQ

SEQ ID NO: 38278 - protein, 9 aa, Homo Sapiens
VTNAGLALG

SEQ ID NO: 38279 - protein, 9 aa, Homo Sapiens
PPFRMVEAA

SEQ ID NO: 38280 - protein, 9 aa, Homo Sapiens
QIWNLNPVF

SEQ ID NO: 38281 - protein, 9 aa, Homo Sapiens
APLKLKCKL

SEQ ID NO: 38282 - protein, 9 aa, Homo Sapiens
EMGAFTFFV

SEQ ID NO: 38283 - protein, 9 aa, Homo Sapiens
CFTYQSTYA

SEQ ID NO: 38284 - protein, 9 aa, Homo Sapiens
VALKDINKV

SEQ ID NO: 38285 - protein, 9 aa, Homo Sapiens
PPGTHLQAL

SEQ ID NO: 38286 - protein, 9 aa, Homo Sapiens
ENHNEVNTL

SEQ ID NO: 38287 - protein, 9 aa, Homo Sapiens
LHRPVHPEP

SEQ ID NO: 38288 - protein, 9 aa, Homo Sapiens
SSSDSCVGE

SEQ ID NO: 38289 - protein, 9 aa, Homo Sapiens
KNGSSSDSC

SEQ ID NO: 38290 - protein, 9 aa, Homo Sapiens
RYFAQPVMM

SEQ ID NO: 38291 - protein, 9 aa, Homo Sapiens
LWGTCGQPA

SEQ ID NO: 38292 - protein, 9 aa, Homo Sapiens
IQPGTEQHE

SEQ ID NO: 38293 - protein, 9 aa, Homo Sapiens
QSLLRMLLK

SEQ ID NO: 38294 - protein, 9 aa, Homo Sapiens
VGEEIVPSP

SEQ ID NO: 38295 - protein, 9 aa, Homo Sapiens
PVWRVLHPW

SEQ ID NO: 38296 - protein, 9 aa, Homo Sapiens
RTIIGLHFL

SEQ ID NO: 38297 - protein, 9 aa, Homo Sapiens
HKREQDHSL

SEQ ID NO: 38298 - protein, 9 aa, Homo Sapiens
KREQDHSLS

SEQ ID NO: 38299 - protein, 9 aa, Homo Sapiens
NHDWRHGFR

SEQ ID NO: 38300 - protein, 9 aa, Homo Sapiens
HRPVHPEPA

SEQ ID NO: 38301 - protein, 9 aa, Homo Sapiens
VSALPHDVC

SEQ ID NO: 38302 - protein, 9 aa, Homo Sapiens
PVTNAGLAL

SEQ ID NO: 38303 - protein, 9 aa, Homo Sapiens
AEGSSLLFL

SEQ ID NO: 38304 - protein, 9 aa, Homo Sapiens
PKKSWAQNL

SEQ ID NO: 38305 - protein, 9 aa, Homo Sapiens
TIYVTALYI

SEQ ID NO: 38306 - protein, 9 aa, Homo Sapiens
SSCFHFLRG

SEQ ID NO: 38307 - protein, 9 aa, Homo Sapiens
AGGPSCCCF

SEQ ID NO: 38308 - protein, 9 aa, Homo Sapiens
VNTLMDLVL

SEQ ID NO: 38309 - protein, 9 aa, Homo Sapiens
LLFLPPPPP

SEQ ID NO: 38310 - protein, 9 aa, Homo Sapiens
RLQRIRMLN

SEQ ID NO: 38311 - protein, 9 aa, Homo Sapiens
IQHHYNLKC

SEQ ID NO: 38312 - protein, 9 aa, Homo Sapiens
STSCGNYRG

SEQ ID NO: 38313 - protein, 9 aa, Homo Sapiens
RGRFRRYFT

SEQ ID NO: 38314 - protein, 9 aa, Homo Sapiens
FPPFRMVEA

SEQ ID NO: 38315 - protein, 9 aa, Homo Sapiens
LHFLPPSSN

SEQ ID NO: 38316 - protein, 9 aa, Homo Sapiens
TWGRWKRST

SEQ ID NO: 38317 - protein, 9 aa, Homo Sapiens
IRGNADFPL

SEQ ID NO: 38318 - protein, 9 aa, Homo Sapiens
HSLTAPNLG

SEQ ID NO: 38319 - protein, 9 aa, Homo Sapiens
KDINKVMAQ

SEQ ID NO: 38320 - protein, 9 aa, Homo Sapiens
PLLRLVEGY

SEQ ID NO: 38321 - protein, 9 aa, Homo Sapiens
WGTCGQPAD

SEQ ID NO: 38322 - protein, 9 aa, Homo Sapiens
LSLLNGRQE

SEQ ID NO: 38323 - protein, 9 aa, Homo Sapiens
LKLIQHHYN

SEQ ID NO: 38324 - protein, 9 aa, Homo Sapiens
RPVHPEPAT

SEQ ID NO: 38325 - protein, 9 aa, Homo Sapiens
VLTFNGISG

SEQ ID NO: 38326 - protein, 9 aa, Homo Sapiens
RSTFQGVNQ

SEQ ID NO: 38327 - protein, 9 aa, Homo Sapiens
KNANGRYVC

SEQ ID NO: 38328 - protein, 9 aa, Homo Sapiens
NAEAAHPTN

SEQ ID NO: 38329 - protein, 9 aa, Homo Sapiens
PVHPEPATT

SEQ ID NO: 38330 - protein, 9 aa, Homo Sapiens
DFLQMCFTY

SEQ ID NO: 38331 - protein, 9 aa, Homo Sapiens
SWGPYLQFW

SEQ ID NO: 38332 - protein, 9 aa, Homo Sapiens
KNFVKIARN

SEQ ID NO: 38333 - protein, 9 aa, Homo Sapiens
KEGRQADRN

SEQ ID NO: 38334 - protein, 9 aa, Homo Sapiens
VDTTMYATM

SEQ ID NO: 38335 - protein, 9 aa, Homo Sapiens
VGASWSAAA

SEQ ID NO: 38336 - protein, 9 aa, Homo Sapiens
ALADTAVFE

SEQ ID NO: 38337 - protein, 9 aa, Homo Sapiens
YDGKTLHRQ

SEQ ID NO: 38338 - protein, 9 aa, Homo Sapiens
PVMMIPEEH

SEQ ID NO: 38339 - protein, 9 aa, Homo Sapiens
ITHLNYRLH

SEQ ID NO: 38340 - protein, 9 aa, Homo Sapiens
RAGVCARRP

SEQ ID NO: 38341 - protein, 9 aa, Homo Sapiens
TGTGKSVHV

SEQ ID NO: 38342 - protein, 9 aa, Homo Sapiens
GINPQVSHD

SEQ ID NO: 38343 - protein, 9 aa, Homo Sapiens
LLNGRQEER

SEQ ID NO: 38344 - protein, 9 aa, Homo Sapiens
LTPVWRVLH

SEQ ID NO: 38345 - protein, 9 aa, Homo Sapiens
LLKRNPANR

SEQ ID NO: 38346 - protein, 9 aa, Homo Sapiens
RHGFRTLLL

SEQ ID NO: 38347 - protein, 9 aa, Homo Sapiens
YFTWGRWKR

SEQ ID NO: 38348 - protein, 9 aa, Homo Sapiens
LTFNGISGP

SEQ ID NO: 38349 - protein, 9 aa, Homo Sapiens
YTLFGLQTI

SEQ ID NO: 38350 - protein, 9 aa, Homo Sapiens
TYLHTYESG

SEQ ID NO: 38351 - protein, 9 aa, Homo Sapiens
SEEGSLAQT

SEQ ID NO: 38352 - protein, 9 aa, Homo Sapiens
PIQLLVELL

SEQ ID NO: 38353 - protein, 9 aa, Homo Sapiens
IYTLFGLQT

SEQ ID NO: 38354 - protein, 9 aa, Homo Sapiens
REAQLIHSL

SEQ ID NO: 38355 - protein, 9 aa, Homo Sapiens
FHFLRGEYV

SEQ ID NO: 38356 - protein, 9 aa, Homo Sapiens
ADFPLSGSF

SEQ ID NO: 38357 - protein, 9 aa, Homo Sapiens
FPAIVQLHT

SEQ ID NO: 38358 - protein, 9 aa, Homo Sapiens
RRSHSELAE

SEQ ID NO: 38359 - protein, 9 aa, Homo Sapiens
TSCGNYRGR

SEQ ID NO: 38360 - protein, 9 aa, Homo Sapiens
PDHVREREL

SEQ ID NO: 38361 - protein, 9 aa, Homo Sapiens
GRFRRYFTW

SEQ ID NO: 38362 - protein, 9 aa, Homo Sapiens
TDSEEGSLA

SEQ ID NO: 38363 - protein, 9 aa, Homo Sapiens
LQRGTSGEN

SEQ ID NO: 38364 - protein, 9 aa, Homo Sapiens
FGLQTIYVT

SEQ ID NO: 38365 - protein, 9 aa, Homo Sapiens
GLHFLPPSS

SEQ ID NO: 38366 - protein, 9 aa, Homo Sapiens
ILKLIQHHY

SEQ ID NO: 38367 - protein, 9 aa, Homo Sapiens
ELIQSGRFQ

SEQ ID NO: 38368 - protein, 9 aa, Homo Sapiens
YKECGKAFS

SEQ ID NO: 38369 - protein, 9 aa, Homo Sapiens
MQLQEIRKI

SEQ ID NO: 38370 - protein, 9 aa, Homo Sapiens
RVLHPWVQP

SEQ ID NO: 38371 - protein, 9 aa, Homo Sapiens
EHGPSADVQ

SEQ ID NO: 38372 - protein, 9 aa, Homo Sapiens
QLRNNYQIG

SEQ ID NO: 38373 - protein, 9 aa, Homo Sapiens
SPHDLQFSE

SEQ ID NO: 38374 - protein, 9 aa, Homo Sapiens
NEVNTLMDL

SEQ ID NO: 38375 - protein, 9 aa, Homo Sapiens
SLTAPNLGT

SEQ ID NO: 38376 - protein, 9 aa, Homo Sapiens
THLQALTPV

SEQ ID NO: 38377 - protein, 9 aa, Homo Sapiens
KSWAQNLYE

SEQ ID NO: 38378 - protein, 9 aa, Homo Sapiens
KMVALKDIN

SEQ ID NO: 38379 - protein, 9 aa, Homo Sapiens
SLSSSSSAS

SEQ ID NO: 38380 - protein, 9 aa, Homo Sapiens
LLKAFGAAP

SEQ ID NO: 38381 - protein, 9 aa, Homo Sapiens
DSEEGSLAQ

SEQ ID NO: 38382 - protein, 9 aa, Homo Sapiens
SCALTNAEA

SEQ ID NO: 38383 - protein, 9 aa, Homo Sapiens
YLKNFVKIA

SEQ ID NO: 38384 - protein, 9 aa, Homo Sapiens
VKWFKVGEE

SEQ ID NO: 38385 - protein, 9 aa, Homo Sapiens
AFGAAPSHL

SEQ ID NO: 38386 - protein, 9 aa, Homo Sapiens
HNEVNTLMD

SEQ ID NO: 38387 - protein, 9 aa, Homo Sapiens
VCARRPVGK

SEQ ID NO: 38388 - protein, 9 aa, Homo Sapiens
RRPVYDGKT

SEQ ID NO: 38389 - protein, 9 aa, Homo Sapiens
SASQIWNLN

SEQ ID NO: 38390 - protein, 9 aa, Homo Sapiens
YQCPHQLMN

SEQ ID NO: 38391 - protein, 9 aa, Homo Sapiens
LSGLVVLAD

SEQ ID NO: 38392 - protein, 9 aa, Homo Sapiens
DSIAAGRHA

SEQ ID NO: 38393 - protein, 9 aa, Homo Sapiens
IAIQGIMNL

SEQ ID NO: 38394 - protein, 9 aa, Homo Sapiens
QESGIEESV

SEQ ID NO: 38395 - protein, 9 aa, Homo Sapiens
RYFTWGRWK

SEQ ID NO: 38396 - protein, 9 aa, Homo Sapiens
NGISGPTNT

SEQ ID NO: 38397 - protein, 9 aa, Homo Sapiens
WAQNLYELD

SEQ ID NO: 38398 - protein, 9 aa, Homo Sapiens
IGKEGRQAD

SEQ ID NO: 38399 - protein, 9 aa, Homo Sapiens
LESPHDLQF

SEQ ID NO: 38400 - protein, 9 aa, Homo Sapiens
VADELKIPI

SEQ ID NO: 38401 - protein, 9 aa, Homo Sapiens
LSGELAPTA

SEQ ID NO: 38402 - protein, 9 aa, Homo Sapiens
SGLVVLADA

SEQ ID NO: 38403 - protein, 9 aa, Homo Sapiens
EKYAGIFYF

SEQ ID NO: 38404 - protein, 9 aa, Homo Sapiens
QMLSLLNGR

SEQ ID NO: 38405 - protein, 9 aa, Homo Sapiens
VGKNGSSFH

SEQ ID NO: 38406 - protein, 9 aa, Homo Sapiens
SGIEESVSW

SEQ ID NO: 38407 - protein, 9 aa, Homo Sapiens
VLTFCLWLA

SEQ ID NO: 38408 - protein, 9 aa, Homo Sapiens
HSELAEGAA

SEQ ID NO: 38409 - protein, 9 aa, Homo Sapiens
LFNMVDGRN

SEQ ID NO: 38410 - protein, 9 aa, Homo Sapiens
CCCCRVCCL

SEQ ID NO: 38411 - protein, 9 aa, Homo Sapiens
GRNIYEQEG

SEQ ID NO: 38412 - protein, 9 aa, Homo Sapiens
PGARRWSSI

SEQ ID NO: 38413 - protein, 9 aa, Homo Sapiens
QSPNTPLLR

SEQ ID NO: 38414 - protein, 9 aa, Homo Sapiens
HDDRFSQSS

SEQ ID NO: 38415 - protein, 9 aa, Homo Sapiens
GRRSHSELA

SEQ ID NO: 38416 - protein, 9 aa, Homo Sapiens
LKCCTLKIS

SEQ ID NO: 38417 - protein, 9 aa, Homo Sapiens
YEVLKCCTL

SEQ ID NO: 38418 - protein, 9 aa, Homo Sapiens
KAFGAAPSH

SEQ ID NO: 38419 - protein, 9 aa, Homo Sapiens
CKLCGRVDF

SEQ ID NO: 38420 - protein, 9 aa, Homo Sapiens
GRKVSPLAT

SEQ ID NO: 38421 - protein, 9 aa, Homo Sapiens
QVSHDAPSP

SEQ ID NO: 38422 - protein, 9 aa, Homo Sapiens
RSSASCRAA

SEQ ID NO: 38423 - protein, 9 aa, Homo Sapiens
PEHGPSADV

SEQ ID NO: 38424 - protein, 9 aa, Homo Sapiens
KSVHVKDKL

SEQ ID NO: 38425 - protein, 9 aa, Homo Sapiens
GREAQLIHS

SEQ ID NO: 38426 - protein, 9 aa, Homo Sapiens
LTAPNLGTF

SEQ ID NO: 38427 - protein, 9 aa, Homo Sapiens
HDWRHGFRT

SEQ ID NO: 38428 - protein, 9 aa, Homo Sapiens
GLFKATKKD

SEQ ID NO: 38429 - protein, 9 aa, Homo Sapiens
GNYRGRFRR

SEQ ID NO: 38430 - protein, 9 aa, Homo Sapiens
SPHDDRFSQ

SEQ ID NO: 38431 - protein, 9 aa, Homo Sapiens
SCFHFLRGE

SEQ ID NO: 38432 - protein, 9 aa, Homo Sapiens
LLLFPPFRM

SEQ ID NO: 38433 - protein, 9 aa, Homo Sapiens
ICLSGELAP

SEQ ID NO: 38434 - protein, 9 aa, Homo Sapiens
GGLHTGKMV

SEQ ID NO: 38435 - protein, 9 aa, Homo Sapiens
TAVFEKGMK

SEQ ID NO: 38436 - protein, 9 aa, Homo Sapiens
WFKVGEEIV

SEQ ID NO: 38437 - protein, 9 aa, Homo Sapiens
TNAGLALGE

SEQ ID NO: 38438 - protein, 9 aa, Homo Sapiens
QKFVAHLTV

SEQ ID NO: 38439 - protein, 9 aa, Homo Sapiens
MYRRRQPIQ

SEQ ID NO: 38440 - protein, 9 aa, Homo Sapiens
QMCFTYQST

SEQ ID NO: 38441 - protein, 9 aa, Homo Sapiens
PPLRRSSAS

SEQ ID NO: 38442 - protein, 9 aa, Homo Sapiens
PGMVVADEL

SEQ ID NO: 38443 - protein, 9 aa, Homo Sapiens
HRQSTSCGN

SEQ ID NO: 38444 - protein, 9 aa, Homo Sapiens
HPTNLPWSA

SEQ ID NO: 38445 - protein, 9 aa, Homo Sapiens
NIYEQEGLE

SEQ ID NO: 38446 - protein, 9 aa, Homo Sapiens
LHSRTIRLA

SEQ ID NO: 38447 - protein, 9 aa, Homo Sapiens
SAAHNHDWR

SEQ ID NO: 38448 - protein, 9 aa, Homo Sapiens
GPIPSCALT

SEQ ID NO: 38449 - protein, 9 aa, Homo Sapiens
DNVVFNTLQ

SEQ ID NO: 38450 - protein, 9 aa, Homo Sapiens
FGPELEAEP

SEQ ID NO: 38451 - protein, 9 aa, Homo Sapiens
EVNTLMDLV

SEQ ID NO: 38452 - protein, 9 aa, Homo Sapiens
LRNNYQIGY

SEQ ID NO: 38453 - protein, 9 aa, Homo Sapiens
NLGTFSKSS

SEQ ID NO: 38454 - protein, 9 aa, Homo Sapiens
NQESGIEES

SEQ ID NO: 38455 - protein, 9 aa, Homo Sapiens
KLKCKLCGR

SEQ ID NO: 38456 - protein, 9 aa, Homo Sapiens
EHIAIQGIM

SEQ ID NO: 38457 - protein, 9 aa, Homo Sapiens
IEESVSWGT

SEQ ID NO: 38458 - protein, 9 aa, Homo Sapiens
VPILDRPHS

SEQ ID NO: 38459 - protein, 9 aa, Homo Sapiens
RFRRYFTWG

SEQ ID NO: 38460 - protein, 9 aa, Homo Sapiens
SFPAIVQLH

SEQ ID NO: 38461 - protein, 9 aa, Homo Sapiens
PEPATTCRW

SEQ ID NO: 38462 - protein, 9 aa, Homo Sapiens
IFYFRFWHF

SEQ ID NO: 38463 - protein, 9 aa, Homo Sapiens
QRGTSGENN

SEQ ID NO: 38464 - protein, 9 aa, Homo Sapiens
QHELIQSGR

SEQ ID NO: 38465 - protein, 9 aa, Homo Sapiens
FNMVDGRNI

SEQ ID NO: 38466 - protein, 9 aa, Homo Sapiens
NGRYVCNAC

SEQ ID NO: 38467 - protein, 9 aa, Homo Sapiens
PQVSHDAPS

SEQ ID NO: 38468 - protein, 9 aa, Homo Sapiens
RRYFTWGRW

SEQ ID NO: 38469 - protein, 9 aa, Homo Sapiens
DAPSPVTNA

SEQ ID NO: 38470 - protein, 9 aa, Homo Sapiens
FLRGEYVDW

SEQ ID NO: 38471 - protein, 9 aa, Homo Sapiens
PVYDGKTLH

SEQ ID NO: 38472 - protein, 9 aa, Homo Sapiens
QADRNSDYA

SEQ ID NO: 38473 - protein, 9 aa, Homo Sapiens
RGEYVDWSP

SEQ ID NO: 38474 - protein, 9 aa, Homo Sapiens
QKDILKLIQ

SEQ ID NO: 38475 - protein, 9 aa, Homo Sapiens
RLGRKVSPL

SEQ ID NO: 38476 - protein, 9 aa, Homo Sapiens
ADVGASWSA

SEQ ID NO: 38477 - protein, 9 aa, Homo Sapiens
GPELEAEPA

SEQ ID NO: 38478 - protein, 9 aa, Homo Sapiens
SQSPNTPLL

SEQ ID NO: 38479 - protein, 9 aa, Homo Sapiens
RTFGPELEA

SEQ ID NO: 38480 - protein, 9 aa, Homo Sapiens
GSSLLFLPP

SEQ ID NO: 38481 - protein, 9 aa, Homo Sapiens
TFFVSALPH

SEQ ID NO: 38482 - protein, 9 aa, Homo Sapiens
QVPPDSIAA

SEQ ID NO: 38483 - protein, 9 aa, Homo Sapiens
QNLYELDSD

SEQ ID NO: 38484 - protein, 9 aa, Homo Sapiens
NNYQIGYDG

SEQ ID NO: 38485 - protein, 9 aa, Homo Sapiens
PQRLSGLVV

SEQ ID NO: 38486 - protein, 9 aa, Homo Sapiens
GVIDEIRMQ

SEQ ID NO: 38487 - protein, 9 aa, Homo Sapiens
AVLTFCLWL

SEQ ID NO: 38488 - protein, 9 aa, Homo Sapiens
GVCARRPVG

SEQ ID NO: 38489 - protein, 9 aa, Homo Sapiens
TCQEHIAIQ

SEQ ID NO: 38490 - protein, 9 aa, Homo Sapiens
GAPLKLKCK

SEQ ID NO: 38491 - protein, 9 aa, Homo Sapiens
DTAVFEKGM

SEQ ID NO: 38492 - protein, 9 aa, Homo Sapiens
DGKTLHRQS

SEQ ID NO: 38493 - protein, 9 aa, Homo Sapiens
WNLNPVFGG

SEQ ID NO: 38494 - protein, 9 aa, Homo Sapiens
TKEVGGQQL

SEQ ID NO: 38495 - protein, 9 aa, Homo Sapiens
DDRFSQSST

SEQ ID NO: 38496 - protein, 9 aa, Homo Sapiens
NITRDFFHP

SEQ ID NO: 38497 - protein, 9 aa, Homo Sapiens
IRMLNADLM

SEQ ID NO: 38498 - protein, 9 aa, Homo Sapiens
PPPKMPPPH

SEQ ID NO: 38499 - protein, 9 aa, Homo Sapiens
FPLSGSFYK

SEQ ID NO: 38500 - protein, 9 aa, Homo Sapiens
EQHELIQSG

SEQ ID NO: 38501 - protein, 9 aa, Homo Sapiens
ESKRLVDTT

SEQ ID NO: 38502 - protein, 9 aa, Homo Sapiens
PELEAEPAK

SEQ ID NO: 38503 - protein, 9 aa, Homo Sapiens
SMALADTAV

SEQ ID NO: 38504 - protein, 9 aa, Homo Sapiens
FGAAPSHLP

SEQ ID NO: 38505 - protein, 9 aa, Homo Sapiens
RLRLQRIRM

SEQ ID NO: 38506 - protein, 9 aa, Homo Sapiens
WSSIPALAP

SEQ ID NO: 38507 - protein, 9 aa, Homo Sapiens
NPRFDGWDN

SEQ ID NO: 38508 - protein, 9 aa, Homo Sapiens
SPVLESPHD

SEQ ID NO: 38509 - protein, 9 aa, Homo Sapiens
FVAHLTVQP

SEQ ID NO: 38510 - protein, 9 aa, Homo Sapiens
PHDLQFSEI

SEQ ID NO: 38511 - protein, 9 aa, Homo Sapiens
MCFTYQSTY

SEQ ID NO: 38512 - protein, 9 aa, Homo Sapiens
CGPIPSCAL

SEQ ID NO: 38513 - protein, 9 aa, Homo Sapiens
MALADTAVF

SEQ ID NO: 38514 - protein, 9 aa, Homo Sapiens
DRPHSVSSP

SEQ ID NO: 38515 - protein, 9 aa, Homo Sapiens
LQRIRMLNA

SEQ ID NO: 38516 - protein, 9 aa, Homo Sapiens
NYRLHRPVH

SEQ ID NO: 38517 - protein, 9 aa, Homo Sapiens
SDNGCEVNN

SEQ ID NO: 38518 - protein, 9 aa, Homo Sapiens
ADTAVFEKG

SEQ ID NO: 38519 - protein, 9 aa, Homo Sapiens
FMYRRRQPI

SEQ ID NO: 38520 - protein, 9 aa, Homo Sapiens
HSVSSPVVQ

SEQ ID NO: 38521 - protein, 9 aa, Homo Sapiens
EAEGSSLLF

SEQ ID NO: 38522 - protein, 9 aa, Homo Sapiens
VSPLATTED

SEQ ID NO: 38523 - protein, 9 aa, Homo Sapiens
AVLTFNGIS

SEQ ID NO: 38524 - protein, 9 aa, Homo Sapiens
WRKNANGRY

SEQ ID NO: 38525 - protein, 9 aa, Homo Sapiens
GPYLQFWAG

SEQ ID NO: 38526 - protein, 9 aa, Homo Sapiens
SRLSASQIW

SEQ ID NO: 38527 - protein, 9 aa, Homo Sapiens
KDILKLIQH

SEQ ID NO: 38528 - protein, 9 aa, Homo Sapiens
RQSTSCGNY

SEQ ID NO: 38529 - protein, 9 aa, Homo Sapiens
IPSCALTNA

SEQ ID NO: 38530 - protein, 9 aa, Homo Sapiens
PRFDGWDNV

SEQ ID NO: 38531 - protein, 9 aa, Homo Sapiens
RGTSGENNN

SEQ ID NO: 38532 - protein, 9 aa, Homo Sapiens
GCEVNNRKS

SEQ ID NO: 38533 - protein, 9 aa, Homo Sapiens
AGVCARRPV

SEQ ID NO: 38534 - protein, 9 aa, Homo Sapiens
AQLIHSLTA

SEQ ID NO: 38535 - protein, 9 aa, Homo Sapiens
RWSSIPALA

SEQ ID NO: 38536 - protein, 9 aa, Homo Sapiens
RLLEGGREP

SEQ ID NO: 38537 - protein, 9 aa, Homo Sapiens
FQGVNQICL

SEQ ID NO: 38538 - protein, 9 aa, Homo Sapiens
VVADELKIP

SEQ ID NO: 38539 - protein, 9 aa, Homo Sapiens
SPLATTEDS

SEQ ID NO: 38540 - protein, 9 aa, Homo Sapiens
GTEQHELIQ

SEQ ID NO: 38541 - protein, 9 aa, Homo Sapiens
RTVLWGTCG

SEQ ID NO: 38542 - protein, 9 aa, Homo Sapiens
ERLGRKVSP

SEQ ID NO: 38543 - protein, 9 aa, Homo Sapiens
NLPWSAAHN

SEQ ID NO: 38544 - protein, 9 aa, Homo Sapiens
QSTSCGNYR

SEQ ID NO: 38545 - protein, 9 aa, Homo Sapiens
EQPGPQRLS

SEQ ID NO: 38546 - protein, 9 aa, Homo Sapiens
VGGQQLREG

SEQ ID NO: 38547 - protein, 9 aa, Homo Sapiens
GQQLREGLQ

SEQ ID NO: 38548 - protein, 9 aa, Homo Sapiens
ISGPTNTRR

SEQ ID NO: 38549 - protein, 9 aa, Homo Sapiens
WPSCGPIPS

SEQ ID NO: 38550 - protein, 9 aa, Homo Sapiens
SASCRAAPP

SEQ ID NO: 38551 - protein, 9 aa, Homo Sapiens
TTIFGGLHT

SEQ ID NO: 38552 - protein, 9 aa, Homo Sapiens
LTFCLWLAA

SEQ ID NO: 38553 - protein, 9 aa, Homo Sapiens
PVKWFKVGE

SEQ ID NO: 38554 - protein, 9 aa, Homo Sapiens
MVALKDINK

SEQ ID NO: 38555 - protein, 9 aa, Homo Sapiens
PDSIAAGRH

SEQ ID NO: 38556 - protein, 9 aa, Homo Sapiens
KSMALADTA

SEQ ID NO: 38557 - protein, 9 aa, Homo Sapiens
ILDRPHSVS

SEQ ID NO: 38558 - protein, 9 aa, Homo Sapiens
LADTAVFEK

SEQ ID NO: 38559 - protein, 9 aa, Homo Sapiens
QICLSGELA

SEQ ID NO: 38560 - protein, 9 aa, Homo Sapiens
HPEPATTCR

SEQ ID NO: 38561 - protein, 9 aa, Homo Sapiens
RSHSELAEG

SEQ ID NO: 38562 - protein, 9 aa, Homo Sapiens
HSLSSSSSA

SEQ ID NO: 38563 - protein, 9 aa, Homo Sapiens
NVSFPAIVQ

SEQ ID NO: 38564 - protein, 9 aa, Homo Sapiens
REQDHSLSS

SEQ ID NO: 38565 - protein, 9 aa, Homo Sapiens
KYAGIFYFR

SEQ ID NO: 38566 - protein, 9 aa, Homo Sapiens
SVSSPVVQE

SEQ ID NO: 38567 - protein, 9 aa, Homo Sapiens
NQICLSGEL

SEQ ID NO: 38568 - protein, 9 aa, Homo Sapiens
LVDTTMYAT

SEQ ID NO: 38569 - protein, 9 aa, Homo Sapiens
TQLRYTIVH

SEQ ID NO: 38570 - protein, 9 aa, Homo Sapiens
LSASQIWNL

SEQ ID NO: 38571 - protein, 9 aa, Homo Sapiens
VHGTKNMQT

SEQ ID NO: 38572 - protein, 9 aa, Homo Sapiens
QDGYKLHSR

SEQ ID NO: 38573 - protein, 9 aa, Homo Sapiens
SPNTPLLRL

SEQ ID NO: 38574 - protein, 9 aa, Homo Sapiens
LIQHHYNLK

SEQ ID NO: 38575 - protein, 9 aa, Homo Sapiens
GLALGEPQV

SEQ ID NO: 38576 - protein, 9 aa, Homo Sapiens
LKNFVKIAR

SEQ ID NO: 38577 - protein, 9 aa, Homo Sapiens
PTNTRRPPL

SEQ ID NO: 38578 - protein, 9 aa, Homo Sapiens
YKLHSRTIR

SEQ ID NO: 38579 - protein, 9 aa, Homo Sapiens
YFRFWHFGE

SEQ ID NO: 38580 - protein, 9 aa, Homo Sapiens
PLSGSFYKS

SEQ ID NO: 38581 - protein, 9 aa, Homo Sapiens
HGPSADVQR

SEQ ID NO: 38582 - protein, 9 aa, Homo Sapiens
SRTVLWGTC

SEQ ID NO: 38583 - protein, 9 aa, Homo Sapiens
ANGRYVCNA

SEQ ID NO: 38584 - protein, 9 aa, Homo Sapiens
RGNADFPLS

SEQ ID NO: 38585 - protein, 9 aa, Homo Sapiens
LFLPPPPPP

SEQ ID NO: 38586 - protein, 9 aa, Homo Sapiens
KNGSSFHKK

SEQ ID NO: 38587 - protein, 9 aa, Homo Sapiens
HAGGPSCCC

SEQ ID NO: 38588 - protein, 9 aa, Homo Sapiens
VCCLLCDCP

SEQ ID NO: 38589 - protein, 9 aa, Homo Sapiens
FFVSALPHD

SEQ ID NO: 38590 - protein, 9 aa, Homo Sapiens
PYLQFWAGR

SEQ ID NO: 38591 - protein, 9 aa, Homo Sapiens
PIPSCALTN

SEQ ID NO: 38592 - protein, 9 aa, Homo Sapiens
MDDEESWVK

SEQ ID NO: 38593 - protein, 9 aa, Homo Sapiens
LRSRTVLWG

SEQ ID NO: 38594 - protein, 9 aa, Homo Sapiens
SWAQNLYEL

SEQ ID NO: 38595 - protein, 9 aa, Homo Sapiens
SCGNYRGRF

SEQ ID NO: 38596 - protein, 9 aa, Homo Sapiens
DGSPHDDRF

SEQ ID NO: 38597 - protein, 9 aa, Homo Sapiens
HNHDWRHGF

SEQ ID NO: 38598 - protein, 9 aa, Homo Sapiens
GEEEEEEDT

SEQ ID NO: 38599 - protein, 9 aa, Homo Sapiens
MLLKRNPAN

SEQ ID NO: 38600 - protein, 9 aa, Homo Sapiens
AAHPTNLPW

SEQ ID NO: 38601 - protein, 9 aa, Homo Sapiens
GSFLGMLVL

SEQ ID NO: 38602 - protein, 9 aa, Homo Sapiens
IPDHVRERE

SEQ ID NO: 38603 - protein, 9 aa, Homo Sapiens
GGPSCCCFH

SEQ ID NO: 38604 - protein, 9 aa, Homo Sapiens
PGTEQHELI

SEQ ID NO: 38605 - protein, 9 aa, Homo Sapiens
LLRMLLKRN

SEQ ID NO: 38606 - protein, 9 aa, Homo Sapiens
CRVCCLLCD

SEQ ID NO: 38607 - protein, 9 aa, Homo Sapiens
RQPIQLLVE

SEQ ID NO: 38608 - protein, 9 aa, Homo Sapiens
QGPGMVVAD

SEQ ID NO: 38609 - protein, 9 aa, Homo Sapiens
PHDPEHGPS

SEQ ID NO: 38610 - protein, 9 aa, Homo Sapiens
GGQQLREGL

SEQ ID NO: 38611 - protein, 9 aa, Homo Sapiens
NIIGSQKFV

SEQ ID NO: 38612 - protein, 9 aa, Homo Sapiens
LKSMALADT

SEQ ID NO: 38613 - protein, 9 aa, Homo Sapiens
LRLVEGYGP

SEQ ID NO: 38614 - protein, 9 aa, Homo Sapiens
KMPPPHDPE

SEQ ID NO: 38615 - protein, 9 aa, Homo Sapiens
LLLLLFPPF

SEQ ID NO: 38616 - protein, 9 aa, Homo Sapiens
RWKRSTFQG

SEQ ID NO: 38617 - protein, 9 aa, Homo Sapiens
NGSSSDSCV

SEQ ID NO: 38618 - protein, 9 aa, Homo Sapiens
TIFGGLHTG

SEQ ID NO: 38619 - protein, 9 aa, Homo Sapiens
SALRPALLW

SEQ ID NO: 38620 - protein, 9 aa, Homo Sapiens
EAQLIHSLT

SEQ ID NO: 38621 - protein, 9 aa, Homo Sapiens
PIVHGTKNM

SEQ ID NO: 38622 - protein, 9 aa, Homo Sapiens
YTIVHFGER

SEQ ID NO: 38623 - protein, 9 aa, Homo Sapiens
LKDINKVMA

SEQ ID NO: 38624 - protein, 9 aa, Homo Sapiens
QLRYTIVHF

SEQ ID NO: 38625 - protein, 9 aa, Homo Sapiens
PILDRPHSV

SEQ ID NO: 38626 - protein, 9 aa, Homo Sapiens
PKMPPPHDP

SEQ ID NO: 38627 - protein, 9 aa, Homo Sapiens
FEYKECGKA

SEQ ID NO: 38628 - protein, 9 aa, Homo Sapiens
SSLLFLPPP

SEQ ID NO: 38629 - protein, 9 aa, Homo Sapiens
DVPVKWFKV

SEQ ID NO: 38630 - protein, 9 aa, Homo Sapiens
FTYQSTYAH

SEQ ID NO: 38631 - protein, 9 aa, Homo Sapiens
FNGISGPTN

SEQ ID NO: 38632 - protein, 9 aa, Homo Sapiens
SLLNGRQEE

SEQ ID NO: 38633 - protein, 9 aa, Homo Sapiens
KTDSEEGSL

SEQ ID NO: 38634 - protein, 9 aa, Homo Sapiens
GVPGAVLTF

SEQ ID NO: 38635 - protein, 9 aa, Homo Sapiens
EVNNRKSIL

SEQ ID NO: 38636 - protein, 9 aa, Homo Sapiens
DILKLIQHH

SEQ ID NO: 38637 - protein, 9 aa, Homo Sapiens
PQVPPDSIA

SEQ ID NO: 38638 - protein, 9 aa, Homo Sapiens
DEESWVKEK

SEQ ID NO: 38639 - protein, 9 aa, Homo Sapiens
ESWVKEKKL

SEQ ID NO: 38640 - protein, 9 aa, Homo Sapiens
MVQDQLRNN

SEQ ID NO: 38641 - protein, 9 aa, Homo Sapiens
TEAIKYLKN

SEQ ID NO: 38642 - protein, 9 aa, Homo Sapiens
LNYRLHRPV

SEQ ID NO: 38643 - protein, 9 aa, Homo Sapiens
RPHSVSSPV

SEQ ID NO: 38644 - protein, 9 aa, Homo Sapiens
MVDGRNIYE

SEQ ID NO: 38645 - protein, 9 aa, Homo Sapiens
IVHGTKNMQ

SEQ ID NO: 38646 - protein, 9 aa, Homo Sapiens
PVLESPHDL

SEQ ID NO: 38647 - protein, 9 aa, Homo Sapiens
NVVFNTLQG

SEQ ID NO: 38648 - protein, 9 aa, Homo Sapiens
ATKKDQGFP

SEQ ID NO: 38649 - protein, 9 aa, Homo Sapiens
LQMCFTYQS

SEQ ID NO: 38650 - protein, 9 aa, Homo Sapiens
MLNADLMTL

SEQ ID NO: 38651 - protein, 9 aa, Homo Sapiens
MLSLLNGRQ

SEQ ID NO: 38652 - protein, 9 aa, Homo Sapiens
RLHRPVHPE

SEQ ID NO: 38653 - protein, 9 aa, Homo Sapiens
TGGKPFEYK

SEQ ID NO: 38654 - protein, 9 aa, Homo Sapiens
DNGCEVNNR

SEQ ID NO: 38655 - protein, 9 aa, Homo Sapiens
IKYLKNFVK

SEQ ID NO: 38656 - protein, 9 aa, Homo Sapiens
IAAGRHAGG

SEQ ID NO: 38657 - protein, 9 aa, Homo Sapiens
RMLNADLMT

SEQ ID NO: 38658 - protein, 9 aa, Homo Sapiens
STYAHQWIR

SEQ ID NO: 38659 - protein, 9 aa, Homo Sapiens
AAGRHAGGP

SEQ ID NO: 38660 - protein, 9 aa, Homo Sapiens
RWPSCGPIP

SEQ ID NO: 38661 - protein, 9 aa, Homo Sapiens
SLAQTLAYG

SEQ ID NO: 38662 - protein, 9 aa, Homo Sapiens
LQTIYVTAL

SEQ ID NO: 38663 - protein, 9 aa, Homo Sapiens
ALGEPQVPP

SEQ ID NO: 38664 - protein, 9 aa, Homo Sapiens
LRGEYVDWS

SEQ ID NO: 38665 - protein, 9 aa, Homo Sapiens
RRQPIQLLV

SEQ ID NO: 38666 - protein, 9 aa, Homo Sapiens
EESWVKEKK

SEQ ID NO: 38667 - protein, 9 aa, Homo Sapiens
GKHKVACLV

SEQ ID NO: 38668 - protein, 9 aa, Homo Sapiens
YRRRQPIQL

SEQ ID NO: 38669 - protein, 9 aa, Homo Sapiens
QALTPVWRV

SEQ ID NO: 38670 - protein, 9 aa, Homo Sapiens
IDEIRMQLQ

SEQ ID NO: 38671 - protein, 9 aa, Homo Sapiens
KCKLCGRVD

SEQ ID NO: 38672 - protein, 9 aa, Homo Sapiens
LGRKVSPLA

SEQ ID NO: 38673 - protein, 9 aa, Homo Sapiens
FRRYFTWGR

SEQ ID NO: 38674 - protein, 9 aa, Homo Sapiens
GIEESVSWG

SEQ ID NO: 38675 - protein, 9 aa, Homo Sapiens
KHKVACLVP

SEQ ID NO: 38676 - protein, 9 aa, Homo Sapiens
VPPDSIAAG

SEQ ID NO: 38677 - protein, 9 aa, Homo Sapiens
EALLKAFGA

SEQ ID NO: 38678 - protein, 9 aa, Homo Sapiens
SSIPALAPL

SEQ ID NO: 38679 - protein, 9 aa, Homo Sapiens
CRAAPPGTH

SEQ ID NO: 38680 - protein, 9 aa, Homo Sapiens
HQWIRGNAD

SEQ ID NO: 38681 - protein, 9 aa, Homo Sapiens
CYHRGKHKV

SEQ ID NO: 38682 - protein, 9 aa, Homo Sapiens
HKCGTQLRY

SEQ ID NO: 38683 - protein, 9 aa, Homo Sapiens
IPALAPLTY

SEQ ID NO: 38684 - protein, 9 aa, Homo Sapiens
LSGSFYKSL

SEQ ID NO: 38685 - protein, 9 aa, Homo Sapiens
PENFTRCLD

SEQ ID NO: 38686 - protein, 9 aa, Homo Sapiens
RIRMLNADL

SEQ ID NO: 38687 - protein, 9 aa, Homo Sapiens
APPGTHLQA

SEQ ID NO: 38688 - protein, 9 aa, Homo Sapiens
GKNGSSFHK

SEQ ID NO: 38689 - protein, 9 aa, Homo Sapiens
RLVDTTMYA

SEQ ID NO: 38690 - protein, 9 aa, Homo Sapiens
HTGGKPFEY

SEQ ID NO: 38691 - protein, 9 aa, Homo Sapiens
ESGIEESVS

SEQ ID NO: 38692 - protein, 9 aa, Homo Sapiens
LSWGPYLQF

SEQ ID NO: 38693 - protein, 9 aa, Homo Sapiens
PFEYKECGK

SEQ ID NO: 38694 - protein, 9 aa, Homo Sapiens
TRRPPLRRS

SEQ ID NO: 38695 - protein, 9 aa, Homo Sapiens
RMLLKRNPA

SEQ ID NO: 38696 - protein, 9 aa, Homo Sapiens
TLMDLVLFE

SEQ ID NO: 38697 - protein, 9 aa, Homo Sapiens
YYATYCQTR

SEQ ID NO: 38698 - protein, 9 aa, Homo Sapiens
YLLPIVHGT

SEQ ID NO: 38699 - protein, 9 aa, Homo Sapiens
GVNQICLSG

SEQ ID NO: 38700 - protein, 9 aa, Homo Sapiens
HLNYRLHRP

SEQ ID NO: 38701 - protein, 9 aa, Homo Sapiens
CCCRVCCLL

SEQ ID NO: 38702 - protein, 9 aa, Homo Sapiens
SKRLVDTTM

SEQ ID NO: 38703 - protein, 9 aa, Homo Sapiens
IQLLVELLW

SEQ ID NO: 38704 - protein, 9 aa, Homo Sapiens
TEQHELIQS

SEQ ID NO: 38705 - protein, 9 aa, Homo Sapiens
PGAVLTFCL

SEQ ID NO: 38706 - protein, 9 aa, Homo Sapiens
GTSGENNNP

SEQ ID NO: 38707 - protein, 9 aa, Homo Sapiens
TFGPELEAE

SEQ ID NO: 38708 - protein, 9 aa, Homo Sapiens
FLQMCFTYQ

SEQ ID NO: 38709 - protein, 9 aa, Homo Sapiens
YFAQPVMMI

SEQ ID NO: 38710 - protein, 9 aa, Homo Sapiens
LTNAEAAHP

SEQ ID NO: 38711 - protein, 9 aa, Homo Sapiens
IDGSFLGML

SEQ ID NO: 38712 - protein, 9 aa, Homo Sapiens
DSCVGEKLG

SEQ ID NO: 38713 - protein, 9 aa, Homo Sapiens
VYDGKTLHR

SEQ ID NO: 38714 - protein, 9 aa, Homo Sapiens
QTRLLIHSM

SEQ ID NO: 38715 - protein, 9 aa, Homo Sapiens
EGRQADRNS

SEQ ID NO: 38716 - protein, 9 aa, Homo Sapiens
SSLDVTSDF

SEQ ID NO: 38717 - protein, 9 aa, Homo Sapiens
VCYHRGKHK

SEQ ID NO: 38718 - protein, 9 aa, Homo Sapiens
HKVACLVPG

SEQ ID NO: 38719 - protein, 9 aa, Homo Sapiens
SDLLLLLFP

SEQ ID NO: 38720 - protein, 9 aa, Homo Sapiens
DHSLSSSSS

SEQ ID NO: 38721 - protein, 9 aa, Homo Sapiens
GARRWSSIP

SEQ ID NO: 38722 - protein, 9 aa, Homo Sapiens
HIAIQGIMN

SEQ ID NO: 38723 - protein, 9 aa, Homo Sapiens
LHRQSTSCG

SEQ ID NO: 38724 - protein, 9 aa, Homo Sapiens
LHTGKMVML

SEQ ID NO: 38725 - protein, 9 aa, Homo Sapiens
SLDVTSDFL

SEQ ID NO: 38726 - protein, 9 aa, Homo Sapiens
QDHSLSSSS

SEQ ID NO: 38727 - protein, 9 aa, Homo Sapiens
KRLVDTTMY

SEQ ID NO: 38728 - protein, 9 aa, Homo Sapiens
GRYVCNACG

SEQ ID NO: 38729 - protein, 9 aa, Homo Sapiens
TPLLRLVEG

SEQ ID NO: 38730 - protein, 9 aa, Homo Sapiens
EPATTCRWP

SEQ ID NO: 38731 - protein, 9 aa, Homo Sapiens
LFPPFRMVE

SEQ ID NO: 38732 - protein, 9 aa, Homo Sapiens
AIQGIMNLG

SEQ ID NO: 38733 - protein, 9 aa, Homo Sapiens
QGIMNLGTL

SEQ ID NO: 38734 - protein, 9 aa, Homo Sapiens
DQLRNNYQI

SEQ ID NO: 38735 - protein, 9 aa, Homo Sapiens
VPGREAQLI

SEQ ID NO: 38736 - protein, 9 aa, Homo Sapiens
IWNLNPVFG

SEQ ID NO: 38737 - protein, 9 aa, Homo Sapiens
PLKLKCKLC

SEQ ID NO: 38738 - protein, 9 aa, Homo Sapiens
CQEHIAIQG

SEQ ID NO: 38739 - protein, 9 aa, Homo Sapiens
QWIRGNADF

SEQ ID NO: 38740 - protein, 9 aa, Homo Sapiens
SSDNGCEVN

SEQ ID NO: 38741 - protein, 9 aa, Homo Sapiens
SITHLNYRL

SEQ ID NO: 38742 - protein, 9 aa, Homo Sapiens
LGEPQVPPD

SEQ ID NO: 38743 - protein, 9 aa, Homo Sapiens
VWRVLHPWV

SEQ ID NO: 38744 - protein, 9 aa, Homo Sapiens
RLSASQIWN

SEQ ID NO: 38745 - protein, 9 aa, Homo Sapiens
YYRTIIGLH

SEQ ID NO: 38746 - protein, 9 aa, Homo Sapiens
QEHIAIQGI

SEQ ID NO: 38747 - protein, 9 aa, Homo Sapiens
YATYCQTRL

SEQ ID NO: 38748 - protein, 9 aa, Homo Sapiens
LQFWAGRIA

SEQ ID NO: 38749 - protein, 9 aa, Homo Sapiens
TYAHQWIRG

SEQ ID NO: 38750 - protein, 9 aa, Homo Sapiens
HGTKNMQTT

SEQ ID NO: 38751 - protein, 9 aa, Homo Sapiens
GRQEERLRE

SEQ ID NO: 38752 - protein, 9 aa, Homo Sapiens
VYQCPHQLM

SEQ ID NO: 38753 - protein, 9 aa, Homo Sapiens
ALLKAFGAA

SEQ ID NO: 38754 - protein, 9 aa, Homo Sapiens
SIAAGRHAG

SEQ ID NO: 38755 - protein, 9 aa, Homo Sapiens
DGSFLGMLV

SEQ ID NO: 38756 - protein, 9 aa, Homo Sapiens
RYVCNACGL

SEQ ID NO: 38757 - protein, 9 aa, Homo Sapiens
VHSPGINPQ

SEQ ID NO: 38758 - protein, 9 aa, Homo Sapiens
SDSCVGEKL

SEQ ID NO: 38759 - protein, 9 aa, Homo Sapiens
DERLLEGGR

SEQ ID NO: 38760 - protein, 9 aa, Homo Sapiens
FAQPVMMIP

SEQ ID NO: 38761 - protein, 9 aa, Homo Sapiens
NHNEVNTLM

SEQ ID NO: 38762 - protein, 9 aa, Homo Sapiens
GKSVHVKDK

SEQ ID NO: 38763 - protein, 9 aa, Homo Sapiens
CQTRLLIHS

SEQ ID NO: 38764 - protein, 9 aa, Homo Sapiens
DEIRMQLQE

SEQ ID NO: 38765 - protein, 9 aa, Homo Sapiens
PNTPLLRLV

SEQ ID NO: 38766 - protein, 9 aa, Homo Sapiens
VKEKKLLVG

SEQ ID NO: 38767 - protein, 9 aa, Homo Sapiens
FYFRFWHFG

SEQ ID NO: 38768 - protein, 9 aa, Homo Sapiens
EGSSLLFLP

SEQ ID NO: 38769 - protein, 9 aa, Homo Sapiens
LLLLFPPFR

SEQ ID NO: 38770 - protein, 9 aa, Homo Sapiens
NGSSFHKKK

SEQ ID NO: 38771 - protein, 9 aa, Homo Sapiens
LALGEPQVP

SEQ ID NO: 38772 - protein, 9 aa, Homo Sapiens
SCTKEVGGQ

SEQ ID NO: 38773 - protein, 9 aa, Homo Sapiens
HSPGINPQV

SEQ ID NO: 38774 - protein, 9 aa, Homo Sapiens
LAQTLAYGD

SEQ ID NO: 38775 - protein, 9 aa, Homo Sapiens
VLWGTCGQP

SEQ ID NO: 38776 - protein, 9 aa, Homo Sapiens
VNQICLSGE

SEQ ID NO: 38777 - protein, 9 aa, Homo Sapiens
INPQVSHDA

SEQ ID NO: 38778 - protein, 9 aa, Homo Sapiens
KTLHRQSTS

SEQ ID NO: 38779 - protein, 9 aa, Homo Sapiens
WDNVVFNTL

SEQ ID NO: 38780 - protein, 9 aa, Homo Sapiens
QSTYAHQWI

SEQ ID NO: 38781 - protein, 9 aa, Homo Sapiens
GSQKFVAHL

SEQ ID NO: 38782 - protein, 9 aa, Homo Sapiens
GRQADRNSD

SEQ ID NO: 38783 - protein, 9 aa, Homo Sapiens
GTHLQALTP

SEQ ID NO: 38784 - protein, 9 aa, Homo Sapiens
SIPALAPLT

SEQ ID NO: 38785 - protein, 9 aa, Homo Sapiens
ACLVPGREA

SEQ ID NO: 38786 - protein, 9 aa, Homo Sapiens
HDPEHGPSA

SEQ ID NO: 38787 - protein, 9 aa, Homo Sapiens
TIIGLHFLP

SEQ ID NO: 38788 - protein, 9 aa, Homo Sapiens
LKRNPANRL

SEQ ID NO: 38789 - protein, 9 aa, Homo Sapiens
GREPLLQEE

SEQ ID NO: 38790 - protein, 9 aa, Homo Sapiens
GRWKRSTFQ

SEQ ID NO: 38791 - protein, 9 aa, Homo Sapiens
CTKEVGGQQ

SEQ ID NO: 38792 - protein, 9 aa, Homo Sapiens
YQSTYAHQW

SEQ ID NO: 38793 - protein, 9 aa, Homo Sapiens
FKATKKDQG

SEQ ID NO: 38794 - protein, 9 aa, Homo Sapiens
QTIYVTALY

SEQ ID NO: 38795 - protein, 9 aa, Homo Sapiens
ALTPVWRVL

SEQ ID NO: 38796 - protein, 9 aa, Homo Sapiens
LPWSAAHNH

SEQ ID NO: 38797 - protein, 9 aa, Homo Sapiens
MGAFTFFVS

SEQ ID NO: 38798 - protein, 9 aa, Homo Sapiens
TFQGVNQIC

SEQ ID NO: 38799 - protein, 9 aa, Homo Sapiens
ADELKIPIR

SEQ ID NO: 38800 - protein, 9 aa, Homo Sapiens
GKPFEYKEC

SEQ ID NO: 38801 - protein, 9 aa, Homo Sapiens
PGINPQVSH

SEQ ID NO: 38802 - protein, 9 aa, Homo Sapiens
LKAFGAAPS

SEQ ID NO: 38803 - protein, 9 aa, Homo Sapiens
RMQLQEIRK

SEQ ID NO: 38804 - protein, 9 aa, Homo Sapiens
MVVADELKI

SEQ ID NO: 38805 - protein, 9 aa, Homo Sapiens
TGKMVMLQG

SEQ ID NO: 38806 - protein, 9 aa, Homo Sapiens
AAPPGTHLQ

SEQ ID NO: 38807 - protein, 9 aa, Homo Sapiens
RYTIVHFGE

SEQ ID NO: 38808 - protein, 9 aa, Homo Sapiens
GTQLRYTIV

SEQ ID NO: 38809 - protein, 9 aa, Homo Sapiens
TSGENNNPG

SEQ ID NO: 38810 - protein, 9 aa, Homo Sapiens
GSLAQTLAY

SEQ ID NO: 38811 - protein, 9 aa, Homo Sapiens
ADRNSDYAI

SEQ ID NO: 38812 - protein, 9 aa, Homo Sapiens
RDFFHPLYP

SEQ ID NO: 38813 - protein, 9 aa, Homo Sapiens
TQGPGMVVA

SEQ ID NO: 38814 - protein, 9 aa, Homo Sapiens
TYQSTYAHQ

SEQ ID NO: 38815 - protein, 9 aa, Homo Sapiens
DVGASWSAA

SEQ ID NO: 38816 - protein, 9 aa, Homo Sapiens
FPENFTRCL

SEQ ID NO: 38817 - protein, 9 aa, Homo Sapiens
TPVWRVLHP

SEQ ID NO: 38818 - protein, 9 aa, Homo Sapiens
RQADRNSDY

SEQ ID NO: 38819 - protein, 9 aa, Homo Sapiens
RPPLRRSSA

SEQ ID NO: 38820 - protein, 9 aa, Homo Sapiens
KPKKSWAQN

SEQ ID NO: 38821 - protein, 9 aa, Homo Sapiens
PGPQRLSGL

SEQ ID NO: 38822 - protein, 9 aa, Homo Sapiens
LRRSSASCR

SEQ ID NO: 38823 - protein, 9 aa, Homo Sapiens
ALKDINKVM

SEQ ID NO: 38824 - protein, 9 aa, Homo Sapiens
HELIQSGRF

SEQ ID NO: 38825 - protein, 9 aa, Homo Sapiens
DHVRERELG

SEQ ID NO: 38826 - protein, 9 aa, Homo Sapiens
LLEGGREPL

SEQ ID NO: 38827 - protein, 9 aa, Homo Sapiens
SHSELAEGA

SEQ ID NO: 38828 - protein, 9 aa, Homo Sapiens
HFLRGEYVD

SEQ ID NO: 38829 - protein, 9 aa, Homo Sapiens
CGTQLRYTI

SEQ ID NO: 38830 - protein, 9 aa, Homo Sapiens
YLHTYESGI

SEQ ID NO: 38831 - protein, 9 aa, Homo Sapiens
DVTSDFLQM

SEQ ID NO: 38832 - protein, 9 aa, Homo Sapiens
QPGTEQHEL

SEQ ID NO: 38833 - protein, 9 aa, Homo Sapiens
AIVQLHTAV

SEQ ID NO: 38834 - protein, 9 aa, Homo Sapiens
ALTNAEAAH

SEQ ID NO: 38835 - protein, 9 aa, Homo Sapiens
APSPVTNAG

SEQ ID NO: 38836 - protein, 9 aa, Homo Sapiens
GSSSDSCVG

SEQ ID NO: 38837 - protein, 9 aa, Homo Sapiens
QPIQLLVEL

SEQ ID NO: 38838 - protein, 9 aa, Homo Sapiens
AEAAHPTNL

SEQ ID NO: 38839 - protein, 9 aa, Homo Sapiens
QPVMMIPEE

SEQ ID NO: 38840 - protein, 9 aa, Homo Sapiens
QPGPQRLSG

SEQ ID NO: 38841 - protein, 9 aa, Homo Sapiens
EDERLLEGG

SEQ ID NO: 38842 - protein, 9 aa, Homo Sapiens
ATTCRWPSC

SEQ ID NO: 38843 - protein, 9 aa, Homo Sapiens
VNNRKSILS

SEQ ID NO: 38844 - protein, 9 aa, Homo Sapiens
CCRVCCLLC

SEQ ID NO: 38845 - protein, 9 aa, Homo Sapiens
VPGAVLTFC

SEQ ID NO: 38846 - protein, 9 aa, Homo Sapiens
QVNVSFPAI

SEQ ID NO: 38847 - protein, 9 aa, Homo Sapiens
FCLWLAASS

SEQ ID NO: 38848 - protein, 9 aa, Homo Sapiens
LIHSLTAPN

SEQ ID NO: 38849 - protein, 9 aa, Homo Sapiens
SGLQRGTSG

SEQ ID NO: 38850 - protein, 9 aa, Homo Sapiens
EESVSWGTQ

SEQ ID NO: 38851 - protein, 9 aa, Homo Sapiens
VHPEPATTC

SEQ ID NO: 38852 - protein, 9 aa, Homo Sapiens
AGFQGRRSH

SEQ ID NO: 38853 - protein, 9 aa, Homo Sapiens
TNAEAAHPT

SEQ ID NO: 38854 - protein, 9 aa, Homo Sapiens
TCRWPSCGP

SEQ ID NO: 38855 - protein, 9 aa, Homo Sapiens
KYLKNFVKI

SEQ ID NO: 38856 - protein, 9 aa, Homo Sapiens
LVPGREAQL

SEQ ID NO: 38857 - protein, 9 aa, Homo Sapiens
GTFSKSSLD

SEQ ID NO: 38858 - protein, 9 aa, Homo Sapiens
SSASCRAAP

SEQ ID NO: 38859 - protein, 9 aa, Homo Sapiens
AGLALGEPQ

SEQ ID NO: 38860 - protein, 9 aa, Homo Sapiens
GGREPLLQE

SEQ ID NO: 38861 - protein, 9 aa, Homo Sapiens
RSRTVLWGT

SEQ ID NO: 38862 - protein, 9 aa, Homo Sapiens
HPLYPGTKY

SEQ ID NO: 38863 - protein, 9 aa, Homo Sapiens
LKLKCKLCG

SEQ ID NO: 38864 - protein, 9 aa, Homo Sapiens
VACLVPGRE

SEQ ID NO: 38865 - protein, 9 aa, Homo Sapiens
KSSLDVTSD

SEQ ID NO: 38866 - protein, 9 aa, Homo Sapiens
ASWSAAAAA

SEQ ID NO: 38867 - protein, 9 aa, Homo Sapiens
PNLGTFSKS

SEQ ID NO: 38868 - protein, 9 aa, Homo Sapiens
SLLFLPPPP

SEQ ID NO: 38869 - protein, 9 aa, Homo Sapiens
RQDGYKLHS

SEQ ID NO: 38870 - protein, 9 aa, Homo Sapiens
DFFHPLYPG

SEQ ID NO: 38871 - protein, 9 aa, Homo Sapiens
YAGIFYFRF

SEQ ID NO: 38872 - protein, 9 aa, Homo Sapiens
SPGINPQVS

SEQ ID NO: 38873 - protein, 9 aa, Homo Sapiens
MPPPHDPEH

SEQ ID NO: 38874 - protein, 9 aa, Homo Sapiens
QLIHSLTAP

SEQ ID NO: 38875 - protein, 9 aa, Homo Sapiens
LDVTSDFLQ

SEQ ID NO: 38876 - protein, 9 aa, Homo Sapiens
SCRAAPPGT

SEQ ID NO: 38877 - protein, 9 aa, Homo Sapiens
DFPLSGSFY

SEQ ID NO: 38878 - protein, 9 aa, Homo Sapiens
RFDGWDNVV

SEQ ID NO: 38879 - protein, 9 aa, Homo Sapiens
NADFPLSGS

SEQ ID NO: 38880 - protein, 9 aa, Homo Sapiens
VLKCCTLKI

SEQ ID NO: 38881 - protein, 9 aa, Homo Sapiens
KVSPLATTE

SEQ ID NO: 38882 - protein, 9 aa, Homo Sapiens
MSALRPALL

SEQ ID NO: 38883 - protein, 9 aa, Homo Sapiens
DWRHGFRTL

SEQ ID NO: 38884 - protein, 9 aa, Homo Sapiens
GPQRLSGLV

SEQ ID NO: 38885 - protein, 9 aa, Homo Sapiens
GPTNTRRPP

SEQ ID NO: 38886 - protein, 9 aa, Homo Sapiens
GFQGRRSHS

SEQ ID NO: 38887 - protein, 9 aa, Homo Sapiens
KAKMVALKD

SEQ ID NO: 38888 - protein, 9 aa, Homo Sapiens
VIDEIRMQL

SEQ ID NO: 38889 - protein, 9 aa, Homo Sapiens
KLCGRVDFA

SEQ ID NO: 38890 - protein, 9 aa, Homo Sapiens
SCVGEKLGA

SEQ ID NO: 38891 - protein, 9 aa, Homo Sapiens
AGRHAGGPS

SEQ ID NO: 38892 - protein, 9 aa, Homo Sapiens
SHDAPSPVT

SEQ ID NO: 38893 - protein, 9 aa, Homo Sapiens
PPPHDPEHG

SEQ ID NO: 38894 - protein, 9 aa, Homo Sapiens
GGKPFEYKE

SEQ ID NO: 38895 - protein, 9 aa, Homo Sapiens
RNIYEQEGL

SEQ ID NO: 38896 - protein, 9 aa, Homo Sapiens
DLLLLLFPP

SEQ ID NO: 38897 - protein, 9 aa, Homo Sapiens
GSPHDDRFS

SEQ ID NO: 38898 - protein, 9 aa, Homo Sapiens
VQDQLRNNY

SEQ ID NO: 38899 - protein, 9 aa, Homo Sapiens
AHQWIRGNA

SEQ ID NO: 38900 - protein, 9 aa, Homo Sapiens
TNTRRPPLR

SEQ ID NO: 38901 - protein, 9 aa, Homo Sapiens
AHPTNLPWS

SEQ ID NO: 38902 - protein, 9 aa, Homo Sapiens
HDLQFSEIR

SEQ ID NO: 38903 - protein, 9 aa, Homo Sapiens
KLIQHHYNL

SEQ ID NO: 38904 - protein, 9 aa, Homo Sapiens
IGLHFLPPS

SEQ ID NO: 38905 - protein, 9 aa, Homo Sapiens
IQNQESGIE

SEQ ID NO: 38906 - protein, 9 aa, Homo Sapiens
VNVSFPAIV

SEQ ID NO: 38907 - protein, 9 aa, Homo Sapiens
THLNYRLHR

SEQ ID NO: 38908 - protein, 9 aa, Homo Sapiens
PPKMPPPHD

SEQ ID NO: 38909 - protein, 9 aa, Homo Sapiens
SSDSCVGEK

SEQ ID NO: 38910 - protein, 9 aa, Homo Sapiens
PTGTGKSVH

SEQ ID NO: 38911 - protein, 9 aa, Homo Sapiens
AQPVMMIPE

SEQ ID NO: 38912 - protein, 9 aa, Homo Sapiens
AIKYLKNFV

SEQ ID NO: 38913 - protein, 9 aa, Homo Sapiens
LRYTIVHFG

SEQ ID NO: 38914 - protein, 9 aa, Homo Sapiens
RGKHKVACL

SEQ ID NO: 38915 - protein, 9 aa, Homo Sapiens
GEPQVPPDS

SEQ ID NO: 38916 - protein, 9 aa, Homo Sapiens
TRDFFHPLY

SEQ ID NO: 38917 - protein, 9 aa, Homo Sapiens
VMLGKVYQC

SEQ ID NO: 38918 - protein, 9 aa, Homo Sapiens
TYCQTRLLI

SEQ ID NO: 38919 - protein, 9 aa, Homo Sapiens
GIFYFRFWH

SEQ ID NO: 38920 - protein, 9 aa, Homo Sapiens
SWSAAAAAS

SEQ ID NO: 38921 - protein, 9 aa, Homo Sapiens
QGRRSHSEL

SEQ ID NO: 38922 - protein, 9 aa, Homo Sapiens
YRTIIGLHF

SEQ ID NO: 38923 - protein, 9 aa, Homo Sapiens
YAHQWIRGN

SEQ ID NO: 38924 - protein, 9 aa, Homo Sapiens
NANGRYVCN

SEQ ID NO: 38925 - protein, 9 aa, Homo Sapiens
YHRGKHKVA

SEQ ID NO: 38926 - protein, 9 aa, Homo Sapiens
GRHAGGPSC

SEQ ID NO: 38927 - protein, 9 aa, Homo Sapiens
LGTFSKSSL

SEQ ID NO: 38928 - protein, 9 aa, Homo Sapiens
GTGKSVHVK

SEQ ID NO: 38929 - protein, 9 aa, Homo Sapiens
FTFFVSALP

SEQ ID NO: 38930 - protein, 9 aa, Homo Sapiens
SVHVKDKLM

SEQ ID NO: 38931 - protein, 9 aa, Homo Sapiens
FKVGEEIVP

SEQ ID NO: 38932 - protein, 9 aa, Homo Sapiens
GAVLTFCLW

SEQ ID NO: 38933 - protein, 9 aa, Homo Sapiens
EVGGQQLRE

SEQ ID NO: 38934 - protein, 9 aa, Homo Sapiens
SRTIRLARV

SEQ ID NO: 38935 - protein, 9 aa, Homo Sapiens
DGRNIYEQE

SEQ ID NO: 38936 - protein, 9 aa, Homo Sapiens
KLHSRTIRL

SEQ ID NO: 38937 - protein, 9 aa, Homo Sapiens
CRWPSCGPI

SEQ ID NO: 38938 - protein, 9 aa, Homo Sapiens
LSPVLESPH

SEQ ID NO: 38939 - protein, 9 aa, Homo Sapiens
GMVVADELK

SEQ ID NO: 38940 - protein, 9 aa, Homo Sapiens
WSAAAAASA

SEQ ID NO: 38941 - protein, 9 aa, Homo Sapiens
RVCCLLCDC

SEQ ID NO: 38942 - protein, 9 aa, Homo Sapiens
LSSSSSASP

SEQ ID NO: 38943 - protein, 9 aa, Homo Sapiens
KLSWGPYLQ

SEQ ID NO: 38944 - protein, 9 aa, Homo Sapiens
CFHFLRGEY

SEQ ID NO: 38945 - protein, 9 aa, Homo Sapiens
LRLQRIRML

SEQ ID NO: 38946 - protein, 9 aa, Homo Sapiens
LMDLVLFED

SEQ ID NO: 38947 - protein, 9 aa, Homo Sapiens
KWFKVGEEI

SEQ ID NO: 38948 - protein, 9 aa, Homo Sapiens
ATYCQTRLL

SEQ ID NO: 38949 - protein, 9 aa, Homo Sapiens
SQIWNLNPV

SEQ ID NO: 38950 - protein, 9 aa, Homo Sapiens
EPQVPPDSI

SEQ ID NO: 38951 - protein, 9 aa, Homo Sapiens
VNKQQRKTK

SEQ ID NO: 38952 - protein, 9 aa, Homo Sapiens
RSSVDEVSF

SEQ ID NO: 38953 - protein, 9 aa, Homo Sapiens
VHIYKDGKV

SEQ ID NO: 38954 - protein, 9 aa, Homo Sapiens
LDIDMNQRI

SEQ ID NO: 38955 - protein, 9 aa, Homo Sapiens
LGGPLPDAR

SEQ ID NO: 38956 - protein, 9 aa, Homo Sapiens
HSMTSLFSS

SEQ ID NO: 38957 - protein, 9 aa, Homo Sapiens
PFSHMFHGR

SEQ ID NO: 38958 - protein, 9 aa, Homo Sapiens
LAQIHFMQK

SEQ ID NO: 38959 - protein, 9 aa, Homo Sapiens
DENAPLVPD

SEQ ID NO: 38960 - protein, 9 aa, Homo Sapiens
GRALLDVTD

SEQ ID NO: 38961 - protein, 9 aa, Homo Sapiens
SDEILNDGQ

SEQ ID NO: 38962 - protein, 9 aa, Homo Sapiens
GSPNWNGNS

SEQ ID NO: 38963 - protein, 9 aa, Homo Sapiens
ELAEYRKTG

SEQ ID NO: 38964 - protein, 9 aa, Homo Sapiens
SREFWIWML

SEQ ID NO: 38965 - protein, 9 aa, Homo Sapiens
KSIISLLLL

SEQ ID NO: 38966 - protein, 9 aa, Homo Sapiens
NEVAAHGIA

SEQ ID NO: 38967 - protein, 9 aa, Homo Sapiens
THDVYVMIN

SEQ ID NO: 38968 - protein, 9 aa, Homo Sapiens
LKCSPGGRQ

SEQ ID NO: 38969 - protein, 9 aa, Homo Sapiens
SDSDVEAQD

SEQ ID NO: 38970 - protein, 9 aa, Homo Sapiens
LHVHKKYNA

SEQ ID NO: 38971 - protein, 9 aa, Homo Sapiens
EMYWGWKEL

SEQ ID NO: 38972 - protein, 9 aa, Homo Sapiens
PNHEVVTMA

SEQ ID NO: 38973 - protein, 9 aa, Homo Sapiens
EKPWKCGDC

SEQ ID NO: 38974 - protein, 9 aa, Homo Sapiens
FFVVFVCEY

SEQ ID NO: 38975 - protein, 9 aa, Homo Sapiens
GSVDLFHMR

SEQ ID NO: 38976 - protein, 9 aa, Homo Sapiens
PAGCTTRQG

SEQ ID NO: 38977 - protein, 9 aa, Homo Sapiens
PLDRCYSTP

SEQ ID NO: 38978 - protein, 9 aa, Homo Sapiens
PTPSNRVKM

SEQ ID NO: 38979 - protein, 9 aa, Homo Sapiens
PQPHVFRSE

SEQ ID NO: 38980 - protein, 9 aa, Homo Sapiens
SNRHLTPEE

SEQ ID NO: 38981 - protein, 9 aa, Homo Sapiens
EAQDGGVQR

SEQ ID NO: 38982 - protein, 9 aa, Homo Sapiens
TGGEKRRWN

SEQ ID NO: 38983 - protein, 9 aa, Homo Sapiens
RFPGNTGRQ

SEQ ID NO: 38984 - protein, 9 aa, Homo Sapiens
DLSSHCQKS

SEQ ID NO: 38985 - protein, 9 aa, Homo Sapiens
LGGKRKGQR

SEQ ID NO: 38986 - protein, 9 aa, Homo Sapiens
QIHFMQKQR

SEQ ID NO: 38987 - protein, 9 aa, Homo Sapiens
IRCCTDDVR

SEQ ID NO: 38988 - protein, 9 aa, Homo Sapiens
GPHEEEPVK

SEQ ID NO: 38989 - protein, 9 aa, Homo Sapiens
RQNDLSSHC

SEQ ID NO: 38990 - protein, 9 aa, Homo Sapiens
KKILALAKY

SEQ ID NO: 38991 - protein, 9 aa, Homo Sapiens
HFPFAIKVF

SEQ ID NO: 38992 - protein, 9 aa, Homo Sapiens
AQDGGVQRG

SEQ ID NO: 38993 - protein, 9 aa, Homo Sapiens
KQEQIVKRL

SEQ ID NO: 38994 - protein, 9 aa, Homo Sapiens
GGNVGEGSQ

SEQ ID NO: 38995 - protein, 9 aa, Homo Sapiens
IGSPANASL

SEQ ID NO: 38996 - protein, 9 aa, Homo Sapiens
LVAGCRAGG

SEQ ID NO: 38997 - protein, 9 aa, Homo Sapiens
KKEIEDLQP

SEQ ID NO: 38998 - protein, 9 aa, Homo Sapiens
GKSVERQHN

SEQ ID NO: 38999 - protein, 9 aa, Homo Sapiens
KFQGLVSFK

SEQ ID NO: 39000 - protein, 9 aa, Homo Sapiens
PLTVLNGTI

SEQ ID NO: 39001 - protein, 9 aa, Homo Sapiens
QLDTNTADL

SEQ ID NO: 39002 - protein, 9 aa, Homo Sapiens
GATLAHTIS

SEQ ID NO: 39003 - protein, 9 aa, Homo Sapiens
SFQPNFTVH

SEQ ID NO: 39004 - protein, 9 aa, Homo Sapiens
KHIEVANGQ

SEQ ID NO: 39005 - protein, 9 aa, Homo Sapiens
VQAFANALL

SEQ ID NO: 39006 - protein, 9 aa, Homo Sapiens
FVTKGVAEA

SEQ ID NO: 39007 - protein, 9 aa, Homo Sapiens
LNGTILALD

SEQ ID NO: 39008 - protein, 9 aa, Homo Sapiens
FHMRESGWE

SEQ ID NO: 39009 - protein, 9 aa, Homo Sapiens
ADKLIKLKA

SEQ ID NO: 39010 - protein, 9 aa, Homo Sapiens
ELPQPHVFR

SEQ ID NO: 39011 - protein, 9 aa, Homo Sapiens
GMIPHPESR

SEQ ID NO: 39012 - protein, 9 aa, Homo Sapiens
SSSEAKSKA

SEQ ID NO: 39013 - protein, 9 aa, Homo Sapiens
GPGLAIYCM

SEQ ID NO: 39014 - protein, 9 aa, Homo Sapiens
TPTYTDGEG

SEQ ID NO: 39015 - protein, 9 aa, Homo Sapiens
SLSLPERPK

SEQ ID NO: 39016 - protein, 9 aa, Homo Sapiens
SCVPLRESG

SEQ ID NO: 39017 - protein, 9 aa, Homo Sapiens
GVPAVYMDE

SEQ ID NO: 39018 - protein, 9 aa, Homo Sapiens
VSSEAQRHE

SEQ ID NO: 39019 - protein, 9 aa, Homo Sapiens
PASQIHRQH

SEQ ID NO: 39020 - protein, 9 aa, Homo Sapiens
SLFVSAAGE

SEQ ID NO: 39021 - protein, 9 aa, Homo Sapiens
SLLAQEQKS

SEQ ID NO: 39022 - protein, 9 aa, Homo Sapiens
HVLGLLELP

SEQ ID NO: 39023 - protein, 9 aa, Homo Sapiens
SAVYSSKVL

SEQ ID NO: 39024 - protein, 9 aa, Homo Sapiens
VLNGTILAL

SEQ ID NO: 39025 - protein, 9 aa, Homo Sapiens
DNATTKECF

SEQ ID NO: 39026 - protein, 9 aa, Homo Sapiens
GSYPRQANH

SEQ ID NO: 39027 - protein, 9 aa, Homo Sapiens
LTSQWFAKY

SEQ ID NO: 39028 - protein, 9 aa, Homo Sapiens
VLKDILHLD

SEQ ID NO: 39029 - protein, 9 aa, Homo Sapiens
LLLFLFIVV

SEQ ID NO: 39030 - protein, 9 aa, Homo Sapiens
AIHPRCRWA

SEQ ID NO: 39031 - protein, 9 aa, Homo Sapiens
RWAAAPYRG

SEQ ID NO: 39032 - protein, 9 aa, Homo Sapiens
FVPQPKKIQ

SEQ ID NO: 39033 - protein, 9 aa, Homo Sapiens
KVPIMFRSG

SEQ ID NO: 39034 - protein, 9 aa, Homo Sapiens
ETASEELHN

SEQ ID NO: 39035 - protein, 9 aa, Homo Sapiens
SQTVSTAIE

SEQ ID NO: 39036 - protein, 9 aa, Homo Sapiens
AKQRNLSEQ

SEQ ID NO: 39037 - protein, 9 aa, Homo Sapiens
ESLDSFVIE

SEQ ID NO: 39038 - protein, 9 aa, Homo Sapiens
QHIEKSRQL

SEQ ID NO: 39039 - protein, 9 aa, Homo Sapiens
CRGGPEAFD

SEQ ID NO: 39040 - protein, 9 aa, Homo Sapiens
PEVLQDPLD

SEQ ID NO: 39041 - protein, 9 aa, Homo Sapiens
PQKDGYYFL

SEQ ID NO: 39042 - protein, 9 aa, Homo Sapiens
SLDSFVIEL

SEQ ID NO: 39043 - protein, 9 aa, Homo Sapiens
HSAGIIHWD

SEQ ID NO: 39044 - protein, 9 aa, Homo Sapiens
AKLAFQKHM

SEQ ID NO: 39045 - protein, 9 aa, Homo Sapiens
RSVGDGGTV

SEQ ID NO: 39046 - protein, 9 aa, Homo Sapiens
RKTGALQDS

SEQ ID NO: 39047 - protein, 9 aa, Homo Sapiens
HLKCSPGGR

SEQ ID NO: 39048 - protein, 9 aa, Homo Sapiens
ASLGEKKDH

SEQ ID NO: 39049 - protein, 9 aa, Homo Sapiens
HVCLHHRSW

SEQ ID NO: 39050 - protein, 9 aa, Homo Sapiens
PFTFVTKGV

SEQ ID NO: 39051 - protein, 9 aa, Homo Sapiens
SQKSFSQRS

SEQ ID NO: 39052 - protein, 9 aa, Homo Sapiens
EHPQKDGYY

SEQ ID NO: 39053 - protein, 9 aa, Homo Sapiens
GPASQIHRQ

SEQ ID NO: 39054 - protein, 9 aa, Homo Sapiens
YRKTGALQD

SEQ ID NO: 39055 - protein, 9 aa, Homo Sapiens
PIHAVVLPQ

SEQ ID NO: 39056 - protein, 9 aa, Homo Sapiens
LDVAPYIGS

SEQ ID NO: 39057 - protein, 9 aa, Homo Sapiens
NKIFLEKLK

SEQ ID NO: 39058 - protein, 9 aa, Homo Sapiens
VEDLQKTLL

SEQ ID NO: 39059 - protein, 9 aa, Homo Sapiens
LPIDLVKIF

SEQ ID NO: 39060 - protein, 9 aa, Homo Sapiens
EGLLLKIDS

SEQ ID NO: 39061 - protein, 9 aa, Homo Sapiens
QDEHPQKDG

SEQ ID NO: 39062 - protein, 9 aa, Homo Sapiens
KSQVVPLSL

SEQ ID NO: 39063 - protein, 9 aa, Homo Sapiens
RHLKRLVRV

SEQ ID NO: 39064 - protein, 9 aa, Homo Sapiens
GWELTEQVE

SEQ ID NO: 39065 - protein, 9 aa, Homo Sapiens
DFICSSLLA

SEQ ID NO: 39066 - protein, 9 aa, Homo Sapiens
VVFVIKPEH

SEQ ID NO: 39067 - protein, 9 aa, Homo Sapiens
VPRSRYSQT

SEQ ID NO: 39068 - protein, 9 aa, Homo Sapiens
KDNDRLMVR

SEQ ID NO: 39069 - protein, 9 aa, Homo Sapiens
VGLSCVPLR

SEQ ID NO: 39070 - protein, 9 aa, Homo Sapiens
LSCVPLRES

SEQ ID NO: 39071 - protein, 9 aa, Homo Sapiens
PWPLSVLSQ

SEQ ID NO: 39072 - protein, 9 aa, Homo Sapiens
LLDVTDRLA

SEQ ID NO: 39073 - protein, 9 aa, Homo Sapiens
EDGASAAEP

SEQ ID NO: 39074 - protein, 9 aa, Homo Sapiens
EGSQSPLGT

SEQ ID NO: 39075 - protein, 9 aa, Homo Sapiens
IIKHELQNL

SEQ ID NO: 39076 - protein, 9 aa, Homo Sapiens
GGGCRGGPE

SEQ ID NO: 39077 - protein, 9 aa, Homo Sapiens
GPVDANWIE

SEQ ID NO: 39078 - protein, 9 aa, Homo Sapiens
TGPGLAIYC

SEQ ID NO: 39079 - protein, 9 aa, Homo Sapiens
PQTNEGMLP

SEQ ID NO: 39080 - protein, 9 aa, Homo Sapiens
LPGHVCLHH

SEQ ID NO: 39081 - protein, 9 aa, Homo Sapiens
ATGVPAVYM

SEQ ID NO: 39082 - protein, 9 aa, Homo Sapiens
QTNEGMLPV

SEQ ID NO: 39083 - protein, 9 aa, Homo Sapiens
NWIENMNTV

SEQ ID NO: 39084 - protein, 9 aa, Homo Sapiens
VDQKFQGLV

SEQ ID NO: 39085 - protein, 9 aa, Homo Sapiens
TSATHCQGP

SEQ ID NO: 39086 - protein, 9 aa, Homo Sapiens
VGSPQPSST

SEQ ID NO: 39087 - protein, 9 aa, Homo Sapiens
DLICCGRGY

SEQ ID NO: 39088 - protein, 9 aa, Homo Sapiens
LSGRALLDV

SEQ ID NO: 39089 - protein, 9 aa, Homo Sapiens
EYRKTGALQ

SEQ ID NO: 39090 - protein, 9 aa, Homo Sapiens
AAVSELLQQ

SEQ ID NO: 39091 - protein, 9 aa, Homo Sapiens
GGKRKGQRP

SEQ ID NO: 39092 - protein, 9 aa, Homo Sapiens
VASSAWLFP

SEQ ID NO: 39093 - protein, 9 aa, Homo Sapiens
KEQTLAQIH

SEQ ID NO: 39094 - protein, 9 aa, Homo Sapiens
ISGSGLQSL

SEQ ID NO: 39095 - protein, 9 aa, Homo Sapiens
KKGLMKKKM

SEQ ID NO: 39096 - protein, 9 aa, Homo Sapiens
EKGPHEEEP

SEQ ID NO: 39097 - protein, 9 aa, Homo Sapiens
VDANWIENM

SEQ ID NO: 39098 - protein, 9 aa, Homo Sapiens
QLVPVVEVG

SEQ ID NO: 39099 - protein, 9 aa, Homo Sapiens
LFVSAAGEK

SEQ ID NO: 39100 - protein, 9 aa, Homo Sapiens
HIYKDGKVL

SEQ ID NO: 39101 - protein, 9 aa, Homo Sapiens
QWLGVSVWS

SEQ ID NO: 39102 - protein, 9 aa, Homo Sapiens
NDLSSHCQK

SEQ ID NO: 39103 - protein, 9 aa, Homo Sapiens
PGDRAKALC

SEQ ID NO: 39104 - protein, 9 aa, Homo Sapiens
CPGPMSPRM

SEQ ID NO: 39105 - protein, 9 aa, Homo Sapiens
MNSREFWIW

SEQ ID NO: 39106 - protein, 9 aa, Homo Sapiens
LIKLKAEIE

SEQ ID NO: 39107 - protein, 9 aa, Homo Sapiens
ATGGATLAH

SEQ ID NO: 39108 - protein, 9 aa, Homo Sapiens
KCPPHSYCV

SEQ ID NO: 39109 - protein, 9 aa, Homo Sapiens
ETHFPFAIK

SEQ ID NO: 39110 - protein, 9 aa, Homo Sapiens
KEDAKAPEE

SEQ ID NO: 39111 - protein, 9 aa, Homo Sapiens
GCTTRQGES

SEQ ID NO: 39112 - protein, 9 aa, Homo Sapiens
ALLDVTDRL

SEQ ID NO: 39113 - protein, 9 aa, Homo Sapiens
IISLLLLLF

SEQ ID NO: 39114 - protein, 9 aa, Homo Sapiens
NSSVKVPIM

SEQ ID NO: 39115 - protein, 9 aa, Homo Sapiens
STTQEMTPH

SEQ ID NO: 39116 - protein, 9 aa, Homo Sapiens
FRPAESRNK

SEQ ID NO: 39117 - protein, 9 aa, Homo Sapiens
KRKGQRPGG

SEQ ID NO: 39118 - protein, 9 aa, Homo Sapiens
NTADLLLRE

SEQ ID NO: 39119 - protein, 9 aa, Homo Sapiens
NWRRVSSLT

SEQ ID NO: 39120 - protein, 9 aa, Homo Sapiens
MLPVVKPLD

SEQ ID NO: 39121 - protein, 9 aa, Homo Sapiens
DKPGGQRRG

SEQ ID NO: 39122 - protein, 9 aa, Homo Sapiens
SLPERPKAP

SEQ ID NO: 39123 - protein, 9 aa, Homo Sapiens
DAECAKKSL

SEQ ID NO: 39124 - protein, 9 aa, Homo Sapiens
FLTVPRSRY

SEQ ID NO: 39125 - protein, 9 aa, Homo Sapiens
VLKWTYEMF

SEQ ID NO: 39126 - protein, 9 aa, Homo Sapiens
QSLGGPLPD

SEQ ID NO: 39127 - protein, 9 aa, Homo Sapiens
DKLAAIQSE

SEQ ID NO: 39128 - protein, 9 aa, Homo Sapiens
YVLPSSTTQ

SEQ ID NO: 39129 - protein, 9 aa, Homo Sapiens
ILLLSIGVP

SEQ ID NO: 39130 - protein, 9 aa, Homo Sapiens
RTPGGGCRG

SEQ ID NO: 39131 - protein, 9 aa, Homo Sapiens
TKGVAEATC

SEQ ID NO: 39132 - protein, 9 aa, Homo Sapiens
DKPLRDPET

SEQ ID NO: 39133 - protein, 9 aa, Homo Sapiens
LNWRRVSSL

SEQ ID NO: 39134 - protein, 9 aa, Homo Sapiens
QLGNRSSVD

SEQ ID NO: 39135 - protein, 9 aa, Homo Sapiens
VGEGSQSPL

SEQ ID NO: 39136 - protein, 9 aa, Homo Sapiens
LVNSKYYTG

SEQ ID NO: 39137 - protein, 9 aa, Homo Sapiens
CYQIRCCTD

SEQ ID NO: 39138 - protein, 9 aa, Homo Sapiens
SQWFAKYLQ

SEQ ID NO: 39139 - protein, 9 aa, Homo Sapiens
SVSFLLLFN

SEQ ID NO: 39140 - protein, 9 aa, Homo Sapiens
ISLLLLLFL

SEQ ID NO: 39141 - protein, 9 aa, Homo Sapiens
FYMYIETLR

SEQ ID NO: 39142 - protein, 9 aa, Homo Sapiens
ASAAEPTSS

SEQ ID NO: 39143 - protein, 9 aa, Homo Sapiens
RFLSGRALL

SEQ ID NO: 39144 - protein, 9 aa, Homo Sapiens
QEQIVKRLV

SEQ ID NO: 39145 - protein, 9 aa, Homo Sapiens
DKVQNIICG

SEQ ID NO: 39146 - protein, 9 aa, Homo Sapiens
ASQSSDKPL

SEQ ID NO: 39147 - protein, 9 aa, Homo Sapiens
FERVSLDKD

SEQ ID NO: 39148 - protein, 9 aa, Homo Sapiens
CLHHRSWAS

SEQ ID NO: 39149 - protein, 9 aa, Homo Sapiens
QDHSLSSSS

SEQ ID NO: 39150 - protein, 9 aa, Homo Sapiens
SDSNRHLTP

SEQ ID NO: 39151 - protein, 9 aa, Homo Sapiens
LDEHQETHP

SEQ ID NO: 39152 - protein, 9 aa, Homo Sapiens
LHLKCSPGG

SEQ ID NO: 39153 - protein, 9 aa, Homo Sapiens
CVLLPLVQL

SEQ ID NO: 39154 - protein, 9 aa, Homo Sapiens
LAKYVKQNT

SEQ ID NO: 39155 - protein, 9 aa, Homo Sapiens
KGVECDGCK

SEQ ID NO: 39156 - protein, 9 aa, Homo Sapiens
KGAYVCVVS

SEQ ID NO: 39157 - protein, 9 aa, Homo Sapiens
KRAQSDSRK

SEQ ID NO: 39158 - protein, 9 aa, Homo Sapiens
PSNRVKMQQ

SEQ ID NO: 39159 - protein, 9 aa, Homo Sapiens
CSSLLAQEQ

SEQ ID NO: 39160 - protein, 9 aa, Homo Sapiens
VGFDTCGQE

SEQ ID NO: 39161 - protein, 9 aa, Homo Sapiens
QLGVQAFAN

SEQ ID NO: 39162 - protein, 9 aa, Homo Sapiens
QEEEDGASA

SEQ ID NO: 39163 - protein, 9 aa, Homo Sapiens
AEPGPEGPP

SEQ ID NO: 39164 - protein, 9 aa, Homo Sapiens
KVYIGEEEN

SEQ ID NO: 39165 - protein, 9 aa, Homo Sapiens
EILNDGQSP

SEQ ID NO: 39166 - protein, 9 aa, Homo Sapiens
HSLSSSSSA

SEQ ID NO: 39167 - protein, 9 aa, Homo Sapiens
CVDEKECQT

SEQ ID NO: 39168 - protein, 9 aa, Homo Sapiens
PELLKGQGV

SEQ ID NO: 39169 - protein, 9 aa, Homo Sapiens
EKKDHHSTH

SEQ ID NO: 39170 - protein, 9 aa, Homo Sapiens
WALWLVWAL

SEQ ID NO: 39171 - protein, 9 aa, Homo Sapiens
NEGMLPVVK

SEQ ID NO: 39172 - protein, 9 aa, Homo Sapiens
LGEKKDHHS

SEQ ID NO: 39173 - protein, 9 aa, Homo Sapiens
IRLAVYHMH

SEQ ID NO: 39174 - protein, 9 aa, Homo Sapiens
DAIELCLEK

SEQ ID NO: 39175 - protein, 9 aa, Homo Sapiens
SVKVPIMFR

SEQ ID NO: 39176 - protein, 9 aa, Homo Sapiens
HIEVANGQA

SEQ ID NO: 39177 - protein, 9 aa, Homo Sapiens
CYKYNPPNH

SEQ ID NO: 39178 - protein, 9 aa, Homo Sapiens
VPAPRLAST

SEQ ID NO: 39179 - protein, 9 aa, Homo Sapiens
IETLRPRLE

SEQ ID NO: 39180 - protein, 9 aa, Homo Sapiens
KNSSVKVPI

SEQ ID NO: 39181 - protein, 9 aa, Homo Sapiens
GLMKKKMVK

SEQ ID NO: 39182 - protein, 9 aa, Homo Sapiens
VHPPGFMGL

SEQ ID NO: 39183 - protein, 9 aa, Homo Sapiens
LVKIFDENE

SEQ ID NO: 39184 - protein, 9 aa, Homo Sapiens
KTFSDESRL

SEQ ID NO: 39185 - protein, 9 aa, Homo Sapiens
PPGPILRLY

SEQ ID NO: 39186 - protein, 9 aa, Homo Sapiens
LLPLGGNHQ

SEQ ID NO: 39187 - protein, 9 aa, Homo Sapiens
TYEMFLNFG

SEQ ID NO: 39188 - protein, 9 aa, Homo Sapiens
LQPFGVIDE

SEQ ID NO: 39189 - protein, 9 aa, Homo Sapiens
WRTPGGGCR

SEQ ID NO: 39190 - protein, 9 aa, Homo Sapiens
LTVLNGTIL

SEQ ID NO: 39191 - protein, 9 aa, Homo Sapiens
GAEAEPGPE

SEQ ID NO: 39192 - protein, 9 aa, Homo Sapiens
RLYLPDNTL

SEQ ID NO: 39193 - protein, 9 aa, Homo Sapiens
VANGQASHF

SEQ ID NO: 39194 - protein, 9 aa, Homo Sapiens
GGGPEKPWK

SEQ ID NO: 39195 - protein, 9 aa, Homo Sapiens
MPMFHRRRR

SEQ ID NO: 39196 - protein, 9 aa, Homo Sapiens
LEQIREMEN

SEQ ID NO: 39197 - protein, 9 aa, Homo Sapiens
HCRLAAAIH

SEQ ID NO: 39198 - protein, 9 aa, Homo Sapiens
VSTAIELRK

SEQ ID NO: 39199 - protein, 9 aa, Homo Sapiens
ERTSATHCQ

SEQ ID NO: 39200 - protein, 9 aa, Homo Sapiens
KILALAKYV

SEQ ID NO: 39201 - protein, 9 aa, Homo Sapiens
VAGCRAGGV

SEQ ID NO: 39202 - protein, 9 aa, Homo Sapiens
KKDHHSTHY

SEQ ID NO: 39203 - protein, 9 aa, Homo Sapiens
QNDLSSHCQ

SEQ ID NO: 39204 - protein, 9 aa, Homo Sapiens
GCVDEKECQ

SEQ ID NO: 39205 - protein, 9 aa, Homo Sapiens
YSQTVSTAI

SEQ ID NO: 39206 - protein, 9 aa, Homo Sapiens
PEHYACGGS

SEQ ID NO: 39207 - protein, 9 aa, Homo Sapiens
NHFIKLLVP

SEQ ID NO: 39208 - protein, 9 aa, Homo Sapiens
MYTFLVGKP

SEQ ID NO: 39209 - protein, 9 aa, Homo Sapiens
NQRRLLQLR

SEQ ID NO: 39210 - protein, 9 aa, Homo Sapiens
NKKRLEEQN

SEQ ID NO: 39211 - protein, 9 aa, Homo Sapiens
TDKTMTELD

SEQ ID NO: 39212 - protein, 9 aa, Homo Sapiens
SEELHNRSL

SEQ ID NO: 39213 - protein, 9 aa, Homo Sapiens
DDGTLVSDP

SEQ ID NO: 39214 - protein, 9 aa, Homo Sapiens
GCIMYTFLV

SEQ ID NO: 39215 - protein, 9 aa, Homo Sapiens
PPWARSEQL

SEQ ID NO: 39216 - protein, 9 aa, Homo Sapiens
FVGRLPPWA

SEQ ID NO: 39217 - protein, 9 aa, Homo Sapiens
CNRYDKKYN

SEQ ID NO: 39218 - protein, 9 aa, Homo Sapiens
KGQGVTPKA

SEQ ID NO: 39219 - protein, 9 aa, Homo Sapiens
SLGEKKDHH

SEQ ID NO: 39220 - protein, 9 aa, Homo Sapiens
FVCEYIEAE

SEQ ID NO: 39221 - protein, 9 aa, Homo Sapiens
PNFTVHITG

SEQ ID NO: 39222 - protein, 9 aa, Homo Sapiens
DLQPPPGIV

SEQ ID NO: 39223 - protein, 9 aa, Homo Sapiens
FICSSLLAQ

SEQ ID NO: 39224 - protein, 9 aa, Homo Sapiens
PQPKKIQLM

SEQ ID NO: 39225 - protein, 9 aa, Homo Sapiens
KKIQLMTSC

SEQ ID NO: 39226 - protein, 9 aa, Homo Sapiens
ELLPIDLVK

SEQ ID NO: 39227 - protein, 9 aa, Homo Sapiens
GVAEATCNC

SEQ ID NO: 39228 - protein, 9 aa, Homo Sapiens
YMYIETLRP

SEQ ID NO: 39229 - protein, 9 aa, Homo Sapiens
LFSSTTSSS

SEQ ID NO: 39230 - protein, 9 aa, Homo Sapiens
VYMDELAAF

SEQ ID NO: 39231 - protein, 9 aa, Homo Sapiens
QSSDKPLRD

SEQ ID NO: 39232 - protein, 9 aa, Homo Sapiens
LLPIDLVKI

SEQ ID NO: 39233 - protein, 9 aa, Homo Sapiens
RDKGAYVCV

SEQ ID NO: 39234 - protein, 9 aa, Homo Sapiens
PSSGSAVYS

SEQ ID NO: 39235 - protein, 9 aa, Homo Sapiens
LYGIDDTER

SEQ ID NO: 39236 - protein, 9 aa, Homo Sapiens
RVKMQQKSN

SEQ ID NO: 39237 - protein, 9 aa, Homo Sapiens
QKYAMDVQN

SEQ ID NO: 39238 - protein, 9 aa, Homo Sapiens
PREMYWGWK

SEQ ID NO: 39239 - protein, 9 aa, Homo Sapiens
SDPLEKAML

SEQ ID NO: 39240 - protein, 9 aa, Homo Sapiens
VDEKECQTK

SEQ ID NO: 39241 - protein, 9 aa, Homo Sapiens
NRHLTPEEE

SEQ ID NO: 39242 - protein, 9 aa, Homo Sapiens
CTTRQGEST

SEQ ID NO: 39243 - protein, 9 aa, Homo Sapiens
SSEAKSKAM

SEQ ID NO: 39244 - protein, 9 aa, Homo Sapiens
ASTGVSWAD

SEQ ID NO: 39245 - protein, 9 aa, Homo Sapiens
HVHKKYNAL

SEQ ID NO: 39246 - protein, 9 aa, Homo Sapiens
YHCRLAAAI

SEQ ID NO: 39247 - protein, 9 aa, Homo Sapiens
KQTHHSLDS

SEQ ID NO: 39248 - protein, 9 aa, Homo Sapiens
LALAKYVKQ

SEQ ID NO: 39249 - protein, 9 aa, Homo Sapiens
GSLGNQRRL

SEQ ID NO: 39250 - protein, 9 aa, Homo Sapiens
SVQLRDKGA

SEQ ID NO: 39251 - protein, 9 aa, Homo Sapiens
DVQNKIQEK

SEQ ID NO: 39252 - protein, 9 aa, Homo Sapiens
LASTGVSWA

SEQ ID NO: 39253 - protein, 9 aa, Homo Sapiens
VIELEKVQS

SEQ ID NO: 39254 - protein, 9 aa, Homo Sapiens
LAACCTFMR

SEQ ID NO: 39255 - protein, 9 aa, Homo Sapiens
GGPREMYWG

SEQ ID NO: 39256 - protein, 9 aa, Homo Sapiens
SQSPLGTLP

SEQ ID NO: 39257 - protein, 9 aa, Homo Sapiens
TELLPIDLV

SEQ ID NO: 39258 - protein, 9 aa, Homo Sapiens
YIGSPANAS

SEQ ID NO: 39259 - protein, 9 aa, Homo Sapiens
GSAVYSSKV

SEQ ID NO: 39260 - protein, 9 aa, Homo Sapiens
PGFKPPTCM

SEQ ID NO: 39261 - protein, 9 aa, Homo Sapiens
IHAVVLPQG

SEQ ID NO: 39262 - protein, 9 aa, Homo Sapiens
VECDGCKKI

SEQ ID NO: 39263 - protein, 9 aa, Homo Sapiens
QGVTPKADI

SEQ ID NO: 39264 - protein, 9 aa, Homo Sapiens
HGRFIPLAR

SEQ ID NO: 39265 - protein, 9 aa, Homo Sapiens
RGGGPEKPW

SEQ ID NO: 39266 - protein, 9 aa, Homo Sapiens
KSFSQRSSS

SEQ ID NO: 39267 - protein, 9 aa, Homo Sapiens
FRQNDLSSH

SEQ ID NO: 39268 - protein, 9 aa, Homo Sapiens
YAMDVQNKI

SEQ ID NO: 39269 - protein, 9 aa, Homo Sapiens
QASSQKSFS

SEQ ID NO: 39270 - protein, 9 aa, Homo Sapiens
SSDKPLRDP

SEQ ID NO: 39271 - protein, 9 aa, Homo Sapiens
ECDGCKKIL

SEQ ID NO: 39272 - protein, 9 aa, Homo Sapiens
PHPGIDLSQ

SEQ ID NO: 39273 - protein, 9 aa, Homo Sapiens
DESLDSFVI

SEQ ID NO: 39274 - protein, 9 aa, Homo Sapiens
GLCPGPMSP

SEQ ID NO: 39275 - protein, 9 aa, Homo Sapiens
LCVPVDSKV

SEQ ID NO: 39276 - protein, 9 aa, Homo Sapiens
LKWTYEMFL

SEQ ID NO: 39277 - protein, 9 aa, Homo Sapiens
SFLLLFNTT

SEQ ID NO: 39278 - protein, 9 aa, Homo Sapiens
GLVAGCRAG

SEQ ID NO: 39279 - protein, 9 aa, Homo Sapiens
EIELAEYRK

SEQ ID NO: 39280 - protein, 9 aa, Homo Sapiens
VGDGGTVEF

SEQ ID NO: 39281 - protein, 9 aa, Homo Sapiens
EGPPPPPSP

SEQ ID NO: 39282 - protein, 9 aa, Homo Sapiens
ACQRMKDAI

SEQ ID NO: 39283 - protein, 9 aa, Homo Sapiens
SLGNQRRLL

SEQ ID NO: 39284 - protein, 9 aa, Homo Sapiens
LLAQEQKSC

SEQ ID NO: 39285 - protein, 9 aa, Homo Sapiens
WARSEQLEE

SEQ ID NO: 39286 - protein, 9 aa, Homo Sapiens
NHQPEPSGK

SEQ ID NO: 39287 - protein, 9 aa, Homo Sapiens
NRSSVDEVS

SEQ ID NO: 39288 - protein, 9 aa, Homo Sapiens
TVEDLQKTL

SEQ ID NO: 39289 - protein, 9 aa, Homo Sapiens
GFPVSDSNR

SEQ ID NO: 39290 - protein, 9 aa, Homo Sapiens
SSVKVPIMF

SEQ ID NO: 39291 - protein, 9 aa, Homo Sapiens
AMDVQNKIQ

SEQ ID NO: 39292 - protein, 9 aa, Homo Sapiens
HFRPAESRN

SEQ ID NO: 39293 - protein, 9 aa, Homo Sapiens
QQMGPRPPE

SEQ ID NO: 39294 - protein, 9 aa, Homo Sapiens
GGCRGGPEA

SEQ ID NO: 39295 - protein, 9 aa, Homo Sapiens
HFMQKQRNR

SEQ ID NO: 39296 - protein, 9 aa, Homo Sapiens
FFKTTMGSN

SEQ ID NO: 39297 - protein, 9 aa, Homo Sapiens
KTLLALDPM

SEQ ID NO: 39298 - protein, 9 aa, Homo Sapiens
SSVSFLLLF

SEQ ID NO: 39299 - protein, 9 aa, Homo Sapiens
RNKSAKGMY

SEQ ID NO: 39300 - protein, 9 aa, Homo Sapiens
ANWIENMNT

SEQ ID NO: 39301 - protein, 9 aa, Homo Sapiens
HMMKPLAPA

SEQ ID NO: 39302 - protein, 9 aa, Homo Sapiens
SVLSQFPKH

SEQ ID NO: 39303 - protein, 9 aa, Homo Sapiens
FAIKVFSLL

SEQ ID NO: 39304 - protein, 9 aa, Homo Sapiens
AGVGLSCVP

SEQ ID NO: 39305 - protein, 9 aa, Homo Sapiens
AIRQQDPEA

SEQ ID NO: 39306 - protein, 9 aa, Homo Sapiens
ACCTFMRDQ

SEQ ID NO: 39307 - protein, 9 aa, Homo Sapiens
EPEVLQDPL

SEQ ID NO: 39308 - protein, 9 aa, Homo Sapiens
LPQPHVFRS

SEQ ID NO: 39309 - protein, 9 aa, Homo Sapiens
SKQEQIVKR

SEQ ID NO: 39310 - protein, 9 aa, Homo Sapiens
VFVCEYIEA

SEQ ID NO: 39311 - protein, 9 aa, Homo Sapiens
EDLQKTLLA

SEQ ID NO: 39312 - protein, 9 aa, Homo Sapiens
EDQGGWELT

SEQ ID NO: 39313 - protein, 9 aa, Homo Sapiens
ENVAKLVGI

SEQ ID NO: 39314 - protein, 9 aa, Homo Sapiens
VHKVINTAE

SEQ ID NO: 39315 - protein, 9 aa, Homo Sapiens
ERVSLDKDN

SEQ ID NO: 39316 - protein, 9 aa, Homo Sapiens
NCYKYNPPN

SEQ ID NO: 39317 - protein, 9 aa, Homo Sapiens
CRLAAAIHD

SEQ ID NO: 39318 - protein, 9 aa, Homo Sapiens
PHGPLVNSK

SEQ ID NO: 39319 - protein, 9 aa, Homo Sapiens
LAFQPPISI

SEQ ID NO: 39320 - protein, 9 aa, Homo Sapiens
EENKIFLEK

SEQ ID NO: 39321 - protein, 9 aa, Homo Sapiens
AECAKKSLI

SEQ ID NO: 39322 - protein, 9 aa, Homo Sapiens
IEKSRQLLS

SEQ ID NO: 39323 - protein, 9 aa, Homo Sapiens
DSLLPKEVK

SEQ ID NO: 39324 - protein, 9 aa, Homo Sapiens
KKYNWDVKS

SEQ ID NO: 39325 - protein, 9 aa, Homo Sapiens
SQSSDKPLR

SEQ ID NO: 39326 - protein, 9 aa, Homo Sapiens
VIKPEHYAC

SEQ ID NO: 39327 - protein, 9 aa, Homo Sapiens
DEILNDGQS

SEQ ID NO: 39328 - protein, 9 aa, Homo Sapiens
RCCTDDVRP

SEQ ID NO: 39329 - protein, 9 aa, Homo Sapiens
EQTLAQIHF

SEQ ID NO: 39330 - protein, 9 aa, Homo Sapiens
IDAIKEIEI

SEQ ID NO: 39331 - protein, 9 aa, Homo Sapiens
TTLSPAGCT

SEQ ID NO: 39332 - protein, 9 aa, Homo Sapiens
ENCSKNKKR

SEQ ID NO: 39333 - protein, 9 aa, Homo Sapiens
QTVSTAIEL

SEQ ID NO: 39334 - protein, 9 aa, Homo Sapiens
KPGGQRRGH

SEQ ID NO: 39335 - protein, 9 aa, Homo Sapiens
NFSGDESEE

SEQ ID NO: 39336 - protein, 9 aa, Homo Sapiens
GQERTSATH

SEQ ID NO: 39337 - protein, 9 aa, Homo Sapiens
MSLTSQWFA

SEQ ID NO: 39338 - protein, 9 aa, Homo Sapiens
CCTFMRDQF

SEQ ID NO: 39339 - protein, 9 aa, Homo Sapiens
GSPQPSSTG

SEQ ID NO: 39340 - protein, 9 aa, Homo Sapiens
HGSQGANFS

SEQ ID NO: 39341 - protein, 9 aa, Homo Sapiens
INVDENVAK

SEQ ID NO: 39342 - protein, 9 aa, Homo Sapiens
AEVKVPMNT

SEQ ID NO: 39343 - protein, 9 aa, Homo Sapiens
HYACGGSFF

SEQ ID NO: 39344 - protein, 9 aa, Homo Sapiens
THHSLDSQL

SEQ ID NO: 39345 - protein, 9 aa, Homo Sapiens
QKGVECDGC

SEQ ID NO: 39346 - protein, 9 aa, Homo Sapiens
KVINTAEKP

SEQ ID NO: 39347 - protein, 9 aa, Homo Sapiens
NHEVVTMAR

SEQ ID NO: 39348 - protein, 9 aa, Homo Sapiens
TSLFSSTTS

SEQ ID NO: 39349 - protein, 9 aa, Homo Sapiens
DVLRLLQPF

SEQ ID NO: 39350 - protein, 9 aa, Homo Sapiens
VDLFHMRES

SEQ ID NO: 39351 - protein, 9 aa, Homo Sapiens
VFDQTSYMV

SEQ ID NO: 39352 - protein, 9 aa, Homo Sapiens
VLSQFPKHL

SEQ ID NO: 39353 - protein, 9 aa, Homo Sapiens
NQMVHIYKD

SEQ ID NO: 39354 - protein, 9 aa, Homo Sapiens
TSKQEQIVK

SEQ ID NO: 39355 - protein, 9 aa, Homo Sapiens
CIMYTFLVG

SEQ ID NO: 39356 - protein, 9 aa, Homo Sapiens
HRQHDKPGG

SEQ ID NO: 39357 - protein, 9 aa, Homo Sapiens
SATHCQGPA

SEQ ID NO: 39358 - protein, 9 aa, Homo Sapiens
FANALLIIP

SEQ ID NO: 39359 - protein, 9 aa, Homo Sapiens
LRPRLEGEK

SEQ ID NO: 39360 - protein, 9 aa, Homo Sapiens
LDTNTADLL

SEQ ID NO: 39361 - protein, 9 aa, Homo Sapiens
IKHELQNLR

SEQ ID NO: 39362 - protein, 9 aa, Homo Sapiens
NGTILALDA

SEQ ID NO: 39363 - protein, 9 aa, Homo Sapiens
RLAVYHMHS

SEQ ID NO: 39364 - protein, 9 aa, Homo Sapiens
LHLDEHQET

SEQ ID NO: 39365 - protein, 9 aa, Homo Sapiens
QNIICGWRT

SEQ ID NO: 39366 - protein, 9 aa, Homo Sapiens
SSGSAVYSS

SEQ ID NO: 39367 - protein, 9 aa, Homo Sapiens
KTKNSHQNK

SEQ ID NO: 39368 - protein, 9 aa, Homo Sapiens
RGSSSEAKS

SEQ ID NO: 39369 - protein, 9 aa, Homo Sapiens
VEEPGEEQL

SEQ ID NO: 39370 - protein, 9 aa, Homo Sapiens
CRHYGLSDS

SEQ ID NO: 39371 - protein, 9 aa, Homo Sapiens
YQIRCCTDD

SEQ ID NO: 39372 - protein, 9 aa, Homo Sapiens
SLFSSTTSS

SEQ ID NO: 39373 - protein, 9 aa, Homo Sapiens
FIDDNATTK

SEQ ID NO: 39374 - protein, 9 aa, Homo Sapiens
HKVINTAEK

SEQ ID NO: 39375 - protein, 9 aa, Homo Sapiens
NQFQKEALA

SEQ ID NO: 39376 - protein, 9 aa, Homo Sapiens
SYPRQANHD

SEQ ID NO: 39377 - protein, 9 aa, Homo Sapiens
SICRHYGLS

SEQ ID NO: 39378 - protein, 9 aa, Homo Sapiens
NIICGWRTM

SEQ ID NO: 39379 - protein, 9 aa, Homo Sapiens
PTCMTGATG

SEQ ID NO: 39380 - protein, 9 aa, Homo Sapiens
WAAAPYRGR

SEQ ID NO: 39381 - protein, 9 aa, Homo Sapiens
HWDLKPSNI

SEQ ID NO: 39382 - protein, 9 aa, Homo Sapiens
SQIHRQHDK

SEQ ID NO: 39383 - protein, 9 aa, Homo Sapiens
EEIPKKEEV

SEQ ID NO: 39384 - protein, 9 aa, Homo Sapiens
GDRAKALCV

SEQ ID NO: 39385 - protein, 9 aa, Homo Sapiens
DGPVDANWI

SEQ ID NO: 39386 - protein, 9 aa, Homo Sapiens
KSKAMSTCI

SEQ ID NO: 39387 - protein, 9 aa, Homo Sapiens
GRVEEEKEE

SEQ ID NO: 39388 - protein, 9 aa, Homo Sapiens
EDVLRLLQP

SEQ ID NO: 39389 - protein, 9 aa, Homo Sapiens
GLVSFKDVT

SEQ ID NO: 39390 - protein, 9 aa, Homo Sapiens
HFERVSLDK

SEQ ID NO: 39391 - protein, 9 aa, Homo Sapiens
GNRSSVDEV

SEQ ID NO: 39392 - protein, 9 aa, Homo Sapiens
NDGQSPKHS

SEQ ID NO: 39393 - protein, 9 aa, Homo Sapiens
NSREFWIWM

SEQ ID NO: 39394 - protein, 9 aa, Homo Sapiens
KRKRAQSDS

SEQ ID NO: 39395 - protein, 9 aa, Homo Sapiens
QNGACRSSK

SEQ ID NO: 39396 - protein, 9 aa, Homo Sapiens
AVLSDKVQN

SEQ ID NO: 39397 - protein, 9 aa, Homo Sapiens
ICAKQRNLS

SEQ ID NO: 39398 - protein, 9 aa, Homo Sapiens
VIDAIKEIE

SEQ ID NO: 39399 - protein, 9 aa, Homo Sapiens
KVQNIICGW

SEQ ID NO: 39400 - protein, 9 aa, Homo Sapiens
GMSPHPGID

SEQ ID NO: 39401 - protein, 9 aa, Homo Sapiens
ASGCDLICC

SEQ ID NO: 39402 - protein, 9 aa, Homo Sapiens
PPNHEVVTM

SEQ ID NO: 39403 - protein, 9 aa, Homo Sapiens
KLAFQKHMM

SEQ ID NO: 39404 - protein, 9 aa, Homo Sapiens
PIMFRSGIY

SEQ ID NO: 39405 - protein, 9 aa, Homo Sapiens
IPGFKPPTC

SEQ ID NO: 39406 - protein, 9 aa, Homo Sapiens
SSTGGEKRR

SEQ ID NO: 39407 - protein, 9 aa, Homo Sapiens
FITQSCVAS

SEQ ID NO: 39408 - protein, 9 aa, Homo Sapiens
HPPGFMGLA

SEQ ID NO: 39409 - protein, 9 aa, Homo Sapiens
RAIRQQDPE

SEQ ID NO: 39410 - protein, 9 aa, Homo Sapiens
MSPRMSCGG

SEQ ID NO: 39411 - protein, 9 aa, Homo Sapiens
PSNISSVSF

SEQ ID NO: 39412 - protein, 9 aa, Homo Sapiens
ITMPNQMVH

SEQ ID NO: 39413 - protein, 9 aa, Homo Sapiens
TQEMTPHEI

SEQ ID NO: 39414 - protein, 9 aa, Homo Sapiens
RQHNLEEAL

SEQ ID NO: 39415 - protein, 9 aa, Homo Sapiens
EVIDAIKEI

SEQ ID NO: 39416 - protein, 9 aa, Homo Sapiens
ALSSDEILN

SEQ ID NO: 39417 - protein, 9 aa, Homo Sapiens
AEYRKTGAL

SEQ ID NO: 39418 - protein, 9 aa, Homo Sapiens
SLKDAIELC

SEQ ID NO: 39419 - protein, 9 aa, Homo Sapiens
TDENAPLVP

SEQ ID NO: 39420 - protein, 9 aa, Homo Sapiens
IHWDLKPSN

SEQ ID NO: 39421 - protein, 9 aa, Homo Sapiens
EEEDGASAA

SEQ ID NO: 39422 - protein, 9 aa, Homo Sapiens
PRAQLGNRS

SEQ ID NO: 39423 - protein, 9 aa, Homo Sapiens
FWIWMLEEN

SEQ ID NO: 39424 - protein, 9 aa, Homo Sapiens
SLGGPLPDA

SEQ ID NO: 39425 - protein, 9 aa, Homo Sapiens
GANFSGDES

SEQ ID NO: 39426 - protein, 9 aa, Homo Sapiens
VPLLTLKWM

SEQ ID NO: 39427 - protein, 9 aa, Homo Sapiens
IIHWDLKPS

SEQ ID NO: 39428 - protein, 9 aa, Homo Sapiens
EAEVESYHC

SEQ ID NO: 39429 - protein, 9 aa, Homo Sapiens
RLLDKLAAI

SEQ ID NO: 39430 - protein, 9 aa, Homo Sapiens
RAQLGNRSS

SEQ ID NO: 39431 - protein, 9 aa, Homo Sapiens
PVSDSNRHL

SEQ ID NO: 39432 - protein, 9 aa, Homo Sapiens
KMQQKSNLE

SEQ ID NO: 39433 - protein, 9 aa, Homo Sapiens
RRRPKKGLM

SEQ ID NO: 39434 - protein, 9 aa, Homo Sapiens
ALVRCGGVG

SEQ ID NO: 39435 - protein, 9 aa, Homo Sapiens
EVGMSLTSQ

SEQ ID NO: 39436 - protein, 9 aa, Homo Sapiens
LELPQPHVF

SEQ ID NO: 39437 - protein, 9 aa, Homo Sapiens
VGLVAGCRA

SEQ ID NO: 39438 - protein, 9 aa, Homo Sapiens
APEEEIPKK

SEQ ID NO: 39439 - protein, 9 aa, Homo Sapiens
VSSLTGPVP

SEQ ID NO: 39440 - protein, 9 aa, Homo Sapiens
HKREQDHSL

SEQ ID NO: 39441 - protein, 9 aa, Homo Sapiens
WTYEMFLNF

SEQ ID NO: 39442 - protein, 9 aa, Homo Sapiens
MITHDVYVM

SEQ ID NO: 39443 - protein, 9 aa, Homo Sapiens
ANALLIIPK

SEQ ID NO: 39444 - protein, 9 aa, Homo Sapiens
VRVIIGYLE

SEQ ID NO: 39445 - protein, 9 aa, Homo Sapiens
EAEPGPEGP

SEQ ID NO: 39446 - protein, 9 aa, Homo Sapiens
EAVLSDKVQ

SEQ ID NO: 39447 - protein, 9 aa, Homo Sapiens
TGLCPGPMS

SEQ ID NO: 39448 - protein, 9 aa, Homo Sapiens
GSKIKKLVH

SEQ ID NO: 39449 - protein, 9 aa, Homo Sapiens
ETTSSSICR

SEQ ID NO: 39450 - protein, 9 aa, Homo Sapiens
WDLKPSNIV

SEQ ID NO: 39451 - protein, 9 aa, Homo Sapiens
DGSYPRQAN

SEQ ID NO: 39452 - protein, 9 aa, Homo Sapiens
PVSSEAQRH

SEQ ID NO: 39453 - protein, 9 aa, Homo Sapiens
QTVLHVHKK

SEQ ID NO: 39454 - protein, 9 aa, Homo Sapiens
PAPRLASTG

SEQ ID NO: 39455 - protein, 9 aa, Homo Sapiens
LSDKVQNII

SEQ ID NO: 39456 - protein, 9 aa, Homo Sapiens
CVLEICAKQ

SEQ ID NO: 39457 - protein, 9 aa, Homo Sapiens
VVMNSREFW

SEQ ID NO: 39458 - protein, 9 aa, Homo Sapiens
KPTSKQEQI

SEQ ID NO: 39459 - protein, 9 aa, Homo Sapiens
MTSLFSSTT

SEQ ID NO: 39460 - protein, 9 aa, Homo Sapiens
DCRFPGNTG

SEQ ID NO: 39461 - protein, 9 aa, Homo Sapiens
SNHFIKLLV

SEQ ID NO: 39462 - protein, 9 aa, Homo Sapiens
PGEEQLYTD

SEQ ID NO: 39463 - protein, 9 aa, Homo Sapiens
NVDENVAKL

SEQ ID NO: 39464 - protein, 9 aa, Homo Sapiens
IPHPESRGP

SEQ ID NO: 39465 - protein, 9 aa, Homo Sapiens
AACCTFMRD

SEQ ID NO: 39466 - protein, 9 aa, Homo Sapiens
IMFRSGIYQ

SEQ ID NO: 39467 - protein, 9 aa, Homo Sapiens
AFQPPISII

SEQ ID NO: 39468 - protein, 9 aa, Homo Sapiens
TQSCVASSA

SEQ ID NO: 39469 - protein, 9 aa, Homo Sapiens
IKEIEIDLE

SEQ ID NO: 39470 - protein, 9 aa, Homo Sapiens
KLIKLKAEI

SEQ ID NO: 39471 - protein, 9 aa, Homo Sapiens
SPHPGIDLS

SEQ ID NO: 39472 - protein, 9 aa, Homo Sapiens
LYKRKRAQS

SEQ ID NO: 39473 - protein, 9 aa, Homo Sapiens
VWSQGPGGK

SEQ ID NO: 39474 - protein, 9 aa, Homo Sapiens
VLPFRQNDL

SEQ ID NO: 39475 - protein, 9 aa, Homo Sapiens
FSKHDIIAE

SEQ ID NO: 39476 - protein, 9 aa, Homo Sapiens
TLLPLGGNH

SEQ ID NO: 39477 - protein, 9 aa, Homo Sapiens
PRCRWAAAP

SEQ ID NO: 39478 - protein, 9 aa, Homo Sapiens
SGCDLICCG

SEQ ID NO: 39479 - protein, 9 aa, Homo Sapiens
YLRSVGDGG

SEQ ID NO: 39480 - protein, 9 aa, Homo Sapiens
SFSQRSSSQ

SEQ ID NO: 39481 - protein, 9 aa, Homo Sapiens
VQTVLHVHK

SEQ ID NO: 39482 - protein, 9 aa, Homo Sapiens
ITGKKACQR

SEQ ID NO: 39483 - protein, 9 aa, Homo Sapiens
TTSSSICRH

SEQ ID NO: 39484 - protein, 9 aa, Homo Sapiens
QMVHIYKDG

SEQ ID NO: 39485 - protein, 9 aa, Homo Sapiens
TERMGAEDK

SEQ ID NO: 39486 - protein, 9 aa, Homo Sapiens
NGACRSSKD

SEQ ID NO: 39487 - protein, 9 aa, Homo Sapiens
AIELRKPIY

SEQ ID NO: 39488 - protein, 9 aa, Homo Sapiens
TVRHLKRLV

SEQ ID NO: 39489 - protein, 9 aa, Homo Sapiens
DPEAVLSDK

SEQ ID NO: 39490 - protein, 9 aa, Homo Sapiens
GRIRLAVYH

SEQ ID NO: 39491 - protein, 9 aa, Homo Sapiens
DAKAPEEEI

SEQ ID NO: 39492 - protein, 9 aa, Homo Sapiens
PAESRNKSA

SEQ ID NO: 39493 - protein, 9 aa, Homo Sapiens
SLDKDNDRL

SEQ ID NO: 39494 - protein, 9 aa, Homo Sapiens
EKEEEEEDV

SEQ ID NO: 39495 - protein, 9 aa, Homo Sapiens
NTAEKPCKC

SEQ ID NO: 39496 - protein, 9 aa, Homo Sapiens
GPLVNSKYY

SEQ ID NO: 39497 - protein, 9 aa, Homo Sapiens
AVYSSKVLD

SEQ ID NO: 39498 - protein, 9 aa, Homo Sapiens
EMITHDVYV

SEQ ID NO: 39499 - protein, 9 aa, Homo Sapiens
SIGVPLLTL

SEQ ID NO: 39500 - protein, 9 aa, Homo Sapiens
TFVTKGVAE

SEQ ID NO: 39501 - protein, 9 aa, Homo Sapiens
CVPLRESGS

SEQ ID NO: 39502 - protein, 9 aa, Homo Sapiens
NCVLEICAK

SEQ ID NO: 39503 - protein, 9 aa, Homo Sapiens
FKPPTCMTG

SEQ ID NO: 39504 - protein, 9 aa, Homo Sapiens
GGQRRGHGH

SEQ ID NO: 39505 - protein, 9 aa, Homo Sapiens
GQGVTPKAD

SEQ ID NO: 39506 - protein, 9 aa, Homo Sapiens
GIANEVAAH

SEQ ID NO: 39507 - protein, 9 aa, Homo Sapiens
TMPNQMVHI

SEQ ID NO: 39508 - protein, 9 aa, Homo Sapiens
TLVSDPLEK

SEQ ID NO: 39509 - protein, 9 aa, Homo Sapiens
REIADKLIK

SEQ ID NO: 39510 - protein, 9 aa, Homo Sapiens
EVGISERQN

SEQ ID NO: 39511 - protein, 9 aa, Homo Sapiens
GLSCVPLRE

SEQ ID NO: 39512 - protein, 9 aa, Homo Sapiens
KLLVPFFLF

SEQ ID NO: 39513 - protein, 9 aa, Homo Sapiens
GIPVSSEAQ

SEQ ID NO: 39514 - protein, 9 aa, Homo Sapiens
NHDDHECCE

SEQ ID NO: 39515 - protein, 9 aa, Homo Sapiens
RVSLDKDND

SEQ ID NO: 39516 - protein, 9 aa, Homo Sapiens
LSSHCQKSG

SEQ ID NO: 39517 - protein, 9 aa, Homo Sapiens
HHLPGHVCL

SEQ ID NO: 39518 - protein, 9 aa, Homo Sapiens
HNRSLEEIL

SEQ ID NO: 39519 - protein, 9 aa, Homo Sapiens
GLLLKIDSL

SEQ ID NO: 39520 - protein, 9 aa, Homo Sapiens
PDAECAKKS

SEQ ID NO: 39521 - protein, 9 aa, Homo Sapiens
SGSAVYSSK

SEQ ID NO: 39522 - protein, 9 aa, Homo Sapiens
EVAAHGIAS

SEQ ID NO: 39523 - protein, 9 aa, Homo Sapiens
KKRLEEQNE

SEQ ID NO: 39524 - protein, 9 aa, Homo Sapiens
GGNHQPEPS

SEQ ID NO: 39525 - protein, 9 aa, Homo Sapiens
PERPKAPPS

SEQ ID NO: 39526 - protein, 9 aa, Homo Sapiens
NGNSEEILG

SEQ ID NO: 39527 - protein, 9 aa, Homo Sapiens
QDPEAVLSD

SEQ ID NO: 39528 - protein, 9 aa, Homo Sapiens
GHVCLHHRS

SEQ ID NO: 39529 - protein, 9 aa, Homo Sapiens
RCRWAAAPY

SEQ ID NO: 39530 - protein, 9 aa, Homo Sapiens
SAAEPTSSG

SEQ ID NO: 39531 - protein, 9 aa, Homo Sapiens
VQLRDKGAY

SEQ ID NO: 39532 - protein, 9 aa, Homo Sapiens
LVDKTLKCD

SEQ ID NO: 39533 - protein, 9 aa, Homo Sapiens
SLTSQWFAK

SEQ ID NO: 39534 - protein, 9 aa, Homo Sapiens
LGLLELPQP

SEQ ID NO: 39535 - protein, 9 aa, Homo Sapiens
YKRKRAQSD

SEQ ID NO: 39536 - protein, 9 aa, Homo Sapiens
IDDNATTKE

SEQ ID NO: 39537 - protein, 9 aa, Homo Sapiens
LMKKKMVKR

SEQ ID NO: 39538 - protein, 9 aa, Homo Sapiens
AKSKAMSTC

SEQ ID NO: 39539 - protein, 9 aa, Homo Sapiens
GPFSHMFHG

SEQ ID NO: 39540 - protein, 9 aa, Homo Sapiens
LVHPPGFMG

SEQ ID NO: 39541 - protein, 9 aa, Homo Sapiens
SSICRHYGL

SEQ ID NO: 39542 - protein, 9 aa, Homo Sapiens
EDSALADKD

SEQ ID NO: 39543 - protein, 9 aa, Homo Sapiens
IGCIMYTFL

SEQ ID NO: 39544 - protein, 9 aa, Homo Sapiens
SDKPLRDPE

SEQ ID NO: 39545 - protein, 9 aa, Homo Sapiens
LRLLQPFGV

SEQ ID NO: 39546 - protein, 9 aa, Homo Sapiens
HPQKDGYYF

SEQ ID NO: 39547 - protein, 9 aa, Homo Sapiens
KKLVHPPGF

SEQ ID NO: 39548 - protein, 9 aa, Homo Sapiens
IATYGMSPH

SEQ ID NO: 39549 - protein, 9 aa, Homo Sapiens
SLLPKEVKN

SEQ ID NO: 39550 - protein, 9 aa, Homo Sapiens
TLAQIHFMQ

SEQ ID NO: 39551 - protein, 9 aa, Homo Sapiens
NRFITQSCV

SEQ ID NO: 39552 - protein, 9 aa, Homo Sapiens
ATYGMSPHP

SEQ ID NO: 39553 - protein, 9 aa, Homo Sapiens
QGKSLDQCV

SEQ ID NO: 39554 - protein, 9 aa, Homo Sapiens
PKKGLMKKK

SEQ ID NO: 39555 - protein, 9 aa, Homo Sapiens
PNWNGNSEE

SEQ ID NO: 39556 - protein, 9 aa, Homo Sapiens
MPNQMVHIY

SEQ ID NO: 39557 - protein, 9 aa, Homo Sapiens
EGMLPVVKP

SEQ ID NO: 39558 - protein, 9 aa, Homo Sapiens
LAIYCMQVH

SEQ ID NO: 39559 - protein, 9 aa, Homo Sapiens
VGFCYQIRC

SEQ ID NO: 39560 - protein, 9 aa, Homo Sapiens
LSLFVSAAG

SEQ ID NO: 39561 - protein, 9 aa, Homo Sapiens
PISIILLLS

SEQ ID NO: 39562 - protein, 9 aa, Homo Sapiens
AQEQKSCIR

SEQ ID NO: 39563 - protein, 9 aa, Homo Sapiens
PRAGEKGPH

SEQ ID NO: 39564 - protein, 9 aa, Homo Sapiens
VVFVCEYIE

SEQ ID NO: 39565 - protein, 9 aa, Homo Sapiens
QMGPRPPEN

SEQ ID NO: 39566 - protein, 9 aa, Homo Sapiens
TFLVGKPPF

SEQ ID NO: 39567 - protein, 9 aa, Homo Sapiens
GSQGANFSG

SEQ ID NO: 39568 - protein, 9 aa, Homo Sapiens
EDAKAPEEE

SEQ ID NO: 39569 - protein, 9 aa, Homo Sapiens
PGGQRRGHG

SEQ ID NO: 39570 - protein, 9 aa, Homo Sapiens
KTLKCDISL

SEQ ID NO: 39571 - protein, 9 aa, Homo Sapiens
MDVQNKIQE

SEQ ID NO: 39572 - protein, 9 aa, Homo Sapiens
KAPEEEIPK

SEQ ID NO: 39573 - protein, 9 aa, Homo Sapiens
CSPGGRQNW

SEQ ID NO: 39574 - protein, 9 aa, Homo Sapiens
LLYKRKRAQ

SEQ ID NO: 39575 - protein, 9 aa, Homo Sapiens
VEAQDGGVQ

SEQ ID NO: 39576 - protein, 9 aa, Homo Sapiens
IELAEYRKT

SEQ ID NO: 39577 - protein, 9 aa, Homo Sapiens
GSHGSQGAN

SEQ ID NO: 39578 - protein, 9 aa, Homo Sapiens
IGEEENKIF

SEQ ID NO: 39579 - protein, 9 aa, Homo Sapiens
VAPYIGSPA

SEQ ID NO: 39580 - protein, 9 aa, Homo Sapiens
SSLLAQEQK

SEQ ID NO: 39581 - protein, 9 aa, Homo Sapiens
NYCPSEWRQ

SEQ ID NO: 39582 - protein, 9 aa, Homo Sapiens
GIDDTERMG

SEQ ID NO: 39583 - protein, 9 aa, Homo Sapiens
RAGVGLSCV

SEQ ID NO: 39584 - protein, 9 aa, Homo Sapiens
PGECWLSLF

SEQ ID NO: 39585 - protein, 9 aa, Homo Sapiens
ICCGRGYNT

SEQ ID NO: 39586 - protein, 9 aa, Homo Sapiens
PPTCMTGAT

SEQ ID NO: 39587 - protein, 9 aa, Homo Sapiens
TVHKVINTA

SEQ ID NO: 39588 - protein, 9 aa, Homo Sapiens
FQGLVSFKD

SEQ ID NO: 39589 - protein, 9 aa, Homo Sapiens
KDHHSTHYR

SEQ ID NO: 39590 - protein, 9 aa, Homo Sapiens
ATTKECFLN

SEQ ID NO: 39591 - protein, 9 aa, Homo Sapiens
MFHRRRRRD

SEQ ID NO: 39592 - protein, 9 aa, Homo Sapiens
PAGRVEEEK

SEQ ID NO: 39593 - protein, 9 aa, Homo Sapiens
TYTDGEGVS

SEQ ID NO: 39594 - protein, 9 aa, Homo Sapiens
LSRHKQTHH

SEQ ID NO: 39595 - protein, 9 aa, Homo Sapiens
LVRCGGVGF

SEQ ID NO: 39596 - protein, 9 aa, Homo Sapiens
REMYWGWKE

SEQ ID NO: 39597 - protein, 9 aa, Homo Sapiens
RRGHGHTAL

SEQ ID NO: 39598 - protein, 9 aa, Homo Sapiens
MTELDIDMN

SEQ ID NO: 39599 - protein, 9 aa, Homo Sapiens
NKSAKGMYS

SEQ ID NO: 39600 - protein, 9 aa, Homo Sapiens
LLSIGVPLL

SEQ ID NO: 39601 - protein, 9 aa, Homo Sapiens
LCLEKMEDI

SEQ ID NO: 39602 - protein, 9 aa, Homo Sapiens
QGGWELTEQ

SEQ ID NO: 39603 - protein, 9 aa, Homo Sapiens
AGIIHWDLK

SEQ ID NO: 39604 - protein, 9 aa, Homo Sapiens
QQRKTKNSH

SEQ ID NO: 39605 - protein, 9 aa, Homo Sapiens
LPSSTTQEM

SEQ ID NO: 39606 - protein, 9 aa, Homo Sapiens
TGVPAVYMD

SEQ ID NO: 39607 - protein, 9 aa, Homo Sapiens
KPPTCMTGA

SEQ ID NO: 39608 - protein, 9 aa, Homo Sapiens
NSKYYTGWL

SEQ ID NO: 39609 - protein, 9 aa, Homo Sapiens
LQDQHTINT

SEQ ID NO: 39610 - protein, 9 aa, Homo Sapiens
GKYIKTWRP

SEQ ID NO: 39611 - protein, 9 aa, Homo Sapiens
VPIMFRSGI

SEQ ID NO: 39612 - protein, 9 aa, Homo Sapiens
FPVSDSNRH

SEQ ID NO: 39613 - protein, 9 aa, Homo Sapiens
DAIKEIEID

SEQ ID NO: 39614 - protein, 9 aa, Homo Sapiens
PMSPRMSCG

SEQ ID NO: 39615 - protein, 9 aa, Homo Sapiens
TPGGGCRGG

SEQ ID NO: 39616 - protein, 9 aa, Homo Sapiens
MYVQTVLHV

SEQ ID NO: 39617 - protein, 9 aa, Homo Sapiens
IELRKPIYW

SEQ ID NO: 39618 - protein, 9 aa, Homo Sapiens
SSDEILNDG

SEQ ID NO: 39619 - protein, 9 aa, Homo Sapiens
KDAIELCLE

SEQ ID NO: 39620 - protein, 9 aa, Homo Sapiens
SPNWNGNSE

SEQ ID NO: 39621 - protein, 9 aa, Homo Sapiens
HKRGKYIKT

SEQ ID NO: 39622 - protein, 9 aa, Homo Sapiens
RVEEEKEEE

SEQ ID NO: 39623 - protein, 9 aa, Homo Sapiens
AAKLAFQKH

SEQ ID NO: 39624 - protein, 9 aa, Homo Sapiens
KGSLGNQRR

SEQ ID NO: 39625 - protein, 9 aa, Homo Sapiens
KIKKLVHPP

SEQ ID NO: 39626 - protein, 9 aa, Homo Sapiens
AKALCVLLP

SEQ ID NO: 39627 - protein, 9 aa, Homo Sapiens
KHELQNLRA

SEQ ID NO: 39628 - protein, 9 aa, Homo Sapiens
ERMGAEDKL

SEQ ID NO: 39629 - protein, 9 aa, Homo Sapiens
CGKTFSDES

SEQ ID NO: 39630 - protein, 9 aa, Homo Sapiens
IEENCSKNK

SEQ ID NO: 39631 - protein, 9 aa, Homo Sapiens
LAEYRKTGA

SEQ ID NO: 39632 - protein, 9 aa, Homo Sapiens
KETTSSSIC

SEQ ID NO: 39633 - protein, 9 aa, Homo Sapiens
LICCGRGYN

SEQ ID NO: 39634 - protein, 9 aa, Homo Sapiens
GWLHKRGKY

SEQ ID NO: 39635 - protein, 9 aa, Homo Sapiens
LSQFPKHLG

SEQ ID NO: 39636 - protein, 9 aa, Homo Sapiens
ECWLSLFVS

SEQ ID NO: 39637 - protein, 9 aa, Homo Sapiens
SSEVFLVDK

SEQ ID NO: 39638 - protein, 9 aa, Homo Sapiens
GGATLAHTI

SEQ ID NO: 39639 - protein, 9 aa, Homo Sapiens
KRGKYIKTW

SEQ ID NO: 39640 - protein, 9 aa, Homo Sapiens
LPFRQNDLS

SEQ ID NO: 39641 - protein, 9 aa, Homo Sapiens
TPFFVVFVC

SEQ ID NO: 39642 - protein, 9 aa, Homo Sapiens
PKKIQLMTS

SEQ ID NO: 39643 - protein, 9 aa, Homo Sapiens
KQGGPREMY

SEQ ID NO: 39644 - protein, 9 aa, Homo Sapiens
QTHHSLDSQ

SEQ ID NO: 39645 - protein, 9 aa, Homo Sapiens
YVKQNTSSV

SEQ ID NO: 39646 - protein, 9 aa, Homo Sapiens
YPSPDAECA

SEQ ID NO: 39647 - protein, 9 aa, Homo Sapiens
DQTSYMVHV

SEQ ID NO: 39648 - protein, 9 aa, Homo Sapiens
TKECFLNQT

SEQ ID NO: 39649 - protein, 9 aa, Homo Sapiens
SVERQHNLE

SEQ ID NO: 39650 - protein, 9 aa, Homo Sapiens
EEDGASAAE

SEQ ID NO: 39651 - protein, 9 aa, Homo Sapiens
GTLVSDPLE

SEQ ID NO: 39652 - protein, 9 aa, Homo Sapiens
PSSTGGEKR

SEQ ID NO: 39653 - protein, 9 aa, Homo Sapiens
TVLNGTILA

SEQ ID NO: 39654 - protein, 9 aa, Homo Sapiens
GVECDGCKK

SEQ ID NO: 39655 - protein, 9 aa, Homo Sapiens
VSVWSQGPG

SEQ ID NO: 39656 - protein, 9 aa, Homo Sapiens
PNQMVHIYK

SEQ ID NO: 39657 - protein, 9 aa, Homo Sapiens
REFWIWMLE

SEQ ID NO: 39658 - protein, 9 aa, Homo Sapiens
PIDLVKIFD

SEQ ID NO: 39659 - protein, 9 aa, Homo Sapiens
NVAKLVGIL

SEQ ID NO: 39660 - protein, 9 aa, Homo Sapiens
PEGPPPPPS

SEQ ID NO: 39661 - protein, 9 aa, Homo Sapiens
DSHFLTVPR

SEQ ID NO: 39662 - protein, 9 aa, Homo Sapiens
GEEQLYTDE

SEQ ID NO: 39663 - protein, 9 aa, Homo Sapiens
LEICAKQRN

SEQ ID NO: 39664 - protein, 9 aa, Homo Sapiens
EEEIPKKEE

SEQ ID NO: 39665 - protein, 9 aa, Homo Sapiens
AIYCMQVHK

SEQ ID NO: 39666 - protein, 9 aa, Homo Sapiens
MVHIYKDGK

SEQ ID NO: 39667 - protein, 9 aa, Homo Sapiens
DEDGSPNWN

SEQ ID NO: 39668 - protein, 9 aa, Homo Sapiens
IKVFSLLQK

SEQ ID NO: 39669 - protein, 9 aa, Homo Sapiens
SIILLLSIG

SEQ ID NO: 39670 - protein, 9 aa, Homo Sapiens
KGLMKKKMV

SEQ ID NO: 39671 - protein, 9 aa, Homo Sapiens
QIEYVEEPG

SEQ ID NO: 39672 - protein, 9 aa, Homo Sapiens
FIIKHELQN

SEQ ID NO: 39673 - protein, 9 aa, Homo Sapiens
LAQEQKSCI

SEQ ID NO: 39674 - protein, 9 aa, Homo Sapiens
AFQKHMMKP

SEQ ID NO: 39675 - protein, 9 aa, Homo Sapiens
IREMENQFQ

SEQ ID NO: 39676 - protein, 9 aa, Homo Sapiens
SKAMSTCIT

SEQ ID NO: 39677 - protein, 9 aa, Homo Sapiens
INTKASEVT

SEQ ID NO: 39678 - protein, 9 aa, Homo Sapiens
SPAGCTTRQ

SEQ ID NO: 39679 - protein, 9 aa, Homo Sapiens
VNSKYYTGW

SEQ ID NO: 39680 - protein, 9 aa, Homo Sapiens
VWRTPGGGC

SEQ ID NO: 39681 - protein, 9 aa, Homo Sapiens
LVVNKQQRK

SEQ ID NO: 39682 - protein, 9 aa, Homo Sapiens
EEENKIFLE

SEQ ID NO: 39683 - protein, 9 aa, Homo Sapiens
ENNPLPQGF

SEQ ID NO: 39684 - protein, 9 aa, Homo Sapiens
FLSGRALLD

SEQ ID NO: 39685 - protein, 9 aa, Homo Sapiens
GVPLLTLKW

SEQ ID NO: 39686 - protein, 9 aa, Homo Sapiens
SDVEAQDGG

SEQ ID NO: 39687 - protein, 9 aa, Homo Sapiens
EIADKLIKL

SEQ ID NO: 39688 - protein, 9 aa, Homo Sapiens
CHHLPGHVC

SEQ ID NO: 39689 - protein, 9 aa, Homo Sapiens
TMGSNYCPS

SEQ ID NO: 39690 - protein, 9 aa, Homo Sapiens
QPPISIILL

SEQ ID NO: 39691 - protein, 9 aa, Homo Sapiens
EPGPEGPPP

SEQ ID NO: 39692 - protein, 9 aa, Homo Sapiens
PGLAIYCMQ

SEQ ID NO: 39693 - protein, 9 aa, Homo Sapiens
HKQTHHSLD

SEQ ID NO: 39694 - protein, 9 aa, Homo Sapiens
RKTKNSHQN

SEQ ID NO: 39695 - protein, 9 aa, Homo Sapiens
MIPHPESRG

SEQ ID NO: 39696 - protein, 9 aa, Homo Sapiens
AEAEPGPEG

SEQ ID NO: 39697 - protein, 9 aa, Homo Sapiens
KAPPSYAEV

SEQ ID NO: 39698 - protein, 9 aa, Homo Sapiens
ADLLLREML

SEQ ID NO: 39699 - protein, 9 aa, Homo Sapiens
LDKLAAIQS

SEQ ID NO: 39700 - protein, 9 aa, Homo Sapiens
QSCVASSAW

SEQ ID NO: 39701 - protein, 9 aa, Homo Sapiens
KIQLMTSCD

SEQ ID NO: 39702 - protein, 9 aa, Homo Sapiens
MLQDQHTIN

SEQ ID NO: 39703 - protein, 9 aa, Homo Sapiens
EQIVKRLVS

SEQ ID NO: 39704 - protein, 9 aa, Homo Sapiens
LDKDNDRLM

SEQ ID NO: 39705 - protein, 9 aa, Homo Sapiens
YWGWKELPG

SEQ ID NO: 39706 - protein, 9 aa, Homo Sapiens
FSQRSSSQR

SEQ ID NO: 39707 - protein, 9 aa, Homo Sapiens
YCVWEGATS

SEQ ID NO: 39708 - protein, 9 aa, Homo Sapiens
DSALADKDE

SEQ ID NO: 39709 - protein, 9 aa, Homo Sapiens
THFPFAIKV

SEQ ID NO: 39710 - protein, 9 aa, Homo Sapiens
SAEDSALAD

SEQ ID NO: 39711 - protein, 9 aa, Homo Sapiens
GAQDCRFPG

SEQ ID NO: 39712 - protein, 9 aa, Homo Sapiens
FSDESRLRK

SEQ ID NO: 39713 - protein, 9 aa, Homo Sapiens
QKDGYYFLL

SEQ ID NO: 39714 - protein, 9 aa, Homo Sapiens
QKFQGLVSF

SEQ ID NO: 39715 - protein, 9 aa, Homo Sapiens
LHNRSLEEI

SEQ ID NO: 39716 - protein, 9 aa, Homo Sapiens
LKGQGVTPK

SEQ ID NO: 39717 - protein, 9 aa, Homo Sapiens
GPREMYWGW

SEQ ID NO: 39718 - protein, 9 aa, Homo Sapiens
VTVTPTYTD

SEQ ID NO: 39719 - protein, 9 aa, Homo Sapiens
GFCYQIRCC

SEQ ID NO: 39720 - protein, 9 aa, Homo Sapiens
VLSDKVQNI

SEQ ID NO: 39721 - protein, 9 aa, Homo Sapiens
ISIILLLSI

SEQ ID NO: 39722 - protein, 9 aa, Homo Sapiens
ASSQKSFSQ

SEQ ID NO: 39723 - protein, 9 aa, Homo Sapiens
QDCRFPGNT

SEQ ID NO: 39724 - protein, 9 aa, Homo Sapiens
AIKVFSLLQ

SEQ ID NO: 39725 - protein, 9 aa, Homo Sapiens
HYRHRLLDK

SEQ ID NO: 39726 - protein, 9 aa, Homo Sapiens
EPGEEQLYT

SEQ ID NO: 39727 - protein, 9 aa, Homo Sapiens
LLKGQGVTP

SEQ ID NO: 39728 - protein, 9 aa, Homo Sapiens
CSKNKKRLE

SEQ ID NO: 39729 - protein, 9 aa, Homo Sapiens
SPGGRQNWA

SEQ ID NO: 39730 - protein, 9 aa, Homo Sapiens
RAGGVALLS

SEQ ID NO: 39731 - protein, 9 aa, Homo Sapiens
QLDDGTLVS

SEQ ID NO: 39732 - protein, 9 aa, Homo Sapiens
ESRLRKHEK

SEQ ID NO: 39733 - protein, 9 aa, Homo Sapiens
ILRLYLPDN

SEQ ID NO: 39734 - protein, 9 aa, Homo Sapiens
ESYHCRLAA

SEQ ID NO: 39735 - protein, 9 aa, Homo Sapiens
SQFPKHLGK

SEQ ID NO: 39736 - protein, 9 aa, Homo Sapiens
LPLGGNHQP

SEQ ID NO: 39737 - protein, 9 aa, Homo Sapiens
AESRNKSAK

SEQ ID NO: 39738 - protein, 9 aa, Homo Sapiens
ASFQPNFTV

SEQ ID NO: 39739 - protein, 9 aa, Homo Sapiens
TEQVESHHR

SEQ ID NO: 39740 - protein, 9 aa, Homo Sapiens
CDGCKKILP

SEQ ID NO: 39741 - protein, 9 aa, Homo Sapiens
WELTEQVES

SEQ ID NO: 39742 - protein, 9 aa, Homo Sapiens
AHTISEAAI

SEQ ID NO: 39743 - protein, 9 aa, Homo Sapiens
SALADKDED

SEQ ID NO: 39744 - protein, 9 aa, Homo Sapiens
EENCSKNKK

SEQ ID NO: 39745 - protein, 9 aa, Homo Sapiens
DDTERMGAE

SEQ ID NO: 39746 - protein, 9 aa, Homo Sapiens
QASHFETRP

SEQ ID NO: 39747 - protein, 9 aa, Homo Sapiens
VINTAEKPC

SEQ ID NO: 39748 - protein, 9 aa, Homo Sapiens
SEAQRHELG

SEQ ID NO: 39749 - protein, 9 aa, Homo Sapiens
KKPTSKQEQ

SEQ ID NO: 39750 - protein, 9 aa, Homo Sapiens
GGWELTEQV

SEQ ID NO: 39751 - protein, 9 aa, Homo Sapiens
IHRQHDKPG

SEQ ID NO: 39752 - protein, 9 aa, Homo Sapiens
AQDCRFPGN

SEQ ID NO: 39753 - protein, 9 aa, Homo Sapiens
DKTLKCDIS

SEQ ID NO: 39754 - protein, 9 aa, Homo Sapiens
HDIIAEVKV

SEQ ID NO: 39755 - protein, 9 aa, Homo Sapiens
IAEVKVPMN

SEQ ID NO: 39756 - protein, 9 aa, Homo Sapiens
GGPEKPWKC

SEQ ID NO: 39757 - protein, 9 aa, Homo Sapiens
ESRNKSAKG

SEQ ID NO: 39758 - protein, 9 aa, Homo Sapiens
PQKYAMDVQ

SEQ ID NO: 39759 - protein, 9 aa, Homo Sapiens
RPAESRNKS

SEQ ID NO: 39760 - protein, 9 aa, Homo Sapiens
YCMQVHKET

SEQ ID NO: 39761 - protein, 9 aa, Homo Sapiens
YMDELAAFA

SEQ ID NO: 39762 - protein, 9 aa, Homo Sapiens
ALADKDEDE

SEQ ID NO: 39763 - protein, 9 aa, Homo Sapiens
DSFVIELEK

SEQ ID NO: 39764 - protein, 9 aa, Homo Sapiens
HFIKLLVPF

SEQ ID NO: 39765 - protein, 9 aa, Homo Sapiens
TLRPRLEGE

SEQ ID NO: 39766 - protein, 9 aa, Homo Sapiens
LRDKGAYVC

SEQ ID NO: 39767 - protein, 9 aa, Homo Sapiens
ACSYGRIRL

SEQ ID NO: 39768 - protein, 9 aa, Homo Sapiens
PPENNPLPQ

SEQ ID NO: 39769 - protein, 9 aa, Homo Sapiens
RDSHFLTVP

SEQ ID NO: 39770 - protein, 9 aa, Homo Sapiens
QDGGVQRGP

SEQ ID NO: 39771 - protein, 9 aa, Homo Sapiens
CSYGRIRLA

SEQ ID NO: 39772 - protein, 9 aa, Homo Sapiens
MKSIISLLL

SEQ ID NO: 39773 - protein, 9 aa, Homo Sapiens
EICAKQRNL

SEQ ID NO: 39774 - protein, 9 aa, Homo Sapiens
DPLDRCYST

SEQ ID NO: 39775 - protein, 9 aa, Homo Sapiens
HMFHGRFIP

SEQ ID NO: 39776 - protein, 9 aa, Homo Sapiens
QPKKIQLMT

SEQ ID NO: 39777 - protein, 9 aa, Homo Sapiens
AGCTTRQGE

SEQ ID NO: 39778 - protein, 9 aa, Homo Sapiens
ASASFQPNF

SEQ ID NO: 39779 - protein, 9 aa, Homo Sapiens
SRLRKHEKL

SEQ ID NO: 39780 - protein, 9 aa, Homo Sapiens
SELLQQQEE

SEQ ID NO: 39781 - protein, 9 aa, Homo Sapiens
FLLLFNTTE

SEQ ID NO: 39782 - protein, 9 aa, Homo Sapiens
TVLHVHKKY

SEQ ID NO: 39783 - protein, 9 aa, Homo Sapiens
MFPLWALWL

SEQ ID NO: 39784 - protein, 9 aa, Homo Sapiens
TRKSQVVPL

SEQ ID NO: 39785 - protein, 9 aa, Homo Sapiens
QRERGGGPE

SEQ ID NO: 39786 - protein, 9 aa, Homo Sapiens
AFANALLII

SEQ ID NO: 39787 - protein, 9 aa, Homo Sapiens
ASQIHRQHD

SEQ ID NO: 39788 - protein, 9 aa, Homo Sapiens
VSLDKDNDR

SEQ ID NO: 39789 - protein, 9 aa, Homo Sapiens
LDSFVIELE

SEQ ID NO: 39790 - protein, 9 aa, Homo Sapiens
PKAPPSYAE

SEQ ID NO: 39791 - protein, 9 aa, Homo Sapiens
KHDIIAEVK

SEQ ID NO: 39792 - protein, 9 aa, Homo Sapiens
QIHRQHDKP

SEQ ID NO: 39793 - protein, 9 aa, Homo Sapiens
DRDSHFLTV

SEQ ID NO: 39794 - protein, 9 aa, Homo Sapiens
PGPEGPPPP

SEQ ID NO: 39795 - protein, 9 aa, Homo Sapiens
IDSLLPKEV

SEQ ID NO: 39796 - protein, 9 aa, Homo Sapiens
WNGNSEEIL

SEQ ID NO: 39797 - protein, 9 aa, Homo Sapiens
VGISERQNA

SEQ ID NO: 39798 - protein, 9 aa, Homo Sapiens
PQGKSLDQC

SEQ ID NO: 39799 - protein, 9 aa, Homo Sapiens
CQRMKDAIR

SEQ ID NO: 39800 - protein, 9 aa, Homo Sapiens
LLELPQPHV

SEQ ID NO: 39801 - protein, 9 aa, Homo Sapiens
RPPENNPLP

SEQ ID NO: 39802 - protein, 9 aa, Homo Sapiens
VKVPIMFRS

SEQ ID NO: 39803 - protein, 9 aa, Homo Sapiens
AIELCLEKM

SEQ ID NO: 39804 - protein, 9 aa, Homo Sapiens
ILNDGQSPK

SEQ ID NO: 39805 - protein, 9 aa, Homo Sapiens
PFAIKVFSL

SEQ ID NO: 39806 - protein, 9 aa, Homo Sapiens
DKKYNWDVK

SEQ ID NO: 39807 - protein, 9 aa, Homo Sapiens
GLLELPQPH

SEQ ID NO: 39808 - protein, 9 aa, Homo Sapiens
WLHKRGKYI

SEQ ID NO: 39809 - protein, 9 aa, Homo Sapiens
PLGGNHQPE

SEQ ID NO: 39810 - protein, 9 aa, Homo Sapiens
KGQRPGGKR

SEQ ID NO: 39811 - protein, 9 aa, Homo Sapiens
INTAEKPCK

SEQ ID NO: 39812 - protein, 9 aa, Homo Sapiens
NRVKMQQKS

SEQ ID NO: 39813 - protein, 9 aa, Homo Sapiens
SNRVKMQQK

SEQ ID NO: 39814 - protein, 9 aa, Homo Sapiens
KACQRMKDA

SEQ ID NO: 39815 - protein, 9 aa, Homo Sapiens
LTVPRSRYS

SEQ ID NO: 39816 - protein, 9 aa, Homo Sapiens
PGPILRLYL

SEQ ID NO: 39817 - protein, 9 aa, Homo Sapiens
LVRVIIGYL

SEQ ID NO: 39818 - protein, 9 aa, Homo Sapiens
QIREMENQF

SEQ ID NO: 39819 - protein, 9 aa, Homo Sapiens
VKMQQKSNL

SEQ ID NO: 39820 - protein, 9 aa, Homo Sapiens
REIEQNGAC

SEQ ID NO: 39821 - protein, 9 aa, Homo Sapiens
QERTSATHC

SEQ ID NO: 39822 - protein, 9 aa, Homo Sapiens
LLKIDSLLP

SEQ ID NO: 39823 - protein, 9 aa, Homo Sapiens
TGKKACQRM

SEQ ID NO: 39824 - protein, 9 aa, Homo Sapiens
HELQNLRAK

SEQ ID NO: 39825 - protein, 9 aa, Homo Sapiens
DSNRHLTPE

SEQ ID NO: 39826 - protein, 9 aa, Homo Sapiens
MSDSDVEAQ

SEQ ID NO: 39827 - protein, 9 aa, Homo Sapiens
QRKTKNSHQ

SEQ ID NO: 39828 - protein, 9 aa, Homo Sapiens
VTPFFVVFV

SEQ ID NO: 39829 - protein, 9 aa, Homo Sapiens
SKYYTGWLD

SEQ ID NO: 39830 - protein, 9 aa, Homo Sapiens
AAAPYRGRP

SEQ ID NO: 39831 - protein, 9 aa, Homo Sapiens
FSSTTSSST

SEQ ID NO: 39832 - protein, 9 aa, Homo Sapiens
DLFHMRESG

SEQ ID NO: 39833 - protein, 9 aa, Homo Sapiens
ANGQASHFE

SEQ ID NO: 39834 - protein, 9 aa, Homo Sapiens
GTGLCPGPM

SEQ ID NO: 39835 - protein, 9 aa, Homo Sapiens
CRFPGNTGR

SEQ ID NO: 39836 - protein, 9 aa, Homo Sapiens
QIVKRLVSE

SEQ ID NO: 39837 - protein, 9 aa, Homo Sapiens
RKGSLGNQR

SEQ ID NO: 39838 - protein, 9 aa, Homo Sapiens
QKKEIEDLQ

SEQ ID NO: 39839 - protein, 9 aa, Homo Sapiens
AGCRAGGVA

SEQ ID NO: 39840 - protein, 9 aa, Homo Sapiens
PSSTTQEMT

SEQ ID NO: 39841 - protein, 9 aa, Homo Sapiens
LLLSIGVPL

SEQ ID NO: 39842 - protein, 9 aa, Homo Sapiens
RLASTGVSW

SEQ ID NO: 39843 - protein, 9 aa, Homo Sapiens
KREQDHSLS

SEQ ID NO: 39844 - protein, 9 aa, Homo Sapiens
HLDEHQETH

SEQ ID NO: 39845 - protein, 9 aa, Homo Sapiens
QRRGHGHTA

SEQ ID NO: 39846 - protein, 9 aa, Homo Sapiens
GQEGAQDCR

SEQ ID NO: 39847 - protein, 9 aa, Homo Sapiens
KEEEEEDVD

SEQ ID NO: 39848 - protein, 9 aa, Homo Sapiens
TTRKSQVVP

SEQ ID NO: 39849 - protein, 9 aa, Homo Sapiens
DGEGCVDEK

SEQ ID NO: 39850 - protein, 9 aa, Homo Sapiens
STGVSWADK

SEQ ID NO: 39851 - protein, 9 aa, Homo Sapiens
RQHDKPGGQ

SEQ ID NO: 39852 - protein, 9 aa, Homo Sapiens
FVKEVLKWT

SEQ ID NO: 39853 - protein, 9 aa, Homo Sapiens
YGIDDTERM

SEQ ID NO: 39854 - protein, 9 aa, Homo Sapiens
SLSSSSSAS

SEQ ID NO: 39855 - protein, 9 aa, Homo Sapiens
QSPLGTLPC

SEQ ID NO: 39856 - protein, 9 aa, Homo Sapiens
RMGAEDKLP

SEQ ID NO: 39857 - protein, 9 aa, Homo Sapiens
HFLTVPRSR

SEQ ID NO: 39858 - protein, 9 aa, Homo Sapiens
LTGPVPRAR

SEQ ID NO: 39859 - protein, 9 aa, Homo Sapiens
SYCVWEGAT

SEQ ID NO: 39860 - protein, 9 aa, Homo Sapiens
ELHNRSLEE

SEQ ID NO: 39861 - protein, 9 aa, Homo Sapiens
EGAQDCRFP

SEQ ID NO: 39862 - protein, 9 aa, Homo Sapiens
FDQTSYMVH

SEQ ID NO: 39863 - protein, 9 aa, Homo Sapiens
DGTLVSDPL

SEQ ID NO: 39864 - protein, 9 aa, Homo Sapiens
AQSDSRKSS

SEQ ID NO: 39865 - protein, 9 aa, Homo Sapiens
ACRSSKDIS

SEQ ID NO: 39866 - protein, 9 aa, Homo Sapiens
KYNWDVKSL

SEQ ID NO: 39867 - protein, 9 aa, Homo Sapiens
TEDTDENAP

SEQ ID NO: 39868 - protein, 9 aa, Homo Sapiens
EAQRHELGK

SEQ ID NO: 39869 - protein, 9 aa, Homo Sapiens
SPANASLEE

SEQ ID NO: 39870 - protein, 9 aa, Homo Sapiens
GNVGEGSQS

SEQ ID NO: 39871 - protein, 9 aa, Homo Sapiens
SSLTGPVPR

SEQ ID NO: 39872 - protein, 9 aa, Homo Sapiens
CDLICCGRG

SEQ ID NO: 39873 - protein, 9 aa, Homo Sapiens
EFWIWMLEE

SEQ ID NO: 39874 - protein, 9 aa, Homo Sapiens
PSPDAECAK

SEQ ID NO: 39875 - protein, 9 aa, Homo Sapiens
VDENVAKLV

SEQ ID NO: 39876 - protein, 9 aa, Homo Sapiens
LQDPLDRCY

SEQ ID NO: 39877 - protein, 9 aa, Homo Sapiens
LSIGVPLLT

SEQ ID NO: 39878 - protein, 9 aa, Homo Sapiens
KYVKQNTSS

SEQ ID NO: 39879 - protein, 9 aa, Homo Sapiens
SDESRLRKH

SEQ ID NO: 39880 - protein, 9 aa, Homo Sapiens
NQWLGVSVW

SEQ ID NO: 39881 - protein, 9 aa, Homo Sapiens
CKKILPLGI

SEQ ID NO: 39882 - protein, 9 aa, Homo Sapiens
CRAGGVALL

SEQ ID NO: 39883 - protein, 9 aa, Homo Sapiens
LQNLRAKDE

SEQ ID NO: 39884 - protein, 9 aa, Homo Sapiens
GLQSLGGPL

SEQ ID NO: 39885 - protein, 9 aa, Homo Sapiens
VFVIKPEHY

SEQ ID NO: 39886 - protein, 9 aa, Homo Sapiens
LLDKLAAIQ

SEQ ID NO: 39887 - protein, 9 aa, Homo Sapiens
HMRESGWEH

SEQ ID NO: 39888 - protein, 9 aa, Homo Sapiens
VTEDTDENA

SEQ ID NO: 39889 - protein, 9 aa, Homo Sapiens
VSDPLEKAM

SEQ ID NO: 39890 - protein, 9 aa, Homo Sapiens
AETASEELH

SEQ ID NO: 39891 - protein, 9 aa, Homo Sapiens
SASFQPNFT

SEQ ID NO: 39892 - protein, 9 aa, Homo Sapiens
NPPNHEVVT

SEQ ID NO: 39893 - protein, 9 aa, Homo Sapiens
QLRDKGAYV

SEQ ID NO: 39894 - protein, 9 aa, Homo Sapiens
HTTRKSQVV

SEQ ID NO: 39895 - protein, 9 aa, Homo Sapiens
KEIEIDLEE

SEQ ID NO: 39896 - protein, 9 aa, Homo Sapiens
VQNIICGWR

SEQ ID NO: 39897 - protein, 9 aa, Homo Sapiens
LKDAIELCL

SEQ ID NO: 39898 - protein, 9 aa, Homo Sapiens
SNISSVSFL

SEQ ID NO: 39899 - protein, 9 aa, Homo Sapiens
PEKPWKCGD

SEQ ID NO: 39900 - protein, 9 aa, Homo Sapiens
MGPRPPENN

SEQ ID NO: 39901 - protein, 9 aa, Homo Sapiens
NTLLPLGGN

SEQ ID NO: 39902 - protein, 9 aa, Homo Sapiens
TNTADLLLR

SEQ ID NO: 39903 - protein, 9 aa, Homo Sapiens
HRRRRRDTH

SEQ ID NO: 39904 - protein, 9 aa, Homo Sapiens
EQIREMENQ

SEQ ID NO: 39905 - protein, 9 aa, Homo Sapiens
MRESGWEHV

SEQ ID NO: 39906 - protein, 9 aa, Homo Sapiens
EIEQNGACR

SEQ ID NO: 39907 - protein, 9 aa, Homo Sapiens
EDLQPPPGI

SEQ ID NO: 39908 - protein, 9 aa, Homo Sapiens
VCLHHRSWA

SEQ ID NO: 39909 - protein, 9 aa, Homo Sapiens
RPKKGLMKK

SEQ ID NO: 39910 - protein, 9 aa, Homo Sapiens
KGPHEEEPV

SEQ ID NO: 39911 - protein, 9 aa, Homo Sapiens
QEMTPHEIK

SEQ ID NO: 39912 - protein, 9 aa, Homo Sapiens
NAPLVPDDT

SEQ ID NO: 39913 - protein, 9 aa, Homo Sapiens
IHPRCRWAA

SEQ ID NO: 39914 - protein, 9 aa, Homo Sapiens
IEVANGQAS

SEQ ID NO: 39915 - protein, 9 aa, Homo Sapiens
VLQDPLDRC

SEQ ID NO: 39916 - protein, 9 aa, Homo Sapiens
MGSNYCPSE

SEQ ID NO: 39917 - protein, 9 aa, Homo Sapiens
DGASAAEPT

SEQ ID NO: 39918 - protein, 9 aa, Homo Sapiens
APYIGSPAN

SEQ ID NO: 39919 - protein, 9 aa, Homo Sapiens
QIRCCTDDV

SEQ ID NO: 39920 - protein, 9 aa, Homo Sapiens
KLVHPPGFM

SEQ ID NO: 39921 - protein, 9 aa, Homo Sapiens
GKTFSDESR

SEQ ID NO: 39922 - protein, 9 aa, Homo Sapiens
RYDKKYNWD

SEQ ID NO: 39923 - protein, 9 aa, Homo Sapiens
PPEKLCVPV

SEQ ID NO: 39924 - protein, 9 aa, Homo Sapiens
HNQHIEKSR

SEQ ID NO: 39925 - protein, 9 aa, Homo Sapiens
KLCVPVDSK

SEQ ID NO: 39926 - protein, 9 aa, Homo Sapiens
AIKEIEIDL

SEQ ID NO: 39927 - protein, 9 aa, Homo Sapiens
FVVFVCEYI

SEQ ID NO: 39928 - protein, 9 aa, Homo Sapiens
LRDPETPRS

SEQ ID NO: 39929 - protein, 9 aa, Homo Sapiens
LRSVGDGGT

SEQ ID NO: 39930 - protein, 9 aa, Homo Sapiens
ICRHYGLSD

SEQ ID NO: 39931 - protein, 9 aa, Homo Sapiens
KLVGILKEP

SEQ ID NO: 39932 - protein, 9 aa, Homo Sapiens
DTDENAPLV

SEQ ID NO: 39933 - protein, 9 aa, Homo Sapiens
NVGEGSQSP

SEQ ID NO: 39934 - protein, 9 aa, Homo Sapiens
AGRVEEEKE

SEQ ID NO: 39935 - protein, 9 aa, Homo Sapiens
VAKLVGILK

SEQ ID NO: 39936 - protein, 9 aa, Homo Sapiens
RHRLLDKLA

SEQ ID NO: 39937 - protein, 9 aa, Homo Sapiens
PPHSYCVWE

SEQ ID NO: 39938 - protein, 9 aa, Homo Sapiens
GSSSEAKSK

SEQ ID NO: 39939 - protein, 9 aa, Homo Sapiens
FQPNFTVHI

SEQ ID NO: 39940 - protein, 9 aa, Homo Sapiens
EYKVTVTPT

SEQ ID NO: 39941 - protein, 9 aa, Homo Sapiens
VKIFDENEL

SEQ ID NO: 39942 - protein, 9 aa, Homo Sapiens
LKRLVRVII

SEQ ID NO: 39943 - protein, 9 aa, Homo Sapiens
LVSDPLEKA

SEQ ID NO: 39944 - protein, 9 aa, Homo Sapiens
VVTEDTDEN

SEQ ID NO: 39945 - protein, 9 aa, Homo Sapiens
HGPLVNSKY

SEQ ID NO: 39946 - protein, 9 aa, Homo Sapiens
PTSKQEQIV

SEQ ID NO: 39947 - protein, 9 aa, Homo Sapiens
AKAPEEEIP

SEQ ID NO: 39948 - protein, 9 aa, Homo Sapiens
REQDHSLSS

SEQ ID NO: 39949 - protein, 9 aa, Homo Sapiens
GEKKDHHST

SEQ ID NO: 39950 - protein, 9 aa, Homo Sapiens
IDLVKIFDE

SEQ ID NO: 39951 - protein, 9 aa, Homo Sapiens
VFLVDKTLK

SEQ ID NO: 39952 - protein, 9 aa, Homo Sapiens
SYGRIRLAV

SEQ ID NO: 39953 - protein, 9 aa, Homo Sapiens
TLSPAGCTT

SEQ ID NO: 39954 - protein, 9 aa, Homo Sapiens
GVSVWSQGP

SEQ ID NO: 39955 - protein, 9 aa, Homo Sapiens
LRLYLPDNT

SEQ ID NO: 39956 - protein, 9 aa, Homo Sapiens
KHMMKPLAP

SEQ ID NO: 39957 - protein, 9 aa, Homo Sapiens
RVSSLTGPV

SEQ ID NO: 39958 - protein, 9 aa, Homo Sapiens
ENQFQKEAL

SEQ ID NO: 39959 - protein, 9 aa, Homo Sapiens
GRQNWAYCI

SEQ ID NO: 39960 - protein, 9 aa, Homo Sapiens
EVLKWTYEM

SEQ ID NO: 39961 - protein, 9 aa, Homo Sapiens
CALVRCGGV

SEQ ID NO: 39962 - protein, 9 aa, Homo Sapiens
LSSDEILND

SEQ ID NO: 39963 - protein, 9 aa, Homo Sapiens
TILALDADQ

SEQ ID NO: 39964 - protein, 9 aa, Homo Sapiens
FPLWALWLV

SEQ ID NO: 39965 - protein, 9 aa, Homo Sapiens
EHYACGGSF

SEQ ID NO: 39966 - protein, 9 aa, Homo Sapiens
NISSVSFLL

SEQ ID NO: 39967 - protein, 9 aa, Homo Sapiens
GIIHWDLKP

SEQ ID NO: 39968 - protein, 9 aa, Homo Sapiens
QKTLLALDP

SEQ ID NO: 39969 - protein, 9 aa, Homo Sapiens
MYIETLRPR

SEQ ID NO: 39970 - protein, 9 aa, Homo Sapiens
LFHMRESGW

SEQ ID NO: 39971 - protein, 9 aa, Homo Sapiens
VERQHNLEE

SEQ ID NO: 39972 - protein, 9 aa, Homo Sapiens
IKLKAEIEE

SEQ ID NO: 39973 - protein, 9 aa, Homo Sapiens
EAKSKAMST

SEQ ID NO: 39974 - protein, 9 aa, Homo Sapiens
AQIHFMQKQ

SEQ ID NO: 39975 - protein, 9 aa, Homo Sapiens
SHHSMTSLF

SEQ ID NO: 39976 - protein, 9 aa, Homo Sapiens
FVSAAGEKP

SEQ ID NO: 39977 - protein, 9 aa, Homo Sapiens
RAGEKGPHE

SEQ ID NO: 39978 - protein, 9 aa, Homo Sapiens
TADLLLREM

SEQ ID NO: 39979 - protein, 9 aa, Homo Sapiens
DDNATTKEC

SEQ ID NO: 39980 - protein, 9 aa, Homo Sapiens
SRNKSAKGM

SEQ ID NO: 39981 - protein, 9 aa, Homo Sapiens
LGVQAFANA

SEQ ID NO: 39982 - protein, 9 aa, Homo Sapiens
CPPHSYCVW

SEQ ID NO: 39983 - protein, 9 aa, Homo Sapiens
GMSLTSQWF

SEQ ID NO: 39984 - protein, 9 aa, Homo Sapiens
YDKKYNWDV

SEQ ID NO: 39985 - protein, 9 aa, Homo Sapiens
KRLVRVIIG

SEQ ID NO: 39986 - protein, 9 aa, Homo Sapiens
YVQTVLHVH

SEQ ID NO: 39987 - protein, 9 aa, Homo Sapiens
EKSRQLLSY

SEQ ID NO: 39988 - protein, 9 aa, Homo Sapiens
CMTGATGSE

SEQ ID NO: 39989 - protein, 9 aa, Homo Sapiens
DKGAYVCVV

SEQ ID NO: 39990 - protein, 9 aa, Homo Sapiens
GDGGTVEFD

SEQ ID NO: 39991 - protein, 9 aa, Homo Sapiens
KYYTGWLDY

SEQ ID NO: 39992 - protein, 9 aa, Homo Sapiens
FDGPVDANW

SEQ ID NO: 39993 - protein, 9 aa, Homo Sapiens
QANHDDHEC

SEQ ID NO: 39994 - protein, 9 aa, Homo Sapiens
PHEEEPVKK

SEQ ID NO: 39995 - protein, 9 aa, Homo Sapiens
WLGVSVWSQ

SEQ ID NO: 39996 - protein, 9 aa, Homo Sapiens
VEEEKEEEE

SEQ ID NO: 39997 - protein, 9 aa, Homo Sapiens
VTPTYTDGE

SEQ ID NO: 39998 - protein, 9 aa, Homo Sapiens
QQDPEAVLS

SEQ ID NO: 39999 - protein, 9 aa, Homo Sapiens
CCTDDVRPQ

SEQ ID NO: 40000 - protein, 9 aa, Homo Sapiens
LPPWARSEQ

SEQ ID NO: 40001 - protein, 9 aa, Homo Sapiens
SIISLLLLL

SEQ ID NO: 40002 - protein, 9 aa, Homo Sapiens
GASAAEPTS

SEQ ID NO: 40003 - protein, 9 aa, Homo Sapiens
HPRCRWAAA

SEQ ID NO: 40004 - protein, 9 aa, Homo Sapiens
ITHDVYVMI

SEQ ID NO: 40005 - protein, 9 aa, Homo Sapiens
ELQNLRAKD

SEQ ID NO: 40006 - protein, 9 aa, Homo Sapiens
PGHVCLHHR

SEQ ID NO: 40007 - protein, 9 aa, Homo Sapiens
GGSVDLFHM

SEQ ID NO: 40008 - protein, 9 aa, Homo Sapiens
KMYVQTVLH

SEQ ID NO: 40009 - protein, 9 aa, Homo Sapiens
YRHRLLDKL

SEQ ID NO: 40010 - protein, 9 aa, Homo Sapiens
EDTDENAPL

SEQ ID NO: 40011 - protein, 9 aa, Homo Sapiens
DQHTINTKA

SEQ ID NO: 40012 - protein, 9 aa, Homo Sapiens
LLLKIDSLL

SEQ ID NO: 40013 - protein, 9 aa, Homo Sapiens
DHSLSSSSS

SEQ ID NO: 40014 - protein, 9 aa, Homo Sapiens
NLEEALLFS

SEQ ID NO: 40015 - protein, 9 aa, Homo Sapiens
IRSVQLRDK

SEQ ID NO: 40016 - protein, 9 aa, Homo Sapiens
SPDAECAKK

SEQ ID NO: 40017 - protein, 9 aa, Homo Sapiens
PRAGVGLSC

SEQ ID NO: 40018 - protein, 9 aa, Homo Sapiens
LHSAGIIHW

SEQ ID NO: 40019 - protein, 9 aa, Homo Sapiens
VVNKQQRKT

SEQ ID NO: 40020 - protein, 9 aa, Homo Sapiens
RAQSDSRKS

SEQ ID NO: 40021 - protein, 9 aa, Homo Sapiens
ERGGGPEKP

SEQ ID NO: 40022 - protein, 9 aa, Homo Sapiens
KYIKTWRPR

SEQ ID NO: 40023 - protein, 9 aa, Homo Sapiens
LGGNHQPEP

SEQ ID NO: 40024 - protein, 9 aa, Homo Sapiens
LNDGQSPKH

SEQ ID NO: 40025 - protein, 9 aa, Homo Sapiens
VRFLSGRAL

SEQ ID NO: 40026 - protein, 9 aa, Homo Sapiens
SMASLGEKK

SEQ ID NO: 40027 - protein, 9 aa, Homo Sapiens
TVTPTYTDG

SEQ ID NO: 40028 - protein, 9 aa, Homo Sapiens
VMNSREFWI

SEQ ID NO: 40029 - protein, 9 aa, Homo Sapiens
NALLIIPKV

SEQ ID NO: 40030 - protein, 9 aa, Homo Sapiens
VGRLPPWAR

SEQ ID NO: 40031 - protein, 9 aa, Homo Sapiens
EVFLVDKTL

SEQ ID NO: 40032 - protein, 9 aa, Homo Sapiens
PEKLCVPVD

SEQ ID NO: 40033 - protein, 9 aa, Homo Sapiens
GVGLSCVPL

SEQ ID NO: 40034 - protein, 9 aa, Homo Sapiens
GSQSPLGTL

SEQ ID NO: 40035 - protein, 9 aa, Homo Sapiens
EYVEEPGEE

SEQ ID NO: 40036 - protein, 9 aa, Homo Sapiens
PGGRQNWAY

SEQ ID NO: 40037 - protein, 9 aa, Homo Sapiens
LQKTLLALD

SEQ ID NO: 40038 - protein, 9 aa, Homo Sapiens
EDGSPNWNG

SEQ ID NO: 40039 - protein, 9 aa, Homo Sapiens
VVPLSLQLK

SEQ ID NO: 40040 - protein, 9 aa, Homo Sapiens
CQGPASQIH

SEQ ID NO: 40041 - protein, 9 aa, Homo Sapiens
IEHNQHIEK

SEQ ID NO: 40042 - protein, 9 aa, Homo Sapiens
PFRQNDLSS

SEQ ID NO: 40043 - protein, 9 aa, Homo Sapiens
AVYMDELAA

SEQ ID NO: 40044 - protein, 9 aa, Homo Sapiens
LASAEDSAL

SEQ ID NO: 40045 - protein, 9 aa, Homo Sapiens
GTILALDAD

SEQ ID NO: 40046 - protein, 9 aa, Homo Sapiens
NQHIEKSRQ

SEQ ID NO: 40047 - protein, 9 aa, Homo Sapiens
KQQRKTKNS

SEQ ID NO: 40048 - protein, 9 aa, Homo Sapiens
VVLPQGKSL

SEQ ID NO: 40049 - protein, 9 aa, Homo Sapiens
VQNKIQEKN

SEQ ID NO: 40050 - protein, 9 aa, Homo Sapiens
NWDVKSLVM

SEQ ID NO: 40051 - protein, 9 aa, Homo Sapiens
IILLLSIGV

SEQ ID NO: 40052 - protein, 9 aa, Homo Sapiens
PWARSEQLE

SEQ ID NO: 40053 - protein, 9 aa, Homo Sapiens
VKEVLKWTY

SEQ ID NO: 40054 - protein, 9 aa, Homo Sapiens
ENAPLVPDD

SEQ ID NO: 40055 - protein, 9 aa, Homo Sapiens
LTEQVESHH

SEQ ID NO: 40056 - protein, 9 aa, Homo Sapiens
TGEMITHDV

SEQ ID NO: 40057 - protein, 9 aa, Homo Sapiens
RGGMIPHPE

SEQ ID NO: 40058 - protein, 9 aa, Homo Sapiens
QKHMMKPLA

SEQ ID NO: 40059 - protein, 9 aa, Homo Sapiens
GEMITHDVY

SEQ ID NO: 40060 - protein, 9 aa, Homo Sapiens
APELLKGQG

SEQ ID NO: 40061 - protein, 9 aa, Homo Sapiens
CVPVDSKVL

SEQ ID NO: 40062 - protein, 9 aa, Homo Sapiens
GPRPPENNP

SEQ ID NO: 40063 - protein, 9 aa, Homo Sapiens
QFIIKHELQ

SEQ ID NO: 40064 - protein, 9 aa, Homo Sapiens
PEEEIPKKE

SEQ ID NO: 40065 - protein, 9 aa, Homo Sapiens
VLDYPSPDA

SEQ ID NO: 40066 - protein, 9 aa, Homo Sapiens
LCPGPMSPR

SEQ ID NO: 40067 - protein, 9 aa, Homo Sapiens
CLQLDTNTA

SEQ ID NO: 40068 - protein, 9 aa, Homo Sapiens
EVESYHCRL

SEQ ID NO: 40069 - protein, 9 aa, Homo Sapiens
ICSSLLAQE

SEQ ID NO: 40070 - protein, 9 aa, Homo Sapiens
LGVSVWSQG

SEQ ID NO: 40071 - protein, 9 aa, Homo Sapiens
NCSKNKKRL

SEQ ID NO: 40072 - protein, 9 aa, Homo Sapiens
RQQDPEAVL

SEQ ID NO: 40073 - protein, 9 aa, Homo Sapiens
KDPPEKLCV

SEQ ID NO: 40074 - protein, 9 aa, Homo Sapiens
SYHCRLAAA

SEQ ID NO: 40075 - protein, 9 aa, Homo Sapiens
EGCVDEKEC

SEQ ID NO: 40076 - protein, 9 aa, Homo Sapiens
LWALWLVWA

SEQ ID NO: 40077 - protein, 9 aa, Homo Sapiens
AKCPPHSYC

SEQ ID NO: 40078 - protein, 9 aa, Homo Sapiens
TASEELHNR

SEQ ID NO: 40079 - protein, 9 aa, Homo Sapiens
VYIGEEENK

SEQ ID NO: 40080 - protein, 9 aa, Homo Sapiens
IKLLVPFFL

SEQ ID NO: 40081 - protein, 9 aa, Homo Sapiens
GNHQPEPSG

SEQ ID NO: 40082 - protein, 9 aa, Homo Sapiens
SIGCIMYTF

SEQ ID NO: 40083 - protein, 9 aa, Homo Sapiens
WLSLFVSAA

SEQ ID NO: 40084 - protein, 9 aa, Homo Sapiens
YNPPNHEVV

SEQ ID NO: 40085 - protein, 9 aa, Homo Sapiens
LGNRSSVDE

SEQ ID NO: 40086 - protein, 9 aa, Homo Sapiens
FHRRRRRDT

SEQ ID NO: 40087 - protein, 9 aa, Homo Sapiens
LADKDEDEP

SEQ ID NO: 40088 - protein, 9 aa, Homo Sapiens
LGNQRRLLQ

SEQ ID NO: 40089 - protein, 9 aa, Homo Sapiens
PAVYMDELA

SEQ ID NO: 40090 - protein, 9 aa, Homo Sapiens
VLEICAKQR

SEQ ID NO: 40091 - protein, 9 aa, Homo Sapiens
VLGLLELPQ

SEQ ID NO: 40092 - protein, 9 aa, Homo Sapiens
IEQNGACRS

SEQ ID NO: 40093 - protein, 9 aa, Homo Sapiens
LQLDTNTAD

SEQ ID NO: 40094 - protein, 9 aa, Homo Sapiens
LVSFKDVTV

SEQ ID NO: 40095 - protein, 9 aa, Homo Sapiens
KPLRDPETP

SEQ ID NO: 40096 - protein, 9 aa, Homo Sapiens
DEHPQKDGY

SEQ ID NO: 40097 - protein, 9 aa, Homo Sapiens
LAHTISEAA

SEQ ID NO: 40098 - protein, 9 aa, Homo Sapiens
RERGGGPEK

SEQ ID NO: 40099 - protein, 9 aa, Homo Sapiens
IKKLVHPPG

SEQ ID NO: 40100 - protein, 9 aa, Homo Sapiens
GFKPPTCMT

SEQ ID NO: 40101 - protein, 9 aa, Homo Sapiens
IELCLEKME

SEQ ID NO: 40102 - protein, 9 aa, Homo Sapiens
NGQASHFET

SEQ ID NO: 40103 - protein, 9 aa, Homo Sapiens
ELDIDMNQR

SEQ ID NO: 40104 - protein, 9 aa, Homo Sapiens
EMENQFQKE

SEQ ID NO: 40105 - protein, 9 aa, Homo Sapiens
QGPASQIHR

SEQ ID NO: 40106 - protein, 9 aa, Homo Sapiens
HDVYVMINR

SEQ ID NO: 40107 - protein, 9 aa, Homo Sapiens
MAAVSELLQ

SEQ ID NO: 40108 - protein, 9 aa, Homo Sapiens
KEIEDLQPP

SEQ ID NO: 40109 - protein, 9 aa, Homo Sapiens
SGFPVSDSN

SEQ ID NO: 40110 - protein, 9 aa, Homo Sapiens
MYWGWKELP

SEQ ID NO: 40111 - protein, 9 aa, Homo Sapiens
RIRLAVYHM

SEQ ID NO: 40112 - protein, 9 aa, Homo Sapiens
QPSSTGGEK

SEQ ID NO: 40113 - protein, 9 aa, Homo Sapiens
VSDSNRHLT

SEQ ID NO: 40114 - protein, 9 aa, Homo Sapiens
KSRQLLSYA

SEQ ID NO: 40115 - protein, 9 aa, Homo Sapiens
ATLAHTISE

SEQ ID NO: 40116 - protein, 9 aa, Homo Sapiens
TFSDESRLR

SEQ ID NO: 40117 - protein, 9 aa, Homo Sapiens
DQKFQGLVS

SEQ ID NO: 40118 - protein, 9 aa, Homo Sapiens
QHTINTKAS

SEQ ID NO: 40119 - protein, 9 aa, Homo Sapiens
PQPSSTGGE

SEQ ID NO: 40120 - protein, 9 aa, Homo Sapiens
KLKAEIEEL

SEQ ID NO: 40121 - protein, 9 aa, Homo Sapiens
KTGALQDSL

SEQ ID NO: 40122 - protein, 9 aa, Homo Sapiens
GKRKGQRPG

SEQ ID NO: 40123 - protein, 9 aa, Homo Sapiens
CWLSLFVSA

SEQ ID NO: 40124 - protein, 9 aa, Homo Sapiens
DGGTVEFDV

SEQ ID NO: 40125 - protein, 9 aa, Homo Sapiens
SNYCPSEWR

SEQ ID NO: 40126 - protein, 9 aa, Homo Sapiens
LFVGRLPPW

SEQ ID NO: 40127 - protein, 9 aa, Homo Sapiens
VTKGVAEAT

SEQ ID NO: 40128 - protein, 9 aa, Homo Sapiens
HSYCVWEGA

SEQ ID NO: 40129 - protein, 9 aa, Homo Sapiens
VRCGGVGFD

SEQ ID NO: 40130 - protein, 9 aa, Homo Sapiens
FIKLLVPFF

SEQ ID NO: 40131 - protein, 9 aa, Homo Sapiens
ILHLDEHQE

SEQ ID NO: 40132 - protein, 9 aa, Homo Sapiens
IACSYGRIR

SEQ ID NO: 40133 - protein, 9 aa, Homo Sapiens
VLPQGKSLD

SEQ ID NO: 40134 - protein, 9 aa, Homo Sapiens
LLTLKWMFR

SEQ ID NO: 40135 - protein, 9 aa, Homo Sapiens
RKRAQSDSR

SEQ ID NO: 40136 - protein, 9 aa, Homo Sapiens
VPQPKKIQL

SEQ ID NO: 40137 - protein, 9 aa, Homo Sapiens
DRAKALCVL

SEQ ID NO: 40138 - protein, 9 aa, Homo Sapiens
EQDHSLSSS

SEQ ID NO: 40139 - protein, 9 aa, Homo Sapiens
FSHMFHGRF

SEQ ID NO: 40140 - protein, 9 aa, Homo Sapiens
QAFANALLI

SEQ ID NO: 40141 - protein, 9 aa, Homo Sapiens
TTMGSNYCP

SEQ ID NO: 40142 - protein, 9 aa, Homo Sapiens
EKECQTKPG

SEQ ID NO: 40143 - protein, 9 aa, Homo Sapiens
SDKVQNIIC

SEQ ID NO: 40144 - protein, 9 aa, Homo Sapiens
GNQRRLLQL

SEQ ID NO: 40145 - protein, 9 aa, Homo Sapiens
FHGRFIPLA

SEQ ID NO: 40146 - protein, 9 aa, Homo Sapiens
IYCMQVHKE

SEQ ID NO: 40147 - protein, 9 aa, Homo Sapiens
QKSFSQRSS

SEQ ID NO: 40148 - protein, 9 aa, Homo Sapiens
QNKIQEKNV

SEQ ID NO: 40149 - protein, 9 aa, Homo Sapiens
YKYNPPNHE

SEQ ID NO: 40150 - protein, 9 aa, Homo Sapiens
YTFLVGKPP

SEQ ID NO: 40151 - protein, 9 aa, Homo Sapiens
ANEVAAHGI

SEQ ID NO: 40152 - protein, 9 aa, Homo Sapiens
HRLLDKLAA

SEQ ID NO: 40153 - protein, 9 aa, Homo Sapiens
SVDLFHMRE

SEQ ID NO: 40154 - protein, 9 aa, Homo Sapiens
QWFAKYLQS

SEQ ID NO: 40155 - protein, 9 aa, Homo Sapiens
KTGEMITHD

SEQ ID NO: 40156 - protein, 9 aa, Homo Sapiens
ERQHNLEEA

SEQ ID NO: 40157 - protein, 9 aa, Homo Sapiens
MENQFQKEA

SEQ ID NO: 40158 - protein, 9 aa, Homo Sapiens
KGVAEATCN

SEQ ID NO: 40159 - protein, 9 aa, Homo Sapiens
RRVSSLTGP

SEQ ID NO: 40160 - protein, 9 aa, Homo Sapiens
PRQANHDDH

SEQ ID NO: 40161 - protein, 9 aa, Homo Sapiens
DIDMNQRIG

SEQ ID NO: 40162 - protein, 9 aa, Homo Sapiens
AKLVGILKE

SEQ ID NO: 40163 - protein, 9 aa, Homo Sapiens
QMLQDQHTI

SEQ ID NO: 40164 - protein, 9 aa, Homo Sapiens
PHPESRGPF

SEQ ID NO: 40165 - protein, 9 aa, Homo Sapiens
GPEKPWKCG

SEQ ID NO: 40166 - protein, 9 aa, Homo Sapiens
FQKHMMKPL

SEQ ID NO: 40167 - protein, 9 aa, Homo Sapiens
DYPSPDAEC

SEQ ID NO: 40168 - protein, 9 aa, Homo Sapiens
EVLQDPLDR

SEQ ID NO: 40169 - protein, 9 aa, Homo Sapiens
YGRIRLAVY

SEQ ID NO: 40170 - protein, 9 aa, Homo Sapiens
LSNHFIKLL

SEQ ID NO: 40171 - protein, 9 aa, Homo Sapiens
SFVIELEKV

SEQ ID NO: 40172 - protein, 9 aa, Homo Sapiens
ETLRPRLEG

SEQ ID NO: 40173 - protein, 9 aa, Homo Sapiens
FTFVTKGVA

SEQ ID NO: 40174 - protein, 9 aa, Homo Sapiens
HNLEEALLF

SEQ ID NO: 40175 - protein, 9 aa, Homo Sapiens
HIEKSRQLL

SEQ ID NO: 40176 - protein, 9 aa, Homo Sapiens
QVVPLSLQL

SEQ ID NO: 40177 - protein, 9 aa, Homo Sapiens
STGGEKRRW

SEQ ID NO: 40178 - protein, 9 aa, Homo Sapiens
LCVLLPLVQ

SEQ ID NO: 40179 - protein, 9 aa, Homo Sapiens
APRLASTGV

SEQ ID NO: 40180 - protein, 9 aa, Homo Sapiens
IIAEVKVPM

SEQ ID NO: 40181 - protein, 9 aa, Homo Sapiens
AGEKGPHEE

SEQ ID NO: 40182 - protein, 9 aa, Homo Sapiens
EVANGQASH

SEQ ID NO: 40183 - protein, 9 aa, Homo Sapiens
GGVGFDTCG

SEQ ID NO: 40184 - protein, 9 aa, Homo Sapiens
KEVLKWTYE

SEQ ID NO: 40185 - protein, 9 aa, Homo Sapiens
PVVKPLDYE

SEQ ID NO: 40186 - protein, 9 aa, Homo Sapiens
CVASSAWLF

SEQ ID NO: 40187 - protein, 9 aa, Homo Sapiens
GGMIPHPES

SEQ ID NO: 40188 - protein, 8 aa, Homo Sapiens
SQPRPRYV

SEQ ID NO: 40189 - protein, 9 aa, Homo Sapiens
PENNPLPQG

SEQ ID NO: 40190 - protein, 9 aa, Homo Sapiens
VILAACCTF

SEQ ID NO: 40191 - protein, 9 aa, Homo Sapiens
KLTVHKVIN

SEQ ID NO: 40192 - protein, 9 aa, Homo Sapiens
AKYVKQNTS

SEQ ID NO: 40193 - protein, 9 aa, Homo Sapiens
TNEGMLPVV

SEQ ID NO: 40194 - protein, 9 aa, Homo Sapiens
VEVGISERQ

SEQ ID NO: 40195 - protein, 9 aa, Homo Sapiens
VPLSLQLKG

SEQ ID NO: 40196 - protein, 9 aa, Homo Sapiens
HLPGHVCLH

SEQ ID NO: 40197 - protein, 9 aa, Homo Sapiens
IEYVEEPGE

SEQ ID NO: 40198 - protein, 9 aa, Homo Sapiens
EQNGACRSS

SEQ ID NO: 40199 - protein, 9 aa, Homo Sapiens
VLHVHKKYN

SEQ ID NO: 40200 - protein, 9 aa, Homo Sapiens
IEDLQPPPG

SEQ ID NO: 40201 - protein, 9 aa, Homo Sapiens
SEEDVLRLL

SEQ ID NO: 40202 - protein, 9 aa, Homo Sapiens
KNKKRLEEQ

SEQ ID NO: 40203 - protein, 9 aa, Homo Sapiens
SSSICRHYG

SEQ ID NO: 40204 - protein, 9 aa, Homo Sapiens
SDESLDSFV

SEQ ID NO: 40205 - protein, 9 aa, Homo Sapiens
PPISIILLL

SEQ ID NO: 40206 - protein, 9 aa, Homo Sapiens
SPSSGSAVY

SEQ ID NO: 40207 - protein, 9 aa, Homo Sapiens
VLRLLQPFG

SEQ ID NO: 40208 - protein, 9 aa, Homo Sapiens
GEGSQSPLG

SEQ ID NO: 40209 - protein, 9 aa, Homo Sapiens
SKNKKRLEE

SEQ ID NO: 40210 - protein, 9 aa, Homo Sapiens
IADKLIKLK

SEQ ID NO: 40211 - protein, 9 aa, Homo Sapiens
TLAHTISEA

SEQ ID NO: 40212 - protein, 9 aa, Homo Sapiens
ILALAKYVK

SEQ ID NO: 40213 - protein, 9 aa, Homo Sapiens
WRRVSSLTG

SEQ ID NO: 40214 - protein, 9 aa, Homo Sapiens
IPVSSEAQR

SEQ ID NO: 40215 - protein, 9 aa, Homo Sapiens
DTERMGAED

SEQ ID NO: 40216 - protein, 9 aa, Homo Sapiens
QPNFTVHIT

SEQ ID NO: 40217 - protein, 9 aa, Homo Sapiens
DANWIENMN

SEQ ID NO: 40218 - protein, 9 aa, Homo Sapiens
GACRSSKDI

SEQ ID NO: 40219 - protein, 9 aa, Homo Sapiens
HAVVLPQGK

SEQ ID NO: 40220 - protein, 9 aa, Homo Sapiens
FKTTMGSNY

SEQ ID NO: 40221 - protein, 9 aa, Homo Sapiens
ESRGPFPTC

SEQ ID NO: 40222 - protein, 9 aa, Homo Sapiens
YIGEEENKI

SEQ ID NO: 40223 - protein, 9 aa, Homo Sapiens
GFYMYIETL

SEQ ID NO: 40224 - protein, 9 aa, Homo Sapiens
RGKYIKTWR

SEQ ID NO: 40225 - protein, 9 aa, Homo Sapiens
HCQGPASQI

SEQ ID NO: 40226 - protein, 9 aa, Homo Sapiens
GVGFDTCGQ

SEQ ID NO: 40227 - protein, 9 aa, Homo Sapiens
IGVPLLTLK

SEQ ID NO: 40228 - protein, 9 aa, Homo Sapiens
DESRLRKHE

SEQ ID NO: 40229 - protein, 9 aa, Homo Sapiens
GECWLSLFV

SEQ ID NO: 40230 - protein, 9 aa, Homo Sapiens
DKDNDRLMV

SEQ ID NO: 40231 - protein, 9 aa, Homo Sapiens
ELTEQVESH

SEQ ID NO: 40232 - protein, 9 aa, Homo Sapiens
VSELLQQQE

SEQ ID NO: 40233 - protein, 9 aa, Homo Sapiens
GPRAQLGNR

SEQ ID NO: 40234 - protein, 9 aa, Homo Sapiens
YLPDNTLRW

SEQ ID NO: 40235 - protein, 9 aa, Homo Sapiens
RAQDEHPQK

SEQ ID NO: 40236 - protein, 9 aa, Homo Sapiens
LDYPSPDAE

SEQ ID NO: 40237 - protein, 9 aa, Homo Sapiens
TAIELRKPI

SEQ ID NO: 40238 - protein, 9 aa, Homo Sapiens
TSSSICRHY

SEQ ID NO: 40239 - protein, 9 aa, Homo Sapiens
LSPAGCTTR

SEQ ID NO: 40240 - protein, 9 aa, Homo Sapiens
PHSYCVWEG

SEQ ID NO: 40241 - protein, 9 aa, Homo Sapiens
QRHELGKVE

SEQ ID NO: 40242 - protein, 9 aa, Homo Sapiens
KEPEVLQDP

SEQ ID NO: 40243 - protein, 9 aa, Homo Sapiens
NRYDKKYNW

SEQ ID NO: 40244 - protein, 9 aa, Homo Sapiens
PEVIDAIKE

SEQ ID NO: 40245 - protein, 9 aa, Homo Sapiens
MFHGRFIPL

SEQ ID NO: 40246 - protein, 9 aa, Homo Sapiens
SKIKKLVHP

SEQ ID NO: 40247 - protein, 9 aa, Homo Sapiens
DKLIKLKAE

SEQ ID NO: 40248 - protein, 9 aa, Homo Sapiens
GRRKGSLGN

SEQ ID NO: 40249 - protein, 9 aa, Homo Sapiens
THCQGPASQ

SEQ ID NO: 40250 - protein, 9 aa, Homo Sapiens
ELLKGQGVT

SEQ ID NO: 40251 - protein, 9 aa, Homo Sapiens
KYAMDVQNK

SEQ ID NO: 40252 - protein, 9 aa, Homo Sapiens
QHDKPGGQR

SEQ ID NO: 40253 - protein, 9 aa, Homo Sapiens
WSQGPGGKI

SEQ ID NO: 40254 - protein, 9 aa, Homo Sapiens
WMPMFHRRR

SEQ ID NO: 40255 - protein, 9 aa, Homo Sapiens
IPWPLSVLS

SEQ ID NO: 40256 - protein, 9 aa, Homo Sapiens
RKSQVVPLS

SEQ ID NO: 40257 - protein, 9 aa, Homo Sapiens
VVEVGISER

SEQ ID NO: 40258 - protein, 9 aa, Homo Sapiens
LAFQKHMMK

SEQ ID NO: 40259 - protein, 9 aa, Homo Sapiens
AVVLPQGKS

SEQ ID NO: 40260 - protein, 9 aa, Homo Sapiens
GEKGPHEEE

SEQ ID NO: 40261 - protein, 9 aa, Homo Sapiens
SEAKSKAMS

SEQ ID NO: 40262 - protein, 9 aa, Homo Sapiens
RHKQTHHSL

SEQ ID NO: 40263 - protein, 9 aa, Homo Sapiens
TQASSQKSF

SEQ ID NO: 40264 - protein, 9 aa, Homo Sapiens
GCRGGPEAF

SEQ ID NO: 40265 - protein, 9 aa, Homo Sapiens
YKVTVTPTY

SEQ ID NO: 40266 - protein, 9 aa, Homo Sapiens
IDDTERMGA

SEQ ID NO: 40267 - protein, 9 aa, Homo Sapiens
GPMSPRMSC

SEQ ID NO: 40268 - protein, 9 aa, Homo Sapiens
GCKKILPLG

SEQ ID NO: 40269 - protein, 9 aa, Homo Sapiens
DGSPNWNGN

SEQ ID NO: 40270 - protein, 9 aa, Homo Sapiens
ENKIFLEKL

SEQ ID NO: 40271 - protein, 9 aa, Homo Sapiens
HLKRLVRVI

SEQ ID NO: 40272 - protein, 9 aa, Homo Sapiens
TCMTGATGS

SEQ ID NO: 40273 - protein, 9 aa, Homo Sapiens
HSLDSQLAR

SEQ ID NO: 40274 - protein, 9 aa, Homo Sapiens
DVYVMINRD

SEQ ID NO: 40275 - protein, 9 aa, Homo Sapiens
PEAVLSDKV

SEQ ID NO: 40276 - protein, 9 aa, Homo Sapiens
DVEAQDGGV

SEQ ID NO: 40277 - protein, 9 aa, Homo Sapiens
LPFTFVTKG

SEQ ID NO: 40278 - protein, 9 aa, Homo Sapiens
SQGANFSGD

SEQ ID NO: 40279 - protein, 9 aa, Homo Sapiens
KPEHYACGG

SEQ ID NO: 40280 - protein, 9 aa, Homo Sapiens
NKQQRKTKN

SEQ ID NO: 40281 - protein, 9 aa, Homo Sapiens
SGLQSLGGP

SEQ ID NO: 40282 - protein, 9 aa, Homo Sapiens
KDGYYFLLQ

SEQ ID NO: 40283 - protein, 9 aa, Homo Sapiens
TLSNHFIKL

SEQ ID NO: 40284 - protein, 9 aa, Homo Sapiens
GPILRLYLP

SEQ ID NO: 40285 - protein, 9 aa, Homo Sapiens
EEDVLRLLQ

SEQ ID NO: 40286 - protein, 9 aa, Homo Sapiens
FFVPQPKKI

SEQ ID NO: 40287 - protein, 9 aa, Homo Sapiens
LQSLGGPLP

SEQ ID NO: 40288 - protein, 9 aa, Homo Sapiens
KYNPPNHEV

SEQ ID NO: 40289 - protein, 9 aa, Homo Sapiens
PESRGPFPT

SEQ ID NO: 40290 - protein, 9 aa, Homo Sapiens
KVTVTPTYT

SEQ ID NO: 40291 - protein, 9 aa, Homo Sapiens
AVGLVAGCR

SEQ ID NO: 40292 - protein, 9 aa, Homo Sapiens
HTTLSPAGC

SEQ ID NO: 40293 - protein, 9 aa, Homo Sapiens
SVGDGGTVE

SEQ ID NO: 40294 - protein, 9 aa, Homo Sapiens
HTISEAAIG

SEQ ID NO: 40295 - protein, 9 aa, Homo Sapiens
KTMTELDID

SEQ ID NO: 40296 - protein, 9 aa, Homo Sapiens
TTKECFLNQ

SEQ ID NO: 40297 - protein, 9 aa, Homo Sapiens
YNWDVKSLV

SEQ ID NO: 40298 - protein, 9 aa, Homo Sapiens
LQPPPGIVA

SEQ ID NO: 40299 - protein, 9 aa, Homo Sapiens
DQGGWELTE

SEQ ID NO: 40300 - protein, 9 aa, Homo Sapiens
LPVVKPLDY

SEQ ID NO: 40301 - protein, 9 aa, Homo Sapiens
TINTKASEV

SEQ ID NO: 40302 - protein, 9 aa, Homo Sapiens
GEGCVDEKE

SEQ ID NO: 40303 - protein, 9 aa, Homo Sapiens
VGMSLTSQW

SEQ ID NO: 40304 - protein, 9 aa, Homo Sapiens
YVEEPGEEQ

SEQ ID NO: 40305 - protein, 9 aa, Homo Sapiens
VESYHCRLA

SEQ ID NO: 40306 - protein, 9 aa, Homo Sapiens
CVWEGATSC

SEQ ID NO: 40307 - protein, 9 aa, Homo Sapiens
QDQHTINTK

SEQ ID NO: 40308 - protein, 9 aa, Homo Sapiens
AVSELLQQQ

SEQ ID NO: 40309 - protein, 9 aa, Homo Sapiens
NATTKECFL

SEQ ID NO: 40310 - protein, 9 aa, Homo Sapiens
MQQKSNLEL

SEQ ID NO: 40311 - protein, 9 aa, Homo Sapiens
KQRNLSEQL

SEQ ID NO: 40312 - protein, 9 aa, Homo Sapiens
RFITQSCVA

SEQ ID NO: 40313 - protein, 9 aa, Homo Sapiens
FVIELEKVQ

SEQ ID NO: 40314 - protein, 9 aa, Homo Sapiens
FQPPISIIL

SEQ ID NO: 40315 - protein, 9 aa, Homo Sapiens
ALCVLLPLV

SEQ ID NO: 40316 - protein, 9 aa, Homo Sapiens
ERPKAPPSY

SEQ ID NO: 40317 - protein, 9 aa, Homo Sapiens
DIIAEVKVP

SEQ ID NO: 40318 - protein, 9 aa, Homo Sapiens
SWMPMFHRR

SEQ ID NO: 40319 - protein, 9 aa, Homo Sapiens
SHFLTVPRS

SEQ ID NO: 40320 - protein, 9 aa, Homo Sapiens
HTINTKASE

SEQ ID NO: 40321 - protein, 9 aa, Homo Sapiens
VPVVEVGIS

SEQ ID NO: 40322 - protein, 9 aa, Homo Sapiens
YGMSPHPGI

SEQ ID NO: 40323 - protein, 9 aa, Homo Sapiens
PRLASTGVS

SEQ ID NO: 40324 - protein, 9 aa, Homo Sapiens
SGSGLQSLG

SEQ ID NO: 40325 - protein, 9 aa, Homo Sapiens
YPRQANHDD

SEQ ID NO: 40326 - protein, 9 aa, Homo Sapiens
RASWMPMFH

SEQ ID NO: 40327 - protein, 9 aa, Homo Sapiens
LYLPDNTLR

SEQ ID NO: 40328 - protein, 9 aa, Homo Sapiens
SPQPSSTGG

SEQ ID NO: 40329 - protein, 9 aa, Homo Sapiens
VCEYIEAEE

SEQ ID NO: 40330 - protein, 9 aa, Homo Sapiens
AEVESYHCR

SEQ ID NO: 40331 - protein, 9 aa, Homo Sapiens
LTVHKVINT

SEQ ID NO: 40332 - protein, 9 aa, Homo Sapiens
TPLTVLNGT

SEQ ID NO: 40333 - protein, 9 aa, Homo Sapiens
PMFHRRRRR

SEQ ID NO: 40334 - protein, 9 aa, Homo Sapiens
KALCVLLPL

SEQ ID NO: 40335 - protein, 9 aa, Homo Sapiens
VYSSKVLDK

SEQ ID NO: 40336 - protein, 9 aa, Homo Sapiens
PILRLYLPD

SEQ ID NO: 40337 - protein, 9 aa, Homo Sapiens
HGPFSHMFH

SEQ ID NO: 40338 - protein, 9 aa, Homo Sapiens
WPLSVLSQF

SEQ ID NO: 40339 - protein, 9 aa, Homo Sapiens
EEPGEEQLY

SEQ ID NO: 40340 - protein, 9 aa, Homo Sapiens
GPEGPPPPP

SEQ ID NO: 40341 - protein, 9 aa, Homo Sapiens
KVDQKFQGL

SEQ ID NO: 40342 - protein, 9 aa, Homo Sapiens
AQLGNRSSV

SEQ ID NO: 40343 - protein, 9 aa, Homo Sapiens
GEEENKIFL

SEQ ID NO: 40344 - protein, 9 aa, Homo Sapiens
DLQKTLLAL

SEQ ID NO: 40345 - protein, 9 aa, Homo Sapiens
VPAVYMDEL

SEQ ID NO: 40346 - protein, 9 aa, Homo Sapiens
KKACQRMKD

SEQ ID NO: 40347 - protein, 9 aa, Homo Sapiens
QDPLDRCYS

SEQ ID NO: 40348 - protein, 9 aa, Homo Sapiens
SSTTQEMTP

SEQ ID NO: 40349 - protein, 9 aa, Homo Sapiens
WIWMLEENL

SEQ ID NO: 40350 - protein, 9 aa, Homo Sapiens
TMTELDIDM

SEQ ID NO: 40351 - protein, 9 aa, Homo Sapiens
IQLMTSCDE

SEQ ID NO: 40352 - protein, 9 aa, Homo Sapiens
DTNTADLLL

SEQ ID NO: 40353 - protein, 9 aa, Homo Sapiens
QEGAQDCRF

SEQ ID NO: 40354 - protein, 9 aa, Homo Sapiens
KWTYEMFLN

SEQ ID NO: 40355 - protein, 9 aa, Homo Sapiens
RAKALCVLL

SEQ ID NO: 40356 - protein, 9 aa, Homo Sapiens
AQDEHPQKD

SEQ ID NO: 40357 - protein, 9 aa, Homo Sapiens
RFSKHDIIA

SEQ ID NO: 40358 - protein, 9 aa, Homo Sapiens
ANHDDHECC

SEQ ID NO: 40359 - protein, 9 aa, Homo Sapiens
GSNYCPSEW

SEQ ID NO: 40360 - protein, 9 aa, Homo Sapiens
PVVEVGISE

SEQ ID NO: 40361 - protein, 9 aa, Homo Sapiens
RQANHDDHE

SEQ ID NO: 40362 - protein, 9 aa, Homo Sapiens
EKLCVPVDS

SEQ ID NO: 40363 - protein, 9 aa, Homo Sapiens
ASEELHNRS

SEQ ID NO: 40364 - protein, 9 aa, Homo Sapiens
KVILAACCT

SEQ ID NO: 40365 - protein, 9 aa, Homo Sapiens
RPKAPPSYA

SEQ ID NO: 40366 - protein, 9 aa, Homo Sapiens
LPQGKSLDQ

SEQ ID NO: 40367 - protein, 9 aa, Homo Sapiens
SQEEEDGAS

SEQ ID NO: 40368 - protein, 9 aa, Homo Sapiens
RRKGSLGNQ

SEQ ID NO: 40369 - protein, 9 aa, Homo Sapiens
RLVRVIIGY

SEQ ID NO: 40370 - protein, 9 aa, Homo Sapiens
PYIGSPANA

SEQ ID NO: 40371 - protein, 9 aa, Homo Sapiens
KTTMGSNYC

SEQ ID NO: 40372 - protein, 9 aa, Homo Sapiens
KSVERQHNL

SEQ ID NO: 40373 - protein, 9 aa, Homo Sapiens
SQVVPLSLQ

SEQ ID NO: 40374 - protein, 9 aa, Homo Sapiens
SEVFLVDKT

SEQ ID NO: 40375 - protein, 9 aa, Homo Sapiens
HPESRGPFP

SEQ ID NO: 40376 - protein, 9 aa, Homo Sapiens
EHNQHIEKS

SEQ ID NO: 40377 - protein, 9 aa, Homo Sapiens
TPSNRVKMQ

SEQ ID NO: 40378 - protein, 9 aa, Homo Sapiens
IKPEHYACG

SEQ ID NO: 40379 - protein, 9 aa, Homo Sapiens
QGANFSGDE

SEQ ID NO: 40380 - protein, 9 aa, Homo Sapiens
QNLRAKDEK

SEQ ID NO: 40381 - protein, 9 aa, Homo Sapiens
IRQQDPEAV

SEQ ID NO: 40382 - protein, 9 aa, Homo Sapiens
RLPPWARSE

SEQ ID NO: 40383 - protein, 9 aa, Homo Sapiens
SLTGPVPRA

SEQ ID NO: 40384 - protein, 9 aa, Homo Sapiens
FTVHITGFG

SEQ ID NO: 40385 - protein, 9 aa, Homo Sapiens
PRPPENNPL

SEQ ID NO: 40386 - protein, 9 aa, Homo Sapiens
RSVQLRDKG

SEQ ID NO: 40387 - protein, 9 aa, Homo Sapiens
GKKACQRMK

SEQ ID NO: 40388 - protein, 9 aa, Homo Sapiens
ANFSGDESE

SEQ ID NO: 40389 - protein, 9 aa, Homo Sapiens
CGGVGFDTC

SEQ ID NO: 40390 - protein, 9 aa, Homo Sapiens
ASAEDSALA

SEQ ID NO: 40391 - protein, 9 aa, Homo Sapiens
AEDSALADK

SEQ ID NO: 40392 - protein, 9 aa, Homo Sapiens
AQRHELGKV

SEQ ID NO: 40393 - protein, 9 aa, Homo Sapiens
QTLAQIHFM

SEQ ID NO: 40394 - protein, 9 aa, Homo Sapiens
PTYTDGEGV

SEQ ID NO: 40395 - protein, 9 aa, Homo Sapiens
YSSKVLDKP

SEQ ID NO: 40396 - protein, 9 aa, Homo Sapiens
HDKPGGQRR

SEQ ID NO: 40397 - protein, 9 aa, Homo Sapiens
QGGPREMYW

SEQ ID NO: 40398 - protein, 9 aa, Homo Sapiens
ETLSNHFIK

SEQ ID NO: 40399 - protein, 9 aa, Homo Sapiens
LVPVVEVGI

SEQ ID NO: 40400 - protein, 9 aa, Homo Sapiens
REMENQFQK

SEQ ID NO: 40401 - protein, 9 aa, Homo Sapiens
SKHDIIAEV

SEQ ID NO: 40402 - protein, 9 aa, Homo Sapiens
TPEVIDAIK

SEQ ID NO: 40403 - protein, 9 aa, Homo Sapiens
LLQPFGVID

SEQ ID NO: 40404 - protein, 9 aa, Homo Sapiens
LDDGTLVSD

SEQ ID NO: 40405 - protein, 9 aa, Homo Sapiens
GQRRGHGHT

SEQ ID NO: 40406 - protein, 9 aa, Homo Sapiens
GLAIYCMQV

SEQ ID NO: 40407 - protein, 9 aa, Homo Sapiens
FATGVPAVY

SEQ ID NO: 40408 - protein, 9 aa, Homo Sapiens
DEHQETHPG

SEQ ID NO: 40409 - protein, 9 aa, Homo Sapiens
TLLALDPMM

SEQ ID NO: 40410 - protein, 9 aa, Homo Sapiens
GSGLQSLGG

SEQ ID NO: 40411 - protein, 9 aa, Homo Sapiens
TSQWFAKYL

SEQ ID NO: 40412 - protein, 9 aa, Homo Sapiens
PLRDPETPR

SEQ ID NO: 40413 - protein, 9 aa, Homo Sapiens
PVDANWIEN

SEQ ID NO: 40414 - protein, 9 aa, Homo Sapiens
CQLVPVVEV

SEQ ID NO: 40415 - protein, 9 aa, Homo Sapiens
MKKKMVKRE

SEQ ID NO: 40416 - protein, 9 aa, Homo Sapiens
FVIKPEHYA

SEQ ID NO: 40417 - protein, 9 aa, Homo Sapiens
PFFVVFVCE

SEQ ID NO: 40418 - protein, 9 aa, Homo Sapiens
IMYTFLVGK

SEQ ID NO: 40419 - protein, 9 aa, Homo Sapiens
RTSATHCQG

SEQ ID NO: 40420 - protein, 9 aa, Homo Sapiens
STAIELRKP

SEQ ID NO: 40421 - protein, 9 aa, Homo Sapiens
DPPEKLCVP

SEQ ID NO: 40422 - protein, 9 aa, Homo Sapiens
PGGGCRGGP

SEQ ID NO: 40423 - protein, 9 aa, Homo Sapiens
VDKTLKCDI

SEQ ID NO: 40424 - protein, 9 aa, Homo Sapiens
DGCKKILPL

SEQ ID NO: 40425 - protein, 9 aa, Homo Sapiens
HPGIDLSQV

SEQ ID NO: 40426 - protein, 9 aa, Homo Sapiens
KIDSLLPKE

SEQ ID NO: 40427 - protein, 9 aa, Homo Sapiens
PLSVLSQFP

SEQ ID NO: 40428 - protein, 9 aa, Homo Sapiens
QSDSRKSSI

SEQ ID NO: 40429 - protein, 9 aa, Homo Sapiens
LSVLSQFPK

SEQ ID NO: 40430 - protein, 9 aa, Homo Sapiens
TKDPPEKLC

SEQ ID NO: 40431 - protein, 9 aa, Homo Sapiens
GSLKDAIEL

SEQ ID NO: 40432 - protein, 9 aa, Homo Sapiens
SGRALLDVT

SEQ ID NO: 40433 - protein, 9 aa, Homo Sapiens
LHKRGKYIK

SEQ ID NO: 40434 - protein, 9 aa, Homo Sapiens
DEKECQTKP

SEQ ID NO: 40435 - protein, 9 aa, Homo Sapiens
GGRQNWAYC

SEQ ID NO: 40436 - protein, 9 aa, Homo Sapiens
IHFMQKQRN

SEQ ID NO: 40437 - protein, 9 aa, Homo Sapiens
GVQAFANAL

SEQ ID NO: 40438 - protein, 9 aa, Homo Sapiens
GPRAGEKGP

SEQ ID NO: 40439 - protein, 9 aa, Homo Sapiens
MSPHPGIDL

SEQ ID NO: 40440 - protein, 9 aa, Homo Sapiens
HKVILAACC

SEQ ID NO: 40441 - protein, 9 aa, Homo Sapiens
ELCLEKMED

SEQ ID NO: 40442 - protein, 9 aa, Homo Sapiens
QHNLEEALL

SEQ ID NO: 40443 - protein, 9 aa, Homo Sapiens
SSEAQRHEL

SEQ ID NO: 40444 - protein, 9 aa, Homo Sapiens
HHSLDSQLA

SEQ ID NO: 40445 - protein, 9 aa, Homo Sapiens
GMLPVVKPL

SEQ ID NO: 40446 - protein, 9 aa, Homo Sapiens
NWNGNSEEI

SEQ ID NO: 40447 - protein, 9 aa, Homo Sapiens
RALLDVTDR

SEQ ID NO: 40448 - protein, 9 aa, Homo Sapiens
SCVASSAWL

SEQ ID NO: 40449 - protein, 9 aa, Homo Sapiens
MASLGEKKD

SEQ ID NO: 40450 - protein, 9 aa, Homo Sapiens
SHMFHGRFI

SEQ ID NO: 40451 - protein, 9 aa, Homo Sapiens
PLWALWLVW

SEQ ID NO: 40452 - protein, 9 aa, Homo Sapiens
KVFSLLQKK

SEQ ID NO: 40453 - protein, 9 aa, Homo Sapiens
SSQKSFSQR

SEQ ID NO: 40454 - protein, 9 aa, Homo Sapiens
RCGGVGFDT

SEQ ID NO: 40455 - protein, 9 aa, Homo Sapiens
VAAHGIASE

SEQ ID NO: 40456 - protein, 9 aa, Homo Sapiens
GCDLICCGR

SEQ ID NO: 40457 - protein, 9 aa, Homo Sapiens
PVFDQTSYM

SEQ ID NO: 40458 - protein, 9 aa, Homo Sapiens
PGPMSPRMS

SEQ ID NO: 40459 - protein, 9 aa, Homo Sapiens
KCSPGGRQN

SEQ ID NO: 40460 - protein, 9 aa, Homo Sapiens
EGWLHKRGK

SEQ ID NO: 40461 - protein, 9 aa, Homo Sapiens
LPERPKAPP

SEQ ID NO: 40462 - protein, 9 aa, Homo Sapiens
TVPRSRYSQ

SEQ ID NO: 40463 - protein, 9 aa, Homo Sapiens
DENVAKLVG

SEQ ID NO: 40464 - protein, 9 aa, Homo Sapiens
YTGPGLAIY

SEQ ID NO: 40465 - protein, 9 aa, Homo Sapiens
VSFLLLFNT

SEQ ID NO: 40466 - protein, 9 aa, Homo Sapiens
DKTMTELDI

SEQ ID NO: 40467 - protein, 9 aa, Homo Sapiens
AHYRHRLLD

SEQ ID NO: 40468 - protein, 9 aa, Homo Sapiens
GCRAGGVAL

SEQ ID NO: 40469 - protein, 9 aa, Homo Sapiens
GLGGKRKGQ

SEQ ID NO: 40470 - protein, 9 aa, Homo Sapiens
NFTVHITGF

SEQ ID NO: 40471 - protein, 9 aa, Homo Sapiens
PQASGCDLI

SEQ ID NO: 40472 - protein, 9 aa, Homo Sapiens
EIEDLQPPP

SEQ ID NO: 40473 - protein, 9 aa, Homo Sapiens
EELHNRSLE

SEQ ID NO: 40474 - protein, 9 aa, Homo Sapiens
KECQTKPGI

SEQ ID NO: 40475 - protein, 9 aa, Homo Sapiens
SHGSQGANF

SEQ ID NO: 40476 - protein, 9 aa, Homo Sapiens
GGTVEFDVV

SEQ ID NO: 40477 - protein, 9 aa, Homo Sapiens
SVWSQGPGG

SEQ ID NO: 40478 - protein, 9 aa, Homo Sapiens
LKIDSLLPK

SEQ ID NO: 40479 - protein, 9 aa, Homo Sapiens
IFDGPVDAN

SEQ ID NO: 40480 - protein, 9 aa, Homo Sapiens
ILAACCTFM

SEQ ID NO: 40481 - protein, 9 aa, Homo Sapiens
PLLTLKWMF

SEQ ID NO: 40482 - protein, 9 aa, Homo Sapiens
FPFAIKVFS

SEQ ID NO: 40483 - protein, 9 aa, Homo Sapiens
RRPKKGLMK

SEQ ID NO: 40484 - protein, 9 aa, Homo Sapiens
DVAPYIGSP

SEQ ID NO: 40485 - protein, 9 aa, Homo Sapiens
RKGQRPGGK

SEQ ID NO: 40486 - protein, 9 aa, Homo Sapiens
QRMKDAIRR

SEQ ID NO: 40487 - protein, 9 aa, Homo Sapiens
QITGKKACQ

SEQ ID NO: 40488 - protein, 9 aa, Homo Sapiens
ASWMPMFHR

SEQ ID NO: 40489 - protein, 9 aa, Homo Sapiens
FCYQIRCCT

SEQ ID NO: 40490 - protein, 9 aa, Homo Sapiens
ALAKYVKQN

SEQ ID NO: 40491 - protein, 9 aa, Homo Sapiens
CRWAAAPYR

SEQ ID NO: 40492 - protein, 9 aa, Homo Sapiens
TGGATLAHT

SEQ ID NO: 40493 - protein, 9 aa, Homo Sapiens
ITQSCVASS

SEQ ID NO: 40494 - protein, 9 aa, Homo Sapiens
WTVEDLQKT

SEQ ID NO: 40495 - protein, 9 aa, Homo Sapiens
TTQEMTPHE

SEQ ID NO: 40496 - protein, 9 aa, Homo Sapiens
TVSTAIELR

SEQ ID NO: 40497 - protein, 9 aa, Homo Sapiens
CRSSKDISK

SEQ ID NO: 40498 - protein, 9 aa, Homo Sapiens
VRHLKRLVR

SEQ ID NO: 40499 - protein, 9 aa, Homo Sapiens
RAPELLKGQ

SEQ ID NO: 40500 - protein, 9 aa, Homo Sapiens
IANEVAAHG

SEQ ID NO: 40501 - protein, 9 aa, Homo Sapiens
GRLPPWARS

SEQ ID NO: 40502 - protein, 9 aa, Homo Sapiens
SRHKQTHHS

SEQ ID NO: 40503 - protein, 9 aa, Homo Sapiens
PLVNSKYYT

SEQ ID NO: 40504 - protein, 9 aa, Homo Sapiens
ISSVSFLLL

SEQ ID NO: 40505 - protein, 9 aa, Homo Sapiens
SAGIIHWDL

SEQ ID NO: 40506 - protein, 9 aa, Homo Sapiens
RLLQPFGVI

SEQ ID NO: 40507 - protein, 9 aa, Homo Sapiens
GSPANASLE

SEQ ID NO: 40508 - protein, 9 aa, Homo Sapiens
ATHCQGPAS

SEQ ID NO: 40509 - protein, 9 aa, Homo Sapiens
TVPAPRLAS

SEQ ID NO: 40510 - protein, 9 aa, Homo Sapiens
VLPSSTTQE

SEQ ID NO: 40511 - protein, 9 aa, Homo Sapiens
DLVKIFDEN

SEQ ID NO: 40512 - protein, 9 aa, Homo Sapiens
FLVDKTLKC

SEQ ID NO: 40513 - protein, 9 aa, Homo Sapiens
TELDIDMNQ

SEQ ID NO: 40514 - protein, 9 aa, Homo Sapiens
CTFMRDQFL

SEQ ID NO: 40515 - protein, 9 aa, Homo Sapiens
DSDVEAQDG

SEQ ID NO: 40516 - protein, 9 aa, Homo Sapiens
HHSMTSLFS

SEQ ID NO: 40517 - protein, 9 aa, Homo Sapiens
TYGMSPHPG

SEQ ID NO: 40518 - protein, 9 aa, Homo Sapiens
YIETLRPRL

SEQ ID NO: 40519 - protein, 9 aa, Homo Sapiens
CAKQRNLSE

SEQ ID NO: 40520 - protein, 9 aa, Homo Sapiens
GQASHFETR

SEQ ID NO: 40521 - protein, 9 aa, Homo Sapiens
LSSSSSASP

SEQ ID NO: 40522 - protein, 9 aa, Homo Sapiens
SMTSLFSST

SEQ ID NO: 40523 - protein, 9 aa, Homo Sapiens
LSLPERPKA

SEQ ID NO: 40524 - protein, 9 aa, Homo Sapiens
QASGCDLIC

SEQ ID NO: 40525 - protein, 9 aa, Homo Sapiens
WSQIVPKST

SEQ ID NO: 40526 - protein, 9 aa, Homo Sapiens
PQPGLQRAL

SEQ ID NO: 40527 - protein, 9 aa, Homo Sapiens
FITMMKKEA

SEQ ID NO: 40528 - protein, 9 aa, Homo Sapiens
ITMMKKEAE

SEQ ID NO: 40529 - protein, 9 aa, Homo Sapiens
MPEASSSSV

SEQ ID NO: 40530 - protein, 9 aa, Homo Sapiens
EASSSSVQF

SEQ ID NO: 40531 - protein, 9 aa, Homo Sapiens
KQMNDARHG

SEQ ID NO: 40532 - protein, 9 aa, Homo Sapiens
IAGRDIMYF

SEQ ID NO: 40533 - protein, 9 aa, Homo Sapiens
LAFHLQRNI

SEQ ID NO: 40534 - protein, 9 aa, Homo Sapiens
LCSKSLSLI

SEQ ID NO: 40535 - protein, 9 aa, Homo Sapiens
INATSKDVS

SEQ ID NO: 40536 - protein, 9 aa, Homo Sapiens
IPIAGRDIM

SEQ ID NO: 40537 - protein, 9 aa, Homo Sapiens
PHLAFHLQR

SEQ ID NO: 40538 - protein, 9 aa, Homo Sapiens
ACDDCEPLM

SEQ ID NO: 40539 - protein, 9 aa, Homo Sapiens
QPGLQRALS

SEQ ID NO: 40540 - protein, 9 aa, Homo Sapiens
QIVPKSTKG

SEQ ID NO: 40541 - protein, 9 aa, Homo Sapiens
VPKSTKGDG

SEQ ID NO: 40542 - protein, 9 aa, Homo Sapiens
PKDRAGKDG

SEQ ID NO: 40543 - protein, 9 aa, Homo Sapiens
HTGSRPFCP

SEQ ID NO: 40544 - protein, 9 aa, Homo Sapiens
NALVELNKL

SEQ ID NO: 40545 - protein, 9 aa, Homo Sapiens
SGKADHMPL

SEQ ID NO: 40546 - protein, 9 aa, Homo Sapiens
MYFIQQLLR

SEQ ID NO: 40547 - protein, 9 aa, Homo Sapiens
LVELNKLFD

SEQ ID NO: 40548 - protein, 9 aa, Homo Sapiens
DRAGKDGAP

SEQ ID NO: 40549 - protein, 9 aa, Homo Sapiens
ELNKLFDAK

SEQ ID NO: 40550 - protein, 9 aa, Homo Sapiens
GRDIMYFIQ

SEQ ID NO: 40551 - protein, 9 aa, Homo Sapiens
CIASQEEES

SEQ ID NO: 40552 - protein, 9 aa, Homo Sapiens
LLTTRCIAS

SEQ ID NO: 40553 - protein, 9 aa, Homo Sapiens
PPPACQVQD

SEQ ID NO: 40554 - protein, 9 aa, Homo Sapiens
WRVLLPLIF

SEQ ID NO: 40555 - protein, 9 aa, Homo Sapiens
SLIDLGSNA

SEQ ID NO: 40556 - protein, 9 aa, Homo Sapiens
HMPLESMDS

SEQ ID NO: 40557 - protein, 9 aa, Homo Sapiens
DDTGTTFIT

SEQ ID NO: 40558 - protein, 9 aa, Homo Sapiens
CSKSLSLID

SEQ ID NO: 40559 - protein, 9 aa, Homo Sapiens
AGRDIMYFI

SEQ ID NO: 40560 - protein, 9 aa, Homo Sapiens
AKDRDSGTN

SEQ ID NO: 40561 - protein, 9 aa, Homo Sapiens
KKEAEKRTR

SEQ ID NO: 40562 - protein, 9 aa, Homo Sapiens
ATSKDVSDV

SEQ ID NO: 40563 - protein, 9 aa, Homo Sapiens
LILTVPLWR

SEQ ID NO: 40564 - protein, 9 aa, Homo Sapiens
ANRLLTTRC

SEQ ID NO: 40565 - protein, 9 aa, Homo Sapiens
NQTLHLLLT

SEQ ID NO: 40566 - protein, 9 aa, Homo Sapiens
VCMEIESLG

SEQ ID NO: 40567 - protein, 9 aa, Homo Sapiens
KADHMPLES

SEQ ID NO: 40568 - protein, 9 aa, Homo Sapiens
MMKKEAEKR

SEQ ID NO: 40569 - protein, 9 aa, Homo Sapiens
KSLSLIDLG

SEQ ID NO: 40570 - protein, 9 aa, Homo Sapiens
KPKDSNQTL

SEQ ID NO: 40571 - protein, 9 aa, Homo Sapiens
PKDSNQTLH

SEQ ID NO: 40572 - protein, 9 aa, Homo Sapiens
GLQRALSSD

SEQ ID NO: 40573 - protein, 9 aa, Homo Sapiens
IHTGSRPFC

SEQ ID NO: 40574 - protein, 9 aa, Homo Sapiens
LPPEDDTGT

SEQ ID NO: 40575 - protein, 9 aa, Homo Sapiens
KEAEKRTRT

SEQ ID NO: 40576 - protein, 9 aa, Homo Sapiens
GFSEASSKG

SEQ ID NO: 40577 - protein, 9 aa, Homo Sapiens
KSVCQRACD

SEQ ID NO: 40578 - protein, 9 aa, Homo Sapiens
KDGDPKDRA

SEQ ID NO: 40579 - protein, 9 aa, Homo Sapiens
DGDPKDRAG

SEQ ID NO: 40580 - protein, 9 aa, Homo Sapiens
GPQPGLQRA

SEQ ID NO: 40581 - protein, 9 aa, Homo Sapiens
NSLTPNHEA

SEQ ID NO: 40582 - protein, 9 aa, Homo Sapiens
EGPQPGLQR

SEQ ID NO: 40583 - protein, 9 aa, Homo Sapiens
PEDDTGTTF

SEQ ID NO: 40584 - protein, 9 aa, Homo Sapiens
EAEKRTRTL

SEQ ID NO: 40585 - protein, 9 aa, Homo Sapiens
LIDLGSNAL

SEQ ID NO: 40586 - protein, 9 aa, Homo Sapiens
DSNSLTPNH

SEQ ID NO: 40587 - protein, 9 aa, Homo Sapiens
SNQTLHLLL

SEQ ID NO: 40588 - protein, 9 aa, Homo Sapiens
AEKRTRTLT

SEQ ID NO: 40589 - protein, 9 aa, Homo Sapiens
MNDARHGGW

SEQ ID NO: 40590 - protein, 9 aa, Homo Sapiens
TMMKKEAEK

SEQ ID NO: 40591 - protein, 9 aa, Homo Sapiens
LRIPHLAFH

SEQ ID NO: 40592 - protein, 9 aa, Homo Sapiens
FHLQRNINE

SEQ ID NO: 40593 - protein, 9 aa, Homo Sapiens
YKPRWSQIV

SEQ ID NO: 40594 - protein, 9 aa, Homo Sapiens
KDRAGKDGA

SEQ ID NO: 40595 - protein, 9 aa, Homo Sapiens
SEGPQPGLQ

SEQ ID NO: 40596 - protein, 9 aa, Homo Sapiens
KEDSNSLTP

SEQ ID NO: 40597 - protein, 9 aa, Homo Sapiens
VELNKLFDA

SEQ ID NO: 40598 - protein, 9 aa, Homo Sapiens
SKSLSLIDL

SEQ ID NO: 40599 - protein, 9 aa, Homo Sapiens
VSDVTEVMW

SEQ ID NO: 40600 - protein, 9 aa, Homo Sapiens
EDSNSLTPN

SEQ ID NO: 40601 - protein, 9 aa, Homo Sapiens
SLSLIDLGS

SEQ ID NO: 40602 - protein, 9 aa, Homo Sapiens
QLKINNPFA

SEQ ID NO: 40603 - protein, 9 aa, Homo Sapiens
GSRPFCPQC

SEQ ID NO: 40604 - protein, 9 aa, Homo Sapiens
LKINNPFAK

SEQ ID NO: 40605 - protein, 9 aa, Homo Sapiens
GSISAKDRD

SEQ ID NO: 40606 - protein, 9 aa, Homo Sapiens
TRCIASQEE

SEQ ID NO: 40607 - protein, 9 aa, Homo Sapiens
SNSLTPNHE

SEQ ID NO: 40608 - protein, 9 aa, Homo Sapiens
GPSGKADHM

SEQ ID NO: 40609 - protein, 9 aa, Homo Sapiens
LLVCMEIES

SEQ ID NO: 40610 - protein, 9 aa, Homo Sapiens
EDDTGTTFI

SEQ ID NO: 40611 - protein, 9 aa, Homo Sapiens
PGPSGKADH

SEQ ID NO: 40612 - protein, 9 aa, Homo Sapiens
ETYSRLLVC

SEQ ID NO: 40613 - protein, 9 aa, Homo Sapiens
NATSKDVSD

SEQ ID NO: 40614 - protein, 9 aa, Homo Sapiens
TLHLLLTED

SEQ ID NO: 40615 - protein, 9 aa, Homo Sapiens
IMYFIQQLL

SEQ ID NO: 40616 - protein, 9 aa, Homo Sapiens
LWRVLLPLI

SEQ ID NO: 40617 - protein, 9 aa, Homo Sapiens
LVCMEIESL

SEQ ID NO: 40618 - protein, 9 aa, Homo Sapiens
CDDCEPLMK

SEQ ID NO: 40619 - protein, 9 aa, Homo Sapiens
SEASSKGFN

SEQ ID NO: 40620 - protein, 9 aa, Homo Sapiens
ILTVPLWRV

SEQ ID NO: 40621 - protein, 9 aa, Homo Sapiens
SSKGFNSVA

SEQ ID NO: 40622 - protein, 9 aa, Homo Sapiens
DIMYFIQQL

SEQ ID NO: 40623 - protein, 9 aa, Homo Sapiens
DPKDRAGKD

SEQ ID NO: 40624 - protein, 9 aa, Homo Sapiens
IPHLAFHLQ

SEQ ID NO: 40625 - protein, 9 aa, Homo Sapiens
DHMPLESMD

SEQ ID NO: 40626 - protein, 9 aa, Homo Sapiens
AGKDGAPKE

SEQ ID NO: 40627 - protein, 9 aa, Homo Sapiens
YSRLLVCME

SEQ ID NO: 40628 - protein, 9 aa, Homo Sapiens
TYSRLLVCM

SEQ ID NO: 40629 - protein, 9 aa, Homo Sapiens
DTGTTFITM

SEQ ID NO: 40630 - protein, 9 aa, Homo Sapiens
EASSKGFNS

SEQ ID NO: 40631 - protein, 9 aa, Homo Sapiens
INNPFAKGF

SEQ ID NO: 40632 - protein, 9 aa, Homo Sapiens
ITQLKINNP

SEQ ID NO: 40633 - protein, 9 aa, Homo Sapiens
FCPQCGKSF

SEQ ID NO: 40634 - protein, 9 aa, Homo Sapiens
SRPFCPQCG

SEQ ID NO: 40635 - protein, 9 aa, Homo Sapiens
RHGGWTTKM

SEQ ID NO: 40636 - protein, 9 aa, Homo Sapiens
RAGKDGAPK

SEQ ID NO: 40637 - protein, 9 aa, Homo Sapiens
QRALSSDSI

SEQ ID NO: 40638 - protein, 9 aa, Homo Sapiens
RACDDCEPL

SEQ ID NO: 40639 - protein, 9 aa, Homo Sapiens
TTFITMMKK

SEQ ID NO: 40640 - protein, 9 aa, Homo Sapiens
LHLLLTEDD

SEQ ID NO: 40641 - protein, 9 aa, Homo Sapiens
TQLKINNPF

SEQ ID NO: 40642 - protein, 9 aa, Homo Sapiens
CKSVCQRAC

SEQ ID NO: 40643 - protein, 9 aa, Homo Sapiens
TSKDVSDVT

SEQ ID NO: 40644 - protein, 9 aa, Homo Sapiens
SAKDRDSGT

SEQ ID NO: 40645 - protein, 9 aa, Homo Sapiens
TFITMMKKE

SEQ ID NO: 40646 - protein, 9 aa, Homo Sapiens
KDSNQTLHL

SEQ ID NO: 40647 - protein, 9 aa, Homo Sapiens
SKDVSDVTE

SEQ ID NO: 40648 - protein, 9 aa, Homo Sapiens
RLLVCMEIE

SEQ ID NO: 40649 - protein, 9 aa, Homo Sapiens
IDLGSNALE

SEQ ID NO: 40650 - protein, 9 aa, Homo Sapiens
ALVELNKLF

SEQ ID NO: 40651 - protein, 9 aa, Homo Sapiens
CMEIESLGI

SEQ ID NO: 40652 - protein, 9 aa, Homo Sapiens
ISAKDRDSG

SEQ ID NO: 40653 - protein, 9 aa, Homo Sapiens
NRLLTTRCI

SEQ ID NO: 40654 - protein, 9 aa, Homo Sapiens
RDIMYFIQQ

SEQ ID NO: 40655 - protein, 9 aa, Homo Sapiens
FMKQMNDAR

SEQ ID NO: 40656 - protein, 9 aa, Homo Sapiens
ARHGGWTTK

SEQ ID NO: 40657 - protein, 9 aa, Homo Sapiens
RWSQIVPKS

SEQ ID NO: 40658 - protein, 9 aa, Homo Sapiens
TGSRPFCPQ

SEQ ID NO: 40659 - protein, 9 aa, Homo Sapiens
DARHGGWTT

SEQ ID NO: 40660 - protein, 9 aa, Homo Sapiens
TVPLWRVLL

SEQ ID NO: 40661 - protein, 9 aa, Homo Sapiens
TTRCIASQE

SEQ ID NO: 40662 - protein, 9 aa, Homo Sapiens
PLWRVLLPL

SEQ ID NO: 40663 - protein, 9 aa, Homo Sapiens
RCIASQEEE

SEQ ID NO: 40664 - protein, 9 aa, Homo Sapiens
AFHLQRNIN

SEQ ID NO: 40665 - protein, 9 aa, Homo Sapiens
LQRALSSDS

SEQ ID NO: 40666 - protein, 9 aa, Homo Sapiens
DSNQTLHLL

SEQ ID NO: 40667 - protein, 9 aa, Homo Sapiens
GDPKDRAGK

SEQ ID NO: 40668 - protein, 9 aa, Homo Sapiens
MKQMNDARH

SEQ ID NO: 40669 - protein, 9 aa, Homo Sapiens
NENALVELN

SEQ ID NO: 40670 - protein, 9 aa, Homo Sapiens
ASSSSVQFE

SEQ ID NO: 40671 - protein, 9 aa, Homo Sapiens
RIPHLAFHL

SEQ ID NO: 40672 - protein, 9 aa, Homo Sapiens
LSLIDLGSN

SEQ ID NO: 40673 - protein, 9 aa, Homo Sapiens
PFCPQCGKS

SEQ ID NO: 40674 - protein, 9 aa, Homo Sapiens
IVPKSTKGD

SEQ ID NO: 40675 - protein, 9 aa, Homo Sapiens
PINATSKDV

SEQ ID NO: 40676 - protein, 9 aa, Homo Sapiens
LNKLFDAKS

SEQ ID NO: 40677 - protein, 9 aa, Homo Sapiens
DKITQLKIN

SEQ ID NO: 40678 - protein, 9 aa, Homo Sapiens
SRLLVCMEI

SEQ ID NO: 40679 - protein, 9 aa, Homo Sapiens
NDARHGGWT

SEQ ID NO: 40680 - protein, 9 aa, Homo Sapiens
PGLQRALSS

SEQ ID NO: 40681 - protein, 9 aa, Homo Sapiens
PNHEAEKED

SEQ ID NO: 40682 - protein, 9 aa, Homo Sapiens
CQRACDDCE

SEQ ID NO: 40683 - protein, 9 aa, Homo Sapiens
GTTFITMMK

SEQ ID NO: 40684 - protein, 9 aa, Homo Sapiens
SISAKDRDS

SEQ ID NO: 40685 - protein, 9 aa, Homo Sapiens
KINNPFAKG

SEQ ID NO: 40686 - protein, 9 aa, Homo Sapiens
VCQRACDDC

SEQ ID NO: 40687 - protein, 9 aa, Homo Sapiens
PPEDDTGTT

SEQ ID NO: 40688 - protein, 9 aa, Homo Sapiens
LTVPLWRVL

SEQ ID NO: 40689 - protein, 9 aa, Homo Sapiens
KDRDSGTNA

SEQ ID NO: 40690 - protein, 9 aa, Homo Sapiens
LLPPEDDTG

SEQ ID NO: 40691 - protein, 9 aa, Homo Sapiens
PSGKADHMP

SEQ ID NO: 40692 - protein, 9 aa, Homo Sapiens
SRPPPACQV

SEQ ID NO: 40693 - protein, 9 aa, Homo Sapiens
RPFCPQCGK

SEQ ID NO: 40694 - protein, 9 aa, Homo Sapiens
DVSDVTEVM

SEQ ID NO: 40695 - protein, 9 aa, Homo Sapiens
QMNDARHGG

SEQ ID NO: 40696 - protein, 9 aa, Homo Sapiens
LTPNHEAEK

SEQ ID NO: 40697 - protein, 9 aa, Homo Sapiens
KDVSDVTEV

SEQ ID NO: 40698 - protein, 9 aa, Homo Sapiens
RPPPACQVQ

SEQ ID NO: 40699 - protein, 9 aa, Homo Sapiens
NKLFDAKSE

SEQ ID NO: 40700 - protein, 9 aa, Homo Sapiens
QTLHLLLTE

SEQ ID NO: 40701 - protein, 9 aa, Homo Sapiens
HIGSISAKD

SEQ ID NO: 40702 - protein, 9 aa, Homo Sapiens
HLAFHLQRN

SEQ ID NO: 40703 - protein, 9 aa, Homo Sapiens
LTTRCIASQ

SEQ ID NO: 40704 - protein, 9 aa, Homo Sapiens
SQIVPKSTK

SEQ ID NO: 40705 - protein, 9 aa, Homo Sapiens
ASSKGFNSV

SEQ ID NO: 40706 - protein, 9 aa, Homo Sapiens
GKADHMPLE

SEQ ID NO: 40707 - protein, 9 aa, Homo Sapiens
SVCQRACDD

SEQ ID NO: 40708 - protein, 9 aa, Homo Sapiens
PIAGRDIMY

SEQ ID NO: 40709 - protein, 9 aa, Homo Sapiens
RLLTTRCIA

SEQ ID NO: 40710 - protein, 9 aa, Homo Sapiens
ADHMPLESM

SEQ ID NO: 40711 - protein, 9 aa, Homo Sapiens
SLTPNHEAE

SEQ ID NO: 40712 - protein, 9 aa, Homo Sapiens
PEASSSSVQ

SEQ ID NO: 40713 - protein, 9 aa, Homo Sapiens
MKKEAEKRT

SEQ ID NO: 40714 - protein, 9 aa, Homo Sapiens
KPRWSQIVP

SEQ ID NO: 40715 - protein, 9 aa, Homo Sapiens
QRACDDCEP

SEQ ID NO: 40716 - protein, 9 aa, Homo Sapiens
KITQLKINN

SEQ ID NO: 40717 - protein, 9 aa, Homo Sapiens
ENALVELNK

SEQ ID NO: 40718 - protein, 9 aa, Homo Sapiens
ILRIPHLAF

SEQ ID NO: 40719 - protein, 9 aa, Homo Sapiens
FSEASSKGF

SEQ ID NO: 40720 - protein, 9 aa, Homo Sapiens
SKGFNSVAT

SEQ ID NO: 40721 - protein, 9 aa, Homo Sapiens
TPNHEAEKE

SEQ ID NO: 40722 - protein, 9 aa, Homo Sapiens
VPLWRVLLP

SEQ ID NO: 40723 - protein, 9 aa, Homo Sapiens
TGTTFITMM

SEQ ID NO: 40724 - protein, 9 aa, Homo Sapiens
VLILTVPLW

SEQ ID NO: 40725 - protein, 9 aa, Homo Sapiens
IGSISAKDR

SEQ ID NO: 40726 - protein, 9 aa, Homo Sapiens
LHIGSISAK

SEQ ID NO: 40727 - protein, 9 aa, Homo Sapiens
PRWSQIVPK

SEQ ID NO: 40728 - protein, 9 aa, Homo Sapiens
CQSYRTSST

SEQ ID NO: 40729 - protein, 9 aa, Homo Sapiens
DQASGCQWR

SEQ ID NO: 40730 - protein, 9 aa, Homo Sapiens
SSPRDTIYT

SEQ ID NO: 40731 - protein, 9 aa, Homo Sapiens
SVGYRVPAS

SEQ ID NO: 40732 - protein, 9 aa, Homo Sapiens
NYSCTELKF

SEQ ID NO: 40733 - protein, 9 aa, Homo Sapiens
ESSTSLKIR

SEQ ID NO: 40734 - protein, 9 aa, Homo Sapiens
LAAQLTRLW

SEQ ID NO: 40735 - protein, 9 aa, Homo Sapiens
PRKAASNLV

SEQ ID NO: 40736 - protein, 9 aa, Homo Sapiens
HFADKEPTK

SEQ ID NO: 40737 - protein, 9 aa, Homo Sapiens
RPSLTFSGV

SEQ ID NO: 40738 - protein, 9 aa, Homo Sapiens
TSEVFFQCK

SEQ ID NO: 40739 - protein, 9 aa, Homo Sapiens
GDQASGCQW

SEQ ID NO: 40740 - protein, 9 aa, Homo Sapiens
LSQGINKNE

SEQ ID NO: 40741 - protein, 9 aa, Homo Sapiens
SKSHNLQIL

SEQ ID NO: 40742 - protein, 9 aa, Homo Sapiens
CQWRAQRFC

SEQ ID NO: 40743 - protein, 9 aa, Homo Sapiens
ELKFTRKTV

SEQ ID NO: 40744 - protein, 9 aa, Homo Sapiens
GVNSSTQGW

SEQ ID NO: 40745 - protein, 9 aa, Homo Sapiens
ANYSCTELK

SEQ ID NO: 40746 - protein, 9 aa, Homo Sapiens
RLLGLTMRR

SEQ ID NO: 40747 - protein, 9 aa, Homo Sapiens
LLLCQEDCN

SEQ ID NO: 40748 - protein, 9 aa, Homo Sapiens
LYEDIISLL

SEQ ID NO: 40749 - protein, 9 aa, Homo Sapiens
ASELLKEWT

SEQ ID NO: 40750 - protein, 9 aa, Homo Sapiens
EKGSGREEG

SEQ ID NO: 40751 - protein, 9 aa, Homo Sapiens
SRVEKLHLF

SEQ ID NO: 40752 - protein, 9 aa, Homo Sapiens
VNYLESRKD

SEQ ID NO: 40753 - protein, 9 aa, Homo Sapiens
APSSRGAEA

SEQ ID NO: 40754 - protein, 9 aa, Homo Sapiens
SSNLSAEHS

SEQ ID NO: 40755 - protein, 9 aa, Homo Sapiens
QARAPREEQ

SEQ ID NO: 40756 - protein, 9 aa, Homo Sapiens
EVIHASRKD

SEQ ID NO: 40757 - protein, 9 aa, Homo Sapiens
LSIIIVIFH

SEQ ID NO: 40758 - protein, 9 aa, Homo Sapiens
AGPSPLSES

SEQ ID NO: 40759 - protein, 9 aa, Homo Sapiens
VNSSTQGWR

SEQ ID NO: 40760 - protein, 9 aa, Homo Sapiens
SCEATRSRN

SEQ ID NO: 40761 - protein, 9 aa, Homo Sapiens
FTTRTLHKA

SEQ ID NO: 40762 - protein, 9 aa, Homo Sapiens
QSLTYSSCM

SEQ ID NO: 40763 - protein, 9 aa, Homo Sapiens
LDAMFVALV

SEQ ID NO: 40764 - protein, 9 aa, Homo Sapiens
VGVDIPFVN

SEQ ID NO: 40765 - protein, 9 aa, Homo Sapiens
ESTTALNLS

SEQ ID NO: 40766 - protein, 9 aa, Homo Sapiens
CQGKEAIRI

SEQ ID NO: 40767 - protein, 9 aa, Homo Sapiens
ELLKEWTVT

SEQ ID NO: 40768 - protein, 9 aa, Homo Sapiens
VIEAKKRIM

SEQ ID NO: 40769 - protein, 9 aa, Homo Sapiens
RDSTGGSHS

SEQ ID NO: 40770 - protein, 9 aa, Homo Sapiens
SLRHNFMQL

SEQ ID NO: 40771 - protein, 9 aa, Homo Sapiens
NSSVEMYRH

SEQ ID NO: 40772 - protein, 9 aa, Homo Sapiens
MPASTTPVV

SEQ ID NO: 40773 - protein, 9 aa, Homo Sapiens
LRYAMSMNT

SEQ ID NO: 40774 - protein, 9 aa, Homo Sapiens
VEMYRHVLL

SEQ ID NO: 40775 - protein, 9 aa, Homo Sapiens
ACESDHEAD

SEQ ID NO: 40776 - protein, 9 aa, Homo Sapiens
DLQLQRNLQ

SEQ ID NO: 40777 - protein, 9 aa, Homo Sapiens
SLSSPLVAI

SEQ ID NO: 40778 - protein, 9 aa, Homo Sapiens
VKAIIYCFP

SEQ ID NO: 40779 - protein, 9 aa, Homo Sapiens
VGYRVPASS

SEQ ID NO: 40780 - protein, 9 aa, Homo Sapiens
AASNLVGVL

SEQ ID NO: 40781 - protein, 9 aa, Homo Sapiens
GSGREEGKG

SEQ ID NO: 40782 - protein, 9 aa, Homo Sapiens
NVAANFGAI

SEQ ID NO: 40783 - protein, 9 aa, Homo Sapiens
ILSSTPTII

SEQ ID NO: 40784 - protein, 9 aa, Homo Sapiens
TRESSKEAQ

SEQ ID NO: 40785 - protein, 9 aa, Homo Sapiens
LIYLLENDV

SEQ ID NO: 40786 - protein, 9 aa, Homo Sapiens
NSARDVLQA

SEQ ID NO: 40787 - protein, 9 aa, Homo Sapiens
PLAPRDSTG

SEQ ID NO: 40788 - protein, 9 aa, Homo Sapiens
VCIRTTKDE

SEQ ID NO: 40789 - protein, 9 aa, Homo Sapiens
QELTQGSPS

SEQ ID NO: 40790 - protein, 9 aa, Homo Sapiens
SLMLCDFCG

SEQ ID NO: 40791 - protein, 9 aa, Homo Sapiens
TTRTLHKAT

SEQ ID NO: 40792 - protein, 9 aa, Homo Sapiens
LSPQAPSSR

SEQ ID NO: 40793 - protein, 9 aa, Homo Sapiens
WPSASRTRG

SEQ ID NO: 40794 - protein, 9 aa, Homo Sapiens
TDFSSNLSA

SEQ ID NO: 40795 - protein, 9 aa, Homo Sapiens
CFLDLGSAP

SEQ ID NO: 40796 - protein, 9 aa, Homo Sapiens
CNPLDSFDL

SEQ ID NO: 40797 - protein, 9 aa, Homo Sapiens
QRNLQYLDQ

SEQ ID NO: 40798 - protein, 9 aa, Homo Sapiens
LLGLSKSHN

SEQ ID NO: 40799 - protein, 9 aa, Homo Sapiens
PKLLGTFGV

SEQ ID NO: 40800 - protein, 9 aa, Homo Sapiens
LTYSSCMSW

SEQ ID NO: 40801 - protein, 9 aa, Homo Sapiens
CTAQECLSS

SEQ ID NO: 40802 - protein, 9 aa, Homo Sapiens
FVNEEAETT

SEQ ID NO: 40803 - protein, 9 aa, Homo Sapiens
DLLFLFGCG

SEQ ID NO: 40804 - protein, 9 aa, Homo Sapiens
PPLYEDIIS

SEQ ID NO: 40805 - protein, 9 aa, Homo Sapiens
ALTHAIRNF

SEQ ID NO: 40806 - protein, 9 aa, Homo Sapiens
LALSPQAPS

SEQ ID NO: 40807 - protein, 9 aa, Homo Sapiens
RDTIYTIDG

SEQ ID NO: 40808 - protein, 9 aa, Homo Sapiens
MDLNSPVRK

SEQ ID NO: 40809 - protein, 9 aa, Homo Sapiens
NKVADQLWV

SEQ ID NO: 40810 - protein, 9 aa, Homo Sapiens
FDCFLDLGS

SEQ ID NO: 40811 - protein, 9 aa, Homo Sapiens
ASGCQWRAQ

SEQ ID NO: 40812 - protein, 9 aa, Homo Sapiens
MVVGTLGAI

SEQ ID NO: 40813 - protein, 9 aa, Homo Sapiens
SVSSVLASE

SEQ ID NO: 40814 - protein, 9 aa, Homo Sapiens
MKNQKIESS

SEQ ID NO: 40815 - protein, 9 aa, Homo Sapiens
NTMLQLSPK

SEQ ID NO: 40816 - protein, 9 aa, Homo Sapiens
GPSCDATFS

SEQ ID NO: 40817 - protein, 9 aa, Homo Sapiens
YSCTELKFT

SEQ ID NO: 40818 - protein, 9 aa, Homo Sapiens
NESEPSCEA

SEQ ID NO: 40819 - protein, 9 aa, Homo Sapiens
FLFGCGRTF

SEQ ID NO: 40820 - protein, 9 aa, Homo Sapiens
SATDIWGVG

SEQ ID NO: 40821 - protein, 9 aa, Homo Sapiens
TLRSKMGTW

SEQ ID NO: 40822 - protein, 9 aa, Homo Sapiens
ELTQGSPSL

SEQ ID NO: 40823 - protein, 9 aa, Homo Sapiens
LQYLDQQMS

SEQ ID NO: 40824 - protein, 9 aa, Homo Sapiens
SRLKIHPKS

SEQ ID NO: 40825 - protein, 9 aa, Homo Sapiens
IIYCFPNVF

SEQ ID NO: 40826 - protein, 9 aa, Homo Sapiens
CQEDCNITD

SEQ ID NO: 40827 - protein, 9 aa, Homo Sapiens
IWNIEEYCR

SEQ ID NO: 40828 - protein, 9 aa, Homo Sapiens
QATSLPVTD

SEQ ID NO: 40829 - protein, 9 aa, Homo Sapiens
SWSAEGYHL

SEQ ID NO: 40830 - protein, 9 aa, Homo Sapiens
PFTTRTLHK

SEQ ID NO: 40831 - protein, 9 aa, Homo Sapiens
GCFPIPMVH

SEQ ID NO: 40832 - protein, 9 aa, Homo Sapiens
EEGKGVVTN

SEQ ID NO: 40833 - protein, 9 aa, Homo Sapiens
QAVRVSLSS

SEQ ID NO: 40834 - protein, 9 aa, Homo Sapiens
IKELKEALI

SEQ ID NO: 40835 - protein, 9 aa, Homo Sapiens
KAIQELTQG

SEQ ID NO: 40836 - protein, 9 aa, Homo Sapiens
KEELGAVHL

SEQ ID NO: 40837 - protein, 9 aa, Homo Sapiens
FPPLYEDII

SEQ ID NO: 40838 - protein, 9 aa, Homo Sapiens
EFDCFLDLG

SEQ ID NO: 40839 - protein, 9 aa, Homo Sapiens
ANGGTVWLE

SEQ ID NO: 40840 - protein, 9 aa, Homo Sapiens
AISENKIVI

SEQ ID NO: 40841 - protein, 9 aa, Homo Sapiens
LTFSGVNSS

SEQ ID NO: 40842 - protein, 9 aa, Homo Sapiens
RHSLGLRLL

SEQ ID NO: 40843 - protein, 9 aa, Homo Sapiens
APECQGKEA

SEQ ID NO: 40844 - protein, 9 aa, Homo Sapiens
YEDIISLLI

SEQ ID NO: 40845 - protein, 9 aa, Homo Sapiens
CRGKTSEFD

SEQ ID NO: 40846 - protein, 9 aa, Homo Sapiens
FTYTSEVFF

SEQ ID NO: 40847 - protein, 9 aa, Homo Sapiens
AAAGGKSYG

SEQ ID NO: 40848 - protein, 9 aa, Homo Sapiens
ESDHEADEW

SEQ ID NO: 40849 - protein, 9 aa, Homo Sapiens
GRVSLLVNG

SEQ ID NO: 40850 - protein, 9 aa, Homo Sapiens
DIISLLIQI

SEQ ID NO: 40851 - protein, 9 aa, Homo Sapiens
WNIEEYCRN

SEQ ID NO: 40852 - protein, 9 aa, Homo Sapiens
PSAAMAASK

SEQ ID NO: 40853 - protein, 9 aa, Homo Sapiens
SPVRKALGS

SEQ ID NO: 40854 - protein, 9 aa, Homo Sapiens
SGVNSSTQG

SEQ ID NO: 40855 - protein, 9 aa, Homo Sapiens
PVAPECQGK

SEQ ID NO: 40856 - protein, 9 aa, Homo Sapiens
KAIIYCFPN

SEQ ID NO: 40857 - protein, 9 aa, Homo Sapiens
LPKADIDVL

SEQ ID NO: 40858 - protein, 9 aa, Homo Sapiens
AQLTRLWPS

SEQ ID NO: 40859 - protein, 9 aa, Homo Sapiens
SCQSYRTSS

SEQ ID NO: 40860 - protein, 9 aa, Homo Sapiens
ILISAHENS

SEQ ID NO: 40861 - protein, 9 aa, Homo Sapiens
VIGDGRHEE

SEQ ID NO: 40862 - protein, 9 aa, Homo Sapiens
CKEVGLFNE

SEQ ID NO: 40863 - protein, 9 aa, Homo Sapiens
LTLDNKVAD

SEQ ID NO: 40864 - protein, 9 aa, Homo Sapiens
KNQKIESSP

SEQ ID NO: 40865 - protein, 9 aa, Homo Sapiens
CVCACPGRD

SEQ ID NO: 40866 - protein, 9 aa, Homo Sapiens
EPSCEATRS

SEQ ID NO: 40867 - protein, 9 aa, Homo Sapiens
FLANGGTVW

SEQ ID NO: 40868 - protein, 9 aa, Homo Sapiens
GMVEVVAQN

SEQ ID NO: 40869 - protein, 9 aa, Homo Sapiens
NLEHRSVKK

SEQ ID NO: 40870 - protein, 9 aa, Homo Sapiens
PWQSSTSTR

SEQ ID NO: 40871 - protein, 9 aa, Homo Sapiens
YHFYQGLIY

SEQ ID NO: 40872 - protein, 9 aa, Homo Sapiens
LTSKDFQQW

SEQ ID NO: 40873 - protein, 9 aa, Homo Sapiens
TGCFPIPMV

SEQ ID NO: 40874 - protein, 9 aa, Homo Sapiens
CPRPFESQM

SEQ ID NO: 40875 - protein, 9 aa, Homo Sapiens
NVLRNIIPP

SEQ ID NO: 40876 - protein, 9 aa, Homo Sapiens
SSTCSCQSY

SEQ ID NO: 40877 - protein, 9 aa, Homo Sapiens
RQPRVIKVT

SEQ ID NO: 40878 - protein, 9 aa, Homo Sapiens
YSQDITYLS

SEQ ID NO: 40879 - protein, 9 aa, Homo Sapiens
VDTTFVLRL

SEQ ID NO: 40880 - protein, 9 aa, Homo Sapiens
QLTRLWPSA

SEQ ID NO: 40881 - protein, 9 aa, Homo Sapiens
SSRGAEAVW

SEQ ID NO: 40882 - protein, 9 aa, Homo Sapiens
PRDTIYTID

SEQ ID NO: 40883 - protein, 9 aa, Homo Sapiens
RKPKIESPK

SEQ ID NO: 40884 - protein, 9 aa, Homo Sapiens
IRNTCVAVV

SEQ ID NO: 40885 - protein, 9 aa, Homo Sapiens
PCTAQECLS

SEQ ID NO: 40886 - protein, 9 aa, Homo Sapiens
VDIPFVNEE

SEQ ID NO: 40887 - protein, 9 aa, Homo Sapiens
YAMSMNTGF

SEQ ID NO: 40888 - protein, 9 aa, Homo Sapiens
RNSFEVCVC

SEQ ID NO: 40889 - protein, 9 aa, Homo Sapiens
WKRTGCFPI

SEQ ID NO: 40890 - protein, 9 aa, Homo Sapiens
VLASEVIHA

SEQ ID NO: 40891 - protein, 9 aa, Homo Sapiens
EDCNITDFL

SEQ ID NO: 40892 - protein, 9 aa, Homo Sapiens
QGINKNEER

SEQ ID NO: 40893 - protein, 9 aa, Homo Sapiens
GKSYGKPCG

SEQ ID NO: 40894 - protein, 9 aa, Homo Sapiens
RNTCVAVVL

SEQ ID NO: 40895 - protein, 9 aa, Homo Sapiens
DARHGGWTT

SEQ ID NO: 40896 - protein, 9 aa, Homo Sapiens
GEESSTSLK

SEQ ID NO: 40897 - protein, 9 aa, Homo Sapiens
PILSKLSQG

SEQ ID NO: 40898 - protein, 9 aa, Homo Sapiens
DFQQWKQMY

SEQ ID NO: 40899 - protein, 9 aa, Homo Sapiens
EPVVTQRKP

SEQ ID NO: 40900 - protein, 9 aa, Homo Sapiens
AHPVPRTLQ

SEQ ID NO: 40901 - protein, 9 aa, Homo Sapiens
PFESQMPHL

SEQ ID NO: 40902 - protein, 9 aa, Homo Sapiens
RLIRNTCVA

SEQ ID NO: 40903 - protein, 9 aa, Homo Sapiens
MKQMNDARH

SEQ ID NO: 40904 - protein, 9 aa, Homo Sapiens
ALNLSSALA

SEQ ID NO: 40905 - protein, 9 aa, Homo Sapiens
NKLDAMFVA

SEQ ID NO: 40906 - protein, 9 aa, Homo Sapiens
THTHTHTAI

SEQ ID NO: 40907 - protein, 9 aa, Homo Sapiens
AMSMNTGFE

SEQ ID NO: 40908 - protein, 9 aa, Homo Sapiens
YTSEVFFQC

SEQ ID NO: 40909 - protein, 9 aa, Homo Sapiens
LAISENKIV

SEQ ID NO: 40910 - protein, 9 aa, Homo Sapiens
IYCFPNVFI

SEQ ID NO: 40911 - protein, 9 aa, Homo Sapiens
FRFLGKIMA

SEQ ID NO: 40912 - protein, 9 aa, Homo Sapiens
NPDLTSKDF

SEQ ID NO: 40913 - protein, 9 aa, Homo Sapiens
PKEKGKLAA

SEQ ID NO: 40914 - protein, 9 aa, Homo Sapiens
KILEVMHTQ

SEQ ID NO: 40915 - protein, 9 aa, Homo Sapiens
LGKIMAKAI

SEQ ID NO: 40916 - protein, 9 aa, Homo Sapiens
VSLLVNGTL

SEQ ID NO: 40917 - protein, 9 aa, Homo Sapiens
ESRKDDFFT

SEQ ID NO: 40918 - protein, 9 aa, Homo Sapiens
SMVPPSAAM

SEQ ID NO: 40919 - protein, 9 aa, Homo Sapiens
IIIVIFHCF

SEQ ID NO: 40920 - protein, 9 aa, Homo Sapiens
WSAEGYHLW

SEQ ID NO: 40921 - protein, 9 aa, Homo Sapiens
RLFTIHQIN

SEQ ID NO: 40922 - protein, 9 aa, Homo Sapiens
LGRNSFEVC

SEQ ID NO: 40923 - protein, 9 aa, Homo Sapiens
QGKAHPVPR

SEQ ID NO: 40924 - protein, 9 aa, Homo Sapiens
TSEFDVPEY

SEQ ID NO: 40925 - protein, 9 aa, Homo Sapiens
STSTRESSK

SEQ ID NO: 40926 - protein, 9 aa, Homo Sapiens
ARHSLGLRL

SEQ ID NO: 40927 - protein, 9 aa, Homo Sapiens
DIPFVNEEA

SEQ ID NO: 40928 - protein, 9 aa, Homo Sapiens
FSGVNSSTQ

SEQ ID NO: 40929 - protein, 9 aa, Homo Sapiens
PMDLNSPVR

SEQ ID NO: 40930 - protein, 9 aa, Homo Sapiens
LDSFDLDNT

SEQ ID NO: 40931 - protein, 9 aa, Homo Sapiens
LSSFIGSKP

SEQ ID NO: 40932 - protein, 9 aa, Homo Sapiens
PSTHFLSII

SEQ ID NO: 40933 - protein, 9 aa, Homo Sapiens
EFDVPEYCN

SEQ ID NO: 40934 - protein, 9 aa, Homo Sapiens
IILSSTPTI

SEQ ID NO: 40935 - protein, 9 aa, Homo Sapiens
VAANFGAIG

SEQ ID NO: 40936 - protein, 9 aa, Homo Sapiens
ALSPQAPSS

SEQ ID NO: 40937 - protein, 9 aa, Homo Sapiens
QGMVEVVAQ

SEQ ID NO: 40938 - protein, 9 aa, Homo Sapiens
ELSSFIGSK

SEQ ID NO: 40939 - protein, 9 aa, Homo Sapiens
GKGVVTNGL

SEQ ID NO: 40940 - protein, 9 aa, Homo Sapiens
VMHTQKRLL

SEQ ID NO: 40941 - protein, 9 aa, Homo Sapiens
CSCQSYRTS

SEQ ID NO: 40942 - protein, 9 aa, Homo Sapiens
EVCVCACPG

SEQ ID NO: 40943 - protein, 9 aa, Homo Sapiens
IDAYVCIRT

SEQ ID NO: 40944 - protein, 9 aa, Homo Sapiens
EAKKRIMWL

SEQ ID NO: 40945 - protein, 9 aa, Homo Sapiens
SFDLDNTQL

SEQ ID NO: 40946 - protein, 9 aa, Homo Sapiens
PASTTPVVS

SEQ ID NO: 40947 - protein, 9 aa, Homo Sapiens
KLSQRHKRQ

SEQ ID NO: 40948 - protein, 9 aa, Homo Sapiens
VVGTLGAII

SEQ ID NO: 40949 - protein, 9 aa, Homo Sapiens
RDVLQARAP

SEQ ID NO: 40950 - protein, 9 aa, Homo Sapiens
DEVARRWDE

SEQ ID NO: 40951 - protein, 9 aa, Homo Sapiens
PVSMVPPSA

SEQ ID NO: 40952 - protein, 9 aa, Homo Sapiens
ASANVAANF

SEQ ID NO: 40953 - protein, 9 aa, Homo Sapiens
LQLQRNLQY

SEQ ID NO: 40954 - protein, 9 aa, Homo Sapiens
TTFVLRLPY

SEQ ID NO: 40955 - protein, 9 aa, Homo Sapiens
IISLLIQIG

SEQ ID NO: 40956 - protein, 9 aa, Homo Sapiens
AVKAIIYCF

SEQ ID NO: 40957 - protein, 9 aa, Homo Sapiens
SQMPHLRLV

SEQ ID NO: 40958 - protein, 9 aa, Homo Sapiens
GSKPNIPWL

SEQ ID NO: 40959 - protein, 9 aa, Homo Sapiens
HNLQILFFL

SEQ ID NO: 40960 - protein, 9 aa, Homo Sapiens
VARRWDERK

SEQ ID NO: 40961 - protein, 9 aa, Homo Sapiens
LTQGSPSLL

SEQ ID NO: 40962 - protein, 9 aa, Homo Sapiens
EGKGVVTNG

SEQ ID NO: 40963 - protein, 9 aa, Homo Sapiens
VFQLSKGHF

SEQ ID NO: 40964 - protein, 9 aa, Homo Sapiens
ITYLSLRHN

SEQ ID NO: 40965 - protein, 9 aa, Homo Sapiens
RYAMSMNTG

SEQ ID NO: 40966 - protein, 9 aa, Homo Sapiens
IIVIFHCFA

SEQ ID NO: 40967 - protein, 9 aa, Homo Sapiens
TFGVARTVI

SEQ ID NO: 40968 - protein, 9 aa, Homo Sapiens
LSSVLKPTN

SEQ ID NO: 40969 - protein, 9 aa, Homo Sapiens
KKNTKQLHQ

SEQ ID NO: 40970 - protein, 9 aa, Homo Sapiens
SFIGSKPNI

SEQ ID NO: 40971 - protein, 9 aa, Homo Sapiens
ASEVIHASR

SEQ ID NO: 40972 - protein, 9 aa, Homo Sapiens
ISARKAKYN

SEQ ID NO: 40973 - protein, 9 aa, Homo Sapiens
SQGINKNEE

SEQ ID NO: 40974 - protein, 9 aa, Homo Sapiens
WQSSTSTRE

SEQ ID NO: 40975 - protein, 9 aa, Homo Sapiens
ESEPSCEAT

SEQ ID NO: 40976 - protein, 9 aa, Homo Sapiens
FLSIIIVIF

SEQ ID NO: 40977 - protein, 9 aa, Homo Sapiens
TWCHHCFPC

SEQ ID NO: 40978 - protein, 9 aa, Homo Sapiens
KFTRKTVPG

SEQ ID NO: 40979 - protein, 9 aa, Homo Sapiens
LRGQPSCTN

SEQ ID NO: 40980 - protein, 9 aa, Homo Sapiens
KQMNDARHG

SEQ ID NO: 40981 - protein, 9 aa, Homo Sapiens
RVSLLVNGT

SEQ ID NO: 40982 - protein, 9 aa, Homo Sapiens
LLVNGTLTV

SEQ ID NO: 40983 - protein, 9 aa, Homo Sapiens
PDLTSKDFQ

SEQ ID NO: 40984 - protein, 9 aa, Homo Sapiens
QYLDQQMSE

SEQ ID NO: 40985 - protein, 9 aa, Homo Sapiens
LLGLTMRRC

SEQ ID NO: 40986 - protein, 9 aa, Homo Sapiens
PECQGKEAI

SEQ ID NO: 40987 - protein, 9 aa, Homo Sapiens
VVTQRKPKI

SEQ ID NO: 40988 - protein, 9 aa, Homo Sapiens
EAVKAIIYC

SEQ ID NO: 40989 - protein, 9 aa, Homo Sapiens
FTDLNNYDG

SEQ ID NO: 40990 - protein, 9 aa, Homo Sapiens
ARRWDERKS

SEQ ID NO: 40991 - protein, 9 aa, Homo Sapiens
GQATSLPVT

SEQ ID NO: 40992 - protein, 9 aa, Homo Sapiens
RRWDERKSK

SEQ ID NO: 40993 - protein, 9 aa, Homo Sapiens
QSYRTSSTS

SEQ ID NO: 40994 - protein, 9 aa, Homo Sapiens
SSCMSWGIQ

SEQ ID NO: 40995 - protein, 9 aa, Homo Sapiens
QINACTNNL

SEQ ID NO: 40996 - protein, 9 aa, Homo Sapiens
STGQATSLP

SEQ ID NO: 40997 - protein, 9 aa, Homo Sapiens
DYATAVPWL

SEQ ID NO: 40998 - protein, 9 aa, Homo Sapiens
GGTASANVA

SEQ ID NO: 40999 - protein, 9 aa, Homo Sapiens
VLRNIIPPS

SEQ ID NO: 41000 - protein, 9 aa, Homo Sapiens
VPPSAAMAA

SEQ ID NO: 41001 - protein, 9 aa, Homo Sapiens
SLKIRVIAP

SEQ ID NO: 41002 - protein, 9 aa, Homo Sapiens
LKIRVIAPP

SEQ ID NO: 41003 - protein, 9 aa, Homo Sapiens
SCMSWGIQQ

SEQ ID NO: 41004 - protein, 9 aa, Homo Sapiens
TCEPVVTQR

SEQ ID NO: 41005 - protein, 9 aa, Homo Sapiens
QMNDARHGG

SEQ ID NO: 41006 - protein, 9 aa, Homo Sapiens
TYSSCMSWG

SEQ ID NO: 41007 - protein, 9 aa, Homo Sapiens
RHEEHAANQ

SEQ ID NO: 41008 - protein, 9 aa, Homo Sapiens
IHQINACTN

SEQ ID NO: 41009 - protein, 9 aa, Homo Sapiens
QECLSSVLK

SEQ ID NO: 41010 - protein, 9 aa, Homo Sapiens
LDNKVADQL

SEQ ID NO: 41011 - protein, 9 aa, Homo Sapiens
NAYKKETNE

SEQ ID NO: 41012 - protein, 9 aa, Homo Sapiens
TGQSECRAN

SEQ ID NO: 41013 - protein, 9 aa, Homo Sapiens
KADIDVLGP

SEQ ID NO: 41014 - protein, 9 aa, Homo Sapiens
DLTSKDFQQ

SEQ ID NO: 41015 - protein, 9 aa, Homo Sapiens
HAIRNFAKS

SEQ ID NO: 41016 - protein, 9 aa, Homo Sapiens
CESDHEADE

SEQ ID NO: 41017 - protein, 9 aa, Homo Sapiens
FSLMLCDFC

SEQ ID NO: 41018 - protein, 9 aa, Homo Sapiens
YMVVGTLGA

SEQ ID NO: 41019 - protein, 9 aa, Homo Sapiens
PHPPPLAPR

SEQ ID NO: 41020 - protein, 9 aa, Homo Sapiens
FTLTENLEH

SEQ ID NO: 41021 - protein, 9 aa, Homo Sapiens
SSVLKPTNE

SEQ ID NO: 41022 - protein, 9 aa, Homo Sapiens
CVAVVLGTL

SEQ ID NO: 41023 - protein, 9 aa, Homo Sapiens
FSHLSQGLN

SEQ ID NO: 41024 - protein, 9 aa, Homo Sapiens
TMLQLSPKE

SEQ ID NO: 41025 - protein, 9 aa, Homo Sapiens
CTHTHTHTH

SEQ ID NO: 41026 - protein, 9 aa, Homo Sapiens
KQIYKKNTK

SEQ ID NO: 41027 - protein, 9 aa, Homo Sapiens
ELKEALIQL

SEQ ID NO: 41028 - protein, 9 aa, Homo Sapiens
GKSFTYTSE

SEQ ID NO: 41029 - protein, 9 aa, Homo Sapiens
SQRHKRQPR

SEQ ID NO: 41030 - protein, 9 aa, Homo Sapiens
EVMHTQKRL

SEQ ID NO: 41031 - protein, 9 aa, Homo Sapiens
TRTLHKATV

SEQ ID NO: 41032 - protein, 9 aa, Homo Sapiens
KTILISAHE

SEQ ID NO: 41033 - protein, 9 aa, Homo Sapiens
PRLSQAAGP

SEQ ID NO: 41034 - protein, 9 aa, Homo Sapiens
LTSFSTIIL

SEQ ID NO: 41035 - protein, 9 aa, Homo Sapiens
RESSKEAQK

SEQ ID NO: 41036 - protein, 9 aa, Homo Sapiens
STSLKIRVI

SEQ ID NO: 41037 - protein, 9 aa, Homo Sapiens
AQNYHNIWA

SEQ ID NO: 41038 - protein, 9 aa, Homo Sapiens
LESRKDDFF

SEQ ID NO: 41039 - protein, 9 aa, Homo Sapiens
TSKDFQQWK

SEQ ID NO: 41040 - protein, 9 aa, Homo Sapiens
RGQPSCTNA

SEQ ID NO: 41041 - protein, 9 aa, Homo Sapiens
YRHVLLSGC

SEQ ID NO: 41042 - protein, 9 aa, Homo Sapiens
AVHLRHEKE

SEQ ID NO: 41043 - protein, 9 aa, Homo Sapiens
EKYDLAIKE

SEQ ID NO: 41044 - protein, 9 aa, Homo Sapiens
SPQAPSSRG

SEQ ID NO: 41045 - protein, 9 aa, Homo Sapiens
ASLISARKA

SEQ ID NO: 41046 - protein, 9 aa, Homo Sapiens
EELAAAGGK

SEQ ID NO: 41047 - protein, 9 aa, Homo Sapiens
TCVAVVLGT

SEQ ID NO: 41048 - protein, 9 aa, Homo Sapiens
NLSAEHSLG

SEQ ID NO: 41049 - protein, 9 aa, Homo Sapiens
LCQEDCNIT

SEQ ID NO: 41050 - protein, 9 aa, Homo Sapiens
QLQRNLQYL

SEQ ID NO: 41051 - protein, 9 aa, Homo Sapiens
FHVQNDHDP

SEQ ID NO: 41052 - protein, 9 aa, Homo Sapiens
LQARAPREE

SEQ ID NO: 41053 - protein, 9 aa, Homo Sapiens
QNDHDPPNL

SEQ ID NO: 41054 - protein, 9 aa, Homo Sapiens
WLLHGLADG

SEQ ID NO: 41055 - protein, 9 aa, Homo Sapiens
SVVDTTFVL

SEQ ID NO: 41056 - protein, 9 aa, Homo Sapiens
RNSSKNKIT

SEQ ID NO: 41057 - protein, 9 aa, Homo Sapiens
GKTMSKRLK

SEQ ID NO: 41058 - protein, 9 aa, Homo Sapiens
SANVAANFG

SEQ ID NO: 41059 - protein, 9 aa, Homo Sapiens
YFEPVAPEC

SEQ ID NO: 41060 - protein, 9 aa, Homo Sapiens
NACTNNLPK

SEQ ID NO: 41061 - protein, 9 aa, Homo Sapiens
KELKEALIQ

SEQ ID NO: 41062 - protein, 9 aa, Homo Sapiens
VNESEPSCE

SEQ ID NO: 41063 - protein, 9 aa, Homo Sapiens
LKNCKEVGL

SEQ ID NO: 41064 - protein, 9 aa, Homo Sapiens
YVCIRTTKD

SEQ ID NO: 41065 - protein, 9 aa, Homo Sapiens
VGTLGAIIH

SEQ ID NO: 41066 - protein, 9 aa, Homo Sapiens
EDIISLLIQ

SEQ ID NO: 41067 - protein, 9 aa, Homo Sapiens
VEKLHLFTI

SEQ ID NO: 41068 - protein, 9 aa, Homo Sapiens
PVNYLESRK

SEQ ID NO: 41069 - protein, 9 aa, Homo Sapiens
EGMYECRVS

SEQ ID NO: 41070 - protein, 9 aa, Homo Sapiens
LSSALAPQG

SEQ ID NO: 41071 - protein, 9 aa, Homo Sapiens
RNIIPPSLN

SEQ ID NO: 41072 - protein, 9 aa, Homo Sapiens
HKRQPRVIK

SEQ ID NO: 41073 - protein, 9 aa, Homo Sapiens
ESQMPHLRL

SEQ ID NO: 41074 - protein, 9 aa, Homo Sapiens
AVRVSLSSP

SEQ ID NO: 41075 - protein, 9 aa, Homo Sapiens
PKSHIGERH

SEQ ID NO: 41076 - protein, 9 aa, Homo Sapiens
STIILSSTP

SEQ ID NO: 41077 - protein, 9 aa, Homo Sapiens
EYCRNSSKN

SEQ ID NO: 41078 - protein, 9 aa, Homo Sapiens
LYMVVGTLG

SEQ ID NO: 41079 - protein, 9 aa, Homo Sapiens
GSASELLKE

SEQ ID NO: 41080 - protein, 9 aa, Homo Sapiens
IQELTQGSP

SEQ ID NO: 41081 - protein, 9 aa, Homo Sapiens
EESSTSLKI

SEQ ID NO: 41082 - protein, 9 aa, Homo Sapiens
FSGDLLFLF

SEQ ID NO: 41083 - protein, 9 aa, Homo Sapiens
ISAHENSSR

SEQ ID NO: 41084 - protein, 9 aa, Homo Sapiens
KINSMSWSA

SEQ ID NO: 41085 - protein, 9 aa, Homo Sapiens
PSPLSESDK

SEQ ID NO: 41086 - protein, 9 aa, Homo Sapiens
NDHDPPNLS

SEQ ID NO: 41087 - protein, 9 aa, Homo Sapiens
NIEEYCRNS

SEQ ID NO: 41088 - protein, 9 aa, Homo Sapiens
PLYEDIISL

SEQ ID NO: 41089 - protein, 9 aa, Homo Sapiens
LISAHENSS

SEQ ID NO: 41090 - protein, 9 aa, Homo Sapiens
GKTSEFDVP

SEQ ID NO: 41091 - protein, 9 aa, Homo Sapiens
SLTYSSCMS

SEQ ID NO: 41092 - protein, 9 aa, Homo Sapiens
SQEDGPHRF

SEQ ID NO: 41093 - protein, 9 aa, Homo Sapiens
MGTWCHHCF

SEQ ID NO: 41094 - protein, 9 aa, Homo Sapiens
THFLSIIIV

SEQ ID NO: 41095 - protein, 9 aa, Homo Sapiens
DVLGPKVDI

SEQ ID NO: 41096 - protein, 9 aa, Homo Sapiens
HGPSCDATF

SEQ ID NO: 41097 - protein, 9 aa, Homo Sapiens
WDERKSKPN

SEQ ID NO: 41098 - protein, 9 aa, Homo Sapiens
RTGCFPIPM

SEQ ID NO: 41099 - protein, 9 aa, Homo Sapiens
AAQLTRLWP

SEQ ID NO: 41100 - protein, 9 aa, Homo Sapiens
GMYECRVSD

SEQ ID NO: 41101 - protein, 9 aa, Homo Sapiens
LITFFPMKN

SEQ ID NO: 41102 - protein, 9 aa, Homo Sapiens
VWKFTLTEN

SEQ ID NO: 41103 - protein, 9 aa, Homo Sapiens
TSMPASTTP

SEQ ID NO: 41104 - protein, 9 aa, Homo Sapiens
KYDLAIKEL

SEQ ID NO: 41105 - protein, 9 aa, Homo Sapiens
QSEFDCFLD

SEQ ID NO: 41106 - protein, 9 aa, Homo Sapiens
HTHTHTHTA

SEQ ID NO: 41107 - protein, 9 aa, Homo Sapiens
NIVGVDIPF

SEQ ID NO: 41108 - protein, 9 aa, Homo Sapiens
CNITDFLLL

SEQ ID NO: 41109 - protein, 9 aa, Homo Sapiens
HSQTGQSEC

SEQ ID NO: 41110 - protein, 9 aa, Homo Sapiens
RLSQAAGPS

SEQ ID NO: 41111 - protein, 9 aa, Homo Sapiens
TLGRVSLLV

SEQ ID NO: 41112 - protein, 9 aa, Homo Sapiens
LGTFGVART

SEQ ID NO: 41113 - protein, 9 aa, Homo Sapiens
CIRTTKDEK

SEQ ID NO: 41114 - protein, 9 aa, Homo Sapiens
PRPFESQMP

SEQ ID NO: 41115 - protein, 9 aa, Homo Sapiens
KIMAKAIMD

SEQ ID NO: 41116 - protein, 9 aa, Homo Sapiens
LTKLAISEN

SEQ ID NO: 41117 - protein, 9 aa, Homo Sapiens
LKQIYKKNT

SEQ ID NO: 41118 - protein, 9 aa, Homo Sapiens
GGKSYGKPC

SEQ ID NO: 41119 - protein, 9 aa, Homo Sapiens
TKLAISENK

SEQ ID NO: 41120 - protein, 9 aa, Homo Sapiens
WRAQRFCPD

SEQ ID NO: 41121 - protein, 9 aa, Homo Sapiens
REKLRYAMS

SEQ ID NO: 41122 - protein, 9 aa, Homo Sapiens
VSVVDTTFV

SEQ ID NO: 41123 - protein, 9 aa, Homo Sapiens
TGQATSLPV

SEQ ID NO: 41124 - protein, 9 aa, Homo Sapiens
DGPHRFSHL

SEQ ID NO: 41125 - protein, 9 aa, Homo Sapiens
LSAEHSLGS

SEQ ID NO: 41126 - protein, 9 aa, Homo Sapiens
LLCQEDCNI

SEQ ID NO: 41127 - protein, 9 aa, Homo Sapiens
YDLAIKELK

SEQ ID NO: 41128 - protein, 9 aa, Homo Sapiens
DKAIQELTQ

SEQ ID NO: 41129 - protein, 9 aa, Homo Sapiens
SELLKEWTV

SEQ ID NO: 41130 - protein, 9 aa, Homo Sapiens
KDFQQWKQM

SEQ ID NO: 41131 - protein, 9 aa, Homo Sapiens
KVADQLWVP

SEQ ID NO: 41132 - protein, 9 aa, Homo Sapiens
RNLQYLDQQ

SEQ ID NO: 41133 - protein, 9 aa, Homo Sapiens
ARHGGWTTK

SEQ ID NO: 41134 - protein, 9 aa, Homo Sapiens
HEADEWCKV

SEQ ID NO: 41135 - protein, 9 aa, Homo Sapiens
IPMVHSTFL

SEQ ID NO: 41136 - protein, 9 aa, Homo Sapiens
TSTRESSKE

SEQ ID NO: 41137 - protein, 9 aa, Homo Sapiens
HFLSIIIVI

SEQ ID NO: 41138 - protein, 9 aa, Homo Sapiens
QYLDQQVPP

SEQ ID NO: 41139 - protein, 9 aa, Homo Sapiens
DGRHEEHAA

SEQ ID NO: 41140 - protein, 9 aa, Homo Sapiens
CMSWGIQQA

SEQ ID NO: 41141 - protein, 9 aa, Homo Sapiens
DIWGVGVLT

SEQ ID NO: 41142 - protein, 9 aa, Homo Sapiens
SPKEKGKLA

SEQ ID NO: 41143 - protein, 9 aa, Homo Sapiens
SQAVRVSLS

SEQ ID NO: 41144 - protein, 9 aa, Homo Sapiens
DAMFVALVS

SEQ ID NO: 41145 - protein, 9 aa, Homo Sapiens
TFEMNKLDA

SEQ ID NO: 41146 - protein, 9 aa, Homo Sapiens
AYVCIRTTK

SEQ ID NO: 41147 - protein, 9 aa, Homo Sapiens
FACESDHEA

SEQ ID NO: 41148 - protein, 9 aa, Homo Sapiens
PKADIDVLG

SEQ ID NO: 41149 - protein, 9 aa, Homo Sapiens
MEGSASELL

SEQ ID NO: 41150 - protein, 9 aa, Homo Sapiens
LQDEGMYEC

SEQ ID NO: 41151 - protein, 9 aa, Homo Sapiens
TQKRLLGTF

SEQ ID NO: 41152 - protein, 9 aa, Homo Sapiens
DAYVCIRTT

SEQ ID NO: 41153 - protein, 9 aa, Homo Sapiens
QLSKGHFAD

SEQ ID NO: 41154 - protein, 9 aa, Homo Sapiens
CRNSSKNKI

SEQ ID NO: 41155 - protein, 9 aa, Homo Sapiens
ILLGLSKSH

SEQ ID NO: 41156 - protein, 9 aa, Homo Sapiens
RWDERKSKP

SEQ ID NO: 41157 - protein, 9 aa, Homo Sapiens
STTALNLSS

SEQ ID NO: 41158 - protein, 9 aa, Homo Sapiens
YLESRKDDF

SEQ ID NO: 41159 - protein, 9 aa, Homo Sapiens
LFLFGCGRT

SEQ ID NO: 41160 - protein, 9 aa, Homo Sapiens
IEAKKRIMW

SEQ ID NO: 41161 - protein, 9 aa, Homo Sapiens
CQSLTYSSC

SEQ ID NO: 41162 - protein, 9 aa, Homo Sapiens
THAIRNFAK

SEQ ID NO: 41163 - protein, 9 aa, Homo Sapiens
SQAAGPSPL

SEQ ID NO: 41164 - protein, 9 aa, Homo Sapiens
ECQGKEAIR

SEQ ID NO: 41165 - protein, 9 aa, Homo Sapiens
LCRGKTSEF

SEQ ID NO: 41166 - protein, 9 aa, Homo Sapiens
HKEELGAVH

SEQ ID NO: 41167 - protein, 9 aa, Homo Sapiens
EKLHLFTIN

SEQ ID NO: 41168 - protein, 9 aa, Homo Sapiens
LSKLSQGIN

SEQ ID NO: 41169 - protein, 9 aa, Homo Sapiens
KSHNLQILF

SEQ ID NO: 41170 - protein, 9 aa, Homo Sapiens
YQGLIYLLE

SEQ ID NO: 41171 - protein, 9 aa, Homo Sapiens
TLTENLEHR

SEQ ID NO: 41172 - protein, 9 aa, Homo Sapiens
INSMSWSAE

SEQ ID NO: 41173 - protein, 9 aa, Homo Sapiens
PPSAAMAAS

SEQ ID NO: 41174 - protein, 9 aa, Homo Sapiens
SKDFQQWKQ

SEQ ID NO: 41175 - protein, 9 aa, Homo Sapiens
RDYATAVPW

SEQ ID NO: 41176 - protein, 9 aa, Homo Sapiens
DSFDLDNTQ

SEQ ID NO: 41177 - protein, 9 aa, Homo Sapiens
NLQYLDQQV

SEQ ID NO: 41178 - protein, 9 aa, Homo Sapiens
HTQKRLLGT

SEQ ID NO: 41179 - protein, 9 aa, Homo Sapiens
MLCDFCGAG

SEQ ID NO: 41180 - protein, 9 aa, Homo Sapiens
DTIYTIDGE

SEQ ID NO: 41181 - protein, 9 aa, Homo Sapiens
SSFIGSKPN

SEQ ID NO: 41182 - protein, 9 aa, Homo Sapiens
NLQYLDQQM

SEQ ID NO: 41183 - protein, 9 aa, Homo Sapiens
SFTYTSEVF

SEQ ID NO: 41184 - protein, 9 aa, Homo Sapiens
HLRHEKEVL

SEQ ID NO: 41185 - protein, 9 aa, Homo Sapiens
TEELAAAGG

SEQ ID NO: 41186 - protein, 9 aa, Homo Sapiens
AQGKAHPVP

SEQ ID NO: 41187 - protein, 9 aa, Homo Sapiens
LTRLWPSAS

SEQ ID NO: 41188 - protein, 9 aa, Homo Sapiens
FEPVAPECQ

SEQ ID NO: 41189 - protein, 9 aa, Homo Sapiens
SVLASEVIH

SEQ ID NO: 41190 - protein, 9 aa, Homo Sapiens
LFGCGRTFE

SEQ ID NO: 41191 - protein, 9 aa, Homo Sapiens
KTLRSKMGT

SEQ ID NO: 41192 - protein, 9 aa, Homo Sapiens
EVARRWDER

SEQ ID NO: 41193 - protein, 9 aa, Homo Sapiens
DIDVLGPKV

SEQ ID NO: 41194 - protein, 9 aa, Homo Sapiens
FMEGSASEL

SEQ ID NO: 41195 - protein, 9 aa, Homo Sapiens
NPLDSFDLD

SEQ ID NO: 41196 - protein, 9 aa, Homo Sapiens
KNTKQLHQK

SEQ ID NO: 41197 - protein, 9 aa, Homo Sapiens
DLNSPVRKA

SEQ ID NO: 41198 - protein, 9 aa, Homo Sapiens
KTSEFDVPE

SEQ ID NO: 41199 - protein, 9 aa, Homo Sapiens
NLSSALAPQ

SEQ ID NO: 41200 - protein, 9 aa, Homo Sapiens
TTALNLSSA

SEQ ID NO: 41201 - protein, 9 aa, Homo Sapiens
TFVLRLPYR

SEQ ID NO: 41202 - protein, 9 aa, Homo Sapiens
SKARKCEEC

SEQ ID NO: 41203 - protein, 9 aa, Homo Sapiens
ELGAVHLRH

SEQ ID NO: 41204 - protein, 9 aa, Homo Sapiens
SSTSLKIRV

SEQ ID NO: 41205 - protein, 9 aa, Homo Sapiens
TKSSSPRDT

SEQ ID NO: 41206 - protein, 9 aa, Homo Sapiens
MNDARHGGW

SEQ ID NO: 41207 - protein, 9 aa, Homo Sapiens
AVRLQDEGM

SEQ ID NO: 41208 - protein, 9 aa, Homo Sapiens
KMGTWCHHC

SEQ ID NO: 41209 - protein, 9 aa, Homo Sapiens
LQRNLQYLD

SEQ ID NO: 41210 - protein, 9 aa, Homo Sapiens
SMSWSAEGY

SEQ ID NO: 41211 - protein, 9 aa, Homo Sapiens
DCFLDLGSA

SEQ ID NO: 41212 - protein, 9 aa, Homo Sapiens
RHVLLSGCR

SEQ ID NO: 41213 - protein, 9 aa, Homo Sapiens
VGVLTYIML

SEQ ID NO: 41214 - protein, 9 aa, Homo Sapiens
YRVPASSGP

SEQ ID NO: 41215 - protein, 9 aa, Homo Sapiens
IYKKNTKQL

SEQ ID NO: 41216 - protein, 9 aa, Homo Sapiens
LNSPVRKAL

SEQ ID NO: 41217 - protein, 9 aa, Homo Sapiens
SGREEGKGV

SEQ ID NO: 41218 - protein, 9 aa, Homo Sapiens
PAQGKAHPV

SEQ ID NO: 41219 - protein, 9 aa, Homo Sapiens
PSALTHAIR

SEQ ID NO: 41220 - protein, 9 aa, Homo Sapiens
FDLDNTQLD

SEQ ID NO: 41221 - protein, 9 aa, Homo Sapiens
RVPASSGPS

SEQ ID NO: 41222 - protein, 9 aa, Homo Sapiens
ASSGPSLPP

SEQ ID NO: 41223 - protein, 9 aa, Homo Sapiens
PQAPSSRGA

SEQ ID NO: 41224 - protein, 9 aa, Homo Sapiens
PTRFLKNCK

SEQ ID NO: 41225 - protein, 9 aa, Homo Sapiens
HTHTHTAIP

SEQ ID NO: 41226 - protein, 9 aa, Homo Sapiens
NELYFLANG

SEQ ID NO: 41227 - protein, 9 aa, Homo Sapiens
GKIMAKAIM

SEQ ID NO: 41228 - protein, 9 aa, Homo Sapiens
VVAQNYHNI

SEQ ID NO: 41229 - protein, 9 aa, Homo Sapiens
QLSPKEKGK

SEQ ID NO: 41230 - protein, 9 aa, Homo Sapiens
PSLTFSGVN

SEQ ID NO: 41231 - protein, 9 aa, Homo Sapiens
LTSMPASTT

SEQ ID NO: 41232 - protein, 9 aa, Homo Sapiens
CHSQTGQSE

SEQ ID NO: 41233 - protein, 9 aa, Homo Sapiens
DHEADEWCK

SEQ ID NO: 41234 - protein, 9 aa, Homo Sapiens
FMKQMNDAR

SEQ ID NO: 41235 - protein, 9 aa, Homo Sapiens
ADIDVLGPK

SEQ ID NO: 41236 - protein, 9 aa, Homo Sapiens
EKLRYAMSM

SEQ ID NO: 41237 - protein, 9 aa, Homo Sapiens
LNLTLDNKV

SEQ ID NO: 41238 - protein, 9 aa, Homo Sapiens
NYLESRKDD

SEQ ID NO: 41239 - protein, 9 aa, Homo Sapiens
IPVLLNVLR

SEQ ID NO: 41240 - protein, 9 aa, Homo Sapiens
VLGPKVDIE

SEQ ID NO: 41241 - protein, 9 aa, Homo Sapiens
QEDGPHRFS

SEQ ID NO: 41242 - protein, 9 aa, Homo Sapiens
GKAHPVPRT

SEQ ID NO: 41243 - protein, 9 aa, Homo Sapiens
AVENASLIS

SEQ ID NO: 41244 - protein, 9 aa, Homo Sapiens
PASSGPSLP

SEQ ID NO: 41245 - protein, 9 aa, Homo Sapiens
DPVNYLESR

SEQ ID NO: 41246 - protein, 9 aa, Homo Sapiens
NASLISARK

SEQ ID NO: 41247 - protein, 9 aa, Homo Sapiens
TFFPMKNQK

SEQ ID NO: 41248 - protein, 9 aa, Homo Sapiens
PPPRKAASN

SEQ ID NO: 41249 - protein, 9 aa, Homo Sapiens
HSLGLRLLG

SEQ ID NO: 41250 - protein, 9 aa, Homo Sapiens
LAAAGGKSY

SEQ ID NO: 41251 - protein, 9 aa, Homo Sapiens
LRLLGLTMR

SEQ ID NO: 41252 - protein, 9 aa, Homo Sapiens
VQNDHDPPN

SEQ ID NO: 41253 - protein, 9 aa, Homo Sapiens
IMAKAIMDF

SEQ ID NO: 41254 - protein, 9 aa, Homo Sapiens
FGCGRTFEG

SEQ ID NO: 41255 - protein, 9 aa, Homo Sapiens
IYLLENDVS

SEQ ID NO: 41256 - protein, 9 aa, Homo Sapiens
KNCKEVGLF

SEQ ID NO: 41257 - protein, 9 aa, Homo Sapiens
AQECLSSVL

SEQ ID NO: 41258 - protein, 9 aa, Homo Sapiens
DNPDLTSKD

SEQ ID NO: 41259 - protein, 9 aa, Homo Sapiens
LISARKAKY

SEQ ID NO: 41260 - protein, 9 aa, Homo Sapiens
CFPIPMVHS

SEQ ID NO: 41261 - protein, 9 aa, Homo Sapiens
LSGKSFTYT

SEQ ID NO: 41262 - protein, 9 aa, Homo Sapiens
ANVAANFGA

SEQ ID NO: 41263 - protein, 9 aa, Homo Sapiens
NGGTVWLEV

SEQ ID NO: 41264 - protein, 9 aa, Homo Sapiens
QWRAQRFCP

SEQ ID NO: 41265 - protein, 9 aa, Homo Sapiens
MVPPSAAMA

SEQ ID NO: 41266 - protein, 9 aa, Homo Sapiens
THTHTAIPL

SEQ ID NO: 41267 - protein, 9 aa, Homo Sapiens
RDAPPPRKA

SEQ ID NO: 41268 - protein, 9 aa, Homo Sapiens
YVVIGDGRH

SEQ ID NO: 41269 - protein, 9 aa, Homo Sapiens
SKLSQGINK

SEQ ID NO: 41270 - protein, 9 aa, Homo Sapiens
TSLKIRVIA

SEQ ID NO: 41271 - protein, 9 aa, Homo Sapiens
DEGMYECRV

SEQ ID NO: 41272 - protein, 9 aa, Homo Sapiens
KEKGKLAAV

SEQ ID NO: 41273 - protein, 9 aa, Homo Sapiens
INACTNNLP

SEQ ID NO: 41274 - protein, 9 aa, Homo Sapiens
RFLGKIMAK

SEQ ID NO: 41275 - protein, 9 aa, Homo Sapiens
SNLTKLAIS

SEQ ID NO: 41276 - protein, 9 aa, Homo Sapiens
SALTHAIRN

SEQ ID NO: 41277 - protein, 9 aa, Homo Sapiens
LWPSASRTR

SEQ ID NO: 41278 - protein, 9 aa, Homo Sapiens
PMKNQKIES

SEQ ID NO: 41279 - protein, 9 aa, Homo Sapiens
KLSQGINKN

SEQ ID NO: 41280 - protein, 9 aa, Homo Sapiens
KGHFADKEP

SEQ ID NO: 41281 - protein, 9 aa, Homo Sapiens
LGLSKSHNL

SEQ ID NO: 41282 - protein, 9 aa, Homo Sapiens
GVDIPFVNE

SEQ ID NO: 41283 - protein, 9 aa, Homo Sapiens
SYRTSSTSC

SEQ ID NO: 41284 - protein, 9 aa, Homo Sapiens
ITDFSSNLS

SEQ ID NO: 41285 - protein, 9 aa, Homo Sapiens
MSMNTGFEL

SEQ ID NO: 41286 - protein, 9 aa, Homo Sapiens
SSVLASEVI

SEQ ID NO: 41287 - protein, 9 aa, Homo Sapiens
LTHAIRNFA

SEQ ID NO: 41288 - protein, 9 aa, Homo Sapiens
GREEGKGVV

SEQ ID NO: 41289 - protein, 9 aa, Homo Sapiens
HVLLSGCRC

SEQ ID NO: 41290 - protein, 9 aa, Homo Sapiens
IGDGRHEEH

SEQ ID NO: 41291 - protein, 9 aa, Homo Sapiens
LSQAAGPSP

SEQ ID NO: 41292 - protein, 9 aa, Homo Sapiens
QAAGPSPLS

SEQ ID NO: 41293 - protein, 9 aa, Homo Sapiens
PAVIDAYVC

SEQ ID NO: 41294 - protein, 9 aa, Homo Sapiens
MLQLSPKEK

SEQ ID NO: 41295 - protein, 9 aa, Homo Sapiens
SNLSAEHSL

SEQ ID NO: 41296 - protein, 9 aa, Homo Sapiens
MYRHVLLSG

SEQ ID NO: 41297 - protein, 9 aa, Homo Sapiens
HTHTAIPLH

SEQ ID NO: 41298 - protein, 9 aa, Homo Sapiens
GLSNLTKLA

SEQ ID NO: 41299 - protein, 9 aa, Homo Sapiens
ARKCEECTW

SEQ ID NO: 41300 - protein, 9 aa, Homo Sapiens
LQYLDQQVP

SEQ ID NO: 41301 - protein, 9 aa, Homo Sapiens
TENLEHRSV

SEQ ID NO: 41302 - protein, 9 aa, Homo Sapiens
AGGKSYGKP

SEQ ID NO: 41303 - protein, 9 aa, Homo Sapiens
FSTIILSST

SEQ ID NO: 41304 - protein, 9 aa, Homo Sapiens
ENASLISAR

SEQ ID NO: 41305 - protein, 9 aa, Homo Sapiens
LEVMHTQKR

SEQ ID NO: 41306 - protein, 9 aa, Homo Sapiens
PIPSALTHA

SEQ ID NO: 41307 - protein, 9 aa, Homo Sapiens
QDEGMYECR

SEQ ID NO: 41308 - protein, 9 aa, Homo Sapiens
GSATDIWGV

SEQ ID NO: 41309 - protein, 9 aa, Homo Sapiens
NSMSWSAEG

SEQ ID NO: 41310 - protein, 9 aa, Homo Sapiens
HVQNDHDPP

SEQ ID NO: 41311 - protein, 9 aa, Homo Sapiens
EPVAPECQG

SEQ ID NO: 41312 - protein, 9 aa, Homo Sapiens
ERLIRNTCV

SEQ ID NO: 41313 - protein, 9 aa, Homo Sapiens
THTAIPLHL

SEQ ID NO: 41314 - protein, 9 aa, Homo Sapiens
KLDAMFVAL

SEQ ID NO: 41315 - protein, 9 aa, Homo Sapiens
LAPRDSTGG

SEQ ID NO: 41316 - protein, 9 aa, Homo Sapiens
DFSSNLSAE

SEQ ID NO: 41317 - protein, 9 aa, Homo Sapiens
LLNVLRNII

SEQ ID NO: 41318 - protein, 9 aa, Homo Sapiens
RPIPSALTH

SEQ ID NO: 41319 - protein, 9 aa, Homo Sapiens
GLIYLLEND

SEQ ID NO: 41320 - protein, 9 aa, Homo Sapiens
TLHKATVLG

SEQ ID NO: 41321 - protein, 9 aa, Homo Sapiens
YRTSSTSCS

SEQ ID NO: 41322 - protein, 9 aa, Homo Sapiens
GTLGAIIHG

SEQ ID NO: 41323 - protein, 9 aa, Homo Sapiens
PSCDATFSP

SEQ ID NO: 41324 - protein, 9 aa, Homo Sapiens
RVSLSSPLV

SEQ ID NO: 41325 - protein, 9 aa, Homo Sapiens
RKCEECTWN

SEQ ID NO: 41326 - protein, 9 aa, Homo Sapiens
SSGPSLPPM

SEQ ID NO: 41327 - protein, 9 aa, Homo Sapiens
RFSHLSQGL

SEQ ID NO: 41328 - protein, 9 aa, Homo Sapiens
MVEVVAQNY

SEQ ID NO: 41329 - protein, 9 aa, Homo Sapiens
SCTELKFTR

SEQ ID NO: 41330 - protein, 9 aa, Homo Sapiens
QDITYLSLR

SEQ ID NO: 41331 - protein, 9 aa, Homo Sapiens
PGTFSLMLC

SEQ ID NO: 41332 - protein, 9 aa, Homo Sapiens
GTASANVAA

SEQ ID NO: 41333 - protein, 9 aa, Homo Sapiens
ELAAAGGKS

SEQ ID NO: 41334 - protein, 9 aa, Homo Sapiens
FSSNLSAEH

SEQ ID NO: 41335 - protein, 9 aa, Homo Sapiens
RPAQGKAHP

SEQ ID NO: 41336 - protein, 9 aa, Homo Sapiens
HPKSHIGER

SEQ ID NO: 41337 - protein, 9 aa, Homo Sapiens
SARKAKYNV

SEQ ID NO: 41338 - protein, 9 aa, Homo Sapiens
WKFTLTENL

SEQ ID NO: 41339 - protein, 9 aa, Homo Sapiens
LKFTRKTVP

SEQ ID NO: 41340 - protein, 9 aa, Homo Sapiens
RGKTSEFDV

SEQ ID NO: 41341 - protein, 9 aa, Homo Sapiens
DPGTFSLML

SEQ ID NO: 41342 - protein, 9 aa, Homo Sapiens
IVGVDIPFV

SEQ ID NO: 41343 - protein, 9 aa, Homo Sapiens
PVLLNVLRN

SEQ ID NO: 41344 - protein, 9 aa, Homo Sapiens
AAMAASKAL

SEQ ID NO: 41345 - protein, 9 aa, Homo Sapiens
STCSCQSYR

SEQ ID NO: 41346 - protein, 9 aa, Homo Sapiens
RLWPSASRT

SEQ ID NO: 41347 - protein, 9 aa, Homo Sapiens
GQPSCTNAY

SEQ ID NO: 41348 - protein, 9 aa, Homo Sapiens
MSWSAEGYH

SEQ ID NO: 41349 - protein, 9 aa, Homo Sapiens
VQLAFHVQN

SEQ ID NO: 41350 - protein, 9 aa, Homo Sapiens
FESQMPHLR

SEQ ID NO: 41351 - protein, 9 aa, Homo Sapiens
TNAYKKETN

SEQ ID NO: 41352 - protein, 9 aa, Homo Sapiens
QEDCNITDF

SEQ ID NO: 41353 - protein, 9 aa, Homo Sapiens
TELKFTRKT

SEQ ID NO: 41354 - protein, 9 aa, Homo Sapiens
QASGCQWRA

SEQ ID NO: 41355 - protein, 9 aa, Homo Sapiens
ELYFLANGG

SEQ ID NO: 41356 - protein, 9 aa, Homo Sapiens
MKFRFLGKI

SEQ ID NO: 41357 - protein, 9 aa, Homo Sapiens
SCPRPFESQ

SEQ ID NO: 41358 - protein, 9 aa, Homo Sapiens
LSQRHKRQP

SEQ ID NO: 41359 - protein, 9 aa, Homo Sapiens
APPPRKAAS

SEQ ID NO: 41360 - protein, 9 aa, Homo Sapiens
VLQARAPRE

SEQ ID NO: 41361 - protein, 9 aa, Homo Sapiens
VAQNYHNIW

SEQ ID NO: 41362 - protein, 9 aa, Homo Sapiens
NTCVAVVLG

SEQ ID NO: 41363 - protein, 9 aa, Homo Sapiens
ATAVPWLLH

SEQ ID NO: 41364 - protein, 9 aa, Homo Sapiens
YDKAIQELT

SEQ ID NO: 41365 - protein, 9 aa, Homo Sapiens
SEVIHASRK

SEQ ID NO: 41366 - protein, 9 aa, Homo Sapiens
TRLWPSASR

SEQ ID NO: 41367 - protein, 9 aa, Homo Sapiens
IHPKSHIGE

SEQ ID NO: 41368 - protein, 9 aa, Homo Sapiens
DITYLSLRH

SEQ ID NO: 41369 - protein, 9 aa, Homo Sapiens
DTTFVLRLP

SEQ ID NO: 41370 - protein, 9 aa, Homo Sapiens
SKMGTWCHH

SEQ ID NO: 41371 - protein, 9 aa, Homo Sapiens
GPSPLSESD

SEQ ID NO: 41372 - protein, 9 aa, Homo Sapiens
HENSSRALL

SEQ ID NO: 41373 - protein, 9 aa, Homo Sapiens
FTIHQINAC

SEQ ID NO: 41374 - protein, 9 aa, Homo Sapiens
LANGGTVWL

SEQ ID NO: 41375 - protein, 9 aa, Homo Sapiens
LNVLRNIIP

SEQ ID NO: 41376 - protein, 9 aa, Homo Sapiens
GDLLFLFGC

SEQ ID NO: 41377 - protein, 9 aa, Homo Sapiens
CLSSVLKPT

SEQ ID NO: 41378 - protein, 9 aa, Homo Sapiens
MNKLDAMFV

SEQ ID NO: 41379 - protein, 9 aa, Homo Sapiens
NDARHGGWT

SEQ ID NO: 41380 - protein, 9 aa, Homo Sapiens
ARDVLQARA

SEQ ID NO: 41381 - protein, 9 aa, Homo Sapiens
PIPMVHSTF

SEQ ID NO: 41382 - protein, 9 aa, Homo Sapiens
GTFSLMLCD

SEQ ID NO: 41383 - protein, 9 aa, Homo Sapiens
FLDLGSAPP

SEQ ID NO: 41384 - protein, 9 aa, Homo Sapiens
SKGHFADKE

SEQ ID NO: 41385 - protein, 9 aa, Homo Sapiens
RKDDFFTSF

SEQ ID NO: 41386 - protein, 9 aa, Homo Sapiens
SCTNAYKKE

SEQ ID NO: 41387 - protein, 9 aa, Homo Sapiens
LCDFCGAGF

SEQ ID NO: 41388 - protein, 9 aa, Homo Sapiens
GVGVLTYIM

SEQ ID NO: 41389 - protein, 9 aa, Homo Sapiens
PLDSFDLDN

SEQ ID NO: 41390 - protein, 9 aa, Homo Sapiens
FYQGLIYLL

SEQ ID NO: 41391 - protein, 9 aa, Homo Sapiens
VSSVLASEV

SEQ ID NO: 41392 - protein, 9 aa, Homo Sapiens
EELGAVHLR

SEQ ID NO: 41393 - protein, 9 aa, Homo Sapiens
VAPECQGKE

SEQ ID NO: 41394 - protein, 9 aa, Homo Sapiens
TQGSPSLLK

SEQ ID NO: 41395 - protein, 9 aa, Homo Sapiens
PFVNEEAET

SEQ ID NO: 41396 - protein, 9 aa, Homo Sapiens
HPPPLAPRD

SEQ ID NO: 41397 - protein, 9 aa, Homo Sapiens
ENLEHRSVK

SEQ ID NO: 41398 - protein, 9 aa, Homo Sapiens
FLGKIMAKA

SEQ ID NO: 41399 - protein, 9 aa, Homo Sapiens
RSKMGTWCH

SEQ ID NO: 41400 - protein, 9 aa, Homo Sapiens
KTMSKRLKL

SEQ ID NO: 41401 - protein, 9 aa, Homo Sapiens
EMYRHVLLS

SEQ ID NO: 41402 - protein, 9 aa, Homo Sapiens
KRTGCFPIP

SEQ ID NO: 41403 - protein, 9 aa, Homo Sapiens
FPIPMVHST

SEQ ID NO: 41404 - protein, 9 aa, Homo Sapiens
KLRYAMSMN

SEQ ID NO: 41405 - protein, 9 aa, Homo Sapiens
DLAIKELKE

SEQ ID NO: 41406 - protein, 9 aa, Homo Sapiens
FLKNCKEVG

SEQ ID NO: 41407 - protein, 9 aa, Homo Sapiens
KEAVKAIIY

SEQ ID NO: 41408 - protein, 9 aa, Homo Sapiens
LSKSHNLQI

SEQ ID NO: 41409 - protein, 9 aa, Homo Sapiens
GLSKSHNLQ

SEQ ID NO: 41410 - protein, 9 aa, Homo Sapiens
VAVVLGTLH

SEQ ID NO: 41411 - protein, 9 aa, Homo Sapiens
AFHVQNDHD

SEQ ID NO: 41412 - protein, 9 aa, Homo Sapiens
LLFLFGCGR

SEQ ID NO: 41413 - protein, 9 aa, Homo Sapiens
SFEVCVCAC

SEQ ID NO: 41414 - protein, 9 aa, Homo Sapiens
LRNIIPPSL

SEQ ID NO: 41415 - protein, 9 aa, Homo Sapiens
CTELKFTRK

SEQ ID NO: 41416 - protein, 9 aa, Homo Sapiens
LLGTFGVAR

SEQ ID NO: 41417 - protein, 9 aa, Homo Sapiens
PPLAPRDST

SEQ ID NO: 41418 - protein, 9 aa, Homo Sapiens
EDGPHRFSH

SEQ ID NO: 41419 - protein, 9 aa, Homo Sapiens
SPRDTIYTI

SEQ ID NO: 41420 - protein, 9 aa, Homo Sapiens
KFTLTENLE

SEQ ID NO: 41421 - protein, 9 aa, Homo Sapiens
YLSLRHNFM

SEQ ID NO: 41422 - protein, 9 aa, Homo Sapiens
LGAIIHGAG

SEQ ID NO: 41423 - protein, 9 aa, Homo Sapiens
VRKALGSAC

SEQ ID NO: 41424 - protein, 9 aa, Homo Sapiens
IDVLGPKVD

SEQ ID NO: 41425 - protein, 9 aa, Homo Sapiens
RLQDEGMYE

SEQ ID NO: 41426 - protein, 9 aa, Homo Sapiens
VCVCACPGR

SEQ ID NO: 41427 - protein, 9 aa, Homo Sapiens
RKALGSACI

SEQ ID NO: 41428 - protein, 9 aa, Homo Sapiens
MYECRVSDY

SEQ ID NO: 41429 - protein, 9 aa, Homo Sapiens
FPMKNQKIE

SEQ ID NO: 41430 - protein, 9 aa, Homo Sapiens
GLRLLGLTM

SEQ ID NO: 41431 - protein, 9 aa, Homo Sapiens
DYHFYQGLI

SEQ ID NO: 41432 - protein, 9 aa, Homo Sapiens
FEMNKLDAM

SEQ ID NO: 41433 - protein, 9 aa, Homo Sapiens
SLLLCQEDC

SEQ ID NO: 41434 - protein, 9 aa, Homo Sapiens
TIYTIDGEK

SEQ ID NO: 41435 - protein, 9 aa, Homo Sapiens
TDLNNYDGY

SEQ ID NO: 41436 - protein, 9 aa, Homo Sapiens
GRNSFEVCV

SEQ ID NO: 41437 - protein, 9 aa, Homo Sapiens
PGGTASANV

SEQ ID NO: 41438 - protein, 9 aa, Homo Sapiens
GQSECRANV

SEQ ID NO: 41439 - protein, 9 aa, Homo Sapiens
AIQELTQGS

SEQ ID NO: 41440 - protein, 9 aa, Homo Sapiens
TFSGVNSST

SEQ ID NO: 41441 - protein, 9 aa, Homo Sapiens
SQDITYLSL

SEQ ID NO: 41442 - protein, 9 aa, Homo Sapiens
AVPWLLHGL

SEQ ID NO: 41443 - protein, 9 aa, Homo Sapiens
ASTTPVVSS

SEQ ID NO: 41444 - protein, 9 aa, Homo Sapiens
SSVEMYRHV

SEQ ID NO: 41445 - protein, 9 aa, Homo Sapiens
KLAISENKI

SEQ ID NO: 41446 - protein, 9 aa, Homo Sapiens
LVFQLSKGH

SEQ ID NO: 41447 - protein, 9 aa, Homo Sapiens
GINKNEERR

SEQ ID NO: 41448 - protein, 9 aa, Homo Sapiens
QNYHNIWAK

SEQ ID NO: 41449 - protein, 9 aa, Homo Sapiens
HEEHAANQH

SEQ ID NO: 41450 - protein, 9 aa, Homo Sapiens
RFLKNCKEV

SEQ ID NO: 41451 - protein, 9 aa, Homo Sapiens
ILEVMHTQK

SEQ ID NO: 41452 - protein, 9 aa, Homo Sapiens
SQTGQSECR

SEQ ID NO: 41453 - protein, 9 aa, Homo Sapiens
TAQECLSSV

SEQ ID NO: 41454 - protein, 9 aa, Homo Sapiens
KIRVIAPPG

SEQ ID NO: 41455 - protein, 9 aa, Homo Sapiens
SARDVLQAR

SEQ ID NO: 41456 - protein, 9 aa, Homo Sapiens
VENASLISA

SEQ ID NO: 41457 - protein, 9 aa, Homo Sapiens
AHENSSRAL

SEQ ID NO: 41458 - protein, 9 aa, Homo Sapiens
TALNLSSAL

SEQ ID NO: 41459 - protein, 9 aa, Homo Sapiens
QIYKKNTKQ

SEQ ID NO: 41460 - protein, 9 aa, Homo Sapiens
NLTLDNKVA

SEQ ID NO: 41461 - protein, 9 aa, Homo Sapiens
AVIDAYVCI

SEQ ID NO: 41462 - protein, 9 aa, Homo Sapiens
ECLSSVLKP

SEQ ID NO: 41463 - protein, 9 aa, Homo Sapiens
VNGTLTVRE

SEQ ID NO: 41464 - protein, 9 aa, Homo Sapiens
KIHPKSHIG

SEQ ID NO: 41465 - protein, 9 aa, Homo Sapiens
IWGVGVLTY

SEQ ID NO: 41466 - protein, 9 aa, Homo Sapiens
VVDTTFVLR

SEQ ID NO: 41467 - protein, 9 aa, Homo Sapiens
ENSSRALLK

SEQ ID NO: 41468 - protein, 9 aa, Homo Sapiens
SLLVNGTLT

SEQ ID NO: 41469 - protein, 9 aa, Homo Sapiens
LLKEWTVTG

SEQ ID NO: 41470 - protein, 9 aa, Homo Sapiens
LVNGTLTVR

SEQ ID NO: 41471 - protein, 9 aa, Homo Sapiens
KARKCEECT

SEQ ID NO: 41472 - protein, 9 aa, Homo Sapiens
RPFESQMPH

SEQ ID NO: 41473 - protein, 9 aa, Homo Sapiens
NLTKLAISE

SEQ ID NO: 41474 - protein, 9 aa, Homo Sapiens
LYFLANGGT

SEQ ID NO: 41475 - protein, 9 aa, Homo Sapiens
RHKRQPRVI

SEQ ID NO: 41476 - protein, 9 aa, Homo Sapiens
QGLIYLLEN

SEQ ID NO: 41477 - protein, 9 aa, Homo Sapiens
NCKEVGLFN

SEQ ID NO: 41478 - protein, 9 aa, Homo Sapiens
PPPLAPRDS

SEQ ID NO: 41479 - protein, 9 aa, Homo Sapiens
DELSSFIGS

SEQ ID NO: 41480 - protein, 9 aa, Homo Sapiens
VRVSLSSPL

SEQ ID NO: 41481 - protein, 9 aa, Homo Sapiens
PHRFSHLSQ

SEQ ID NO: 41482 - protein, 9 aa, Homo Sapiens
SSALAPQGL

SEQ ID NO: 41483 - protein, 9 aa, Homo Sapiens
FFPMKNQKI

SEQ ID NO: 41484 - protein, 9 aa, Homo Sapiens
LSLRHNFMQ

SEQ ID NO: 41485 - protein, 9 aa, Homo Sapiens
STHFLSIII

SEQ ID NO: 41486 - protein, 9 aa, Homo Sapiens
ITFFPMKNQ

SEQ ID NO: 41487 - protein, 9 aa, Homo Sapiens
TDIWGVGVL

SEQ ID NO: 41488 - protein, 9 aa, Homo Sapiens
SIIIVIFHC

SEQ ID NO: 41489 - protein, 9 aa, Homo Sapiens
PSSRGAEAV

SEQ ID NO: 41490 - protein, 9 aa, Homo Sapiens
LSKGHFADK

SEQ ID NO: 41491 - protein, 9 aa, Homo Sapiens
QRKPKIESP

SEQ ID NO: 41492 - protein, 9 aa, Homo Sapiens
RVEKLHLFT

SEQ ID NO: 41493 - protein, 9 aa, Homo Sapiens
SSSPRDTIY

SEQ ID NO: 41494 - protein, 9 aa, Homo Sapiens
VAVIEAKKR

SEQ ID NO: 41495 - protein, 9 aa, Homo Sapiens
LASEVIHAS

SEQ ID NO: 41496 - protein, 9 aa, Homo Sapiens
SEFDVPEYC

SEQ ID NO: 41497 - protein, 9 aa, Homo Sapiens
WKSRLKIHP

SEQ ID NO: 41498 - protein, 9 aa, Homo Sapiens
VPASSGPSL

SEQ ID NO: 41499 - protein, 9 aa, Homo Sapiens
PSCEATRSR

SEQ ID NO: 41500 - protein, 9 aa, Homo Sapiens
LGAVHLRHE

SEQ ID NO: 41501 - protein, 9 aa, Homo Sapiens
LSSPLVAIS

SEQ ID NO: 41502 - protein, 9 aa, Homo Sapiens
HTAIPLHLH

SEQ ID NO: 41503 - protein, 9 aa, Homo Sapiens
SAHENSSRA

SEQ ID NO: 41504 - protein, 9 aa, Homo Sapiens
LSNLTKLAI

SEQ ID NO: 41505 - protein, 9 aa, Homo Sapiens
GAIIHGAGL

SEQ ID NO: 41506 - protein, 9 aa, Homo Sapiens
VEVVAQNYH

SEQ ID NO: 41507 - protein, 9 aa, Homo Sapiens
FEVCVCACP

SEQ ID NO: 41508 - protein, 9 aa, Homo Sapiens
DVLQARAPR

SEQ ID NO: 41509 - protein, 9 aa, Homo Sapiens
DNKVADQLW

SEQ ID NO: 41510 - protein, 9 aa, Homo Sapiens
HSQAVRVSL

SEQ ID NO: 41511 - protein, 9 aa, Homo Sapiens
AKKRIMWLL

SEQ ID NO: 41512 - protein, 9 aa, Homo Sapiens
IGSKPNIPW

SEQ ID NO: 41513 - protein, 9 aa, Homo Sapiens
PSCTNAYKK

SEQ ID NO: 41514 - protein, 9 aa, Homo Sapiens
SGKSFTYTS

SEQ ID NO: 41515 - protein, 9 aa, Homo Sapiens
LKIHPKSHI

SEQ ID NO: 41516 - protein, 9 aa, Homo Sapiens
TIILSSTPT

SEQ ID NO: 41517 - protein, 9 aa, Homo Sapiens
HQINACTNN

SEQ ID NO: 41518 - protein, 9 aa, Homo Sapiens
GCQWRAQRF

SEQ ID NO: 41519 - protein, 9 aa, Homo Sapiens
GDGRHEEHA

SEQ ID NO: 41520 - protein, 9 aa, Homo Sapiens
ISLLIQIGQ

SEQ ID NO: 41521 - protein, 9 aa, Homo Sapiens
HFYQGLIYL

SEQ ID NO: 41522 - protein, 9 aa, Homo Sapiens
PVRKALGSA

SEQ ID NO: 41523 - protein, 9 aa, Homo Sapiens
VPWLLHGLA

SEQ ID NO: 41524 - protein, 9 aa, Homo Sapiens
TASANVAAN

SEQ ID NO: 41525 - protein, 9 aa, Homo Sapiens
YCFPNVFIA

SEQ ID NO: 41526 - protein, 9 aa, Homo Sapiens
PRPAQGKAH

SEQ ID NO: 41527 - protein, 9 aa, Homo Sapiens
FQLSKGHFA

SEQ ID NO: 41528 - protein, 9 aa, Homo Sapiens
TSFSTIILS

SEQ ID NO: 41529 - protein, 9 aa, Homo Sapiens
SLISARKAK

SEQ ID NO: 41530 - protein, 9 aa, Homo Sapiens
GRHEEHAAN

SEQ ID NO: 41531 - protein, 9 aa, Homo Sapiens
QSSTSTRES

SEQ ID NO: 41532 - protein, 9 aa, Homo Sapiens
YATAVPWLL

SEQ ID NO: 41533 - protein, 9 aa, Homo Sapiens
SHNLQILFF

SEQ ID NO: 41534 - protein, 9 aa, Homo Sapiens
TRFLKNCKE

SEQ ID NO: 41535 - protein, 9 aa, Homo Sapiens
QTGQSECRA

SEQ ID NO: 41536 - protein, 9 aa, Homo Sapiens
FVLRLPYRG

SEQ ID NO: 41537 - protein, 9 aa, Homo Sapiens
LREKLRYAM

SEQ ID NO: 41538 - protein, 9 aa, Homo Sapiens
QMPHLRLVL

SEQ ID NO: 41539 - protein, 9 aa, Homo Sapiens
GAVHLRHEK

SEQ ID NO: 41540 - protein, 9 aa, Homo Sapiens
EGSASELLK

SEQ ID NO: 41541 - protein, 9 aa, Homo Sapiens
LGPKVDIEG

SEQ ID NO: 41542 - protein, 9 aa, Homo Sapiens
REEGKGVVT

SEQ ID NO: 41543 - protein, 9 aa, Homo Sapiens
IPSALTHAI

SEQ ID NO: 41544 - protein, 9 aa, Homo Sapiens
MHTQKRLLG

SEQ ID NO: 41545 - protein, 9 aa, Homo Sapiens
SFSTIILSS

SEQ ID NO: 41546 - protein, 9 aa, Homo Sapiens
LFTIHQINA

SEQ ID NO: 41547 - protein, 9 aa, Homo Sapiens
LAIKELKEA

SEQ ID NO: 41548 - protein, 9 aa, Homo Sapiens
AAGPSPLSE

SEQ ID NO: 41549 - protein, 9 aa, Homo Sapiens
TCSCQSYRT

SEQ ID NO: 41550 - protein, 9 aa, Homo Sapiens
AVIEAKKRI

SEQ ID NO: 41551 - protein, 9 aa, Homo Sapiens
QAPSSRGAE

SEQ ID NO: 41552 - protein, 9 aa, Homo Sapiens
QLAFHVQND

SEQ ID NO: 41553 - protein, 9 aa, Homo Sapiens
LKINSMSWS

SEQ ID NO: 41554 - protein, 9 aa, Homo Sapiens
VIDAYVCIR

SEQ ID NO: 41555 - protein, 9 aa, Homo Sapiens
EVVAQNYHN

SEQ ID NO: 41556 - protein, 9 aa, Homo Sapiens
SEFDCFLDL

SEQ ID NO: 41557 - protein, 9 aa, Homo Sapiens
NSPVRKALG

SEQ ID NO: 41558 - protein, 9 aa, Homo Sapiens
SMPASTTPV

SEQ ID NO: 41559 - protein, 9 aa, Homo Sapiens
YSSCMSWGI

SEQ ID NO: 41560 - protein, 9 aa, Homo Sapiens
GNSARDVLQ

SEQ ID NO: 41561 - protein, 9 aa, Homo Sapiens
KTFACESDH

SEQ ID NO: 41562 - protein, 9 aa, Homo Sapiens
FNELYFLAN

SEQ ID NO: 41563 - protein, 9 aa, Homo Sapiens
IEEYCRNSS

SEQ ID NO: 41564 - protein, 9 aa, Homo Sapiens
KRQPRVIKV

SEQ ID NO: 41565 - protein, 9 aa, Homo Sapiens
HRFSHLSQG

SEQ ID NO: 41566 - protein, 9 aa, Homo Sapiens
WGVGVLTYI

SEQ ID NO: 41567 - protein, 9 aa, Homo Sapiens
FGVARTVIC

SEQ ID NO: 41568 - protein, 9 aa, Homo Sapiens
VCHSQTGQS

SEQ ID NO: 41569 - protein, 9 aa, Homo Sapiens
IPKLLGTFG

SEQ ID NO: 41570 - protein, 9 aa, Homo Sapiens
AIKELKEAL

SEQ ID NO: 41571 - protein, 9 aa, Homo Sapiens
SKPNIPWLF

SEQ ID NO: 41572 - protein, 9 aa, Homo Sapiens
NVNESEPSC

SEQ ID NO: 41573 - protein, 9 aa, Homo Sapiens
TLGAIIHGA

SEQ ID NO: 41574 - protein, 9 aa, Homo Sapiens
KAASNLVGV

SEQ ID NO: 41575 - protein, 9 aa, Homo Sapiens
SAAMAASKA

SEQ ID NO: 41576 - protein, 9 aa, Homo Sapiens
SAEGYHLWV

SEQ ID NO: 41577 - protein, 9 aa, Homo Sapiens
ETFEMNKLD

SEQ ID NO: 41578 - protein, 9 aa, Homo Sapiens
QVCNPLDSF

SEQ ID NO: 41579 - protein, 9 aa, Homo Sapiens
TLDNKVADQ

SEQ ID NO: 41580 - protein, 9 aa, Homo Sapiens
AAGGKSYGK

SEQ ID NO: 41581 - protein, 9 aa, Homo Sapiens
CEPVVTQRK

SEQ ID NO: 41582 - protein, 9 aa, Homo Sapiens
VCNPLDSFD

SEQ ID NO: 41583 - protein, 9 aa, Homo Sapiens
LTENLEHRS

SEQ ID NO: 41584 - protein, 9 aa, Homo Sapiens
RHGGWTTKM

SEQ ID NO: 41585 - protein, 9 aa, Homo Sapiens
QPSCTNAYK

SEQ ID NO: 41586 - protein, 9 aa, Homo Sapiens
SSTSTRESS

SEQ ID NO: 41587 - protein, 9 aa, Homo Sapiens
NTKQLHQKV

SEQ ID NO: 41588 - protein, 9 aa, Homo Sapiens
ILSKLSQGI

SEQ ID NO: 41589 - protein, 9 aa, Homo Sapiens
SEPSCEATR

SEQ ID NO: 41590 - protein, 9 aa, Homo Sapiens
DAPPPRKAA

SEQ ID NO: 41591 - protein, 9 aa, Homo Sapiens
VRLQDEGMY

SEQ ID NO: 41592 - protein, 9 aa, Homo Sapiens
LAFHVQNDH

SEQ ID NO: 41593 - protein, 9 aa, Homo Sapiens
TQRKPKIES

SEQ ID NO: 41594 - protein, 9 aa, Homo Sapiens
SLGLRLLGL

SEQ ID NO: 41595 - protein, 9 aa, Homo Sapiens
VSMVPPSAA

SEQ ID NO: 41596 - protein, 9 aa, Homo Sapiens
KAHPVPRTL

SEQ ID NO: 41597 - protein, 9 aa, Homo Sapiens
LGLRLLGLT

SEQ ID NO: 41598 - protein, 9 aa, Homo Sapiens
KLLGTFGVA

SEQ ID NO: 41599 - protein, 9 aa, Homo Sapiens
SDHEADEWC

SEQ ID NO: 41600 - protein, 9 aa, Homo Sapiens
SECRANVQG

SEQ ID NO: 41601 - protein, 9 aa, Homo Sapiens
SVEMYRHVL

SEQ ID NO: 41602 - protein, 9 aa, Homo Sapiens
AIIYCFPNV

SEQ ID NO: 41603 - protein, 9 aa, Homo Sapiens
QSECRANVQ

SEQ ID NO: 41604 - protein, 9 aa, Homo Sapiens
GTFGVARTV

SEQ ID NO: 41605 - protein, 9 aa, Homo Sapiens
HKATVLGEY

SEQ ID NO: 41606 - protein, 9 aa, Homo Sapiens
GHFADKEPT

SEQ ID NO: 41607 - protein, 9 aa, Homo Sapiens
VLLNVLRNI

SEQ ID NO: 41608 - protein, 9 aa, Homo Sapiens
PRDSTGGSH

SEQ ID NO: 41609 - protein, 9 aa, Homo Sapiens
SRKDDFFTS

SEQ ID NO: 41610 - protein, 9 aa, Homo Sapiens
LHKATVLGE

SEQ ID NO: 41611 - protein, 9 aa, Homo Sapiens
GTWCHHCFP

SEQ ID NO: 41612 - protein, 9 aa, Homo Sapiens
LIRNTCVAV

SEQ ID NO: 41613 - protein, 9 aa, Homo Sapiens
RTLHKATVL

SEQ ID NO: 41614 - protein, 9 aa, Homo Sapiens
TYTSEVFFQ

SEQ ID NO: 41615 - protein, 9 aa, Homo Sapiens
GITDFSSNL

SEQ ID NO: 41616 - protein, 9 aa, Homo Sapiens
VLRLPYRGS

SEQ ID NO: 41617 - protein, 9 aa, Homo Sapiens
HPVPRTLQE

SEQ ID NO: 41618 - protein, 9 aa, Homo Sapiens
DCNITDFLL

SEQ ID NO: 41619 - protein, 9 aa, Homo Sapiens
GVARTVICM

SEQ ID NO: 41620 - protein, 9 aa, Homo Sapiens
TFACESDHE

SEQ ID NO: 41621 - protein, 9 aa, Homo Sapiens
YKKNTKQLH

SEQ ID NO: 41622 - protein, 9 aa, Homo Sapiens
QKRLLGTFF

SEQ ID NO: 41623 - protein, 9 aa, Homo Sapiens
LSPKEKGKL

SEQ ID NO: 41624 - protein, 9 aa, Homo Sapiens
DERKSKPNM

SEQ ID NO: 41625 - protein, 9 aa, Homo Sapiens
KSRLKIHPK

SEQ ID NO: 41626 - protein, 9 aa, Homo Sapiens
IPFVNEEAE

SEQ ID NO: 41627 - protein, 9 aa, Homo Sapiens
KEVGLFNEL

SEQ ID NO: 41628 - protein, 9 aa, Homo Sapiens
KGSGREEGK

SEQ ID NO: 41629 - protein, 9 aa, Homo Sapiens
TAVPWLLHG

SEQ ID NO: 41630 - protein, 9 aa, Homo Sapiens
GQSEFDCFL

SEQ ID NO: 41631 - protein, 9 aa, Homo Sapiens
TYLSLRHNF

SEQ ID NO: 41632 - protein, 9 aa, Homo Sapiens
STRESSKEA

SEQ ID NO: 41633 - protein, 9 aa, Homo Sapiens
ATDIWGVGV

SEQ ID NO: 41634 - protein, 9 aa, Homo Sapiens
TIHQINACT

SEQ ID NO: 41635 - protein, 9 aa, Homo Sapiens
PDEVARRWD

SEQ ID NO: 41636 - protein, 9 aa, Homo Sapiens
PPRKAASNL

SEQ ID NO: 41637 - protein, 9 aa, Homo Sapiens
QRHKRQPRV

SEQ ID NO: 41638 - protein, 9 aa, Homo Sapiens
YFLANGGTV

SEQ ID NO: 41639 - protein, 9 aa, Homo Sapiens
QKLSQRHKR

SEQ ID NO: 41640 - protein, 9 aa, Homo Sapiens
SLTFSGVNS

SEQ ID NO: 41641 - protein, 9 aa, Homo Sapiens
KSSSPRDTI

SEQ ID NO: 41642 - protein, 9 aa, Homo Sapiens
VPFTTRTLH

SEQ ID NO: 41643 - protein, 9 aa, Homo Sapiens
PWLLHGLAD

SEQ ID NO: 41644 - protein, 9 aa, Homo Sapiens
VTQRKPKIE

SEQ ID NO: 41645 - protein, 9 aa, Homo Sapiens
GLITFFPMK

SEQ ID NO: 41646 - protein, 9 aa, Homo Sapiens
SASELLKEW

SEQ ID NO: 41647 - protein, 9 aa, Homo Sapiens
SGDLLFLFG

SEQ ID NO: 41648 - protein, 9 aa, Homo Sapiens
GYRVPASSG

SEQ ID NO: 41649 - protein, 9 aa, Homo Sapiens
LDLGSAPPA

SEQ ID NO: 41650 - protein, 9 aa, Homo Sapiens
FDVPEYCNG

SEQ ID NO: 41651 - protein, 9 aa, Homo Sapiens
TFSLMLCDF

SEQ ID NO: 41652 - protein, 9 aa, Homo Sapiens
RLKIHPKSH

SEQ ID NO: 41653 - protein, 9 aa, Homo Sapiens
NSFEVCVCA

SEQ ID NO: 41654 - protein, 9 aa, Homo Sapiens
KFRFLGKIM

SEQ ID NO: 41655 - protein, 9 aa, Homo Sapiens
LQLSPKEKG

SEQ ID NO: 41656 - protein, 9 aa, Homo Sapiens
VSLSSPLVA

SEQ ID NO: 41657 - protein, 9 aa, Homo Sapiens
GPHRFSHLS

SEQ ID NO: 41658 - protein, 9 aa, Homo Sapiens
EMNKLDAMF

SEQ ID NO: 41659 - protein, 9 aa, Homo Sapiens
LRSKMGTWC

SEQ ID NO: 41660 - protein, 9 aa, Homo Sapiens
SGCQWRAQR

SEQ ID NO: 41661 - protein, 9 aa, Homo Sapiens
TILISAHEN

SEQ ID NO: 41662 - protein, 9 aa, Homo Sapiens
LMLCDFCGA

SEQ ID NO: 41663 - protein, 9 aa, Homo Sapiens
LGRVSLLVN

SEQ ID NO: 41664 - protein, 9 aa, Homo Sapiens
ELKQIYKKN

SEQ ID NO: 41665 - protein, 9 aa, Homo Sapiens
MGKTMSKRL

SEQ ID NO: 41666 - protein, 9 aa, Homo Sapiens
VHLRHEKEV

SEQ ID NO: 41667 - protein, 9 aa, Homo Sapiens
YCRNSSKNK

SEQ ID NO: 41668 - protein, 9 aa, Homo Sapiens
KSFTYTSEV

SEQ ID NO: 41669 - protein, 9 aa, Homo Sapiens
LNLSSALAP

SEQ ID NO: 41670 - protein, 9 aa, Homo Sapiens
FIGSKPNIP

SEQ ID NO: 41671 - protein, 9 aa, Homo Sapiens
VVIGDGRHE

SEQ ID NO: 41672 - protein, 9 aa, Homo Sapiens
APRDSTGGS

SEQ ID NO: 41673 - protein, 9 aa, Homo Sapiens
LSSTPTIIM

SEQ ID NO: 41674 - protein, 9 aa, Homo Sapiens
PLNLTLDNK

SEQ ID NO: 41675 - protein, 9 aa, Homo Sapiens
CEATRSRNR

SEQ ID NO: 41676 - protein, 9 aa, Homo Sapiens
PVVTQRKPK

SEQ ID NO: 41677 - protein, 9 aa, Homo Sapiens
RKAASNLVG

SEQ ID NO: 41678 - protein, 9 aa, Homo Sapiens
EEYCRNSSK

SEQ ID NO: 41679 - protein, 9 aa, Homo Sapiens
CTNAYKKET

SEQ ID NO: 41680 - protein, 9 aa, Homo Sapiens
HEAQLSDKI

SEQ ID NO: 41681 - protein, 9 aa, Homo Sapiens
WNLNPVFGG

SEQ ID NO: 41682 - protein, 9 aa, Homo Sapiens
RHMCSMKKT

SEQ ID NO: 41683 - protein, 9 aa, Homo Sapiens
QSLICFHVR

SEQ ID NO: 41684 - protein, 9 aa, Homo Sapiens
LPDASEYAA

SEQ ID NO: 41685 - protein, 9 aa, Homo Sapiens
HGVYMWPDG

SEQ ID NO: 41686 - protein, 9 aa, Homo Sapiens
VPMNHGVYM

SEQ ID NO: 41687 - protein, 9 aa, Homo Sapiens
SQDFSTFAV

SEQ ID NO: 41688 - protein, 9 aa, Homo Sapiens
FSTFAVEIQ

SEQ ID NO: 41689 - protein, 9 aa, Homo Sapiens
SWSLSYYFV

SEQ ID NO: 41690 - protein, 9 aa, Homo Sapiens
VCSWSLSYY

SEQ ID NO: 41691 - protein, 9 aa, Homo Sapiens
QIWNLNPVF

SEQ ID NO: 41692 - protein, 9 aa, Homo Sapiens
LLPDASEYA

SEQ ID NO: 41693 - protein, 9 aa, Homo Sapiens
TKQEKDFLW

SEQ ID NO: 41694 - protein, 9 aa, Homo Sapiens
RLSASQIWN

SEQ ID NO: 41695 - protein, 9 aa, Homo Sapiens
MNHGVYMWP

SEQ ID NO: 41696 - protein, 9 aa, Homo Sapiens
LSVSNLVPD

SEQ ID NO: 41697 - protein, 9 aa, Homo Sapiens
ICFHVRFDL

SEQ ID NO: 41698 - protein, 9 aa, Homo Sapiens
SEYAAAAGG

SEQ ID NO: 41699 - protein, 9 aa, Homo Sapiens
VEIQETITA

SEQ ID NO: 41700 - protein, 9 aa, Homo Sapiens
ASQIWNLNP

SEQ ID NO: 41701 - protein, 9 aa, Homo Sapiens
ASGPGRWPR

SEQ ID NO: 41702 - protein, 9 aa, Homo Sapiens
SHSYDLSSA

SEQ ID NO: 41703 - protein, 9 aa, Homo Sapiens
YSHSYDLSS

SEQ ID NO: 41704 - protein, 9 aa, Homo Sapiens
SRLSASQIW

SEQ ID NO: 41705 - protein, 9 aa, Homo Sapiens
FHAMDTLYS

SEQ ID NO: 41706 - protein, 9 aa, Homo Sapiens
VEEESEEFR

SEQ ID NO: 41707 - protein, 9 aa, Homo Sapiens
ALDQEEHLS

SEQ ID NO: 41708 - protein, 9 aa, Homo Sapiens
SNLVPDSYF

SEQ ID NO: 41709 - protein, 9 aa, Homo Sapiens
DASEYAAAA

SEQ ID NO: 41710 - protein, 9 aa, Homo Sapiens
WASGPGRWP

SEQ ID NO: 41711 - protein, 9 aa, Homo Sapiens
LKTIQQRNL

SEQ ID NO: 41712 - protein, 9 aa, Homo Sapiens
YAAAAGGQH

SEQ ID NO: 41713 - protein, 9 aa, Homo Sapiens
DTLYSHSYD

SEQ ID NO: 41714 - protein, 9 aa, Homo Sapiens
IWNLNPVFG

SEQ ID NO: 41715 - protein, 9 aa, Homo Sapiens
HAMDTLYSH

SEQ ID NO: 41716 - protein, 9 aa, Homo Sapiens
PEALDQEEH

SEQ ID NO: 41717 - protein, 9 aa, Homo Sapiens
PAPPPLPGD

SEQ ID NO: 41718 - protein, 9 aa, Homo Sapiens
NHGVYMWPD

SEQ ID NO: 41719 - protein, 9 aa, Homo Sapiens
LICFHVRFD

SEQ ID NO: 41720 - protein, 9 aa, Homo Sapiens
EAQLSDKIS

SEQ ID NO: 41721 - protein, 9 aa, Homo Sapiens
FVTSGIKDK

SEQ ID NO: 41722 - protein, 9 aa, Homo Sapiens
GPGRWPRRE

SEQ ID NO: 41723 - protein, 9 aa, Homo Sapiens
HVRFDLLGQ

SEQ ID NO: 41724 - protein, 9 aa, Homo Sapiens
CSWSLSYYF

SEQ ID NO: 41725 - protein, 9 aa, Homo Sapiens
SDKISLQAI

SEQ ID NO: 41726 - protein, 9 aa, Homo Sapiens
FECLKTIQQ

SEQ ID NO: 41727 - protein, 9 aa, Homo Sapiens
LCGRHMCSM

SEQ ID NO: 41728 - protein, 9 aa, Homo Sapiens
SGIKDKKPD

SEQ ID NO: 41729 - protein, 9 aa, Homo Sapiens
SQSLICFHV

SEQ ID NO: 41730 - protein, 9 aa, Homo Sapiens
RSMPEALDQ

SEQ ID NO: 41731 - protein, 9 aa, Homo Sapiens
TSGIKDKKP

SEQ ID NO: 41732 - protein, 9 aa, Homo Sapiens
KPDLDTALG

SEQ ID NO: 41733 - protein, 9 aa, Homo Sapiens
ECLKTIQQR

SEQ ID NO: 41734 - protein, 9 aa, Homo Sapiens
SMFFSQSLI

SEQ ID NO: 41735 - protein, 9 aa, Homo Sapiens
PPLPGDASF

SEQ ID NO: 41736 - protein, 9 aa, Homo Sapiens
FENPDFQVE

SEQ ID NO: 41737 - protein, 9 aa, Homo Sapiens
PGRWPRREH

SEQ ID NO: 41738 - protein, 9 aa, Homo Sapiens
CSMKKTIGC

SEQ ID NO: 41739 - protein, 9 aa, Homo Sapiens
SLICFHVRF

SEQ ID NO: 41740 - protein, 9 aa, Homo Sapiens
SYYFVTSGI

SEQ ID NO: 41741 - protein, 9 aa, Homo Sapiens
PDFQVEEES

SEQ ID NO: 41742 - protein, 9 aa, Homo Sapiens
VLSVSNLVP

SEQ ID NO: 41743 - protein, 9 aa, Homo Sapiens
QCFECLKTI

SEQ ID NO: 41744 - protein, 9 aa, Homo Sapiens
DPLSEITKQ

SEQ ID NO: 41745 - protein, 9 aa, Homo Sapiens
SLSYYFVTS

SEQ ID NO: 41746 - protein, 9 aa, Homo Sapiens
GVYMWPDGS

SEQ ID NO: 41747 - protein, 9 aa, Homo Sapiens
PDASEYAAA

SEQ ID NO: 41748 - protein, 9 aa, Homo Sapiens
ALLISVTVV

SEQ ID NO: 41749 - protein, 9 aa, Homo Sapiens
DKISLQAIQ

SEQ ID NO: 41750 - protein, 9 aa, Homo Sapiens
QDFSTFAVE

SEQ ID NO: 41751 - protein, 9 aa, Homo Sapiens
EYAAAAGGQ

SEQ ID NO: 41752 - protein, 9 aa, Homo Sapiens
NPDFQVEEE

SEQ ID NO: 41753 - protein, 9 aa, Homo Sapiens
DELDKDYST

SEQ ID NO: 41754 - protein, 9 aa, Homo Sapiens
VYMWPDGSM

SEQ ID NO: 41755 - protein, 9 aa, Homo Sapiens
KKTIGCWEK

SEQ ID NO: 41756 - protein, 9 aa, Homo Sapiens
LYSHSYDLS

SEQ ID NO: 41757 - protein, 9 aa, Homo Sapiens
FHEAQLSDK

SEQ ID NO: 41758 - protein, 9 aa, Homo Sapiens
DFSTFAVEI

SEQ ID NO: 41759 - protein, 9 aa, Homo Sapiens
GSGGSSGSS

SEQ ID NO: 41760 - protein, 9 aa, Homo Sapiens
YYFVTSGIK

SEQ ID NO: 41761 - protein, 9 aa, Homo Sapiens
AGRSMPEAL

SEQ ID NO: 41762 - protein, 9 aa, Homo Sapiens
FLCGRHMCS

SEQ ID NO: 41763 - protein, 9 aa, Homo Sapiens
PVNFLCGRH

SEQ ID NO: 41764 - protein, 9 aa, Homo Sapiens
WSLSYYFVT

SEQ ID NO: 41765 - protein, 9 aa, Homo Sapiens
IKDKKPDLD

SEQ ID NO: 41766 - protein, 9 aa, Homo Sapiens
KLFSMFFSQ

SEQ ID NO: 41767 - protein, 9 aa, Homo Sapiens
LDQEEHLSP

SEQ ID NO: 41768 - protein, 9 aa, Homo Sapiens
CFECLKTIQ

SEQ ID NO: 41769 - protein, 9 aa, Homo Sapiens
GRSMPEALD

SEQ ID NO: 41770 - protein, 9 aa, Homo Sapiens
LSEITKQEK

SEQ ID NO: 41771 - protein, 9 aa, Homo Sapiens
MKKTIGCWE

SEQ ID NO: 41772 - protein, 9 aa, Homo Sapiens
LDELDKDYS

SEQ ID NO: 41773 - protein, 9 aa, Homo Sapiens
ILDELDKDY

SEQ ID NO: 41774 - protein, 9 aa, Homo Sapiens
MFFSQSLIC

SEQ ID NO: 41775 - protein, 9 aa, Homo Sapiens
KFHEAQLSD

SEQ ID NO: 41776 - protein, 9 aa, Homo Sapiens
RDPLSEITK

SEQ ID NO: 41777 - protein, 9 aa, Homo Sapiens
GGSSGSSSS

SEQ ID NO: 41778 - protein, 9 aa, Homo Sapiens
CQNTVLSVS

SEQ ID NO: 41779 - protein, 9 aa, Homo Sapiens
FSQSLICFH

SEQ ID NO: 41780 - protein, 9 aa, Homo Sapiens
FHVRFDLLG

SEQ ID NO: 41781 - protein, 9 aa, Homo Sapiens
PPPLPGDAS

SEQ ID NO: 41782 - protein, 9 aa, Homo Sapiens
GPPPAPPPL

SEQ ID NO: 41783 - protein, 9 aa, Homo Sapiens
ELDKDYSTH

SEQ ID NO: 41784 - protein, 9 aa, Homo Sapiens
SVSNLVPDS

SEQ ID NO: 41785 - protein, 8 aa, Homo Sapiens
PRVVPDQR

SEQ ID NO: 41786 - protein, 9 aa, Homo Sapiens
SGPGRWPRR

SEQ ID NO: 41787 - protein, 9 aa, Homo Sapiens
VTVVCSWSL

SEQ ID NO: 41788 - protein, 9 aa, Homo Sapiens
VSNLVPDSY

SEQ ID NO: 41789 - protein, 9 aa, Homo Sapiens
VVCSWSLSY

SEQ ID NO: 41790 - protein, 9 aa, Homo Sapiens
KKPDLDTAL

SEQ ID NO: 41791 - protein, 9 aa, Homo Sapiens
APPPLPGDA

SEQ ID NO: 41792 - protein, 9 aa, Homo Sapiens
SASQIWNLN

SEQ ID NO: 41793 - protein, 9 aa, Homo Sapiens
CGRHMCSMK

SEQ ID NO: 41794 - protein, 9 aa, Homo Sapiens
ASEYAAAAG

SEQ ID NO: 41795 - protein, 9 aa, Homo Sapiens
LLISVTVVC

SEQ ID NO: 41796 - protein, 9 aa, Homo Sapiens
GSSSSSSKK

SEQ ID NO: 41797 - protein, 9 aa, Homo Sapiens
DLLGQPMIL

SEQ ID NO: 41798 - protein, 9 aa, Homo Sapiens
TLYSHSYDL

SEQ ID NO: 41799 - protein, 9 aa, Homo Sapiens
TSSWASGPG

SEQ ID NO: 41800 - protein, 9 aa, Homo Sapiens
LFSMFFSQS

SEQ ID NO: 41801 - protein, 9 aa, Homo Sapiens
DKKPDLDTA

SEQ ID NO: 41802 - protein, 9 aa, Homo Sapiens
FFSQSLICF

SEQ ID NO: 41803 - protein, 9 aa, Homo Sapiens
FQVEEESEE

SEQ ID NO: 41804 - protein, 9 aa, Homo Sapiens
KDKKPDLDT

SEQ ID NO: 41805 - protein, 9 aa, Homo Sapiens
FAVEIQETI

SEQ ID NO: 41806 - protein, 9 aa, Homo Sapiens
SEITKQEKD

SEQ ID NO: 41807 - protein, 9 aa, Homo Sapiens
FSMFFSQSL

SEQ ID NO: 41808 - protein, 9 aa, Homo Sapiens
AVEIQETIT

SEQ ID NO: 41809 - protein, 9 aa, Homo Sapiens
MWPDGSMYE

SEQ ID NO: 41810 - protein, 9 aa, Homo Sapiens
HMCSMKKTI

SEQ ID NO: 41811 - protein, 9 aa, Homo Sapiens
QLSDKISLQ

SEQ ID NO: 41812 - protein, 9 aa, Homo Sapiens
MCSMKKTIG

SEQ ID NO: 41813 - protein, 9 aa, Homo Sapiens
EKLFSMFFS

SEQ ID NO: 41814 - protein, 9 aa, Homo Sapiens
VRFDLLGQP

SEQ ID NO: 41815 - protein, 9 aa, Homo Sapiens
YLLPDASEY

SEQ ID NO: 41816 - protein, 9 aa, Homo Sapiens
MAGPPPAPP

SEQ ID NO: 41817 - protein, 9 aa, Homo Sapiens
SMPEALDQE

SEQ ID NO: 41818 - protein, 9 aa, Homo Sapiens
EALDQEEHL

SEQ ID NO: 41819 - protein, 9 aa, Homo Sapiens
PLSEITKQE

SEQ ID NO: 41820 - protein, 9 aa, Homo Sapiens
YFVTSGIKD

SEQ ID NO: 41821 - protein, 9 aa, Homo Sapiens
STFAVEIQE

SEQ ID NO: 41822 - protein, 9 aa, Homo Sapiens
ISVTVVCSW

SEQ ID NO: 41823 - protein, 9 aa, Homo Sapiens
RFDLLGQPM

SEQ ID NO: 41824 - protein, 9 aa, Homo Sapiens
LISVTVVCS

SEQ ID NO: 41825 - protein, 9 aa, Homo Sapiens
CFHVRFDLL

SEQ ID NO: 41826 - protein, 9 aa, Homo Sapiens
PPAPPPLPG

SEQ ID NO: 41827 - protein, 9 aa, Homo Sapiens
TFAVEIQET

SEQ ID NO: 41828 - protein, 9 aa, Homo Sapiens
DKDYSTHES

SEQ ID NO: 41829 - protein, 9 aa, Homo Sapiens
SMKKTIGCW

SEQ ID NO: 41830 - protein, 9 aa, Homo Sapiens
CWEKLFSMF

SEQ ID NO: 41831 - protein, 9 aa, Homo Sapiens
EEESEEFRL

SEQ ID NO: 41832 - protein, 9 aa, Homo Sapiens
WEKLFSMFF

SEQ ID NO: 41833 - protein, 9 aa, Homo Sapiens
MPEALDQEE

SEQ ID NO: 41834 - protein, 9 aa, Homo Sapiens
GCWEKLFSM

SEQ ID NO: 41835 - protein, 9 aa, Homo Sapiens
TVLSVSNLV

SEQ ID NO: 41836 - protein, 9 aa, Homo Sapiens
PMNHGVYMW

SEQ ID NO: 41837 - protein, 9 aa, Homo Sapiens
DFQVEEESE

SEQ ID NO: 41838 - protein, 9 aa, Homo Sapiens
YMWPDGSMY

SEQ ID NO: 41839 - protein, 9 aa, Homo Sapiens
FDLLGQPMI

SEQ ID NO: 41840 - protein, 9 aa, Homo Sapiens
GRHMCSMKK

SEQ ID NO: 41841 - protein, 9 aa, Homo Sapiens
TIGCWEKLF

SEQ ID NO: 41842 - protein, 9 aa, Homo Sapiens
PPPAPPPLP

SEQ ID NO: 41843 - protein, 9 aa, Homo Sapiens
YSTHESLSQ

SEQ ID NO: 41844 - protein, 9 aa, Homo Sapiens
AMDTLYSHS

SEQ ID NO: 41845 - protein, 9 aa, Homo Sapiens
ITKQEKDFL

SEQ ID NO: 41846 - protein, 9 aa, Homo Sapiens
SGSSSSSSK

SEQ ID NO: 41847 - protein, 9 aa, Homo Sapiens
LSYYFVTSG

SEQ ID NO: 41848 - protein, 9 aa, Homo Sapiens
LSSVSTGHT

SEQ ID NO: 41849 - protein, 9 aa, Homo Sapiens
LSASQIWNL

SEQ ID NO: 41850 - protein, 9 aa, Homo Sapiens
TVVCSWSLS

SEQ ID NO: 41851 - protein, 9 aa, Homo Sapiens
GIKDKKPDL

SEQ ID NO: 41852 - protein, 9 aa, Homo Sapiens
NTVLSVSNL

SEQ ID NO: 41853 - protein, 9 aa, Homo Sapiens
VTSGIKDKK

SEQ ID NO: 41854 - protein, 9 aa, Homo Sapiens
MDTLYSHSY

SEQ ID NO: 41855 - protein, 9 aa, Homo Sapiens
DYSTHESLS

SEQ ID NO: 41856 - protein, 9 aa, Homo Sapiens
SSWASGPGR

SEQ ID NO: 41857 - protein, 9 aa, Homo Sapiens
SVTVVCSWS

SEQ ID NO: 41858 - protein, 9 aa, Homo Sapiens
ENPDFQVEE

SEQ ID NO: 41859 - protein, 9 aa, Homo Sapiens
LLGQPMILA

SEQ ID NO: 41860 - protein, 9 aa, Homo Sapiens
SWASGPGRW

SEQ ID NO: 41861 - protein, 9 aa, Homo Sapiens
LSDKISLQA

SEQ ID NO: 41862 - protein, 9 aa, Homo Sapiens
KTIGCWEKL

SEQ ID NO: 41863 - protein, 9 aa, Homo Sapiens
AQLSDKISL

SEQ ID NO: 41864 - protein, 9 aa, Homo Sapiens
NFLCGRHMC

SEQ ID NO: 41865 - protein, 9 aa, Homo Sapiens
EITKQEKDF

SEQ ID NO: 41866 - protein, 9 aa, Homo Sapiens
IGCWEKLFS

SEQ ID NO: 41867 - protein, 9 aa, Homo Sapiens
VNFLCGRHM

SEQ ID NO: 41868 - protein, 9 aa, Homo Sapiens
CLKTIQQRN

SEQ ID NO: 41869 - protein, 9 aa, Homo Sapiens
QNTVLSVSN

SEQ ID NO: 41870 - protein, 9 aa, Homo Sapiens
KQEKDFLWS

SEQ ID NO: 41871 - protein, 9 aa, Homo Sapiens
QVEEESEEF

SEQ ID NO: 41872 - protein, 9 aa, Homo Sapiens
SGSGGSSGS

SEQ ID NO: 41873 - protein, 9 aa, Homo Sapiens
LDKDYSTHE

SEQ ID NO: 41874 - protein, 9 aa, Homo Sapiens
GRWPRREHV

SEQ ID NO: 41875 - protein, 9 aa, Homo Sapiens
KDYSTHESL

SEQ ID NO: 41876 - protein, 9 aa, Homo Sapiens
SQIWNLNPV

SEQ ID NO: 41877 - protein, 9 aa, Homo Sapiens
QKSLWLEGD

SEQ ID NO: 41878 - protein, 9 aa, Homo Sapiens
FPCSSNKTE

SEQ ID NO: 41879 - protein, 9 aa, Homo Sapiens
FDVLAELRH

SEQ ID NO: 41880 - protein, 9 aa, Homo Sapiens
AKVPPTFQN

SEQ ID NO: 41881 - protein, 9 aa, Homo Sapiens
TASALAPGP

SEQ ID NO: 41882 - protein, 9 aa, Homo Sapiens
KKTNDLRYI

SEQ ID NO: 41883 - protein, 9 aa, Homo Sapiens
IVGELKKPR

SEQ ID NO: 41884 - protein, 9 aa, Homo Sapiens
AISTAKAEA

SEQ ID NO: 41885 - protein, 9 aa, Homo Sapiens
KVPPTFQNN

SEQ ID NO: 41886 - protein, 9 aa, Homo Sapiens
VDNCCRFYN

SEQ ID NO: 41887 - protein, 9 aa, Homo Sapiens
NSAYRQKKT

SEQ ID NO: 41888 - protein, 9 aa, Homo Sapiens
PMFTKHTPC

SEQ ID NO: 41889 - protein, 9 aa, Homo Sapiens
TLAVNPEDP

SEQ ID NO: 41890 - protein, 9 aa, Homo Sapiens
NQCAKWKRQ

SEQ ID NO: 41891 - protein, 9 aa, Homo Sapiens
KYEGVVYSV

SEQ ID NO: 41892 - protein, 9 aa, Homo Sapiens
SAAKHIVSP

SEQ ID NO: 41893 - protein, 9 aa, Homo Sapiens
LLATGGPLW

SEQ ID NO: 41894 - protein, 9 aa, Homo Sapiens
LSRTIPPHK

SEQ ID NO: 41895 - protein, 9 aa, Homo Sapiens
APPAGTMAH

SEQ ID NO: 41896 - protein, 9 aa, Homo Sapiens
KTFKNKQTL

SEQ ID NO: 41897 - protein, 9 aa, Homo Sapiens
MKSTEEETA

SEQ ID NO: 41898 - protein, 9 aa, Homo Sapiens
FVRIFHEVM

SEQ ID NO: 41899 - protein, 9 aa, Homo Sapiens
EAVDNCCRF

SEQ ID NO: 41900 - protein, 9 aa, Homo Sapiens
TMAHSRVLL

SEQ ID NO: 41901 - protein, 9 aa, Homo Sapiens
LLEISTMER

SEQ ID NO: 41902 - protein, 9 aa, Homo Sapiens
GDPAIRFPN

SEQ ID NO: 41903 - protein, 9 aa, Homo Sapiens
QCAKWKRQQ

SEQ ID NO: 41904 - protein, 9 aa, Homo Sapiens
RNFCSDSCV

SEQ ID NO: 41905 - protein, 9 aa, Homo Sapiens
RLNDIYTKT

SEQ ID NO: 41906 - protein, 9 aa, Homo Sapiens
IFPMKNATV

SEQ ID NO: 41907 - protein, 9 aa, Homo Sapiens
AMDDFLLAY

SEQ ID NO: 41908 - protein, 9 aa, Homo Sapiens
FAKAFISNA

SEQ ID NO: 41909 - protein, 9 aa, Homo Sapiens
EEAGEEPTT

SEQ ID NO: 41910 - protein, 9 aa, Homo Sapiens
SGGPCCCHA

SEQ ID NO: 41911 - protein, 9 aa, Homo Sapiens
KHIVSPSAP

SEQ ID NO: 41912 - protein, 9 aa, Homo Sapiens
CSDSCVVAF

SEQ ID NO: 41913 - protein, 9 aa, Homo Sapiens
LQNGMKMTN

SEQ ID NO: 41914 - protein, 9 aa, Homo Sapiens
PPSAAKHIV

SEQ ID NO: 41915 - protein, 9 aa, Homo Sapiens
RRLDPFTIY

SEQ ID NO: 41916 - protein, 9 aa, Homo Sapiens
NNQVNGTRA

SEQ ID NO: 41917 - protein, 9 aa, Homo Sapiens
LDKDELIHT

SEQ ID NO: 41918 - protein, 9 aa, Homo Sapiens
DPFTIYTLT

SEQ ID NO: 41919 - protein, 9 aa, Homo Sapiens
CPMFTKHTP

SEQ ID NO: 41920 - protein, 9 aa, Homo Sapiens
SISFQVQKI

SEQ ID NO: 41921 - protein, 9 aa, Homo Sapiens
KALEILEEV

SEQ ID NO: 41922 - protein, 9 aa, Homo Sapiens
GPCCCHARI

SEQ ID NO: 41923 - protein, 9 aa, Homo Sapiens
AAKHIVSPS

SEQ ID NO: 41924 - protein, 9 aa, Homo Sapiens
LRKAITCPK

SEQ ID NO: 41925 - protein, 9 aa, Homo Sapiens
KYSKVPSAL

SEQ ID NO: 41926 - protein, 9 aa, Homo Sapiens
AVDNCCRFY

SEQ ID NO: 41927 - protein, 9 aa, Homo Sapiens
MEWMPVGTK

SEQ ID NO: 41928 - protein, 9 aa, Homo Sapiens
NSSPSPCLW

SEQ ID NO: 41929 - protein, 9 aa, Homo Sapiens
PLWLQVWDQ

SEQ ID NO: 41930 - protein, 9 aa, Homo Sapiens
FTSQSSRAL

SEQ ID NO: 41931 - protein, 9 aa, Homo Sapiens
CSSNKTEFK

SEQ ID NO: 41932 - protein, 9 aa, Homo Sapiens
HSTALGERL

SEQ ID NO: 41933 - protein, 9 aa, Homo Sapiens
KQLRRFSMA

SEQ ID NO: 41934 - protein, 9 aa, Homo Sapiens
MITVDGLKL

SEQ ID NO: 41935 - protein, 9 aa, Homo Sapiens
VATGDPAIR

SEQ ID NO: 41936 - protein, 9 aa, Homo Sapiens
LIVGELKKP

SEQ ID NO: 41937 - protein, 9 aa, Homo Sapiens
RLDPFTIYT

SEQ ID NO: 41938 - protein, 9 aa, Homo Sapiens
YFPNIRDAI

SEQ ID NO: 41939 - protein, 9 aa, Homo Sapiens
VVKSQKQVN

SEQ ID NO: 41940 - protein, 9 aa, Homo Sapiens
LWLQVWDQD

SEQ ID NO: 41941 - protein, 9 aa, Homo Sapiens
LQATLAVNP

SEQ ID NO: 41942 - protein, 9 aa, Homo Sapiens
EILEEVKVT

SEQ ID NO: 41943 - protein, 9 aa, Homo Sapiens
VKSQKQVNI

SEQ ID NO: 41944 - protein, 9 aa, Homo Sapiens
AKAEAQLEE

SEQ ID NO: 41945 - protein, 9 aa, Homo Sapiens
SGTVLQEMA

SEQ ID NO: 41946 - protein, 9 aa, Homo Sapiens
KQGLKQKMV

SEQ ID NO: 41947 - protein, 9 aa, Homo Sapiens
IVGAGPKPE

SEQ ID NO: 41948 - protein, 9 aa, Homo Sapiens
GGNPQAGGE

SEQ ID NO: 41949 - protein, 9 aa, Homo Sapiens
RDKYSKVPS

SEQ ID NO: 41950 - protein, 9 aa, Homo Sapiens
LSGTVLQEM

SEQ ID NO: 41951 - protein, 9 aa, Homo Sapiens
HRLDFIRNQ

SEQ ID NO: 41952 - protein, 9 aa, Homo Sapiens
PTASALAPG

SEQ ID NO: 41953 - protein, 9 aa, Homo Sapiens
KKFRFQLKN

SEQ ID NO: 41954 - protein, 9 aa, Homo Sapiens
TQQLRVFES

SEQ ID NO: 41955 - protein, 9 aa, Homo Sapiens
NVHHQKGKY

SEQ ID NO: 41956 - protein, 9 aa, Homo Sapiens
QVNIIAKEN

SEQ ID NO: 41957 - protein, 9 aa, Homo Sapiens
KVDYELKNL

SEQ ID NO: 41958 - protein, 9 aa, Homo Sapiens
SWNFYFPNI

SEQ ID NO: 41959 - protein, 9 aa, Homo Sapiens
GLKQKMVAW

SEQ ID NO: 41960 - protein, 9 aa, Homo Sapiens
QKKTNDLRY

SEQ ID NO: 41961 - protein, 9 aa, Homo Sapiens
ALAPGPGTG

SEQ ID NO: 41962 - protein, 9 aa, Homo Sapiens
VGELKKPRT

SEQ ID NO: 41963 - protein, 9 aa, Homo Sapiens
HSRVLLLLL

SEQ ID NO: 41964 - protein, 9 aa, Homo Sapiens
PDVVTPNSL

SEQ ID NO: 41965 - protein, 9 aa, Homo Sapiens
YLDLPVAII

SEQ ID NO: 41966 - protein, 9 aa, Homo Sapiens
LASKHFRAE

SEQ ID NO: 41967 - protein, 9 aa, Homo Sapiens
WFKNQCAKW

SEQ ID NO: 41968 - protein, 9 aa, Homo Sapiens
KWEGKLSSF

SEQ ID NO: 41969 - protein, 9 aa, Homo Sapiens
QKKTFDLQD

SEQ ID NO: 41970 - protein, 9 aa, Homo Sapiens
GETNNQVNG

SEQ ID NO: 41971 - protein, 9 aa, Homo Sapiens
QAMNILFSS

SEQ ID NO: 41972 - protein, 9 aa, Homo Sapiens
AGTMAHSRV

SEQ ID NO: 41973 - protein, 9 aa, Homo Sapiens
PESHSPPFQ

SEQ ID NO: 41974 - protein, 9 aa, Homo Sapiens
PASGGPCCC

SEQ ID NO: 41975 - protein, 9 aa, Homo Sapiens
KLGLRRSDR

SEQ ID NO: 41976 - protein, 9 aa, Homo Sapiens
TSSWNFYFP

SEQ ID NO: 41977 - protein, 9 aa, Homo Sapiens
EKVKNAFTK

SEQ ID NO: 41978 - protein, 9 aa, Homo Sapiens
SAVSRDKYS

SEQ ID NO: 41979 - protein, 9 aa, Homo Sapiens
TRKTNSSPS

SEQ ID NO: 41980 - protein, 9 aa, Homo Sapiens
RRDAELHVH

SEQ ID NO: 41981 - protein, 9 aa, Homo Sapiens
TNNQVNGTR

SEQ ID NO: 41982 - protein, 9 aa, Homo Sapiens
QITYSIVRA

SEQ ID NO: 41983 - protein, 9 aa, Homo Sapiens
YRQKKTFDL

SEQ ID NO: 41984 - protein, 9 aa, Homo Sapiens
VGCQESQLC

SEQ ID NO: 41985 - protein, 9 aa, Homo Sapiens
TTSVPLNLE

SEQ ID NO: 41986 - protein, 9 aa, Homo Sapiens
QIPIHRAKV

SEQ ID NO: 41987 - protein, 9 aa, Homo Sapiens
FLDFLQNGL

SEQ ID NO: 41988 - protein, 9 aa, Homo Sapiens
LVIHADELE

SEQ ID NO: 41989 - protein, 9 aa, Homo Sapiens
PHKTVIEYE

SEQ ID NO: 41990 - protein, 9 aa, Homo Sapiens
PNTFNVGCQ

SEQ ID NO: 41991 - protein, 9 aa, Homo Sapiens
EKTQPTGVG

SEQ ID NO: 41992 - protein, 9 aa, Homo Sapiens
QQLAKELQA

SEQ ID NO: 41993 - protein, 9 aa, Homo Sapiens
SNANIGPRL

SEQ ID NO: 41994 - protein, 9 aa, Homo Sapiens
PTTGLGNFA

SEQ ID NO: 41995 - protein, 9 aa, Homo Sapiens
WLQVWDQDS

SEQ ID NO: 41996 - protein, 9 aa, Homo Sapiens
GAGPKPEAS

SEQ ID NO: 41997 - protein, 9 aa, Homo Sapiens
FLSGTVLQE

SEQ ID NO: 41998 - protein, 9 aa, Homo Sapiens
AKEGAPGGN

SEQ ID NO: 41999 - protein, 9 aa, Homo Sapiens
KKTFDLQDW

SEQ ID NO: 42000 - protein, 9 aa, Homo Sapiens
AVNPEDPNV

SEQ ID NO: 42001 - protein, 9 aa, Homo Sapiens
LLILDKDEL

SEQ ID NO: 42002 - protein, 9 aa, Homo Sapiens
DWRTEEENL

SEQ ID NO: 42003 - protein, 9 aa, Homo Sapiens
SLLLILDKD

SEQ ID NO: 42004 - protein, 9 aa, Homo Sapiens
LASSCPMFT

SEQ ID NO: 42005 - protein, 9 aa, Homo Sapiens
MFQKLKWEG

SEQ ID NO: 42006 - protein, 9 aa, Homo Sapiens
RKLGLRRSD

SEQ ID NO: 42007 - protein, 9 aa, Homo Sapiens
SLHLDPESH

SEQ ID NO: 42008 - protein, 9 aa, Homo Sapiens
GTMAHSRVL

SEQ ID NO: 42009 - protein, 9 aa, Homo Sapiens
GHNDSINST

SEQ ID NO: 42010 - protein, 9 aa, Homo Sapiens
LICVAMVKR

SEQ ID NO: 42011 - protein, 9 aa, Homo Sapiens
KKLLKRTPR

SEQ ID NO: 42012 - protein, 9 aa, Homo Sapiens
LVMKQKSLW

SEQ ID NO: 42013 - protein, 9 aa, Homo Sapiens
LKQKMVAWF

SEQ ID NO: 42014 - protein, 9 aa, Homo Sapiens
ASKHFRAER

SEQ ID NO: 42015 - protein, 9 aa, Homo Sapiens
TYSIVRASA

SEQ ID NO: 42016 - protein, 9 aa, Homo Sapiens
EKDGLTVSL

SEQ ID NO: 42017 - protein, 9 aa, Homo Sapiens
GKMADILEM

SEQ ID NO: 42018 - protein, 9 aa, Homo Sapiens
NPFLDFLQN

SEQ ID NO: 42019 - protein, 9 aa, Homo Sapiens
ACLSCPCLN

SEQ ID NO: 42020 - protein, 9 aa, Homo Sapiens
NGGQLVSIE

SEQ ID NO: 42021 - protein, 9 aa, Homo Sapiens
GKLSSFLYS

SEQ ID NO: 42022 - protein, 9 aa, Homo Sapiens
IKALEILEE

SEQ ID NO: 42023 - protein, 9 aa, Homo Sapiens
PAIRFPNLV

SEQ ID NO: 42024 - protein, 9 aa, Homo Sapiens
AEAVTYLDL

SEQ ID NO: 42025 - protein, 9 aa, Homo Sapiens
AKIKALEIL

SEQ ID NO: 42026 - protein, 9 aa, Homo Sapiens
EGKLSSFLY

SEQ ID NO: 42027 - protein, 9 aa, Homo Sapiens
KQQLAKELQ

SEQ ID NO: 42028 - protein, 9 aa, Homo Sapiens
NLMVATGDP

SEQ ID NO: 42029 - protein, 9 aa, Homo Sapiens
SSWNFYFPN

SEQ ID NO: 42030 - protein, 9 aa, Homo Sapiens
NSISFQVQK

SEQ ID NO: 42031 - protein, 9 aa, Homo Sapiens
EEEALASKH

SEQ ID NO: 42032 - protein, 9 aa, Homo Sapiens
HLVIHADEL

SEQ ID NO: 42033 - protein, 9 aa, Homo Sapiens
LDFLQNGLM

SEQ ID NO: 42034 - protein, 9 aa, Homo Sapiens
SEAATEGGA

SEQ ID NO: 42035 - protein, 9 aa, Homo Sapiens
FLIWINQED

SEQ ID NO: 42036 - protein, 9 aa, Homo Sapiens
GYTALSQSS

SEQ ID NO: 42037 - protein, 9 aa, Homo Sapiens
LEMIKNLFM

SEQ ID NO: 42038 - protein, 9 aa, Homo Sapiens
SMATLRGFG

SEQ ID NO: 42039 - protein, 9 aa, Homo Sapiens
DPAIRFPNL

SEQ ID NO: 42040 - protein, 9 aa, Homo Sapiens
RFQLKNSIS

SEQ ID NO: 42041 - protein, 9 aa, Homo Sapiens
KNSISFQVQ

SEQ ID NO: 42042 - protein, 9 aa, Homo Sapiens
TSQSSRALT

SEQ ID NO: 42043 - protein, 9 aa, Homo Sapiens
IYTLTLEAC

SEQ ID NO: 42044 - protein, 9 aa, Homo Sapiens
SHSPPFQTI

SEQ ID NO: 42045 - protein, 9 aa, Homo Sapiens
ATGDPAIRF

SEQ ID NO: 42046 - protein, 9 aa, Homo Sapiens
SVPLNLEKN

SEQ ID NO: 42047 - protein, 9 aa, Homo Sapiens
VEDTQLCHT

SEQ ID NO: 42048 - protein, 9 aa, Homo Sapiens
LAPGPGTGA

SEQ ID NO: 42049 - protein, 9 aa, Homo Sapiens
EAVTYLDLP

SEQ ID NO: 42050 - protein, 9 aa, Homo Sapiens
AQLCGLHLV

SEQ ID NO: 42051 - protein, 9 aa, Homo Sapiens
LTSSWNFYF

SEQ ID NO: 42052 - protein, 9 aa, Homo Sapiens
TVLAEAVTY

SEQ ID NO: 42053 - protein, 9 aa, Homo Sapiens
CPCLNGGTC

SEQ ID NO: 42054 - protein, 9 aa, Homo Sapiens
RHTACLSCP

SEQ ID NO: 42055 - protein, 9 aa, Homo Sapiens
NMLPLLEVA

SEQ ID NO: 42056 - protein, 9 aa, Homo Sapiens
KVKNAFTKT

SEQ ID NO: 42057 - protein, 9 aa, Homo Sapiens
ELPTASALA

SEQ ID NO: 42058 - protein, 9 aa, Homo Sapiens
SDENLVSLD

SEQ ID NO: 42059 - protein, 9 aa, Homo Sapiens
ESDYSDGHN

SEQ ID NO: 42060 - protein, 9 aa, Homo Sapiens
LVKHGGDFF

SEQ ID NO: 42061 - protein, 9 aa, Homo Sapiens
KDEKDGLTV

SEQ ID NO: 42062 - protein, 9 aa, Homo Sapiens
YAKIFPMKN

SEQ ID NO: 42063 - protein, 9 aa, Homo Sapiens
HTACLSCPC

SEQ ID NO: 42064 - protein, 9 aa, Homo Sapiens
WEGKLSSFL

SEQ ID NO: 42065 - protein, 9 aa, Homo Sapiens
CRQNFLSGT

SEQ ID NO: 42066 - protein, 9 aa, Homo Sapiens
RIFHEVMGC

SEQ ID NO: 42067 - protein, 9 aa, Homo Sapiens
PFLDFLQNG

SEQ ID NO: 42068 - protein, 9 aa, Homo Sapiens
KSTEEETAV

SEQ ID NO: 42069 - protein, 9 aa, Homo Sapiens
LKKLLKRTP

SEQ ID NO: 42070 - protein, 9 aa, Homo Sapiens
VAMVKRVVH

SEQ ID NO: 42071 - protein, 9 aa, Homo Sapiens
RDAELHVHE

SEQ ID NO: 42072 - protein, 9 aa, Homo Sapiens
DIYTKTDSK

SEQ ID NO: 42073 - protein, 9 aa, Homo Sapiens
TSGETNNQV

SEQ ID NO: 42074 - protein, 9 aa, Homo Sapiens
FTRKTNSSP

SEQ ID NO: 42075 - protein, 9 aa, Homo Sapiens
YSLLEISTM

SEQ ID NO: 42076 - protein, 9 aa, Homo Sapiens
TFKNKQTLI

SEQ ID NO: 42077 - protein, 9 aa, Homo Sapiens
LPPSAAKHI

SEQ ID NO: 42078 - protein, 9 aa, Homo Sapiens
ELQAPIGSE

SEQ ID NO: 42079 - protein, 9 aa, Homo Sapiens
NPEFSPEAV

SEQ ID NO: 42080 - protein, 9 aa, Homo Sapiens
RTRSTQQLR

SEQ ID NO: 42081 - protein, 9 aa, Homo Sapiens
LATGGPLWL

SEQ ID NO: 42082 - protein, 9 aa, Homo Sapiens
SESDYSDGH

SEQ ID NO: 42083 - protein, 9 aa, Homo Sapiens
QRKFTSQSS

SEQ ID NO: 42084 - protein, 9 aa, Homo Sapiens
HNDSINSTS

SEQ ID NO: 42085 - protein, 9 aa, Homo Sapiens
QESQLCNLN

SEQ ID NO: 42086 - protein, 9 aa, Homo Sapiens
TGGPLWLQV

SEQ ID NO: 42087 - protein, 9 aa, Homo Sapiens
HLASSCPMF

SEQ ID NO: 42088 - protein, 9 aa, Homo Sapiens
CCCHARIPR

SEQ ID NO: 42089 - protein, 9 aa, Homo Sapiens
YSKVPSALA

SEQ ID NO: 42090 - protein, 9 aa, Homo Sapiens
ARGKQDGEK

SEQ ID NO: 42091 - protein, 9 aa, Homo Sapiens
EQEDEEEEE

SEQ ID NO: 42092 - protein, 9 aa, Homo Sapiens
ASALAPGPG

SEQ ID NO: 42093 - protein, 9 aa, Homo Sapiens
WINQEDHTR

SEQ ID NO: 42094 - protein, 9 aa, Homo Sapiens
KNNMLPLLE

SEQ ID NO: 42095 - protein, 9 aa, Homo Sapiens
DKRKYAVHI

SEQ ID NO: 42096 - protein, 9 aa, Homo Sapiens
KSPVCSSDS

SEQ ID NO: 42097 - protein, 9 aa, Homo Sapiens
SDGHNDSIN

SEQ ID NO: 42098 - protein, 9 aa, Homo Sapiens
QLRVFESFY

SEQ ID NO: 42099 - protein, 9 aa, Homo Sapiens
MAHSRVLLL

SEQ ID NO: 42100 - protein, 9 aa, Homo Sapiens
SPATPARRK

SEQ ID NO: 42101 - protein, 9 aa, Homo Sapiens
KFTLSLVGL

SEQ ID NO: 42102 - protein, 9 aa, Homo Sapiens
DGEDSRSSE

SEQ ID NO: 42103 - protein, 9 aa, Homo Sapiens
SGPWPIVPY

SEQ ID NO: 42104 - protein, 9 aa, Homo Sapiens
SEQQRKFTS

SEQ ID NO: 42105 - protein, 9 aa, Homo Sapiens
KTSGETNNQ

SEQ ID NO: 42106 - protein, 9 aa, Homo Sapiens
LLNIARGKQ

SEQ ID NO: 42107 - protein, 9 aa, Homo Sapiens
SDSNGHCTG

SEQ ID NO: 42108 - protein, 9 aa, Homo Sapiens
FQKLKWEGK

SEQ ID NO: 42109 - protein, 9 aa, Homo Sapiens
QTLIIEPEK

SEQ ID NO: 42110 - protein, 9 aa, Homo Sapiens
SFLQATLAV

SEQ ID NO: 42111 - protein, 9 aa, Homo Sapiens
GSIRNFCSD

SEQ ID NO: 42112 - protein, 9 aa, Homo Sapiens
RRFSMATLR

SEQ ID NO: 42113 - protein, 9 aa, Homo Sapiens
FLLAYLAWN

SEQ ID NO: 42114 - protein, 9 aa, Homo Sapiens
VRLNDIYTK

SEQ ID NO: 42115 - protein, 9 aa, Homo Sapiens
VLAELRHLN

SEQ ID NO: 42116 - protein, 9 aa, Homo Sapiens
STAKAEAQL

SEQ ID NO: 42117 - protein, 9 aa, Homo Sapiens
SSDSNGHCT

SEQ ID NO: 42118 - protein, 9 aa, Homo Sapiens
TNSSPSPCL

SEQ ID NO: 42119 - protein, 9 aa, Homo Sapiens
LHLDPESHS

SEQ ID NO: 42120 - protein, 9 aa, Homo Sapiens
PNSLNVKKF

SEQ ID NO: 42121 - protein, 9 aa, Homo Sapiens
FKNKQTLII

SEQ ID NO: 42122 - protein, 9 aa, Homo Sapiens
HVHELEKLD

SEQ ID NO: 42123 - protein, 9 aa, Homo Sapiens
MDDFLLAYL

SEQ ID NO: 42124 - protein, 9 aa, Homo Sapiens
LLLILDKDE

SEQ ID NO: 42125 - protein, 9 aa, Homo Sapiens
RSGPWPIVP

SEQ ID NO: 42126 - protein, 9 aa, Homo Sapiens
ATLAVNPED

SEQ ID NO: 42127 - protein, 9 aa, Homo Sapiens
LLEDLQKKT

SEQ ID NO: 42128 - protein, 9 aa, Homo Sapiens
RDFKNNMLP

SEQ ID NO: 42129 - protein, 9 aa, Homo Sapiens
FGNSLVVIY

SEQ ID NO: 42130 - protein, 9 aa, Homo Sapiens
AGEEPTTGL

SEQ ID NO: 42131 - protein, 9 aa, Homo Sapiens
KNKQTLIIE

SEQ ID NO: 42132 - protein, 9 aa, Homo Sapiens
HHQKGKYEG

SEQ ID NO: 42133 - protein, 9 aa, Homo Sapiens
TAASVEDTQ

SEQ ID NO: 42134 - protein, 9 aa, Homo Sapiens
PCCCHARIP

SEQ ID NO: 42135 - protein, 9 aa, Homo Sapiens
IEKVKNAFT

SEQ ID NO: 42136 - protein, 9 aa, Homo Sapiens
SILQNGMKM

SEQ ID NO: 42137 - protein, 9 aa, Homo Sapiens
FFAENENKD

SEQ ID NO: 42138 - protein, 9 aa, Homo Sapiens
LQAPIGSEE

SEQ ID NO: 42139 - protein, 9 aa, Homo Sapiens
GGYIIKKFT

SEQ ID NO: 42140 - protein, 9 aa, Homo Sapiens
PWPIVPYSS

SEQ ID NO: 42141 - protein, 9 aa, Homo Sapiens
VRASAFGSY

SEQ ID NO: 42142 - protein, 9 aa, Homo Sapiens
ACPGRDWRT

SEQ ID NO: 42143 - protein, 9 aa, Homo Sapiens
IWINQEDHT

SEQ ID NO: 42144 - protein, 9 aa, Homo Sapiens
TRTRSTQQL

SEQ ID NO: 42145 - protein, 9 aa, Homo Sapiens
SQKQVNIIA

SEQ ID NO: 42146 - protein, 9 aa, Homo Sapiens
CLSCPCLNG

SEQ ID NO: 42147 - protein, 9 aa, Homo Sapiens
QLRRFSMAT

SEQ ID NO: 42148 - protein, 9 aa, Homo Sapiens
QNGMKMTNE

SEQ ID NO: 42149 - protein, 9 aa, Homo Sapiens
KTNDLRYIE

SEQ ID NO: 42150 - protein, 9 aa, Homo Sapiens
QQLRVFESF

SEQ ID NO: 42151 - protein, 9 aa, Homo Sapiens
EQQRKFTSQ

SEQ ID NO: 42152 - protein, 9 aa, Homo Sapiens
VDGLKLLRS

SEQ ID NO: 42153 - protein, 9 aa, Homo Sapiens
SAQIVGAGP

SEQ ID NO: 42154 - protein, 9 aa, Homo Sapiens
SSEAATEGG

SEQ ID NO: 42155 - protein, 9 aa, Homo Sapiens
GLHLVIHAD

SEQ ID NO: 42156 - protein, 9 aa, Homo Sapiens
ISTAKAEAQ

SEQ ID NO: 42157 - protein, 9 aa, Homo Sapiens
SIQAMNILF

SEQ ID NO: 42158 - protein, 9 aa, Homo Sapiens
ESSLLLILD

SEQ ID NO: 42159 - protein, 9 aa, Homo Sapiens
LPTASALAP

SEQ ID NO: 42160 - protein, 9 aa, Homo Sapiens
PIHRAKVPP

SEQ ID NO: 42161 - protein, 9 aa, Homo Sapiens
EDEQEDEEE

SEQ ID NO: 42162 - protein, 9 aa, Homo Sapiens
ALASKHFRA

SEQ ID NO: 42163 - protein, 9 aa, Homo Sapiens
RTIPPHKTV

SEQ ID NO: 42164 - protein, 9 aa, Homo Sapiens
TAKAEAQLE

SEQ ID NO: 42165 - protein, 9 aa, Homo Sapiens
IKKFTLSLV

SEQ ID NO: 42166 - protein, 9 aa, Homo Sapiens
KKFTLSLVG

SEQ ID NO: 42167 - protein, 9 aa, Homo Sapiens
GEEPTTGLG

SEQ ID NO: 42168 - protein, 9 aa, Homo Sapiens
SELPTASAL

SEQ ID NO: 42169 - protein, 9 aa, Homo Sapiens
PLILKKLLK

SEQ ID NO: 42170 - protein, 9 aa, Homo Sapiens
AKHIVSPSA

SEQ ID NO: 42171 - protein, 9 aa, Homo Sapiens
MRSGPWPIV

SEQ ID NO: 42172 - protein, 9 aa, Homo Sapiens
STQQLRVFE

SEQ ID NO: 42173 - protein, 9 aa, Homo Sapiens
PAGTMAHSR

SEQ ID NO: 42174 - protein, 9 aa, Homo Sapiens
PGGNPQAGG

SEQ ID NO: 42175 - protein, 9 aa, Homo Sapiens
HKTVIEYEY

SEQ ID NO: 42176 - protein, 9 aa, Homo Sapiens
SSAQIVGAG

SEQ ID NO: 42177 - protein, 9 aa, Homo Sapiens
NKQTLIIEP

SEQ ID NO: 42178 - protein, 9 aa, Homo Sapiens
AREYGGLKR

SEQ ID NO: 42179 - protein, 9 aa, Homo Sapiens
CAKWKRQQR

SEQ ID NO: 42180 - protein, 9 aa, Homo Sapiens
DEQEDEEEE

SEQ ID NO: 42181 - protein, 9 aa, Homo Sapiens
EEKREKTQP

SEQ ID NO: 42182 - protein, 9 aa, Homo Sapiens
AYRQKKTFD

SEQ ID NO: 42183 - protein, 9 aa, Homo Sapiens
LEISTMERG

SEQ ID NO: 42184 - protein, 9 aa, Homo Sapiens
MKMTNEPPK

SEQ ID NO: 42185 - protein, 9 aa, Homo Sapiens
EISTMERGV

SEQ ID NO: 42186 - protein, 9 aa, Homo Sapiens
RFSMATLRG

SEQ ID NO: 42187 - protein, 9 aa, Homo Sapiens
HFRAERQDN

SEQ ID NO: 42188 - protein, 9 aa, Homo Sapiens
RKFTSQSSR

SEQ ID NO: 42189 - protein, 9 aa, Homo Sapiens
ADILEMIKN

SEQ ID NO: 42190 - protein, 9 aa, Homo Sapiens
ALMITVDGL

SEQ ID NO: 42191 - protein, 9 aa, Homo Sapiens
TPARRKLGL

SEQ ID NO: 42192 - protein, 9 aa, Homo Sapiens
PGRDWRTEE

SEQ ID NO: 42193 - protein, 9 aa, Homo Sapiens
SALAPGPGT

SEQ ID NO: 42194 - protein, 9 aa, Homo Sapiens
WMPVGTKLT

SEQ ID NO: 42195 - protein, 9 aa, Homo Sapiens
EAKEACRRN

SEQ ID NO: 42196 - protein, 9 aa, Homo Sapiens
QATLAVNPE

SEQ ID NO: 42197 - protein, 9 aa, Homo Sapiens
PMKNATVAV

SEQ ID NO: 42198 - protein, 9 aa, Homo Sapiens
TACLSCPCL

SEQ ID NO: 42199 - protein, 9 aa, Homo Sapiens
VLAEAVTYL

SEQ ID NO: 42200 - protein, 9 aa, Homo Sapiens
SLLEISTME

SEQ ID NO: 42201 - protein, 9 aa, Homo Sapiens
EKREKTQPT

SEQ ID NO: 42202 - protein, 9 aa, Homo Sapiens
VHHQKGKYE

SEQ ID NO: 42203 - protein, 9 aa, Homo Sapiens
MVKRVVHRL

SEQ ID NO: 42204 - protein, 9 aa, Homo Sapiens
AELRDFKNN

SEQ ID NO: 42205 - protein, 9 aa, Homo Sapiens
AVSRDKYSK

SEQ ID NO: 42206 - protein, 9 aa, Homo Sapiens
SSCPMFTKH

SEQ ID NO: 42207 - protein, 9 aa, Homo Sapiens
SRTIPPHKT

SEQ ID NO: 42208 - protein, 9 aa, Homo Sapiens
QQFLVMKQK

SEQ ID NO: 42209 - protein, 9 aa, Homo Sapiens
IFHEVMGCF

SEQ ID NO: 42210 - protein, 9 aa, Homo Sapiens
SDYSDGHND

SEQ ID NO: 42211 - protein, 9 aa, Homo Sapiens
SEDKRKYAV

SEQ ID NO: 42212 - protein, 9 aa, Homo Sapiens
HQKGKYEGV

SEQ ID NO: 42213 - protein, 9 aa, Homo Sapiens
KTFDLQDWT

SEQ ID NO: 42214 - protein, 9 aa, Homo Sapiens
MFTKHTPCR

SEQ ID NO: 42215 - protein, 9 aa, Homo Sapiens
HTAASVEDT

SEQ ID NO: 42216 - protein, 9 aa, Homo Sapiens
SPSDKVDYE

SEQ ID NO: 42217 - protein, 9 aa, Homo Sapiens
DKVDYELKN

SEQ ID NO: 42218 - protein, 9 aa, Homo Sapiens
IARGKQDGE

SEQ ID NO: 42219 - protein, 9 aa, Homo Sapiens
KLKWEGKLS

SEQ ID NO: 42220 - protein, 9 aa, Homo Sapiens
EAGEEPTTG

SEQ ID NO: 42221 - protein, 9 aa, Homo Sapiens
KKVRLNDIY

SEQ ID NO: 42222 - protein, 9 aa, Homo Sapiens
YAISTAKAE

SEQ ID NO: 42223 - protein, 9 aa, Homo Sapiens
KFRFQLKNS

SEQ ID NO: 42224 - protein, 9 aa, Homo Sapiens
FQLKNSISF

SEQ ID NO: 42225 - protein, 9 aa, Homo Sapiens
IHTAASVED

SEQ ID NO: 42226 - protein, 9 aa, Homo Sapiens
YELKNLEHL

SEQ ID NO: 42227 - protein, 9 aa, Homo Sapiens
ATGGPLWLQ

SEQ ID NO: 42228 - protein, 9 aa, Homo Sapiens
CACPGRDWR

SEQ ID NO: 42229 - protein, 9 aa, Homo Sapiens
EKKVRLNDI

SEQ ID NO: 42230 - protein, 9 aa, Homo Sapiens
SDKVDYELK

SEQ ID NO: 42231 - protein, 9 aa, Homo Sapiens
VSRDKYSKV

SEQ ID NO: 42232 - protein, 9 aa, Homo Sapiens
SLSRTIPPH

SEQ ID NO: 42233 - protein, 9 aa, Homo Sapiens
KSLWLEGDY

SEQ ID NO: 42234 - protein, 9 aa, Homo Sapiens
RSTQQLRVF

SEQ ID NO: 42235 - protein, 9 aa, Homo Sapiens
RSLHLDPES

SEQ ID NO: 42236 - protein, 9 aa, Homo Sapiens
QHCTEEDEQ

SEQ ID NO: 42237 - protein, 9 aa, Homo Sapiens
KELQAPIGS

SEQ ID NO: 42238 - protein, 9 aa, Homo Sapiens
NQEDHTRVI

SEQ ID NO: 42239 - protein, 9 aa, Homo Sapiens
TFTRKTNSS

SEQ ID NO: 42240 - protein, 9 aa, Homo Sapiens
GQIPIHRAK

SEQ ID NO: 42241 - protein, 9 aa, Homo Sapiens
LQKKTNDLR

SEQ ID NO: 42242 - protein, 9 aa, Homo Sapiens
MVATGDPAI

SEQ ID NO: 42243 - protein, 9 aa, Homo Sapiens
GGDFFAENE

SEQ ID NO: 42244 - protein, 9 aa, Homo Sapiens
ITCPKTGHA

SEQ ID NO: 42245 - protein, 9 aa, Homo Sapiens
WRTEEENLR

SEQ ID NO: 42246 - protein, 9 aa, Homo Sapiens
VKHGGDFFA

SEQ ID NO: 42247 - protein, 9 aa, Homo Sapiens
EKKTSGETN

SEQ ID NO: 42248 - protein, 9 aa, Homo Sapiens
EPRLICVAM

SEQ ID NO: 42249 - protein, 9 aa, Homo Sapiens
SQSSDENLV

SEQ ID NO: 42250 - protein, 9 aa, Homo Sapiens
SIVRASAFG

SEQ ID NO: 42251 - protein, 9 aa, Homo Sapiens
SLVVIYFYM

SEQ ID NO: 42252 - protein, 9 aa, Homo Sapiens
SKHFRAERQ

SEQ ID NO: 42253 - protein, 9 aa, Homo Sapiens
KAFISNANI

SEQ ID NO: 42254 - protein, 9 aa, Homo Sapiens
QLKNSISFQ

SEQ ID NO: 42255 - protein, 9 aa, Homo Sapiens
LAEAVTYLD

SEQ ID NO: 42256 - protein, 9 aa, Homo Sapiens
PYAISTAKA

SEQ ID NO: 42257 - protein, 9 aa, Homo Sapiens
FRFQLKNSI

SEQ ID NO: 42258 - protein, 9 aa, Homo Sapiens
MIKNLFMWV

SEQ ID NO: 42259 - protein, 9 aa, Homo Sapiens
QKLKWEGKL

SEQ ID NO: 42260 - protein, 9 aa, Homo Sapiens
FNVGCQESQ

SEQ ID NO: 42261 - protein, 9 aa, Homo Sapiens
NKTEFKFDL

SEQ ID NO: 42262 - protein, 9 aa, Homo Sapiens
KIKALEILE

SEQ ID NO: 42263 - protein, 9 aa, Homo Sapiens
GDFFAENEN

SEQ ID NO: 42264 - protein, 9 aa, Homo Sapiens
ILKKLLKRT

SEQ ID NO: 42265 - protein, 9 aa, Homo Sapiens
GKYEGVVYS

SEQ ID NO: 42266 - protein, 9 aa, Homo Sapiens
EIEGGAFDV

SEQ ID NO: 42267 - protein, 9 aa, Homo Sapiens
ITVDGLKLL

SEQ ID NO: 42268 - protein, 9 aa, Homo Sapiens
FQVQKIIDQ

SEQ ID NO: 42269 - protein, 9 aa, Homo Sapiens
PSDKVDYEL

SEQ ID NO: 42270 - protein, 9 aa, Homo Sapiens
ALAREYGGL

SEQ ID NO: 42271 - protein, 9 aa, Homo Sapiens
ISNANIGPR

SEQ ID NO: 42272 - protein, 9 aa, Homo Sapiens
QVQKIIDQN

SEQ ID NO: 42273 - protein, 9 aa, Homo Sapiens
ASGGPCCCH

SEQ ID NO: 42274 - protein, 9 aa, Homo Sapiens
IQAMNILFS

SEQ ID NO: 42275 - protein, 9 aa, Homo Sapiens
TRHTACLSC

SEQ ID NO: 42276 - protein, 9 aa, Homo Sapiens
EACRRNGGQ

SEQ ID NO: 42277 - protein, 9 aa, Homo Sapiens
RDWRTEEEN

SEQ ID NO: 42278 - protein, 9 aa, Homo Sapiens
EPTTGLGNF

SEQ ID NO: 42279 - protein, 9 aa, Homo Sapiens
ARRKLGLRR

SEQ ID NO: 42280 - protein, 9 aa, Homo Sapiens
TGLGNFAFY

SEQ ID NO: 42281 - protein, 9 aa, Homo Sapiens
LMITVDGLK

SEQ ID NO: 42282 - protein, 9 aa, Homo Sapiens
AMVKRVVHR

SEQ ID NO: 42283 - protein, 9 aa, Homo Sapiens
AMNILFSSW

SEQ ID NO: 42284 - protein, 9 aa, Homo Sapiens
HGGDFFAEN

SEQ ID NO: 42285 - protein, 9 aa, Homo Sapiens
IPPHKTVIE

SEQ ID NO: 42286 - protein, 9 aa, Homo Sapiens
EEDEQEDEE

SEQ ID NO: 42287 - protein, 9 aa, Homo Sapiens
KYAVHIAME

SEQ ID NO: 42288 - protein, 9 aa, Homo Sapiens
PEAVDNCCR

SEQ ID NO: 42289 - protein, 9 aa, Homo Sapiens
KLLKRTPRK

SEQ ID NO: 42290 - protein, 9 aa, Homo Sapiens
SGETNNQVN

SEQ ID NO: 42291 - protein, 9 aa, Homo Sapiens
TIIMEWMPV

SEQ ID NO: 42292 - protein, 9 aa, Homo Sapiens
VMKQKSLWL

SEQ ID NO: 42293 - protein, 9 aa, Homo Sapiens
FPMKNATVA

SEQ ID NO: 42294 - protein, 9 aa, Homo Sapiens
CHARIPRTP

SEQ ID NO: 42295 - protein, 9 aa, Homo Sapiens
PATPARRKL

SEQ ID NO: 42296 - protein, 9 aa, Homo Sapiens
SSEQQRKFT

SEQ ID NO: 42297 - protein, 9 aa, Homo Sapiens
IEGGAFDVL

SEQ ID NO: 42298 - protein, 9 aa, Homo Sapiens
PPHKTVIEY

SEQ ID NO: 42299 - protein, 9 aa, Homo Sapiens
HVSNRSIQA

SEQ ID NO: 42300 - protein, 9 aa, Homo Sapiens
NAFTKTHPA

SEQ ID NO: 42301 - protein, 9 aa, Homo Sapiens
QGLKQKMVA

SEQ ID NO: 42302 - protein, 9 aa, Homo Sapiens
SPEAVDNCC

SEQ ID NO: 42303 - protein, 9 aa, Homo Sapiens
FKNNMLPLL

SEQ ID NO: 42304 - protein, 9 aa, Homo Sapiens
KNQCAKWKR

SEQ ID NO: 42305 - protein, 9 aa, Homo Sapiens
KEACRRNGG

SEQ ID NO: 42306 - protein, 9 aa, Homo Sapiens
KIWFKNQCA

SEQ ID NO: 42307 - protein, 9 aa, Homo Sapiens
SYDTIIMEW

SEQ ID NO: 42308 - protein, 9 aa, Homo Sapiens
KQKSLWLEG

SEQ ID NO: 42309 - protein, 9 aa, Homo Sapiens
IHRLDFIRN

SEQ ID NO: 42310 - protein, 9 aa, Homo Sapiens
LHVHELEKL

SEQ ID NO: 42311 - protein, 9 aa, Homo Sapiens
SKKFRFQLK

SEQ ID NO: 42312 - protein, 9 aa, Homo Sapiens
ISFQVQKII

SEQ ID NO: 42313 - protein, 9 aa, Homo Sapiens
LAREYGGLK

SEQ ID NO: 42314 - protein, 9 aa, Homo Sapiens
RSSEAATEG

SEQ ID NO: 42315 - protein, 9 aa, Homo Sapiens
DAELHVHEL

SEQ ID NO: 42316 - protein, 9 aa, Homo Sapiens
NDIYTKTDS

SEQ ID NO: 42317 - protein, 9 aa, Homo Sapiens
FLQNGLMIS

SEQ ID NO: 42318 - protein, 9 aa, Homo Sapiens
YTALSQSSD

SEQ ID NO: 42319 - protein, 9 aa, Homo Sapiens
HLDPESHSP

SEQ ID NO: 42320 - protein, 9 aa, Homo Sapiens
VTPNSLNVK

SEQ ID NO: 42321 - protein, 9 aa, Homo Sapiens
HRAKVPPTF

SEQ ID NO: 42322 - protein, 9 aa, Homo Sapiens
AFISNANIG

SEQ ID NO: 42323 - protein, 9 aa, Homo Sapiens
FEDFVRIFH

SEQ ID NO: 42324 - protein, 9 aa, Homo Sapiens
GKQDGEKTR

SEQ ID NO: 42325 - protein, 9 aa, Homo Sapiens
DGLTVSLRE

SEQ ID NO: 42326 - protein, 9 aa, Homo Sapiens
DYAKIFPMK

SEQ ID NO: 42327 - protein, 9 aa, Homo Sapiens
LAKELQAPI

SEQ ID NO: 42328 - protein, 9 aa, Homo Sapiens
TVDGLKLLR

SEQ ID NO: 42329 - protein, 9 aa, Homo Sapiens
ETFTRKTNS

SEQ ID NO: 42330 - protein, 9 aa, Homo Sapiens
LCGLHLVIH

SEQ ID NO: 42331 - protein, 9 aa, Homo Sapiens
KSKKFRFQL

SEQ ID NO: 42332 - protein, 9 aa, Homo Sapiens
TALSQSSDE

SEQ ID NO: 42333 - protein, 9 aa, Homo Sapiens
DFFAENENK

SEQ ID NO: 42334 - protein, 9 aa, Homo Sapiens
LVVIYFYMK

SEQ ID NO: 42335 - protein, 9 aa, Homo Sapiens
ALEILEEVK

SEQ ID NO: 42336 - protein, 9 aa, Homo Sapiens
VMRSGPWPI

SEQ ID NO: 42337 - protein, 9 aa, Homo Sapiens
FTIYTLTLE

SEQ ID NO: 42338 - protein, 9 aa, Homo Sapiens
GDGEDSRSS

SEQ ID NO: 42339 - protein, 9 aa, Homo Sapiens
WNFYFPNIR

SEQ ID NO: 42340 - protein, 9 aa, Homo Sapiens
IIKKFTLSL

SEQ ID NO: 42341 - protein, 9 aa, Homo Sapiens
RNGGQLVSI

SEQ ID NO: 42342 - protein, 9 aa, Homo Sapiens
LISEDKRKY

SEQ ID NO: 42343 - protein, 9 aa, Homo Sapiens
RQKKTFDLQ

SEQ ID NO: 42344 - protein, 9 aa, Homo Sapiens
EDTQLCHTA

SEQ ID NO: 42345 - protein, 9 aa, Homo Sapiens
KDGLTVSLR

SEQ ID NO: 42346 - protein, 9 aa, Homo Sapiens
ESHSPPFQT

SEQ ID NO: 42347 - protein, 9 aa, Homo Sapiens
SCPCLNGGT

SEQ ID NO: 42348 - protein, 9 aa, Homo Sapiens
FSPEAVDNC

SEQ ID NO: 42349 - protein, 9 aa, Homo Sapiens
TRSTQQLRV

SEQ ID NO: 42350 - protein, 9 aa, Homo Sapiens
MIKQGLKQK

SEQ ID NO: 42351 - protein, 9 aa, Homo Sapiens
LLAYLAWNT

SEQ ID NO: 42352 - protein, 9 aa, Homo Sapiens
TMERGVVSL

SEQ ID NO: 42353 - protein, 9 aa, Homo Sapiens
DDFLLAYLA

SEQ ID NO: 42354 - protein, 9 aa, Homo Sapiens
IMEWMPVGT

SEQ ID NO: 42355 - protein, 9 aa, Homo Sapiens
LDPESHSPP

SEQ ID NO: 42356 - protein, 9 aa, Homo Sapiens
LMVATGDPA

SEQ ID NO: 42357 - protein, 9 aa, Homo Sapiens
QNFLSGTVL

SEQ ID NO: 42358 - protein, 9 aa, Homo Sapiens
TNDLRYIEM

SEQ ID NO: 42359 - protein, 9 aa, Homo Sapiens
EMIKNLFMW

SEQ ID NO: 42360 - protein, 9 aa, Homo Sapiens
QLEEEKREK

SEQ ID NO: 42361 - protein, 9 aa, Homo Sapiens
SSDENLVSL

SEQ ID NO: 42362 - protein, 9 aa, Homo Sapiens
YGGLKRNAL

SEQ ID NO: 42363 - protein, 9 aa, Homo Sapiens
EREDQIHRL

SEQ ID NO: 42364 - protein, 9 aa, Homo Sapiens
ISSAQIVGA

SEQ ID NO: 42365 - protein, 9 aa, Homo Sapiens
LKWEGKLSS

SEQ ID NO: 42366 - protein, 9 aa, Homo Sapiens
RQNFLSGTV

SEQ ID NO: 42367 - protein, 9 aa, Homo Sapiens
LGALMITVD

SEQ ID NO: 42368 - protein, 9 aa, Homo Sapiens
CKYPLILKK

SEQ ID NO: 42369 - protein, 9 aa, Homo Sapiens
SRDKYSKVP

SEQ ID NO: 42370 - protein, 9 aa, Homo Sapiens
AQLEEEKRE

SEQ ID NO: 42371 - protein, 9 aa, Homo Sapiens
EGGAFDVLA

SEQ ID NO: 42372 - protein, 9 aa, Homo Sapiens
IKQGLKQKM

SEQ ID NO: 42373 - protein, 9 aa, Homo Sapiens
EEREDQIHR

SEQ ID NO: 42374 - protein, 9 aa, Homo Sapiens
EDQIHRLDF

SEQ ID NO: 42375 - protein, 9 aa, Homo Sapiens
SCPMFTKHT

SEQ ID NO: 42376 - protein, 9 aa, Homo Sapiens
AEAQLEELA

SEQ ID NO: 42377 - protein, 9 aa, Homo Sapiens
ETNNQVNGT

SEQ ID NO: 42378 - protein, 9 aa, Homo Sapiens
FSMATLRGF

SEQ ID NO: 42379 - protein, 9 aa, Homo Sapiens
FCSDSCVVA

SEQ ID NO: 42380 - protein, 9 aa, Homo Sapiens
IWFKNQCAK

SEQ ID NO: 42381 - protein, 9 aa, Homo Sapiens
KIEKVKNAF

SEQ ID NO: 42382 - protein, 9 aa, Homo Sapiens
NVGCQESQL

SEQ ID NO: 42383 - protein, 9 aa, Homo Sapiens
IHRAKVPPT

SEQ ID NO: 42384 - protein, 9 aa, Homo Sapiens
SFAKAFISN

SEQ ID NO: 42385 - protein, 9 aa, Homo Sapiens
EEALASKHF

SEQ ID NO: 42386 - protein, 9 aa, Homo Sapiens
IQLTTSVPL

SEQ ID NO: 42387 - protein, 9 aa, Homo Sapiens
LSCPCLNGG

SEQ ID NO: 42388 - protein, 9 aa, Homo Sapiens
QKQVNIIAK

SEQ ID NO: 42389 - protein, 9 aa, Homo Sapiens
DSCVVAFQN

SEQ ID NO: 42390 - protein, 9 aa, Homo Sapiens
EGAPGGNPQ

SEQ ID NO: 42391 - protein, 9 aa, Homo Sapiens
FLVMKQKSL

SEQ ID NO: 42392 - protein, 9 aa, Homo Sapiens
SRSSEAATE

SEQ ID NO: 42393 - protein, 9 aa, Homo Sapiens
EWMPVGTKL

SEQ ID NO: 42394 - protein, 9 aa, Homo Sapiens
REYGGLKRN

SEQ ID NO: 42395 - protein, 9 aa, Homo Sapiens
SFQVQKIID

SEQ ID NO: 42396 - protein, 9 aa, Homo Sapiens
EALASKHFR

SEQ ID NO: 42397 - protein, 9 aa, Homo Sapiens
DGHNDSINS

SEQ ID NO: 42398 - protein, 9 aa, Homo Sapiens
GLPPSAAKH

SEQ ID NO: 42399 - protein, 9 aa, Homo Sapiens
SDSCVVAFQ

SEQ ID NO: 42400 - protein, 9 aa, Homo Sapiens
DYSDGHNDS

SEQ ID NO: 42401 - protein, 9 aa, Homo Sapiens
SVEDTQLCH

SEQ ID NO: 42402 - protein, 9 aa, Homo Sapiens
QIHRLDFIR

SEQ ID NO: 42403 - protein, 9 aa, Homo Sapiens
NSPSDKVDY

SEQ ID NO: 42404 - protein, 9 aa, Homo Sapiens
GGACFTLIV

SEQ ID NO: 42405 - protein, 9 aa, Homo Sapiens
CGLHLVIHA

SEQ ID NO: 42406 - protein, 9 aa, Homo Sapiens
VVIYFYMKL

SEQ ID NO: 42407 - protein, 9 aa, Homo Sapiens
YIIKKFTLS

SEQ ID NO: 42408 - protein, 9 aa, Homo Sapiens
DFKNNMLPL

SEQ ID NO: 42409 - protein, 9 aa, Homo Sapiens
VGAGPKPEA

SEQ ID NO: 42410 - protein, 9 aa, Homo Sapiens
ALSQSSDEN

SEQ ID NO: 42411 - protein, 9 aa, Homo Sapiens
YDTIIMEWM

SEQ ID NO: 42412 - protein, 9 aa, Homo Sapiens
DYELKNLEH

SEQ ID NO: 42413 - protein, 9 aa, Homo Sapiens
AASVEDTQL

SEQ ID NO: 42414 - protein, 9 aa, Homo Sapiens
DFLQNGLMI

SEQ ID NO: 42415 - protein, 9 aa, Homo Sapiens
TVLQEMASL

SEQ ID NO: 42416 - protein, 9 aa, Homo Sapiens
LEILEEVKV

SEQ ID NO: 42417 - protein, 9 aa, Homo Sapiens
MADILEMIK

SEQ ID NO: 42418 - protein, 9 aa, Homo Sapiens
TIPPHKTVI

SEQ ID NO: 42419 - protein, 9 aa, Homo Sapiens
DQRRDAELH

SEQ ID NO: 42420 - protein, 9 aa, Homo Sapiens
QSSDENLVS

SEQ ID NO: 42421 - protein, 9 aa, Homo Sapiens
CETFTRKTN

SEQ ID NO: 42422 - protein, 9 aa, Homo Sapiens
LTVSLRESQ

SEQ ID NO: 42423 - protein, 9 aa, Homo Sapiens
VDYELKNLE

SEQ ID NO: 42424 - protein, 9 aa, Homo Sapiens
IIMEWMPVG

SEQ ID NO: 42425 - protein, 9 aa, Homo Sapiens
LILDKDELI

SEQ ID NO: 42426 - protein, 9 aa, Homo Sapiens
GTVLQEMAS

SEQ ID NO: 42427 - protein, 9 aa, Homo Sapiens
MATLRGFGV

SEQ ID NO: 42428 - protein, 9 aa, Homo Sapiens
EDKRKYAVH

SEQ ID NO: 42429 - protein, 9 aa, Homo Sapiens
QNGLMISLS

SEQ ID NO: 42430 - protein, 9 aa, Homo Sapiens
ASSCPMFTK

SEQ ID NO: 42431 - protein, 9 aa, Homo Sapiens
CRRNGGQLV

SEQ ID NO: 42432 - protein, 9 aa, Homo Sapiens
ELRDFKNNM

SEQ ID NO: 42433 - protein, 9 aa, Homo Sapiens
EEEKREKTQ

SEQ ID NO: 42434 - protein, 9 aa, Homo Sapiens
QFLVMKQKS

SEQ ID NO: 42435 - protein, 9 aa, Homo Sapiens
KQKMVAWFE

SEQ ID NO: 42436 - protein, 9 aa, Homo Sapiens
FAQLCGLHL

SEQ ID NO: 42437 - protein, 9 aa, Homo Sapiens
AAKIKALEI

SEQ ID NO: 42438 - protein, 9 aa, Homo Sapiens
GACFTLIVG

SEQ ID NO: 42439 - protein, 9 aa, Homo Sapiens
AGLPPSAAK

SEQ ID NO: 42440 - protein, 9 aa, Homo Sapiens
KNAFTKTHP

SEQ ID NO: 42441 - protein, 9 aa, Homo Sapiens
KNATVAVDI

SEQ ID NO: 42442 - protein, 9 aa, Homo Sapiens
AKELQAPIG

SEQ ID NO: 42443 - protein, 9 aa, Homo Sapiens
IVRASAFGS

SEQ ID NO: 42444 - protein, 9 aa, Homo Sapiens
WLTSSWNFY

SEQ ID NO: 42445 - protein, 9 aa, Homo Sapiens
HEVMGCFSD

SEQ ID NO: 42446 - protein, 9 aa, Homo Sapiens
GCQESQLCN

SEQ ID NO: 42447 - protein, 9 aa, Homo Sapiens
VKIWFKNQC

SEQ ID NO: 42448 - protein, 9 aa, Homo Sapiens
YEGVVYSVV

SEQ ID NO: 42449 - protein, 9 aa, Homo Sapiens
KRKYAVHIA

SEQ ID NO: 42450 - protein, 9 aa, Homo Sapiens
AHSRVLLLL

SEQ ID NO: 42451 - protein, 9 aa, Homo Sapiens
LAYLAWNTM

SEQ ID NO: 42452 - protein, 9 aa, Homo Sapiens
WLISEDKRK

SEQ ID NO: 42453 - protein, 9 aa, Homo Sapiens
NFLSGTVLQ

SEQ ID NO: 42454 - protein, 9 aa, Homo Sapiens
AGPKPEASA

SEQ ID NO: 42455 - protein, 9 aa, Homo Sapiens
LTTSVPLNL

SEQ ID NO: 42456 - protein, 9 aa, Homo Sapiens
NQITYSIVR

SEQ ID NO: 42457 - protein, 9 aa, Homo Sapiens
GFPCSSNKT

SEQ ID NO: 42458 - protein, 9 aa, Homo Sapiens
NRSIQAMNI

SEQ ID NO: 42459 - protein, 9 aa, Homo Sapiens
KPDVVTPNS

SEQ ID NO: 42460 - protein, 9 aa, Homo Sapiens
DLQKKTNDL

SEQ ID NO: 42461 - protein, 9 aa, Homo Sapiens
EYGGLKRNA

SEQ ID NO: 42462 - protein, 9 aa, Homo Sapiens
RLICVAMVK

SEQ ID NO: 42463 - protein, 9 aa, Homo Sapiens
NSLVVIYFY

SEQ ID NO: 42464 - protein, 9 aa, Homo Sapiens
TVSLRESQK

SEQ ID NO: 42465 - protein, 9 aa, Homo Sapiens
DSRSSEAAT

SEQ ID NO: 42466 - protein, 9 aa, Homo Sapiens
REDQIHRLD

SEQ ID NO: 42467 - protein, 9 aa, Homo Sapiens
LEEEKREKT

SEQ ID NO: 42468 - protein, 9 aa, Homo Sapiens
PPAGTMAHS

SEQ ID NO: 42469 - protein, 9 aa, Homo Sapiens
FKNQCAKWK

SEQ ID NO: 42470 - protein, 9 aa, Homo Sapiens
KGKYEGVVY

SEQ ID NO: 42471 - protein, 9 aa, Homo Sapiens
KTEFKFDLT

SEQ ID NO: 42472 - protein, 9 aa, Homo Sapiens
QIQLTTSVP

SEQ ID NO: 42473 - protein, 9 aa, Homo Sapiens
KVRLNDIYT

SEQ ID NO: 42474 - protein, 9 aa, Homo Sapiens
VKGALRKAI

SEQ ID NO: 42475 - protein, 9 aa, Homo Sapiens
DGLKLLRSS

SEQ ID NO: 42476 - protein, 9 aa, Homo Sapiens
TFNVGCQES

SEQ ID NO: 42477 - protein, 9 aa, Homo Sapiens
ATPARRKLG

SEQ ID NO: 42478 - protein, 9 aa, Homo Sapiens
VTYLDLPVA

SEQ ID NO: 42479 - protein, 9 aa, Homo Sapiens
ISEDKRKYA

SEQ ID NO: 42480 - protein, 9 aa, Homo Sapiens
PARRKLGLR

SEQ ID NO: 42481 - protein, 9 aa, Homo Sapiens
QEDEEEEEE

SEQ ID NO: 42482 - protein, 9 aa, Homo Sapiens
KAITCPKTG

SEQ ID NO: 42483 - protein, 9 aa, Homo Sapiens
ELHVHELEK

SEQ ID NO: 42484 - protein, 9 aa, Homo Sapiens
QDGEKTRRV

SEQ ID NO: 42485 - protein, 9 aa, Homo Sapiens
SSNKTEFKF

SEQ ID NO: 42486 - protein, 9 aa, Homo Sapiens
NFCSDSCVV

SEQ ID NO: 42487 - protein, 9 aa, Homo Sapiens
FRRLDPFTI

SEQ ID NO: 42488 - protein, 9 aa, Homo Sapiens
PFTIYTLTL

SEQ ID NO: 42489 - protein, 9 aa, Homo Sapiens
KQTLIIEPE

SEQ ID NO: 42490 - protein, 9 aa, Homo Sapiens
CVAMVKRVV

SEQ ID NO: 42491 - protein, 9 aa, Homo Sapiens
PCSSNKTEF

SEQ ID NO: 42492 - protein, 9 aa, Homo Sapiens
DKYSKVPSA

SEQ ID NO: 42493 - protein, 9 aa, Homo Sapiens
QKGKYEGVV

SEQ ID NO: 42494 - protein, 9 aa, Homo Sapiens
SAYRQKKTF

SEQ ID NO: 42495 - protein, 9 aa, Homo Sapiens
KAEAQLEEL

SEQ ID NO: 42496 - protein, 9 aa, Homo Sapiens
CQESQLCNL

SEQ ID NO: 42497 - protein, 9 aa, Homo Sapiens
DVVTPNSLN

SEQ ID NO: 42498 - protein, 9 aa, Homo Sapiens
GNSLVVIYF

SEQ ID NO: 42499 - protein, 9 aa, Homo Sapiens
MKNATVAVD

SEQ ID NO: 42500 - protein, 9 aa, Homo Sapiens
SQKTFKNKQ

SEQ ID NO: 42501 - protein, 9 aa, Homo Sapiens
TEEDEQEDE

SEQ ID NO: 42502 - protein, 9 aa, Homo Sapiens
EDLQKKTND

SEQ ID NO: 42503 - protein, 9 aa, Homo Sapiens
EDSRSSEAA

SEQ ID NO: 42504 - protein, 9 aa, Homo Sapiens
RRNGGQLVS

SEQ ID NO: 42505 - protein, 9 aa, Homo Sapiens
DDVMRSGPW

SEQ ID NO: 42506 - protein, 9 aa, Homo Sapiens
IRNFCSDSC

SEQ ID NO: 42507 - protein, 9 aa, Homo Sapiens
AKQLRRFSM

SEQ ID NO: 42508 - protein, 9 aa, Homo Sapiens
DKIEKVKNA

SEQ ID NO: 42509 - protein, 9 aa, Homo Sapiens
ILEEVKVTK

SEQ ID NO: 42510 - protein, 9 aa, Homo Sapiens
PRLICVAMV

SEQ ID NO: 42511 - protein, 9 aa, Homo Sapiens
NIARGKQDG

SEQ ID NO: 42512 - protein, 9 aa, Homo Sapiens
AITCPKTGH

SEQ ID NO: 42513 - protein, 9 aa, Homo Sapiens
PEFSPEAVD

SEQ ID NO: 42514 - protein, 9 aa, Homo Sapiens
NGMKMTNEP

SEQ ID NO: 42515 - protein, 9 aa, Homo Sapiens
HHLASSCPM

SEQ ID NO: 42516 - protein, 9 aa, Homo Sapiens
KTNSSPSPC

SEQ ID NO: 42517 - protein, 9 aa, Homo Sapiens
DVMRSGPWP

SEQ ID NO: 42518 - protein, 9 aa, Homo Sapiens
QEDHTRVIS

SEQ ID NO: 42519 - protein, 9 aa, Homo Sapiens
VPLNLEKNS

SEQ ID NO: 42520 - protein, 9 aa, Homo Sapiens
AVTYLDLPV

SEQ ID NO: 42521 - protein, 9 aa, Homo Sapiens
LSQSSDENL

SEQ ID NO: 42522 - protein, 9 aa, Homo Sapiens
QIVGAGPKP

SEQ ID NO: 42523 - protein, 9 aa, Homo Sapiens
KEGAPGGNP

SEQ ID NO: 42524 - protein, 9 aa, Homo Sapiens
LNIARGKQD

SEQ ID NO: 42525 - protein, 9 aa, Homo Sapiens
TLSLVGLAK

SEQ ID NO: 42526 - protein, 9 aa, Homo Sapiens
LIWINQEDH

SEQ ID NO: 42527 - protein, 9 aa, Homo Sapiens
APGGNPQAG

SEQ ID NO: 42528 - protein, 9 aa, Homo Sapiens
QKTFKNKQT

SEQ ID NO: 42529 - protein, 9 aa, Homo Sapiens
LDPFTIYTL

SEQ ID NO: 42530 - protein, 9 aa, Homo Sapiens
KREKTQPTG

SEQ ID NO: 42531 - protein, 9 aa, Homo Sapiens
SIRNFCSDS

SEQ ID NO: 42532 - protein, 9 aa, Homo Sapiens
NNMLPLLEV

SEQ ID NO: 42533 - protein, 9 aa, Homo Sapiens
ASVEDTQLC

SEQ ID NO: 42534 - protein, 9 aa, Homo Sapiens
LAVNPEDPN

SEQ ID NO: 42535 - protein, 9 aa, Homo Sapiens
AFDVLAELR

SEQ ID NO: 42536 - protein, 9 aa, Homo Sapiens
LHLVIHADE

SEQ ID NO: 42537 - protein, 9 aa, Homo Sapiens
PLNLEKNSA

SEQ ID NO: 42538 - protein, 9 aa, Homo Sapiens
AKEACRRNG

SEQ ID NO: 42539 - protein, 9 aa, Homo Sapiens
SIHTAASVE

SEQ ID NO: 42540 - protein, 9 aa, Homo Sapiens
GGPCCCHAR

SEQ ID NO: 42541 - protein, 9 aa, Homo Sapiens
TMIKQGLKQ

SEQ ID NO: 42542 - protein, 9 aa, Homo Sapiens
DFLLAYLAW

SEQ ID NO: 42543 - protein, 9 aa, Homo Sapiens
TGDPAIRFP

SEQ ID NO: 42544 - protein, 9 aa, Homo Sapiens
VSLRESQKL

SEQ ID NO: 42545 - protein, 9 aa, Homo Sapiens
FTLIVGELK

SEQ ID NO: 42546 - protein, 9 aa, Homo Sapiens
KHGGDFFAE

SEQ ID NO: 42547 - protein, 9 aa, Homo Sapiens
FTLSLVGLA

SEQ ID NO: 42548 - protein, 9 aa, Homo Sapiens
GEDSRSSEA

SEQ ID NO: 42549 - protein, 9 aa, Homo Sapiens
CPGRDWRTE

SEQ ID NO: 42550 - protein, 9 aa, Homo Sapiens
LQNGLMISL

SEQ ID NO: 42551 - protein, 9 aa, Homo Sapiens
GLTVSLRES

SEQ ID NO: 42552 - protein, 9 aa, Homo Sapiens
AKAFISNAN

SEQ ID NO: 42553 - protein, 9 aa, Homo Sapiens
LKQQLAKEL

SEQ ID NO: 42554 - protein, 9 aa, Homo Sapiens
ACRRNGGQL

SEQ ID NO: 42555 - protein, 9 aa, Homo Sapiens
GAFDVLAEL

SEQ ID NO: 42556 - protein, 9 aa, Homo Sapiens
RASAFGSYF

SEQ ID NO: 42557 - protein, 9 aa, Homo Sapiens
TEEETAVDK

SEQ ID NO: 42558 - protein, 9 aa, Homo Sapiens
AYLAWNTME

SEQ ID NO: 42559 - protein, 9 aa, Homo Sapiens
AQIVGAGPK

SEQ ID NO: 42560 - protein, 9 aa, Homo Sapiens
VNPEDPNVC

SEQ ID NO: 42561 - protein, 9 aa, Homo Sapiens
ICVAMVKRV

SEQ ID NO: 42562 - protein, 9 aa, Homo Sapiens
KQVNIIAKE

SEQ ID NO: 42563 - protein, 9 aa, Homo Sapiens
GPLWLQVWD

SEQ ID NO: 42564 - protein, 9 aa, Homo Sapiens
ALRKAITCP

SEQ ID NO: 42565 - protein, 9 aa, Homo Sapiens
ILQNGMKMT

SEQ ID NO: 42566 - protein, 9 aa, Homo Sapiens
FYFPNIRDA

SEQ ID NO: 42567 - protein, 9 aa, Homo Sapiens
KHFRAERQD

SEQ ID NO: 42568 - protein, 9 aa, Homo Sapiens
QLTTSVPLN

SEQ ID NO: 42569 - protein, 9 aa, Homo Sapiens
VKSPVCSSD

SEQ ID NO: 42570 - protein, 9 aa, Homo Sapiens
DFVRIFHEV

SEQ ID NO: 42571 - protein, 9 aa, Homo Sapiens
DILEMIKNL

SEQ ID NO: 42572 - protein, 9 aa, Homo Sapiens
KMADILEMI

SEQ ID NO: 42573 - protein, 9 aa, Homo Sapiens
TFLIWINQE

SEQ ID NO: 42574 - protein, 9 aa, Homo Sapiens
STEEETAVD

SEQ ID NO: 42575 - protein, 9 aa, Homo Sapiens
KESSLLLIL

SEQ ID NO: 42576 - protein, 9 aa, Homo Sapiens
LILKKLLKR

SEQ ID NO: 42577 - protein, 9 aa, Homo Sapiens
RKAITCPKT

SEQ ID NO: 42578 - protein, 9 aa, Homo Sapiens
STMERGVVS

SEQ ID NO: 42579 - protein, 9 aa, Homo Sapiens
TYLDLPVAI

SEQ ID NO: 42580 - protein, 9 aa, Homo Sapiens
TPNSLNVKK

SEQ ID NO: 42581 - protein, 9 aa, Homo Sapiens
REKTQPTGV

SEQ ID NO: 42582 - protein, 9 aa, Homo Sapiens
GGLKRNALL

SEQ ID NO: 42583 - protein, 9 aa, Homo Sapiens
DTIIMEWMP

SEQ ID NO: 42584 - protein, 9 aa, Homo Sapiens
SSLLLILDK

SEQ ID NO: 42585 - protein, 9 aa, Homo Sapiens
TTGLGNFAF

SEQ ID NO: 42586 - protein, 9 aa, Homo Sapiens
RRKLGLRRS

SEQ ID NO: 42587 - protein, 9 aa, Homo Sapiens
YLAWNTMES

SEQ ID NO: 42588 - protein, 9 aa, Homo Sapiens
LRDFKNNML

SEQ ID NO: 42589 - protein, 9 aa, Homo Sapiens
RKTNSSPSP

SEQ ID NO: 42590 - protein, 9 aa, Homo Sapiens
GYIIKKFTL

SEQ ID NO: 42591 - protein, 9 aa, Homo Sapiens
ADKIEKVKN

SEQ ID NO: 42592 - protein, 9 aa, Homo Sapiens
ILDKDELIH

SEQ ID NO: 42593 - protein, 9 aa, Homo Sapiens
LKRNALLKW

SEQ ID NO: 42594 - protein, 9 aa, Homo Sapiens
EFSPEAVDN

SEQ ID NO: 42595 - protein, 9 aa, Homo Sapiens
GMKMTNEPP

SEQ ID NO: 42596 - protein, 9 aa, Homo Sapiens
GAPGGNPQA

SEQ ID NO: 42597 - protein, 9 aa, Homo Sapiens
LRRFSMATL

SEQ ID NO: 42598 - protein, 9 aa, Homo Sapiens
DVLAELRHL

SEQ ID NO: 42599 - protein, 9 aa, Homo Sapiens
FHEVMGCFS

SEQ ID NO: 42600 - protein, 9 aa, Homo Sapiens
SNRSIQAMN

SEQ ID NO: 42601 - protein, 9 aa, Homo Sapiens
HCTEEDEQE

SEQ ID NO: 42602 - protein, 9 aa, Homo Sapiens
NGLMISLST

SEQ ID NO: 42603 - protein, 9 aa, Homo Sapiens
QIKSKKFRF

SEQ ID NO: 42604 - protein, 9 aa, Homo Sapiens
MERGVVSLF

SEQ ID NO: 42605 - protein, 9 aa, Homo Sapiens
FISNANIGP

SEQ ID NO: 42606 - protein, 9 aa, Homo Sapiens
GNPQAGGEA

SEQ ID NO: 42607 - protein, 9 aa, Homo Sapiens
QLAKELQAP

SEQ ID NO: 42608 - protein, 9 aa, Homo Sapiens
ITYSIVRAS

SEQ ID NO: 42609 - protein, 9 aa, Homo Sapiens
IPIHRAKVP

SEQ ID NO: 42610 - protein, 9 aa, Homo Sapiens
DQIHRLDFI

SEQ ID NO: 42611 - protein, 9 aa, Homo Sapiens
VEEREDQIH

SEQ ID NO: 42612 - protein, 9 aa, Homo Sapiens
DSNGHCTGP

SEQ ID NO: 42613 - protein, 9 aa, Homo Sapiens
DEKDGLTVS

SEQ ID NO: 42614 - protein, 9 aa, Homo Sapiens
YEKKVRLND

SEQ ID NO: 42615 - protein, 9 aa, Homo Sapiens
GGPLWLQVW

SEQ ID NO: 42616 - protein, 9 aa, Homo Sapiens
YSDGHNDSI

SEQ ID NO: 42617 - protein, 9 aa, Homo Sapiens
NANIGPRLT

SEQ ID NO: 42618 - protein, 9 aa, Homo Sapiens
KQDGEKTRR

SEQ ID NO: 42619 - protein, 9 aa, Homo Sapiens
ACFTLIVGE

SEQ ID NO: 42620 - protein, 9 aa, Homo Sapiens
ILEMIKNLF

SEQ ID NO: 42621 - protein, 9 aa, Homo Sapiens
KSQKQVNII

SEQ ID NO: 42622 - protein, 9 aa, Homo Sapiens
PSAAKHIVS

SEQ ID NO: 42623 - protein, 9 aa, Homo Sapiens
VRIFHEVMG

SEQ ID NO: 42624 - protein, 9 aa, Homo Sapiens
CTEEDEQED

SEQ ID NO: 42625 - protein, 9 aa, Homo Sapiens
ISTMERGVV

SEQ ID NO: 42626 - protein, 9 aa, Homo Sapiens
SPVCSSDSN

SEQ ID NO: 42627 - protein, 9 aa, Homo Sapiens
GALRKAITC

SEQ ID NO: 42628 - protein, 9 aa, Homo Sapiens
KIFPMKNAT

SEQ ID NO: 42629 - protein, 9 aa, Homo Sapiens
PVCSSDSNG

SEQ ID NO: 42630 - protein, 9 aa, Homo Sapiens
RSIQAMNIL

SEQ ID NO: 42631 - protein, 9 aa, Homo Sapiens
TIYTLTLEA

SEQ ID NO: 42632 - protein, 9 aa, Homo Sapiens
VCSSDSNGH

SEQ ID NO: 42633 - protein, 9 aa, Homo Sapiens
GLKRNALLK

SEQ ID NO: 42634 - protein, 9 aa, Homo Sapiens
AELHVHELE

SEQ ID NO: 42635 - protein, 9 aa, Homo Sapiens
NFYFPNIRD

SEQ ID NO: 42636 - protein, 9 aa, Homo Sapiens
RKYAVHIAM

SEQ ID NO: 42637 - protein, 9 aa, Homo Sapiens
FLQATLAVN

SEQ ID NO: 42638 - protein, 9 aa, Homo Sapiens
YSIVRASAF

SEQ ID NO: 42639 - protein, 9 aa, Homo Sapiens
EDFVRIFHE

SEQ ID NO: 42640 - protein, 9 aa, Homo Sapiens
QQRKFTSQS

SEQ ID NO: 42641 - protein, 9 aa, Homo Sapiens
SLNVKKFSA

SEQ ID NO: 42642 - protein, 9 aa, Homo Sapiens
LKNSISFQV

SEQ ID NO: 42643 - protein, 9 aa, Homo Sapiens
EEPTTGLGN

SEQ ID NO: 42644 - protein, 9 aa, Homo Sapiens
KKTSGETNN

SEQ ID NO: 42645 - protein, 9 aa, Homo Sapiens
LEDLQKKTN

SEQ ID NO: 42646 - protein, 9 aa, Homo Sapiens
LLVKHGGDF

SEQ ID NO: 42647 - protein, 9 aa, Homo Sapiens
AKIFPMKNA

SEQ ID NO: 42648 - protein, 9 aa, Homo Sapiens
GPWPIVPYS

SEQ ID NO: 42649 - protein, 9 aa, Homo Sapiens
LNDIYTKTD

SEQ ID NO: 42650 - protein, 9 aa, Homo Sapiens
QLCGLHLVI

SEQ ID NO: 42651 - protein, 9 aa, Homo Sapiens
STALGERLC

SEQ ID NO: 42652 - protein, 9 aa, Homo Sapiens
VCACPGRDW

SEQ ID NO: 42653 - protein, 9 aa, Homo Sapiens
YPLILKKLL

SEQ ID NO: 42654 - protein, 9 aa, Homo Sapiens
KTFLIWINQ

SEQ ID NO: 42655 - protein, 9 aa, Homo Sapiens
RGKQDGEKT

SEQ ID NO: 42656 - protein, 9 aa, Homo Sapiens
GGAFDVLAE

SEQ ID NO: 42657 - protein, 9 aa, Homo Sapiens
KFTSQSSRA

SEQ ID NO: 42658 - protein, 9 aa, Homo Sapiens
VSILQNGMK

SEQ ID NO: 42659 - protein, 9 aa, Homo Sapiens
RAKVPPTFQ

SEQ ID NO: 42660 - protein, 9 aa, Homo Sapiens
LGFPCSSNK

SEQ ID NO: 42661 - protein, 9 aa, Homo Sapiens
INQEDHTRV

SEQ ID NO: 42662 - protein, 9 aa, Homo Sapiens
KYPLILKKL

SEQ ID NO: 42663 - protein, 9 aa, Homo Sapiens
PVSILQNGM

SEQ ID NO: 42664 - protein, 9 aa, Homo Sapiens
IKSKKFRFQ

SEQ ID NO: 42665 - protein, 9 aa, Homo Sapiens
MKQKSLWLE

SEQ ID NO: 42666 - protein, 9 aa, Homo Sapiens
NPQAGGEAQ

SEQ ID NO: 42667 - protein, 9 aa, Homo Sapiens
PSAVSRDKY

SEQ ID NO: 42668 - protein, 9 aa, Homo Sapiens
SNKTEFKFD

SEQ ID NO: 42669 - protein, 9 aa, Homo Sapiens
LTMIKQGLK

SEQ ID NO: 42670 - protein, 9 aa, Homo Sapiens
CCHARIPRT

SEQ ID NO: 42671 - protein, 9 aa, Homo Sapiens
WPIVPYSSM

SEQ ID NO: 42672 - protein, 9 aa, Homo Sapiens
CSSDSNGHC

SEQ ID NO: 42673 - protein, 9 aa, Homo Sapiens
VSNRSIQAM

SEQ ID NO: 42674 - protein, 9 aa, Homo Sapiens
GALMITVDG

SEQ ID NO: 42675 - protein, 9 aa, Homo Sapiens
CFTLIVGEL

SEQ ID NO: 42676 - protein, 9 aa, Homo Sapiens
NSLNVKKFS

SEQ ID NO: 42677 - protein, 9 aa, Homo Sapiens
DPESHSPPF

SEQ ID NO: 42678 - protein, 9 aa, Homo Sapiens
VVTPNSLNV

SEQ ID NO: 42679 - protein, 9 aa, Homo Sapiens
KGALRKAIT

SEQ ID NO: 42680 - protein, 9 aa, Homo Sapiens
TFDLQDWTQ

SEQ ID NO: 42681 - protein, 9 aa, Homo Sapiens
GRDWRTEEE

SEQ ID NO: 42682 - protein, 9 aa, Homo Sapiens
LRVFESFYE

SEQ ID NO: 42683 - protein, 9 aa, Homo Sapiens
QRRDAELHV

SEQ ID NO: 42684 - protein, 9 aa, Homo Sapiens
TLIVGELKK

SEQ ID NO: 42685 - protein, 9 aa, Homo Sapiens
TSVPLNLEK

SEQ ID NO: 42686 - protein, 9 aa, Homo Sapiens
NTFNVGCQE

SEQ ID NO: 42687 - protein, 9 aa, Homo Sapiens
VKNAFTKTH

SEQ ID NO: 42688 - protein, 9 aa, Homo Sapiens
KASELTKKK

SEQ ID NO: 42689 - protein, 9 aa, Homo Sapiens
AKQNHDLMH

SEQ ID NO: 42690 - protein, 9 aa, Homo Sapiens
HDLMHRKSP

SEQ ID NO: 42691 - protein, 9 aa, Homo Sapiens
VEVPRCSNA

SEQ ID NO: 42692 - protein, 9 aa, Homo Sapiens
PIHAFHKAL

SEQ ID NO: 42693 - protein, 9 aa, Homo Sapiens
LSPVYYYQV

SEQ ID NO: 42694 - protein, 9 aa, Homo Sapiens
CEVDSPGNE

SEQ ID NO: 42695 - protein, 9 aa, Homo Sapiens
EGQYEGHKA

SEQ ID NO: 42696 - protein, 9 aa, Homo Sapiens
TYHLCSEQL

SEQ ID NO: 42697 - protein, 9 aa, Homo Sapiens
SPVYYYQVE

SEQ ID NO: 42698 - protein, 9 aa, Homo Sapiens
QNHDLMHRK

SEQ ID NO: 42699 - protein, 9 aa, Homo Sapiens
QTLKELFSD

SEQ ID NO: 42700 - protein, 9 aa, Homo Sapiens
HFFQLPEAL

SEQ ID NO: 42701 - protein, 9 aa, Homo Sapiens
LVIMLFDEL

SEQ ID NO: 42702 - protein, 9 aa, Homo Sapiens
VTMTTALRG

SEQ ID NO: 42703 - protein, 9 aa, Homo Sapiens
CCSHVRDYR

SEQ ID NO: 42704 - protein, 9 aa, Homo Sapiens
GGNSAAGRG

SEQ ID NO: 42705 - protein, 9 aa, Homo Sapiens
EGHKAELTE

SEQ ID NO: 42706 - protein, 9 aa, Homo Sapiens
GSRKKGQQY

SEQ ID NO: 42707 - protein, 9 aa, Homo Sapiens
CNFPDYFTY

SEQ ID NO: 42708 - protein, 9 aa, Homo Sapiens
LHETAAPSD

SEQ ID NO: 42709 - protein, 9 aa, Homo Sapiens
YSVHFVNRS

SEQ ID NO: 42710 - protein, 9 aa, Homo Sapiens
KAELTEDQI

SEQ ID NO: 42711 - protein, 9 aa, Homo Sapiens
AVKNLLDLI

SEQ ID NO: 42712 - protein, 9 aa, Homo Sapiens
WGLFTAQTQ

SEQ ID NO: 42713 - protein, 9 aa, Homo Sapiens
FRCCSHVRD

SEQ ID NO: 42714 - protein, 9 aa, Homo Sapiens
RASTSSTHS

SEQ ID NO: 42715 - protein, 9 aa, Homo Sapiens
DLLQGGGNS

SEQ ID NO: 42716 - protein, 9 aa, Homo Sapiens
PNCNFPDYF

SEQ ID NO: 42717 - protein, 9 aa, Homo Sapiens
WPKQTLKEL

SEQ ID NO: 42718 - protein, 9 aa, Homo Sapiens
ADLFRDKVV

SEQ ID NO: 42719 - protein, 9 aa, Homo Sapiens
VDQMDNAKR

SEQ ID NO: 42720 - protein, 9 aa, Homo Sapiens
STSSTHSPL

SEQ ID NO: 42721 - protein, 9 aa, Homo Sapiens
AADLFRDKV

SEQ ID NO: 42722 - protein, 9 aa, Homo Sapiens
EPSNPSMAV

SEQ ID NO: 42723 - protein, 9 aa, Homo Sapiens
GLFTAQTQK

SEQ ID NO: 42724 - protein, 9 aa, Homo Sapiens
NERIYVHRP

SEQ ID NO: 42725 - protein, 9 aa, Homo Sapiens
VPQSPAQKQ

SEQ ID NO: 42726 - protein, 9 aa, Homo Sapiens
NRAEVEQMH

SEQ ID NO: 42727 - protein, 9 aa, Homo Sapiens
ITSEAISQL

SEQ ID NO: 42728 - protein, 9 aa, Homo Sapiens
VAFKSCPCG

SEQ ID NO: 42729 - protein, 9 aa, Homo Sapiens
ISRSMTNST

SEQ ID NO: 42730 - protein, 9 aa, Homo Sapiens
SKCTSFPQD

SEQ ID NO: 42731 - protein, 9 aa, Homo Sapiens
NCNFPDYFT

SEQ ID NO: 42732 - protein, 9 aa, Homo Sapiens
YYHPRNLAG

SEQ ID NO: 42733 - protein, 9 aa, Homo Sapiens
HSKGEARSS

SEQ ID NO: 42734 - protein, 9 aa, Homo Sapiens
EQIRQEIAE

SEQ ID NO: 42735 - protein, 9 aa, Homo Sapiens
LFDELCGPD

SEQ ID NO: 42736 - protein, 9 aa, Homo Sapiens
EGETTKPDV

SEQ ID NO: 42737 - protein, 9 aa, Homo Sapiens
TSFPQDLCV

SEQ ID NO: 42738 - protein, 9 aa, Homo Sapiens
QKRDEEAQQ

SEQ ID NO: 42739 - protein, 9 aa, Homo Sapiens
PKYTEVTEI

SEQ ID NO: 42740 - protein, 9 aa, Homo Sapiens
LGPTNVLLI

SEQ ID NO: 42741 - protein, 9 aa, Homo Sapiens
LQGGGNSAA

SEQ ID NO: 42742 - protein, 9 aa, Homo Sapiens
DHENERIYV

SEQ ID NO: 42743 - protein, 9 aa, Homo Sapiens
YNSRAADLF

SEQ ID NO: 42744 - protein, 9 aa, Homo Sapiens
ERIYVHRPV

SEQ ID NO: 42745 - protein, 9 aa, Homo Sapiens
LNADVQGLQ

SEQ ID NO: 42746 - protein, 9 aa, Homo Sapiens
LNLTLQRKI

SEQ ID NO: 42747 - protein, 9 aa, Homo Sapiens
FRCSSAFLR

SEQ ID NO: 42748 - protein, 9 aa, Homo Sapiens
GFVGLFRTV

SEQ ID NO: 42749 - protein, 9 aa, Homo Sapiens
MLHETAAPS

SEQ ID NO: 42750 - protein, 9 aa, Homo Sapiens
GGPSVISIV

SEQ ID NO: 42751 - protein, 9 aa, Homo Sapiens
KEVMLTEED

SEQ ID NO: 42752 - protein, 9 aa, Homo Sapiens
MIPMTEFRQ

SEQ ID NO: 42753 - protein, 9 aa, Homo Sapiens
YVSTDSAIP

SEQ ID NO: 42754 - protein, 9 aa, Homo Sapiens
AFLRHQRLH

SEQ ID NO: 42755 - protein, 9 aa, Homo Sapiens
ILEQIRQEI

SEQ ID NO: 42756 - protein, 9 aa, Homo Sapiens
MLNADVQGL

SEQ ID NO: 42757 - protein, 9 aa, Homo Sapiens
KRVTSVPHK

SEQ ID NO: 42758 - protein, 9 aa, Homo Sapiens
SSTHSPLPV

SEQ ID NO: 42759 - protein, 9 aa, Homo Sapiens
SKPVPQSPA

SEQ ID NO: 42760 - protein, 9 aa, Homo Sapiens
LFENYVSTD

SEQ ID NO: 42761 - protein, 9 aa, Homo Sapiens
AMSRPGRGE

SEQ ID NO: 42762 - protein, 9 aa, Homo Sapiens
LRFMQEHVL

SEQ ID NO: 42763 - protein, 9 aa, Homo Sapiens
SPLPVFRLL

SEQ ID NO: 42764 - protein, 9 aa, Homo Sapiens
TIVGFPDLM

SEQ ID NO: 42765 - protein, 9 aa, Homo Sapiens
LGLPAMELK

SEQ ID NO: 42766 - protein, 9 aa, Homo Sapiens
PRCSNAKME

SEQ ID NO: 42767 - protein, 9 aa, Homo Sapiens
PCEVDSPGN

SEQ ID NO: 42768 - protein, 9 aa, Homo Sapiens
TNQDVINAM

SEQ ID NO: 42769 - protein, 9 aa, Homo Sapiens
SVQQGSCTC

SEQ ID NO: 42770 - protein, 9 aa, Homo Sapiens
IFPLILSVD

SEQ ID NO: 42771 - protein, 9 aa, Homo Sapiens
EHGSGKRTI

SEQ ID NO: 42772 - protein, 9 aa, Homo Sapiens
IGFVGLFRT

SEQ ID NO: 42773 - protein, 9 aa, Homo Sapiens
QIFSTLLGE

SEQ ID NO: 42774 - protein, 9 aa, Homo Sapiens
GDCQVTLSD

SEQ ID NO: 42775 - protein, 9 aa, Homo Sapiens
WPNCNFPDY

SEQ ID NO: 42776 - protein, 9 aa, Homo Sapiens
FIICLGPTN

SEQ ID NO: 42777 - protein, 9 aa, Homo Sapiens
QPLRFMQEH

SEQ ID NO: 42778 - protein, 9 aa, Homo Sapiens
MPLFVDQMD

SEQ ID NO: 42779 - protein, 9 aa, Homo Sapiens
CTSFPQDLC

SEQ ID NO: 42780 - protein, 9 aa, Homo Sapiens
FVNRSAMFI

SEQ ID NO: 42781 - protein, 9 aa, Homo Sapiens
DFIEEQQAQ

SEQ ID NO: 42782 - protein, 9 aa, Homo Sapiens
LLKATNDKL

SEQ ID NO: 42783 - protein, 9 aa, Homo Sapiens
DEHSRQITP

SEQ ID NO: 42784 - protein, 9 aa, Homo Sapiens
HLCSEQLSS

SEQ ID NO: 42785 - protein, 9 aa, Homo Sapiens
QLVIMLFDE

SEQ ID NO: 42786 - protein, 9 aa, Homo Sapiens
QGQWPKQTL

SEQ ID NO: 42787 - protein, 9 aa, Homo Sapiens
NDKLSVYAA

SEQ ID NO: 42788 - protein, 9 aa, Homo Sapiens
SKGEARSSF

SEQ ID NO: 42789 - protein, 9 aa, Homo Sapiens
FPLILSVDP

SEQ ID NO: 42790 - protein, 9 aa, Homo Sapiens
HGGGGPRSG

SEQ ID NO: 42791 - protein, 9 aa, Homo Sapiens
LPGTMEPPA

SEQ ID NO: 42792 - protein, 9 aa, Homo Sapiens
PLFVDQMDN

SEQ ID NO: 42793 - protein, 9 aa, Homo Sapiens
EIDMLNADV

SEQ ID NO: 42794 - protein, 9 aa, Homo Sapiens
ALERRNLIT

SEQ ID NO: 42795 - protein, 9 aa, Homo Sapiens
ALRGLQSGD

SEQ ID NO: 42796 - protein, 9 aa, Homo Sapiens
TSCANFAMK

SEQ ID NO: 42797 - protein, 9 aa, Homo Sapiens
LVIGCAVSS

SEQ ID NO: 42798 - protein, 9 aa, Homo Sapiens
VLDMVRKEA

SEQ ID NO: 42799 - protein, 9 aa, Homo Sapiens
VYYELNDEH

SEQ ID NO: 42800 - protein, 9 aa, Homo Sapiens
SRQITPQSV

SEQ ID NO: 42801 - protein, 9 aa, Homo Sapiens
VGLFAVLLA

SEQ ID NO: 42802 - protein, 9 aa, Homo Sapiens
RNAALERRN

SEQ ID NO: 42803 - protein, 9 aa, Homo Sapiens
QRKIFLWTF

SEQ ID NO: 42804 - protein, 9 aa, Homo Sapiens
EGAEEIDML

SEQ ID NO: 42805 - protein, 9 aa, Homo Sapiens
QTEDDRPFF

SEQ ID NO: 42806 - protein, 9 aa, Homo Sapiens
PLRFMQEHV

SEQ ID NO: 42807 - protein, 9 aa, Homo Sapiens
QLPEALVFE

SEQ ID NO: 42808 - protein, 9 aa, Homo Sapiens
DVQGLQGDL

SEQ ID NO: 42809 - protein, 9 aa, Homo Sapiens
CANFAMKGK

SEQ ID NO: 42810 - protein, 9 aa, Homo Sapiens
EESSSLLKP

SEQ ID NO: 42811 - protein, 9 aa, Homo Sapiens
IMLFDELCG

SEQ ID NO: 42812 - protein, 9 aa, Homo Sapiens
ANSLTMRLE

SEQ ID NO: 42813 - protein, 9 aa, Homo Sapiens
ERSDRWSPE

SEQ ID NO: 42814 - protein, 9 aa, Homo Sapiens
ATSCANFAM

SEQ ID NO: 42815 - protein, 9 aa, Homo Sapiens
AAREAQGTA

SEQ ID NO: 42816 - protein, 9 aa, Homo Sapiens
CAVSSMALL

SEQ ID NO: 42817 - protein, 9 aa, Homo Sapiens
CLGPTNVLL

SEQ ID NO: 42818 - protein, 9 aa, Homo Sapiens
FYLHCILSF

SEQ ID NO: 42819 - protein, 9 aa, Homo Sapiens
VDQKSADQV

SEQ ID NO: 42820 - protein, 9 aa, Homo Sapiens
ESSEDIDQI

SEQ ID NO: 42821 - protein, 9 aa, Homo Sapiens
PHKHLDGYK

SEQ ID NO: 42822 - protein, 9 aa, Homo Sapiens
NQLVIMLFD

SEQ ID NO: 42823 - protein, 9 aa, Homo Sapiens
LQTEDDRPF

SEQ ID NO: 42824 - protein, 9 aa, Homo Sapiens
GGVDLLIEA

SEQ ID NO: 42825 - protein, 9 aa, Homo Sapiens
FMQEHVLIP

SEQ ID NO: 42826 - protein, 9 aa, Homo Sapiens
YLHCILSFP

SEQ ID NO: 42827 - protein, 9 aa, Homo Sapiens
NVYYELNDE

SEQ ID NO: 42828 - protein, 9 aa, Homo Sapiens
IQGQWPKQT

SEQ ID NO: 42829 - protein, 9 aa, Homo Sapiens
MAVSAQVEA

SEQ ID NO: 42830 - protein, 9 aa, Homo Sapiens
ETSKPVPQS

SEQ ID NO: 42831 - protein, 9 aa, Homo Sapiens
KELGGVDLL

SEQ ID NO: 42832 - protein, 9 aa, Homo Sapiens
VLLAERRVL

SEQ ID NO: 42833 - protein, 9 aa, Homo Sapiens
HRPKDHGGG

SEQ ID NO: 42834 - protein, 9 aa, Homo Sapiens
KIVATYHLC

SEQ ID NO: 42835 - protein, 9 aa, Homo Sapiens
DRWSPEVGC

SEQ ID NO: 42836 - protein, 9 aa, Homo Sapiens
IICLGPTNV

SEQ ID NO: 42837 - protein, 9 aa, Homo Sapiens
KYADAVKNL

SEQ ID NO: 42838 - protein, 9 aa, Homo Sapiens
KNLLDLISS

SEQ ID NO: 42839 - protein, 9 aa, Homo Sapiens
KLAVDQKSA

SEQ ID NO: 42840 - protein, 9 aa, Homo Sapiens
QNRAEVEQM

SEQ ID NO: 42841 - protein, 9 aa, Homo Sapiens
FGFRKPEVT

SEQ ID NO: 42842 - protein, 9 aa, Homo Sapiens
SLEDHENER

SEQ ID NO: 42843 - protein, 9 aa, Homo Sapiens
AQHKRIHSR

SEQ ID NO: 42844 - protein, 9 aa, Homo Sapiens
AGDCQVTLS

SEQ ID NO: 42845 - protein, 9 aa, Homo Sapiens
PMVMMPLFV

SEQ ID NO: 42846 - protein, 9 aa, Homo Sapiens
NPERSDRWS

SEQ ID NO: 42847 - protein, 9 aa, Homo Sapiens
PMLRGRAVT

SEQ ID NO: 42848 - protein, 9 aa, Homo Sapiens
KLPGTMEPP

SEQ ID NO: 42849 - protein, 9 aa, Homo Sapiens
PVPQSPAQK

SEQ ID NO: 42850 - protein, 9 aa, Homo Sapiens
HSPLPVFRL

SEQ ID NO: 42851 - protein, 9 aa, Homo Sapiens
ARNAALERR

SEQ ID NO: 42852 - protein, 9 aa, Homo Sapiens
TTCSTSLLN

SEQ ID NO: 42853 - protein, 9 aa, Homo Sapiens
IGCAVSSMA

SEQ ID NO: 42854 - protein, 9 aa, Homo Sapiens
SPAQKQALH

SEQ ID NO: 42855 - protein, 9 aa, Homo Sapiens
LTTCSTSLL

SEQ ID NO: 42856 - protein, 9 aa, Homo Sapiens
VGLFRTVAI

SEQ ID NO: 42857 - protein, 9 aa, Homo Sapiens
TAMSRPGRG

SEQ ID NO: 42858 - protein, 9 aa, Homo Sapiens
VFCIFIICL

SEQ ID NO: 42859 - protein, 9 aa, Homo Sapiens
GKRTISQSS

SEQ ID NO: 42860 - protein, 9 aa, Homo Sapiens
IRLIMQKQK

SEQ ID NO: 42861 - protein, 9 aa, Homo Sapiens
TVAIVSPFI

SEQ ID NO: 42862 - protein, 9 aa, Homo Sapiens
CQVPLKRLL

SEQ ID NO: 42863 - protein, 9 aa, Homo Sapiens
LNDEHSRQI

SEQ ID NO: 42864 - protein, 9 aa, Homo Sapiens
SQTCESLTI

SEQ ID NO: 42865 - protein, 9 aa, Homo Sapiens
DLMHRKSPS

SEQ ID NO: 42866 - protein, 9 aa, Homo Sapiens
VMMPLFVDQ

SEQ ID NO: 42867 - protein, 9 aa, Homo Sapiens
IHAFHKALE

SEQ ID NO: 42868 - protein, 9 aa, Homo Sapiens
TLQRKIFLW

SEQ ID NO: 42869 - protein, 9 aa, Homo Sapiens
LEEDISRSM

SEQ ID NO: 42870 - protein, 9 aa, Homo Sapiens
VRKFLQTED

SEQ ID NO: 42871 - protein, 9 aa, Homo Sapiens
FVDQMDNAK

SEQ ID NO: 42872 - protein, 9 aa, Homo Sapiens
YMLHETAAP

SEQ ID NO: 42873 - protein, 9 aa, Homo Sapiens
QVRAQNRAE

SEQ ID NO: 42874 - protein, 9 aa, Homo Sapiens
IFIICLGPT

SEQ ID NO: 42875 - protein, 9 aa, Homo Sapiens
QTCESLTIE

SEQ ID NO: 42876 - protein, 9 aa, Homo Sapiens
HPRNLAGIL

SEQ ID NO: 42877 - protein, 9 aa, Homo Sapiens
VMLTEEDVK

SEQ ID NO: 42878 - protein, 9 aa, Homo Sapiens
FTAQTQKKE

SEQ ID NO: 42879 - protein, 9 aa, Homo Sapiens
SMRYFDTAM

SEQ ID NO: 42880 - protein, 9 aa, Homo Sapiens
CILSFPENW

SEQ ID NO: 42881 - protein, 9 aa, Homo Sapiens
EAQQYREQL

SEQ ID NO: 42882 - protein, 9 aa, Homo Sapiens
RYFDTAMSR

SEQ ID NO: 42883 - protein, 9 aa, Homo Sapiens
MEPPASFLS

SEQ ID NO: 42884 - protein, 9 aa, Homo Sapiens
YTEVTEINS

SEQ ID NO: 42885 - protein, 9 aa, Homo Sapiens
DAKQNHDLM

SEQ ID NO: 42886 - protein, 9 aa, Homo Sapiens
RLEGTVVPM

SEQ ID NO: 42887 - protein, 9 aa, Homo Sapiens
ALLNLTLQR

SEQ ID NO: 42888 - protein, 9 aa, Homo Sapiens
DISRSMTNS

SEQ ID NO: 42889 - protein, 9 aa, Homo Sapiens
LSVDPTSKR

SEQ ID NO: 42890 - protein, 9 aa, Homo Sapiens
LFAVLLAER

SEQ ID NO: 42891 - protein, 9 aa, Homo Sapiens
RSAMFIFLM

SEQ ID NO: 42892 - protein, 9 aa, Homo Sapiens
RSYYHPRNL

SEQ ID NO: 42893 - protein, 9 aa, Homo Sapiens
PSVLSHRSL

SEQ ID NO: 42894 - protein, 9 aa, Homo Sapiens
TSSTHSPLP

SEQ ID NO: 42895 - protein, 9 aa, Homo Sapiens
RAQNRAEVE

SEQ ID NO: 42896 - protein, 9 aa, Homo Sapiens
LQRANSDFI

SEQ ID NO: 42897 - protein, 9 aa, Homo Sapiens
QAAAREAQG

SEQ ID NO: 42898 - protein, 9 aa, Homo Sapiens
AVLLAERRV

SEQ ID NO: 42899 - protein, 9 aa, Homo Sapiens
TSVPHKHLD

SEQ ID NO: 42900 - protein, 9 aa, Homo Sapiens
IVGLFAVLL

SEQ ID NO: 42901 - protein, 9 aa, Homo Sapiens
ISKQGNLSC

SEQ ID NO: 42902 - protein, 9 aa, Homo Sapiens
THSPLPVFR

SEQ ID NO: 42903 - protein, 9 aa, Homo Sapiens
CGSRKKGQQ

SEQ ID NO: 42904 - protein, 9 aa, Homo Sapiens
EEIDMLNAD

SEQ ID NO: 42905 - protein, 9 aa, Homo Sapiens
TNDKLSVYA

SEQ ID NO: 42906 - protein, 9 aa, Homo Sapiens
VQQGSCTCV

SEQ ID NO: 42907 - protein, 9 aa, Homo Sapiens
EDHENERIY

SEQ ID NO: 42908 - protein, 9 aa, Homo Sapiens
ALIVEGGPS

SEQ ID NO: 42909 - protein, 9 aa, Homo Sapiens
QYEGHKAEL

SEQ ID NO: 42910 - protein, 9 aa, Homo Sapiens
KQGNLSCQV

SEQ ID NO: 42911 - protein, 9 aa, Homo Sapiens
RFMQEHVLI

SEQ ID NO: 42912 - protein, 9 aa, Homo Sapiens
ENYVSTDSA

SEQ ID NO: 42913 - protein, 9 aa, Homo Sapiens
CAAHSKGEA

SEQ ID NO: 42914 - protein, 9 aa, Homo Sapiens
DLCVQWKNA

SEQ ID NO: 42915 - protein, 9 aa, Homo Sapiens
ENIRLIMQK

SEQ ID NO: 42916 - protein, 9 aa, Homo Sapiens
AFGFRKPEV

SEQ ID NO: 42917 - protein, 9 aa, Homo Sapiens
LVSVGEGET

SEQ ID NO: 42918 - protein, 9 aa, Homo Sapiens
ELLANSLTM

SEQ ID NO: 42919 - protein, 9 aa, Homo Sapiens
LTFQPLRFM

SEQ ID NO: 42920 - protein, 9 aa, Homo Sapiens
RAQNPERSD

SEQ ID NO: 42921 - protein, 9 aa, Homo Sapiens
GPSVISIVL

SEQ ID NO: 42922 - protein, 9 aa, Homo Sapiens
CPSVLSHRS

SEQ ID NO: 42923 - protein, 9 aa, Homo Sapiens
ALAPPASDL

SEQ ID NO: 42924 - protein, 9 aa, Homo Sapiens
LRGLQSGDR

SEQ ID NO: 42925 - protein, 9 aa, Homo Sapiens
ILSFPENWP

SEQ ID NO: 42926 - protein, 9 aa, Homo Sapiens
RKFLQTEDD

SEQ ID NO: 42927 - protein, 9 aa, Homo Sapiens
EFRCCSHVR

SEQ ID NO: 42928 - protein, 9 aa, Homo Sapiens
DIDQIFSTL

SEQ ID NO: 42929 - protein, 9 aa, Homo Sapiens
KNQLVIMLF

SEQ ID NO: 42930 - protein, 9 aa, Homo Sapiens
LMHRKSPSG

SEQ ID NO: 42931 - protein, 9 aa, Homo Sapiens
AQGTAGGWG

SEQ ID NO: 42932 - protein, 9 aa, Homo Sapiens
YSNLVSVGE

SEQ ID NO: 42933 - protein, 9 aa, Homo Sapiens
VDLLQGGGN

SEQ ID NO: 42934 - protein, 9 aa, Homo Sapiens
LYATSCANF

SEQ ID NO: 42935 - protein, 9 aa, Homo Sapiens
ASELTKKKA

SEQ ID NO: 42936 - protein, 9 aa, Homo Sapiens
VTEINSVDA

SEQ ID NO: 42937 - protein, 9 aa, Homo Sapiens
AFKSCPCGY

SEQ ID NO: 42938 - protein, 9 aa, Homo Sapiens
EKYNSRAAD

SEQ ID NO: 42939 - protein, 9 aa, Homo Sapiens
SDRWSPEVG

SEQ ID NO: 42940 - protein, 9 aa, Homo Sapiens
NSRAADLFR

SEQ ID NO: 42941 - protein, 9 aa, Homo Sapiens
RNLAGILKE

SEQ ID NO: 42942 - protein, 9 aa, Homo Sapiens
FPDYFTYSV

SEQ ID NO: 42943 - protein, 9 aa, Homo Sapiens
LGGVDLLIE

SEQ ID NO: 42944 - protein, 9 aa, Homo Sapiens
LLANSLTMR

SEQ ID NO: 42945 - protein, 9 aa, Homo Sapiens
YELNDEHSR

SEQ ID NO: 42946 - protein, 9 aa, Homo Sapiens
NRSAMFIFL

SEQ ID NO: 42947 - protein, 9 aa, Homo Sapiens
SCANFAMKG

SEQ ID NO: 42948 - protein, 9 aa, Homo Sapiens
SMALLTLLA

SEQ ID NO: 42949 - protein, 9 aa, Homo Sapiens
EVMLTEEDV

SEQ ID NO: 42950 - protein, 9 aa, Homo Sapiens
QEFRCCSHV

SEQ ID NO: 42951 - protein, 9 aa, Homo Sapiens
LLQGGGNSA

SEQ ID NO: 42952 - protein, 9 aa, Homo Sapiens
IVATYHLCS

SEQ ID NO: 42953 - protein, 9 aa, Homo Sapiens
LAVDQKSAD

SEQ ID NO: 42954 - protein, 9 aa, Homo Sapiens
MLFDELCGP

SEQ ID NO: 42955 - protein, 9 aa, Homo Sapiens
DPKTEHGSG

SEQ ID NO: 42956 - protein, 9 aa, Homo Sapiens
VRLEGTVVP

SEQ ID NO: 42957 - protein, 9 aa, Homo Sapiens
RQKRDEEAQ

SEQ ID NO: 42958 - protein, 9 aa, Homo Sapiens
KSADQVRNT

SEQ ID NO: 42959 - protein, 9 aa, Homo Sapiens
LEGTVVPML

SEQ ID NO: 42960 - protein, 9 aa, Homo Sapiens
LINKCGSRK

SEQ ID NO: 42961 - protein, 9 aa, Homo Sapiens
HGSGKRTIS

SEQ ID NO: 42962 - protein, 9 aa, Homo Sapiens
EINSVDANY

SEQ ID NO: 42963 - protein, 9 aa, Homo Sapiens
CDQQVPVAF

SEQ ID NO: 42964 - protein, 9 aa, Homo Sapiens
TIALAPPAS

SEQ ID NO: 42965 - protein, 9 aa, Homo Sapiens
DQKSADQVR

SEQ ID NO: 42966 - protein, 9 aa, Homo Sapiens
LRAKEERLN

SEQ ID NO: 42967 - protein, 9 aa, Homo Sapiens
LLIEAVFEE

SEQ ID NO: 42968 - protein, 9 aa, Homo Sapiens
ITHRENIRL

SEQ ID NO: 42969 - protein, 9 aa, Homo Sapiens
CSNAKMEIA

SEQ ID NO: 42970 - protein, 9 aa, Homo Sapiens
LLKPSEMGR

SEQ ID NO: 42971 - protein, 9 aa, Homo Sapiens
NYVLSPVYY

SEQ ID NO: 42972 - protein, 9 aa, Homo Sapiens
QYYMLHETA

SEQ ID NO: 42973 - protein, 9 aa, Homo Sapiens
LEQIRQEIA

SEQ ID NO: 42974 - protein, 9 aa, Homo Sapiens
LSQVRAQNR

SEQ ID NO: 42975 - protein, 9 aa, Homo Sapiens
AISQLHRSL

SEQ ID NO: 42976 - protein, 9 aa, Homo Sapiens
FRKPEVTSA

SEQ ID NO: 42977 - protein, 9 aa, Homo Sapiens
HEDQEFRCC

SEQ ID NO: 42978 - protein, 9 aa, Homo Sapiens
MLTEEDVKF

SEQ ID NO: 42979 - protein, 9 aa, Homo Sapiens
VQEHFFQLP

SEQ ID NO: 42980 - protein, 9 aa, Homo Sapiens
MVRKEAESC

SEQ ID NO: 42981 - protein, 9 aa, Homo Sapiens
NIRLIMQKQ

SEQ ID NO: 42982 - protein, 9 aa, Homo Sapiens
LIVEGGPSV

SEQ ID NO: 42983 - protein, 9 aa, Homo Sapiens
LPEALVFEL

SEQ ID NO: 42984 - protein, 9 aa, Homo Sapiens
IQDLKRRFK

SEQ ID NO: 42985 - protein, 9 aa, Homo Sapiens
IDQIFSTLL

SEQ ID NO: 42986 - protein, 9 aa, Homo Sapiens
KEGAEEIDM

SEQ ID NO: 42987 - protein, 9 aa, Homo Sapiens
SERPCEVDS

SEQ ID NO: 42988 - protein, 9 aa, Homo Sapiens
DKLEEDISR

SEQ ID NO: 42989 - protein, 9 aa, Homo Sapiens
PDYFTYSVL

SEQ ID NO: 42990 - protein, 9 aa, Homo Sapiens
PQSPAQKQA

SEQ ID NO: 42991 - protein, 9 aa, Homo Sapiens
DTAMSRPGR

SEQ ID NO: 42992 - protein, 9 aa, Homo Sapiens
KPVPQSPAQ

SEQ ID NO: 42993 - protein, 9 aa, Homo Sapiens
TAAPSDIVG

SEQ ID NO: 42994 - protein, 9 aa, Homo Sapiens
SSSLLKPSE

SEQ ID NO: 42995 - protein, 9 aa, Homo Sapiens
ELSQVRAQN

SEQ ID NO: 42996 - protein, 9 aa, Homo Sapiens
NLLTTCSTS

SEQ ID NO: 42997 - protein, 9 aa, Homo Sapiens
FCIFIICLG

SEQ ID NO: 42998 - protein, 9 aa, Homo Sapiens
ICLGPTNVL

SEQ ID NO: 42999 - protein, 9 aa, Homo Sapiens
NFPDYFTYS

SEQ ID NO: 43000 - protein, 9 aa, Homo Sapiens
SLLKPSEMG

SEQ ID NO: 43001 - protein, 9 aa, Homo Sapiens
VVEVPRCSN

SEQ ID NO: 43002 - protein, 9 aa, Homo Sapiens
FDTAMSRPG

SEQ ID NO: 43003 - protein, 9 aa, Homo Sapiens
KYTEVTEIN

SEQ ID NO: 43004 - protein, 9 aa, Homo Sapiens
KVDLLQGGG

SEQ ID NO: 43005 - protein, 9 aa, Homo Sapiens
FSLEDHENE

SEQ ID NO: 43006 - protein, 9 aa, Homo Sapiens
GCAVSSMAL

SEQ ID NO: 43007 - protein, 9 aa, Homo Sapiens
KFLQTEDDR

SEQ ID NO: 43008 - protein, 9 aa, Homo Sapiens
NHDLMHRKS

SEQ ID NO: 43009 - protein, 9 aa, Homo Sapiens
VPVAFKSCP

SEQ ID NO: 43010 - protein, 9 aa, Homo Sapiens
VSTDSAIPF

SEQ ID NO: 43011 - protein, 9 aa, Homo Sapiens
EEDCPSVLS

SEQ ID NO: 43012 - protein, 9 aa, Homo Sapiens
PLILSVDPT

SEQ ID NO: 43013 - protein, 9 aa, Homo Sapiens
QWPKQTLKE

SEQ ID NO: 43014 - protein, 9 aa, Homo Sapiens
QKILEQIRQ

SEQ ID NO: 43015 - protein, 9 aa, Homo Sapiens
SPNIQDLKR

SEQ ID NO: 43016 - protein, 9 aa, Homo Sapiens
ASTSSTHSP

SEQ ID NO: 43017 - protein, 9 aa, Homo Sapiens
SSAFLRHQR

SEQ ID NO: 43018 - protein, 9 aa, Homo Sapiens
SEAISQLHR

SEQ ID NO: 43019 - protein, 9 aa, Homo Sapiens
AVDQKSADQ

SEQ ID NO: 43020 - protein, 9 aa, Homo Sapiens
YSERPCEVD

SEQ ID NO: 43021 - protein, 9 aa, Homo Sapiens
EEGQYEGHK

SEQ ID NO: 43022 - protein, 9 aa, Homo Sapiens
TEINSVDAN

SEQ ID NO: 43023 - protein, 9 aa, Homo Sapiens
GGGNSAAGR

SEQ ID NO: 43024 - protein, 9 aa, Homo Sapiens
MELRAKEER

SEQ ID NO: 43025 - protein, 9 aa, Homo Sapiens
EDISRSMTN

SEQ ID NO: 43026 - protein, 9 aa, Homo Sapiens
RAKEERLNK

SEQ ID NO: 43027 - protein, 9 aa, Homo Sapiens
EEAQQYREQ

SEQ ID NO: 43028 - protein, 9 aa, Homo Sapiens
LASLFENYV

SEQ ID NO: 43029 - protein, 9 aa, Homo Sapiens
GAEEIDMLN

SEQ ID NO: 43030 - protein, 9 aa, Homo Sapiens
LILSVDPTS

SEQ ID NO: 43031 - protein, 9 aa, Homo Sapiens
LANSLTMRL

SEQ ID NO: 43032 - protein, 9 aa, Homo Sapiens
AKASELTKK

SEQ ID NO: 43033 - protein, 9 aa, Homo Sapiens
CSSAFLRHQ

SEQ ID NO: 43034 - protein, 9 aa, Homo Sapiens
TMRLENMWQ

SEQ ID NO: 43035 - protein, 9 aa, Homo Sapiens
KPSEMGRGT

SEQ ID NO: 43036 - protein, 9 aa, Homo Sapiens
FQPLRFMQE

SEQ ID NO: 43037 - protein, 9 aa, Homo Sapiens
VLSPVYYYQ

SEQ ID NO: 43038 - protein, 9 aa, Homo Sapiens
VIMLFDELC

SEQ ID NO: 43039 - protein, 9 aa, Homo Sapiens
ESSSLLKPS

SEQ ID NO: 43040 - protein, 9 aa, Homo Sapiens
VDLLIEAVF

SEQ ID NO: 43041 - protein, 9 aa, Homo Sapiens
PGTMEPPAS

SEQ ID NO: 43042 - protein, 9 aa, Homo Sapiens
PKCAAHSKG

SEQ ID NO: 43043 - protein, 9 aa, Homo Sapiens
PVAFKSCPC

SEQ ID NO: 43044 - protein, 9 aa, Homo Sapiens
NSDFIEEQQ

SEQ ID NO: 43045 - protein, 9 aa, Homo Sapiens
HLFYLHCIL

SEQ ID NO: 43046 - protein, 9 aa, Homo Sapiens
KLEEDISRS

SEQ ID NO: 43047 - protein, 9 aa, Homo Sapiens
IEEVINEGL

SEQ ID NO: 43048 - protein, 9 aa, Homo Sapiens
ETAAPSDIV

SEQ ID NO: 43049 - protein, 9 aa, Homo Sapiens
ESLTIEEVI

SEQ ID NO: 43050 - protein, 9 aa, Homo Sapiens
LEEDCPSVL

SEQ ID NO: 43051 - protein, 9 aa, Homo Sapiens
VLINKCGSR

SEQ ID NO: 43052 - protein, 9 aa, Homo Sapiens
TIEEVINEG

SEQ ID NO: 43053 - protein, 9 aa, Homo Sapiens
EKAKASELT

SEQ ID NO: 43054 - protein, 9 aa, Homo Sapiens
YATIVGFPD

SEQ ID NO: 43055 - protein, 9 aa, Homo Sapiens
SKQGNLSCQ

SEQ ID NO: 43056 - protein, 9 aa, Homo Sapiens
QIRQEIAEQ

SEQ ID NO: 43057 - protein, 9 aa, Homo Sapiens
QKSADQVRN

SEQ ID NO: 43058 - protein, 9 aa, Homo Sapiens
FPIHAFHKA

SEQ ID NO: 43059 - protein, 9 aa, Homo Sapiens
AAHSKGEAR

SEQ ID NO: 43060 - protein, 9 aa, Homo Sapiens
PSVISIVLE

SEQ ID NO: 43061 - protein, 9 aa, Homo Sapiens
NLTLQRKIF

SEQ ID NO: 43062 - protein, 9 aa, Homo Sapiens
THRENIRLI

SEQ ID NO: 43063 - protein, 9 aa, Homo Sapiens
FVGLFRTVA

SEQ ID NO: 43064 - protein, 9 aa, Homo Sapiens
GGMFEAGDC

SEQ ID NO: 43065 - protein, 9 aa, Homo Sapiens
DMVRKEAES

SEQ ID NO: 43066 - protein, 9 aa, Homo Sapiens
RCCSHVRDY

SEQ ID NO: 43067 - protein, 9 aa, Homo Sapiens
GEGETTKPD

SEQ ID NO: 43068 - protein, 9 aa, Homo Sapiens
PKSPNIQDL

SEQ ID NO: 43069 - protein, 9 aa, Homo Sapiens
QRANSDFIE

SEQ ID NO: 43070 - protein, 9 aa, Homo Sapiens
CQVTLSDLH

SEQ ID NO: 43071 - protein, 9 aa, Homo Sapiens
RPKDHGGGG

SEQ ID NO: 43072 - protein, 9 aa, Homo Sapiens
SNLVSVGEG

SEQ ID NO: 43073 - protein, 9 aa, Homo Sapiens
LVDSVLDMV

SEQ ID NO: 43074 - protein, 9 aa, Homo Sapiens
YHLCSEQLS

SEQ ID NO: 43075 - protein, 9 aa, Homo Sapiens
LPAMELKVW

SEQ ID NO: 43076 - protein, 9 aa, Homo Sapiens
RELQRANSD

SEQ ID NO: 43077 - protein, 9 aa, Homo Sapiens
NLVTMTTAL

SEQ ID NO: 43078 - protein, 9 aa, Homo Sapiens
DVINAMEQD

SEQ ID NO: 43079 - protein, 9 aa, Homo Sapiens
LQRKIFLWT

SEQ ID NO: 43080 - protein, 9 aa, Homo Sapiens
SDLEQYVNN

SEQ ID NO: 43081 - protein, 9 aa, Homo Sapiens
TPQSVQQGS

SEQ ID NO: 43082 - protein, 9 aa, Homo Sapiens
NSLTMRLEN

SEQ ID NO: 43083 - protein, 9 aa, Homo Sapiens
KRDEEAQQY

SEQ ID NO: 43084 - protein, 9 aa, Homo Sapiens
KGEARSSFS

SEQ ID NO: 43085 - protein, 9 aa, Homo Sapiens
SYYHPRNLA

SEQ ID NO: 43086 - protein, 9 aa, Homo Sapiens
EHSRQITPQ

SEQ ID NO: 43087 - protein, 9 aa, Homo Sapiens
EDDRPFFLY

SEQ ID NO: 43088 - protein, 9 aa, Homo Sapiens
PLSAASPFY

SEQ ID NO: 43089 - protein, 9 aa, Homo Sapiens
LKVDLLQGG

SEQ ID NO: 43090 - protein, 9 aa, Homo Sapiens
EDQEFRCCS

SEQ ID NO: 43091 - protein, 9 aa, Homo Sapiens
MRYFDTAMS

SEQ ID NO: 43092 - protein, 9 aa, Homo Sapiens
IPRPKSPNI

SEQ ID NO: 43093 - protein, 9 aa, Homo Sapiens
NIQDLKRRF

SEQ ID NO: 43094 - protein, 9 aa, Homo Sapiens
LFYLHCILS

SEQ ID NO: 43095 - protein, 9 aa, Homo Sapiens
SVLSHRSLD

SEQ ID NO: 43096 - protein, 9 aa, Homo Sapiens
NDEHSRQIT

SEQ ID NO: 43097 - protein, 9 aa, Homo Sapiens
NFPIHAFHK

SEQ ID NO: 43098 - protein, 9 aa, Homo Sapiens
VATYHLCSE

SEQ ID NO: 43099 - protein, 9 aa, Homo Sapiens
QVPVAFKSC

SEQ ID NO: 43100 - protein, 9 aa, Homo Sapiens
YLRSYYHPR

SEQ ID NO: 43101 - protein, 9 aa, Homo Sapiens
FLQTEDDRP

SEQ ID NO: 43102 - protein, 9 aa, Homo Sapiens
TSEAISQLH

SEQ ID NO: 43103 - protein, 9 aa, Homo Sapiens
HRENIRLIM

SEQ ID NO: 43104 - protein, 9 aa, Homo Sapiens
ANSDFIEEQ

SEQ ID NO: 43105 - protein, 9 aa, Homo Sapiens
YNFPIHAFH

SEQ ID NO: 43106 - protein, 9 aa, Homo Sapiens
ATYHLCSEQ

SEQ ID NO: 43107 - protein, 9 aa, Homo Sapiens
TSLLNSPPS

SEQ ID NO: 43108 - protein, 9 aa, Homo Sapiens
TEVTEINSV

SEQ ID NO: 43109 - protein, 9 aa, Homo Sapiens
QQVPVAFKS

SEQ ID NO: 43110 - protein, 9 aa, Homo Sapiens
HENERIYVH

SEQ ID NO: 43111 - protein, 9 aa, Homo Sapiens
TEKLPGTME

SEQ ID NO: 43112 - protein, 9 aa, Homo Sapiens
RPCEVDSPG

SEQ ID NO: 43113 - protein, 9 aa, Homo Sapiens
TRLSKEVML

SEQ ID NO: 43114 - protein, 9 aa, Homo Sapiens
LHCILSFPE

SEQ ID NO: 43115 - protein, 9 aa, Homo Sapiens
PIVMPLSAA

SEQ ID NO: 43116 - protein, 9 aa, Homo Sapiens
KAKASELTK

SEQ ID NO: 43117 - protein, 9 aa, Homo Sapiens
PVYYYQVEA

SEQ ID NO: 43118 - protein, 9 aa, Homo Sapiens
SLSARNAAL

SEQ ID NO: 43119 - protein, 9 aa, Homo Sapiens
SDFIEEQQA

SEQ ID NO: 43120 - protein, 9 aa, Homo Sapiens
ATIVGFPDL

SEQ ID NO: 43121 - protein, 9 aa, Homo Sapiens
IDMLNADVQ

SEQ ID NO: 43122 - protein, 9 aa, Homo Sapiens
KILEQIRQE

SEQ ID NO: 43123 - protein, 9 aa, Homo Sapiens
GTMEPPASF

SEQ ID NO: 43124 - protein, 9 aa, Homo Sapiens
ELVDSVLDM

SEQ ID NO: 43125 - protein, 9 aa, Homo Sapiens
VSSMALLTL

SEQ ID NO: 43126 - protein, 9 aa, Homo Sapiens
QDVINAMEQ

SEQ ID NO: 43127 - protein, 9 aa, Homo Sapiens
NPSMAVSAQ

SEQ ID NO: 43128 - protein, 9 aa, Homo Sapiens
EDCPSVLSH

SEQ ID NO: 43129 - protein, 9 aa, Homo Sapiens
AQNRAEVEQ

SEQ ID NO: 43130 - protein, 9 aa, Homo Sapiens
VRAQNRAEV

SEQ ID NO: 43131 - protein, 9 aa, Homo Sapiens
KDHGGGGPR

SEQ ID NO: 43132 - protein, 9 aa, Homo Sapiens
VEGGPSVIS

SEQ ID NO: 43133 - protein, 9 aa, Homo Sapiens
AQNPERSDR

SEQ ID NO: 43134 - protein, 9 aa, Homo Sapiens
SRKKGQQYD

SEQ ID NO: 43135 - protein, 9 aa, Homo Sapiens
HMVVEVPRC

SEQ ID NO: 43136 - protein, 9 aa, Homo Sapiens
DQIFSTLLG

SEQ ID NO: 43137 - protein, 9 aa, Homo Sapiens
PAMELKVWV

SEQ ID NO: 43138 - protein, 9 aa, Homo Sapiens
MEQDYRLPP

SEQ ID NO: 43139 - protein, 9 aa, Homo Sapiens
DCPSVLSHR

SEQ ID NO: 43140 - protein, 9 aa, Homo Sapiens
PRNLAGILK

SEQ ID NO: 43141 - protein, 9 aa, Homo Sapiens
LSKEVMLTE

SEQ ID NO: 43142 - protein, 9 aa, Homo Sapiens
IVGFPDLMS

SEQ ID NO: 43143 - protein, 9 aa, Homo Sapiens
EKLPGTMEP

SEQ ID NO: 43144 - protein, 9 aa, Homo Sapiens
AKEERLNKL

SEQ ID NO: 43145 - protein, 9 aa, Homo Sapiens
DEEAQQYRE

SEQ ID NO: 43146 - protein, 9 aa, Homo Sapiens
SEDIDQIFS

SEQ ID NO: 43147 - protein, 9 aa, Homo Sapiens
MQEHVLIPV

SEQ ID NO: 43148 - protein, 9 aa, Homo Sapiens
SLTMRLENM

SEQ ID NO: 43149 - protein, 9 aa, Homo Sapiens
INAMEQDYR

SEQ ID NO: 43150 - protein, 9 aa, Homo Sapiens
GLPAMELKV

SEQ ID NO: 43151 - protein, 9 aa, Homo Sapiens
CSTSLLNSP

SEQ ID NO: 43152 - protein, 9 aa, Homo Sapiens
YEGHKAELT

SEQ ID NO: 43153 - protein, 9 aa, Homo Sapiens
YYMLHETAA

SEQ ID NO: 43154 - protein, 9 aa, Homo Sapiens
LKPSEMGRG

SEQ ID NO: 43155 - protein, 9 aa, Homo Sapiens
VSVGEGETT

SEQ ID NO: 43156 - protein, 9 aa, Homo Sapiens
FFQLPEALV

SEQ ID NO: 43157 - protein, 9 aa, Homo Sapiens
SVKIVATYH

SEQ ID NO: 43158 - protein, 9 aa, Homo Sapiens
RDEEAQQYR

SEQ ID NO: 43159 - protein, 9 aa, Homo Sapiens
QQKILEQIR

SEQ ID NO: 43160 - protein, 9 aa, Homo Sapiens
AMEQDYRLP

SEQ ID NO: 43161 - protein, 9 aa, Homo Sapiens
ASDLEQYVN

SEQ ID NO: 43162 - protein, 9 aa, Homo Sapiens
IKRVTSVPH

SEQ ID NO: 43163 - protein, 9 aa, Homo Sapiens
VKIVATYHL

SEQ ID NO: 43164 - protein, 9 aa, Homo Sapiens
LIEAVFEEM

SEQ ID NO: 43165 - protein, 9 aa, Homo Sapiens
SELTKKKAS

SEQ ID NO: 43166 - protein, 9 aa, Homo Sapiens
LTKKKASAL

SEQ ID NO: 43167 - protein, 9 aa, Homo Sapiens
VPHKHLDGY

SEQ ID NO: 43168 - protein, 9 aa, Homo Sapiens
LLLKATNDK

SEQ ID NO: 43169 - protein, 9 aa, Homo Sapiens
VDSPGNETW

SEQ ID NO: 43170 - protein, 9 aa, Homo Sapiens
ENIVGLFAV

SEQ ID NO: 43171 - protein, 9 aa, Homo Sapiens
TAQTQKKEE

SEQ ID NO: 43172 - protein, 9 aa, Homo Sapiens
SFPQDLCVQ

SEQ ID NO: 43173 - protein, 9 aa, Homo Sapiens
LLGLPAMEL

SEQ ID NO: 43174 - protein, 9 aa, Homo Sapiens
LWGLFTAQT

SEQ ID NO: 43175 - protein, 9 aa, Homo Sapiens
VYYYQVEAW

SEQ ID NO: 43176 - protein, 9 aa, Homo Sapiens
AVSSMALLT

SEQ ID NO: 43177 - protein, 9 aa, Homo Sapiens
CIFIICLGP

SEQ ID NO: 43178 - protein, 9 aa, Homo Sapiens
TQKKEESTE

SEQ ID NO: 43179 - protein, 9 aa, Homo Sapiens
VHFVNRSAM

SEQ ID NO: 43180 - protein, 9 aa, Homo Sapiens
PQSVQQGSC

SEQ ID NO: 43181 - protein, 9 aa, Homo Sapiens
VDPTSKREQ

SEQ ID NO: 43182 - protein, 9 aa, Homo Sapiens
ELNDEHSRQ

SEQ ID NO: 43183 - protein, 9 aa, Homo Sapiens
IALAPPASD

SEQ ID NO: 43184 - protein, 9 aa, Homo Sapiens
SQLHRSLES

SEQ ID NO: 43185 - protein, 9 aa, Homo Sapiens
RPKSPNIQD

SEQ ID NO: 43186 - protein, 9 aa, Homo Sapiens
YVLSPVYYY

SEQ ID NO: 43187 - protein, 9 aa, Homo Sapiens
EHFFQLPEA

SEQ ID NO: 43188 - protein, 9 aa, Homo Sapiens
YADAVKNLL

SEQ ID NO: 43189 - protein, 9 aa, Homo Sapiens
STHSPLPVF

SEQ ID NO: 43190 - protein, 9 aa, Homo Sapiens
IRQEIAEQK

SEQ ID NO: 43191 - protein, 9 aa, Homo Sapiens
STSLLNSPP

SEQ ID NO: 43192 - protein, 9 aa, Homo Sapiens
QGNLSCQVP

SEQ ID NO: 43193 - protein, 9 aa, Homo Sapiens
LTEEDVKFY

SEQ ID NO: 43194 - protein, 9 aa, Homo Sapiens
HKALEQQEA

SEQ ID NO: 43195 - protein, 9 aa, Homo Sapiens
TCESLTIEE

SEQ ID NO: 43196 - protein, 9 aa, Homo Sapiens
PRPKSPNIQ

SEQ ID NO: 43197 - protein, 9 aa, Homo Sapiens
SLTIEEVIN

SEQ ID NO: 43198 - protein, 9 aa, Homo Sapiens
VPMLRGRAV

SEQ ID NO: 43199 - protein, 9 aa, Homo Sapiens
ELGGVDLLI

SEQ ID NO: 43200 - protein, 9 aa, Homo Sapiens
KYNSRAADL

SEQ ID NO: 43201 - protein, 9 aa, Homo Sapiens
TFQPLRFMQ

SEQ ID NO: 43202 - protein, 9 aa, Homo Sapiens
IVEGGPSVI

SEQ ID NO: 43203 - protein, 9 aa, Homo Sapiens
MEKLAVDQK

SEQ ID NO: 43204 - protein, 9 aa, Homo Sapiens
GLLLKATND

SEQ ID NO: 43205 - protein, 9 aa, Homo Sapiens
KEERLNKLR

SEQ ID NO: 43206 - protein, 9 aa, Homo Sapiens
CSHVRDYRK

SEQ ID NO: 43207 - protein, 9 aa, Homo Sapiens
TMEPPASFL

SEQ ID NO: 43208 - protein, 9 aa, Homo Sapiens
SAMFIFLMY

SEQ ID NO: 43209 - protein, 9 aa, Homo Sapiens
ADVQGLQGD

SEQ ID NO: 43210 - protein, 9 aa, Homo Sapiens
KITSEAISQ

SEQ ID NO: 43211 - protein, 9 aa, Homo Sapiens
FENYVSTDS

SEQ ID NO: 43212 - protein, 9 aa, Homo Sapiens
EGGPSVISI

SEQ ID NO: 43213 - protein, 9 aa, Homo Sapiens
LLNLTLQRK

SEQ ID NO: 43214 - protein, 9 aa, Homo Sapiens
SVGEGETTK

SEQ ID NO: 43215 - protein, 9 aa, Homo Sapiens
TTALRGLQS

SEQ ID NO: 43216 - protein, 9 aa, Homo Sapiens
LSARNAALE

SEQ ID NO: 43217 - protein, 9 aa, Homo Sapiens
APAFGFRKP

SEQ ID NO: 43218 - protein, 9 aa, Homo Sapiens
REAQGTAGG

SEQ ID NO: 43219 - protein, 9 aa, Homo Sapiens
GFRKPEVTS

SEQ ID NO: 43220 - protein, 9 aa, Homo Sapiens
KQNHDLMHR

SEQ ID NO: 43221 - protein, 9 aa, Homo Sapiens
PMTEFRQFS

SEQ ID NO: 43222 - protein, 9 aa, Homo Sapiens
VGEGETTKP

SEQ ID NO: 43223 - protein, 9 aa, Homo Sapiens
YHPRNLAGI

SEQ ID NO: 43224 - protein, 9 aa, Homo Sapiens
KQTLKELFS

SEQ ID NO: 43225 - protein, 9 aa, Homo Sapiens
RQITPQSVQ

SEQ ID NO: 43226 - protein, 9 aa, Homo Sapiens
FHKALEQQE

SEQ ID NO: 43227 - protein, 9 aa, Homo Sapiens
VPRCSNAKM

SEQ ID NO: 43228 - protein, 9 aa, Homo Sapiens
KCAAHSKGE

SEQ ID NO: 43229 - protein, 9 aa, Homo Sapiens
EAQGTAGGW

SEQ ID NO: 43230 - protein, 9 aa, Homo Sapiens
THLFYLHCI

SEQ ID NO: 43231 - protein, 9 aa, Homo Sapiens
TEHGSGKRT

SEQ ID NO: 43232 - protein, 9 aa, Homo Sapiens
IPMTEFRQF

SEQ ID NO: 43233 - protein, 9 aa, Homo Sapiens
VRQKRDEEA

SEQ ID NO: 43234 - protein, 9 aa, Homo Sapiens
FKSCPCGYI

SEQ ID NO: 43235 - protein, 9 aa, Homo Sapiens
QITPQSVQQ

SEQ ID NO: 43236 - protein, 9 aa, Homo Sapiens
RKPEVTSAA

SEQ ID NO: 43237 - protein, 9 aa, Homo Sapiens
SCQVPLKRL

SEQ ID NO: 43238 - protein, 9 aa, Homo Sapiens
RCSNAKMEI

SEQ ID NO: 43239 - protein, 9 aa, Homo Sapiens
TEDDRPFFL

SEQ ID NO: 43240 - protein, 9 aa, Homo Sapiens
LTIEEVINE

SEQ ID NO: 43241 - protein, 9 aa, Homo Sapiens
DLLIEAVFE

SEQ ID NO: 43242 - protein, 9 aa, Homo Sapiens
MHRKSPSGP

SEQ ID NO: 43243 - protein, 9 aa, Homo Sapiens
VVLINKCGS

SEQ ID NO: 43244 - protein, 9 aa, Homo Sapiens
SRSMTNSTA

SEQ ID NO: 43245 - protein, 9 aa, Homo Sapiens
SRAADLFRD

SEQ ID NO: 43246 - protein, 9 aa, Homo Sapiens
WKITSEAIS

SEQ ID NO: 43247 - protein, 9 aa, Homo Sapiens
NADVQGLQG

SEQ ID NO: 43248 - protein, 9 aa, Homo Sapiens
NLLDLISSS

SEQ ID NO: 43249 - protein, 9 aa, Homo Sapiens
LTLQRKIFL

SEQ ID NO: 43250 - protein, 9 aa, Homo Sapiens
EQQKILEQI

SEQ ID NO: 43251 - protein, 9 aa, Homo Sapiens
ATNDKLSVY

SEQ ID NO: 43252 - protein, 9 aa, Homo Sapiens
NYVSTDSAI

SEQ ID NO: 43253 - protein, 9 aa, Homo Sapiens
HCILSFPEN

SEQ ID NO: 43254 - protein, 9 aa, Homo Sapiens
SLFENYVST

SEQ ID NO: 43255 - protein, 9 aa, Homo Sapiens
LFVDQMDNA

SEQ ID NO: 43256 - protein, 9 aa, Homo Sapiens
MTTALRGLQ

SEQ ID NO: 43257 - protein, 9 aa, Homo Sapiens
HFVNRSAMF

SEQ ID NO: 43258 - protein, 9 aa, Homo Sapiens
MVVEVPRCS

SEQ ID NO: 43259 - protein, 9 aa, Homo Sapiens
ELRAKEERL

SEQ ID NO: 43260 - protein, 9 aa, Homo Sapiens
NAMEQDYRL

SEQ ID NO: 43261 - protein, 9 aa, Homo Sapiens
VSSHRPKDH

SEQ ID NO: 43262 - protein, 9 aa, Homo Sapiens
DSVLDMVRK

SEQ ID NO: 43263 - protein, 9 aa, Homo Sapiens
TSKPVPQSP

SEQ ID NO: 43264 - protein, 9 aa, Homo Sapiens
KTEHGSGKR

SEQ ID NO: 43265 - protein, 9 aa, Homo Sapiens
AAAREAQGT

SEQ ID NO: 43266 - protein, 9 aa, Homo Sapiens
CESLTIEEV

SEQ ID NO: 43267 - protein, 9 aa, Homo Sapiens
CPIVMPLSA

SEQ ID NO: 43268 - protein, 9 aa, Homo Sapiens
DYFTYSVLL

SEQ ID NO: 43269 - protein, 9 aa, Homo Sapiens
HPLEEDCPS

SEQ ID NO: 43270 - protein, 9 aa, Homo Sapiens
QSVQQGSCT

SEQ ID NO: 43271 - protein, 9 aa, Homo Sapiens
TKKKASALL

SEQ ID NO: 43272 - protein, 9 aa, Homo Sapiens
KSPNIQDLK

SEQ ID NO: 43273 - protein, 9 aa, Homo Sapiens
SARNAALER

SEQ ID NO: 43274 - protein, 9 aa, Homo Sapiens
EVPRCSNAK

SEQ ID NO: 43275 - protein, 9 aa, Homo Sapiens
SAPAFGFRK

SEQ ID NO: 43276 - protein, 9 aa, Homo Sapiens
SQVRAQNRA

SEQ ID NO: 43277 - protein, 9 aa, Homo Sapiens
ISQLHRSLE

SEQ ID NO: 43278 - protein, 9 aa, Homo Sapiens
QGGGNSAAG

SEQ ID NO: 43279 - protein, 9 aa, Homo Sapiens
LIKRVTSVP

SEQ ID NO: 43280 - protein, 9 aa, Homo Sapiens
ICPIVMPLS

SEQ ID NO: 43281 - protein, 9 aa, Homo Sapiens
SGKRTISQS

SEQ ID NO: 43282 - protein, 9 aa, Homo Sapiens
NLVSVGEGE

SEQ ID NO: 43283 - protein, 9 aa, Homo Sapiens
LEESSSLLK

SEQ ID NO: 43284 - protein, 9 aa, Homo Sapiens
SSEDIDQIF

SEQ ID NO: 43285 - protein, 9 aa, Homo Sapiens
PQDLCVQWK

SEQ ID NO: 43286 - protein, 9 aa, Homo Sapiens
KCGSRKKGQ

SEQ ID NO: 43287 - protein, 9 aa, Homo Sapiens
LFTAQTQKK

SEQ ID NO: 43288 - protein, 9 aa, Homo Sapiens
DLFRDKVVA

SEQ ID NO: 43289 - protein, 9 aa, Homo Sapiens
NIVGLFAVL

SEQ ID NO: 43290 - protein, 9 aa, Homo Sapiens
GVDLLIEAV

SEQ ID NO: 43291 - protein, 9 aa, Homo Sapiens
AQTQKKEES

SEQ ID NO: 43292 - protein, 9 aa, Homo Sapiens
GQWPKQTLK

SEQ ID NO: 43293 - protein, 9 aa, Homo Sapiens
SSHRPKDHG

SEQ ID NO: 43294 - protein, 9 aa, Homo Sapiens
PIFPLILSV

SEQ ID NO: 43295 - protein, 9 aa, Homo Sapiens
SVISIVLEY

SEQ ID NO: 43296 - protein, 9 aa, Homo Sapiens
MPLSAASPF

SEQ ID NO: 43297 - protein, 9 aa, Homo Sapiens
GQYEGHKAE

SEQ ID NO: 43298 - protein, 9 aa, Homo Sapiens
EYSERPCEV

SEQ ID NO: 43299 - protein, 9 aa, Homo Sapiens
LLDLISSSG

SEQ ID NO: 43300 - protein, 9 aa, Homo Sapiens
YYELNDEHS

SEQ ID NO: 43301 - protein, 9 aa, Homo Sapiens
TICPIVMPL

SEQ ID NO: 43302 - protein, 9 aa, Homo Sapiens
HKAELTEDQ

SEQ ID NO: 43303 - protein, 9 aa, Homo Sapiens
SSLLKPSEM

SEQ ID NO: 43304 - protein, 9 aa, Homo Sapiens
PWPNCNFPD

SEQ ID NO: 43305 - protein, 9 aa, Homo Sapiens
VTSVPHKHL

SEQ ID NO: 43306 - protein, 9 aa, Homo Sapiens
PKTEHGSGK

SEQ ID NO: 43307 - protein, 9 aa, Homo Sapiens
SAFLRHQRL

SEQ ID NO: 43308 - protein, 9 aa, Homo Sapiens
VINAMEQDY

SEQ ID NO: 43309 - protein, 9 aa, Homo Sapiens
MLLGLPAME

SEQ ID NO: 43310 - protein, 9 aa, Homo Sapiens
LKATNDKLS

SEQ ID NO: 43311 - protein, 9 aa, Homo Sapiens
EGTVVPMLR

SEQ ID NO: 43312 - protein, 9 aa, Homo Sapiens
DMLNADVQG

SEQ ID NO: 43313 - protein, 9 aa, Homo Sapiens
TMTTALRGL

SEQ ID NO: 43314 - protein, 9 aa, Homo Sapiens
EDIDQIFST

SEQ ID NO: 43315 - protein, 9 aa, Homo Sapiens
PLEEDCPSV

SEQ ID NO: 43316 - protein, 9 aa, Homo Sapiens
VITHRENIR

SEQ ID NO: 43317 - protein, 9 aa, Homo Sapiens
AALERRNLI

SEQ ID NO: 43318 - protein, 9 aa, Homo Sapiens
AFHKALEQQ

SEQ ID NO: 43319 - protein, 9 aa, Homo Sapiens
FQLPEALVF

SEQ ID NO: 43320 - protein, 9 aa, Homo Sapiens
FLRHQRLHA

SEQ ID NO: 43321 - protein, 9 aa, Homo Sapiens
ATICPIVMP

SEQ ID NO: 43322 - protein, 9 aa, Homo Sapiens
SMAVSAQVE

SEQ ID NO: 43323 - protein, 9 aa, Homo Sapiens
FAVLLAERR

SEQ ID NO: 43324 - protein, 9 aa, Homo Sapiens
ELTKKKASA

SEQ ID NO: 43325 - protein, 9 aa, Homo Sapiens
LAPPASDLE

SEQ ID NO: 43326 - protein, 9 aa, Homo Sapiens
TVVPMLRGR

SEQ ID NO: 43327 - protein, 9 aa, Homo Sapiens
ILSVDPTSK

SEQ ID NO: 43328 - protein, 9 aa, Homo Sapiens
MTEFRQFSE

SEQ ID NO: 43329 - protein, 9 aa, Homo Sapiens
RCSSAFLRH

SEQ ID NO: 43330 - protein, 9 aa, Homo Sapiens
PAFGFRKPE

SEQ ID NO: 43331 - protein, 9 aa, Homo Sapiens
PASDLEQYV

SEQ ID NO: 43332 - protein, 9 aa, Homo Sapiens
QVITHRENI

SEQ ID NO: 43333 - protein, 9 aa, Homo Sapiens
ANFAMKGKR

SEQ ID NO: 43334 - protein, 9 aa, Homo Sapiens
GTVVPMLRG

SEQ ID NO: 43335 - protein, 9 aa, Homo Sapiens
LEDHENERI

SEQ ID NO: 43336 - protein, 9 aa, Homo Sapiens
RSDRWSPEV

SEQ ID NO: 43337 - protein, 9 aa, Homo Sapiens
HSRQITPQS

SEQ ID NO: 43338 - protein, 9 aa, Homo Sapiens
SVDPTSKRE

SEQ ID NO: 43339 - protein, 9 aa, Homo Sapiens
QGTAGGWGV

SEQ ID NO: 43340 - protein, 9 aa, Homo Sapiens
MVMMPLFVD

SEQ ID NO: 43341 - protein, 9 aa, Homo Sapiens
SVHFVNRSA

SEQ ID NO: 43342 - protein, 9 aa, Homo Sapiens
PKDHGGGGP

SEQ ID NO: 43343 - protein, 9 aa, Homo Sapiens
DHGGGGPRS

SEQ ID NO: 43344 - protein, 9 aa, Homo Sapiens
ITPQSVQQG

SEQ ID NO: 43345 - protein, 9 aa, Homo Sapiens
ASLFENYVS

SEQ ID NO: 43346 - protein, 9 aa, Homo Sapiens
GEARSSFSQ

SEQ ID NO: 43347 - protein, 9 aa, Homo Sapiens
AEEIDMLNA

SEQ ID NO: 43348 - protein, 9 aa, Homo Sapiens
RANSDFIEE

SEQ ID NO: 43349 - protein, 9 aa, Homo Sapiens
RTVAIVSPF

SEQ ID NO: 43350 - protein, 9 aa, Homo Sapiens
AQQYREQLE

SEQ ID NO: 43351 - protein, 9 aa, Homo Sapiens
PERSDRWSP

SEQ ID NO: 43352 - protein, 9 aa, Homo Sapiens
NQDVINAME

SEQ ID NO: 43353 - protein, 9 aa, Homo Sapiens
QEHFFQLPE

SEQ ID NO: 43354 - protein, 9 aa, Homo Sapiens
AAPSDIVGA

SEQ ID NO: 43355 - protein, 9 aa, Homo Sapiens
ADAVKNLLD

SEQ ID NO: 43356 - protein, 9 aa, Homo Sapiens
KCTSFPQDL

SEQ ID NO: 43357 - protein, 9 aa, Homo Sapiens
LLTTCSTSL

SEQ ID NO: 43358 - protein, 9 aa, Homo Sapiens
QDLCVQWKN

SEQ ID NO: 43359 - protein, 9 aa, Homo Sapiens
NLSCQVPLK

SEQ ID NO: 43360 - protein, 9 aa, Homo Sapiens
IFSTLLGEM

SEQ ID NO: 43361 - protein, 9 aa, Homo Sapiens
SVLDMVRKE

SEQ ID NO: 43362 - protein, 9 aa, Homo Sapiens
APPASDLEQ

SEQ ID NO: 43363 - protein, 9 aa, Homo Sapiens
SHRPKDHGG

SEQ ID NO: 43364 - protein, 9 aa, Homo Sapiens
LVTMTTALR

SEQ ID NO: 43365 - protein, 9 aa, Homo Sapiens
FEAGDCQVT

SEQ ID NO: 43366 - protein, 9 aa, Homo Sapiens
TALRGLQSG

SEQ ID NO: 43367 - protein, 9 aa, Homo Sapiens
YFDTAMSRP

SEQ ID NO: 43368 - protein, 9 aa, Homo Sapiens
GLFAVLLAE

SEQ ID NO: 43369 - protein, 9 aa, Homo Sapiens
ERPCEVDSP

SEQ ID NO: 43370 - protein, 9 aa, Homo Sapiens
LTMRLENMW

SEQ ID NO: 43371 - protein, 9 aa, Homo Sapiens
QSPAQKQAL

SEQ ID NO: 43372 - protein, 9 aa, Homo Sapiens
MRLENMWQE

SEQ ID NO: 43373 - protein, 9 aa, Homo Sapiens
INKCGSRKK

SEQ ID NO: 43374 - protein, 9 aa, Homo Sapiens
MFEAGDCQV

SEQ ID NO: 43375 - protein, 9 aa, Homo Sapiens
EAISQLHRS

SEQ ID NO: 43376 - protein, 9 aa, Homo Sapiens
GMFEAGDCQ

SEQ ID NO: 43377 - protein, 9 aa, Homo Sapiens
SSMALLTLL

SEQ ID NO: 43378 - protein, 9 aa, Homo Sapiens
DQEFRCCSH

SEQ ID NO: 43379 - protein, 9 aa, Homo Sapiens
PPASDLEQY

SEQ ID NO: 43380 - protein, 9 aa, Homo Sapiens
EKLAVDQKS

SEQ ID NO: 43381 - protein, 9 aa, Homo Sapiens
YATSCANFA

SEQ ID NO: 43382 - protein, 9 aa, Homo Sapiens
KNYATIVGF

SEQ ID NO: 43383 - protein, 9 aa, Homo Sapiens
MLNYVLSPV

SEQ ID NO: 43384 - protein, 9 aa, Homo Sapiens
DQQVPVAFK

SEQ ID NO: 43385 - protein, 9 aa, Homo Sapiens
EKNYATIVG

SEQ ID NO: 43386 - protein, 9 aa, Homo Sapiens
QTQKKEEST

SEQ ID NO: 43387 - protein, 9 aa, Homo Sapiens
ELQRANSDF

SEQ ID NO: 43388 - protein, 9 aa, Homo Sapiens
WPKYTEVTE

SEQ ID NO: 43389 - protein, 9 aa, Homo Sapiens
SKEVMLTEE

SEQ ID NO: 43390 - protein, 9 aa, Homo Sapiens
VVPMLRGRA

SEQ ID NO: 43391 - protein, 9 aa, Homo Sapiens
QNPERSDRW

SEQ ID NO: 43392 - protein, 9 aa, Homo Sapiens
MMPLFVDQM

SEQ ID NO: 43393 - protein, 9 aa, Homo Sapiens
LERRNLITV

SEQ ID NO: 43394 - protein, 9 aa, Homo Sapiens
DCQVTLSDL

SEQ ID NO: 43395 - protein, 9 aa, Homo Sapiens
LNYVLSPVY

SEQ ID NO: 43396 - protein, 9 aa, Homo Sapiens
RQAAAREAQ

SEQ ID NO: 43397 - protein, 9 aa, Homo Sapiens
RLSKEVMLT

SEQ ID NO: 43398 - protein, 9 aa, Homo Sapiens
HAFHKALEQ

SEQ ID NO: 43399 - protein, 9 aa, Homo Sapiens
HETAAPSDI

SEQ ID NO: 43400 - protein, 9 aa, Homo Sapiens
SLLNSPPSF

SEQ ID NO: 43401 - protein, 9 aa, Homo Sapiens
IVMPLSAAS

SEQ ID NO: 43402 - protein, 9 aa, Homo Sapiens
AREAQGTAG

SEQ ID NO: 43403 - protein, 9 aa, Homo Sapiens
GEPSNPSMA

SEQ ID NO: 43404 - protein, 9 aa, Homo Sapiens
TSAPAFGFR

SEQ ID NO: 43405 - protein, 9 aa, Homo Sapiens
ETEKLPGTM

SEQ ID NO: 43406 - protein, 9 aa, Homo Sapiens
DAVKNLLDL

SEQ ID NO: 43407 - protein, 9 aa, Homo Sapiens
SVPHKHLDG

SEQ ID NO: 43408 - protein, 9 aa, Homo Sapiens
VKNLLDLIS

SEQ ID NO: 43409 - protein, 9 aa, Homo Sapiens
GLFRTVAIV

SEQ ID NO: 43410 - protein, 9 aa, Homo Sapiens
PSNPSMAVS

SEQ ID NO: 43411 - protein, 9 aa, Homo Sapiens
EVDSPGNET

SEQ ID NO: 43412 - protein, 9 aa, Homo Sapiens
TCSTSLLNS

SEQ ID NO: 43413 - protein, 9 aa, Homo Sapiens
PEALVFELH

SEQ ID NO: 43414 - protein, 9 aa, Homo Sapiens
SIQGQWPKQ

SEQ ID NO: 43415 - protein, 9 aa, Homo Sapiens
VMPLSAASP

SEQ ID NO: 43416 - protein, 9 aa, Homo Sapiens
LDMVRKEAE

SEQ ID NO: 43417 - protein, 9 aa, Homo Sapiens
YGEPSNPSM

SEQ ID NO: 43418 - protein, 9 aa, Homo Sapiens
RAADLFRDK

SEQ ID NO: 43419 - protein, 9 aa, Homo Sapiens
ENERIYVHR

SEQ ID NO: 43420 - protein, 9 aa, Homo Sapiens
GHKAELTED

SEQ ID NO: 43421 - protein, 9 aa, Homo Sapiens
LVRKFLQTE

SEQ ID NO: 43422 - protein, 9 aa, Homo Sapiens
PSMAVSAQV

SEQ ID NO: 43423 - protein, 9 aa, Homo Sapiens
FDELCGPDP

SEQ ID NO: 43424 - protein, 9 aa, Homo Sapiens
FRTVAIVSP

SEQ ID NO: 43425 - protein, 9 aa, Homo Sapiens
PKQTLKELF

SEQ ID NO: 43426 - protein, 9 aa, Homo Sapiens
AFRCSSAFL

SEQ ID NO: 43427 - protein, 9 aa, Homo Sapiens
EEDISRSMT

SEQ ID NO: 43428 - protein, 9 aa, Homo Sapiens
AHSKGEARS

SEQ ID NO: 43429 - protein, 9 aa, Homo Sapiens
VNRSAMFIF

SEQ ID NO: 43430 - protein, 9 aa, Homo Sapiens
NYATIVGFP

SEQ ID NO: 43431 - protein, 9 aa, Homo Sapiens
PNIQDLKRR

SEQ ID NO: 43432 - protein, 9 aa, Homo Sapiens
RSMTNSTAA

SEQ ID NO: 43433 - protein, 9 aa, Homo Sapiens
DKLSVYAAL

SEQ ID NO: 43434 - protein, 9 aa, Homo Sapiens
FPQDLCVQW

SEQ ID NO: 43435 - protein, 9 aa, Homo Sapiens
VDSVLDMVR

SEQ ID NO: 43436 - protein, 9 aa, Homo Sapiens
RENIRLIMQ

SEQ ID NO: 43437 - protein, 9 aa, Homo Sapiens
KATNDKLSV

SEQ ID NO: 43438 - protein, 9 aa, Homo Sapiens
VIGCAVSSM

SEQ ID NO: 43439 - protein, 9 aa, Homo Sapiens
RVTSVPHKH

SEQ ID NO: 43440 - protein, 9 aa, Homo Sapiens
NKCGSRKKG

SEQ ID NO: 43441 - protein, 9 aa, Homo Sapiens
NAALERRNL

SEQ ID NO: 43442 - protein, 9 aa, Homo Sapiens
LSCQVPLKR

SEQ ID NO: 43443 - protein, 9 aa, Homo Sapiens
GNLSCQVPL

SEQ ID NO: 43444 - protein, 9 aa, Homo Sapiens
LFRTVAIVS

SEQ ID NO: 43445 - protein, 9 aa, Homo Sapiens
EVTEINSVD

SEQ ID NO: 43446 - protein, 9 aa, Homo Sapiens
LRSYYHPRN

SEQ ID NO: 43447 - protein, 9 aa, Homo Sapiens
GSGKRTISQ

SEQ ID NO: 43448 - protein, 9 aa, Homo Sapiens
SNPSMAVSA

SEQ ID NO: 43449 - protein, 9 aa, Homo Sapiens
EAGDCQVTL

SEQ ID NO: 43450 - protein, 9 aa, Homo Sapiens
MSALLISSS

SEQ ID NO: 43451 - protein, 9 aa, Homo Sapiens
LLSTVQYFS

SEQ ID NO: 43452 - protein, 9 aa, Homo Sapiens
RSPSHNPRS

SEQ ID NO: 43453 - protein, 9 aa, Homo Sapiens
VATGTSLSL

SEQ ID NO: 43454 - protein, 9 aa, Homo Sapiens
PKFTKKNTL

SEQ ID NO: 43455 - protein, 9 aa, Homo Sapiens
MDLRVYGPA

SEQ ID NO: 43456 - protein, 9 aa, Homo Sapiens
LYNPITKRI

SEQ ID NO: 43457 - protein, 9 aa, Homo Sapiens
KQMNDARHG

SEQ ID NO: 43458 - protein, 9 aa, Homo Sapiens
NHIWKIYRN

SEQ ID NO: 43459 - protein, 9 aa, Homo Sapiens
AAVAWVGRG

SEQ ID NO: 43460 - protein, 9 aa, Homo Sapiens
NSFGNGKVH

SEQ ID NO: 43461 - protein, 9 aa, Homo Sapiens
DTQGCYRCR

SEQ ID NO: 43462 - protein, 9 aa, Homo Sapiens
VQYFSSFYA

SEQ ID NO: 43463 - protein, 9 aa, Homo Sapiens
DDDTLSTSR

SEQ ID NO: 43464 - protein, 9 aa, Homo Sapiens
YAASQHFMK

SEQ ID NO: 43465 - protein, 9 aa, Homo Sapiens
KPIFQASLE

SEQ ID NO: 43466 - protein, 9 aa, Homo Sapiens
QQQQQRRRH

SEQ ID NO: 43467 - protein, 9 aa, Homo Sapiens
WPQGAHGES

SEQ ID NO: 43468 - protein, 9 aa, Homo Sapiens
QRRRHHRSP

SEQ ID NO: 43469 - protein, 9 aa, Homo Sapiens
TQGCYRCRS

SEQ ID NO: 43470 - protein, 9 aa, Homo Sapiens
QGCYRCRSG

SEQ ID NO: 43471 - protein, 9 aa, Homo Sapiens
SHNPRSPSP

SEQ ID NO: 43472 - protein, 9 aa, Homo Sapiens
GDTQGCYRC

SEQ ID NO: 43473 - protein, 9 aa, Homo Sapiens
VRETKGKLS

SEQ ID NO: 43474 - protein, 9 aa, Homo Sapiens
DENKWTHVY

SEQ ID NO: 43475 - protein, 9 aa, Homo Sapiens
KWGAPLWTV

SEQ ID NO: 43476 - protein, 9 aa, Homo Sapiens
PDDMDLRVY

SEQ ID NO: 43477 - protein, 9 aa, Homo Sapiens
ISLYNPITK

SEQ ID NO: 43478 - protein, 9 aa, Homo Sapiens
PFNWELKSH

SEQ ID NO: 43479 - protein, 9 aa, Homo Sapiens
EGEDDDDDE

SEQ ID NO: 43480 - protein, 9 aa, Homo Sapiens
RHHRSPSHN

SEQ ID NO: 43481 - protein, 9 aa, Homo Sapiens
SLSLQFFPA

SEQ ID NO: 43482 - protein, 9 aa, Homo Sapiens
ADHHVIPMP

SEQ ID NO: 43483 - protein, 9 aa, Homo Sapiens
VGYAASQHF

SEQ ID NO: 43484 - protein, 9 aa, Homo Sapiens
AANVLNFAD

SEQ ID NO: 43485 - protein, 9 aa, Homo Sapiens
HNPRSPSPD

SEQ ID NO: 43486 - protein, 9 aa, Homo Sapiens
IIMVCVGFF

SEQ ID NO: 43487 - protein, 9 aa, Homo Sapiens
WLPFSRPTN

SEQ ID NO: 43488 - protein, 9 aa, Homo Sapiens
ETKGKLSSY

SEQ ID NO: 43489 - protein, 9 aa, Homo Sapiens
STVQYFSSF

SEQ ID NO: 43490 - protein, 9 aa, Homo Sapiens
ALLISSSDA

SEQ ID NO: 43491 - protein, 9 aa, Homo Sapiens
TMSGANSFG

SEQ ID NO: 43492 - protein, 9 aa, Homo Sapiens
LLTGDTQGC

SEQ ID NO: 43493 - protein, 9 aa, Homo Sapiens
MVIIMVCVG

SEQ ID NO: 43494 - protein, 9 aa, Homo Sapiens
KLRGNGNGH

SEQ ID NO: 43495 - protein, 9 aa, Homo Sapiens
WELKSHILD

SEQ ID NO: 43496 - protein, 9 aa, Homo Sapiens
DEEGEGEDD

SEQ ID NO: 43497 - protein, 9 aa, Homo Sapiens
MNDARHGGW

SEQ ID NO: 43498 - protein, 9 aa, Homo Sapiens
GAHGESSLA

SEQ ID NO: 43499 - protein, 9 aa, Homo Sapiens
EWLPFSRPT

SEQ ID NO: 43500 - protein, 9 aa, Homo Sapiens
VYLSSTKLT

SEQ ID NO: 43501 - protein, 9 aa, Homo Sapiens
WVGRGGGGA

SEQ ID NO: 43502 - protein, 9 aa, Homo Sapiens
YFSSFYASC

SEQ ID NO: 43503 - protein, 9 aa, Homo Sapiens
NKWTHVYLS

SEQ ID NO: 43504 - protein, 9 aa, Homo Sapiens
GNGNGHIGS

SEQ ID NO: 43505 - protein, 9 aa, Homo Sapiens
QQQQRRRHH

SEQ ID NO: 43506 - protein, 9 aa, Homo Sapiens
TRPDLNKTK

SEQ ID NO: 43507 - protein, 9 aa, Homo Sapiens
AAAAVAWVG

SEQ ID NO: 43508 - protein, 9 aa, Homo Sapiens
GEDDDDDEE

SEQ ID NO: 43509 - protein, 9 aa, Homo Sapiens
CLLSTVQYF

SEQ ID NO: 43510 - protein, 9 aa, Homo Sapiens
AFPDDMDLR

SEQ ID NO: 43511 - protein, 9 aa, Homo Sapiens
CYRCRSGLS

SEQ ID NO: 43512 - protein, 9 aa, Homo Sapiens
ATGTSLSLQ

SEQ ID NO: 43513 - protein, 9 aa, Homo Sapiens
FPFNWELKS

SEQ ID NO: 43514 - protein, 9 aa, Homo Sapiens
KWTHVYLSS

SEQ ID NO: 43515 - protein, 9 aa, Homo Sapiens
LRGNGNGHI

SEQ ID NO: 43516 - protein, 9 aa, Homo Sapiens
LAFPDDMDL

SEQ ID NO: 43517 - protein, 9 aa, Homo Sapiens
AVAWVGRGG

SEQ ID NO: 43518 - protein, 9 aa, Homo Sapiens
THVYLSSTK

SEQ ID NO: 43519 - protein, 9 aa, Homo Sapiens
ANVLNFADH

SEQ ID NO: 43520 - protein, 9 aa, Homo Sapiens
SLYNPITKR

SEQ ID NO: 43521 - protein, 9 aa, Homo Sapiens
SQHFMKDPF

SEQ ID NO: 43522 - protein, 9 aa, Homo Sapiens
SRAEVKENR

SEQ ID NO: 43523 - protein, 9 aa, Homo Sapiens
FSSFYASCL

SEQ ID NO: 43524 - protein, 9 aa, Homo Sapiens
VAANVLNFA

SEQ ID NO: 43525 - protein, 9 aa, Homo Sapiens
PEWLPFSRP

SEQ ID NO: 43526 - protein, 9 aa, Homo Sapiens
LNKTKIFLF

SEQ ID NO: 43527 - protein, 9 aa, Homo Sapiens
KKNTLRTEC

SEQ ID NO: 43528 - protein, 9 aa, Homo Sapiens
LPKFTKKNT

SEQ ID NO: 43529 - protein, 9 aa, Homo Sapiens
KFTKKNTLR

SEQ ID NO: 43530 - protein, 9 aa, Homo Sapiens
PQGAHGESS

SEQ ID NO: 43531 - protein, 9 aa, Homo Sapiens
AVLAFPDDM

SEQ ID NO: 43532 - protein, 9 aa, Homo Sapiens
GKLSSYKEK

SEQ ID NO: 43533 - protein, 9 aa, Homo Sapiens
TSLSLQFFP

SEQ ID NO: 43534 - protein, 9 aa, Homo Sapiens
ESSLASSQA

SEQ ID NO: 43535 - protein, 9 aa, Homo Sapiens
HGESSLASS

SEQ ID NO: 43536 - protein, 9 aa, Homo Sapiens
PVKQKRKLR

SEQ ID NO: 43537 - protein, 9 aa, Homo Sapiens
SSLASSQAK

SEQ ID NO: 43538 - protein, 9 aa, Homo Sapiens
SALLISSSD

SEQ ID NO: 43539 - protein, 9 aa, Homo Sapiens
VLNFADHHV

SEQ ID NO: 43540 - protein, 9 aa, Homo Sapiens
APEWLPFSR

SEQ ID NO: 43541 - protein, 9 aa, Homo Sapiens
SRGSLEGTG

SEQ ID NO: 43542 - protein, 9 aa, Homo Sapiens
TKGKLSSYK

SEQ ID NO: 43543 - protein, 9 aa, Homo Sapiens
SRPTNLTDE

SEQ ID NO: 43544 - protein, 9 aa, Homo Sapiens
QQQRRRHHR

SEQ ID NO: 43545 - protein, 9 aa, Homo Sapiens
QGAHGESSL

SEQ ID NO: 43546 - protein, 9 aa, Homo Sapiens
IWKIYRNGV

SEQ ID NO: 43547 - protein, 9 aa, Homo Sapiens
AHGESSLAS

SEQ ID NO: 43548 - protein, 9 aa, Homo Sapiens
RKWGAPLWT

SEQ ID NO: 43549 - protein, 9 aa, Homo Sapiens
HHRSPSHNP

SEQ ID NO: 43550 - protein, 9 aa, Homo Sapiens
SPDRKWGAP

SEQ ID NO: 43551 - protein, 9 aa, Homo Sapiens
GCYRCRSGL

SEQ ID NO: 43552 - protein, 9 aa, Homo Sapiens
MISLYNPIT

SEQ ID NO: 43553 - protein, 9 aa, Homo Sapiens
TVQYFSSFY

SEQ ID NO: 43554 - protein, 9 aa, Homo Sapiens
DDMDLRVYG

SEQ ID NO: 43555 - protein, 9 aa, Homo Sapiens
DSRGSLEGT

SEQ ID NO: 43556 - protein, 9 aa, Homo Sapiens
NGHIGSSVG

SEQ ID NO: 43557 - protein, 9 aa, Homo Sapiens
PSPDRKWGA

SEQ ID NO: 43558 - protein, 9 aa, Homo Sapiens
NPRSPSPDR

SEQ ID NO: 43559 - protein, 9 aa, Homo Sapiens
KIYRNGVLE

SEQ ID NO: 43560 - protein, 9 aa, Homo Sapiens
NVLNFADHH

SEQ ID NO: 43561 - protein, 9 aa, Homo Sapiens
VNHIWKIYR

SEQ ID NO: 43562 - protein, 9 aa, Homo Sapiens
SPSHNPRSP

SEQ ID NO: 43563 - protein, 9 aa, Homo Sapiens
VLAFPDDMD

SEQ ID NO: 43564 - protein, 9 aa, Homo Sapiens
PSHNPRSPS

SEQ ID NO: 43565 - protein, 9 aa, Homo Sapiens
RAEVKENRN

SEQ ID NO: 43566 - protein, 9 aa, Homo Sapiens
FPDDMDLRV

SEQ ID NO: 43567 - protein, 9 aa, Homo Sapiens
HNDSRGSLE

SEQ ID NO: 43568 - protein, 9 aa, Homo Sapiens
NGNGHIGSS

SEQ ID NO: 43569 - protein, 9 aa, Homo Sapiens
FADHHVIPM

SEQ ID NO: 43570 - protein, 9 aa, Homo Sapiens
YLSSTKLTL

SEQ ID NO: 43571 - protein, 9 aa, Homo Sapiens
GYAASQHFM

SEQ ID NO: 43572 - protein, 9 aa, Homo Sapiens
LNFADHHVI

SEQ ID NO: 43573 - protein, 9 aa, Homo Sapiens
QEALKRPVK

SEQ ID NO: 43574 - protein, 9 aa, Homo Sapiens
EGEGEDDDD

SEQ ID NO: 43575 - protein, 9 aa, Homo Sapiens
RETKGKLSS

SEQ ID NO: 43576 - protein, 9 aa, Homo Sapiens
ASLELAQLE

SEQ ID NO: 43577 - protein, 9 aa, Homo Sapiens
SLELAQLEL

SEQ ID NO: 43578 - protein, 9 aa, Homo Sapiens
WTHVYLSST

SEQ ID NO: 43579 - protein, 9 aa, Homo Sapiens
AHNDSRGSL

SEQ ID NO: 43580 - protein, 9 aa, Homo Sapiens
ELKSHILDS

SEQ ID NO: 43581 - protein, 9 aa, Homo Sapiens
WKIYRNGVL

SEQ ID NO: 43582 - protein, 9 aa, Homo Sapiens
RGNGNGHIG

SEQ ID NO: 43583 - protein, 9 aa, Homo Sapiens
DDEEGEGED

SEQ ID NO: 43584 - protein, 9 aa, Homo Sapiens
RPDLNKTKI

SEQ ID NO: 43585 - protein, 9 aa, Homo Sapiens
NWELKSHIL

SEQ ID NO: 43586 - protein, 9 aa, Homo Sapiens
HRSPSHNPR

SEQ ID NO: 43587 - protein, 9 aa, Homo Sapiens
KESAHNDSR

SEQ ID NO: 43588 - protein, 9 aa, Homo Sapiens
GEGEDDDDD

SEQ ID NO: 43589 - protein, 9 aa, Homo Sapiens
TLPKFTKKN

SEQ ID NO: 43590 - protein, 9 aa, Homo Sapiens
RGSLEGTGA

SEQ ID NO: 43591 - protein, 9 aa, Homo Sapiens
PRKLRGNGN

SEQ ID NO: 43592 - protein, 9 aa, Homo Sapiens
YRNGVLEFC

SEQ ID NO: 43593 - protein, 9 aa, Homo Sapiens
QQRRRHHRS

SEQ ID NO: 43594 - protein, 9 aa, Homo Sapiens
KFPFNWELK

SEQ ID NO: 43595 - protein, 9 aa, Homo Sapiens
TGDTQGCYR

SEQ ID NO: 43596 - protein, 9 aa, Homo Sapiens
HVYLSSTKL

SEQ ID NO: 43597 - protein, 9 aa, Homo Sapiens
RHGGWTTKM

SEQ ID NO: 43598 - protein, 9 aa, Homo Sapiens
MDKFPFNWE

SEQ ID NO: 43599 - protein, 9 aa, Homo Sapiens
CTVMISLYN

SEQ ID NO: 43600 - protein, 9 aa, Homo Sapiens
NDSRGSLEG

SEQ ID NO: 43601 - protein, 9 aa, Homo Sapiens
SAHNDSRGS

SEQ ID NO: 43602 - protein, 9 aa, Homo Sapiens
EEGEGEDDD

SEQ ID NO: 43603 - protein, 9 aa, Homo Sapiens
AAAAAAVAW

SEQ ID NO: 43604 - protein, 9 aa, Homo Sapiens
SFGNGKVHT

SEQ ID NO: 43605 - protein, 9 aa, Homo Sapiens
YVMTRPDLN

SEQ ID NO: 43606 - protein, 9 aa, Homo Sapiens
EGHLQWLNR

SEQ ID NO: 43607 - protein, 9 aa, Homo Sapiens
ACTVMISLY

SEQ ID NO: 43608 - protein, 9 aa, Homo Sapiens
LSTVQYFSS

SEQ ID NO: 43609 - protein, 9 aa, Homo Sapiens
ANSFGNGKV

SEQ ID NO: 43610 - protein, 9 aa, Homo Sapiens
GACTVMISL

SEQ ID NO: 43611 - protein, 9 aa, Homo Sapiens
ALKRPVKQK

SEQ ID NO: 43612 - protein, 9 aa, Homo Sapiens
PIFQASLEL

SEQ ID NO: 43613 - protein, 9 aa, Homo Sapiens
DTLSTSRAE

SEQ ID NO: 43614 - protein, 9 aa, Homo Sapiens
WLVGYAASQ

SEQ ID NO: 43615 - protein, 9 aa, Homo Sapiens
TLSTSRAEV

SEQ ID NO: 43616 - protein, 9 aa, Homo Sapiens
MSGANSFGN

SEQ ID NO: 43617 - protein, 9 aa, Homo Sapiens
GANSFGNGK

SEQ ID NO: 43618 - protein, 9 aa, Homo Sapiens
LKRPVKQKR

SEQ ID NO: 43619 - protein, 9 aa, Homo Sapiens
GHLQWLNRR

SEQ ID NO: 43620 - protein, 9 aa, Homo Sapiens
TVMISLYNP

SEQ ID NO: 43621 - protein, 9 aa, Homo Sapiens
FMKQMNDAR

SEQ ID NO: 43622 - protein, 9 aa, Homo Sapiens
SLMVIIMVC

SEQ ID NO: 43623 - protein, 9 aa, Homo Sapiens
LSTSRAEVK

SEQ ID NO: 43624 - protein, 9 aa, Homo Sapiens
VAWVGRGGG

SEQ ID NO: 43625 - protein, 9 aa, Homo Sapiens
ARHGGWTTK

SEQ ID NO: 43626 - protein, 9 aa, Homo Sapiens
GESSLASSQ

SEQ ID NO: 43627 - protein, 9 aa, Homo Sapiens
DARHGGWTT

SEQ ID NO: 43628 - protein, 9 aa, Homo Sapiens
VMTRPDLNK

SEQ ID NO: 43629 - protein, 9 aa, Homo Sapiens
ENKWTHVYL

SEQ ID NO: 43630 - protein, 9 aa, Homo Sapiens
DRKWGAPLW

SEQ ID NO: 43631 - protein, 9 aa, Homo Sapiens
GTSLSLQFF

SEQ ID NO: 43632 - protein, 9 aa, Homo Sapiens
LVGYAASQH

SEQ ID NO: 43633 - protein, 9 aa, Homo Sapiens
FSRPTNLTD

SEQ ID NO: 43634 - protein, 9 aa, Homo Sapiens
FVATGTSLS

SEQ ID NO: 43635 - protein, 9 aa, Homo Sapiens
LSSYKEKMA

SEQ ID NO: 43636 - protein, 9 aa, Homo Sapiens
PQAEGHLQW

SEQ ID NO: 43637 - protein, 9 aa, Homo Sapiens
NPQAEGHLQ

SEQ ID NO: 43638 - protein, 9 aa, Homo Sapiens
MKQMNDARH

SEQ ID NO: 43639 - protein, 9 aa, Homo Sapiens
TSRAEVKEN

SEQ ID NO: 43640 - protein, 9 aa, Homo Sapiens
FNWELKSHI

SEQ ID NO: 43641 - protein, 9 aa, Homo Sapiens
FQASLELAQ

SEQ ID NO: 43642 - protein, 9 aa, Homo Sapiens
IQEALKRPV

SEQ ID NO: 43643 - protein, 9 aa, Homo Sapiens
AASQHFMKD

SEQ ID NO: 43644 - protein, 9 aa, Homo Sapiens
AAAAAVAWV

SEQ ID NO: 43645 - protein, 9 aa, Homo Sapiens
NDARHGGWT

SEQ ID NO: 43646 - protein, 9 aa, Homo Sapiens
LMVIIMVCV

SEQ ID NO: 43647 - protein, 9 aa, Homo Sapiens
LVTMSGANS

SEQ ID NO: 43648 - protein, 9 aa, Homo Sapiens
RSPSPDRKW

SEQ ID NO: 43649 - protein, 9 aa, Homo Sapiens
PFSRQEKFM

SEQ ID NO: 43650 - protein, 9 aa, Homo Sapiens
DKFPFNWEL

SEQ ID NO: 43651 - protein, 9 aa, Homo Sapiens
IFQASLELA

SEQ ID NO: 43652 - protein, 9 aa, Homo Sapiens
PFSRPTNLT

SEQ ID NO: 43653 - protein, 9 aa, Homo Sapiens
STSRAEVKE

SEQ ID NO: 43654 - protein, 9 aa, Homo Sapiens
QAEGHLQWL

SEQ ID NO: 43655 - protein, 9 aa, Homo Sapiens
HIWKIYRNG

SEQ ID NO: 43656 - protein, 9 aa, Homo Sapiens
DMDLRVYGP

SEQ ID NO: 43657 - protein, 9 aa, Homo Sapiens
KLSSYKEKM

SEQ ID NO: 43658 - protein, 9 aa, Homo Sapiens
KKPIFQASL

SEQ ID NO: 43659 - protein, 9 aa, Homo Sapiens
EALKRPVKQ

SEQ ID NO: 43660 - protein, 9 aa, Homo Sapiens
GNGHIGSSV

SEQ ID NO: 43661 - protein, 9 aa, Homo Sapiens
AWVGRGGGG

SEQ ID NO: 43662 - protein, 9 aa, Homo Sapiens
LTGDTQGCY

SEQ ID NO: 43663 - protein, 9 aa, Homo Sapiens
MSLMVIIMV

SEQ ID NO: 43664 - protein, 9 aa, Homo Sapiens
DLNKTKIFL

SEQ ID NO: 43665 - protein, 9 aa, Homo Sapiens
ESAHNDSRG

SEQ ID NO: 43666 - protein, 9 aa, Homo Sapiens
QASLELAQL

SEQ ID NO: 43667 - protein, 9 aa, Homo Sapiens
NAPEWLPFS

SEQ ID NO: 43668 - protein, 9 aa, Homo Sapiens
SRQEKFMLH

SEQ ID NO: 43669 - protein, 9 aa, Homo Sapiens
AFVATGTSL

SEQ ID NO: 43670 - protein, 9 aa, Homo Sapiens
QMNDARHGG

SEQ ID NO: 43671 - protein, 9 aa, Homo Sapiens
NFADHHVIP

SEQ ID NO: 43672 - protein, 9 aa, Homo Sapiens
LPFSRPTNL

SEQ ID NO: 43673 - protein, 9 aa, Homo Sapiens
RRRHHRSPS

SEQ ID NO: 43674 - protein, 9 aa, Homo Sapiens
AAAVAWVGR

SEQ ID NO: 43675 - protein, 9 aa, Homo Sapiens
SPSPDRKWG

SEQ ID NO: 43676 - protein, 9 aa, Homo Sapiens
SGANSFGNG

SEQ ID NO: 43677 - protein, 9 aa, Homo Sapiens
QHFMKDPFL

SEQ ID NO: 43678 - protein, 9 aa, Homo Sapiens
DDTLSTSRA

SEQ ID NO: 43679 - protein, 9 aa, Homo Sapiens
RPVKQKRKL

SEQ ID NO: 43680 - protein, 9 aa, Homo Sapiens
MTRPDLNKT

SEQ ID NO: 43681 - protein, 9 aa, Homo Sapiens
FSRQEKFML

SEQ ID NO: 43682 - protein, 9 aa, Homo Sapiens
RKLRGNGNG

SEQ ID NO: 43683 - protein, 9 aa, Homo Sapiens
PDLNKTKIF

SEQ ID NO: 43684 - protein, 9 aa, Homo Sapiens
NKTKIFLFG

SEQ ID NO: 43685 - protein, 9 aa, Homo Sapiens
VTMSGANSF

SEQ ID NO: 43686 - protein, 9 aa, Homo Sapiens
IYRNGVLEF

SEQ ID NO: 43687 - protein, 9 aa, Homo Sapiens
FTKKNTLRT

SEQ ID NO: 43688 - protein, 9 aa, Homo Sapiens
AEGHLQWLN

SEQ ID NO: 43689 - protein, 9 aa, Homo Sapiens
TKKPIFQAS

SEQ ID NO: 43690 - protein, 9 aa, Homo Sapiens
ANPQAEGHL

SEQ ID NO: 43691 - protein, 9 aa, Homo Sapiens
KNTLRTECC

SEQ ID NO: 43692 - protein, 9 aa, Homo Sapiens
QYFSSFYAS

SEQ ID NO: 43693 - protein, 9 aa, Homo Sapiens
QQQQQQRRR

SEQ ID NO: 43694 - protein, 9 aa, Homo Sapiens
VIIMVCVGF

SEQ ID NO: 43695 - protein, 9 aa, Homo Sapiens
KGKLSSYKE

SEQ ID NO: 43696 - protein, 9 aa, Homo Sapiens
TKKNTLRTE

SEQ ID NO: 43697 - protein, 9 aa, Homo Sapiens
PDRKWGAPL

SEQ ID NO: 43698 - protein, 9 aa, Homo Sapiens
SSYKEKMAQ

SEQ ID NO: 43699 - protein, 9 aa, Homo Sapiens
IMVCVGFFL

SEQ ID NO: 43700 - protein, 9 aa, Homo Sapiens
IAFVATGTS

SEQ ID NO: 43701 - protein, 9 aa, Homo Sapiens
TGTSLSLQF

SEQ ID NO: 43702 - protein, 9 aa, Homo Sapiens
VANPQAEGH

SEQ ID NO: 43703 - protein, 9 aa, Homo Sapiens
KRPVKQKRK

SEQ ID NO: 43704 - protein, 9 aa, Homo Sapiens
VKQKRKLRI

SEQ ID NO: 43705 - protein, 9 aa, Homo Sapiens
PRSPSPDRK

SEQ ID NO: 43706 - protein, 9 aa, Homo Sapiens
RRHHRSPSH

SEQ ID NO: 43707 - protein, 9 aa, Homo Sapiens
RNGVLEFCI

SEQ ID NO: 43708 - protein, 9 aa, Homo Sapiens
HLQWLNRRA

SEQ ID NO: 43709 - protein, 9 aa, Homo Sapiens
VMISLYNPI

SEQ ID NO: 43710 - protein, 9 aa, Homo Sapiens
ASQHFMKDP

SEQ ID NO: 43711 - protein, 9 aa, Homo Sapiens
KKLSQIGTT

SEQ ID NO: 43712 - protein, 9 aa, Homo Sapiens
AKGLGARGP

SEQ ID NO: 43713 - protein, 9 aa, Homo Sapiens
MAHSLATML

SEQ ID NO: 43714 - protein, 9 aa, Homo Sapiens
KKIKTSESS

SEQ ID NO: 43715 - protein, 9 aa, Homo Sapiens
SRESVDTLR

SEQ ID NO: 43716 - protein, 9 aa, Homo Sapiens
FKIRAIYDK

SEQ ID NO: 43717 - protein, 9 aa, Homo Sapiens
QPPAPRSRK

SEQ ID NO: 43718 - protein, 9 aa, Homo Sapiens
DVDQWCQAL

SEQ ID NO: 43719 - protein, 9 aa, Homo Sapiens
SSLASSQAK

SEQ ID NO: 43720 - protein, 9 aa, Homo Sapiens
IHQDWANWE

SEQ ID NO: 43721 - protein, 9 aa, Homo Sapiens
STANEKATP

SEQ ID NO: 43722 - protein, 9 aa, Homo Sapiens
RWCKKVDPS

SEQ ID NO: 43723 - protein, 9 aa, Homo Sapiens
LGVAISSRS

SEQ ID NO: 43724 - protein, 9 aa, Homo Sapiens
IALKPTPHR

SEQ ID NO: 43725 - protein, 9 aa, Homo Sapiens
AISSRSFFN

SEQ ID NO: 43726 - protein, 9 aa, Homo Sapiens
DPQPAPKKI

SEQ ID NO: 43727 - protein, 9 aa, Homo Sapiens
MLSDQVKKA

SEQ ID NO: 43728 - protein, 9 aa, Homo Sapiens
YARWQSRWC

SEQ ID NO: 43729 - protein, 9 aa, Homo Sapiens
FLLDMAVRT

SEQ ID NO: 43730 - protein, 9 aa, Homo Sapiens
VAISSRSFF

SEQ ID NO: 43731 - protein, 9 aa, Homo Sapiens
YVPEDSKQG

SEQ ID NO: 43732 - protein, 9 aa, Homo Sapiens
KLLPRPHLS

SEQ ID NO: 43733 - protein, 9 aa, Homo Sapiens
RSRLASERG

SEQ ID NO: 43734 - protein, 9 aa, Homo Sapiens
SYVPEDSKQ

SEQ ID NO: 43735 - protein, 9 aa, Homo Sapiens
NWRPILTII

SEQ ID NO: 43736 - protein, 9 aa, Homo Sapiens
PKKIKTSES

SEQ ID NO: 43737 - protein, 9 aa, Homo Sapiens
CMGGMNWRP

SEQ ID NO: 43738 - protein, 9 aa, Homo Sapiens
GQDKVIFLL

SEQ ID NO: 43739 - protein, 9 aa, Homo Sapiens
QWCQALSQR

SEQ ID NO: 43740 - protein, 9 aa, Homo Sapiens
WEYIEIITS

SEQ ID NO: 43741 - protein, 9 aa, Homo Sapiens
SSRSFFNDE

SEQ ID NO: 43742 - protein, 9 aa, Homo Sapiens
PQPPAPRSR

SEQ ID NO: 43743 - protein, 9 aa, Homo Sapiens
RVQSYVPED

SEQ ID NO: 43744 - protein, 9 aa, Homo Sapiens
LLPRPHLSE

SEQ ID NO: 43745 - protein, 9 aa, Homo Sapiens
HFAAKLDNY

SEQ ID NO: 43746 - protein, 9 aa, Homo Sapiens
LDNYMYILP

SEQ ID NO: 43747 - protein, 9 aa, Homo Sapiens
SAKGLGARG

SEQ ID NO: 43748 - protein, 9 aa, Homo Sapiens
SSQPQIRRS

SEQ ID NO: 43749 - protein, 9 aa, Homo Sapiens
QDKVIFLLV

SEQ ID NO: 43750 - protein, 9 aa, Homo Sapiens
ECEVSPCSA

SEQ ID NO: 43751 - protein, 9 aa, Homo Sapiens
ARWQSRWCK

SEQ ID NO: 43752 - protein, 9 aa, Homo Sapiens
LRNFSRSRL

SEQ ID NO: 43753 - protein, 9 aa, Homo Sapiens
AVTPVKKLS

SEQ ID NO: 43754 - protein, 9 aa, Homo Sapiens
TYFKIRAIY

SEQ ID NO: 43755 - protein, 9 aa, Homo Sapiens
YPVPQPPAP

SEQ ID NO: 43756 - protein, 9 aa, Homo Sapiens
ANEKATPFP

SEQ ID NO: 43757 - protein, 9 aa, Homo Sapiens
PTECEVSPC

SEQ ID NO: 43758 - protein, 9 aa, Homo Sapiens
LASERGHLR

SEQ ID NO: 43759 - protein, 9 aa, Homo Sapiens
SGRLARPPL

SEQ ID NO: 43760 - protein, 9 aa, Homo Sapiens
TSNLSCGRQ

SEQ ID NO: 43761 - protein, 9 aa, Homo Sapiens
LSCGRQQRV

SEQ ID NO: 43762 - protein, 9 aa, Homo Sapiens
RSAKGLGAR

SEQ ID NO: 43763 - protein, 9 aa, Homo Sapiens
HSLATMLSD

SEQ ID NO: 43764 - protein, 9 aa, Homo Sapiens
KNYSRRNQN

SEQ ID NO: 43765 - protein, 9 aa, Homo Sapiens
SSCMGGMNW

SEQ ID NO: 43766 - protein, 9 aa, Homo Sapiens
CGRQQRVTL

SEQ ID NO: 43767 - protein, 9 aa, Homo Sapiens
SRLASERGH

SEQ ID NO: 43768 - protein, 9 aa, Homo Sapiens
QPQIRRSTS

SEQ ID NO: 43769 - protein, 9 aa, Homo Sapiens
AKLDNYMYI

SEQ ID NO: 43770 - protein, 9 aa, Homo Sapiens
LRSSQPQIR

SEQ ID NO: 43771 - protein, 9 aa, Homo Sapiens
DSLRNCIAL

SEQ ID NO: 43772 - protein, 9 aa, Homo Sapiens
LLDMAVRTM

SEQ ID NO: 43773 - protein, 9 aa, Homo Sapiens
SCGRQQRVT

SEQ ID NO: 43774 - protein, 9 aa, Homo Sapiens
SLMRDGCGC

SEQ ID NO: 43775 - protein, 9 aa, Homo Sapiens
NWEYIEIIT

SEQ ID NO: 43776 - protein, 9 aa, Homo Sapiens
TMTSHINIC

SEQ ID NO: 43777 - protein, 9 aa, Homo Sapiens
VALRSSQPQ

SEQ ID NO: 43778 - protein, 9 aa, Homo Sapiens
WANWEYIEI

SEQ ID NO: 43779 - protein, 9 aa, Homo Sapiens
TRSAKGLGA

SEQ ID NO: 43780 - protein, 9 aa, Homo Sapiens
EIHQDWANW

SEQ ID NO: 43781 - protein, 9 aa, Homo Sapiens
NRGLKKKKQ

SEQ ID NO: 43782 - protein, 9 aa, Homo Sapiens
CKKVDPSAV

SEQ ID NO: 43783 - protein, 9 aa, Homo Sapiens
DMAVRTMTS

SEQ ID NO: 43784 - protein, 9 aa, Homo Sapiens
WCQALSQRL

SEQ ID NO: 43785 - protein, 9 aa, Homo Sapiens
TMLSDQVKK

SEQ ID NO: 43786 - protein, 9 aa, Homo Sapiens
NYSRRNQNC

SEQ ID NO: 43787 - protein, 9 aa, Homo Sapiens
ATMLSDQVK

SEQ ID NO: 43788 - protein, 9 aa, Homo Sapiens
VMATQGQDK

SEQ ID NO: 43789 - protein, 9 aa, Homo Sapiens
ETSNLSCGR

SEQ ID NO: 43790 - protein, 9 aa, Homo Sapiens
RTMTSHINI

SEQ ID NO: 43791 - protein, 9 aa, Homo Sapiens
YSRRNQNCA

SEQ ID NO: 43792 - protein, 9 aa, Homo Sapiens
KIRAIYDKP

SEQ ID NO: 43793 - protein, 9 aa, Homo Sapiens
RCPPGVSLM

SEQ ID NO: 43794 - protein, 9 aa, Homo Sapiens
QDPKKAPSV

SEQ ID NO: 43795 - protein, 9 aa, Homo Sapiens
RHFAAKLDN

SEQ ID NO: 43796 - protein, 9 aa, Homo Sapiens
ESSLASSQA

SEQ ID NO: 43797 - protein, 9 aa, Homo Sapiens
HGESSLASS

SEQ ID NO: 43798 - protein, 9 aa, Homo Sapiens
MAVRTMTSH

SEQ ID NO: 43799 - protein, 9 aa, Homo Sapiens
GRLARPPLG

SEQ ID NO: 43800 - protein, 9 aa, Homo Sapiens
NYMYILPYK

SEQ ID NO: 43801 - protein, 9 aa, Homo Sapiens
SRSFFNDER

SEQ ID NO: 43802 - protein, 9 aa, Homo Sapiens
GVSLMRDGC

SEQ ID NO: 43803 - protein, 9 aa, Homo Sapiens
EDVDQWCQA

SEQ ID NO: 43804 - protein, 9 aa, Homo Sapiens
TTSRESVDT

SEQ ID NO: 43805 - protein, 9 aa, Homo Sapiens
SQIGTTVVT

SEQ ID NO: 43806 - protein, 9 aa, Homo Sapiens
QSRWCKKVD

SEQ ID NO: 43807 - protein, 9 aa, Homo Sapiens
GAHGESSLA

SEQ ID NO: 43808 - protein, 9 aa, Homo Sapiens
WPQGAHGES

SEQ ID NO: 43809 - protein, 9 aa, Homo Sapiens
EDSLRNCIA

SEQ ID NO: 43810 - protein, 9 aa, Homo Sapiens
TRVQSYVPE

SEQ ID NO: 43811 - protein, 9 aa, Homo Sapiens
PGVSLMRDG

SEQ ID NO: 43812 - protein, 9 aa, Homo Sapiens
QGAHGESSL

SEQ ID NO: 43813 - protein, 9 aa, Homo Sapiens
VTPVKKLSQ

SEQ ID NO: 43814 - protein, 9 aa, Homo Sapiens
PPAPRSRKR

SEQ ID NO: 43815 - protein, 9 aa, Homo Sapiens
IDEPTEVDG

SEQ ID NO: 43816 - protein, 9 aa, Homo Sapiens
LARPPLGML

SEQ ID NO: 43817 - protein, 9 aa, Homo Sapiens
SPCSAWGPC

SEQ ID NO: 43818 - protein, 9 aa, Homo Sapiens
TECEVSPCS

SEQ ID NO: 43819 - protein, 9 aa, Homo Sapiens
LMAHSLATM

SEQ ID NO: 43820 - protein, 9 aa, Homo Sapiens
AHGESSLAS

SEQ ID NO: 43821 - protein, 9 aa, Homo Sapiens
VRYPVPQPP

SEQ ID NO: 43822 - protein, 9 aa, Homo Sapiens
GVAISSRSF

SEQ ID NO: 43823 - protein, 9 aa, Homo Sapiens
DQWCQALSQ

SEQ ID NO: 43824 - protein, 9 aa, Homo Sapiens
ESTANEKAT

SEQ ID NO: 43825 - protein, 9 aa, Homo Sapiens
SKNYSRRNQ

SEQ ID NO: 43826 - protein, 9 aa, Homo Sapiens
PAPKKIKTS

SEQ ID NO: 43827 - protein, 9 aa, Homo Sapiens
AHSLATMLS

SEQ ID NO: 43828 - protein, 9 aa, Homo Sapiens
ALRSSQPQI

SEQ ID NO: 43829 - protein, 9 aa, Homo Sapiens
PRPHLSEKS

SEQ ID NO: 43830 - protein, 9 aa, Homo Sapiens
CSAWGPCTY

SEQ ID NO: 43831 - protein, 9 aa, Homo Sapiens
RESVDTLRL

SEQ ID NO: 43832 - protein, 9 aa, Homo Sapiens
RNFSRSRLA

SEQ ID NO: 43833 - protein, 9 aa, Homo Sapiens
PAPRSRKRG

SEQ ID NO: 43834 - protein, 9 aa, Homo Sapiens
AQRKLLPRP

SEQ ID NO: 43835 - protein, 9 aa, Homo Sapiens
VQSYVPEDS

SEQ ID NO: 43836 - protein, 9 aa, Homo Sapiens
EPTEVDGPW

SEQ ID NO: 43837 - protein, 9 aa, Homo Sapiens
LLRRLLGSP

SEQ ID NO: 43838 - protein, 9 aa, Homo Sapiens
MGGMNWRPI

SEQ ID NO: 43839 - protein, 9 aa, Homo Sapiens
SSGRLARPP

SEQ ID NO: 43840 - protein, 9 aa, Homo Sapiens
VPEDSKQGP

SEQ ID NO: 43841 - protein, 9 aa, Homo Sapiens
TEVDGPWNL

SEQ ID NO: 43842 - protein, 9 aa, Homo Sapiens
VETSNLSCG

SEQ ID NO: 43843 - protein, 9 aa, Homo Sapiens
ANWEYIEII

SEQ ID NO: 43844 - protein, 9 aa, Homo Sapiens
VSPCSAWGP

SEQ ID NO: 43845 - protein, 9 aa, Homo Sapiens
RGLKKKKQY

SEQ ID NO: 43846 - protein, 9 aa, Homo Sapiens
QDWANWEYI

SEQ ID NO: 43847 - protein, 9 aa, Homo Sapiens
SQPQIRRST

SEQ ID NO: 43848 - protein, 9 aa, Homo Sapiens
RRLLGSPPP

SEQ ID NO: 43849 - protein, 9 aa, Homo Sapiens
MRDGCGCCK

SEQ ID NO: 43850 - protein, 9 aa, Homo Sapiens
MATTSRESV

SEQ ID NO: 43851 - protein, 9 aa, Homo Sapiens
KIKTSESST

SEQ ID NO: 43852 - protein, 9 aa, Homo Sapiens
LELLRRLLG

SEQ ID NO: 43853 - protein, 9 aa, Homo Sapiens
QSYVPEDSK

SEQ ID NO: 43854 - protein, 9 aa, Homo Sapiens
CEVSPCSAW

SEQ ID NO: 43855 - protein, 9 aa, Homo Sapiens
CIALKPTPH

SEQ ID NO: 43856 - protein, 9 aa, Homo Sapiens
RSSQPQIRR

SEQ ID NO: 43857 - protein, 9 aa, Homo Sapiens
GGMNWRPIL

SEQ ID NO: 43858 - protein, 9 aa, Homo Sapiens
SNLSCGRQQ

SEQ ID NO: 43859 - protein, 9 aa, Homo Sapiens
KATPFPAEP

SEQ ID NO: 43860 - protein, 9 aa, Homo Sapiens
TPVKKLSQI

SEQ ID NO: 43861 - protein, 9 aa, Homo Sapiens
ISSRSFFND

SEQ ID NO: 43862 - protein, 9 aa, Homo Sapiens
LSSSGRLAR

SEQ ID NO: 43863 - protein, 9 aa, Homo Sapiens
QRKLLPRPH

SEQ ID NO: 43864 - protein, 9 aa, Homo Sapiens
PQPAPKKIK

SEQ ID NO: 43865 - protein, 9 aa, Homo Sapiens
PCSAWGPCT

SEQ ID NO: 43866 - protein, 9 aa, Homo Sapiens
RLARPPLGM

SEQ ID NO: 43867 - protein, 9 aa, Homo Sapiens
PHLSEKSHH

SEQ ID NO: 43868 - protein, 9 aa, Homo Sapiens
RESTANEKA

SEQ ID NO: 43869 - protein, 9 aa, Homo Sapiens
IDGTYFKIR

SEQ ID NO: 43870 - protein, 9 aa, Homo Sapiens
VDTLRLELD

SEQ ID NO: 43871 - protein, 9 aa, Homo Sapiens
VDQWCQALS

SEQ ID NO: 43872 - protein, 9 aa, Homo Sapiens
KHKRIHTGQ

SEQ ID NO: 43873 - protein, 9 aa, Homo Sapiens
AVRTMTSHI

SEQ ID NO: 43874 - protein, 9 aa, Homo Sapiens
SLRNCIALK

SEQ ID NO: 43875 - protein, 9 aa, Homo Sapiens
HQDWANWEY

SEQ ID NO: 43876 - protein, 9 aa, Homo Sapiens
LATMLSDQV

SEQ ID NO: 43877 - protein, 9 aa, Homo Sapiens
RPHLSEKSH

SEQ ID NO: 43878 - protein, 9 aa, Homo Sapiens
WQSRWCKKV

SEQ ID NO: 43879 - protein, 9 aa, Homo Sapiens
RKLLPRPHL

SEQ ID NO: 43880 - protein, 9 aa, Homo Sapiens
RWQSRWCKK

SEQ ID NO: 43881 - protein, 9 aa, Homo Sapiens
NCIALKPTP

SEQ ID NO: 43882 - protein, 9 aa, Homo Sapiens
CVETSNLSC

SEQ ID NO: 43883 - protein, 9 aa, Homo Sapiens
KLDNYMYIL

SEQ ID NO: 43884 - protein, 9 aa, Homo Sapiens
SPSKNYSRR

SEQ ID NO: 43885 - protein, 9 aa, Homo Sapiens
WRPILTIIT

SEQ ID NO: 43886 - protein, 9 aa, Homo Sapiens
ATPFPAEPT

SEQ ID NO: 43887 - protein, 9 aa, Homo Sapiens
LPRPHLSEK

SEQ ID NO: 43888 - protein, 9 aa, Homo Sapiens
LGLSPSKNY

SEQ ID NO: 43889 - protein, 9 aa, Homo Sapiens
HVLLELLRR

SEQ ID NO: 43890 - protein, 9 aa, Homo Sapiens
QSLGVAISS

SEQ ID NO: 43891 - protein, 9 aa, Homo Sapiens
EVMATQGQD

SEQ ID NO: 43892 - protein, 9 aa, Homo Sapiens
TQGQDKVIF

SEQ ID NO: 43893 - protein, 9 aa, Homo Sapiens
SLATMLSDQ

SEQ ID NO: 43894 - protein, 9 aa, Homo Sapiens
LGARGPDVL

SEQ ID NO: 43895 - protein, 9 aa, Homo Sapiens
VKKLSQIGT

SEQ ID NO: 43896 - protein, 9 aa, Homo Sapiens
GESSLASSQ

SEQ ID NO: 43897 - protein, 9 aa, Homo Sapiens
RLASERGHL

SEQ ID NO: 43898 - protein, 9 aa, Homo Sapiens
LRRLLGSPP

SEQ ID NO: 43899 - protein, 9 aa, Homo Sapiens
NLSCGRQQR

SEQ ID NO: 43900 - protein, 9 aa, Homo Sapiens
LSQIGTTVV

SEQ ID NO: 43901 - protein, 9 aa, Homo Sapiens
RYPVPQPPA

SEQ ID NO: 43902 - protein, 9 aa, Homo Sapiens
ALTRVQSYV

SEQ ID NO: 43903 - protein, 9 aa, Homo Sapiens
LSPSKNYSR

SEQ ID NO: 43904 - protein, 9 aa, Homo Sapiens
PTLSSSGRL

SEQ ID NO: 43905 - protein, 9 aa, Homo Sapiens
PPGVSLMRD

SEQ ID NO: 43906 - protein, 9 aa, Homo Sapiens
ATTSRESVD

SEQ ID NO: 43907 - protein, 9 aa, Homo Sapiens
TLSSSGRLA

SEQ ID NO: 43908 - protein, 9 aa, Homo Sapiens
EVSPCSAWG

SEQ ID NO: 43909 - protein, 9 aa, Homo Sapiens
QPAPKKIKT

SEQ ID NO: 43910 - protein, 9 aa, Homo Sapiens
PQGAHGESS

SEQ ID NO: 43911 - protein, 9 aa, Homo Sapiens
ALKPTPHRR

SEQ ID NO: 43912 - protein, 9 aa, Homo Sapiens
DGPWNLPTL

SEQ ID NO: 43913 - protein, 9 aa, Homo Sapiens
SRWCKKVDP

SEQ ID NO: 43914 - protein, 9 aa, Homo Sapiens
RNCIALKPT

SEQ ID NO: 43915 - protein, 9 aa, Homo Sapiens
VDGPWNLPT

SEQ ID NO: 43916 - protein, 9 aa, Homo Sapiens
PTEVDGPWN

SEQ ID NO: 43917 - protein, 9 aa, Homo Sapiens
QVLEDVDQW

SEQ ID NO: 43918 - protein, 9 aa, Homo Sapiens
KTRSAKGLG

SEQ ID NO: 43919 - protein, 9 aa, Homo Sapiens
NEKATPFPA

SEQ ID NO: 43920 - protein, 9 aa, Homo Sapiens
FAAKLDNYM

SEQ ID NO: 43921 - protein, 9 aa, Homo Sapiens
MATQGQDKV

SEQ ID NO: 43922 - protein, 9 aa, Homo Sapiens
MNWRPILTI

SEQ ID NO: 43923 - protein, 9 aa, Homo Sapiens
IKTSESSTI

SEQ ID NO: 43924 - protein, 9 aa, Homo Sapiens
AAKLDNYMY

SEQ ID NO: 43925 - protein, 9 aa, Homo Sapiens
DGTYFKIRA

SEQ ID NO: 43926 - protein, 9 aa, Homo Sapiens
LNRGLKKKK

SEQ ID NO: 43927 - protein, 9 aa, Homo Sapiens
HNVALRSSQ

SEQ ID NO: 43928 - protein, 9 aa, Homo Sapiens
SLGVAISSR

SEQ ID NO: 43929 - protein, 9 aa, Homo Sapiens
NFSRSRLAS

SEQ ID NO: 43930 - protein, 9 aa, Homo Sapiens
VPQPPAPRS

SEQ ID NO: 43931 - protein, 9 aa, Homo Sapiens
RHVLLELLR

SEQ ID NO: 43932 - protein, 9 aa, Homo Sapiens
VRTMTSHIN

SEQ ID NO: 43933 - protein, 9 aa, Homo Sapiens
NVALRSSQP

SEQ ID NO: 43934 - protein, 9 aa, Homo Sapiens
SRSRLASER

SEQ ID NO: 43935 - protein, 9 aa, Homo Sapiens
LDMAVRTMT

SEQ ID NO: 43936 - protein, 9 aa, Homo Sapiens
LEDVDQWCQ

SEQ ID NO: 43937 - protein, 9 aa, Homo Sapiens
DWANWEYIE

SEQ ID NO: 43938 - protein, 9 aa, Homo Sapiens
DEPTEVDGP

SEQ ID NO: 43939 - protein, 9 aa, Homo Sapiens
FSRSRLASE

SEQ ID NO: 43940 - protein, 9 aa, Homo Sapiens
VLEDVDQWC

SEQ ID NO: 43941 - protein, 9 aa, Homo Sapiens
APKKIKTSE

SEQ ID NO: 43942 - protein, 9 aa, Homo Sapiens
ELLRRLLGS

SEQ ID NO: 43943 - protein, 9 aa, Homo Sapiens
SSSGRLARP

SEQ ID NO: 43944 - protein, 9 aa, Homo Sapiens
EKATPFPAE

SEQ ID NO: 43945 - protein, 9 aa, Homo Sapiens
DNYMYILPY

SEQ ID NO: 43946 - protein, 9 aa, Homo Sapiens
EVDGPWNLP

SEQ ID NO: 43947 - protein, 9 aa, Homo Sapiens
SCMGGMNWR

SEQ ID NO: 43948 - protein, 9 aa, Homo Sapiens
SVDTLRLEL

SEQ ID NO: 43949 - protein, 9 aa, Homo Sapiens
GLSPSKNYS

SEQ ID NO: 43950 - protein, 9 aa, Homo Sapiens
GLGARGPDV

SEQ ID NO: 43951 - protein, 9 aa, Homo Sapiens
VSLMRDGCG

SEQ ID NO: 43952 - protein, 9 aa, Homo Sapiens
KLSQIGTTV

SEQ ID NO: 43953 - protein, 9 aa, Homo Sapiens
QEVMATQGQ

SEQ ID NO: 43954 - protein, 9 aa, Homo Sapiens
VLLELLRRL

SEQ ID NO: 43955 - protein, 9 aa, Homo Sapiens
QGQDKVIFL

SEQ ID NO: 43956 - protein, 9 aa, Homo Sapiens
ESVDTLRLE

SEQ ID NO: 43957 - protein, 9 aa, Homo Sapiens
PVKKLSQIG

SEQ ID NO: 43958 - protein, 9 aa, Homo Sapiens
ATQGQDKVI

SEQ ID NO: 43959 - protein, 9 aa, Homo Sapiens
PVPQPPAPR

SEQ ID NO: 43960 - protein, 9 aa, Homo Sapiens
LMRDGCGCC

SEQ ID NO: 43961 - protein, 9 aa, Homo Sapiens
YFKIRAIYD

SEQ ID NO: 43962 - protein, 9 aa, Homo Sapiens
GPWNLPTLQ

SEQ ID NO: 43963 - protein, 9 aa, Homo Sapiens
LRNCIALKP

SEQ ID NO: 43964 - protein, 9 aa, Homo Sapiens
TSRESVDTL

SEQ ID NO: 43965 - protein, 9 aa, Homo Sapiens
CPPGVSLMR

SEQ ID NO: 43966 - protein, 9 aa, Homo Sapiens
KGLGARGPD

SEQ ID NO: 43967 - protein, 9 aa, Homo Sapiens
LLELLRRLL

SEQ ID NO: 43968 - protein, 9 aa, Homo Sapiens
LTRVQSYVP

SEQ ID NO: 43969 - protein, 9 aa, Homo Sapiens
WCKKVDPSA

SEQ ID NO: 43970 - protein, 9 aa, Homo Sapiens
GTYFKIRAI

SEQ ID NO: 43971 - protein, 9 aa, Homo Sapiens
PSKNYSRRN

SEQ ID NO: 43972 - protein, 9 aa, Homo Sapiens
TANEKATPF

SEQ ID NO: 43973 - protein, 9 aa, Homo Sapiens
FKTRSAKGL

SEQ ID NO: 43974 - protein, 9 aa, Homo Sapiens
GMNWRPILT

SEQ ID NO: 43975 - protein, 9 aa, Homo Sapiens
CISRVEKND

SEQ ID NO: 43976 - protein, 9 aa, Homo Sapiens
AENLQNTRA

SEQ ID NO: 43977 - protein, 9 aa, Homo Sapiens
TLHDEEANN

SEQ ID NO: 43978 - protein, 9 aa, Homo Sapiens
RPEWYDFFY

SEQ ID NO: 43979 - protein, 9 aa, Homo Sapiens
VTTTLKLIL

SEQ ID NO: 43980 - protein, 9 aa, Homo Sapiens
MMTSPTRSS

SEQ ID NO: 43981 - protein, 9 aa, Homo Sapiens
KKSPDKTKF

SEQ ID NO: 43982 - protein, 9 aa, Homo Sapiens
RIYKFRCVW

SEQ ID NO: 43983 - protein, 9 aa, Homo Sapiens
GKSHSWKVT

SEQ ID NO: 43984 - protein, 9 aa, Homo Sapiens
THTHCNPLA

SEQ ID NO: 43985 - protein, 9 aa, Homo Sapiens
RCPHGSDKW

SEQ ID NO: 43986 - protein, 9 aa, Homo Sapiens
PHKFNETQI

SEQ ID NO: 43987 - protein, 9 aa, Homo Sapiens
RRVEEPLRQ

SEQ ID NO: 43988 - protein, 9 aa, Homo Sapiens
LTFCISRVE

SEQ ID NO: 43989 - protein, 9 aa, Homo Sapiens
KLILVMLEI

SEQ ID NO: 43990 - protein, 9 aa, Homo Sapiens
KKLKLAPLQ

SEQ ID NO: 43991 - protein, 9 aa, Homo Sapiens
RSITGAVSL

SEQ ID NO: 43992 - protein, 9 aa, Homo Sapiens
LANTSIWNL

SEQ ID NO: 43993 - protein, 9 aa, Homo Sapiens
LKFEDKEAQ

SEQ ID NO: 43994 - protein, 9 aa, Homo Sapiens
LHDEEANND

SEQ ID NO: 43995 - protein, 9 aa, Homo Sapiens
YNFQPSVSL

SEQ ID NO: 43996 - protein, 9 aa, Homo Sapiens
FYREPGCEK

SEQ ID NO: 43997 - protein, 9 aa, Homo Sapiens
TRIYKFRCV

SEQ ID NO: 43998 - protein, 9 aa, Homo Sapiens
APLQVTTTL

SEQ ID NO: 43999 - protein, 9 aa, Homo Sapiens
HQGGSWWQD

SEQ ID NO: 44000 - protein, 9 aa, Homo Sapiens
NMMTSPTRS

SEQ ID NO: 44001 - protein, 9 aa, Homo Sapiens
ITGAVSLMT

SEQ ID NO: 44002 - protein, 9 aa, Homo Sapiens
PSKKKLKLA

SEQ ID NO: 44003 - protein, 9 aa, Homo Sapiens
WEGKSHSWK

SEQ ID NO: 44004 - protein, 9 aa, Homo Sapiens
YSLGFLTFC

SEQ ID NO: 44005 - protein, 9 aa, Homo Sapiens
QALAHEYNF

SEQ ID NO: 44006 - protein, 9 aa, Homo Sapiens
SSSTRQGRS

SEQ ID NO: 44007 - protein, 9 aa, Homo Sapiens
CALKTAENL

SEQ ID NO: 44008 - protein, 9 aa, Homo Sapiens
HITLHDEEA

SEQ ID NO: 44009 - protein, 9 aa, Homo Sapiens
FCISRVEKN

SEQ ID NO: 44010 - protein, 9 aa, Homo Sapiens
GLPRRVEEP

SEQ ID NO: 44011 - protein, 9 aa, Homo Sapiens
FQPSVSLRD

SEQ ID NO: 44012 - protein, 9 aa, Homo Sapiens
THTHTHCNP

SEQ ID NO: 44013 - protein, 9 aa, Homo Sapiens
TGAVSLMTG

SEQ ID NO: 44014 - protein, 9 aa, Homo Sapiens
CHSLTRIYK

SEQ ID NO: 44015 - protein, 9 aa, Homo Sapiens
YGAFQPRLR

SEQ ID NO: 44016 - protein, 9 aa, Homo Sapiens
STRQGRSIT

SEQ ID NO: 44017 - protein, 9 aa, Homo Sapiens
SWEGKSHSW

SEQ ID NO: 44018 - protein, 9 aa, Homo Sapiens
TRSSSTRQG

SEQ ID NO: 44019 - protein, 9 aa, Homo Sapiens
YREPGCEKW

SEQ ID NO: 44020 - protein, 9 aa, Homo Sapiens
GPNNLSKCK

SEQ ID NO: 44021 - protein, 9 aa, Homo Sapiens
LSKCKLLPA

SEQ ID NO: 44022 - protein, 9 aa, Homo Sapiens
NGFSNRDVL

SEQ ID NO: 44023 - protein, 9 aa, Homo Sapiens
CISQLRCSW

SEQ ID NO: 44024 - protein, 9 aa, Homo Sapiens
QVTTTLKLI

SEQ ID NO: 44025 - protein, 9 aa, Homo Sapiens
WTNMMTSPT

SEQ ID NO: 44026 - protein, 9 aa, Homo Sapiens
CTHTHTHTH

SEQ ID NO: 44027 - protein, 9 aa, Homo Sapiens
RVHITLHDE

SEQ ID NO: 44028 - protein, 9 aa, Homo Sapiens
HREFLHRPV

SEQ ID NO: 44029 - protein, 9 aa, Homo Sapiens
IYKFRCVWI

SEQ ID NO: 44030 - protein, 9 aa, Homo Sapiens
TRQGRSITG

SEQ ID NO: 44031 - protein, 9 aa, Homo Sapiens
FFTSDYSYF

SEQ ID NO: 44032 - protein, 9 aa, Homo Sapiens
SISWSPGLA

SEQ ID NO: 44033 - protein, 9 aa, Homo Sapiens
RQGRSITGA

SEQ ID NO: 44034 - protein, 9 aa, Homo Sapiens
ANTSIWNLS

SEQ ID NO: 44035 - protein, 9 aa, Homo Sapiens
AEKPYKCGE

SEQ ID NO: 44036 - protein, 9 aa, Homo Sapiens
LRCSWTNMM

SEQ ID NO: 44037 - protein, 9 aa, Homo Sapiens
SWSPGLARK

SEQ ID NO: 44038 - protein, 9 aa, Homo Sapiens
PSCNNRHFW

SEQ ID NO: 44039 - protein, 9 aa, Homo Sapiens
AGTYPHKFN

SEQ ID NO: 44040 - protein, 9 aa, Homo Sapiens
VPAGTYPHK

SEQ ID NO: 44041 - protein, 9 aa, Homo Sapiens
EAAQILETE

SEQ ID NO: 44042 - protein, 9 aa, Homo Sapiens
PLRQLMPNP

SEQ ID NO: 44043 - protein, 9 aa, Homo Sapiens
VSGYVPEEI

SEQ ID NO: 44044 - protein, 9 aa, Homo Sapiens
PSNYADPYR

SEQ ID NO: 44045 - protein, 9 aa, Homo Sapiens
IDTHNRNYG

SEQ ID NO: 44046 - protein, 9 aa, Homo Sapiens
ENLQNTRAW

SEQ ID NO: 44047 - protein, 9 aa, Homo Sapiens
MTSPTRSSS

SEQ ID NO: 44048 - protein, 9 aa, Homo Sapiens
FLTFCISRV

SEQ ID NO: 44049 - protein, 9 aa, Homo Sapiens
SSAAARLDQ

SEQ ID NO: 44050 - protein, 9 aa, Homo Sapiens
AQILETETF

SEQ ID NO: 44051 - protein, 9 aa, Homo Sapiens
FTSDYSYFR

SEQ ID NO: 44052 - protein, 9 aa, Homo Sapiens
YGIREGNGF

SEQ ID NO: 44053 - protein, 9 aa, Homo Sapiens
KEAQAVYWH

SEQ ID NO: 44054 - protein, 9 aa, Homo Sapiens
IREGNGFSN

SEQ ID NO: 44055 - protein, 9 aa, Homo Sapiens
KSPDKTKFF

SEQ ID NO: 44056 - protein, 9 aa, Homo Sapiens
DFSWEGKSH

SEQ ID NO: 44057 - protein, 9 aa, Homo Sapiens
LYGIREGNG

SEQ ID NO: 44058 - protein, 9 aa, Homo Sapiens
LHRPVSGYV

SEQ ID NO: 44059 - protein, 9 aa, Homo Sapiens
HTHTHCNPL

SEQ ID NO: 44060 - protein, 9 aa, Homo Sapiens
SLTRIYKFR

SEQ ID NO: 44061 - protein, 9 aa, Homo Sapiens
DTHNRNYGA

SEQ ID NO: 44062 - protein, 9 aa, Homo Sapiens
CSWTNMMTS

SEQ ID NO: 44063 - protein, 9 aa, Homo Sapiens
TRHKRLHTA

SEQ ID NO: 44064 - protein, 9 aa, Homo Sapiens
ALKTAENLQ

SEQ ID NO: 44065 - protein, 9 aa, Homo Sapiens
SYAAGPPSN

SEQ ID NO: 44066 - protein, 9 aa, Homo Sapiens
AVSLMTGTG

SEQ ID NO: 44067 - protein, 9 aa, Homo Sapiens
DLGKVSSAA

SEQ ID NO: 44068 - protein, 9 aa, Homo Sapiens
NLSKCKLLP

SEQ ID NO: 44069 - protein, 9 aa, Homo Sapiens
EFLHRPVSG

SEQ ID NO: 44070 - protein, 9 aa, Homo Sapiens
THTHTHTHC

SEQ ID NO: 44071 - protein, 9 aa, Homo Sapiens
ISWSPGLAR

SEQ ID NO: 44072 - protein, 9 aa, Homo Sapiens
HKFNETQIK

SEQ ID NO: 44073 - protein, 9 aa, Homo Sapiens
REFLHRPVS

SEQ ID NO: 44074 - protein, 9 aa, Homo Sapiens
EEPLRQLMP

SEQ ID NO: 44075 - protein, 9 aa, Homo Sapiens
KLKLAPLQV

SEQ ID NO: 44076 - protein, 9 aa, Homo Sapiens
KKKLKLAPL

SEQ ID NO: 44077 - protein, 9 aa, Homo Sapiens
LVMLEIVTE

SEQ ID NO: 44078 - protein, 9 aa, Homo Sapiens
LAPLQVTTT

SEQ ID NO: 44079 - protein, 9 aa, Homo Sapiens
RVEEPLRQL

SEQ ID NO: 44080 - protein, 9 aa, Homo Sapiens
SSTRQGRSI

SEQ ID NO: 44081 - protein, 9 aa, Homo Sapiens
EHQGGSWWQ

SEQ ID NO: 44082 - protein, 9 aa, Homo Sapiens
YIVERCPHG

SEQ ID NO: 44083 - protein, 9 aa, Homo Sapiens
SLMTGTGAA

SEQ ID NO: 44084 - protein, 9 aa, Homo Sapiens
SIWNLSLSN

SEQ ID NO: 44085 - protein, 9 aa, Homo Sapiens
VSLMTGTGA

SEQ ID NO: 44086 - protein, 9 aa, Homo Sapiens
FIDTHNRNY

SEQ ID NO: 44087 - protein, 9 aa, Homo Sapiens
WYDFFYREP

SEQ ID NO: 44088 - protein, 9 aa, Homo Sapiens
YDFFYREPG

SEQ ID NO: 44089 - protein, 9 aa, Homo Sapiens
TSDYSYFRT

SEQ ID NO: 44090 - protein, 9 aa, Homo Sapiens
EECGLVLFC

SEQ ID NO: 44091 - protein, 9 aa, Homo Sapiens
RCSWTNMMT

SEQ ID NO: 44092 - protein, 9 aa, Homo Sapiens
FFYREPGCE

SEQ ID NO: 44093 - protein, 9 aa, Homo Sapiens
HKRLHTAEK

SEQ ID NO: 44094 - protein, 9 aa, Homo Sapiens
TFCISRVEK

SEQ ID NO: 44095 - protein, 9 aa, Homo Sapiens
RNYGAFQPR

SEQ ID NO: 44096 - protein, 9 aa, Homo Sapiens
SKCKLLPAV

SEQ ID NO: 44097 - protein, 9 aa, Homo Sapiens
LILVMLEIV

SEQ ID NO: 44098 - protein, 9 aa, Homo Sapiens
VEEPLRQLM

SEQ ID NO: 44099 - protein, 9 aa, Homo Sapiens
RHKRLHTAE

SEQ ID NO: 44100 - protein, 9 aa, Homo Sapiens
QDFSWEGKS

SEQ ID NO: 44101 - protein, 9 aa, Homo Sapiens
REGNGFSNR

SEQ ID NO: 44102 - protein, 9 aa, Homo Sapiens
ILVMLEIVT

SEQ ID NO: 44103 - protein, 9 aa, Homo Sapiens
LMTGTGAAS

SEQ ID NO: 44104 - protein, 9 aa, Homo Sapiens
VSSAAARLD

SEQ ID NO: 44105 - protein, 9 aa, Homo Sapiens
NLQNTRAWL

SEQ ID NO: 44106 - protein, 9 aa, Homo Sapiens
PAGTYPHKF

SEQ ID NO: 44107 - protein, 9 aa, Homo Sapiens
LRICISQLR

SEQ ID NO: 44108 - protein, 9 aa, Homo Sapiens
YPHKFNETQ

SEQ ID NO: 44109 - protein, 9 aa, Homo Sapiens
HNRNYGAFQ

SEQ ID NO: 44110 - protein, 9 aa, Homo Sapiens
AGPPSNYAD

SEQ ID NO: 44111 - protein, 9 aa, Homo Sapiens
GSWWQDFSW

SEQ ID NO: 44112 - protein, 9 aa, Homo Sapiens
GFLTFCISR

SEQ ID NO: 44113 - protein, 9 aa, Homo Sapiens
TTTLKLILV

SEQ ID NO: 44114 - protein, 9 aa, Homo Sapiens
TLKLILVML

SEQ ID NO: 44115 - protein, 9 aa, Homo Sapiens
TPSKKKLKL

SEQ ID NO: 44116 - protein, 9 aa, Homo Sapiens
ICISQLRCS

SEQ ID NO: 44117 - protein, 9 aa, Homo Sapiens
DVPAGTYPH

SEQ ID NO: 44118 - protein, 9 aa, Homo Sapiens
PRRVEEPLR

SEQ ID NO: 44119 - protein, 9 aa, Homo Sapiens
IVERCPHGS

SEQ ID NO: 44120 - protein, 9 aa, Homo Sapiens
SCLPSCNNR

SEQ ID NO: 44121 - protein, 9 aa, Homo Sapiens
ITTPSKKKL

SEQ ID NO: 44122 - protein, 9 aa, Homo Sapiens
LELLKFEDK

SEQ ID NO: 44123 - protein, 9 aa, Homo Sapiens
LETETFIPL

SEQ ID NO: 44124 - protein, 9 aa, Homo Sapiens
PEWYDFFYR

SEQ ID NO: 44125 - protein, 9 aa, Homo Sapiens
EYNFQPSVS

SEQ ID NO: 44126 - protein, 9 aa, Homo Sapiens
QLRCSWTNM

SEQ ID NO: 44127 - protein, 9 aa, Homo Sapiens
LKLILVMLE

SEQ ID NO: 44128 - protein, 9 aa, Homo Sapiens
GNGFSNRDV

SEQ ID NO: 44129 - protein, 9 aa, Homo Sapiens
HSWKVTSLG

SEQ ID NO: 44130 - protein, 9 aa, Homo Sapiens
LPSCNNRHF

SEQ ID NO: 44131 - protein, 9 aa, Homo Sapiens
WEGVSISWS

SEQ ID NO: 44132 - protein, 9 aa, Homo Sapiens
QGGSWWQDF

SEQ ID NO: 44133 - protein, 9 aa, Homo Sapiens
SITGAVSLM

SEQ ID NO: 44134 - protein, 9 aa, Homo Sapiens
FLHRPVSGY

SEQ ID NO: 44135 - protein, 9 aa, Homo Sapiens
IWNLSLSNS

SEQ ID NO: 44136 - protein, 9 aa, Homo Sapiens
SPTRSSSTR

SEQ ID NO: 44137 - protein, 9 aa, Homo Sapiens
SPQCRRLAE

SEQ ID NO: 44138 - protein, 9 aa, Homo Sapiens
TSIWNLSLS

SEQ ID NO: 44139 - protein, 9 aa, Homo Sapiens
PTRSSSTRQ

SEQ ID NO: 44140 - protein, 9 aa, Homo Sapiens
THNRNYGAF

SEQ ID NO: 44141 - protein, 9 aa, Homo Sapiens
LKTAENLQN

SEQ ID NO: 44142 - protein, 9 aa, Homo Sapiens
HTHTHTHCN

SEQ ID NO: 44143 - protein, 9 aa, Homo Sapiens
EKKSPDKTK

SEQ ID NO: 44144 - protein, 9 aa, Homo Sapiens
EWYDFFYRE

SEQ ID NO: 44145 - protein, 9 aa, Homo Sapiens
QCRRLAEHQ

SEQ ID NO: 44146 - protein, 9 aa, Homo Sapiens
ELLKFEDKE

SEQ ID NO: 44147 - protein, 9 aa, Homo Sapiens
SHSWKVTSL

SEQ ID NO: 44148 - protein, 9 aa, Homo Sapiens
YAAGPPSNY

SEQ ID NO: 44149 - protein, 9 aa, Homo Sapiens
TYPHKFNET

SEQ ID NO: 44150 - protein, 9 aa, Homo Sapiens
GKVSSAAAR

SEQ ID NO: 44151 - protein, 9 aa, Homo Sapiens
NTSIWNLSL

SEQ ID NO: 44152 - protein, 9 aa, Homo Sapiens
ALSDLGKVS

SEQ ID NO: 44153 - protein, 9 aa, Homo Sapiens
SWTNMMTSP

SEQ ID NO: 44154 - protein, 9 aa, Homo Sapiens
GAVSLMTGT

SEQ ID NO: 44155 - protein, 9 aa, Homo Sapiens
AAGPPSNYA

SEQ ID NO: 44156 - protein, 9 aa, Homo Sapiens
PDKTKFFTS

SEQ ID NO: 44157 - protein, 9 aa, Homo Sapiens
KVSSAAARL

SEQ ID NO: 44158 - protein, 9 aa, Homo Sapiens
EEAAQILET

SEQ ID NO: 44159 - protein, 9 aa, Homo Sapiens
PVSGYVPEE

SEQ ID NO: 44160 - protein, 9 aa, Homo Sapiens
ASYAAGPPS

SEQ ID NO: 44161 - protein, 9 aa, Homo Sapiens
IEECGLVLF

SEQ ID NO: 44162 - protein, 9 aa, Homo Sapiens
TAENLQNTR

SEQ ID NO: 44163 - protein, 9 aa, Homo Sapiens
VERCPHGSD

SEQ ID NO: 44164 - protein, 9 aa, Homo Sapiens
SDLGKVSSA

SEQ ID NO: 44165 - protein, 9 aa, Homo Sapiens
FSWEGKSHS

SEQ ID NO: 44166 - protein, 9 aa, Homo Sapiens
LAHEYNFQP

SEQ ID NO: 44167 - protein, 9 aa, Homo Sapiens
LGKVSSAAA

SEQ ID NO: 44168 - protein, 9 aa, Homo Sapiens
SPDKTKFFT

SEQ ID NO: 44169 - protein, 9 aa, Homo Sapiens
LQVTTTLKL

SEQ ID NO: 44170 - protein, 9 aa, Homo Sapiens
PLYGIREGN

SEQ ID NO: 44171 - protein, 9 aa, Homo Sapiens
FEDKEAQAV

SEQ ID NO: 44172 - protein, 9 aa, Homo Sapiens
NIEECGLVL

SEQ ID NO: 44173 - protein, 9 aa, Homo Sapiens
KTKFFTSDY

SEQ ID NO: 44174 - protein, 9 aa, Homo Sapiens
CRRLAEHQG

SEQ ID NO: 44175 - protein, 9 aa, Homo Sapiens
AEHQGGSWW

SEQ ID NO: 44176 - protein, 9 aa, Homo Sapiens
LTRIYKFRC

SEQ ID NO: 44177 - protein, 9 aa, Homo Sapiens
QGRSITGAV

SEQ ID NO: 44178 - protein, 9 aa, Homo Sapiens
NRNYGAFQP

SEQ ID NO: 44179 - protein, 9 aa, Homo Sapiens
NFQPSVSLR

SEQ ID NO: 44180 - protein, 9 aa, Homo Sapiens
WSPGLARKR

SEQ ID NO: 44181 - protein, 9 aa, Homo Sapiens
CLPSCNNRH

SEQ ID NO: 44182 - protein, 9 aa, Homo Sapiens
SWKVTSLGT

SEQ ID NO: 44183 - protein, 9 aa, Homo Sapiens
VSISWSPGL

SEQ ID NO: 44184 - protein, 9 aa, Homo Sapiens
PNNLSKCKL

SEQ ID NO: 44185 - protein, 9 aa, Homo Sapiens
TTLKLILVM

SEQ ID NO: 44186 - protein, 9 aa, Homo Sapiens
TKFFTSDYS

SEQ ID NO: 44187 - protein, 9 aa, Homo Sapiens
RASYAAGPP

SEQ ID NO: 44188 - protein, 9 aa, Homo Sapiens
KFFTSDYSY

SEQ ID NO: 44189 - protein, 9 aa, Homo Sapiens
KTAENLQNT

SEQ ID NO: 44190 - protein, 9 aa, Homo Sapiens
TTPSKKKLK

SEQ ID NO: 44191 - protein, 9 aa, Homo Sapiens
AHEYNFQPS

SEQ ID NO: 44192 - protein, 9 aa, Homo Sapiens
ITLHDEEAN

SEQ ID NO: 44193 - protein, 9 aa, Homo Sapiens
ASPQCRRLA

SEQ ID NO: 44194 - protein, 9 aa, Homo Sapiens
GYIVERCPH

SEQ ID NO: 44195 - protein, 9 aa, Homo Sapiens
KSHSWKVTS

SEQ ID NO: 44196 - protein, 9 aa, Homo Sapiens
QILETETFI

SEQ ID NO: 44197 - protein, 9 aa, Homo Sapiens
LQNTRAWLN

SEQ ID NO: 44198 - protein, 9 aa, Homo Sapiens
PLASPQCRR

SEQ ID NO: 44199 - protein, 9 aa, Homo Sapiens
NYGAFQPRL

SEQ ID NO: 44200 - protein, 9 aa, Homo Sapiens
YKFRCVWIE

SEQ ID NO: 44201 - protein, 9 aa, Homo Sapiens
EGKSHSWKV

SEQ ID NO: 44202 - protein, 9 aa, Homo Sapiens
GRSITGAVS

SEQ ID NO: 44203 - protein, 9 aa, Homo Sapiens
QWEGVSISW

SEQ ID NO: 44204 - protein, 9 aa, Homo Sapiens
CPHGSDKWV

SEQ ID NO: 44205 - protein, 9 aa, Homo Sapiens
CKLLPAVRA

SEQ ID NO: 44206 - protein, 9 aa, Homo Sapiens
LAEHQGGSW

SEQ ID NO: 44207 - protein, 9 aa, Homo Sapiens
HEYNFQPSV

SEQ ID NO: 44208 - protein, 9 aa, Homo Sapiens
TNMMTSPTR

SEQ ID NO: 44209 - protein, 9 aa, Homo Sapiens
HSLTRIYKF

SEQ ID NO: 44210 - protein, 9 aa, Homo Sapiens
TSPTRSSST

SEQ ID NO: 44211 - protein, 9 aa, Homo Sapiens
RLAEHQGGS

SEQ ID NO: 44212 - protein, 9 aa, Homo Sapiens
SLGFLTFCI

SEQ ID NO: 44213 - protein, 9 aa, Homo Sapiens
HTHCNPLAS

SEQ ID NO: 44214 - protein, 9 aa, Homo Sapiens
LGFLTFCIS

SEQ ID NO: 44215 - protein, 9 aa, Homo Sapiens
LPRRVEEPL

SEQ ID NO: 44216 - protein, 9 aa, Homo Sapiens
NNIEECGLV

SEQ ID NO: 44217 - protein, 9 aa, Homo Sapiens
HCNPLASPQ

SEQ ID NO: 44218 - protein, 9 aa, Homo Sapiens
TAEKPYKCG

SEQ ID NO: 44219 - protein, 9 aa, Homo Sapiens
TETFIPLLL

SEQ ID NO: 44220 - protein, 9 aa, Homo Sapiens
PHGSDKWVA

SEQ ID NO: 44221 - protein, 9 aa, Homo Sapiens
SQLRCSWTN

SEQ ID NO: 44222 - protein, 9 aa, Homo Sapiens
NPLASPQCR

SEQ ID NO: 44223 - protein, 9 aa, Homo Sapiens
SDYSYFRTM

SEQ ID NO: 44224 - protein, 9 aa, Homo Sapiens
EGVSISWSP

SEQ ID NO: 44225 - protein, 9 aa, Homo Sapiens
GGSWWQDFS

SEQ ID NO: 44226 - protein, 9 aa, Homo Sapiens
PPSNYADPY

SEQ ID NO: 44227 - protein, 9 aa, Homo Sapiens
DKTKFFTSD

SEQ ID NO: 44228 - protein, 9 aa, Homo Sapiens
KFEDKEAQA

SEQ ID NO: 44229 - protein, 9 aa, Homo Sapiens
SKKKLKLAP

SEQ ID NO: 44230 - protein, 9 aa, Homo Sapiens
HGSDKWVAC

SEQ ID NO: 44231 - protein, 9 aa, Homo Sapiens
AAQILETET

SEQ ID NO: 44232 - protein, 9 aa, Homo Sapiens
KRLHTAEKP

SEQ ID NO: 44233 - protein, 9 aa, Homo Sapiens
EGNGFSNRD

SEQ ID NO: 44234 - protein, 9 aa, Homo Sapiens
KCHSLTRIY

SEQ ID NO: 44235 - protein, 9 aa, Homo Sapiens
DEEANNDIF

SEQ ID NO: 44236 - protein, 9 aa, Homo Sapiens
ETETFIPLL

SEQ ID NO: 44237 - protein, 9 aa, Homo Sapiens
EDKEAQAVY

SEQ ID NO: 44238 - protein, 9 aa, Homo Sapiens
GVSISWSPG

SEQ ID NO: 44239 - protein, 9 aa, Homo Sapiens
GPPSNYADP

SEQ ID NO: 44240 - protein, 9 aa, Homo Sapiens
FRVHITLHD

SEQ ID NO: 44241 - protein, 9 aa, Homo Sapiens
ISQLRCSWT

SEQ ID NO: 44242 - protein, 9 aa, Homo Sapiens
CNPLASPQC

SEQ ID NO: 44243 - protein, 9 aa, Homo Sapiens
KGPNNLSKC

SEQ ID NO: 44244 - protein, 9 aa, Homo Sapiens
GIREGNGFS

SEQ ID NO: 44245 - protein, 9 aa, Homo Sapiens
EPLRQLMPN

SEQ ID NO: 44246 - protein, 9 aa, Homo Sapiens
WWQDFSWEG

SEQ ID NO: 44247 - protein, 9 aa, Homo Sapiens
WNLSLSNSQ

SEQ ID NO: 44248 - protein, 9 aa, Homo Sapiens
SWWQDFSWE

SEQ ID NO: 44249 - protein, 9 aa, Homo Sapiens
PQCRRLAEH

SEQ ID NO: 44250 - protein, 9 aa, Homo Sapiens
RPVSGYVPE

SEQ ID NO: 44251 - protein, 9 aa, Homo Sapiens
RSSSTRQGR

SEQ ID NO: 44252 - protein, 9 aa, Homo Sapiens
RICISQLRC

SEQ ID NO: 44253 - protein, 9 aa, Homo Sapiens
GTYPHKFNE

SEQ ID NO: 44254 - protein, 9 aa, Homo Sapiens
KLAPLQVTT

SEQ ID NO: 44255 - protein, 9 aa, Homo Sapiens
WQDFSWEGK

SEQ ID NO: 44256 - protein, 9 aa, Homo Sapiens
HDEEANNDI

SEQ ID NO: 44257 - protein, 9 aa, Homo Sapiens
RRLAEHQGG

SEQ ID NO: 44258 - protein, 9 aa, Homo Sapiens
LLKFEDKEA

SEQ ID NO: 44259 - protein, 9 aa, Homo Sapiens
LSDLGKVSS

SEQ ID NO: 44260 - protein, 9 aa, Homo Sapiens
THCNPLASP

SEQ ID NO: 44261 - protein, 9 aa, Homo Sapiens
PLQVTTTLK

SEQ ID NO: 44262 - protein, 9 aa, Homo Sapiens
HRPVSGYVP

SEQ ID NO: 44263 - protein, 9 aa, Homo Sapiens
DFFYREPGC

SEQ ID NO: 44264 - protein, 9 aa, Homo Sapiens
ALAHEYNFQ

SEQ ID NO: 44265 - protein, 9 aa, Homo Sapiens
LASPQCRRL

SEQ ID NO: 44266 - protein, 9 aa, Homo Sapiens
DKEAQAVYW

SEQ ID NO: 44267 - protein, 9 aa, Homo Sapiens
VHITLHDEE

SEQ ID NO: 44268 - protein, 9 aa, Homo Sapiens
ILETETFIP

SEQ ID NO: 44269 - protein, 9 aa, Homo Sapiens
LELANTSIW

SEQ ID NO: 44270 - protein, 9 aa, Homo Sapiens
LKLAPLQVT

SEQ ID NO: 44271 - protein, 9 aa, Homo Sapiens
ELANTSIWN

SEQ ID NO: 44272 - protein, 9 aa, Homo Sapiens
ERCPHGSDK

SEQ ID NO: 44273 - protein, 9 aa, Homo Sapiens
NNLSKCKLL

SEQ ID NO: 44274 - protein, 9 aa, Homo Sapiens
KCKLLPAVR

SEQ ID NO: 44275 - protein, 9 aa, Homo Sapiens
DAFTDPAIK

SEQ ID NO: 44276 - protein, 9 aa, Homo Sapiens
PEVLHTEVL

SEQ ID NO: 44277 - protein, 9 aa, Homo Sapiens
KFLHINDFK

SEQ ID NO: 44278 - protein, 9 aa, Homo Sapiens
YRQALQEKV

SEQ ID NO: 44279 - protein, 9 aa, Homo Sapiens
LKKQKLMKL

SEQ ID NO: 44280 - protein, 9 aa, Homo Sapiens
RVNAEFVLL

SEQ ID NO: 44281 - protein, 9 aa, Homo Sapiens
PVIEDAQHP

SEQ ID NO: 44282 - protein, 9 aa, Homo Sapiens
CAIVAGNKE

SEQ ID NO: 44283 - protein, 9 aa, Homo Sapiens
PHLELEDDT

SEQ ID NO: 44284 - protein, 9 aa, Homo Sapiens
HGVRIFAIN

SEQ ID NO: 44285 - protein, 9 aa, Homo Sapiens
IRSEYRKKG

SEQ ID NO: 44286 - protein, 9 aa, Homo Sapiens
DDGDCCEPQ

SEQ ID NO: 44287 - protein, 9 aa, Homo Sapiens
IIWCNLQYR

SEQ ID NO: 44288 - protein, 9 aa, Homo Sapiens
HLELEDDTS

SEQ ID NO: 44289 - protein, 9 aa, Homo Sapiens
AVFILEVHQ

SEQ ID NO: 44290 - protein, 9 aa, Homo Sapiens
LLPTLLESS

SEQ ID NO: 44291 - protein, 9 aa, Homo Sapiens
FSQSFSLIE

SEQ ID NO: 44292 - protein, 9 aa, Homo Sapiens
LEDDTSYFD

SEQ ID NO: 44293 - protein, 9 aa, Homo Sapiens
LHGVRIFAI

SEQ ID NO: 44294 - protein, 9 aa, Homo Sapiens
TSMPTLTPS

SEQ ID NO: 44295 - protein, 9 aa, Homo Sapiens
APSSVTDDL

SEQ ID NO: 44296 - protein, 9 aa, Homo Sapiens
GASAGGLVA

SEQ ID NO: 44297 - protein, 9 aa, Homo Sapiens
DYSLGDSQG

SEQ ID NO: 44298 - protein, 9 aa, Homo Sapiens
SLQLKKQKL

SEQ ID NO: 44299 - protein, 9 aa, Homo Sapiens
TKFYQEDEM

SEQ ID NO: 44300 - protein, 9 aa, Homo Sapiens
TTLRNGLIV

SEQ ID NO: 44301 - protein, 9 aa, Homo Sapiens
TTKSRDPLA

SEQ ID NO: 44302 - protein, 9 aa, Homo Sapiens
CNFPHRPDS

SEQ ID NO: 44303 - protein, 9 aa, Homo Sapiens
HPNDSSTLK

SEQ ID NO: 44304 - protein, 9 aa, Homo Sapiens
NQAHSCPEH

SEQ ID NO: 44305 - protein, 9 aa, Homo Sapiens
GRSGDGASA

SEQ ID NO: 44306 - protein, 9 aa, Homo Sapiens
TEETKKYGR

SEQ ID NO: 44307 - protein, 9 aa, Homo Sapiens
DENRMYKQC

SEQ ID NO: 44308 - protein, 9 aa, Homo Sapiens
NLVNNLRKD

SEQ ID NO: 44309 - protein, 9 aa, Homo Sapiens
IITNQFVAR

SEQ ID NO: 44310 - protein, 9 aa, Homo Sapiens
GDGASAGGL

SEQ ID NO: 44311 - protein, 9 aa, Homo Sapiens
PKVSEESHK

SEQ ID NO: 44312 - protein, 9 aa, Homo Sapiens
SHRVTNLPC

SEQ ID NO: 44313 - protein, 9 aa, Homo Sapiens
FEEVFGFKI

SEQ ID NO: 44314 - protein, 9 aa, Homo Sapiens
KIMPPLKPH

SEQ ID NO: 44315 - protein, 9 aa, Homo Sapiens
EAIRQQQVE

SEQ ID NO: 44316 - protein, 9 aa, Homo Sapiens
KPLAPAPEV

SEQ ID NO: 44317 - protein, 9 aa, Homo Sapiens
AEFIPHLEL

SEQ ID NO: 44318 - protein, 9 aa, Homo Sapiens
GAQVIENYP

SEQ ID NO: 44319 - protein, 9 aa, Homo Sapiens
SPAPEKPLA

SEQ ID NO: 44320 - protein, 9 aa, Homo Sapiens
SSIITNQFV

SEQ ID NO: 44321 - protein, 9 aa, Homo Sapiens
LAENRKNTS

SEQ ID NO: 44322 - protein, 9 aa, Homo Sapiens
ISTDYSLGD

SEQ ID NO: 44323 - protein, 9 aa, Homo Sapiens
IRQQQVEQL

SEQ ID NO: 44324 - protein, 9 aa, Homo Sapiens
EGRTCWSLG

SEQ ID NO: 44325 - protein, 9 aa, Homo Sapiens
QWPDLHSHH

SEQ ID NO: 44326 - protein, 9 aa, Homo Sapiens
SVPTAPKVS

SEQ ID NO: 44327 - protein, 9 aa, Homo Sapiens
CRKGFIYKS

SEQ ID NO: 44328 - protein, 9 aa, Homo Sapiens
VLSRYNVRL

SEQ ID NO: 44329 - protein, 9 aa, Homo Sapiens
ALKLACLLP

SEQ ID NO: 44330 - protein, 9 aa, Homo Sapiens
FIPHLELED

SEQ ID NO: 44331 - protein, 9 aa, Homo Sapiens
VNNLRKDKS

SEQ ID NO: 44332 - protein, 9 aa, Homo Sapiens
YSLGDSQGA

SEQ ID NO: 44333 - protein, 9 aa, Homo Sapiens
FPLASPSTS

SEQ ID NO: 44334 - protein, 9 aa, Homo Sapiens
KDYSDRTIS

SEQ ID NO: 44335 - protein, 9 aa, Homo Sapiens
VITEETKKY

SEQ ID NO: 44336 - protein, 9 aa, Homo Sapiens
EHNCMTTKS

SEQ ID NO: 44337 - protein, 9 aa, Homo Sapiens
APKVSEESH

SEQ ID NO: 44338 - protein, 9 aa, Homo Sapiens
MPPLKPHPP

SEQ ID NO: 44339 - protein, 9 aa, Homo Sapiens
QELYRQALQ

SEQ ID NO: 44340 - protein, 9 aa, Homo Sapiens
PPQIRILNR

SEQ ID NO: 44341 - protein, 9 aa, Homo Sapiens
SEDPEGPCP

SEQ ID NO: 44342 - protein, 9 aa, Homo Sapiens
KIMTKFYQE

SEQ ID NO: 44343 - protein, 9 aa, Homo Sapiens
FPHRPDSGD

SEQ ID NO: 44344 - protein, 9 aa, Homo Sapiens
RPFACGDCR

SEQ ID NO: 44345 - protein, 9 aa, Homo Sapiens
PYNCKQCGK

SEQ ID NO: 44346 - protein, 9 aa, Homo Sapiens
PTAPKVSEE

SEQ ID NO: 44347 - protein, 9 aa, Homo Sapiens
GNGSVPMPT

SEQ ID NO: 44348 - protein, 9 aa, Homo Sapiens
VLLQQHQDR

SEQ ID NO: 44349 - protein, 9 aa, Homo Sapiens
NVRLRPNFG

SEQ ID NO: 44350 - protein, 9 aa, Homo Sapiens
PTIMGCYLG

SEQ ID NO: 44351 - protein, 9 aa, Homo Sapiens
SMPTLTPSE

SEQ ID NO: 44352 - protein, 9 aa, Homo Sapiens
LVVETGQDV

SEQ ID NO: 44353 - protein, 9 aa, Homo Sapiens
GEQKIVTSV

SEQ ID NO: 44354 - protein, 9 aa, Homo Sapiens
LSDSAICVQ

SEQ ID NO: 44355 - protein, 9 aa, Homo Sapiens
LELEDDTSY

SEQ ID NO: 44356 - protein, 9 aa, Homo Sapiens
EYPCLCDAD

SEQ ID NO: 44357 - protein, 9 aa, Homo Sapiens
LDPFRVNAE

SEQ ID NO: 44358 - protein, 9 aa, Homo Sapiens
FDDGDCCEP

SEQ ID NO: 44359 - protein, 9 aa, Homo Sapiens
IDLKKPQNQ

SEQ ID NO: 44360 - protein, 9 aa, Homo Sapiens
NIIWCNLQY

SEQ ID NO: 44361 - protein, 9 aa, Homo Sapiens
LMYSLRNKE

SEQ ID NO: 44362 - protein, 9 aa, Homo Sapiens
LWQWPDLHS

SEQ ID NO: 44363 - protein, 9 aa, Homo Sapiens
RKKGFQEVV

SEQ ID NO: 44364 - protein, 9 aa, Homo Sapiens
QKIMPPLKP

SEQ ID NO: 44365 - protein, 9 aa, Homo Sapiens
KDKSKVAKK

SEQ ID NO: 44366 - protein, 9 aa, Homo Sapiens
SQNKIEVLL

SEQ ID NO: 44367 - protein, 9 aa, Homo Sapiens
PQNQGLNHT

SEQ ID NO: 44368 - protein, 9 aa, Homo Sapiens
IMTKFYQED

SEQ ID NO: 44369 - protein, 9 aa, Homo Sapiens
ENILVNNDF

SEQ ID NO: 44370 - protein, 9 aa, Homo Sapiens
NKENIFIID

SEQ ID NO: 44371 - protein, 9 aa, Homo Sapiens
SNDDGEQKI

SEQ ID NO: 44372 - protein, 9 aa, Homo Sapiens
PPLKPHPPV

SEQ ID NO: 44373 - protein, 9 aa, Homo Sapiens
PEPKDVAVP

SEQ ID NO: 44374 - protein, 9 aa, Homo Sapiens
QLKKQKLMK

SEQ ID NO: 44375 - protein, 9 aa, Homo Sapiens
VLSRKEKER

SEQ ID NO: 44376 - protein, 9 aa, Homo Sapiens
HPQSKISEL

SEQ ID NO: 44377 - protein, 9 aa, Homo Sapiens
SKSPAGFTP

SEQ ID NO: 44378 - protein, 9 aa, Homo Sapiens
TRCVWFPLA

SEQ ID NO: 44379 - protein, 9 aa, Homo Sapiens
PAPEKPLAP

SEQ ID NO: 44380 - protein, 9 aa, Homo Sapiens
ASDGVSPPL

SEQ ID NO: 44381 - protein, 9 aa, Homo Sapiens
LCDADGTST

SEQ ID NO: 44382 - protein, 9 aa, Homo Sapiens
IEDAQHPHK

SEQ ID NO: 44383 - protein, 9 aa, Homo Sapiens
LDRVLSRYN

SEQ ID NO: 44384 - protein, 9 aa, Homo Sapiens
EKIFMARCD

SEQ ID NO: 44385 - protein, 9 aa, Homo Sapiens
CPNPGEIQN

SEQ ID NO: 44386 - protein, 9 aa, Homo Sapiens
GIRPQWYAS

SEQ ID NO: 44387 - protein, 9 aa, Homo Sapiens
NEMFCQLAK

SEQ ID NO: 44388 - protein, 9 aa, Homo Sapiens
HPSLQLKKQ

SEQ ID NO: 44389 - protein, 9 aa, Homo Sapiens
QNGQIDVPG

SEQ ID NO: 44390 - protein, 9 aa, Homo Sapiens
LYDVHSLEG

SEQ ID NO: 44391 - protein, 9 aa, Homo Sapiens
DCCEPQVAD

SEQ ID NO: 44392 - protein, 9 aa, Homo Sapiens
GFKISKVGM

SEQ ID NO: 44393 - protein, 9 aa, Homo Sapiens
LSCNFPHRP

SEQ ID NO: 44394 - protein, 9 aa, Homo Sapiens
PHRPDSGDV

SEQ ID NO: 44395 - protein, 9 aa, Homo Sapiens
LHKNNWNIK

SEQ ID NO: 44396 - protein, 9 aa, Homo Sapiens
LTKSHQMEN

SEQ ID NO: 44397 - protein, 9 aa, Homo Sapiens
TYYSNFIFH

SEQ ID NO: 44398 - protein, 9 aa, Homo Sapiens
QKLMKLAAQ

SEQ ID NO: 44399 - protein, 9 aa, Homo Sapiens
EKPLAPAPE

SEQ ID NO: 44400 - protein, 9 aa, Homo Sapiens
SGDGASAGG

SEQ ID NO: 44401 - protein, 9 aa, Homo Sapiens
LNNVGDAQT

SEQ ID NO: 44402 - protein, 9 aa, Homo Sapiens
ILNPRQVFS

SEQ ID NO: 44403 - protein, 9 aa, Homo Sapiens
IKDNNIKNA

SEQ ID NO: 44404 - protein, 9 aa, Homo Sapiens
QKLKIMTKF

SEQ ID NO: 44405 - protein, 9 aa, Homo Sapiens
HQMENVDSG

SEQ ID NO: 44406 - protein, 9 aa, Homo Sapiens
LSRYNVRLR

SEQ ID NO: 44407 - protein, 9 aa, Homo Sapiens
CSTDTVFHM

SEQ ID NO: 44408 - protein, 9 aa, Homo Sapiens
HTQDFVAKT

SEQ ID NO: 44409 - protein, 9 aa, Homo Sapiens
LGIMVWHDF

SEQ ID NO: 44410 - protein, 9 aa, Homo Sapiens
PLAPAPEVD

SEQ ID NO: 44411 - protein, 9 aa, Homo Sapiens
FRVNAEFVL

SEQ ID NO: 44412 - protein, 9 aa, Homo Sapiens
QCVTAQHGL

SEQ ID NO: 44413 - protein, 9 aa, Homo Sapiens
GFTPVAIPR

SEQ ID NO: 44414 - protein, 9 aa, Homo Sapiens
MAVFILEVH

SEQ ID NO: 44415 - protein, 9 aa, Homo Sapiens
QQKLKIMTK

SEQ ID NO: 44416 - protein, 9 aa, Homo Sapiens
GKDLKLVVC

SEQ ID NO: 44417 - protein, 9 aa, Homo Sapiens
EEAIRQQQV

SEQ ID NO: 44418 - protein, 9 aa, Homo Sapiens
VDRLSGEVY

SEQ ID NO: 44419 - protein, 9 aa, Homo Sapiens
DLKLVVCST

SEQ ID NO: 44420 - protein, 9 aa, Homo Sapiens
FTPVAIPRD

SEQ ID NO: 44421 - protein, 9 aa, Homo Sapiens
DSEDPEGPC

SEQ ID NO: 44422 - protein, 9 aa, Homo Sapiens
AQHPHKYRM

SEQ ID NO: 44423 - protein, 9 aa, Homo Sapiens
EVFGFKISK

SEQ ID NO: 44424 - protein, 9 aa, Homo Sapiens
FAYGFETSW

SEQ ID NO: 44425 - protein, 9 aa, Homo Sapiens
HNCMTTKSR

SEQ ID NO: 44426 - protein, 9 aa, Homo Sapiens
VLSLSTVVK

SEQ ID NO: 44427 - protein, 9 aa, Homo Sapiens
ASAGGLVAA

SEQ ID NO: 44428 - protein, 9 aa, Homo Sapiens
LDTAARQGQ

SEQ ID NO: 44429 - protein, 9 aa, Homo Sapiens
TLRNGLIVT

SEQ ID NO: 44430 - protein, 9 aa, Homo Sapiens
KLVVCSTDT

SEQ ID NO: 44431 - protein, 9 aa, Homo Sapiens
GEVKPRTAQ

SEQ ID NO: 44432 - protein, 9 aa, Homo Sapiens
SFSLIEHQR

SEQ ID NO: 44433 - protein, 9 aa, Homo Sapiens
SDGVSPPLS

SEQ ID NO: 44434 - protein, 9 aa, Homo Sapiens
ALNEMFCQL

SEQ ID NO: 44435 - protein, 9 aa, Homo Sapiens
NQFVARAAI

SEQ ID NO: 44436 - protein, 9 aa, Homo Sapiens
GNKENIFII

SEQ ID NO: 44437 - protein, 9 aa, Homo Sapiens
EVLLQQHQD

SEQ ID NO: 44438 - protein, 9 aa, Homo Sapiens
ICVQSPNCN

SEQ ID NO: 44439 - protein, 9 aa, Homo Sapiens
QDFVAKTIR

SEQ ID NO: 44440 - protein, 9 aa, Homo Sapiens
WNIKDNNIK

SEQ ID NO: 44441 - protein, 9 aa, Homo Sapiens
SASILFHPN

SEQ ID NO: 44442 - protein, 9 aa, Homo Sapiens
FHPNDSSTL

SEQ ID NO: 44443 - protein, 9 aa, Homo Sapiens
NLPCNSLSH

SEQ ID NO: 44444 - protein, 9 aa, Homo Sapiens
QQVEQLDFR

SEQ ID NO: 44445 - protein, 9 aa, Homo Sapiens
TVVKELVEN

SEQ ID NO: 44446 - protein, 9 aa, Homo Sapiens
CLSDSAICV

SEQ ID NO: 44447 - protein, 9 aa, Homo Sapiens
WQWPDLHSH

SEQ ID NO: 44448 - protein, 9 aa, Homo Sapiens
FYESSPEVL

SEQ ID NO: 44449 - protein, 9 aa, Homo Sapiens
NPAEKIFMA

SEQ ID NO: 44450 - protein, 9 aa, Homo Sapiens
FHLANIKYP

SEQ ID NO: 44451 - protein, 9 aa, Homo Sapiens
AEKIFMARC

SEQ ID NO: 44452 - protein, 9 aa, Homo Sapiens
SRKEKERVI

SEQ ID NO: 44453 - protein, 9 aa, Homo Sapiens
KKLGSLFVK

SEQ ID NO: 44454 - protein, 9 aa, Homo Sapiens
IWCNLQYRC

SEQ ID NO: 44455 - protein, 9 aa, Homo Sapiens
NFIFHLANI

SEQ ID NO: 44456 - protein, 9 aa, Homo Sapiens
AFSQSFSLI

SEQ ID NO: 44457 - protein, 9 aa, Homo Sapiens
VVCSTDTVF

SEQ ID NO: 44458 - protein, 9 aa, Homo Sapiens
SVTDDLKDV

SEQ ID NO: 44459 - protein, 9 aa, Homo Sapiens
SCPNPGEIQ

SEQ ID NO: 44460 - protein, 9 aa, Homo Sapiens
AHSCPEHII

SEQ ID NO: 44461 - protein, 9 aa, Homo Sapiens
PQWYASREE

SEQ ID NO: 44462 - protein, 9 aa, Homo Sapiens
VETGQDVVQ

SEQ ID NO: 44463 - protein, 9 aa, Homo Sapiens
MDCNPAEKI

SEQ ID NO: 44464 - protein, 9 aa, Homo Sapiens
QVEQLDFRD

SEQ ID NO: 44465 - protein, 9 aa, Homo Sapiens
EDYLYDVHS

SEQ ID NO: 44466 - protein, 9 aa, Homo Sapiens
RYNVRLRPN

SEQ ID NO: 44467 - protein, 9 aa, Homo Sapiens
EIQNGQIDV

SEQ ID NO: 44468 - protein, 9 aa, Homo Sapiens
TVARPVLYE

SEQ ID NO: 44469 - protein, 9 aa, Homo Sapiens
SCAIVAGNK

SEQ ID NO: 44470 - protein, 9 aa, Homo Sapiens
KISKVGMLS

SEQ ID NO: 44471 - protein, 9 aa, Homo Sapiens
FSLLKDGPE

SEQ ID NO: 44472 - protein, 9 aa, Homo Sapiens
TQQQELYRQ

SEQ ID NO: 44473 - protein, 9 aa, Homo Sapiens
ALDPFRVNA

SEQ ID NO: 44474 - protein, 9 aa, Homo Sapiens
NYPVTGIRV

SEQ ID NO: 44475 - protein, 9 aa, Homo Sapiens
RQQQVEQLD

SEQ ID NO: 44476 - protein, 9 aa, Homo Sapiens
IEVLLQQHQ

SEQ ID NO: 44477 - protein, 9 aa, Homo Sapiens
SLTKSHQME

SEQ ID NO: 44478 - protein, 9 aa, Homo Sapiens
EDAQHPHKY

SEQ ID NO: 44479 - protein, 9 aa, Homo Sapiens
ASSASILFH

SEQ ID NO: 44480 - protein, 9 aa, Homo Sapiens
QDVVQIRSL

SEQ ID NO: 44481 - protein, 9 aa, Homo Sapiens
ALQKFLAEN

SEQ ID NO: 44482 - protein, 9 aa, Homo Sapiens
MSEDSEKKD

SEQ ID NO: 44483 - protein, 9 aa, Homo Sapiens
ESLSLLHPQ

SEQ ID NO: 44484 - protein, 9 aa, Homo Sapiens
LTQQQELYR

SEQ ID NO: 44485 - protein, 9 aa, Homo Sapiens
EGTSMPTLT

SEQ ID NO: 44486 - protein, 9 aa, Homo Sapiens
RMYKQCFSC

SEQ ID NO: 44487 - protein, 9 aa, Homo Sapiens
AIVAGNKEN

SEQ ID NO: 44488 - protein, 9 aa, Homo Sapiens
NVGDAQTPG

SEQ ID NO: 44489 - protein, 9 aa, Homo Sapiens
VSVPTAPKV

SEQ ID NO: 44490 - protein, 9 aa, Homo Sapiens
QCGKSFASG

SEQ ID NO: 44491 - protein, 9 aa, Homo Sapiens
VPMPTVGLE

SEQ ID NO: 44492 - protein, 9 aa, Homo Sapiens
QALKLACLL

SEQ ID NO: 44493 - protein, 9 aa, Homo Sapiens
QENIIWCNL

SEQ ID NO: 44494 - protein, 9 aa, Homo Sapiens
QNKIEVLLQ

SEQ ID NO: 44495 - protein, 9 aa, Homo Sapiens
DRVLSRYNV

SEQ ID NO: 44496 - protein, 9 aa, Homo Sapiens
SLGDSQGAQ

SEQ ID NO: 44497 - protein, 9 aa, Homo Sapiens
DGKSSDAFT

SEQ ID NO: 44498 - protein, 9 aa, Homo Sapiens
SVLSRKEKE

SEQ ID NO: 44499 - protein, 9 aa, Homo Sapiens
KEKERVIRR

SEQ ID NO: 44500 - protein, 9 aa, Homo Sapiens
KDVAVPGGV

SEQ ID NO: 44501 - protein, 9 aa, Homo Sapiens
GISTDYSLG

SEQ ID NO: 44502 - protein, 9 aa, Homo Sapiens
LINEYPCLC

SEQ ID NO: 44503 - protein, 9 aa, Homo Sapiens
RQALQEKVA

SEQ ID NO: 44504 - protein, 9 aa, Homo Sapiens
ARQGQHQVP

SEQ ID NO: 44505 - protein, 9 aa, Homo Sapiens
PEGPCPSFN

SEQ ID NO: 44506 - protein, 9 aa, Homo Sapiens
VNNDFHIKI

SEQ ID NO: 44507 - protein, 9 aa, Homo Sapiens
KDLKLVVCS

SEQ ID NO: 44508 - protein, 9 aa, Homo Sapiens
NRPTSNGVV

SEQ ID NO: 44509 - protein, 9 aa, Homo Sapiens
IIDKFLHIN

SEQ ID NO: 44510 - protein, 9 aa, Homo Sapiens
ISLRASDGV

SEQ ID NO: 44511 - protein, 9 aa, Homo Sapiens
KCLEDPKKL

SEQ ID NO: 44512 - protein, 9 aa, Homo Sapiens
ESSPEVLHT

SEQ ID NO: 44513 - protein, 9 aa, Homo Sapiens
EDPEGPCPS

SEQ ID NO: 44514 - protein, 9 aa, Homo Sapiens
ETDENRMYK

SEQ ID NO: 44515 - protein, 9 aa, Homo Sapiens
KLYRVMSGH

SEQ ID NO: 44516 - protein, 9 aa, Homo Sapiens
NTYYSNFIF

SEQ ID NO: 44517 - protein, 9 aa, Homo Sapiens
TLSVLSRKE

SEQ ID NO: 44518 - protein, 9 aa, Homo Sapiens
ASLVGIRPQ

SEQ ID NO: 44519 - protein, 9 aa, Homo Sapiens
DGEQKIVTS

SEQ ID NO: 44520 - protein, 9 aa, Homo Sapiens
VTPALNPLM

SEQ ID NO: 44521 - protein, 9 aa, Homo Sapiens
NNVGDAQTP

SEQ ID NO: 44522 - protein, 9 aa, Homo Sapiens
PEKPLAPAP

SEQ ID NO: 44523 - protein, 9 aa, Homo Sapiens
VHSLEGEKV

SEQ ID NO: 44524 - protein, 9 aa, Homo Sapiens
GCYLGVAHQ

SEQ ID NO: 44525 - protein, 9 aa, Homo Sapiens
LQTPTIMGC

SEQ ID NO: 44526 - protein, 9 aa, Homo Sapiens
DCRKGFIYK

SEQ ID NO: 44527 - protein, 9 aa, Homo Sapiens
SPALNEMFC

SEQ ID NO: 44528 - protein, 9 aa, Homo Sapiens
APEPKDVAV

SEQ ID NO: 44529 - protein, 9 aa, Homo Sapiens
NDDGEQKIV

SEQ ID NO: 44530 - protein, 9 aa, Homo Sapiens
WKLYRVMSG

SEQ ID NO: 44531 - protein, 9 aa, Homo Sapiens
HRVTNLPCN

SEQ ID NO: 44532 - protein, 9 aa, Homo Sapiens
GQDVVQIRS

SEQ ID NO: 44533 - protein, 9 aa, Homo Sapiens
VIENYPVTG

SEQ ID NO: 44534 - protein, 9 aa, Homo Sapiens
MKNNRFYTI

SEQ ID NO: 44535 - protein, 9 aa, Homo Sapiens
RASDGVSPP

SEQ ID NO: 44536 - protein, 9 aa, Homo Sapiens
YLLGPLDYE

SEQ ID NO: 44537 - protein, 9 aa, Homo Sapiens
ALNPLMYSL

SEQ ID NO: 44538 - protein, 9 aa, Homo Sapiens
EGPCPSFNK

SEQ ID NO: 44539 - protein, 9 aa, Homo Sapiens
NFPHRPDSG

SEQ ID NO: 44540 - protein, 9 aa, Homo Sapiens
DGDCCEPQV

SEQ ID NO: 44541 - protein, 9 aa, Homo Sapiens
LSLSTVVKE

SEQ ID NO: 44542 - protein, 9 aa, Homo Sapiens
VSKKVYDWK

SEQ ID NO: 44543 - protein, 9 aa, Homo Sapiens
LRKDKSKVA

SEQ ID NO: 44544 - protein, 9 aa, Homo Sapiens
RVLSRYNVR

SEQ ID NO: 44545 - protein, 9 aa, Homo Sapiens
DRLSGEVYL

SEQ ID NO: 44546 - protein, 9 aa, Homo Sapiens
FACGDCRKG

SEQ ID NO: 44547 - protein, 9 aa, Homo Sapiens
FMLSCNFPH

SEQ ID NO: 44548 - protein, 9 aa, Homo Sapiens
PMPTVGLEN

SEQ ID NO: 44549 - protein, 9 aa, Homo Sapiens
DELGIMVWH

SEQ ID NO: 44550 - protein, 9 aa, Homo Sapiens
HQFILTSLT

SEQ ID NO: 44551 - protein, 9 aa, Homo Sapiens
LKLVVCSTD

SEQ ID NO: 44552 - protein, 9 aa, Homo Sapiens
AQTPGTVSP

SEQ ID NO: 44553 - protein, 9 aa, Homo Sapiens
SSVTDDLKD

SEQ ID NO: 44554 - protein, 9 aa, Homo Sapiens
DDAAVIPMK

SEQ ID NO: 44555 - protein, 9 aa, Homo Sapiens
PTLTPSEGS

SEQ ID NO: 44556 - protein, 9 aa, Homo Sapiens
RPQWYASRE

SEQ ID NO: 44557 - protein, 9 aa, Homo Sapiens
LSRKEKERV

SEQ ID NO: 44558 - protein, 9 aa, Homo Sapiens
QYSSIITNQ

SEQ ID NO: 44559 - protein, 9 aa, Homo Sapiens
CCEPQVADV

SEQ ID NO: 44560 - protein, 9 aa, Homo Sapiens
MSGHLGWVR

SEQ ID NO: 44561 - protein, 9 aa, Homo Sapiens
PVSVPTAPK

SEQ ID NO: 44562 - protein, 9 aa, Homo Sapiens
YSPALNEMF

SEQ ID NO: 44563 - protein, 9 aa, Homo Sapiens
QIRILNRPT

SEQ ID NO: 44564 - protein, 9 aa, Homo Sapiens
YSLTKSHQM

SEQ ID NO: 44565 - protein, 9 aa, Homo Sapiens
VWFPLASPS

SEQ ID NO: 44566 - protein, 9 aa, Homo Sapiens
EKCLEDPKK

SEQ ID NO: 44567 - protein, 9 aa, Homo Sapiens
NNWNIKDNN

SEQ ID NO: 44568 - protein, 9 aa, Homo Sapiens
LKPHPPVVG

SEQ ID NO: 44569 - protein, 9 aa, Homo Sapiens
DVHSLEGEK

SEQ ID NO: 44570 - protein, 9 aa, Homo Sapiens
VFILEVHQF

SEQ ID NO: 44571 - protein, 9 aa, Homo Sapiens
ISNDDGEQK

SEQ ID NO: 44572 - protein, 9 aa, Homo Sapiens
TLVSKKVYD

SEQ ID NO: 44573 - protein, 9 aa, Homo Sapiens
VAGNKENIF

SEQ ID NO: 44574 - protein, 9 aa, Homo Sapiens
GEGRTCWSL

SEQ ID NO: 44575 - protein, 9 aa, Homo Sapiens
FTDPAIKLR

SEQ ID NO: 44576 - protein, 9 aa, Homo Sapiens
QTPGTVSPN

SEQ ID NO: 44577 - protein, 9 aa, Homo Sapiens
PGEIQNGQI

SEQ ID NO: 44578 - protein, 9 aa, Homo Sapiens
AEAPSSVTD

SEQ ID NO: 44579 - protein, 9 aa, Homo Sapiens
CYLGVAHQR

SEQ ID NO: 44580 - protein, 9 aa, Homo Sapiens
CVWFPLASP

SEQ ID NO: 44581 - protein, 9 aa, Homo Sapiens
PVLYEFYED

SEQ ID NO: 44582 - protein, 9 aa, Homo Sapiens
FLAENRKNT

SEQ ID NO: 44583 - protein, 9 aa, Homo Sapiens
QHPHKYRML

SEQ ID NO: 44584 - protein, 9 aa, Homo Sapiens
LKIMTKFYQ

SEQ ID NO: 44585 - protein, 9 aa, Homo Sapiens
KQKLMKLAA

SEQ ID NO: 44586 - protein, 9 aa, Homo Sapiens
VCSTDTVFH

SEQ ID NO: 44587 - protein, 9 aa, Homo Sapiens
TNNTSSVIT

SEQ ID NO: 44588 - protein, 9 aa, Homo Sapiens
EFIPHLELE

SEQ ID NO: 44589 - protein, 9 aa, Homo Sapiens
NIKDNNIKN

SEQ ID NO: 44590 - protein, 9 aa, Homo Sapiens
DKFLHINDF

SEQ ID NO: 44591 - protein, 9 aa, Homo Sapiens
GEIQNGQID

SEQ ID NO: 44592 - protein, 9 aa, Homo Sapiens
AQCVTAQHG

SEQ ID NO: 44593 - protein, 9 aa, Homo Sapiens
VIEDAQHPH

SEQ ID NO: 44594 - protein, 9 aa, Homo Sapiens
PENILVNND

SEQ ID NO: 44595 - protein, 9 aa, Homo Sapiens
VLTLVSKKV

SEQ ID NO: 44596 - protein, 9 aa, Homo Sapiens
PLKPHPPVV

SEQ ID NO: 44597 - protein, 9 aa, Homo Sapiens
RLSGEVYLL

SEQ ID NO: 44598 - protein, 9 aa, Homo Sapiens
TLNNVGDAQ

SEQ ID NO: 44599 - protein, 9 aa, Homo Sapiens
GEKPYNCKQ

SEQ ID NO: 44600 - protein, 9 aa, Homo Sapiens
DLDTAARQG

SEQ ID NO: 44601 - protein, 9 aa, Homo Sapiens
VGDAQTPGT

SEQ ID NO: 44602 - protein, 9 aa, Homo Sapiens
GMQTRCVWF

SEQ ID NO: 44603 - protein, 9 aa, Homo Sapiens
VLYEFYEDT

SEQ ID NO: 44604 - protein, 9 aa, Homo Sapiens
AEFVLLTVK

SEQ ID NO: 44605 - protein, 9 aa, Homo Sapiens
FKISKVGML

SEQ ID NO: 44606 - protein, 9 aa, Homo Sapiens
QAHSCPEHI

SEQ ID NO: 44607 - protein, 9 aa, Homo Sapiens
TDPAIKLRN

SEQ ID NO: 44608 - protein, 9 aa, Homo Sapiens
HSLEGEKVN

SEQ ID NO: 44609 - protein, 9 aa, Homo Sapiens
YGFETSWDD

SEQ ID NO: 44610 - protein, 9 aa, Homo Sapiens
SVPMPTVGL

SEQ ID NO: 44611 - protein, 9 aa, Homo Sapiens
LPTLLESSS

SEQ ID NO: 44612 - protein, 9 aa, Homo Sapiens
VKPRTAQCV

SEQ ID NO: 44613 - protein, 9 aa, Homo Sapiens
NQGLNHTCN

SEQ ID NO: 44614 - protein, 9 aa, Homo Sapiens
KKDYSDRTI

SEQ ID NO: 44615 - protein, 9 aa, Homo Sapiens
RKGFIYKSK

SEQ ID NO: 44616 - protein, 9 aa, Homo Sapiens
ACLLPTLLE

SEQ ID NO: 44617 - protein, 9 aa, Homo Sapiens
EQKIVTSVR

SEQ ID NO: 44618 - protein, 9 aa, Homo Sapiens
VTDDLKDVS

SEQ ID NO: 44619 - protein, 9 aa, Homo Sapiens
ASKSPAGFT

SEQ ID NO: 44620 - protein, 9 aa, Homo Sapiens
KKQKLMKLA

SEQ ID NO: 44621 - protein, 9 aa, Homo Sapiens
LRASDGVSP

SEQ ID NO: 44622 - protein, 9 aa, Homo Sapiens
CNPAEKIFM

SEQ ID NO: 44623 - protein, 9 aa, Homo Sapiens
LAPAPEVDE

SEQ ID NO: 44624 - protein, 9 aa, Homo Sapiens
RQGQHQVPQ

SEQ ID NO: 44625 - protein, 9 aa, Homo Sapiens
PTVGLENRL

SEQ ID NO: 44626 - protein, 9 aa, Homo Sapiens
MYSLRNKEV

SEQ ID NO: 44627 - protein, 9 aa, Homo Sapiens
YDVHSLEGE

SEQ ID NO: 44628 - protein, 9 aa, Homo Sapiens
SEDSEKKDY

SEQ ID NO: 44629 - protein, 9 aa, Homo Sapiens
MYKQCFSCL

SEQ ID NO: 44630 - protein, 9 aa, Homo Sapiens
NPRQVFSLL

SEQ ID NO: 44631 - protein, 9 aa, Homo Sapiens
LEDPKKLGS

SEQ ID NO: 44632 - protein, 9 aa, Homo Sapiens
VFGFKISKV

SEQ ID NO: 44633 - protein, 9 aa, Homo Sapiens
STEHNCMTT

SEQ ID NO: 44634 - protein, 9 aa, Homo Sapiens
SILFHPNDS

SEQ ID NO: 44635 - protein, 9 aa, Homo Sapiens
DSEKKDYSD

SEQ ID NO: 44636 - protein, 9 aa, Homo Sapiens
QQQVEQLDF

SEQ ID NO: 44637 - protein, 9 aa, Homo Sapiens
DLKKPQNQG

SEQ ID NO: 44638 - protein, 9 aa, Homo Sapiens
LETDENRMY

SEQ ID NO: 44639 - protein, 9 aa, Homo Sapiens
IGEGRTCWS

SEQ ID NO: 44640 - protein, 9 aa, Homo Sapiens
RTAQCVTAQ

SEQ ID NO: 44641 - protein, 9 aa, Homo Sapiens
NCMTTKSRD

SEQ ID NO: 44642 - protein, 9 aa, Homo Sapiens
LYRVMSGHL

SEQ ID NO: 44643 - protein, 9 aa, Homo Sapiens
IDKFLHIND

SEQ ID NO: 44644 - protein, 9 aa, Homo Sapiens
AGNKENIFI

SEQ ID NO: 44645 - protein, 9 aa, Homo Sapiens
YNCKQCGKS

SEQ ID NO: 44646 - protein, 9 aa, Homo Sapiens
ASTEHNCMT

SEQ ID NO: 44647 - protein, 9 aa, Homo Sapiens
QQELYRQAL

SEQ ID NO: 44648 - protein, 9 aa, Homo Sapiens
LYEFYEDTN

SEQ ID NO: 44649 - protein, 9 aa, Homo Sapiens
TQDFVAKTI

SEQ ID NO: 44650 - protein, 9 aa, Homo Sapiens
IMGCYLGVA

SEQ ID NO: 44651 - protein, 9 aa, Homo Sapiens
GDAQTPGTV

SEQ ID NO: 44652 - protein, 9 aa, Homo Sapiens
DFDDGDCCE

SEQ ID NO: 44653 - protein, 9 aa, Homo Sapiens
VRIFAINKY

SEQ ID NO: 44654 - protein, 9 aa, Homo Sapiens
CEPQVADVR

SEQ ID NO: 44655 - protein, 9 aa, Homo Sapiens
AAVIPMKNN

SEQ ID NO: 44656 - protein, 9 aa, Homo Sapiens
SSVITEETK

SEQ ID NO: 44657 - protein, 9 aa, Homo Sapiens
LRNGLIVTG

SEQ ID NO: 44658 - protein, 9 aa, Homo Sapiens
ENRKNTSFM

SEQ ID NO: 44659 - protein, 9 aa, Homo Sapiens
RQVFSLLKD

SEQ ID NO: 44660 - protein, 9 aa, Homo Sapiens
ILEVHQFIL

SEQ ID NO: 44661 - protein, 9 aa, Homo Sapiens
NRMYKQCFS

SEQ ID NO: 44662 - protein, 9 aa, Homo Sapiens
KIEVLLQQH

SEQ ID NO: 44663 - protein, 9 aa, Homo Sapiens
RPVLYEFYE

SEQ ID NO: 44664 - protein, 9 aa, Homo Sapiens
AASKSPAGF

SEQ ID NO: 44665 - protein, 9 aa, Homo Sapiens
IPVIEDAQH

SEQ ID NO: 44666 - protein, 9 aa, Homo Sapiens
GDCRKGFIY

SEQ ID NO: 44667 - protein, 9 aa, Homo Sapiens
KGFQEVVTP

SEQ ID NO: 44668 - protein, 9 aa, Homo Sapiens
NGSVPMPTV

SEQ ID NO: 44669 - protein, 9 aa, Homo Sapiens
NDRIGEGRT

SEQ ID NO: 44670 - protein, 9 aa, Homo Sapiens
LQYSSIITN

SEQ ID NO: 44671 - protein, 9 aa, Homo Sapiens
TYSPALNEM

SEQ ID NO: 44672 - protein, 9 aa, Homo Sapiens
NWNIKDNNI

SEQ ID NO: 44673 - protein, 9 aa, Homo Sapiens
YSSIITNQF

SEQ ID NO: 44674 - protein, 9 aa, Homo Sapiens
YRVMSGHLG

SEQ ID NO: 44675 - protein, 9 aa, Homo Sapiens
ELGIMVWHD

SEQ ID NO: 44676 - protein, 9 aa, Homo Sapiens
PMKNNRFYT

SEQ ID NO: 44677 - protein, 9 aa, Homo Sapiens
CPSFNKLSK

SEQ ID NO: 44678 - protein, 9 aa, Homo Sapiens
TALQKFLAE

SEQ ID NO: 44679 - protein, 9 aa, Homo Sapiens
IRPQWYASR

SEQ ID NO: 44680 - protein, 9 aa, Homo Sapiens
ELETDENRM

SEQ ID NO: 44681 - protein, 9 aa, Homo Sapiens
NKIEVLLQQ

SEQ ID NO: 44682 - protein, 9 aa, Homo Sapiens
ELEDDTSYF

SEQ ID NO: 44683 - protein, 9 aa, Homo Sapiens
NTSSVITEE

SEQ ID NO: 44684 - protein, 9 aa, Homo Sapiens
KSSDAFTDP

SEQ ID NO: 44685 - protein, 9 aa, Homo Sapiens
ENRMYKQCF

SEQ ID NO: 44686 - protein, 9 aa, Homo Sapiens
KKGFQEVVT

SEQ ID NO: 44687 - protein, 9 aa, Homo Sapiens
TLTPSEGST

SEQ ID NO: 44688 - protein, 9 aa, Homo Sapiens
LSTVVKELV

SEQ ID NO: 44689 - protein, 9 aa, Homo Sapiens
TKSHQMENV

SEQ ID NO: 44690 - protein, 9 aa, Homo Sapiens
ELYRQALQE

SEQ ID NO: 44691 - protein, 9 aa, Homo Sapiens
LEKCLEDPK

SEQ ID NO: 44692 - protein, 9 aa, Homo Sapiens
PSPAPEKPL

SEQ ID NO: 44693 - protein, 9 aa, Homo Sapiens
SHQMENVDS

SEQ ID NO: 44694 - protein, 9 aa, Homo Sapiens
PFRVNAEFV

SEQ ID NO: 44695 - protein, 9 aa, Homo Sapiens
SIIDKFLHI

SEQ ID NO: 44696 - protein, 9 aa, Homo Sapiens
LTLVSKKVY

SEQ ID NO: 44697 - protein, 9 aa, Homo Sapiens
ETGQDVVQI

SEQ ID NO: 44698 - protein, 9 aa, Homo Sapiens
QKIVTSVRR

SEQ ID NO: 44699 - protein, 9 aa, Homo Sapiens
VVLSLSTVV

SEQ ID NO: 44700 - protein, 9 aa, Homo Sapiens
SEGTSMPTL

SEQ ID NO: 44701 - protein, 9 aa, Homo Sapiens
RLWQWPDLH

SEQ ID NO: 44702 - protein, 9 aa, Homo Sapiens
EDSEKKDYS

SEQ ID NO: 44703 - protein, 9 aa, Homo Sapiens
MTTKSRDPL

SEQ ID NO: 44704 - protein, 9 aa, Homo Sapiens
EYRKKGFQE

SEQ ID NO: 44705 - protein, 9 aa, Homo Sapiens
LKKPQNQGL

SEQ ID NO: 44706 - protein, 9 aa, Homo Sapiens
EKERVIRRL

SEQ ID NO: 44707 - protein, 9 aa, Homo Sapiens
RKSKSIIDK

SEQ ID NO: 44708 - protein, 9 aa, Homo Sapiens
SEKKDYSDR

SEQ ID NO: 44709 - protein, 9 aa, Homo Sapiens
VTNLPCNSL

SEQ ID NO: 44710 - protein, 9 aa, Homo Sapiens
QVVLSLSTV

SEQ ID NO: 44711 - protein, 9 aa, Homo Sapiens
AICVQSPNC

SEQ ID NO: 44712 - protein, 9 aa, Homo Sapiens
ARPVLYEFY

SEQ ID NO: 44713 - protein, 9 aa, Homo Sapiens
SDSAICVQS

SEQ ID NO: 44714 - protein, 9 aa, Homo Sapiens
IMPPLKPHP

SEQ ID NO: 44715 - protein, 9 aa, Homo Sapiens
KSHQMENVD

SEQ ID NO: 44716 - protein, 9 aa, Homo Sapiens
CLEDPKKLG

SEQ ID NO: 44717 - protein, 9 aa, Homo Sapiens
KQCGKSFAS

SEQ ID NO: 44718 - protein, 9 aa, Homo Sapiens
SLSLLHPQS

SEQ ID NO: 44719 - protein, 9 aa, Homo Sapiens
VVETGQDVV

SEQ ID NO: 44720 - protein, 9 aa, Homo Sapiens
QTRCVWFPL

SEQ ID NO: 44721 - protein, 9 aa, Homo Sapiens
EVHQFILTS

SEQ ID NO: 44722 - protein, 9 aa, Homo Sapiens
IQNGQIDVP

SEQ ID NO: 44723 - protein, 9 aa, Homo Sapiens
PFYESSPEV

SEQ ID NO: 44724 - protein, 9 aa, Homo Sapiens
PDDAAVIPM

SEQ ID NO: 44725 - protein, 9 aa, Homo Sapiens
NGLIVTGGK

SEQ ID NO: 44726 - protein, 9 aa, Homo Sapiens
DFVAKTIRP

SEQ ID NO: 44727 - protein, 9 aa, Homo Sapiens
KKVYDWKVL

SEQ ID NO: 44728 - protein, 9 aa, Homo Sapiens
SSPEVLHTE

SEQ ID NO: 44729 - protein, 9 aa, Homo Sapiens
YRKKGFQEV

SEQ ID NO: 44730 - protein, 9 aa, Homo Sapiens
SPAGFTPVA

SEQ ID NO: 44731 - protein, 9 aa, Homo Sapiens
MVVNQAHSC

SEQ ID NO: 44732 - protein, 9 aa, Homo Sapiens
NFCIRFAYG

SEQ ID NO: 44733 - protein, 9 aa, Homo Sapiens
AIRQQQVEQ

SEQ ID NO: 44734 - protein, 9 aa, Homo Sapiens
AENRKNTSF

SEQ ID NO: 44735 - protein, 9 aa, Homo Sapiens
ECLSDSAIC

SEQ ID NO: 44736 - protein, 9 aa, Homo Sapiens
WFPLASPST

SEQ ID NO: 44737 - protein, 9 aa, Homo Sapiens
ILNRPTSNG

SEQ ID NO: 44738 - protein, 9 aa, Homo Sapiens
AMYTTLRNG

SEQ ID NO: 44739 - protein, 9 aa, Homo Sapiens
NPGEIQNGQ

SEQ ID NO: 44740 - protein, 9 aa, Homo Sapiens
YPCLCDADG

SEQ ID NO: 44741 - protein, 9 aa, Homo Sapiens
AGFTPVAIP

SEQ ID NO: 44742 - protein, 9 aa, Homo Sapiens
KENIFIIDP

SEQ ID NO: 44743 - protein, 9 aa, Homo Sapiens
PPRAPEPKD

SEQ ID NO: 44744 - protein, 9 aa, Homo Sapiens
KNFCIRFAY

SEQ ID NO: 44745 - protein, 9 aa, Homo Sapiens
LNRPTSNGV

SEQ ID NO: 44746 - protein, 9 aa, Homo Sapiens
PQIRILNRP

SEQ ID NO: 44747 - protein, 9 aa, Homo Sapiens
EPKDVAVPG

SEQ ID NO: 44748 - protein, 9 aa, Homo Sapiens
PCNSLSHNP

SEQ ID NO: 44749 - protein, 9 aa, Homo Sapiens
YLYDVHSLE

SEQ ID NO: 44750 - protein, 9 aa, Homo Sapiens
DYSLTKSHQ

SEQ ID NO: 44751 - protein, 9 aa, Homo Sapiens
KNNWNIKDN

SEQ ID NO: 44752 - protein, 9 aa, Homo Sapiens
GIMVWHDFM

SEQ ID NO: 44753 - protein, 9 aa, Homo Sapiens
FCIRFAYGF

SEQ ID NO: 44754 - protein, 9 aa, Homo Sapiens
FILEVHQFI

SEQ ID NO: 44755 - protein, 9 aa, Homo Sapiens
ILVNNDFHI

SEQ ID NO: 44756 - protein, 9 aa, Homo Sapiens
DDGEQKIVT

SEQ ID NO: 44757 - protein, 9 aa, Homo Sapiens
GVSPPLSTE

SEQ ID NO: 44758 - protein, 9 aa, Homo Sapiens
MVWHDFMFA

SEQ ID NO: 44759 - protein, 9 aa, Homo Sapiens
IYCRLWQWP

SEQ ID NO: 44760 - protein, 9 aa, Homo Sapiens
SGISTDYSL

SEQ ID NO: 44761 - protein, 9 aa, Homo Sapiens
IPMKNNRFY

SEQ ID NO: 44762 - protein, 9 aa, Homo Sapiens
PWKLYRVMS

SEQ ID NO: 44763 - protein, 9 aa, Homo Sapiens
KLACLLPTL

SEQ ID NO: 44764 - protein, 9 aa, Homo Sapiens
STVVKELVE

SEQ ID NO: 44765 - protein, 9 aa, Homo Sapiens
EVLHTEVLQ

SEQ ID NO: 44766 - protein, 9 aa, Homo Sapiens
LSVLSRKEK

SEQ ID NO: 44767 - protein, 9 aa, Homo Sapiens
EMFCQLAKT

SEQ ID NO: 44768 - protein, 9 aa, Homo Sapiens
PNPGEIQNG

SEQ ID NO: 44769 - protein, 9 aa, Homo Sapiens
YPVTGIRVW

SEQ ID NO: 44770 - protein, 9 aa, Homo Sapiens
LNPRQVFSL

SEQ ID NO: 44771 - protein, 9 aa, Homo Sapiens
TAQCVTAQH

SEQ ID NO: 44772 - protein, 9 aa, Homo Sapiens
RNGLIVTGG

SEQ ID NO: 44773 - protein, 9 aa, Homo Sapiens
TNLPCNSLS

SEQ ID NO: 44774 - protein, 9 aa, Homo Sapiens
QMENVDSGE

SEQ ID NO: 44775 - protein, 9 aa, Homo Sapiens
MYTTLRNGL

SEQ ID NO: 44776 - protein, 9 aa, Homo Sapiens
EAPSSVTDD

SEQ ID NO: 44777 - protein, 9 aa, Homo Sapiens
SQSFSLIEH

SEQ ID NO: 44778 - protein, 9 aa, Homo Sapiens
LEVHQFILT

SEQ ID NO: 44779 - protein, 9 aa, Homo Sapiens
PALNPLMYS

SEQ ID NO: 44780 - protein, 9 aa, Homo Sapiens
RCVWFPLAS

SEQ ID NO: 44781 - protein, 9 aa, Homo Sapiens
ENYPVTGIR

SEQ ID NO: 44782 - protein, 9 aa, Homo Sapiens
PSLQLKKQK

SEQ ID NO: 44783 - protein, 9 aa, Homo Sapiens
AQVIENYPV

SEQ ID NO: 44784 - protein, 9 aa, Homo Sapiens
FIFHLANIK

SEQ ID NO: 44785 - protein, 9 aa, Homo Sapiens
KPENILVNN

SEQ ID NO: 44786 - protein, 9 aa, Homo Sapiens
QVIENYPVT

SEQ ID NO: 44787 - protein, 9 aa, Homo Sapiens
HVIYCRLWQ

SEQ ID NO: 44788 - protein, 9 aa, Homo Sapiens
CIRFAYGFE

SEQ ID NO: 44789 - protein, 9 aa, Homo Sapiens
LVNNDFHIK

SEQ ID NO: 44790 - protein, 9 aa, Homo Sapiens
SRYNVRLRP

SEQ ID NO: 44791 - protein, 9 aa, Homo Sapiens
IVAGNKENI

SEQ ID NO: 44792 - protein, 9 aa, Homo Sapiens
ITEETKKYG

SEQ ID NO: 44793 - protein, 9 aa, Homo Sapiens
IIPVIEDAQ

SEQ ID NO: 44794 - protein, 9 aa, Homo Sapiens
SEYRKKGFQ

SEQ ID NO: 44795 - protein, 9 aa, Homo Sapiens
CLCDADGTS

SEQ ID NO: 44796 - protein, 9 aa, Homo Sapiens
VIYCRLWQW

SEQ ID NO: 44797 - protein, 9 aa, Homo Sapiens
DAQHPHKYR

SEQ ID NO: 44798 - protein, 9 aa, Homo Sapiens
MGCYLGVAH

SEQ ID NO: 44799 - protein, 9 aa, Homo Sapiens
HKNNWNIKD

SEQ ID NO: 44800 - protein, 9 aa, Homo Sapiens
PFACGDCRK

SEQ ID NO: 44801 - protein, 9 aa, Homo Sapiens
YFEEVFGFK

SEQ ID NO: 44802 - protein, 9 aa, Homo Sapiens
GKSSDAFTD

SEQ ID NO: 44803 - protein, 9 aa, Homo Sapiens
SAICVQSPN

SEQ ID NO: 44804 - protein, 9 aa, Homo Sapiens
GKAFSQSFS

SEQ ID NO: 44805 - protein, 9 aa, Homo Sapiens
SEDYLYDVH

SEQ ID NO: 44806 - protein, 9 aa, Homo Sapiens
LHPQSKISE

SEQ ID NO: 44807 - protein, 9 aa, Homo Sapiens
HRPDSGDVT

SEQ ID NO: 44808 - protein, 9 aa, Homo Sapiens
VGNGSVPMP

SEQ ID NO: 44809 - protein, 9 aa, Homo Sapiens
QKFLAENRK

SEQ ID NO: 44810 - protein, 9 aa, Homo Sapiens
DGVSPPLST

SEQ ID NO: 44811 - protein, 9 aa, Homo Sapiens
HDFMFACAL

SEQ ID NO: 44812 - protein, 9 aa, Homo Sapiens
RVMSGHLGW

SEQ ID NO: 44813 - protein, 9 aa, Homo Sapiens
TDDLKDVSS

SEQ ID NO: 44814 - protein, 9 aa, Homo Sapiens
EPQVADVRK

SEQ ID NO: 44815 - protein, 9 aa, Homo Sapiens
ELINEYPCL

SEQ ID NO: 44816 - protein, 9 aa, Homo Sapiens
NCKQCGKSF

SEQ ID NO: 44817 - protein, 9 aa, Homo Sapiens
LKPENILVN

SEQ ID NO: 44818 - protein, 9 aa, Homo Sapiens
APEKPLAPA

SEQ ID NO: 44819 - protein, 9 aa, Homo Sapiens
SLRASDGVS

SEQ ID NO: 44820 - protein, 9 aa, Homo Sapiens
RILNRPTSN

SEQ ID NO: 44821 - protein, 9 aa, Homo Sapiens
KPRTAQCVT

SEQ ID NO: 44822 - protein, 9 aa, Homo Sapiens
DRIGEGRTC

SEQ ID NO: 44823 - protein, 9 aa, Homo Sapiens
RFAYGFETS

SEQ ID NO: 44824 - protein, 9 aa, Homo Sapiens
QQQELYRQA

SEQ ID NO: 44825 - protein, 9 aa, Homo Sapiens
SKKVYDWKV

SEQ ID NO: 44826 - protein, 9 aa, Homo Sapiens
SISNDDGEQ

SEQ ID NO: 44827 - protein, 9 aa, Homo Sapiens
EVYLLGPLD

SEQ ID NO: 44828 - protein, 9 aa, Homo Sapiens
RSEYRKKGF

SEQ ID NO: 44829 - protein, 9 aa, Homo Sapiens
EPQKIMPPL

SEQ ID NO: 44830 - protein, 9 aa, Homo Sapiens
PRTAQCVTA

SEQ ID NO: 44831 - protein, 9 aa, Homo Sapiens
VSPPLSTET

SEQ ID NO: 44832 - protein, 9 aa, Homo Sapiens
TIMGCYLGV

SEQ ID NO: 44833 - protein, 9 aa, Homo Sapiens
DCNPAEKIF

SEQ ID NO: 44834 - protein, 9 aa, Homo Sapiens
YESSPEVLH

SEQ ID NO: 44835 - protein, 9 aa, Homo Sapiens
DPFRVNAEF

SEQ ID NO: 44836 - protein, 9 aa, Homo Sapiens
GRTCWSLGN

SEQ ID NO: 44837 - protein, 9 aa, Homo Sapiens
LVVCSTDTV

SEQ ID NO: 44838 - protein, 9 aa, Homo Sapiens
LVSKKVYDW

SEQ ID NO: 44839 - protein, 9 aa, Homo Sapiens
GSVPMPTVG

SEQ ID NO: 44840 - protein, 9 aa, Homo Sapiens
KSIIDKFLH

SEQ ID NO: 44841 - protein, 9 aa, Homo Sapiens
SLLHPQSKI

SEQ ID NO: 44842 - protein, 9 aa, Homo Sapiens
IPHLELEDD

SEQ ID NO: 44843 - protein, 9 aa, Homo Sapiens
SESQNKIEV

SEQ ID NO: 44844 - protein, 9 aa, Homo Sapiens
NMVVNQAHS

SEQ ID NO: 44845 - protein, 9 aa, Homo Sapiens
AYGFETSWD

SEQ ID NO: 44846 - protein, 9 aa, Homo Sapiens
TDENRMYKQ

SEQ ID NO: 44847 - protein, 9 aa, Homo Sapiens
PAEKIFMAR

SEQ ID NO: 44848 - protein, 9 aa, Homo Sapiens
IMVWHDFMF

SEQ ID NO: 44849 - protein, 9 aa, Homo Sapiens
AFTDPAIKL

SEQ ID NO: 44850 - protein, 9 aa, Homo Sapiens
PKDVAVPGG

SEQ ID NO: 44851 - protein, 9 aa, Homo Sapiens
ENIIWCNLQ

SEQ ID NO: 44852 - protein, 9 aa, Homo Sapiens
WHDFMFACA

SEQ ID NO: 44853 - protein, 9 aa, Homo Sapiens
LYRQALQEK

SEQ ID NO: 44854 - protein, 9 aa, Homo Sapiens
VYLLGPLDY

SEQ ID NO: 44855 - protein, 9 aa, Homo Sapiens
DKSKVAKKI

SEQ ID NO: 44856 - protein, 9 aa, Homo Sapiens
AVIPMKNNR

SEQ ID NO: 44857 - protein, 9 aa, Homo Sapiens
GPPRAPEPK

SEQ ID NO: 44858 - protein, 9 aa, Homo Sapiens
MPTVGLENR

SEQ ID NO: 44859 - protein, 9 aa, Homo Sapiens
GDLDTAARQ

SEQ ID NO: 44860 - protein, 9 aa, Homo Sapiens
MQTRCVWFP

SEQ ID NO: 44861 - protein, 9 aa, Homo Sapiens
TAARQGQHQ

SEQ ID NO: 44862 - protein, 9 aa, Homo Sapiens
YSNFIFHLA

SEQ ID NO: 44863 - protein, 9 aa, Homo Sapiens
IFHLANIKY

SEQ ID NO: 44864 - protein, 9 aa, Homo Sapiens
CKQCGKSFA

SEQ ID NO: 44865 - protein, 9 aa, Homo Sapiens
SSDAFTDPA

SEQ ID NO: 44866 - protein, 9 aa, Homo Sapiens
TEEAIRQQQ

SEQ ID NO: 44867 - protein, 9 aa, Homo Sapiens
RKDKSKVAK

SEQ ID NO: 44868 - protein, 9 aa, Homo Sapiens
KFLAENRKN

SEQ ID NO: 44869 - protein, 9 aa, Homo Sapiens
FAMYTTLRN

SEQ ID NO: 44870 - protein, 9 aa, Homo Sapiens
VVQIRSLSK

SEQ ID NO: 44871 - protein, 9 aa, Homo Sapiens
NILVNNDFH

SEQ ID NO: 44872 - protein, 9 aa, Homo Sapiens
CNLQYRCND

SEQ ID NO: 44873 - protein, 9 aa, Homo Sapiens
DTAARQGQH

SEQ ID NO: 44874 - protein, 9 aa, Homo Sapiens
CRLWQWPDL

SEQ ID NO: 44875 - protein, 9 aa, Homo Sapiens
YTTLRNGLI

SEQ ID NO: 44876 - protein, 9 aa, Homo Sapiens
FSLIEHQRI

SEQ ID NO: 44877 - protein, 9 aa, Homo Sapiens
PCPSFNKLS

SEQ ID NO: 44878 - protein, 9 aa, Homo Sapiens
TDYSLGDSQ

SEQ ID NO: 44879 - protein, 9 aa, Homo Sapiens
NNTSSVITE

SEQ ID NO: 44880 - protein, 9 aa, Homo Sapiens
FVAKTIRPP

SEQ ID NO: 44881 - protein, 9 aa, Homo Sapiens
PQKIMPPLK

SEQ ID NO: 44882 - protein, 9 aa, Homo Sapiens
MTKFYQEDE

SEQ ID NO: 44883 - protein, 9 aa, Homo Sapiens
RVTNLPCNS

SEQ ID NO: 44884 - protein, 9 aa, Homo Sapiens
EVKPRTAQC

SEQ ID NO: 44885 - protein, 9 aa, Homo Sapiens
LFHPNDSST

SEQ ID NO: 44886 - protein, 9 aa, Homo Sapiens
ASILFHPND

SEQ ID NO: 44887 - protein, 9 aa, Homo Sapiens
KPQNQGLNH

SEQ ID NO: 44888 - protein, 9 aa, Homo Sapiens
SVITEETKK

SEQ ID NO: 44889 - protein, 9 aa, Homo Sapiens
CVQSPNCNQ

SEQ ID NO: 44890 - protein, 9 aa, Homo Sapiens
VFSLLKDGP

SEQ ID NO: 44891 - protein, 9 aa, Homo Sapiens
IRILNRPTS

SEQ ID NO: 44892 - protein, 9 aa, Homo Sapiens
ILFHPNDSS

SEQ ID NO: 44893 - protein, 9 aa, Homo Sapiens
KDNNIKNAS

SEQ ID NO: 44894 - protein, 9 aa, Homo Sapiens
RAPEPKDVA

SEQ ID NO: 44895 - protein, 9 aa, Homo Sapiens
NAEFVLLTV

SEQ ID NO: 44896 - protein, 9 aa, Homo Sapiens
QWYASREEH

SEQ ID NO: 44897 - protein, 9 aa, Homo Sapiens
NLRKDKSKV

SEQ ID NO: 44898 - protein, 9 aa, Homo Sapiens
IHESLSLLH

SEQ ID NO: 44899 - protein, 9 aa, Homo Sapiens
SLLKDGPEI

SEQ ID NO: 44900 - protein, 9 aa, Homo Sapiens
PPWKLYRVM

SEQ ID NO: 44901 - protein, 9 aa, Homo Sapiens
FIRSEYRKK

SEQ ID NO: 44902 - protein, 9 aa, Homo Sapiens
KAFSQSFSL

SEQ ID NO: 44903 - protein, 9 aa, Homo Sapiens
VWHDFMFAC

SEQ ID NO: 44904 - protein, 9 aa, Homo Sapiens
PCLCDADGT

SEQ ID NO: 44905 - protein, 9 aa, Homo Sapiens
TGQDVVQIR

SEQ ID NO: 44906 - protein, 9 aa, Homo Sapiens
LVNNLRKDK

SEQ ID NO: 44907 - protein, 9 aa, Homo Sapiens
VARPVLYEF

SEQ ID NO: 44908 - protein, 9 aa, Homo Sapiens
SSASILFHP

SEQ ID NO: 44909 - protein, 9 aa, Homo Sapiens
YEFYEDTNS

SEQ ID NO: 44910 - protein, 9 aa, Homo Sapiens
DSAICVQSP

SEQ ID NO: 44911 - protein, 9 aa, Homo Sapiens
HSCPEHIIY

SEQ ID NO: 44912 - protein, 9 aa, Homo Sapiens
HESLSLLHP

SEQ ID NO: 44913 - protein, 9 aa, Homo Sapiens
SKSIIDKFL

SEQ ID NO: 44914 - protein, 9 aa, Homo Sapiens
PAGFTPVAI

SEQ ID NO: 44915 - protein, 9 aa, Homo Sapiens
QGQHQVPQH

SEQ ID NO: 44916 - protein, 9 aa, Homo Sapiens
RTCWSLGNA

SEQ ID NO: 44917 - protein, 9 aa, Homo Sapiens
DAAVIPMKN

SEQ ID NO: 44918 - protein, 9 aa, Homo Sapiens
VNAEFVLLT

SEQ ID NO: 44919 - protein, 9 aa, Homo Sapiens
EDPKKLGSL

SEQ ID NO: 44920 - protein, 9 aa, Homo Sapiens
TEHNCMTTK

SEQ ID NO: 44921 - protein, 9 aa, Homo Sapiens
FGFKISKVG

SEQ ID NO: 44922 - protein, 9 aa, Homo Sapiens
VIPMKNNRF

SEQ ID NO: 44923 - protein, 9 aa, Homo Sapiens
SAGGLVAAI

SEQ ID NO: 44924 - protein, 9 aa, Homo Sapiens
QVFSLLKDG

SEQ ID NO: 44925 - protein, 9 aa, Homo Sapiens
CGDCRKGFI

SEQ ID NO: 44926 - protein, 9 aa, Homo Sapiens
FIDLKKPQN

SEQ ID NO: 44927 - protein, 9 aa, Homo Sapiens
GTSMPTLTP

SEQ ID NO: 44928 - protein, 9 aa, Homo Sapiens
MAEAPSSVT

SEQ ID NO: 44929 - protein, 9 aa, Homo Sapiens
DAQTPGTVS

SEQ ID NO: 44930 - protein, 9 aa, Homo Sapiens
YCRLWQWPD

SEQ ID NO: 44931 - protein, 9 aa, Homo Sapiens
MPTLTPSEG

SEQ ID NO: 44932 - protein, 9 aa, Homo Sapiens
KSKSIIDKF

SEQ ID NO: 44933 - protein, 9 aa, Homo Sapiens
LKLACLLPT

SEQ ID NO: 44934 - protein, 9 aa, Homo Sapiens
IRFAYGFET

SEQ ID NO: 44935 - protein, 9 aa, Homo Sapiens
LQKFLAENR

SEQ ID NO: 44936 - protein, 9 aa, Homo Sapiens
KPYNCKQCG

SEQ ID NO: 44937 - protein, 9 aa, Homo Sapiens
LSGEVYLLG

SEQ ID NO: 44938 - protein, 9 aa, Homo Sapiens
RKEKERVIR

SEQ ID NO: 44939 - protein, 9 aa, Homo Sapiens
YNVRLRPNF

SEQ ID NO: 44940 - protein, 9 aa, Homo Sapiens
ITNQFVARA

SEQ ID NO: 44941 - protein, 9 aa, Homo Sapiens
CNSLSHNPG

SEQ ID NO: 44942 - protein, 9 aa, Homo Sapiens
LNEMFCQLA

SEQ ID NO: 44943 - protein, 9 aa, Homo Sapiens
ACGDCRKGF

SEQ ID NO: 44944 - protein, 9 aa, Homo Sapiens
TPALNPLMY

SEQ ID NO: 44945 - protein, 9 aa, Homo Sapiens
CMTTKSRDP

SEQ ID NO: 44946 - protein, 9 aa, Homo Sapiens
IENYPVTGI

SEQ ID NO: 44947 - protein, 9 aa, Homo Sapiens
INEYPCLCD

SEQ ID NO: 44948 - protein, 9 aa, Homo Sapiens
SPEVLHTEV

SEQ ID NO: 44949 - protein, 9 aa, Homo Sapiens
SNFIFHLAN

SEQ ID NO: 44950 - protein, 9 aa, Homo Sapiens
LGDSQGAQG

SEQ ID NO: 44951 - protein, 9 aa, Homo Sapiens
YYSNFIFHL

SEQ ID NO: 44952 - protein, 9 aa, Homo Sapiens
FSQENIIWC

SEQ ID NO: 44953 - protein, 9 aa, Homo Sapiens
KVSEESHKP

SEQ ID NO: 44954 - protein, 9 aa, Homo Sapiens
CGKAFSQSF

SEQ ID NO: 44955 - protein, 9 aa, Homo Sapiens
LTPSEGSTP

SEQ ID NO: 44956 - protein, 9 aa, Homo Sapiens
SGEVYLLGP

SEQ ID NO: 44957 - protein, 9 aa, Homo Sapiens
PRAPEPKDV

SEQ ID NO: 44958 - protein, 9 aa, Homo Sapiens
EKKDYSDRT

SEQ ID NO: 44959 - protein, 9 aa, Homo Sapiens
PSSVTDDLK

SEQ ID NO: 44960 - protein, 9 aa, Homo Sapiens
TPTIMGCYL

SEQ ID NO: 44961 - protein, 9 aa, Homo Sapiens
VVKELVENS

SEQ ID NO: 44962 - protein, 9 aa, Homo Sapiens
SLVGIRPQW

SEQ ID NO: 44963 - protein, 9 aa, Homo Sapiens
SQENIIWCN

SEQ ID NO: 44964 - protein, 9 aa, Homo Sapiens
QTPTIMGCY

SEQ ID NO: 44965 - protein, 9 aa, Homo Sapiens
PPPQIRILN

SEQ ID NO: 44966 - protein, 9 aa, Homo Sapiens
LQLKKQKLM

SEQ ID NO: 44967 - protein, 9 aa, Homo Sapiens
STDYSLGDS

SEQ ID NO: 44968 - protein, 9 aa, Homo Sapiens
LVGIRPQWY

SEQ ID NO: 44969 - protein, 9 aa, Homo Sapiens
LACLLPTLL

SEQ ID NO: 44970 - protein, 9 aa, Homo Sapiens
RGAQVIENY

SEQ ID NO: 44971 - protein, 9 aa, Homo Sapiens
RSGDGASAG

SEQ ID NO: 44972 - protein, 9 aa, Homo Sapiens
SDAFTDPAI

SEQ ID NO: 44973 - protein, 9 aa, Homo Sapiens
DPEGPCPSF

SEQ ID NO: 44974 - protein, 9 aa, Homo Sapiens
KNMVVNQAH

SEQ ID NO: 44975 - protein, 9 aa, Homo Sapiens
GVRIFAINK

SEQ ID NO: 44976 - protein, 9 aa, Homo Sapiens
CTYSPALNE

SEQ ID NO: 44977 - protein, 9 aa, Homo Sapiens
GEVYLLGPL

SEQ ID NO: 44978 - protein, 9 aa, Homo Sapiens
VHQFILTSL

SEQ ID NO: 44979 - protein, 9 aa, Homo Sapiens
LPFYESSPE

SEQ ID NO: 44980 - protein, 9 aa, Homo Sapiens
VGIRPQWYA

SEQ ID NO: 44981 - protein, 9 aa, Homo Sapiens
SVVLTLVSK

SEQ ID NO: 44982 - protein, 9 aa, Homo Sapiens
TSSVITEET

SEQ ID NO: 44983 - protein, 9 aa, Homo Sapiens
KSPAGFTPV

SEQ ID NO: 44984 - protein, 9 aa, Homo Sapiens
VVNQAHSCP

SEQ ID NO: 44985 - protein, 9 aa, Homo Sapiens
QLHGVRIFA

SEQ ID NO: 44986 - protein, 9 aa, Homo Sapiens
SCNFPHRPD

SEQ ID NO: 44987 - protein, 9 aa, Homo Sapiens
NEYPCLCDA

SEQ ID NO: 44988 - protein, 9 aa, Homo Sapiens
DPKKLGSLF

SEQ ID NO: 44989 - protein, 9 aa, Homo Sapiens
EKPYNCKQC

SEQ ID NO: 44990 - protein, 9 aa, Homo Sapiens
RIGEGRTCW

SEQ ID NO: 44991 - protein, 9 aa, Homo Sapiens
DYLYDVHSL

SEQ ID NO: 44992 - protein, 9 aa, Homo Sapiens
QGRSGDGAS

SEQ ID NO: 44993 - protein, 9 aa, Homo Sapiens
PKKLGSLFV

SEQ ID NO: 44994 - protein, 9 aa, Homo Sapiens
VVLTLVSKK

SEQ ID NO: 44995 - protein, 9 aa, Homo Sapiens
GDCCEPQVA

SEQ ID NO: 44996 - protein, 9 aa, Homo Sapiens
VNQAHSCPE

SEQ ID NO: 44997 - protein, 9 aa, Homo Sapiens
CLLPTLLES

SEQ ID NO: 44998 - protein, 9 aa, Homo Sapiens
QNQGLNHTC

SEQ ID NO: 44999 - protein, 9 aa, Homo Sapiens
SLSTVVKEL

SEQ ID NO: 45000 - protein, 9 aa, Homo Sapiens
EEVFGFKIS

SEQ ID NO: 45001 - protein, 9 aa, Homo Sapiens
KLKIMTKFY

SEQ ID NO: 45002 - protein, 9 aa, Homo Sapiens
WCNLQYRCN

SEQ ID NO: 45003 - protein, 9 aa, Homo Sapiens
AARQGQHQV

SEQ ID NO: 45004 - protein, 9 aa, Homo Sapiens
LLHPQSKIS

SEQ ID NO: 45005 - protein, 9 aa, Homo Sapiens
TNQFVARAA

SEQ ID NO: 45006 - protein, 9 aa, Homo Sapiens
TCWSLGNAY

SEQ ID NO: 45007 - protein, 9 aa, Homo Sapiens
PALNEMFCQ

SEQ ID NO: 45008 - protein, 9 aa, Homo Sapiens
TAPKVSEES

SEQ ID NO: 45009 - protein, 9 aa, Homo Sapiens
DVVQIRSLS

SEQ ID NO: 45010 - protein, 9 aa, Homo Sapiens
LSLLHPQSK

SEQ ID NO: 45011 - protein, 9 aa, Homo Sapiens
ETVARPVLY

SEQ ID NO: 45012 - protein, 9 aa, Homo Sapiens
VMSGHLGWV

SEQ ID NO: 45013 - protein, 9 aa, Homo Sapiens
QSFSLIEHQ

SEQ ID NO: 45014 - protein, 9 aa, Homo Sapiens
NNLRKDKSK

SEQ ID NO: 45015 - protein, 9 aa, Homo Sapiens
VPTAPKVSE

SEQ ID NO: 45016 - protein, 9 aa, Homo Sapiens
DGASAGGLV

SEQ ID NO: 45017 - protein, 9 aa, Homo Sapiens
KKPQNQGLN

SEQ ID NO: 45018 - protein, 9 aa, Homo Sapiens
NNDFHIKIA

SEQ ID NO: 45019 - protein, 9 aa, Homo Sapiens
LPCNSLSHN

SEQ ID NO: 45020 - protein, 9 aa, Homo Sapiens
MLSCNFPHR

SEQ ID NO: 45021 - protein, 9 aa, Homo Sapiens
KFYQEDEMK

SEQ ID NO: 45022 - protein, 9 aa, Homo Sapiens
GPCPSFNKL

SEQ ID NO: 45023 - protein, 9 aa, Homo Sapiens
PRQVFSLLK

SEQ ID NO: 45024 - protein, 9 aa, Homo Sapiens
ESQNKIEVL

SEQ ID NO: 45025 - protein, 9 aa, Homo Sapiens
GFILVIFAI

SEQ ID NO: 45026 - protein, 9 aa, Homo Sapiens
TLREVGNVK

SEQ ID NO: 45027 - protein, 9 aa, Homo Sapiens
AGVALPNDH

SEQ ID NO: 45028 - protein, 9 aa, Homo Sapiens
MGWNSSRIA

SEQ ID NO: 45029 - protein, 9 aa, Homo Sapiens
GAGVALPND

SEQ ID NO: 45030 - protein, 9 aa, Homo Sapiens
REPVQSKSP

SEQ ID NO: 45031 - protein, 9 aa, Homo Sapiens
KKMTTKILQ

SEQ ID NO: 45032 - protein, 9 aa, Homo Sapiens
VAERLRVLG

SEQ ID NO: 45033 - protein, 9 aa, Homo Sapiens
GNLTSHKTV

SEQ ID NO: 45034 - protein, 9 aa, Homo Sapiens
LIRRQNTLS

SEQ ID NO: 45035 - protein, 9 aa, Homo Sapiens
YKGNLTSHK

SEQ ID NO: 45036 - protein, 9 aa, Homo Sapiens
TLSESMRKG

SEQ ID NO: 45037 - protein, 9 aa, Homo Sapiens
VDFKRHIEV

SEQ ID NO: 45038 - protein, 9 aa, Homo Sapiens
VCACPGRDW

SEQ ID NO: 45039 - protein, 9 aa, Homo Sapiens
EAFIVKQLE

SEQ ID NO: 45040 - protein, 9 aa, Homo Sapiens
KGNCASEDV

SEQ ID NO: 45041 - protein, 9 aa, Homo Sapiens
KTLREVGNV

SEQ ID NO: 45042 - protein, 9 aa, Homo Sapiens
EGFLLIDHE

SEQ ID NO: 45043 - protein, 9 aa, Homo Sapiens
GMGWNSSRI

SEQ ID NO: 45044 - protein, 9 aa, Homo Sapiens
RGSIREPVQ

SEQ ID NO: 45045 - protein, 9 aa, Homo Sapiens
CRVLFSQAQ

SEQ ID NO: 45046 - protein, 9 aa, Homo Sapiens
QRKEVKYEV

SEQ ID NO: 45047 - protein, 9 aa, Homo Sapiens
TQGCGECVS

SEQ ID NO: 45048 - protein, 9 aa, Homo Sapiens
CGLRAMPSP

SEQ ID NO: 45049 - protein, 9 aa, Homo Sapiens
KVFKVLYDR

SEQ ID NO: 45050 - protein, 9 aa, Homo Sapiens
KMTTKILQQ

SEQ ID NO: 45051 - protein, 9 aa, Homo Sapiens
GTQGCGECV

SEQ ID NO: 45052 - protein, 9 aa, Homo Sapiens
FGFILVIFA

SEQ ID NO: 45053 - protein, 9 aa, Homo Sapiens
KAFQKNTVF

SEQ ID NO: 45054 - protein, 9 aa, Homo Sapiens
ASEDVIWEV

SEQ ID NO: 45055 - protein, 9 aa, Homo Sapiens
AMPSPEARV

SEQ ID NO: 45056 - protein, 9 aa, Homo Sapiens
NVKALMECA

SEQ ID NO: 45057 - protein, 9 aa, Homo Sapiens
KCRVLFSQA

SEQ ID NO: 45058 - protein, 9 aa, Homo Sapiens
TSKKMTTKI

SEQ ID NO: 45059 - protein, 9 aa, Homo Sapiens
AAAPRRKCR

SEQ ID NO: 45060 - protein, 9 aa, Homo Sapiens
PNDHIYVVG

SEQ ID NO: 45061 - protein, 9 aa, Homo Sapiens
LREVGNVKA

SEQ ID NO: 45062 - protein, 9 aa, Homo Sapiens
IKGNCASED

SEQ ID NO: 45063 - protein, 9 aa, Homo Sapiens
EFTSKKMTT

SEQ ID NO: 45064 - protein, 9 aa, Homo Sapiens
CQKAFQKNT

SEQ ID NO: 45065 - protein, 9 aa, Homo Sapiens
GNCASEDVI

SEQ ID NO: 45066 - protein, 9 aa, Homo Sapiens
RWSVPQIPC

SEQ ID NO: 45067 - protein, 9 aa, Homo Sapiens
AVDFKRHIE

SEQ ID NO: 45068 - protein, 9 aa, Homo Sapiens
GGEEGFLLI

SEQ ID NO: 45069 - protein, 9 aa, Homo Sapiens
LFAYFTVPG

SEQ ID NO: 45070 - protein, 9 aa, Homo Sapiens
PRRKCRVLF

SEQ ID NO: 45071 - protein, 9 aa, Homo Sapiens
NCASEDVIW

SEQ ID NO: 45072 - protein, 9 aa, Homo Sapiens
FFGFILVIF

SEQ ID NO: 45073 - protein, 9 aa, Homo Sapiens
SEKVFKVLY

SEQ ID NO: 45074 - protein, 9 aa, Homo Sapiens
AGWQVGGTQ

SEQ ID NO: 45075 - protein, 9 aa, Homo Sapiens
EVANQTSGL

SEQ ID NO: 45076 - protein, 9 aa, Homo Sapiens
SGLQRAFPA

SEQ ID NO: 45077 - protein, 9 aa, Homo Sapiens
RQNTLSESM

SEQ ID NO: 45078 - protein, 9 aa, Homo Sapiens
PVQSKSPQD

SEQ ID NO: 45079 - protein, 9 aa, Homo Sapiens
EADFLFAYF

SEQ ID NO: 45080 - protein, 9 aa, Homo Sapiens
EVKYEVPQA

SEQ ID NO: 45081 - protein, 9 aa, Homo Sapiens
KEAFIVKQL

SEQ ID NO: 45082 - protein, 9 aa, Homo Sapiens
SGAGVALPN

SEQ ID NO: 45083 - protein, 9 aa, Homo Sapiens
LVGGEEGFL

SEQ ID NO: 45084 - protein, 9 aa, Homo Sapiens
EVGNVKALM

SEQ ID NO: 45085 - protein, 9 aa, Homo Sapiens
EVPQATDGL

SEQ ID NO: 45086 - protein, 9 aa, Homo Sapiens
QKKSEKVFK

SEQ ID NO: 45087 - protein, 9 aa, Homo Sapiens
EQKEAFIVK

SEQ ID NO: 45088 - protein, 9 aa, Homo Sapiens
RRKCRVLFS

SEQ ID NO: 45089 - protein, 9 aa, Homo Sapiens
ILVIFAIEI

SEQ ID NO: 45090 - protein, 9 aa, Homo Sapiens
HEQKKSEKV

SEQ ID NO: 45091 - protein, 9 aa, Homo Sapiens
RKCRVLFSQ

SEQ ID NO: 45092 - protein, 9 aa, Homo Sapiens
GEEGFLLID

SEQ ID NO: 45093 - protein, 9 aa, Homo Sapiens
PAGWQVGGT

SEQ ID NO: 45094 - protein, 9 aa, Homo Sapiens
SKKMTTKIL

SEQ ID NO: 45095 - protein, 9 aa, Homo Sapiens
PDEFTSKKM

SEQ ID NO: 45096 - protein, 9 aa, Homo Sapiens
NLTSHKTVH

SEQ ID NO: 45097 - protein, 9 aa, Homo Sapiens
LASAVDFKR

SEQ ID NO: 45098 - protein, 9 aa, Homo Sapiens
RSGAGVALP

SEQ ID NO: 45099 - protein, 9 aa, Homo Sapiens
REVGNVKAL

SEQ ID NO: 45100 - protein, 9 aa, Homo Sapiens
CPGRDWRTE

SEQ ID NO: 45101 - protein, 9 aa, Homo Sapiens
NEVVVVAER

SEQ ID NO: 45102 - protein, 9 aa, Homo Sapiens
VGGEEGFLL

SEQ ID NO: 45103 - protein, 9 aa, Homo Sapiens
GNVKALMEC

SEQ ID NO: 45104 - protein, 9 aa, Homo Sapiens
MPSPEARVL

SEQ ID NO: 45105 - protein, 9 aa, Homo Sapiens
RAMPSPEAR

SEQ ID NO: 45106 - protein, 9 aa, Homo Sapiens
EQKKSEKVF

SEQ ID NO: 45107 - protein, 9 aa, Homo Sapiens
ACPGRDWRT

SEQ ID NO: 45108 - protein, 9 aa, Homo Sapiens
ASAVDFKRH

SEQ ID NO: 45109 - protein, 9 aa, Homo Sapiens
FILVIFAIE

SEQ ID NO: 45110 - protein, 9 aa, Homo Sapiens
YEVPQATDG

SEQ ID NO: 45111 - protein, 9 aa, Homo Sapiens
LPNDHIYVV

SEQ ID NO: 45112 - protein, 9 aa, Homo Sapiens
SPRWSVPQI

SEQ ID NO: 45113 - protein, 9 aa, Homo Sapiens
DVIWEVLNA

SEQ ID NO: 45114 - protein, 9 aa, Homo Sapiens
SFRYKGNLT

SEQ ID NO: 45115 - protein, 9 aa, Homo Sapiens
AFIVKQLED

SEQ ID NO: 45116 - protein, 9 aa, Homo Sapiens
EKVFKVLYD

SEQ ID NO: 45117 - protein, 9 aa, Homo Sapiens
QVGGTQGCG

SEQ ID NO: 45118 - protein, 9 aa, Homo Sapiens
ADNNEVVVV

SEQ ID NO: 45119 - protein, 9 aa, Homo Sapiens
CPRGSIREP

SEQ ID NO: 45120 - protein, 9 aa, Homo Sapiens
FIVKQLEDA

SEQ ID NO: 45121 - protein, 9 aa, Homo Sapiens
KSEKVFKVL

SEQ ID NO: 45122 - protein, 9 aa, Homo Sapiens
RRQNTLSES

SEQ ID NO: 45123 - protein, 9 aa, Homo Sapiens
VPQATDGLA

SEQ ID NO: 45124 - protein, 9 aa, Homo Sapiens
ANQTSGLQR

SEQ ID NO: 45125 - protein, 9 aa, Homo Sapiens
GLFFGFILV

SEQ ID NO: 45126 - protein, 9 aa, Homo Sapiens
RSQQQQQQG

SEQ ID NO: 45127 - protein, 9 aa, Homo Sapiens
NTVFVNHME

SEQ ID NO: 45128 - protein, 9 aa, Homo Sapiens
ADFLFAYFT

SEQ ID NO: 45129 - protein, 9 aa, Homo Sapiens
FQKNTVFVN

SEQ ID NO: 45130 - protein, 9 aa, Homo Sapiens
QEQKEAFIV

SEQ ID NO: 45131 - protein, 9 aa, Homo Sapiens
PICGLRAMP

SEQ ID NO: 45132 - protein, 9 aa, Homo Sapiens
LGMGWNSSR

SEQ ID NO: 45133 - protein, 9 aa, Homo Sapiens
NTLSESMRK

SEQ ID NO: 45134 - protein, 9 aa, Homo Sapiens
AAAAPRRKC

SEQ ID NO: 45135 - protein, 9 aa, Homo Sapiens
VGGTQGCGE

SEQ ID NO: 45136 - protein, 9 aa, Homo Sapiens
IRRQNTLSE

SEQ ID NO: 45137 - protein, 9 aa, Homo Sapiens
SLEVANQTS

SEQ ID NO: 45138 - protein, 9 aa, Homo Sapiens
CLGMGWNSS

SEQ ID NO: 45139 - protein, 9 aa, Homo Sapiens
AAPRRKCRV

SEQ ID NO: 45140 - protein, 9 aa, Homo Sapiens
LTSHKTVHT

SEQ ID NO: 45141 - protein, 9 aa, Homo Sapiens
PRWSVPQIP

SEQ ID NO: 45142 - protein, 9 aa, Homo Sapiens
GVALPNDHI

SEQ ID NO: 45143 - protein, 9 aa, Homo Sapiens
RYKGNLTSH

SEQ ID NO: 45144 - protein, 9 aa, Homo Sapiens
VFKVLYDRM

SEQ ID NO: 45145 - protein, 9 aa, Homo Sapiens
YFTVPGYYS

SEQ ID NO: 45146 - protein, 9 aa, Homo Sapiens
IREPVQSKS

SEQ ID NO: 45147 - protein, 9 aa, Homo Sapiens
VVAERLRVL

SEQ ID NO: 45148 - protein, 9 aa, Homo Sapiens
WQVGGTQGC

SEQ ID NO: 45149 - protein, 9 aa, Homo Sapiens
PRGSIREPV

SEQ ID NO: 45150 - protein, 9 aa, Homo Sapiens
QTSGLQRAF

SEQ ID NO: 45151 - protein, 9 aa, Homo Sapiens
AFQKNTVFV

SEQ ID NO: 45152 - protein, 9 aa, Homo Sapiens
LEVANQTSG

SEQ ID NO: 45153 - protein, 9 aa, Homo Sapiens
GSPRWSVPQ

SEQ ID NO: 45154 - protein, 9 aa, Homo Sapiens
NNEVVVVAE

SEQ ID NO: 45155 - protein, 9 aa, Homo Sapiens
EKCLGMGWN

SEQ ID NO: 45156 - protein, 9 aa, Homo Sapiens
GSIREPVQS

SEQ ID NO: 45157 - protein, 9 aa, Homo Sapiens
LEAGSPRWS

SEQ ID NO: 45158 - protein, 9 aa, Homo Sapiens
WSVPQIPCL

SEQ ID NO: 45159 - protein, 9 aa, Homo Sapiens
CACPGRDWR

SEQ ID NO: 45160 - protein, 9 aa, Homo Sapiens
KYEVPQATD

SEQ ID NO: 45161 - protein, 9 aa, Homo Sapiens
RKEVKYEVP

SEQ ID NO: 45162 - protein, 9 aa, Homo Sapiens
GFLLIDHEA

SEQ ID NO: 45163 - protein, 9 aa, Homo Sapiens
KNTVFVNHM

SEQ ID NO: 45164 - protein, 9 aa, Homo Sapiens
FAYFTVPGY

SEQ ID NO: 45165 - protein, 9 aa, Homo Sapiens
DWRTEEENL

SEQ ID NO: 45166 - protein, 9 aa, Homo Sapiens
VALPNDHIY

SEQ ID NO: 45167 - protein, 9 aa, Homo Sapiens
SAVDFKRHI

SEQ ID NO: 45168 - protein, 9 aa, Homo Sapiens
FRYKGNLTS

SEQ ID NO: 45169 - protein, 9 aa, Homo Sapiens
CASEDVIWE

SEQ ID NO: 45170 - protein, 9 aa, Homo Sapiens
ICGLRAMPS

SEQ ID NO: 45171 - protein, 9 aa, Homo Sapiens
EAGSPRWSV

SEQ ID NO: 45172 - protein, 9 aa, Homo Sapiens
GWNSSRIAN

SEQ ID NO: 45173 - protein, 9 aa, Homo Sapiens
AYFTVPGYY

SEQ ID NO: 45174 - protein, 9 aa, Homo Sapiens
QKNTVFVNH

SEQ ID NO: 45175 - protein, 9 aa, Homo Sapiens
FTSKKMTTK

SEQ ID NO: 45176 - protein, 9 aa, Homo Sapiens
KRHIEVLHY

SEQ ID NO: 45177 - protein, 9 aa, Homo Sapiens
EEGFLLIDH

SEQ ID NO: 45178 - protein, 9 aa, Homo Sapiens
LQEQKEAFI

SEQ ID NO: 45179 - protein, 9 aa, Homo Sapiens
LRAMPSPEA

SEQ ID NO: 45180 - protein, 9 aa, Homo Sapiens
FLLIDHEAM

SEQ ID NO: 45181 - protein, 9 aa, Homo Sapiens
EDVIWEVLN

SEQ ID NO: 45182 - protein, 9 aa, Homo Sapiens
EVVVVAERL

SEQ ID NO: 45183 - protein, 9 aa, Homo Sapiens
SEDVIWEVL

SEQ ID NO: 45184 - protein, 9 aa, Homo Sapiens
GGTQGCGEC

SEQ ID NO: 45185 - protein, 9 aa, Homo Sapiens
MLGLFFGFI

SEQ ID NO: 45186 - protein, 9 aa, Homo Sapiens
SIREPVQSK

SEQ ID NO: 45187 - protein, 9 aa, Homo Sapiens
DFKRHIEVL

SEQ ID NO: 45188 - protein, 9 aa, Homo Sapiens
VVVVAERLR

SEQ ID NO: 45189 - protein, 9 aa, Homo Sapiens
WNSSRIANR

SEQ ID NO: 45190 - protein, 9 aa, Homo Sapiens
DNNEVVVVA

SEQ ID NO: 45191 - protein, 9 aa, Homo Sapiens
EPVQSKSPQ

SEQ ID NO: 45192 - protein, 9 aa, Homo Sapiens
VGNVKALME

SEQ ID NO: 45193 - protein, 9 aa, Homo Sapiens
EPICGLRAM

SEQ ID NO: 45194 - protein, 9 aa, Homo Sapiens
FKRHIEVLH

SEQ ID NO: 45195 - protein, 9 aa, Homo Sapiens
WRTEEENLR

SEQ ID NO: 45196 - protein, 9 aa, Homo Sapiens
KCLGMGWNS

SEQ ID NO: 45197 - protein, 9 aa, Homo Sapiens
DEFTSKKMT

SEQ ID NO: 45198 - protein, 9 aa, Homo Sapiens
ECQKAFQKN

SEQ ID NO: 45199 - protein, 9 aa, Homo Sapiens
LGLFFGFIL

SEQ ID NO: 45200 - protein, 9 aa, Homo Sapiens
GWQVGGTQG

SEQ ID NO: 45201 - protein, 9 aa, Homo Sapiens
TSHKTVHTG

SEQ ID NO: 45202 - protein, 9 aa, Homo Sapiens
KGNLTSHKT

SEQ ID NO: 45203 - protein, 9 aa, Homo Sapiens
PGRDWRTEE

SEQ ID NO: 45204 - protein, 9 aa, Homo Sapiens
LEKCLGMGW

SEQ ID NO: 45205 - protein, 9 aa, Homo Sapiens
VANQTSGLQ

SEQ ID NO: 45206 - protein, 9 aa, Homo Sapiens
KEVKYEVPQ

SEQ ID NO: 45207 - protein, 9 aa, Homo Sapiens
APRRKCRVL

SEQ ID NO: 45208 - protein, 9 aa, Homo Sapiens
GRDWRTEEE

SEQ ID NO: 45209 - protein, 9 aa, Homo Sapiens
GLRAMPSPE

SEQ ID NO: 45210 - protein, 9 aa, Homo Sapiens
AGSPRWSVP

SEQ ID NO: 45211 - protein, 9 aa, Homo Sapiens
ALPNDHIYV

SEQ ID NO: 45212 - protein, 9 aa, Homo Sapiens
NQTSGLQRA

SEQ ID NO: 45213 - protein, 9 aa, Homo Sapiens
RHIEVLHYL

SEQ ID NO: 45214 - protein, 9 aa, Homo Sapiens
VVVAERLRV

SEQ ID NO: 45215 - protein, 9 aa, Homo Sapiens
QKAFQKNTV

SEQ ID NO: 45216 - protein, 9 aa, Homo Sapiens
VLQEQKEAF

SEQ ID NO: 45217 - protein, 9 aa, Homo Sapiens
SESMRKGHS

SEQ ID NO: 45218 - protein, 9 aa, Homo Sapiens
LSESMRKGH

SEQ ID NO: 45219 - protein, 9 aa, Homo Sapiens
MTTKILQQI

SEQ ID NO: 45220 - protein, 9 aa, Homo Sapiens
TSGLQRAFP

SEQ ID NO: 45221 - protein, 9 aa, Homo Sapiens
SVPQIPCLI

SEQ ID NO: 45222 - protein, 9 aa, Homo Sapiens
SQQQQQQGL

SEQ ID NO: 45223 - protein, 9 aa, Homo Sapiens
LFFGFILVI

SEQ ID NO: 45224 - protein, 9 aa, Homo Sapiens
KKTLREVGN

SEQ ID NO: 45225 - protein, 9 aa, Homo Sapiens
QKEAFIVKQ

SEQ ID NO: 45226 - protein, 9 aa, Homo Sapiens
KKSEKVFKV

SEQ ID NO: 45227 - protein, 9 aa, Homo Sapiens
DFLFAYFTV

SEQ ID NO: 45228 - protein, 9 aa, Homo Sapiens
LLIDHEAMS

SEQ ID NO: 45229 - protein, 9 aa, Homo Sapiens
FLFAYFTVP

SEQ ID NO: 45230 - protein, 9 aa, Homo Sapiens
VKYEVPQAT

SEQ ID NO: 45231 - protein, 9 aa, Homo Sapiens
FTVPGYYSW

SEQ ID NO: 45232 - protein, 9 aa, Homo Sapiens
RDWRTEEEN

SEQ ID NO: 45233 - protein, 9 aa, Homo Sapiens
QNTLSESMR

SEQ ID NO: 45234 - protein, 9 aa, Homo Sapiens
TEHPYRSKK

SEQ ID NO: 45235 - protein, 9 aa, Homo Sapiens
QAPVAPQKN

SEQ ID NO: 45236 - protein, 9 aa, Homo Sapiens
LRCLCPTGY

SEQ ID NO: 45237 - protein, 9 aa, Homo Sapiens
HEAGIQARS

SEQ ID NO: 45238 - protein, 9 aa, Homo Sapiens
GDSHVRMLE

SEQ ID NO: 45239 - protein, 9 aa, Homo Sapiens
DLVCGMETR

SEQ ID NO: 45240 - protein, 9 aa, Homo Sapiens
FLQDHDRYM

SEQ ID NO: 45241 - protein, 9 aa, Homo Sapiens
DHVHGRAPD

SEQ ID NO: 45242 - protein, 9 aa, Homo Sapiens
METRHCTDH

SEQ ID NO: 45243 - protein, 9 aa, Homo Sapiens
TNAKGDSHV

SEQ ID NO: 45244 - protein, 9 aa, Homo Sapiens
LCPLGHNDS

SEQ ID NO: 45245 - protein, 9 aa, Homo Sapiens
TLLLSPGSP

SEQ ID NO: 45246 - protein, 9 aa, Homo Sapiens
ARCAEEEKL

SEQ ID NO: 45247 - protein, 9 aa, Homo Sapiens
ACTTTPCML

SEQ ID NO: 45248 - protein, 9 aa, Homo Sapiens
PQGLRCLCP

SEQ ID NO: 45249 - protein, 9 aa, Homo Sapiens
IQACTTTPC

SEQ ID NO: 45250 - protein, 9 aa, Homo Sapiens
QDHDRYMEH

SEQ ID NO: 45251 - protein, 9 aa, Homo Sapiens
NQQQLLQRH

SEQ ID NO: 45252 - protein, 9 aa, Homo Sapiens
KTYMVHKQY

SEQ ID NO: 45253 - protein, 9 aa, Homo Sapiens
ATTVPVTQF

SEQ ID NO: 45254 - protein, 9 aa, Homo Sapiens
IICITNAKG

SEQ ID NO: 45255 - protein, 9 aa, Homo Sapiens
ELQFYQNNI

SEQ ID NO: 45256 - protein, 9 aa, Homo Sapiens
QQQLLQRHI

SEQ ID NO: 45257 - protein, 9 aa, Homo Sapiens
PTSRHHRFW

SEQ ID NO: 45258 - protein, 9 aa, Homo Sapiens
QFYQNNIFK

SEQ ID NO: 45259 - protein, 9 aa, Homo Sapiens
LGVEGTVFP

SEQ ID NO: 45260 - protein, 9 aa, Homo Sapiens
EQARCAEEE

SEQ ID NO: 45261 - protein, 9 aa, Homo Sapiens
ITFSRHKTY

SEQ ID NO: 45262 - protein, 9 aa, Homo Sapiens
IKELQFYQN

SEQ ID NO: 45263 - protein, 9 aa, Homo Sapiens
VGKYHIQAC

SEQ ID NO: 45264 - protein, 9 aa, Homo Sapiens
FEVRVCACT

SEQ ID NO: 45265 - protein, 9 aa, Homo Sapiens
AKGDSHVRM

SEQ ID NO: 45266 - protein, 9 aa, Homo Sapiens
CTGRDRRTE

SEQ ID NO: 45267 - protein, 9 aa, Homo Sapiens
VDSWRNFKA

SEQ ID NO: 45268 - protein, 9 aa, Homo Sapiens
TGRDRRTEE

SEQ ID NO: 45269 - protein, 9 aa, Homo Sapiens
GMETRHCTD

SEQ ID NO: 45270 - protein, 9 aa, Homo Sapiens
SRHHRFWQS

SEQ ID NO: 45271 - protein, 9 aa, Homo Sapiens
RVDSWRNFK

SEQ ID NO: 45272 - protein, 9 aa, Homo Sapiens
KKESLITCL

SEQ ID NO: 45273 - protein, 9 aa, Homo Sapiens
LLLSAIVSI

SEQ ID NO: 45274 - protein, 9 aa, Homo Sapiens
TTVPVTQFP

SEQ ID NO: 45275 - protein, 9 aa, Homo Sapiens
RNFKANTKG

SEQ ID NO: 45276 - protein, 9 aa, Homo Sapiens
ANIVTTTTH

SEQ ID NO: 45277 - protein, 9 aa, Homo Sapiens
VCACTGRDR

SEQ ID NO: 45278 - protein, 9 aa, Homo Sapiens
GGQQEDAES

SEQ ID NO: 45279 - protein, 9 aa, Homo Sapiens
DRYMEHLEK

SEQ ID NO: 45280 - protein, 9 aa, Homo Sapiens
PLVSSTLLL

SEQ ID NO: 45281 - protein, 9 aa, Homo Sapiens
QQRLNKYHE

SEQ ID NO: 45282 - protein, 9 aa, Homo Sapiens
EHPYRSKKA

SEQ ID NO: 45283 - protein, 9 aa, Homo Sapiens
RAPDRLSHL

SEQ ID NO: 45284 - protein, 9 aa, Homo Sapiens
LLLSPGSPQ

SEQ ID NO: 45285 - protein, 9 aa, Homo Sapiens
FKHANIVTT

SEQ ID NO: 45286 - protein, 9 aa, Homo Sapiens
LCLCHARRL

SEQ ID NO: 45287 - protein, 9 aa, Homo Sapiens
ITCLADLFH

SEQ ID NO: 45288 - protein, 9 aa, Homo Sapiens
STLLLSPGS

SEQ ID NO: 45289 - protein, 9 aa, Homo Sapiens
GQQEDAESR

SEQ ID NO: 45290 - protein, 9 aa, Homo Sapiens
RLNKYHEAG

SEQ ID NO: 45291 - protein, 9 aa, Homo Sapiens
QRLNKYHEA

SEQ ID NO: 45292 - protein, 9 aa, Homo Sapiens
PVGKYHIQA

SEQ ID NO: 45293 - protein, 9 aa, Homo Sapiens
VSSTLLLSP

SEQ ID NO: 45294 - protein, 9 aa, Homo Sapiens
VAPQKNCKA

SEQ ID NO: 45295 - protein, 9 aa, Homo Sapiens
NFKANTKGK

SEQ ID NO: 45296 - protein, 9 aa, Homo Sapiens
CQSPFLHSR

SEQ ID NO: 45297 - protein, 9 aa, Homo Sapiens
ERLRVLGVE

SEQ ID NO: 45298 - protein, 9 aa, Homo Sapiens
RHKTYMVHK

SEQ ID NO: 45299 - protein, 9 aa, Homo Sapiens
VTYQANNCQ

SEQ ID NO: 45300 - protein, 9 aa, Homo Sapiens
FPTSRHHRF

SEQ ID NO: 45301 - protein, 9 aa, Homo Sapiens
PLGHNDSPQ

SEQ ID NO: 45302 - protein, 9 aa, Homo Sapiens
KVPGGQQED

SEQ ID NO: 45303 - protein, 9 aa, Homo Sapiens
SSTLLLSPG

SEQ ID NO: 45304 - protein, 9 aa, Homo Sapiens
QDSPQGLRC

SEQ ID NO: 45305 - protein, 9 aa, Homo Sapiens
AISSSSFMT

SEQ ID NO: 45306 - protein, 9 aa, Homo Sapiens
GLRCLCPTG

SEQ ID NO: 45307 - protein, 9 aa, Homo Sapiens
CHARRLPVA

SEQ ID NO: 45308 - protein, 9 aa, Homo Sapiens
VLGVEGTVF

SEQ ID NO: 45309 - protein, 9 aa, Homo Sapiens
HIQACTTTP

SEQ ID NO: 45310 - protein, 9 aa, Homo Sapiens
DSWRNFKAN

SEQ ID NO: 45311 - protein, 9 aa, Homo Sapiens
VPVTQFPGS

SEQ ID NO: 45312 - protein, 9 aa, Homo Sapiens
EATQAPVAP

SEQ ID NO: 45313 - protein, 9 aa, Homo Sapiens
PNNQQQLLQ

SEQ ID NO: 45314 - protein, 9 aa, Homo Sapiens
CPLGHNDSP

SEQ ID NO: 45315 - protein, 9 aa, Homo Sapiens
SSFMTSNHS

SEQ ID NO: 45316 - protein, 9 aa, Homo Sapiens
QGLRCLCPT

SEQ ID NO: 45317 - protein, 9 aa, Homo Sapiens
VPHFLQDHD

SEQ ID NO: 45318 - protein, 9 aa, Homo Sapiens
CLCHARRLP

SEQ ID NO: 45319 - protein, 9 aa, Homo Sapiens
RIEATQAPV

SEQ ID NO: 45320 - protein, 9 aa, Homo Sapiens
GLCLCHARR

SEQ ID NO: 45321 - protein, 9 aa, Homo Sapiens
SVFPTSRHH

SEQ ID NO: 45322 - protein, 9 aa, Homo Sapiens
YLLKIANFC

SEQ ID NO: 45323 - protein, 9 aa, Homo Sapiens
IPVTYQANN

SEQ ID NO: 45324 - protein, 9 aa, Homo Sapiens
ITNAKGDSH

SEQ ID NO: 45325 - protein, 9 aa, Homo Sapiens
LQDHDRYME

SEQ ID NO: 45326 - protein, 9 aa, Homo Sapiens
LAISSSSFM

SEQ ID NO: 45327 - protein, 9 aa, Homo Sapiens
HANIVTTTT

SEQ ID NO: 45328 - protein, 9 aa, Homo Sapiens
RLLCPLGHN

SEQ ID NO: 45329 - protein, 9 aa, Homo Sapiens
SQKVPGGQQ

SEQ ID NO: 45330 - protein, 9 aa, Homo Sapiens
LMSLAWALA

SEQ ID NO: 45331 - protein, 9 aa, Homo Sapiens
VTQFPGSSQ

SEQ ID NO: 45332 - protein, 9 aa, Homo Sapiens
FSRHKTYMV

SEQ ID NO: 45333 - protein, 9 aa, Homo Sapiens
FTAAASLMS

SEQ ID NO: 45334 - protein, 9 aa, Homo Sapiens
PDRLSHLQA

SEQ ID NO: 45335 - protein, 9 aa, Homo Sapiens
PFLHSRERG

SEQ ID NO: 45336 - protein, 9 aa, Homo Sapiens
FLHSRERGG

SEQ ID NO: 45337 - protein, 9 aa, Homo Sapiens
PFPEQARCA

SEQ ID NO: 45338 - protein, 9 aa, Homo Sapiens
GKYHIQACT

SEQ ID NO: 45339 - protein, 9 aa, Homo Sapiens
PVAPQKNCK

SEQ ID NO: 45340 - protein, 9 aa, Homo Sapiens
RVCACTGRD

SEQ ID NO: 45341 - protein, 9 aa, Homo Sapiens
RVLGVEGTV

SEQ ID NO: 45342 - protein, 9 aa, Homo Sapiens
LNKYHEAGI

SEQ ID NO: 45343 - protein, 9 aa, Homo Sapiens
GRAPDRLSH

SEQ ID NO: 45344 - protein, 9 aa, Homo Sapiens
YQNNIFKKK

SEQ ID NO: 45345 - protein, 9 aa, Homo Sapiens
HVHGRAPDR

SEQ ID NO: 45346 - protein, 9 aa, Homo Sapiens
HFLQDHDRY

SEQ ID NO: 45347 - protein, 9 aa, Homo Sapiens
FKANTKGKK

SEQ ID NO: 45348 - protein, 9 aa, Homo Sapiens
GAVLAACSN

SEQ ID NO: 45349 - protein, 9 aa, Homo Sapiens
IIFHCHGAV

SEQ ID NO: 45350 - protein, 9 aa, Homo Sapiens
PVTYQANNC

SEQ ID NO: 45351 - protein, 9 aa, Homo Sapiens
PSPFKHANI

SEQ ID NO: 45352 - protein, 9 aa, Homo Sapiens
TQFPGSSQP

SEQ ID NO: 45353 - protein, 9 aa, Homo Sapiens
QKVPGGQQE

SEQ ID NO: 45354 - protein, 9 aa, Homo Sapiens
IFHCHGAVL

SEQ ID NO: 45355 - protein, 9 aa, Homo Sapiens
PGGQQEDAE

SEQ ID NO: 45356 - protein, 9 aa, Homo Sapiens
TQAPVAPQK

SEQ ID NO: 45357 - protein, 9 aa, Homo Sapiens
VLIPVTYQA

SEQ ID NO: 45358 - protein, 9 aa, Homo Sapiens
VHGRAPDRL

SEQ ID NO: 45359 - protein, 9 aa, Homo Sapiens
YHEAGIQAR

SEQ ID NO: 45360 - protein, 9 aa, Homo Sapiens
KGDSHVRML

SEQ ID NO: 45361 - protein, 9 aa, Homo Sapiens
QACTTTPCM

SEQ ID NO: 45362 - protein, 9 aa, Homo Sapiens
IPSPFKHAN

SEQ ID NO: 45363 - protein, 9 aa, Homo Sapiens
VGLCLCHAR

SEQ ID NO: 45364 - protein, 9 aa, Homo Sapiens
ISSSSFMTS

SEQ ID NO: 45365 - protein, 9 aa, Homo Sapiens
TDHVHGRAP

SEQ ID NO: 45366 - protein, 9 aa, Homo Sapiens
AERLRVLGV

SEQ ID NO: 45367 - protein, 9 aa, Homo Sapiens
APDRLSHLQ

SEQ ID NO: 45368 - protein, 9 aa, Homo Sapiens
CNFIFLHLK

SEQ ID NO: 45369 - protein, 9 aa, Homo Sapiens
IANFCNFIF

SEQ ID NO: 45370 - protein, 9 aa, Homo Sapiens
MTSNHSVQN

SEQ ID NO: 45371 - protein, 9 aa, Homo Sapiens
SPFKHANIV

SEQ ID NO: 45372 - protein, 9 aa, Homo Sapiens
KELQFYQNN

SEQ ID NO: 45373 - protein, 9 aa, Homo Sapiens
CNITFSRHK

SEQ ID NO: 45374 - protein, 9 aa, Homo Sapiens
AERSVLIPV

SEQ ID NO: 45375 - protein, 9 aa, Homo Sapiens
HHRFWQSQL

SEQ ID NO: 45376 - protein, 9 aa, Homo Sapiens
APVAPQKNC

SEQ ID NO: 45377 - protein, 9 aa, Homo Sapiens
VPGGQQEDA

SEQ ID NO: 45378 - protein, 9 aa, Homo Sapiens
RSVLIPVTY

SEQ ID NO: 45379 - protein, 9 aa, Homo Sapiens
ETRHCTDHV

SEQ ID NO: 45380 - protein, 9 aa, Homo Sapiens
SPQGLRCLC

SEQ ID NO: 45381 - protein, 9 aa, Homo Sapiens
EQLSDIMMI

SEQ ID NO: 45382 - protein, 9 aa, Homo Sapiens
FVLLLSAIV

SEQ ID NO: 45383 - protein, 9 aa, Homo Sapiens
LVCGMETRH

SEQ ID NO: 45384 - protein, 9 aa, Homo Sapiens
LVSSTLLLS

SEQ ID NO: 45385 - protein, 9 aa, Homo Sapiens
PFKHANIVT

SEQ ID NO: 45386 - protein, 9 aa, Homo Sapiens
SVLIPVTYQ

SEQ ID NO: 45387 - protein, 9 aa, Homo Sapiens
PRKKESLIT

SEQ ID NO: 45388 - protein, 9 aa, Homo Sapiens
LLKIANFCN

SEQ ID NO: 45389 - protein, 9 aa, Homo Sapiens
PSQKVPGGQ

SEQ ID NO: 45390 - protein, 9 aa, Homo Sapiens
NITFSRHKT

SEQ ID NO: 45391 - protein, 9 aa, Homo Sapiens
TRHCTDHVH

SEQ ID NO: 45392 - protein, 9 aa, Homo Sapiens
VCGMETRHC

SEQ ID NO: 45393 - protein, 9 aa, Homo Sapiens
CITNAKGDS

SEQ ID NO: 45394 - protein, 9 aa, Homo Sapiens
HCHGAVLAA

SEQ ID NO: 45395 - protein, 9 aa, Homo Sapiens
EMRLLCPLG

SEQ ID NO: 45396 - protein, 9 aa, Homo Sapiens
LSAIVSISA

SEQ ID NO: 45397 - protein, 9 aa, Homo Sapiens
SPFLHSRER

SEQ ID NO: 45398 - protein, 9 aa, Homo Sapiens
LQQRLNKYH

SEQ ID NO: 45399 - protein, 9 aa, Homo Sapiens
SIKELQFYQ

SEQ ID NO: 45400 - protein, 9 aa, Homo Sapiens
NAKGDSHVR

SEQ ID NO: 45401 - protein, 9 aa, Homo Sapiens
LGHNDSPQL

SEQ ID NO: 45402 - protein, 9 aa, Homo Sapiens
QARCAEEEK

SEQ ID NO: 45403 - protein, 9 aa, Homo Sapiens
VEGTVFPKS

SEQ ID NO: 45404 - protein, 9 aa, Homo Sapiens
NNQQQLLQR

SEQ ID NO: 45405 - protein, 9 aa, Homo Sapiens
WRNFKANTK

SEQ ID NO: 45406 - protein, 9 aa, Homo Sapiens
SWRNFKANT

SEQ ID NO: 45407 - protein, 9 aa, Homo Sapiens
NIVTTTTHK

SEQ ID NO: 45408 - protein, 9 aa, Homo Sapiens
GVGLCLCHA

SEQ ID NO: 45409 - protein, 9 aa, Homo Sapiens
NFCNFIFLH

SEQ ID NO: 45410 - protein, 9 aa, Homo Sapiens
SLITCLADL

SEQ ID NO: 45411 - protein, 9 aa, Homo Sapiens
SRHKTYMVH

SEQ ID NO: 45412 - protein, 9 aa, Homo Sapiens
DHDRYMEHL

SEQ ID NO: 45413 - protein, 9 aa, Homo Sapiens
SGIIFHCHG

SEQ ID NO: 45414 - protein, 9 aa, Homo Sapiens
FMTSNHSVQ

SEQ ID NO: 45415 - protein, 9 aa, Homo Sapiens
LLQRHIGND

SEQ ID NO: 45416 - protein, 9 aa, Homo Sapiens
CACTGRDRR

SEQ ID NO: 45417 - protein, 9 aa, Homo Sapiens
RLSHLQAHN

SEQ ID NO: 45418 - protein, 9 aa, Homo Sapiens
LITCLADLF

SEQ ID NO: 45419 - protein, 9 aa, Homo Sapiens
DSPQGLRCL

SEQ ID NO: 45420 - protein, 9 aa, Homo Sapiens
QQLLQRHIG

SEQ ID NO: 45421 - protein, 9 aa, Homo Sapiens
LLSAIVSIS

SEQ ID NO: 45422 - protein, 9 aa, Homo Sapiens
FPEQARCAE

SEQ ID NO: 45423 - protein, 9 aa, Homo Sapiens
RLRVLGVEG

SEQ ID NO: 45424 - protein, 9 aa, Homo Sapiens
NKEQLSDIM

SEQ ID NO: 45425 - protein, 9 aa, Homo Sapiens
KIANFCNFI

SEQ ID NO: 45426 - protein, 9 aa, Homo Sapiens
ICITNAKGD

SEQ ID NO: 45427 - protein, 9 aa, Homo Sapiens
ATQAPVAPQ

SEQ ID NO: 45428 - protein, 9 aa, Homo Sapiens
LCHARRLPV

SEQ ID NO: 45429 - protein, 9 aa, Homo Sapiens
TSRHHRFWQ

SEQ ID NO: 45430 - protein, 9 aa, Homo Sapiens
IIFVLLLSA

SEQ ID NO: 45431 - protein, 9 aa, Homo Sapiens
CTDHVHGRA

SEQ ID NO: 45432 - protein, 9 aa, Homo Sapiens
QRHIGNDIV

SEQ ID NO: 45433 - protein, 9 aa, Homo Sapiens
HKTYMVHKQ

SEQ ID NO: 45434 - protein, 9 aa, Homo Sapiens
VRVCACTGR

SEQ ID NO: 45435 - protein, 9 aa, Homo Sapiens
DQTEHPYRS

SEQ ID NO: 45436 - protein, 9 aa, Homo Sapiens
LPFPEQARC

SEQ ID NO: 45437 - protein, 9 aa, Homo Sapiens
SDIMMINKQ

SEQ ID NO: 45438 - protein, 9 aa, Homo Sapiens
RKKESLITC

SEQ ID NO: 45439 - protein, 9 aa, Homo Sapiens
NKYHEAGIQ

SEQ ID NO: 45440 - protein, 9 aa, Homo Sapiens
CHGAVLAAC

SEQ ID NO: 45441 - protein, 9 aa, Homo Sapiens
HARRLPVAT

SEQ ID NO: 45442 - protein, 9 aa, Homo Sapiens
IEATQAPVA

SEQ ID NO: 45443 - protein, 9 aa, Homo Sapiens
MRLLCPLGH

SEQ ID NO: 45444 - protein, 9 aa, Homo Sapiens
QLSDIMMIN

SEQ ID NO: 45445 - protein, 9 aa, Homo Sapiens
PEMRLLCPL

SEQ ID NO: 45446 - protein, 9 aa, Homo Sapiens
QNNIFKKKI

SEQ ID NO: 45447 - protein, 9 aa, Homo Sapiens
DIMMINKQK

SEQ ID NO: 45448 - protein, 9 aa, Homo Sapiens
TFSRHKTYM

SEQ ID NO: 45449 - protein, 9 aa, Homo Sapiens
KEQLSDIMM

SEQ ID NO: 45450 - protein, 9 aa, Homo Sapiens
GVEGTVFPK

SEQ ID NO: 45451 - protein, 9 aa, Homo Sapiens
IFVLLLSAI

SEQ ID NO: 45452 - protein, 9 aa, Homo Sapiens
FYQNNIFKK

SEQ ID NO: 45453 - protein, 9 aa, Homo Sapiens
VFPTSRHHR

SEQ ID NO: 45454 - protein, 9 aa, Homo Sapiens
ANFCNFIFL

SEQ ID NO: 45455 - protein, 9 aa, Homo Sapiens
VLLLSAIVS

SEQ ID NO: 45456 - protein, 9 aa, Homo Sapiens
HDRYMEHLE

SEQ ID NO: 45457 - protein, 9 aa, Homo Sapiens
FHCHGAVLA

SEQ ID NO: 45458 - protein, 9 aa, Homo Sapiens
DRLSHLQAH

SEQ ID NO: 45459 - protein, 9 aa, Homo Sapiens
LQFYQNNIF

SEQ ID NO: 45460 - protein, 9 aa, Homo Sapiens
AGVGLCLCH

SEQ ID NO: 45461 - protein, 9 aa, Homo Sapiens
HGAVLAACS

SEQ ID NO: 45462 - protein, 9 aa, Homo Sapiens
AASLMSLAW

SEQ ID NO: 45463 - protein, 9 aa, Homo Sapiens
KYHEAGIQA

SEQ ID NO: 45464 - protein, 9 aa, Homo Sapiens
KHANIVTTT

SEQ ID NO: 45465 - protein, 9 aa, Homo Sapiens
ESLITCLAD

SEQ ID NO: 45466 - protein, 9 aa, Homo Sapiens
ACTGRDRRT

SEQ ID NO: 45467 - protein, 9 aa, Homo Sapiens
SSSFMTSNH

SEQ ID NO: 45468 - protein, 9 aa, Homo Sapiens
RCAEEEKLT

SEQ ID NO: 45469 - protein, 9 aa, Homo Sapiens
YRSKKAVWH

SEQ ID NO: 45470 - protein, 9 aa, Homo Sapiens
QPRKKESLI

SEQ ID NO: 45471 - protein, 9 aa, Homo Sapiens
YHIQACTTT

SEQ ID NO: 45472 - protein, 9 aa, Homo Sapiens
FPGSSQPAV

SEQ ID NO: 45473 - protein, 9 aa, Homo Sapiens
HCTDHVHGR

SEQ ID NO: 45474 - protein, 9 aa, Homo Sapiens
SSSSFMTSN

SEQ ID NO: 45475 - protein, 9 aa, Homo Sapiens
CGMETRHCT

SEQ ID NO: 45476 - protein, 9 aa, Homo Sapiens
PVTQFPGSS

SEQ ID NO: 45477 - protein, 9 aa, Homo Sapiens
DLPFPEQAR

SEQ ID NO: 45478 - protein, 9 aa, Homo Sapiens
LSDIMMINK

SEQ ID NO: 45479 - protein, 9 aa, Homo Sapiens
LHSRERGGF

SEQ ID NO: 45480 - protein, 9 aa, Homo Sapiens
LCQSPFLHS

SEQ ID NO: 45481 - protein, 9 aa, Homo Sapiens
RHHRFWQSQ

SEQ ID NO: 45482 - protein, 9 aa, Homo Sapiens
LKIANFCNF

SEQ ID NO: 45483 - protein, 9 aa, Homo Sapiens
GIIFHCHGA

SEQ ID NO: 45484 - protein, 9 aa, Homo Sapiens
LIPVTYQAN

SEQ ID NO: 45485 - protein, 9 aa, Homo Sapiens
SSVFPTSRH

SEQ ID NO: 45486 - protein, 9 aa, Homo Sapiens
PHFLQDHDR

SEQ ID NO: 45487 - protein, 9 aa, Homo Sapiens
HPYRSKKAV

SEQ ID NO: 45488 - protein, 9 aa, Homo Sapiens
GLCQSPFLH

SEQ ID NO: 45489 - protein, 9 aa, Homo Sapiens
HSRERGGFF

SEQ ID NO: 45490 - protein, 9 aa, Homo Sapiens
LSPGSPQET

SEQ ID NO: 45491 - protein, 9 aa, Homo Sapiens
PYRSKKAVW

SEQ ID NO: 45492 - protein, 9 aa, Homo Sapiens
LDQTEHPYR

SEQ ID NO: 45493 - protein, 9 aa, Homo Sapiens
KESLITCLA

SEQ ID NO: 45494 - protein, 9 aa, Homo Sapiens
QFPGSSQPA

SEQ ID NO: 45495 - protein, 9 aa, Homo Sapiens
AIVSISALS

SEQ ID NO: 45496 - protein, 9 aa, Homo Sapiens
TVPVTQFPG

SEQ ID NO: 45497 - protein, 9 aa, Homo Sapiens
PEQARCAEE

SEQ ID NO: 45498 - protein, 9 aa, Homo Sapiens
EVRVCACTG

SEQ ID NO: 45499 - protein, 9 aa, Homo Sapiens
KYHIQACTT

SEQ ID NO: 45500 - protein, 9 aa, Homo Sapiens
FCNFIFLHL

SEQ ID NO: 45501 - protein, 9 aa, Homo Sapiens
MSLAWALAS

SEQ ID NO: 45502 - protein, 9 aa, Homo Sapiens
LQRHIGNDI

SEQ ID NO: 45503 - protein, 9 aa, Homo Sapiens
RHCTDHVHG

SEQ ID NO: 45504 - protein, 9 aa, Homo Sapiens
SFMTSNHSV

SEQ ID NO: 45505 - protein, 9 aa, Homo Sapiens
QQEDAESRY

SEQ ID NO: 45506 - protein, 9 aa, Homo Sapiens
SLMSLAWAL

SEQ ID NO: 45507 - protein, 9 aa, Homo Sapiens
AAASLMSLA

SEQ ID NO: 45508 - protein, 9 aa, Homo Sapiens
LRVLGVEGT

SEQ ID NO: 45509 - protein, 9 aa, Homo Sapiens
KANTKGKKE

SEQ ID NO: 45510 - protein, 9 aa, Homo Sapiens
KNKEQLSDI

SEQ ID NO: 45511 - protein, 9 aa, Homo Sapiens
LLCPLGHND

SEQ ID NO: 45512 - protein, 9 aa, Homo Sapiens
QSPFLHSRE

SEQ ID NO: 45513 - protein, 9 aa, Homo Sapiens
QTEHPYRSK

SEQ ID NO: 45514 - protein, 9 aa, Homo Sapiens
TCQDSPQGL

SEQ ID NO: 45515 - protein, 9 aa, Homo Sapiens
QLLQRHIGN

SEQ ID NO: 45516 - protein, 9 aa, Homo Sapiens
SAIVSISAL

SEQ ID NO: 45517 - protein, 9 aa, Homo Sapiens
GFTAAASLM

SEQ ID NO: 45518 - protein, 9 aa, Homo Sapiens
LLSPGSPQE

SEQ ID NO: 45519 - protein, 9 aa, Homo Sapiens
ASLMSLAWA

SEQ ID NO: 45520 - protein, 9 aa, Homo Sapiens
TAAASLMSL

SEQ ID NO: 45521 - protein, 9 aa, Homo Sapiens
CQDSPQGLR

SEQ ID NO: 45522 - protein, 9 aa, Homo Sapiens
HGRAPDRLS

SEQ ID NO: 45523 - protein, 9 aa, Homo Sapiens
ERSVLIPVT

SEQ ID NO: 45524 - protein, 9 aa, Homo Sapiens
IMMINKQKG

SEQ ID NO: 45525 - protein, 9 aa, Homo Sapiens
PYKPPNTRE

SEQ ID NO: 45526 - protein, 9 aa, Homo Sapiens
PEGAPSHPP

SEQ ID NO: 45527 - protein, 9 aa, Homo Sapiens
VASAKGFSK

SEQ ID NO: 45528 - protein, 9 aa, Homo Sapiens
RKLFEKYRK

SEQ ID NO: 45529 - protein, 9 aa, Homo Sapiens
KKTDLKDLI

SEQ ID NO: 45530 - protein, 9 aa, Homo Sapiens
LKFIPMSVL

SEQ ID NO: 45531 - protein, 9 aa, Homo Sapiens
QHHTEPIGK

SEQ ID NO: 45532 - protein, 9 aa, Homo Sapiens
PMPMRVNGA

SEQ ID NO: 45533 - protein, 9 aa, Homo Sapiens
PLQPSLATT

SEQ ID NO: 45534 - protein, 9 aa, Homo Sapiens
ELREIIRGL

SEQ ID NO: 45535 - protein, 9 aa, Homo Sapiens
PPYKPPNTR

SEQ ID NO: 45536 - protein, 9 aa, Homo Sapiens
CPFYGAWLT

SEQ ID NO: 45537 - protein, 9 aa, Homo Sapiens
EKYRKAGEV

SEQ ID NO: 45538 - protein, 9 aa, Homo Sapiens
LATTPVPWL

SEQ ID NO: 45539 - protein, 9 aa, Homo Sapiens
PFYGAWLTG

SEQ ID NO: 45540 - protein, 9 aa, Homo Sapiens
SSSVASAKG

SEQ ID NO: 45541 - protein, 9 aa, Homo Sapiens
LQPSLATTP

SEQ ID NO: 45542 - protein, 9 aa, Homo Sapiens
PSLATTPVP

SEQ ID NO: 45543 - protein, 9 aa, Homo Sapiens
RELREIIRG

SEQ ID NO: 45544 - protein, 9 aa, Homo Sapiens
LFEKYRKAG

SEQ ID NO: 45545 - protein, 9 aa, Homo Sapiens
EGAPSHPPK

SEQ ID NO: 45546 - protein, 9 aa, Homo Sapiens
YMSIHIHAY

SEQ ID NO: 45547 - protein, 9 aa, Homo Sapiens
QPSLATTPV

SEQ ID NO: 45548 - protein, 9 aa, Homo Sapiens
HTEPIGKNN

SEQ ID NO: 45549 - protein, 9 aa, Homo Sapiens
MRKLFEKYR

SEQ ID NO: 45550 - protein, 9 aa, Homo Sapiens
FYGAWLTGE

SEQ ID NO: 45551 - protein, 9 aa, Homo Sapiens
ITDEERAPI

SEQ ID NO: 45552 - protein, 9 aa, Homo Sapiens
SVASAKGFS

SEQ ID NO: 45553 - protein, 9 aa, Homo Sapiens
IGTIGDSQN

SEQ ID NO: 45554 - protein, 9 aa, Homo Sapiens
APSHPPKDV

SEQ ID NO: 45555 - protein, 9 aa, Homo Sapiens
GDSQNLAWH

SEQ ID NO: 45556 - protein, 9 aa, Homo Sapiens
PHRPPGAAL

SEQ ID NO: 45557 - protein, 9 aa, Homo Sapiens
EQAESGNMD

SEQ ID NO: 45558 - protein, 9 aa, Homo Sapiens
TDEERAPIA

SEQ ID NO: 45559 - protein, 9 aa, Homo Sapiens
KLFEKYRKA

SEQ ID NO: 45560 - protein, 9 aa, Homo Sapiens
GSSEQAESG

SEQ ID NO: 45561 - protein, 9 aa, Homo Sapiens
HHTEPIGKN

SEQ ID NO: 45562 - protein, 9 aa, Homo Sapiens
SSPASSSVA

SEQ ID NO: 45563 - protein, 9 aa, Homo Sapiens
AFKIIHLLT

SEQ ID NO: 45564 - protein, 9 aa, Homo Sapiens
SILKFIPMS

SEQ ID NO: 45565 - protein, 9 aa, Homo Sapiens
GIGTIGDSQ

SEQ ID NO: 45566 - protein, 9 aa, Homo Sapiens
DVSSVGCAI

SEQ ID NO: 45567 - protein, 9 aa, Homo Sapiens
TSLELHRGT

SEQ ID NO: 45568 - protein, 9 aa, Homo Sapiens
SVLYGVFLY

SEQ ID NO: 45569 - protein, 9 aa, Homo Sapiens
KYRKAGEVF

SEQ ID NO: 45570 - protein, 9 aa, Homo Sapiens
PASSSVASA

SEQ ID NO: 45571 - protein, 9 aa, Homo Sapiens
PAPPYKPPN

SEQ ID NO: 45572 - protein, 9 aa, Homo Sapiens
ASSSVASAK

SEQ ID NO: 45573 - protein, 9 aa, Homo Sapiens
VPMPMRVNG

SEQ ID NO: 45574 - protein, 9 aa, Homo Sapiens
ARSAFRPLR

SEQ ID NO: 45575 - protein, 9 aa, Homo Sapiens
REIIRGLLA

SEQ ID NO: 45576 - protein, 9 aa, Homo Sapiens
AFHAACPFY

SEQ ID NO: 45577 - protein, 9 aa, Homo Sapiens
TTPVPWLNQ

SEQ ID NO: 45578 - protein, 9 aa, Homo Sapiens
VPTSLELHR

SEQ ID NO: 45579 - protein, 9 aa, Homo Sapiens
IPMSVLYGV

SEQ ID NO: 45580 - protein, 9 aa, Homo Sapiens
SLVSRELRE

SEQ ID NO: 45581 - protein, 9 aa, Homo Sapiens
CSSPASSSV

SEQ ID NO: 45582 - protein, 9 aa, Homo Sapiens
GFGIGTIGD

SEQ ID NO: 45583 - protein, 9 aa, Homo Sapiens
KTDLKDLII

SEQ ID NO: 45584 - protein, 9 aa, Homo Sapiens
MHTYMSIHI

SEQ ID NO: 45585 - protein, 9 aa, Homo Sapiens
GNMDVPPED

SEQ ID NO: 45586 - protein, 9 aa, Homo Sapiens
LVSRELREI

SEQ ID NO: 45587 - protein, 9 aa, Homo Sapiens
APPYKPPNT

SEQ ID NO: 45588 - protein, 9 aa, Homo Sapiens
ISPAPPYKP

SEQ ID NO: 45589 - protein, 9 aa, Homo Sapiens
LREIIRGLL

SEQ ID NO: 45590 - protein, 9 aa, Homo Sapiens
THMHTYMSI

SEQ ID NO: 45591 - protein, 9 aa, Homo Sapiens
HAFKIIHLL

SEQ ID NO: 45592 - protein, 9 aa, Homo Sapiens
HTYMSIHIH

SEQ ID NO: 45593 - protein, 9 aa, Homo Sapiens
YKPPNTREN

SEQ ID NO: 45594 - protein, 9 aa, Homo Sapiens
SLATTPVPW

SEQ ID NO: 45595 - protein, 9 aa, Homo Sapiens
KPLSLVKKT

SEQ ID NO: 45596 - protein, 9 aa, Homo Sapiens
RAPIATFHD

SEQ ID NO: 45597 - protein, 9 aa, Homo Sapiens
SGNMDVPPE

SEQ ID NO: 45598 - protein, 9 aa, Homo Sapiens
RIVKHAFKI

SEQ ID NO: 45599 - protein, 9 aa, Homo Sapiens
ATTPVPWLN

SEQ ID NO: 45600 - protein, 9 aa, Homo Sapiens
GDARSAFRP

SEQ ID NO: 45601 - protein, 9 aa, Homo Sapiens
ELHRGTDGG

SEQ ID NO: 45602 - protein, 9 aa, Homo Sapiens
LKPLSLVKK

SEQ ID NO: 45603 - protein, 9 aa, Homo Sapiens
FKIIHLLTG

SEQ ID NO: 45604 - protein, 9 aa, Homo Sapiens
AVPTSLELH

SEQ ID NO: 45605 - protein, 9 aa, Homo Sapiens
VKKTDLKDL

SEQ ID NO: 45606 - protein, 9 aa, Homo Sapiens
FHAACPFYG

SEQ ID NO: 45607 - protein, 9 aa, Homo Sapiens
FPHRPPGAA

SEQ ID NO: 45608 - protein, 9 aa, Homo Sapiens
KFIPMSVLY

SEQ ID NO: 45609 - protein, 9 aa, Homo Sapiens
TDINQLAET

SEQ ID NO: 45610 - protein, 9 aa, Homo Sapiens
TEPIGKNNP

SEQ ID NO: 45611 - protein, 9 aa, Homo Sapiens
KLTDINQLA

SEQ ID NO: 45612 - protein, 9 aa, Homo Sapiens
SPASSSVAS

SEQ ID NO: 45613 - protein, 9 aa, Homo Sapiens
CDVSSVGCA

SEQ ID NO: 45614 - protein, 9 aa, Homo Sapiens
TIGDSQNLA

SEQ ID NO: 45615 - protein, 9 aa, Homo Sapiens
SPAPPYKPP

SEQ ID NO: 45616 - protein, 9 aa, Homo Sapiens
GTIGDSQNL

SEQ ID NO: 45617 - protein, 9 aa, Homo Sapiens
ERAPIATFH

SEQ ID NO: 45618 - protein, 9 aa, Homo Sapiens
RPPGAALPS

SEQ ID NO: 45619 - protein, 9 aa, Homo Sapiens
HPPKDVYYA

SEQ ID NO: 45620 - protein, 9 aa, Homo Sapiens
LTDINQLAE

SEQ ID NO: 45621 - protein, 9 aa, Homo Sapiens
HRGTDGGTL

SEQ ID NO: 45622 - protein, 9 aa, Homo Sapiens
IATFHDSKH

SEQ ID NO: 45623 - protein, 9 aa, Homo Sapiens
PLSLVKKTD

SEQ ID NO: 45624 - protein, 9 aa, Homo Sapiens
CISPAPPYK

SEQ ID NO: 45625 - protein, 9 aa, Homo Sapiens
VSRELREII

SEQ ID NO: 45626 - protein, 9 aa, Homo Sapiens
HAACPFYGA

SEQ ID NO: 45627 - protein, 9 aa, Homo Sapiens
CTQHHTEPI

SEQ ID NO: 45628 - protein, 9 aa, Homo Sapiens
VKHAFKIIH

SEQ ID NO: 45629 - protein, 9 aa, Homo Sapiens
FIPMSVLYG

SEQ ID NO: 45630 - protein, 9 aa, Homo Sapiens
DEERAPIAT

SEQ ID NO: 45631 - protein, 9 aa, Homo Sapiens
TYMSIHIHA

SEQ ID NO: 45632 - protein, 9 aa, Homo Sapiens
VRIVKHAFK

SEQ ID NO: 45633 - protein, 9 aa, Homo Sapiens
QTPEGAPSH

SEQ ID NO: 45634 - protein, 9 aa, Homo Sapiens
DWTLVPMPM

SEQ ID NO: 45635 - protein, 9 aa, Homo Sapiens
GAALPSLMP

SEQ ID NO: 45636 - protein, 9 aa, Homo Sapiens
KIIHLLTGE

SEQ ID NO: 45637 - protein, 9 aa, Homo Sapiens
SHPPKDVYY

SEQ ID NO: 45638 - protein, 9 aa, Homo Sapiens
EPIGKNNPP

SEQ ID NO: 45639 - protein, 9 aa, Homo Sapiens
RKAGEVFIH

SEQ ID NO: 45640 - protein, 9 aa, Homo Sapiens
YGAWLTGEH

SEQ ID NO: 45641 - protein, 9 aa, Homo Sapiens
HRPPGAALP

SEQ ID NO: 45642 - protein, 9 aa, Homo Sapiens
FEKYRKAGE

SEQ ID NO: 45643 - protein, 9 aa, Homo Sapiens
WGFGIGTIG

SEQ ID NO: 45644 - protein, 9 aa, Homo Sapiens
TPEGAPSHP

SEQ ID NO: 45645 - protein, 9 aa, Homo Sapiens
LSLVKKTDL

SEQ ID NO: 45646 - protein, 9 aa, Homo Sapiens
PMRVNGASK

SEQ ID NO: 45647 - protein, 9 aa, Homo Sapiens
KHAFKIIHL

SEQ ID NO: 45648 - protein, 9 aa, Homo Sapiens
SRELREIIR

SEQ ID NO: 45649 - protein, 9 aa, Homo Sapiens
GAPSHPPKD

(The sequence listing continues in the following parts.)

What is claimed is:

1. A method of generating a pharmaceutical agent for cancer immune therapy, comprising:
    using matched normal omics data of a tumor to generate in silico a plurality of n-mers that contain at least one patient- and cancer-specific cancer neoepitope wherein the omics data from each of the tumor and the matched patient normal sample include data selected from the group consisting of whole genomic sequencing data, exome sequencing data, transcriptome data, and combinations thereof;
    filtering in silico the n-mers to so obtain a subset of neoepitope sequences wherein the filtering is filtering by type of mutation, filtering by strength of expression, filtering by subcellular location, and/or filtering by binding affinity towards an HLA-type of the patient;
    preparing at least one synthetic n-mer peptide using sequence information from the subset of neoepitope sequences;
    using the synthetic n-mer peptide to isolate a recombinant antibody;
    obtaining sequence information of the complementarity determining region of the recombinant antibody;
    generating a synthetic antibody using the sequence information of the complementarity determining region of the recombinant antibody; and
    coupling the synthetic antibody to a therapeutic or diagnostic agent to so obtain the pharmaceutical agent.

2. The method of claim 1 wherein the matched normal omics data are matched against normal before treatment of the patient.

3. The method of claim 1 wherein each of the plurality of n-mer peptides has a length of between 7 and 11 amino acids.

4. The method of claim 1 wherein the plurality of n-mer peptides is at least 1,000 n-mer peptides.

5. The method of claim 1 wherein different of the plurality of n-mer peptides have different neoepitopes.

6. The method of claim 1 wherein the step of filtering includes at least two of filtering by type of mutation, filtering by strength of expression, filtering by sub-cellular location, and filtering by binding affinity towards an HLA-type of the patient.

7. The method of claim 1 wherein the step of using the synthetic n-mer peptide to isolate the recombinant antibody comprises phage panning.

8. The method of claim 7 wherein the step of phage panning further comprises affinity maturation.

9. The method of claim 1 wherein the sequence information of the complementarity determining region of the recombinant antibody comprises CDR1-H, CDR2-H, and CDR3-H.

10. The method of claim 1 wherein the synthetic antibody is generated using CDR or SDR grafting onto a human antibody scaffold.

11. The method of claim 1 wherein the synthetic antibody is generated via recombinant expression as a IgG, a F(ab')2, a Fab', a Fab, or a scFv.

12. The method of claim 1 wherein the therapeutic or diagnostic agent is a non-cellular agent.

13. The method of claim 12 wherein the non-cellular agent is a chemotherapeutic drug, a radio isotope, a PET detectable isotope, a SPECT detectable isotope, or an affinity agent.

14. The method of claim 1 wherein the therapeutic agent is a cell.

15. The method of claim 14 wherein the cell is a T-cell or an NK cell.

16. The method of claim 15 wherein the cell is a T-cell expressing a chimeric receptor having a scFv as ectodomain and wherein the synthetic antibody is the scFv.

17. The method of claim 15 wherein the cell is an NK cell expressing a high-affinity Fcγ receptor (CD16) and wherein the synthetic antibody is an IgG and is bound to the NK cell via the high-affinity Fcγ receptor.

* * * * *